United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 44

SEQ ID NO: 1967070 - RNA, 20 nt, Human
aagauaccuuaaaauuugaa

SEQ ID NO: 1967071 - RNA, 21 nt, Human
aagauaccuuaaaauuugaaa

SEQ ID NO: 1967072 - RNA, 23 nt, Human
aagauaccuuaaaauuugaaaca

SEQ ID NO: 1967073 - RNA, 18 nt, Human
aagauaccuuuuuuuuuc

SEQ ID NO: 1967074 - RNA, 20 nt, Human
aagauaccuuuuuuuuucuu

SEQ ID NO: 1967075 - RNA, 21 nt, Human
aagauaccuuuuuuuuucuuu

SEQ ID NO: 1967076 - RNA, 14 nt, Human
aagauaccuuaaaa

SEQ ID NO: 1967077 - RNA, 15 nt, Human
aagauaccuuaaaau

SEQ ID NO: 1967078 - RNA, 16 nt, Human
aagauaccuuaaaauu

SEQ ID NO: 1967079 - RNA, 17 nt, Human
aagauaccuuaaaauuu

SEQ ID NO: 1967080 - RNA, 23 nt, Human
aagauacaguuacucagaauucu

SEQ ID NO: 1967081 - RNA, 13 nt, Human
aagauaaaugugc

SEQ ID NO: 1967082 - RNA, 12 nt, Human
aagauaaaugug

SEQ ID NO: 1967083 - RNA, 18 nt, Human
aagauaaaaaaacagcuu

SEQ ID NO: 1967084 - RNA, 16 nt, Human
aacuuucaagaacuug

SEQ ID NO: 1967085 - RNA, 19 nt, Human
aacuuucaagaacuuguuu

SEQ ID NO: 1967086 - RNA, 21 nt, Human
aacuuucaagaacuuguuuaa

SEQ ID NO: 1967087 - RNA, 22 nt, Human
aagaguggcagcuauaggaaau

SEQ ID NO: 1967088 - RNA, 15 nt, Human
aagaguggccccacc

SEQ ID NO: 1967089 - RNA, 16 nt, Human
aagaguggccccaccu

SEQ ID NO: 1967090 - RNA, 17 nt, Human
aagaguggccccaccug

SEQ ID NO: 1967091 - RNA, 19 nt, Human
aagaguggccccaccuggc

SEQ ID NO: 1967092 - RNA, 21 nt, Human
aagaguggccccaccuggccc

SEQ ID NO: 1967093 - RNA, 19 nt, Human
aagaguuugccuuauaaau

SEQ ID NO: 1967094 - RNA, 15 nt, Human
aagaguguaaaauau

SEQ ID NO: 1967095 - RNA, 17 nt, Human
aagaguguaaaauauuu

SEQ ID NO: 1967096 - RNA, 22 nt, Human
aagaguggccccaccuggcccu

SEQ ID NO: 1967097 - RNA, 17 nt, Human
aagagucuggggaccag

SEQ ID NO: 1967098 - RNA, 13 nt, Human
aagagucuuucuu

SEQ ID NO: 1967099 - RNA, 16 nt, Human
aagagucuuucuucuu

SEQ ID NO: 1967100 - RNA, 22 nt, Human
aagagugaaauaccauuauuau

SEQ ID NO: 1967101 - RNA, 23 nt, Human
aagccagcaggcucucaggccag

SEQ ID NO: 1967102 - RNA, 20 nt, Human
aagccagcaggcucucaggc

SEQ ID NO: 1967103 - RNA, 13 nt, Human
aagcagcucuccc

SEQ ID NO: 1967104 - RNA, 14 nt, Human
aagccaccaacagc

SEQ ID NO: 1967105 - RNA, 19 nt, Human
aagccagcaggcucucagg

SEQ ID NO: 1967106 - RNA, 21 nt, Human
aagcagcguuucuaugacaca

SEQ ID NO: 1967107 - RNA, 22 nt, Human
aagcagcguuucuaugacacau

SEQ ID NO: 1967108 - RNA, 14 nt, Human
aagcagcguuucua

SEQ ID NO: 1967109 - RNA, 17 nt, Human
aagcagcguuucuauga

SEQ ID NO: 1967110 - RNA, 20 nt, Human
aagcagcguuucuaugacac

SEQ ID NO: 1967111 - RNA, 17 nt, Human
aagcagcauaaagaauu

SEQ ID NO: 1967112 - RNA, 19 nt, Human
aagauucuauguuaauauu

SEQ ID NO: 1967113 - RNA, 11 nt, Human
aagauucuaug

SEQ ID NO: 1967114 - RNA, 19 nt, Human
aagauuaauagcauucgaa

SEQ ID NO: 1967115 - RNA, 18 nt, Human
aaaaguucugcagauaaa

SEQ ID NO: 1967116 - RNA, 11 nt, Human
aaaaguucuuu

SEQ ID NO: 1967117 - RNA, 15 nt, Human
aaaaguuauuaaaau

SEQ ID NO: 1967118 - RNA, 17 nt, Human
aaaaguuauuaaaauug

SEQ ID NO: 1967119 - RNA, 13 nt, Human
aaaaguugaauuu

SEQ ID NO: 1967120 - RNA, 17 nt, Human
aaaauaaaacuuuuuaa

SEQ ID NO: 1967121 - RNA, 19 nt, Human
aaaauaaaauuaaagcuga

SEQ ID NO: 1967122 - RNA, 18 nt, Human
aaaaguugaagaucguga

SEQ ID NO: 1967123 - RNA, 15 nt, Human
aaaauaaaauaaaua

SEQ ID NO: 1967124 - RNA, 22 nt, Human
aaaaucccuuaccucggugccu

SEQ ID NO: 1967125 - RNA, 21 nt, Human
aaaaucuacacuccagugaga

SEQ ID NO: 1967126 - RNA, 14 nt, Human
aaaauaaacuuucu

SEQ ID NO: 1967127 - RNA, 22 nt, Human
aaaauaaacuuucuuaauauuu

SEQ ID NO: 1967128 - RNA, 22 nt, Human
aaaagugcugcagggcuuuaaa

SEQ ID NO: 1967129 - RNA, 18 nt, Human
aaaaagaaagaaagagga

SEQ ID NO: 1967130 - RNA, 13 nt, Human
aaaaagaacuucc

SEQ ID NO: 1967131 - RNA, 15 nt, Human
aaaaagaaaggaggg

SEQ ID NO: 1967132 - RNA, 19 nt, Human
aaaaacucuuuaacuugua

SEQ ID NO: 1967133 - RNA, 20 nt, Human
aaaaacucuuuaacuuguaa

SEQ ID NO: 1967134 - RNA, 12 nt, Human
aaaaacugaagu

SEQ ID NO: 1967135 - RNA, 13 nt, Human
aaaaacugaaguu

SEQ ID NO: 1967136 - RNA, 11 nt, Human
aaaaagaaaaa

SEQ ID NO: 1967137 - RNA, 13 nt, Human
aaaaagaaaaaag

SEQ ID NO: 1967138 - RNA, 15 nt, Human
aaacagaaauuggua

SEQ ID NO: 1967139 - RNA, 14 nt, Human
aaacagaaauuggu

SEQ ID NO: 1967140 - RNA, 17 nt, Human
aaacacguuuuaaggac

SEQ ID NO: 1967141 - RNA, 18 nt, Human
aaacacguuuuaaggacu

SEQ ID NO: 1967142 - RNA, 22 nt, Human
aaacacguuuuaaggacugacu

SEQ ID NO: 1967143 - RNA, 13 nt, Human
aaacacuaaaugu

SEQ ID NO: 1967144 - RNA, 14 nt, Human
aaacacuaaauguu

SEQ ID NO: 1967145 - RNA, 15 nt, Human
aaacacuaaauguua

SEQ ID NO: 1967146 - RNA, 16 nt, Human
aaacacuaaauguuaa

SEQ ID NO: 1967147 - RNA, 17 nt, Human
aaacacuaaauguuaaa

SEQ ID NO: 1967148 - RNA, 19 nt, Human
aaacacuaaauguuaaaga

SEQ ID NO: 1967149 - RNA, 20 nt, Human
aaacacuaaauguuaaagau

SEQ ID NO: 1967150 - RNA, 21 nt, Human
aaacacuaaauguuaaagaug

SEQ ID NO: 1967151 - RNA, 22 nt, Human
aaacacuaaauguuaaagaugu

SEQ ID NO: 1967152 - RNA, 21 nt, Human
aaacacugggagaaaugaaaa

SEQ ID NO: 1967153 - RNA, 22 nt, Human
aaacacugggagaaaugaaaaa

SEQ ID NO: 1967154 - RNA, 16 nt, Human
aaacacuguucucugc

SEQ ID NO: 1967155 - RNA, 16 nt, Human
aaacacuugugacuuu

SEQ ID NO: 1967156 - RNA, 20 nt, Human
aaacacuugugacuuuugcu

SEQ ID NO: 1967157 - RNA, 19 nt, Human
aaaaucucaaauuucuaaa

SEQ ID NO: 1967158 - RNA, 22 nt, Human
aaaaucucaaauuucuaaaucu

SEQ ID NO: 1967159 - RNA, 14 nt, Human
aaacaccuucuaua

SEQ ID NO: 1967160 - RNA, 21 nt, Human
aaaauugaugggauuugguca

SEQ ID NO: 1967161 - RNA, 17 nt, Human
aaagauauuuugcuuug

SEQ ID NO: 1967162 - RNA, 20 nt, Human
aaagauauuuugcuuuguga

SEQ ID NO: 1967163 - RNA, 12 nt, Human
aaagauauuuug

SEQ ID NO: 1967164 - RNA, 16 nt, Human
aaagauauuuugcuuu

SEQ ID NO: 1967165 - RNA, 18 nt, Human
aaagaguguaaaauauuu

SEQ ID NO: 1967166 - RNA, 16 nt, Human
aaagaguguaaaauau

SEQ ID NO: 1967167 - RNA, 23 nt, Human
aaagaaaucuauagaaaguguuc

SEQ ID NO: 1967168 - RNA, 14 nt, Human
aaagaguaggaaga

SEQ ID NO: 1967169 - RNA, 20 nt, Human
aaagaagguuucagaaagaa

SEQ ID NO: 1967170 - RNA, 14 nt, Human
aaagagucuuucuu

SEQ ID NO: 1967171 - RNA, 18 nt, Human
aaacucugaauuuaucuu

SEQ ID NO: 1967172 - RNA, 15 nt, Human
aaacucugaauuuau

SEQ ID NO: 1967173 - RNA, 17 nt, Human
aaacucugaauuuaucu

SEQ ID NO: 1967174 - RNA, 15 nt, Human
aaagaaaucuauaga

SEQ ID NO: 1967175 - RNA, 18 nt, Human
aaagaaaucuauagaaag

SEQ ID NO: 1967176 - RNA, 21 nt, Human
aaagaaaucuauagaaagugu

SEQ ID NO: 1967177 - RNA, 22 nt, Human
aaagaaaucuauagaaaguguu

SEQ ID NO: 1967178 - RNA, 17 nt, Human
aaagaaauauaccuaaa

SEQ ID NO: 1967179 - RNA, 15 nt, Human
aaagaaauauaccua

SEQ ID NO: 1967180 - RNA, 18 nt, Human
aaaccaucauugaaaucu

SEQ ID NO: 1967181 - RNA, 13 nt, Human
aaacucucugaac

SEQ ID NO: 1967182 - RNA, 12 nt, Human
aaacucucugaa

SEQ ID NO: 1967183 - RNA, 15 nt, Human
aaacccugucaaaca

SEQ ID NO: 1967184 - RNA, 18 nt, Human
aaacucuccucugcugcu

SEQ ID NO: 1967185 - RNA, 14 nt, Human
aaacccugucaaac

SEQ ID NO: 1967186 - RNA, 16 nt, Human
aaacccugucaaacau

SEQ ID NO: 1967187 - RNA, 18 nt, Human
aaaccccuguaggccuca

SEQ ID NO: 1967188 - RNA, 16 nt, Human
aaacccuauugguaaa

SEQ ID NO: 1967189 - RNA, 15 nt, Human
aaagccaaugugaac

SEQ ID NO: 1967190 - RNA, 17 nt, Human
aaagccaaugugaacag

SEQ ID NO: 1967191 - RNA, 16 nt, Human
aaagccuccuccagcc

SEQ ID NO: 1967192 - RNA, 22 nt, Human
aaagcccuuccaugucgccucu

SEQ ID NO: 1967193 - RNA, 23 nt, Human
aaagcccuuccaugucgccucug

SEQ ID NO: 1967194 - RNA, 13 nt, Human
aaaggcaaggucc

SEQ ID NO: 1967195 - RNA, 16 nt, Human
aaaggcaaacauuuga

SEQ ID NO: 1967196 - RNA, 16 nt, Human
aaaggcuccaggagca

SEQ ID NO: 1967197 - RNA, 15 nt, Human
aaaggcuccaggagc

SEQ ID NO: 1967198 - RNA, 21 nt, Human
aaaggccuaauucuaugccug

SEQ ID NO: 1967199 - RNA, 12 nt, Human
aaaggcccagag

SEQ ID NO: 1967200 - RNA, 14 nt, Human
aaaggcagaagcaa

SEQ ID NO: 1967201 - RNA, 20 nt, Human
aaaggcacauggaauauauu

SEQ ID NO: 1967202 - RNA, 21 nt, Human
aaaggcacauggaauauauuu

SEQ ID NO: 1967203 - RNA, 20 nt, Human
aaaggcuccaggagcagcca

SEQ ID NO: 1967204 - RNA, 19 nt, Human
aaaggcuccaggagcagcc

SEQ ID NO: 1967205 - RNA, 13 nt, Human
aaaguggaaaaau

SEQ ID NO: 1967206 - RNA, 19 nt, Human
aaauaaaacuuuuuaaaau

SEQ ID NO: 1967207 - RNA, 13 nt, Human
aaauaaaacuuuu

SEQ ID NO: 1967208 - RNA, 16 nt, Human
aaauaaaacuuuuuaa

SEQ ID NO: 1967209 - RNA, 22 nt, Human
aaaguggcaccugucugcucca

SEQ ID NO: 1967210 - RNA, 18 nt, Human
aaaguggcaccugucugc

SEQ ID NO: 1967211 - RNA, 20 nt, Human
aaaguggcaccugucugcuc

SEQ ID NO: 1967212 - RNA, 17 nt, Human
aaauaaaucuacuguuu

SEQ ID NO: 1967213 - RNA, 16 nt, Human
aaaucaauaugcagaa

SEQ ID NO: 1967214 - RNA, 23 nt, Human
aaaucaaguauuauaaacaagaa

SEQ ID NO: 1967215 - RNA, 19 nt, Human
aaaucaaugcuauaacuau

SEQ ID NO: 1967216 - RNA, 17 nt, Human
aaaucaauaugcagaau

SEQ ID NO: 1967217 - RNA, 15 nt, Human
aaaucuuaauacugu

SEQ ID NO: 1967218 - RNA, 16 nt, Human
aaaucuuaauacuguu

SEQ ID NO: 1967219 - RNA, 17 nt, Human
aaaucuuaauacuguua

SEQ ID NO: 1967220 - RNA, 12 nt, Human
aaaucugucugc

SEQ ID NO: 1967221 - RNA, 14 nt, Human
aaaucugucugcug

SEQ ID NO: 1967222 - RNA, 13 nt, Human
aaaucaaagugcu

SEQ ID NO: 1967223 - RNA, 21 nt, Human
aaauaguuuauuuuaaaacaa

SEQ ID NO: 1967224 - RNA, 12 nt, Human
aaauaguuuauu

SEQ ID NO: 1967225 - RNA, 17 nt, Human
aaauaguuuauuuuaaa

SEQ ID NO: 1967226 - RNA, 20 nt, Human
aaauaguuuauuuuaaaaca

SEQ ID NO: 1967227 - RNA, 14 nt, Human
aaaucaaagugcua

SEQ ID NO: 1967228 - RNA, 15 nt, Human
aaaucaaagugcuau

SEQ ID NO: 1967229 - RNA, 22 nt, Human
aaaucaaauaauaccuuagaag

SEQ ID NO: 1967230 - RNA, 17 nt, Human
aaaucaaguauuauaaa

SEQ ID NO: 1967231 - RNA, 24 nt, Human
aaauagcucaggugucccugcacu

SEQ ID NO: 1967232 - RNA, 20 nt, Human
aaauagcuuuuuucucugau

SEQ ID NO: 1967233 - RNA, 17 nt, Human
aaauagcuuuuuucucu

SEQ ID NO: 1967234 - RNA, 19 nt, Human
aaauaguguuauugagaga

SEQ ID NO: 1967235 - RNA, 21 nt, Human
aaauaguguggaaauuaagaa

SEQ ID NO: 1967236 - RNA, 16 nt, Human
aaauaguucugugacu

SEQ ID NO: 1967237 - RNA, 22 nt, Human
aaauaguucugugacuaggaaa

SEQ ID NO: 1967238 - RNA, 23 nt, Human
aaauaguucugugacuaggaaaa

SEQ ID NO: 1967239 - RNA, 13 nt, Human
aaauaguucuucu

SEQ ID NO: 1967240 - RNA, 19 nt, Human
aaauaguggugugauuugg

SEQ ID NO: 1967241 - RNA, 20 nt, Human
aaauaguguggaaauuaaga

SEQ ID NO: 1967242 - RNA, 13 nt, Human
aaauucuuucauu

SEQ ID NO: 1967243 - RNA, 21 nt, Human
aaauucuugcaaaguaucccu

SEQ ID NO: 1967244 - RNA, 21 nt, Human
aaauugaaaaguuauuucccu

SEQ ID NO: 1967245 - RNA, 14 nt, Human
aaauugaaaaguua

SEQ ID NO: 1967246 - RNA, 13 nt, Human
aaauuaaagcuga

SEQ ID NO: 1967247 - RNA, 17 nt, Human
aaauuaaagcugaaaac

SEQ ID NO: 1967248 - RNA, 19 nt, Human
aaauugacacuuaaaaaug

SEQ ID NO: 1967249 - RNA, 13 nt, Human
aaauugcuccuug

SEQ ID NO: 1967250 - RNA, 15 nt, Human
aaauugcucacaguu

SEQ ID NO: 1967251 - RNA, 18 nt, Human
aaauugcucacaguuauu

SEQ ID NO: 1967252 - RNA, 23 nt, Human
aaauugcucacaguuauuacaua

SEQ ID NO: 1967253 - RNA, 14 nt, Human
aaauugcuccuuga

SEQ ID NO: 1967254 - RNA, 20 nt, Human
aaauugccuuucuguguuua

SEQ ID NO: 1967255 - RNA, 21 nt, Human
aaauugccuuucuguguuuau

SEQ ID NO: 1967256 - RNA, 14 nt, Human
aaauugccuuucug

SEQ ID NO: 1967257 - RNA, 16 nt, Human
aaauugccuuucugug

SEQ ID NO: 1967258 - RNA, 19 nt, Human
aaauugccuuucuguguuu

SEQ ID NO: 1967259 - RNA, 15 nt, Human
aaaugccuuuguacu

SEQ ID NO: 1967260 - RNA, 14 nt, Human
aaaucuuauuaaag

SEQ ID NO: 1967261 - RNA, 16 nt, Human
aaaucuuauuaaaguu

SEQ ID NO: 1967262 - RNA, 19 nt, Human
aaaucuuauuaaaguuuca

SEQ ID NO: 1967263 - RNA, 23 nt, Human
aaaugccuuacccucauguucuu

SEQ ID NO: 1967264 - RNA, 12 nt, Human
aaaucuuauuaa

SEQ ID NO: 1967265 - RNA, 19 nt, Human
aaaucuuaauacuguuauu

SEQ ID NO: 1967266 - RNA, 23 nt, Human
aaaucuuaauacuguuauucuuu

SEQ ID NO: 1967267 - RNA, 17 nt, Human
aaaucuuauaauuuaaa

SEQ ID NO: 1967268 - RNA, 12 nt, Human
aaauguuucuaa

SEQ ID NO: 1967269 - RNA, 14 nt, Human
aacaacauauacaa

SEQ ID NO: 1967270 - RNA, 18 nt, Human
aacaaauuuacagagaca

SEQ ID NO: 1967271 - RNA, 23 nt, Human
aaauuuuuuuucaugcuuuauca

SEQ ID NO: 1967272 - RNA, 12 nt, Human
aacacauuucuu

SEQ ID NO: 1967273 - RNA, 15 nt, Human
aacacauuucuuuuu

SEQ ID NO: 1967274 - RNA, 22 nt, Human
aacacauuucuuuuuaaaaaaa

SEQ ID NO: 1967275 - RNA, 15 nt, Human
aacacccacaggcau

SEQ ID NO: 1967276 - RNA, 13 nt, Human
aacacguuuuaag

SEQ ID NO: 1967277 - RNA, 13 nt, Human
aacacuaaauguu

SEQ ID NO: 1967278 - RNA, 14 nt, Human
aacacuaaauguua

SEQ ID NO: 1967279 - RNA, 15 nt, Human
aacacuaaauguuaa

SEQ ID NO: 1967280 - RNA, 22 nt, Human
aacacuaaauguuaaagaugua

SEQ ID NO: 1967281 - RNA, 16 nt, Human
aacacuaaauguuaaa

SEQ ID NO: 1967282 - RNA, 18 nt, Human
aacacuaaauguuaaaga

SEQ ID NO: 1967283 - RNA, 19 nt, Human
aacacuaaauguuaaagau

SEQ ID NO: 1967284 - RNA, 21 nt, Human
aacacuaaauguuaaagaugu

SEQ ID NO: 1967285 - RNA, 21 nt, Human
aaccgaacugauguaaguaaa

SEQ ID NO: 1967286 - RNA, 16 nt, Human
aacccuugccaggucc

SEQ ID NO: 1967287 - RNA, 21 nt, Human
aacccuuggagccaauggaga

SEQ ID NO: 1967288 - RNA, 15 nt, Human
aacccuauugguaaa

SEQ ID NO: 1967289 - RNA, 13 nt, Human
aacauccacucuc

SEQ ID NO: 1967290 - RNA, 15 nt, Human
aacauccacucucuc

SEQ ID NO: 1967291 - RNA, 16 nt, Human
aacauccaaguggccu

SEQ ID NO: 1967292 - RNA, 17 nt, Human
aacauccaaguggccuc

SEQ ID NO: 1967293 - RNA, 24 nt, Human
aacauccaaguggccuccgucacu

SEQ ID NO: 1967294 - RNA, 22 nt, Human
aacagcuucauguucccaaaau

SEQ ID NO: 1967295 - RNA, 17 nt, Human
aacaucauuccuuuuua

SEQ ID NO: 1967296 - RNA, 20 nt, Human
aacaucauuccuuuuuauuu

SEQ ID NO: 1967297 - RNA, 21 nt, Human
aacaucauuccuuuuuauuua

SEQ ID NO: 1967298 - RNA, 22 nt, Human
aacaucauuccuuuuuauuuau

SEQ ID NO: 1967299 - RNA, 15 nt, Human
aacagcuguugacuc

SEQ ID NO: 1967300 - RNA, 15 nt, Human
aacagcuucauguuc

SEQ ID NO: 1967301 - RNA, 18 nt, Human
aaccaccagaagcccaga

SEQ ID NO: 1967302 - RNA, 19 nt, Human
aaccaccagaagcccagaa

SEQ ID NO: 1967303 - RNA, 16 nt, Human
aacauccacucucucu

SEQ ID NO: 1967304 - RNA, 13 nt, Human
aaccacgcuggac

SEQ ID NO: 1967305 - RNA, 15 nt, Human
aaccacuucagcuga

SEQ ID NO: 1967306 - RNA, 22 nt, Human
aaccacuggaaaguuuaugguu

SEQ ID NO: 1967307 - RNA, 12 nt, Human
aaccagacacaa

SEQ ID NO: 1967308 - RNA, 22 nt, Human
aaccacuuguagauuugauuuu

SEQ ID NO: 1967309 - RNA, 12 nt, Human
aaccacuuguag

SEQ ID NO: 1967310 - RNA, 17 nt, Human
aaccacuuguagauuug

SEQ ID NO: 1967311 - RNA, 18 nt, Human
aaccacuuguagauuuga

SEQ ID NO: 1967312 - RNA, 20 nt, Human
aaccacuuguagauuugauu

SEQ ID NO: 1967313 - RNA, 21 nt, Human
aaccacuuguagauuugauuu

SEQ ID NO: 1967314 - RNA, 18 nt, Human
aacagcaguuucagguag

SEQ ID NO: 1967315 - RNA, 16 nt, Human
aacagcaagugugaau

SEQ ID NO: 1967316 - RNA, 15 nt, Human
aacagcaagugugaa

SEQ ID NO: 1967317 - RNA, 21 nt, Human
aacuuuaugcuaagugaaaua

SEQ ID NO: 1967318 - RNA, 20 nt, Human
aacuuuaugcuaagugaaau

SEQ ID NO: 1967319 - RNA, 15 nt, Human
aacuuaaucuaaaug

SEQ ID NO: 1967320 - RNA, 16 nt, Human
aacuuaaucuaaaugg

SEQ ID NO: 1967321 - RNA, 18 nt, Human
aacuuaaucuaaauggaa

SEQ ID NO: 1967322 - RNA, 20 nt, Human
aacuuaauaaucaagagccu

SEQ ID NO: 1967323 - RNA, 13 nt, Human
aacugacuugcug

SEQ ID NO: 1967324 - RNA, 13 nt, Human
aacuuaauaauca

SEQ ID NO: 1967325 - RNA, 15 nt, Human
aacuuaauaaucaag

SEQ ID NO: 1967326 - RNA, 17 nt, Human
aacuuaauaaucaagag

SEQ ID NO: 1967327 - RNA, 16 nt, Human
aacugagugccuuuug

SEQ ID NO: 1967328 - RNA, 14 nt, Human
aacugauaaagaug

SEQ ID NO: 1967329 - RNA, 15 nt, Human
aacgauuuaauuuau

SEQ ID NO: 1967330 - RNA, 11 nt, Human
aacgcagcccu

SEQ ID NO: 1967331 - RNA, 15 nt, Human
aacgcugauuuaaag

SEQ ID NO: 1967332 - RNA, 14 nt, Human
aacggccccagcuu

SEQ ID NO: 1967333 - RNA, 15 nt, Human
aacggccccagcuuc

SEQ ID NO: 1967334 - RNA, 17 nt, Human
aacggccccagcuucuc

SEQ ID NO: 1967335 - RNA, 15 nt, Human
aacuauuuaaagaaa

SEQ ID NO: 1967336 - RNA, 17 nt, Human
aacuauuuaaagaaaua

SEQ ID NO: 1967337 - RNA, 21 nt, Human
accccucccggcccugccugc

SEQ ID NO: 1967338 - RNA, 19 nt, Human
accccucccggcccugccu

SEQ ID NO: 1967339 - RNA, 20 nt, Human
accccucccggcccugccug

SEQ ID NO: 1967340 - RNA, 18 nt, Human
accccucccggcccugcc

SEQ ID NO: 1967341 - RNA, 16 nt, Human
accccuccaugugggc

SEQ ID NO: 1967342 - RNA, 19 nt, Human
accccuccaugugggcuag

SEQ ID NO: 1967343 - RNA, 17 nt, Human
accccucauagcccuca

SEQ ID NO: 1967344 - RNA, 14 nt, Human
accauauuaccaca

SEQ ID NO: 1967345 - RNA, 16 nt, Human
accauauuaccacaga

SEQ ID NO: 1967346 - RNA, 22 nt, Human
acccaagggccuggccugagcu

SEQ ID NO: 1967347 - RNA, 19 nt, Human
acccaagggccuggccuga

SEQ ID NO: 1967348 - RNA, 18 nt, Human
acccaagggccuggccug

SEQ ID NO: 1967349 - RNA, 20 nt, Human
accauauuaccacagacaua

SEQ ID NO: 1967350 - RNA, 21 nt, Human
acccacaagaaaugaaagcag

SEQ ID NO: 1967351 - RNA, 17 nt, Human
acccacaagaaaugaaa

SEQ ID NO: 1967352 - RNA, 23 nt, Human
acccaagggccuggccugagcug

SEQ ID NO: 1967353 - RNA, 13 nt, Human
acccaccucagcc

SEQ ID NO: 1967354 - RNA, 14 nt, Human
acccaccucagccu

SEQ ID NO: 1967355 - RNA, 15 nt, Human
acccaccucagccuc

SEQ ID NO: 1967356 - RNA, 16 nt, Human
acccaccucagccucc

SEQ ID NO: 1967357 - RNA, 11 nt, Human
acccaguggca

SEQ ID NO: 1967358 - RNA, 13 nt, Human
acccaguggcagg

SEQ ID NO: 1967359 - RNA, 14 nt, Human
acccaguggcaggg

SEQ ID NO: 1967360 - RNA, 15 nt, Human
acccaguggcagggc

SEQ ID NO: 1967361 - RNA, 16 nt, Human
acccaguggcagggca

SEQ ID NO: 1967362 - RNA, 17 nt, Human
acccaguggcagggcac

SEQ ID NO: 1967363 - RNA, 18 nt, Human
acccaguggcagggcaca

SEQ ID NO: 1967364 - RNA, 19 nt, Human
acccaguggcagggcacag

SEQ ID NO: 1967365 - RNA, 20 nt, Human
acccaguggcagggcacagg

SEQ ID NO: 1967366 - RNA, 22 nt, Human
acccaguggcagggcacagggc

SEQ ID NO: 1967367 - RNA, 24 nt, Human
acccaguggcagggcacagggccu

SEQ ID NO: 1967368 - RNA, 16 nt, Human
acccaugggcaggaga

SEQ ID NO: 1967369 - RNA, 17 nt, Human
acccaugggcaggagac

SEQ ID NO: 1967370 - RNA, 11 nt, Human
acccccugaau

SEQ ID NO: 1967371 - RNA, 14 nt, Human
acccccugcaaagc

SEQ ID NO: 1967372 - RNA, 17 nt, Human
acccccugcaaagccca

SEQ ID NO: 1967373 - RNA, 22 nt, Human
acccccugcaaagcccagcuug

SEQ ID NO: 1967374 - RNA, 18 nt, Human
acccccugcaaagcccag

SEQ ID NO: 1967375 - RNA, 20 nt, Human
acccccugcaaagcccagcu

SEQ ID NO: 1967376 - RNA, 13 nt, Human
acccauucagaga

SEQ ID NO: 1967377 - RNA, 21 nt, Human
acccauucagagacugucccu

SEQ ID NO: 1967378 - RNA, 18 nt, Human
acccaugggcaggagacu

SEQ ID NO: 1967379 - RNA, 17 nt, Human
accagccaguaaauggg

SEQ ID NO: 1967380 - RNA, 22 nt, Human
accagcccacgcugacuacagg

SEQ ID NO: 1967381 - RNA, 19 nt, Human
accagccccaauccaaaac

SEQ ID NO: 1967382 - RNA, 19 nt, Human
accagccagggaaagacug

SEQ ID NO: 1967383 - RNA, 11 nt, Human
accagcccacg

SEQ ID NO: 1967384 - RNA, 17 nt, Human
accagcccacgcugacu

SEQ ID NO: 1967385 - RNA, 21 nt, Human
accagcccacgcugacuacag

SEQ ID NO: 1967386 - RNA, 18 nt, Human
accagcacacucccgaga

SEQ ID NO: 1967387 - RNA, 14 nt, Human
accagcacacuccc

SEQ ID NO: 1967388 - RNA, 15 nt, Human
accagcacacucccg

SEQ ID NO: 1967389 - RNA, 16 nt, Human
accagcacacucccga

SEQ ID NO: 1967390 - RNA, 17 nt, Human
accagcacacucccgag

SEQ ID NO: 1967391 - RNA, 13 nt, Human
accagcagaaaug

SEQ ID NO: 1967392 - RNA, 14 nt, Human
accagaugugacag

SEQ ID NO: 1967393 - RNA, 13 nt, Human
accagcacacucc

SEQ ID NO: 1967394 - RNA, 19 nt, Human
accagagcugccaccugcc

SEQ ID NO: 1967395 - RNA, 13 nt, Human
accagaucauugu

SEQ ID NO: 1967396 - RNA, 12 nt, Human
accaagcccagu

SEQ ID NO: 1967397 - RNA, 20 nt, Human
accaagguagaaugaccuug

SEQ ID NO: 1967398 - RNA, 23 nt, Human
accaagguagaaugaccuuguaa

SEQ ID NO: 1967399 - RNA, 19 nt, Human
acauuuguucuauagcuuu

SEQ ID NO: 1967400 - RNA, 17 nt, Human
acauuugucauuuucau

SEQ ID NO: 1967401 - RNA, 18 nt, Human
acauuugucauuuucauu

SEQ ID NO: 1967402 - RNA, 19 nt, Human
acauuugucauuuucauua

SEQ ID NO: 1967403 - RNA, 22 nt, Human
acauuugucauuuucauuagca

SEQ ID NO: 1967404 - RNA, 23 nt, Human
acauuugucauuuucauuagcaa

SEQ ID NO: 1967405 - RNA, 23 nt, Human
acauuuguuugguuauagugcaa

SEQ ID NO: 1967406 - RNA, 15 nt, Human
acauuuauucugcuc

SEQ ID NO: 1967407 - RNA, 15 nt, Human
acauuucacugucug

SEQ ID NO: 1967408 - RNA, 16 nt, Human
acauuucacugucugu

SEQ ID NO: 1967409 - RNA, 22 nt, Human
acauuucacugucugucugguc

SEQ ID NO: 1967410 - RNA, 11 nt, Human
acauuugucau

SEQ ID NO: 1967411 - RNA, 14 nt, Human
acauuugucauuuu

SEQ ID NO: 1967412 - RNA, 16 nt, Human
acauuugucauuuuca

SEQ ID NO: 1967413 - RNA, 14 nt, Human
acauuuauucugcu

SEQ ID NO: 1967414 - RNA, 23 nt, Human
acauaaugcgugcauaccacuuu

SEQ ID NO: 1967415 - RNA, 22 nt, Human
acauaaugcgugcauaccacuu

SEQ ID NO: 1967416 - RNA, 21 nt, Human
acauaaugcgugcauaccacu

SEQ ID NO: 1967417 - RNA, 19 nt, Human
acaggcaaugcuggcuguu

SEQ ID NO: 1967418 - RNA, 23 nt, Human
acaggcaaugcuggcuguuggcu

SEQ ID NO: 1967419 - RNA, 19 nt, Human
acaggguuuugccauguug

SEQ ID NO: 1967420 - RNA, 22 nt, Human
acauguuucuuuguaaugaaaa

SEQ ID NO: 1967421 - RNA, 19 nt, Human
acauguuucuuuguaauga

SEQ ID NO: 1967422 - RNA, 21 nt, Human
acauguuuauguaaacaaauc

SEQ ID NO: 1967423 - RNA, 23 nt, Human
acauguuuauguaaacaaaucuu

SEQ ID NO: 1967424 - RNA, 23 nt, Human
acauguuucuuuguaaugaaaac

SEQ ID NO: 1967425 - RNA, 15 nt, Human
acaucagcacgauuu

SEQ ID NO: 1967426 - RNA, 17 nt, Human
acaucagcacgauuucu

SEQ ID NO: 1967427 - RNA, 18 nt, Human
acaucagcacgauuucug

SEQ ID NO: 1967428 - RNA, 16 nt, Human
acaugaugauuucaga

SEQ ID NO: 1967429 - RNA, 12 nt, Human
acaugauuucac

SEQ ID NO: 1967430 - RNA, 13 nt, Human
acaugauuucaca

SEQ ID NO: 1967431 - RNA, 14 nt, Human
acaugauuucacaa

SEQ ID NO: 1967432 - RNA, 15 nt, Human
acaugauuucacaaa

SEQ ID NO: 1967433 - RNA, 21 nt, Human
acaugauuucacaaauauuaa

SEQ ID NO: 1967434 - RNA, 22 nt, Human
acaugauuucacaaauauuaaa

SEQ ID NO: 1967435 - RNA, 17 nt, Human
acaugauuucacaaaua

SEQ ID NO: 1967436 - RNA, 18 nt, Human
acaugauuucacaaauau

SEQ ID NO: 1967437 - RNA, 19 nt, Human
acaugauuucacaaauauu

SEQ ID NO: 1967438 - RNA, 20 nt, Human
acaugauuucacaaauauua

SEQ ID NO: 1967439 - RNA, 19 nt, Human
acaugaucuucuuuauaau

SEQ ID NO: 1967440 - RNA, 16 nt, Human
acaugugcacaugcac

SEQ ID NO: 1967441 - RNA, 18 nt, Human
acaugugcacaugcacgu

SEQ ID NO: 1967442 - RNA, 14 nt, Human
acaggauuauugga

SEQ ID NO: 1967443 - RNA, 21 nt, Human
acaggaugaugacuauggaaa

SEQ ID NO: 1967444 - RNA, 18 nt, Human
acaggcaaugcuggcugu

SEQ ID NO: 1967445 - RNA, 12 nt, Human
acaggcaagcac

SEQ ID NO: 1967446 - RNA, 14 nt, Human
acaggcaaacauuu

SEQ ID NO: 1967447 - RNA, 15 nt, Human
acaggcaaacauuuu

SEQ ID NO: 1967448 - RNA, 14 nt, Human
acaggauuauuuug

SEQ ID NO: 1967449 - RNA, 15 nt, Human
acaggauuauuuuga

SEQ ID NO: 1967450 - RNA, 23 nt, Human
acaggcaaauccgaaaucagcag

SEQ ID NO: 1967451 - RNA, 16 nt, Human
acagcucuucuccagg

SEQ ID NO: 1967452 - RNA, 17 nt, Human
acagcucuucuccaggc

SEQ ID NO: 1967453 - RNA, 15 nt, Human
acaggaucagucuga

SEQ ID NO: 1967454 - RNA, 18 nt, Human
acagcucuucuccaggcu

SEQ ID NO: 1967455 - RNA, 18 nt, Human
acagccacggccaggcca

SEQ ID NO: 1967456 - RNA, 15 nt, Human
acagccacggccagg

SEQ ID NO: 1967457 - RNA, 16 nt, Human
acagccacggccaggc

SEQ ID NO: 1967458 - RNA, 17 nt, Human
acagccacggccaggcc

SEQ ID NO: 1967459 - RNA, 20 nt, Human
acacuggcaaugguaguuuc

SEQ ID NO: 1967460 - RNA, 21 nt, Human
acacuggcaaugguaguuucu

SEQ ID NO: 1967461 - RNA, 21 nt, Human
acacugccaacugaucuguua

SEQ ID NO: 1967462 - RNA, 14 nt, Human
acacugcauguuug

SEQ ID NO: 1967463 - RNA, 15 nt, Human
acacugcauguuugu

SEQ ID NO: 1967464 - RNA, 15 nt, Human
acacuguacugcaau

SEQ ID NO: 1967465 - RNA, 13 nt, Human
acagacaaagcgu

SEQ ID NO: 1967466 - RNA, 11 nt, Human
acagacacagg

SEQ ID NO: 1967467 - RNA, 15 nt, Human
acagacacaggcccg

SEQ ID NO: 1967468 - RNA, 19 nt, Human
acagaggcagccccauucu

SEQ ID NO: 1967469 - RNA, 23 nt, Human
acagaggcagccccauucugccu

SEQ ID NO: 1967470 - RNA, 13 nt, Human
acagacacaggcc

SEQ ID NO: 1967471 - RNA, 14 nt, Human
acagacacaggccc

SEQ ID NO: 1967472 - RNA, 14 nt, Human
acagaggcagcccc

SEQ ID NO: 1967473 - RNA, 15 nt, Human
acagaggcagcccca

SEQ ID NO: 1967474 - RNA, 16 nt, Human
acagcaguuucaggua

SEQ ID NO: 1967475 - RNA, 17 nt, Human
acagccaacuauggccu

SEQ ID NO: 1967476 - RNA, 19 nt, Human
acagccaacuauggccugu

SEQ ID NO: 1967477 - RNA, 14 nt, Human
acagaggggguggc

SEQ ID NO: 1967478 - RNA, 15 nt, Human
acagagugagacucu

SEQ ID NO: 1967479 - RNA, 17 nt, Human
acagaggcuauuguccc

SEQ ID NO: 1967480 - RNA, 23 nt, Human
acagagucucacuguugcccagg

SEQ ID NO: 1967481 - RNA, 19 nt, Human
acagagugagacucugucu

SEQ ID NO: 1967482 - RNA, 20 nt, Human
acacagcucuguccugggag

SEQ ID NO: 1967483 - RNA, 17 nt, Human
acacagauuugagcuca

SEQ ID NO: 1967484 - RNA, 14 nt, Human
acacagcucugucc

SEQ ID NO: 1967485 - RNA, 19 nt, Human
acacagaggcugccucucc

SEQ ID NO: 1967486 - RNA, 12 nt, Human
acacauuuuucu

SEQ ID NO: 1967487 - RNA, 20 nt, Human
acacauuuuuuaaaugcacc

SEQ ID NO: 1967488 - RNA, 22 nt, Human
acacauuuuuuaaaugcaccug

SEQ ID NO: 1967489 - RNA, 21 nt, Human
acacauuuuauuuuauuaugc

SEQ ID NO: 1967490 - RNA, 22 nt, Human
acacauuuuauuuuauuaugca

SEQ ID NO: 1967491 - RNA, 11 nt, Human
acacagcucuu

SEQ ID NO: 1967492 - RNA, 13 nt, Human
acacagcucuucu

SEQ ID NO: 1967493 - RNA, 15 nt, Human
acacgcgugcacaca

SEQ ID NO: 1967494 - RNA, 17 nt, Human
acacgcgugcacacacc

SEQ ID NO: 1967495 - RNA, 14 nt, Human
acaccaaaaaauau

SEQ ID NO: 1967496 - RNA, 15 nt, Human
acaccaaaaaauauc

SEQ ID NO: 1967497 - RNA, 19 nt, Human
acaccaaaaaaauccagaa

SEQ ID NO: 1967498 - RNA, 16 nt, Human
acacgcuccuuccucu

SEQ ID NO: 1967499 - RNA, 14 nt, Human
acacgcuccuuccu

SEQ ID NO: 1967500 - RNA, 21 nt, Human
acaauucucccgggacucugc

SEQ ID NO: 1967501 - RNA, 15 nt, Human
acaaggcaaggcugu

SEQ ID NO: 1967502 - RNA, 15 nt, Human
acaaggcaaaaacaa

SEQ ID NO: 1967503 - RNA, 17 nt, Human
acaaggcaaaaacaaag

SEQ ID NO: 1967504 - RNA, 20 nt, Human
acaaggcaaggcugucaauu

SEQ ID NO: 1967505 - RNA, 23 nt, Human
acaagggaaaauaaaaaaagaaa

SEQ ID NO: 1967506 - RNA, 17 nt, Human
acaaggcuugcugcaga

SEQ ID NO: 1967507 - RNA, 22 nt, Human
acaaggcuugcugcagauacua

SEQ ID NO: 1967508 - RNA, 23 nt, Human
acaaccuuggcuuggcccuggca

SEQ ID NO: 1967509 - RNA, 16 nt, Human
acaacgagccuuuuca

SEQ ID NO: 1967510 - RNA, 13 nt, Human
acaaacaaaagca

SEQ ID NO: 1967511 - RNA, 14 nt, Human
acaaacaaaagcau

SEQ ID NO: 1967512 - RNA, 16 nt, Human
acaaaauucuuucugg

SEQ ID NO: 1967513 - RNA, 11 nt, Human
acaaacaaaag

SEQ ID NO: 1967514 - RNA, 22 nt, Human
acaaaauguaggguuauaauaa

SEQ ID NO: 1967515 - RNA, 14 nt, Human
acaaggcaaggcug

SEQ ID NO: 1967516 - RNA, 12 nt, Human
acaaggcaaggc

SEQ ID NO: 1967517 - RNA, 17 nt, Human
acaaggauugcuacugu

SEQ ID NO: 1967518 - RNA, 13 nt, Human
acaagaaaugaaa

SEQ ID NO: 1967519 - RNA, 15 nt, Human
acaacuuuuuuuucu

SEQ ID NO: 1967520 - RNA, 18 nt, Human
acaacuuuuuuuucuuuu

SEQ ID NO: 1967521 - RNA, 20 nt, Human
acaacuuuuuuuucuuuuuu

SEQ ID NO: 1967522 - RNA, 10 nt, Human
acaagaaaau

SEQ ID NO: 1967523 - RNA, 18 nt, Human
aauuuuguaauguaucaa

SEQ ID NO: 1967524 - RNA, 21 nt, Human
aauuuugucugccccaaguuu

SEQ ID NO: 1967525 - RNA, 22 nt, Human
aauuuugucugccccaaguuuu

SEQ ID NO: 1967526 - RNA, 14 nt, Human
aauuuuguguaaga

SEQ ID NO: 1967527 - RNA, 23 nt, Human
aauuuugugaaacagacuuguau

SEQ ID NO: 1967528 - RNA, 15 nt, Human
aauuuuguguaagaa

SEQ ID NO: 1967529 - RNA, 17 nt, Human
aauuuuguguaagaaau

SEQ ID NO: 1967530 - RNA, 18 nt, Human
aauuuuguguaagaaaua

SEQ ID NO: 1967531 - RNA, 22 nt, Human
aauuuuguguaagaaauacaga

SEQ ID NO: 1967532 - RNA, 20 nt, Human
aauuuuccuucagauauuuu

SEQ ID NO: 1967533 - RNA, 11 nt, Human
aauuuuccuuu

SEQ ID NO: 1967534 - RNA, 20 nt, Human
aauuuuccuuuaauaugaaa

SEQ ID NO: 1967535 - RNA, 23 nt, Human
aauuuuccuuuaauaugaaauuu

SEQ ID NO: 1967536 - RNA, 15 nt, Human
acucauauuuucaug

SEQ ID NO: 1967537 - RNA, 22 nt, Human
acucauauccccuauuuaacag

SEQ ID NO: 1967538 - RNA, 17 nt, Human
acucuagggaaaaacca

SEQ ID NO: 1967539 - RNA, 15 nt, Human
acucuagggaaaaac

SEQ ID NO: 1967540 - RNA, 21 nt, Human
acucuaucaaguauuauaccu

SEQ ID NO: 1967541 - RNA, 17 nt, Human
acucuauguucuaagaa

SEQ ID NO: 1967542 - RNA, 16 nt, Human
acucuaguacugugaa

SEQ ID NO: 1967543 - RNA, 17 nt, Human
acucuaguacugugaau

SEQ ID NO: 1967544 - RNA, 23 nt, Human
acucuaucaaguauuauaccuuu

SEQ ID NO: 1967545 - RNA, 19 nt, Human
acucugucgcccagucugg

SEQ ID NO: 1967546 - RNA, 13 nt, Human
acucuauggucuu

SEQ ID NO: 1967547 - RNA, 15 nt, Human
acuagauuugggaga

SEQ ID NO: 1967548 - RNA, 13 nt, Human
acuagauuacauu

SEQ ID NO: 1967549 - RNA, 18 nt, Human
acuagauuacauucaguu

SEQ ID NO: 1967550 - RNA, 23 nt, Human
acucaaaugcucagaccagcucu

SEQ ID NO: 1967551 - RNA, 21 nt, Human
acucaaaugcucagaccagcu

SEQ ID NO: 1967552 - RNA, 22 nt, Human
acucaaaucuuaagaaauaaau

SEQ ID NO: 1967553 - RNA, 18 nt, Human
acucaaaugcucagacca

SEQ ID NO: 1967554 - RNA, 13 nt, Human
acucaaaaagcug

SEQ ID NO: 1967555 - RNA, 18 nt, Human
acucaaaucuuaagaaau

SEQ ID NO: 1967556 - RNA, 17 nt, Human
acucagcccucauuggc

SEQ ID NO: 1967557 - RNA, 21 nt, Human
acucagcccucauuggcucuu

SEQ ID NO: 1967558 - RNA, 16 nt, Human
acucaggcccaaagcc

SEQ ID NO: 1967559 - RNA, 19 nt, Human
acucaguccauagcagaga

SEQ ID NO: 1967560 - RNA, 13 nt, Human
acucaaaagcugg

SEQ ID NO: 1967561 - RNA, 16 nt, Human
acuaguauuuguugag

SEQ ID NO: 1967562 - RNA, 21 nt, Human
accucugcagcaauaaagcag

SEQ ID NO: 1967563 - RNA, 19 nt, Human
accucugccuuugugguga

SEQ ID NO: 1967564 - RNA, 18 nt, Human
accucugcagcaauaaag

SEQ ID NO: 1967565 - RNA, 20 nt, Human
accucugcagcaauaaagca

SEQ ID NO: 1967566 - RNA, 15 nt, Human
accucugcagcaaua

SEQ ID NO: 1967567 - RNA, 20 nt, Human
accugcccugcugaguccca

SEQ ID NO: 1967568 - RNA, 14 nt, Human
accucugggagcug

SEQ ID NO: 1967569 - RNA, 13 nt, Human
accucugggagcu

SEQ ID NO: 1967570 - RNA, 11 nt, Human
accugucugcu

SEQ ID NO: 1967571 - RNA, 13 nt, Human
accugucugcucc

SEQ ID NO: 1967572 - RNA, 14 nt, Human
accugucugcucca

SEQ ID NO: 1967573 - RNA, 19 nt, Human
accugucugcuccagcucu

SEQ ID NO: 1967574 - RNA, 20 nt, Human
accugucugcuccagcucug

SEQ ID NO: 1967575 - RNA, 17 nt, Human
accuguuaaaauuauac

SEQ ID NO: 1967576 - RNA, 15 nt, Human
accugucccccugac

SEQ ID NO: 1967577 - RNA, 12 nt, Human
accugucccccu

SEQ ID NO: 1967578 - RNA, 16 nt, Human
accugucccccugaca

SEQ ID NO: 1967579 - RNA, 22 nt, Human
accuguccuaaggaaccuuccu

SEQ ID NO: 1967580 - RNA, 15 nt, Human
accuuuaagagaaau

SEQ ID NO: 1967581 - RNA, 22 nt, Human
accuuuaaucagguccugcuca

SEQ ID NO: 1967582 - RNA, 16 nt, Human
accuuuaaucuguuuu

SEQ ID NO: 1967583 - RNA, 18 nt, Human
accuuucccaucuuccaa

SEQ ID NO: 1967584 - RNA, 13 nt, Human
accuuucccaucu

SEQ ID NO: 1967585 - RNA, 17 nt, Human
accuuggcugcagggag

SEQ ID NO: 1967586 - RNA, 18 nt, Human
accuuggcugcagggagu

SEQ ID NO: 1967587 - RNA, 12 nt, Human
accuuggcuugg

SEQ ID NO: 1967588 - RNA, 17 nt, Human
accuuggcuuggcccug

SEQ ID NO: 1967589 - RNA, 20 nt, Human
accuuggcuuggcccuggca

SEQ ID NO: 1967590 - RNA, 21 nt, Human
accuuggcuuggcccuggcag

SEQ ID NO: 1967591 - RNA, 13 nt, Human
accuugguuccug

SEQ ID NO: 1967592 - RNA, 15 nt, Human
accuugguuccuggg

SEQ ID NO: 1967593 - RNA, 15 nt, Human
accuugguuggaagg

SEQ ID NO: 1967594 - RNA, 14 nt, Human
accuuguaauguaa

SEQ ID NO: 1967595 - RNA, 15 nt, Human
accuuguaauguaac

SEQ ID NO: 1967596 - RNA, 22 nt, Human
acuaagucucuuuuuuacaaag

SEQ ID NO: 1967597 - RNA, 23 nt, Human
acuaagucucuuuuuuacaaagg

SEQ ID NO: 1967598 - RNA, 15 nt, Human
acuaagucucuuuuu

SEQ ID NO: 1967599 - RNA, 18 nt, Human
acuaagucucuuuuuuac

SEQ ID NO: 1967600 - RNA, 19 nt, Human
acuaagucucuuuuuuaca

SEQ ID NO: 1967601 - RNA, 20 nt, Human
acuaagucucuuuuuuacaa

SEQ ID NO: 1967602 - RNA, 21 nt, Human
acuaagucucuuuuuuacaaa

SEQ ID NO: 1967603 - RNA, 21 nt, Human
acgugaugugcucaucagaaa

SEQ ID NO: 1967604 - RNA, 18 nt, Human
acuaacuucuaaaacugu

SEQ ID NO: 1967605 - RNA, 19 nt, Human
acuaacuucuaaaacugua

SEQ ID NO: 1967606 - RNA, 22 nt, Human
acuaacuucuaaaacuguacuu

SEQ ID NO: 1967607 - RNA, 11 nt, Human
acgugaguccu

SEQ ID NO: 1967608 - RNA, 21 nt, Human
acgucuauuucaucagaacag

SEQ ID NO: 1967609 - RNA, 22 nt, Human
acgucuauuucaucagaacagc

SEQ ID NO: 1967610 - RNA, 14 nt, Human
acggaacucaaaua

SEQ ID NO: 1967611 - RNA, 13 nt, Human
acgucugacaggc

SEQ ID NO: 1967612 - RNA, 14 nt, Human
acgucugacaggca

SEQ ID NO: 1967613 - RNA, 18 nt, Human
acgucuauuucaucagaa

SEQ ID NO: 1967614 - RNA, 14 nt, Human
acgcugugcugccc

SEQ ID NO: 1967615 - RNA, 12 nt, Human
acgcugugcugc

SEQ ID NO: 1967616 - RNA, 11 nt, Human
acgcugugcug

SEQ ID NO: 1967617 - RNA, 12 nt, Human
acgccacauccc

SEQ ID NO: 1967618 - RNA, 15 nt, Human
acgccacauccccca

SEQ ID NO: 1967619 - RNA, 14 nt, Human
agaaaguguucugu

SEQ ID NO: 1967620 - RNA, 16 nt, Human
agaaaguguucuguua

SEQ ID NO: 1967621 - RNA, 18 nt, Human
agaaaguguucuguuaca

SEQ ID NO: 1967622 - RNA, 19 nt, Human
agaaaguguucuguuacaa

SEQ ID NO: 1967623 - RNA, 20 nt, Human
agaaaguguucuguuacaaa

SEQ ID NO: 1967624 - RNA, 23 nt, Human
agaaaguguucuguuacaaaaug

SEQ ID NO: 1967625 - RNA, 21 nt, Human
agaaauaaauccacccauguu

SEQ ID NO: 1967626 - RNA, 19 nt, Human
agaaauaaugucaaaaaua

SEQ ID NO: 1967627 - RNA, 14 nt, Human
agaaauaauaaaaa

SEQ ID NO: 1967628 - RNA, 17 nt, Human
agaaaguaaauaaaagg

SEQ ID NO: 1967629 - RNA, 23 nt, Human
agaaaguacuucuccacccugcu

SEQ ID NO: 1967630 - RNA, 22 nt, Human
agaaaguacuucuccacccugc

SEQ ID NO: 1967631 - RNA, 16 nt, Human
agaaaggauaaaguug

SEQ ID NO: 1967632 - RNA, 23 nt, Human
agaaaaucugaauuggaaugcac

SEQ ID NO: 1967633 - RNA, 17 nt, Human
acuuuuccaauauguga

SEQ ID NO: 1967634 - RNA, 20 nt, Human
acuuuuccaauaugugauuu

SEQ ID NO: 1967635 - RNA, 16 nt, Human
acuuuucaaguauuua

SEQ ID NO: 1967636 - RNA, 21 nt, Human
acuuuuccaauaugugauuuu

SEQ ID NO: 1967637 - RNA, 11 nt, Human
acuuuuccagu

SEQ ID NO: 1967638 - RNA, 14 nt, Human
acuuuuccaguauu

SEQ ID NO: 1967639 - RNA, 15 nt, Human
acuuuuccaguauuu

SEQ ID NO: 1967640 - RNA, 16 nt, Human
acuuuuccaguauuuu

SEQ ID NO: 1967641 - RNA, 18 nt, Human
acuuuuccaguauuuuag

SEQ ID NO: 1967642 - RNA, 19 nt, Human
acuuuuccaguauuuuagu

SEQ ID NO: 1967643 - RNA, 16 nt, Human
acuuuucuuucagcca

SEQ ID NO: 1967644 - RNA, 23 nt, Human
acuuuuaugauacuugaaaauua

SEQ ID NO: 1967645 - RNA, 23 nt, Human
acuuuuauuuccagugaaaucag

SEQ ID NO: 1967646 - RNA, 22 nt, Human
acuuuuagaugugguuaauuuu

SEQ ID NO: 1967647 - RNA, 20 nt, Human
acuuuucauaaccuagccuu

SEQ ID NO: 1967648 - RNA, 14 nt, Human
agaaaauaacaaua

SEQ ID NO: 1967649 - RNA, 13 nt, Human
acuuuugcuuuaa

SEQ ID NO: 1967650 - RNA, 12 nt, Human
acuuuugcuuua

SEQ ID NO: 1967651 - RNA, 14 nt, Human
acuuuucuuugugg

SEQ ID NO: 1967652 - RNA, 15 nt, Human
agaaaauaccaagga

SEQ ID NO: 1967653 - RNA, 19 nt, Human
agaaaauaguggugugauu

SEQ ID NO: 1967654 - RNA, 16 nt, Human
agaaaaucaggcuggc

SEQ ID NO: 1967655 - RNA, 19 nt, Human
agaaaauacuuaaauguua

SEQ ID NO: 1967656 - RNA, 17 nt, Human
agaaaauacuuaaaugu

SEQ ID NO: 1967657 - RNA, 18 nt, Human
agaaaauacuuaaauguu

SEQ ID NO: 1967658 - RNA, 13 nt, Human
acuuuuauaaacu

SEQ ID NO: 1967659 - RNA, 12 nt, Human
acuuuuagaugu

SEQ ID NO: 1967660 - RNA, 16 nt, Human
acuuuuaugauacuug

SEQ ID NO: 1967661 - RNA, 12 nt, Human
acuuuuaugaua

SEQ ID NO: 1967662 - RNA, 19 nt, Human
acuuuguucuggcucuucc

SEQ ID NO: 1967663 - RNA, 20 nt, Human
acuuuguucuggcucuucca

SEQ ID NO: 1967664 - RNA, 21 nt, Human
acuuuuaaagaauuucuuuau

SEQ ID NO: 1967665 - RNA, 17 nt, Human
acuuuguucuggcucuu

SEQ ID NO: 1967666 - RNA, 16 nt, Human
acuuuguucuggcucu

SEQ ID NO: 1967667 - RNA, 22 nt, Human
acuuuauuuucuauaauuuaaa

SEQ ID NO: 1967668 - RNA, 13 nt, Human
acuuuauugcauc

SEQ ID NO: 1967669 - RNA, 17 nt, Human
acuuuauugccaaaacc

SEQ ID NO: 1967670 - RNA, 16 nt, Human
acuuuauuagcagcug

SEQ ID NO: 1967671 - RNA, 22 nt, Human
acuuuaucuugaauaauguaag

SEQ ID NO: 1967672 - RNA, 17 nt, Human
acuuuauagaagaaugc

SEQ ID NO: 1967673 - RNA, 18 nt, Human
acuuuauagaagaaugca

SEQ ID NO: 1967674 - RNA, 19 nt, Human
acuuuauaguuguuuuaua

SEQ ID NO: 1967675 - RNA, 20 nt, Human
acugugcugagucugaaggc

SEQ ID NO: 1967676 - RNA, 17 nt, Human
acugugcguggggcucc

SEQ ID NO: 1967677 - RNA, 23 nt, Human
acugugcguggggcucccgccuc

SEQ ID NO: 1967678 - RNA, 22 nt, Human
acugugcugagucugaaggcug

SEQ ID NO: 1967679 - RNA, 17 nt, Human
acuuggggcacagggag

SEQ ID NO: 1967680 - RNA, 16 nt, Human
acuugguuuuuaaaaa

SEQ ID NO: 1967681 - RNA, 11 nt, Human
acuucuucugu

SEQ ID NO: 1967682 - RNA, 20 nt, Human
acuucuucuguccaagcaga

SEQ ID NO: 1967683 - RNA, 14 nt, Human
acuugggccacugu

SEQ ID NO: 1967684 - RNA, 15 nt, Human
acuugggccacugug

SEQ ID NO: 1967685 - RNA, 19 nt, Human
acuucaaaacaaacagaug

SEQ ID NO: 1967686 - RNA, 12 nt, Human
acuucagacaua

SEQ ID NO: 1967687 - RNA, 16 nt, Human
acuuauuucacuuuag

SEQ ID NO: 1967688 - RNA, 21 nt, Human
acucugucgagccugggggcu

SEQ ID NO: 1967689 - RNA, 18 nt, Human
acucugucucaguccaug

SEQ ID NO: 1967690 - RNA, 20 nt, Human
acucugucucaguccaugaa

SEQ ID NO: 1967691 - RNA, 15 nt, Human
acuggagaaaaugga

SEQ ID NO: 1967692 - RNA, 13 nt, Human
acugguccaucug

SEQ ID NO: 1967693 - RNA, 18 nt, Human
acugguaggaaacuaggu

SEQ ID NO: 1967694 - RNA, 17 nt, Human
acugccagcucuuccua

SEQ ID NO: 1967695 - RNA, 12 nt, Human
acugccagcucu

SEQ ID NO: 1967696 - RNA, 16 nt, Human
acugccagcucuuccu

SEQ ID NO: 1967697 - RNA, 19 nt, Human
acugccccccaugaggaag

SEQ ID NO: 1967698 - RNA, 22 nt, Human
acugccccccaugaggaaggaa

SEQ ID NO: 1967699 - RNA, 14 nt, Human
acugcccccucugc

SEQ ID NO: 1967700 - RNA, 15 nt, Human
acugcccccucugcc

SEQ ID NO: 1967701 - RNA, 19 nt, Human
acuggaagcacagcuucau

SEQ ID NO: 1967702 - RNA, 17 nt, Human
acuggaagcacagcuuc

SEQ ID NO: 1967703 - RNA, 16 nt, Human
acugcccccucugccc

SEQ ID NO: 1967704 - RNA, 17 nt, Human
acugcccccucugcccu

SEQ ID NO: 1967705 - RNA, 18 nt, Human
acugguuccauggccucu

SEQ ID NO: 1967706 - RNA, 14 nt, Human
acugguuauuuaaa

SEQ ID NO: 1967707 - RNA, 19 nt, Human
acugucucaagagggcacu

SEQ ID NO: 1967708 - RNA, 12 nt, Human
acugugaagagc

SEQ ID NO: 1967709 - RNA, 15 nt, Human
acugugaagagcugg

SEQ ID NO: 1967710 - RNA, 20 nt, Human
acugucucaagagggcacug

SEQ ID NO: 1967711 - RNA, 21 nt, Human
acugucucaagagggcacugg

SEQ ID NO: 1967712 - RNA, 23 nt, Human
acugucucaagagggcacuggug

SEQ ID NO: 1967713 - RNA, 14 nt, Human
acugugacaucucu

SEQ ID NO: 1967714 - RNA, 22 nt, Human
acugugcgcauaggccugcuuu

SEQ ID NO: 1967715 - RNA, 13 nt, Human
cucucccuuggau

SEQ ID NO: 1967716 - RNA, 20 nt, Human
cucuccuccuuuucacaguu

SEQ ID NO: 1967717 - RNA, 13 nt, Human
cucuccuccuuuu

SEQ ID NO: 1967718 - RNA, 16 nt, Human
cucuccgaccagacac

SEQ ID NO: 1967719 - RNA, 20 nt, Human
cucucuugauuaagaucuca

SEQ ID NO: 1967720 - RNA, 19 nt, Human
cucucuggccuucggccuc

SEQ ID NO: 1967721 - RNA, 22 nt, Human
cucucuggccuucggccuccau

SEQ ID NO: 1967722 - RNA, 17 nt, Human
cucucuggccuucggcc

SEQ ID NO: 1967723 - RNA, 10 nt, Human
cucuccucug

SEQ ID NO: 1967724 - RNA, 16 nt, Human
cucugcacaagcugca

SEQ ID NO: 1967725 - RNA, 16 nt, Human
cucgaacuccugaccu

SEQ ID NO: 1967726 - RNA, 17 nt, Human
cucgaacuccugaccuu

SEQ ID NO: 1967727 - RNA, 13 nt, Human
cucgaacuccuga

SEQ ID NO: 1967728 - RNA, 16 nt, Human
cuccuuuuccagagca

SEQ ID NO: 1967729 - RNA, 17 nt, Human
cuccuuuuccagagcau

SEQ ID NO: 1967730 - RNA, 19 nt, Human
cuccuuuuccagagcauuc

SEQ ID NO: 1967731 - RNA, 13 nt, Human
cuccuuuuguguu

SEQ ID NO: 1967732 - RNA, 17 nt, Human
cuccuuuuguguuccaa

SEQ ID NO: 1967733 - RNA, 23 nt, Human
cuccuuugugaggaagccgcugg

SEQ ID NO: 1967734 - RNA, 24 nt, Human
cuccuuuucacaguucucuccuuc

SEQ ID NO: 1967735 - RNA, 16 nt, Human
cuccuagccacccacc

SEQ ID NO: 1967736 - RNA, 22 nt, Human
cuccuagccugugccucuggga

SEQ ID NO: 1967737 - RNA, 16 nt, Human
cuccuuuagcgcccag

SEQ ID NO: 1967738 - RNA, 17 nt, Human
cuccuuuagcgcccagu

SEQ ID NO: 1967739 - RNA, 22 nt, Human
cuccuuuagcgcccaguugggu

SEQ ID NO: 1967740 - RNA, 17 nt, Human
cuccuuuagggacagcu

SEQ ID NO: 1967741 - RNA, 11 nt, Human
cucggugccuu

SEQ ID NO: 1967742 - RNA, 18 nt, Human
cucguauaugucucaggu

SEQ ID NO: 1967743 - RNA, 16 nt, Human
cucguauagaagucuu

SEQ ID NO: 1967744 - RNA, 20 nt, Human
cucguauaugucucaggucc

SEQ ID NO: 1967745 - RNA, 23 nt, Human
cucguauagaagucuucaugaaa

SEQ ID NO: 1967746 - RNA, 16 nt, Human
cuccgucacuaccugg

SEQ ID NO: 1967747 - RNA, 17 nt, Human
cuccgucacuaccuggc

SEQ ID NO: 1967748 - RNA, 19 nt, Human
cuccgucacuaccuggcug

SEQ ID NO: 1967749 - RNA, 14 nt, Human
cuccgucaacucau

SEQ ID NO: 1967750 - RNA, 14 nt, Human
cuccgucacuaccu

SEQ ID NO: 1967751 - RNA, 22 nt, Human
cuccgcuuucuacccagcgagc

SEQ ID NO: 1967752 - RNA, 15 nt, Human
cuccgggucuuccua

SEQ ID NO: 1967753 - RNA, 21 nt, Human
cuccgcuuucuacccagcgag

SEQ ID NO: 1967754 - RNA, 20 nt, Human
cuccgcuuucuacccagcga

SEQ ID NO: 1967755 - RNA, 19 nt, Human
cucccucuuucccucccuu

SEQ ID NO: 1967756 - RNA, 15 nt, Human
cucccucuuucccuc

SEQ ID NO: 1967757 - RNA, 16 nt, Human
cucccucccucuuucc

SEQ ID NO: 1967758 - RNA, 18 nt, Human
cucccagcuccaccccgc

SEQ ID NO: 1967759 - RNA, 21 nt, Human
cuccagaauuucccaaagcag

SEQ ID NO: 1967760 - RNA, 17 nt, Human
cucagaaucucaaauaa

SEQ ID NO: 1967761 - RNA, 16 nt, Human
cucagaaucucaaaua

SEQ ID NO: 1967762 - RNA, 11 nt, Human
cuccagacaca

SEQ ID NO: 1967763 - RNA, 22 nt, Human
cuccagaauuucccaaagcagu

SEQ ID NO: 1967764 - RNA, 16 nt, Human
cuccagacacaugucc

SEQ ID NO: 1967765 - RNA, 23 nt, Human
cuccaggcuguaucccaugagcc

SEQ ID NO: 1967766 - RNA, 22 nt, Human
cuccaggcuguaucccaugagc

SEQ ID NO: 1967767 - RNA, 20 nt, Human
cuccaggugcacaagcucca

SEQ ID NO: 1967768 - RNA, 19 nt, Human
cuccaggugcacaagcucc

SEQ ID NO: 1967769 - RNA, 18 nt, Human
cuccaggugcacaagcuc

SEQ ID NO: 1967770 - RNA, 22 nt, Human
cuccaggugcacaagcuccaag

SEQ ID NO: 1967771 - RNA, 14 nt, Human
cucccaccucagcc

SEQ ID NO: 1967772 - RNA, 17 nt, Human
cuccauacacacgcugc

SEQ ID NO: 1967773 - RNA, 19 nt, Human
cuccauacacacgcugccu

SEQ ID NO: 1967774 - RNA, 20 nt, Human
cuccauacacacgcugccuu

SEQ ID NO: 1967775 - RNA, 16 nt, Human
cucccaccucagccuc

SEQ ID NO: 1967776 - RNA, 17 nt, Human
cucccaccucagccucc

SEQ ID NO: 1967777 - RNA, 13 nt, Human
cucccagcaucgc

SEQ ID NO: 1967778 - RNA, 19 nt, Human
cucccagcaucgcacucug

SEQ ID NO: 1967779 - RNA, 14 nt, Human
cucuugagccuggg

SEQ ID NO: 1967780 - RNA, 13 nt, Human
cucuugagccugg

SEQ ID NO: 1967781 - RNA, 16 nt, Human
cucuugagccugggag

SEQ ID NO: 1967782 - RNA, 15 nt, Human
cucuugagccuggga

SEQ ID NO: 1967783 - RNA, 22 nt, Human
cucuugauucauaaugacuuaa

SEQ ID NO: 1967784 - RNA, 23 nt, Human
cucuugaguuguuuuuguauauu

SEQ ID NO: 1967785 - RNA, 21 nt, Human
cucuugaguuguuuuuguaua

SEQ ID NO: 1967786 - RNA, 22 nt, Human
cucuugaguuguuuuuguauau

SEQ ID NO: 1967787 - RNA, 13 nt, Human
cucuugaguuguu

SEQ ID NO: 1967788 - RNA, 16 nt, Human
cucuugaguuguuuuu

SEQ ID NO: 1967789 - RNA, 18 nt, Human
cucuugaguuguuuuugu

SEQ ID NO: 1967790 - RNA, 20 nt, Human
cucuugaguuguuuuuguau

SEQ ID NO: 1967791 - RNA, 24 nt, Human
cucuugauucauaaugacuuaagc

SEQ ID NO: 1967792 - RNA, 22 nt, Human
cucuugccacugccucuuccuc

SEQ ID NO: 1967793 - RNA, 21 nt, Human
cucuugccucagcuuccccag

SEQ ID NO: 1967794 - RNA, 19 nt, Human
cucuugccucagcuucccc

SEQ ID NO: 1967795 - RNA, 22 nt, Human
cucuugccucagcuuccccagu

SEQ ID NO: 1967796 - RNA, 13 nt, Human
cucuuuuuuaagu

SEQ ID NO: 1967797 - RNA, 14 nt, Human
cucuuuuuuacaaa

SEQ ID NO: 1967798 - RNA, 13 nt, Human
cugaaagaggaau

SEQ ID NO: 1967799 - RNA, 17 nt, Human
cugaaagaggaaugaag

SEQ ID NO: 1967800 - RNA, 15 nt, Human
cucuuuuuuacaaag

SEQ ID NO: 1967801 - RNA, 19 nt, Human
cucugcacaagcugcaccc

SEQ ID NO: 1967802 - RNA, 18 nt, Human
cucugcacaagcugcacc

SEQ ID NO: 1967803 - RNA, 17 nt, Human
cucugcacaagcugcac

SEQ ID NO: 1967804 - RNA, 20 nt, Human
cugaccccucauagcccuca

SEQ ID NO: 1967805 - RNA, 21 nt, Human
cugaccccucauagcccucac

SEQ ID NO: 1967806 - RNA, 17 nt, Human
cugaccccucauagccc

SEQ ID NO: 1967807 - RNA, 17 nt, Human
cugacaccccacuuagc

SEQ ID NO: 1967808 - RNA, 18 nt, Human
cugacaccccacuuagcc

SEQ ID NO: 1967809 - RNA, 14 nt, Human
cugacaccccacuu

SEQ ID NO: 1967810 - RNA, 14 nt, Human
cugaaaauguaugu

SEQ ID NO: 1967811 - RNA, 17 nt, Human
cugaaagagucuuucuu

SEQ ID NO: 1967812 - RNA, 18 nt, Human
cugaaagaggccaaacag

SEQ ID NO: 1967813 - RNA, 13 nt, Human
cugacacacagcu

SEQ ID NO: 1967814 - RNA, 15 nt, Human
cugacacacagcucu

SEQ ID NO: 1967815 - RNA, 16 nt, Human
cugacacacagcucug

SEQ ID NO: 1967816 - RNA, 17 nt, Human
cugacacacagcucugu

SEQ ID NO: 1967817 - RNA, 18 nt, Human
cugacacacagcucuguc

SEQ ID NO: 1967818 - RNA, 19 nt, Human
cugacacacagcucugucc

SEQ ID NO: 1967819 - RNA, 20 nt, Human
cugacacacagcucuguccu

SEQ ID NO: 1967820 - RNA, 21 nt, Human
cugacacacagcucuguccug

SEQ ID NO: 1967821 - RNA, 22 nt, Human
cugacacacagcucuguccugg

SEQ ID NO: 1967822 - RNA, 23 nt, Human
cugacacacagcucuguccuggg

SEQ ID NO: 1967823 - RNA, 21 nt, Human
cugaguaaaaaagcugugugc

SEQ ID NO: 1967824 - RNA, 20 nt, Human
cugagguugggagaggugca

SEQ ID NO: 1967825 - RNA, 21 nt, Human
cugagguugggagaggugcac

SEQ ID NO: 1967826 - RNA, 19 nt, Human
cugacccugcuucaaauau

SEQ ID NO: 1967827 - RNA, 12 nt, Human
cugagcugggau

SEQ ID NO: 1967828 - RNA, 22 nt, Human
cugagcugggaugauuggaggg

SEQ ID NO: 1967829 - RNA, 17 nt, Human
cugagcuggccucucac

SEQ ID NO: 1967830 - RNA, 22 nt, Human
cugagcuggccucucacugccu

SEQ ID NO: 1967831 - RNA, 14 nt, Human
cugagcuggccucu

SEQ ID NO: 1967832 - RNA, 16 nt, Human
cugagcuggccucuca

SEQ ID NO: 1967833 - RNA, 14 nt, Human
cugagcuuggaagc

SEQ ID NO: 1967834 - RNA, 20 nt, Human
cugagcuuggaagcuucugg

SEQ ID NO: 1967835 - RNA, 21 nt, Human
cugagcuuggaagcuucuggu

SEQ ID NO: 1967836 - RNA, 12 nt, Human
cugagcuuggaa

SEQ ID NO: 1967837 - RNA, 22 nt, Human
cugagcuugcagagaugaggcc

SEQ ID NO: 1967838 - RNA, 18 nt, Human
cugaggaagagggacugu

SEQ ID NO: 1967839 - RNA, 23 nt, Human
cugaggaagagggacuguucuuu

SEQ ID NO: 1967840 - RNA, 21 nt, Human
cugaggugggagauguggaaa

SEQ ID NO: 1967841 - RNA, 22 nt, Human
cugaggugggaggaucucuuga

SEQ ID NO: 1967842 - RNA, 13 nt, Human
cugaggugggagg

SEQ ID NO: 1967843 - RNA, 14 nt, Human
cugaggggccucuu

SEQ ID NO: 1967844 - RNA, 19 nt, Human
cugaggggagacagagcaa

SEQ ID NO: 1967845 - RNA, 15 nt, Human
cugaggggcagccug

SEQ ID NO: 1967846 - RNA, 16 nt, Human
cugaggggcagccugc

SEQ ID NO: 1967847 - RNA, 17 nt, Human
cugaggggcagccugcc

SEQ ID NO: 1967848 - RNA, 18 nt, Human
cugaggggcagccugccu

SEQ ID NO: 1967849 - RNA, 19 nt, Human
cugaggggcagccugccuu

SEQ ID NO: 1967850 - RNA, 23 nt, Human
cugaggggcagccugccuugccc

SEQ ID NO: 1967851 - RNA, 23 nt, Human
cugaggaauccagacccggcugc

SEQ ID NO: 1967852 - RNA, 18 nt, Human
cugaggggagacagagca

SEQ ID NO: 1967853 - RNA, 18 nt, Human
cugaucucucgugauuga

SEQ ID NO: 1967854 - RNA, 17 nt, Human
cugaucucucgugauug

SEQ ID NO: 1967855 - RNA, 15 nt, Human
cggagacggaguccc

SEQ ID NO: 1967856 - RNA, 15 nt, Human
cgguguccccaccau

SEQ ID NO: 1967857 - RNA, 16 nt, Human
cgguguccccaccauc

SEQ ID NO: 1967858 - RNA, 19 nt, Human
cgguguccccaccaucugc

SEQ ID NO: 1967859 - RNA, 22 nt, Human
cgguguccccaccaucugcugu

SEQ ID NO: 1967860 - RNA, 14 nt, Human
cgguguccccacca

SEQ ID NO: 1967861 - RNA, 16 nt, Human
cggugggggggcagag

SEQ ID NO: 1967862 - RNA, 13 nt, Human
cguacacauuuua

SEQ ID NO: 1967863 - RNA, 16 nt, Human
cguacacauuuuauuu

SEQ ID NO: 1967864 - RNA, 20 nt, Human
cgguuuaucgcccuggcagg

SEQ ID NO: 1967865 - RNA, 14 nt, Human
cguaauucuuauuc

SEQ ID NO: 1967866 - RNA, 23 nt, Human
cguaauucuuauuccauauuaga

SEQ ID NO: 1967867 - RNA, 17 nt, Human
cgguuccuacacaggac

SEQ ID NO: 1967868 - RNA, 16 nt, Human
cgguuccuacacagga

SEQ ID NO: 1967869 - RNA, 19 nt, Human
cgguucaguguuucugggg

SEQ ID NO: 1967870 - RNA, 13 nt, Human
cgguucaguguuu

SEQ ID NO: 1967871 - RNA, 18 nt, Human
cgguucaaaccugugaag

SEQ ID NO: 1967872 - RNA, 18 nt, Human
cguacaaguaguucugua

SEQ ID NO: 1967873 - RNA, 19 nt, Human
cguacaaguaguucuguau

SEQ ID NO: 1967874 - RNA, 21 nt, Human
cguacaaguaguucuguauuu

SEQ ID NO: 1967875 - RNA, 22 nt, Human
cguacaaguaguucuguauuug

SEQ ID NO: 1967876 - RNA, 22 nt, Human
cuaaaguguauuuuuuuacuaa

SEQ ID NO: 1967877 - RNA, 17 nt, Human
cuaaaggcuaccuuugu

SEQ ID NO: 1967878 - RNA, 19 nt, Human
cuaaaggcuaccuuuguau

SEQ ID NO: 1967879 - RNA, 15 nt, Human
cuaaaguuguacuuu

SEQ ID NO: 1967880 - RNA, 19 nt, Human
cuaaaguuguacuuuaaaa

SEQ ID NO: 1967881 - RNA, 20 nt, Human
cuaaaguuguacuuuaaaaa

SEQ ID NO: 1967882 - RNA, 14 nt, Human
cuaaagcugccagc

SEQ ID NO: 1967883 - RNA, 21 nt, Human
cuaaagaagguuucagaaaga

SEQ ID NO: 1967884 - RNA, 15 nt, Human
cuaaaggcuaccuuu

SEQ ID NO: 1967885 - RNA, 16 nt, Human
cuaaaggcuaccuuug

SEQ ID NO: 1967886 - RNA, 15 nt, Human
cuaaagcugccagcc

SEQ ID NO: 1967887 - RNA, 17 nt, Human
cguguuugucucuucug

SEQ ID NO: 1967888 - RNA, 18 nt, Human
cguguuugucucuucugg

SEQ ID NO: 1967889 - RNA, 14 nt, Human
cguuaaaaacagau

SEQ ID NO: 1967890 - RNA, 21 nt, Human
cguuaaaaacagauuuggaaa

SEQ ID NO: 1967891 - RNA, 13 nt, Human
cguuaaaauacca

SEQ ID NO: 1967892 - RNA, 14 nt, Human
cguuaccaggcagg

SEQ ID NO: 1967893 - RNA, 22 nt, Human
cguguccccuauccuacuuccc

SEQ ID NO: 1967894 - RNA, 16 nt, Human
cguguuugucucuucu

SEQ ID NO: 1967895 - RNA, 19 nt, Human
cgaguagcugagauuauag

SEQ ID NO: 1967896 - RNA, 20 nt, Human
cgaguaauugcauuugcuuu

SEQ ID NO: 1967897 - RNA, 18 nt, Human
cgauacaccgggccugga

SEQ ID NO: 1967898 - RNA, 20 nt, Human
cgauacaccgggccuggaga

SEQ ID NO: 1967899 - RNA, 21 nt, Human
cgauacaccgggccuggagaa

SEQ ID NO: 1967900 - RNA, 15 nt, Human
cgcaucagcugcuca

SEQ ID NO: 1967901 - RNA, 16 nt, Human
cgcaucagcugcucag

SEQ ID NO: 1967902 - RNA, 16 nt, Human
cgcauaggccugcuuu

SEQ ID NO: 1967903 - RNA, 13 nt, Human
cgcaucucacagc

SEQ ID NO: 1967904 - RNA, 16 nt, Human
cgccuuaaggauguuc

SEQ ID NO: 1967905 - RNA, 18 nt, Human
cgcugccccuggcagccc

SEQ ID NO: 1967906 - RNA, 14 nt, Human
cgccuucacagcag

SEQ ID NO: 1967907 - RNA, 20 nt, Human
cgccuuccaccucugggagc

SEQ ID NO: 1967908 - RNA, 12 nt, Human
cgcugcucugcc

SEQ ID NO: 1967909 - RNA, 15 nt, Human
cgcugcucugcccca

SEQ ID NO: 1967910 - RNA, 19 nt, Human
cgcuggaccuugaacuggg

SEQ ID NO: 1967911 - RNA, 23 nt, Human
cgcuggaccuugaacuggguacu

SEQ ID NO: 1967912 - RNA, 17 nt, Human
cgcugccccuggcagcc

SEQ ID NO: 1967913 - RNA, 16 nt, Human
cgcugccccuggcagc

SEQ ID NO: 1967914 - RNA, 13 nt, Human
cgcugccccuggc

SEQ ID NO: 1967915 - RNA, 13 nt, Human
cgccuucacagca

SEQ ID NO: 1967916 - RNA, 20 nt, Human
cgcuggggccaguugguccc

SEQ ID NO: 1967917 - RNA, 17 nt, Human
cgcuggggccaguuggu

SEQ ID NO: 1967918 - RNA, 16 nt, Human
cuacucaaagcaaaag

SEQ ID NO: 1967919 - RNA, 20 nt, Human
cuacuagggaaaugccuuug

SEQ ID NO: 1967920 - RNA, 23 nt, Human
cuaccugaggggccucuuauggg

SEQ ID NO: 1967921 - RNA, 19 nt, Human
cuaccugaggggccucuua

SEQ ID NO: 1967922 - RNA, 16 nt, Human
cuaccugaggggccuc

SEQ ID NO: 1967923 - RNA, 22 nt, Human
cuaccuuuaaucagguccugcu

SEQ ID NO: 1967924 - RNA, 20 nt, Human
cuaccuuuggcuuaauucca

SEQ ID NO: 1967925 - RNA, 21 nt, Human
cuaccuuuggcuuaauuccaa

SEQ ID NO: 1967926 - RNA, 17 nt, Human
cuacuaccuguaaugac

SEQ ID NO: 1967927 - RNA, 18 nt, Human
cuaccuuccaguuccuca

SEQ ID NO: 1967928 - RNA, 14 nt, Human
cuagggaagauaau

SEQ ID NO: 1967929 - RNA, 13 nt, Human
cuaggcuccuuca

SEQ ID NO: 1967930 - RNA, 12 nt, Human
cuaggcuccuuc

SEQ ID NO: 1967931 - RNA, 17 nt, Human
cuaguuugauuaaauuc

SEQ ID NO: 1967932 - RNA, 19 nt, Human
cuaguuugauuaaauucuu

SEQ ID NO: 1967933 - RNA, 13 nt, Human
cuaggguccuggg

SEQ ID NO: 1967934 - RNA, 14 nt, Human
cuaggguccugggg

SEQ ID NO: 1967935 - RNA, 15 nt, Human
cuaggguccugggga

SEQ ID NO: 1967936 - RNA, 20 nt, Human
cuaguuugauuaaauucuug

SEQ ID NO: 1967937 - RNA, 16 nt, Human
cuauaaaauguaucaa

SEQ ID NO: 1967938 - RNA, 12 nt, Human
cuauaaacacug

SEQ ID NO: 1967939 - RNA, 14 nt, Human
cuauaaacacuguu

SEQ ID NO: 1967940 - RNA, 21 nt, Human
cuauaaacacuguuuguucca

SEQ ID NO: 1967941 - RNA, 16 nt, Human
cuagcauacguacaca

SEQ ID NO: 1967942 - RNA, 18 nt, Human
cuagcauacguacacauu

SEQ ID NO: 1967943 - RNA, 19 nt, Human
cuagcauacguacacauuu

SEQ ID NO: 1967944 - RNA, 20 nt, Human
cuagcauacguacacauuuu

SEQ ID NO: 1967945 - RNA, 17 nt, Human
cuagccagaggagagag

SEQ ID NO: 1967946 - RNA, 19 nt, Human
cuagccagaggagagagga

SEQ ID NO: 1967947 - RNA, 13 nt, Human
cuaggccuggcca

SEQ ID NO: 1967948 - RNA, 14 nt, Human
cuaggccuggccag

SEQ ID NO: 1967949 - RNA, 15 nt, Human
cuaggccuggccaga

SEQ ID NO: 1967950 - RNA, 18 nt, Human
cuaggccuggccagaugc

SEQ ID NO: 1967951 - RNA, 19 nt, Human
cuaggccuggccagaugca

SEQ ID NO: 1967952 - RNA, 13 nt, Human
cuaggccugggga

SEQ ID NO: 1967953 - RNA, 12 nt, Human
cuaggccugggg

SEQ ID NO: 1967954 - RNA, 21 nt, Human
cucacacaugagcaucaggcc

SEQ ID NO: 1967955 - RNA, 14 nt, Human
cucacacaugagca

SEQ ID NO: 1967956 - RNA, 18 nt, Human
cucacaaaugaaaccuga

SEQ ID NO: 1967957 - RNA, 12 nt, Human
cucaaauaacua

SEQ ID NO: 1967958 - RNA, 21 nt, Human
cucaaauaauauuuuuuuccu

SEQ ID NO: 1967959 - RNA, 14 nt, Human
cucacaaaggaugc

SEQ ID NO: 1967960 - RNA, 22 nt, Human
cucaaaggccagguugcuaaga

SEQ ID NO: 1967961 - RNA, 19 nt, Human
cucaaagccccauuaacug

SEQ ID NO: 1967962 - RNA, 22 nt, Human
cucaaagccccauuaacugcuu

SEQ ID NO: 1967963 - RNA, 12 nt, Human
cucaaagcaaaa

SEQ ID NO: 1967964 - RNA, 15 nt, Human
cucaaagcaaaagug

SEQ ID NO: 1967965 - RNA, 14 nt, Human
cucaaagaggcagu

SEQ ID NO: 1967966 - RNA, 14 nt, Human
cucaaaacaaaggc

SEQ ID NO: 1967967 - RNA, 19 nt, Human
cucaaaaagcugccuggga

SEQ ID NO: 1967968 - RNA, 18 nt, Human
cucaaaaaaagaaaaaga

SEQ ID NO: 1967969 - RNA, 13 nt, Human
cucaaaacaaagg

SEQ ID NO: 1967970 - RNA, 16 nt, Human
cuauguugcccaggca

SEQ ID NO: 1967971 - RNA, 17 nt, Human
cuauguugcccaggcag

SEQ ID NO: 1967972 - RNA, 20 nt, Human
cuaucucccccagccccauc

SEQ ID NO: 1967973 - RNA, 19 nt, Human
cuauguaucaaugaguaac

SEQ ID NO: 1967974 - RNA, 19 nt, Human
cuaucucuauuauuggaaa

SEQ ID NO: 1967975 - RNA, 22 nt, Human
cuauguguagggcgggaggaug

SEQ ID NO: 1967976 - RNA, 15 nt, Human
cuauguugcccaggc

SEQ ID NO: 1967977 - RNA, 14 nt, Human
cuaugugugugcuu

SEQ ID NO: 1967978 - RNA, 13 nt, Human
cuauguuaauauu

SEQ ID NO: 1967979 - RNA, 23 nt, Human
cuaugucauuugcuggagcucug

SEQ ID NO: 1967980 - RNA, 13 nt, Human
cuaugucauuuca

SEQ ID NO: 1967981 - RNA, 14 nt, Human
cuaugucauuucau

SEQ ID NO: 1967982 - RNA, 16 nt, Human
cuaugucauuucaugu

SEQ ID NO: 1967983 - RNA, 17 nt, Human
cucaccucucccuugga

SEQ ID NO: 1967984 - RNA, 16 nt, Human
cucaccucucccuugg

SEQ ID NO: 1967985 - RNA, 15 nt, Human
cucaccucucccuug

SEQ ID NO: 1967986 - RNA, 14 nt, Human
cucaccucucccuu

SEQ ID NO: 1967987 - RNA, 13 nt, Human
cucaccucucccu

SEQ ID NO: 1967988 - RNA, 16 nt, Human
cucaccucccccaucu

SEQ ID NO: 1967989 - RNA, 16 nt, Human
cucaccugccccucaa

SEQ ID NO: 1967990 - RNA, 14 nt, Human
cucaccugccccuc

SEQ ID NO: 1967991 - RNA, 18 nt, Human
cucaccugccccucaacu

SEQ ID NO: 1967992 - RNA, 13 nt, Human
cucaccugccccu

SEQ ID NO: 1967993 - RNA, 17 nt, Human
cucagaaggucuguuuu

SEQ ID NO: 1967994 - RNA, 18 nt, Human
cucagaaacuccaugaug

SEQ ID NO: 1967995 - RNA, 13 nt, Human
cucacuuuuucau

SEQ ID NO: 1967996 - RNA, 22 nt, Human
cucagaaaagacgcaccagccc

SEQ ID NO: 1967997 - RNA, 18 nt, Human
cucacuuguuuuauuuaa

SEQ ID NO: 1967998 - RNA, 16 nt, Human
cucaccuugguuccug

SEQ ID NO: 1967999 - RNA, 14 nt, Human
cucacccuggggcu

SEQ ID NO: 1968000 - RNA, 22 nt, Human
ccugguuuccugcccugggagg

SEQ ID NO: 1968001 - RNA, 17 nt, Human
ccugucucuacuaaaaa

SEQ ID NO: 1968002 - RNA, 13 nt, Human
ccuggugguucac

SEQ ID NO: 1968003 - RNA, 22 nt, Human
ccuggugguucacucuuggagc

SEQ ID NO: 1968004 - RNA, 12 nt, Human
ccuggugguuca

SEQ ID NO: 1968005 - RNA, 15 nt, Human
ccuggugguuucugu

SEQ ID NO: 1968006 - RNA, 13 nt, Human
ccugguguggaag

SEQ ID NO: 1968007 - RNA, 18 nt, Human
ccugguuuccugcccugg

SEQ ID NO: 1968008 - RNA, 19 nt, Human
ccugguuuccugcccuggg

SEQ ID NO: 1968009 - RNA, 20 nt, Human
ccugguuuccugcccuggga

SEQ ID NO: 1968010 - RNA, 21 nt, Human
ccugguuuccugcccugggag

SEQ ID NO: 1968011 - RNA, 16 nt, Human
ccugguuuccugcccu

SEQ ID NO: 1968012 - RNA, 23 nt, Human
ccugguucaagcgauucucuugc

SEQ ID NO: 1968013 - RNA, 20 nt, Human
ccugguggcagugggagcug

SEQ ID NO: 1968014 - RNA, 18 nt, Human
ccugguggcagugggagc

SEQ ID NO: 1968015 - RNA, 19 nt, Human
ccugguggcagugggagcu

SEQ ID NO: 1968016 - RNA, 15 nt, Human
ccuggggagaaagua

SEQ ID NO: 1968017 - RNA, 22 nt, Human
ccugggcuuuuguuuugcuuuu

SEQ ID NO: 1968018 - RNA, 18 nt, Human
ccuggggaaccugacccc

SEQ ID NO: 1968019 - RNA, 13 nt, Human
ccuggccugucuc

SEQ ID NO: 1968020 - RNA, 17 nt, Human
ccuggccugucucggaa

SEQ ID NO: 1968021 - RNA, 13 nt, Human
ccuggccugucug

SEQ ID NO: 1968022 - RNA, 17 nt, Human
ccuggccugucugugaa

SEQ ID NO: 1968023 - RNA, 20 nt, Human
ccuggccuugggauccaggc

SEQ ID NO: 1968024 - RNA, 22 nt, Human
ccuggccuugggauccaggccc

SEQ ID NO: 1968025 - RNA, 18 nt, Human
ccuggccccucagggucc

SEQ ID NO: 1968026 - RNA, 21 nt, Human
ccuggccccucagggucccug

SEQ ID NO: 1968027 - RNA, 20 nt, Human
ccuggccccucagggucccu

SEQ ID NO: 1968028 - RNA, 22 nt, Human
ccuggccucaagugauucuccu

SEQ ID NO: 1968029 - RNA, 15 nt, Human
ccuggauggggcugc

SEQ ID NO: 1968030 - RNA, 18 nt, Human
ccuggauggggcugcacc

SEQ ID NO: 1968031 - RNA, 17 nt, Human
ccuggauggggcugcac

SEQ ID NO: 1968032 - RNA, 15 nt, Human
ccugccucucugcag

SEQ ID NO: 1968033 - RNA, 14 nt, Human
ccugccucucugca

SEQ ID NO: 1968034 - RNA, 18 nt, Human
ccugcugagucccaggcu

SEQ ID NO: 1968035 - RNA, 22 nt, Human
ccugccucuccgccccugagcc

SEQ ID NO: 1968036 - RNA, 23 nt, Human
ccugccucuccgccccugagccc

SEQ ID NO: 1968037 - RNA, 19 nt, Human
ccugcugagucccaggcug

SEQ ID NO: 1968038 - RNA, 20 nt, Human
ccugcugagucccaggcuga

SEQ ID NO: 1968039 - RNA, 13 nt, Human
ccugccucucugc

SEQ ID NO: 1968040 - RNA, 13 nt, Human
ccugccucuccgc

SEQ ID NO: 1968041 - RNA, 16 nt, Human
ccugccucuccgcccc

SEQ ID NO: 1968042 - RNA, 17 nt, Human
ccugccucuccgccccu

SEQ ID NO: 1968043 - RNA, 18 nt, Human
ccugccucuccgccccug

SEQ ID NO: 1968044 - RNA, 21 nt, Human
ccugccucuccgccccugagc

SEQ ID NO: 1968045 - RNA, 17 nt, Human
ccugccucagccucccg

SEQ ID NO: 1968046 - RNA, 16 nt, Human
ccugccucagccuccc

SEQ ID NO: 1968047 - RNA, 15 nt, Human
ccugccucagccucc

SEQ ID NO: 1968048 - RNA, 21 nt, Human
ccugcccaggccccugccacc

SEQ ID NO: 1968049 - RNA, 22 nt, Human
ccugcccaggccccugccaccc

SEQ ID NO: 1968050 - RNA, 19 nt, Human
ccugcccaccuggccucug

SEQ ID NO: 1968051 - RNA, 18 nt, Human
ccugcccaccuggccucu

SEQ ID NO: 1968052 - RNA, 18 nt, Human
ccugcccaggccccugcc

SEQ ID NO: 1968053 - RNA, 19 nt, Human
ccugccaugccaggaaccu

SEQ ID NO: 1968054 - RNA, 23 nt, Human
ccugcccaaugagacucuagggu

SEQ ID NO: 1968055 - RNA, 19 nt, Human
ccugcccaggccccugcca

SEQ ID NO: 1968056 - RNA, 18 nt, Human
ccugccaucauguuuaca

SEQ ID NO: 1968057 - RNA, 20 nt, Human
ccugccaucauguuuacaga

SEQ ID NO: 1968058 - RNA, 17 nt, Human
ccugcccaccuggccuc

SEQ ID NO: 1968059 - RNA, 15 nt, Human
ccugcccaccuggcc

SEQ ID NO: 1968060 - RNA, 15 nt, Human
ccugccaugccagga

SEQ ID NO: 1968061 - RNA, 20 nt, Human
ccucggaucagcugagccuu

SEQ ID NO: 1968062 - RNA, 16 nt, Human
ccucggauccccuucc

SEQ ID NO: 1968063 - RNA, 15 nt, Human
ccucggaucagcuga

SEQ ID NO: 1968064 - RNA, 17 nt, Human
ccucggaucagcugagc

SEQ ID NO: 1968065 - RNA, 17 nt, Human
ccucggauccccuuccu

SEQ ID NO: 1968066 - RNA, 19 nt, Human
ccucuuucccucccuuccu

SEQ ID NO: 1968067 - RNA, 15 nt, Human
ccucuuucccuucca

SEQ ID NO: 1968068 - RNA, 16 nt, Human
ccucuuucccuuccag

SEQ ID NO: 1968069 - RNA, 18 nt, Human
ccucuuucccuuccaguu

SEQ ID NO: 1968070 - RNA, 15 nt, Human
ccucuuugagugaag

SEQ ID NO: 1968071 - RNA, 23 nt, Human
ccucuugccacugccucuuccuc

SEQ ID NO: 1968072 - RNA, 22 nt, Human
ccucuugccacugccucuuccu

SEQ ID NO: 1968073 - RNA, 14 nt, Human
ccucuugccacugc

SEQ ID NO: 1968074 - RNA, 20 nt, Human
ccugaguuccuagccaccgc

SEQ ID NO: 1968075 - RNA, 21 nt, Human
ccugaguuccuagccaccgcc

SEQ ID NO: 1968076 - RNA, 13 nt, Human
ccugaguuccuga

SEQ ID NO: 1968077 - RNA, 14 nt, Human
ccugaguuccugag

SEQ ID NO: 1968078 - RNA, 22 nt, Human
ccugaguuccugaggugaugaa

SEQ ID NO: 1968079 - RNA, 13 nt, Human
ccugaguugaaga

SEQ ID NO: 1968080 - RNA, 15 nt, Human
ccugaguugaagagg

SEQ ID NO: 1968081 - RNA, 18 nt, Human
ccugaguugaagagggga

SEQ ID NO: 1968082 - RNA, 22 nt, Human
ccugauauugaaguaaaaaauu

SEQ ID NO: 1968083 - RNA, 13 nt, Human
ccugcaggcagcc

SEQ ID NO: 1968084 - RNA, 12 nt, Human
ccugcaggcagc

SEQ ID NO: 1968085 - RNA, 14 nt, Human
ccugcaggcagcca

SEQ ID NO: 1968086 - RNA, 18 nt, Human
ccugagaucucugcagga

SEQ ID NO: 1968087 - RNA, 22 nt, Human
ccugagaugguaugcacaauuc

SEQ ID NO: 1968088 - RNA, 17 nt, Human
ccugagaucucugcagg

SEQ ID NO: 1968089 - RNA, 18 nt, Human
ccugaccccucauagccc

SEQ ID NO: 1968090 - RNA, 19 nt, Human
ccugaguuccuagccaccg

SEQ ID NO: 1968091 - RNA, 23 nt, Human
ccugaggugaugaagacagcccg

SEQ ID NO: 1968092 - RNA, 12 nt, Human
ccuagccaccca

SEQ ID NO: 1968093 - RNA, 17 nt, Human
ccuaauuaauuucagua

SEQ ID NO: 1968094 - RNA, 16 nt, Human
ccuagccacccaccac

SEQ ID NO: 1968095 - RNA, 21 nt, Human
ccuagcauacguacacauuuu

SEQ ID NO: 1968096 - RNA, 14 nt, Human
ccuaauuaauuuca

SEQ ID NO: 1968097 - RNA, 15 nt, Human
ccuaauggugaugca

SEQ ID NO: 1968098 - RNA, 12 nt, Human
ccuaauguguuu

SEQ ID NO: 1968099 - RNA, 21 nt, Human
ccuaaugcgcaggcuggcccu

SEQ ID NO: 1968100 - RNA, 20 nt, Human
ccuaaugcgcaggcuggccc

SEQ ID NO: 1968101 - RNA, 17 nt, Human
ccgugaagauacuuugu

SEQ ID NO: 1968102 - RNA, 18 nt, Human
ccgugaagauacuuugua

SEQ ID NO: 1968103 - RNA, 20 nt, Human
ccgugaagauacuuuguauu

SEQ ID NO: 1968104 - RNA, 13 nt, Human
ccuaauaaagcug

SEQ ID NO: 1968105 - RNA, 12 nt, Human
ccgugagcccuu

SEQ ID NO: 1968106 - RNA, 12 nt, Human
ccuaauaaagcu

SEQ ID NO: 1968107 - RNA, 22 nt, Human
ccuagccuuagaagucacacag

SEQ ID NO: 1968108 - RNA, 23 nt, Human
ccuagccugugccucugggacug

SEQ ID NO: 1968109 - RNA, 19 nt, Human
ccuagccuuagaagucaca

SEQ ID NO: 1968110 - RNA, 12 nt, Human
ccguaaaaacug

SEQ ID NO: 1968111 - RNA, 16 nt, Human
ccguaaaaacugaagu

SEQ ID NO: 1968112 - RNA, 20 nt, Human
ccguaaaaacugaaguucug

SEQ ID NO: 1968113 - RNA, 23 nt, Human
ccguacgacucuuuuccaaacac

SEQ ID NO: 1968114 - RNA, 14 nt, Human
ccgucccccucugg

SEQ ID NO: 1968115 - RNA, 11 nt, Human
ccguccccucc

SEQ ID NO: 1968116 - RNA, 14 nt, Human
ccguccccucccag

SEQ ID NO: 1968117 - RNA, 15 nt, Human
ccguccccucccagg

SEQ ID NO: 1968118 - RNA, 16 nt, Human
ccguccccucccaggg

SEQ ID NO: 1968119 - RNA, 17 nt, Human
ccguccccucccaggga

SEQ ID NO: 1968120 - RNA, 14 nt, Human
ccggcccaguuuug

SEQ ID NO: 1968121 - RNA, 18 nt, Human
ccggccaccugcggugcu

SEQ ID NO: 1968122 - RNA, 17 nt, Human
ccggccaccugcggugc

SEQ ID NO: 1968123 - RNA, 20 nt, Human
ccggcaauaaaagcccagga

SEQ ID NO: 1968124 - RNA, 23 nt, Human
ccggcaauaaaagcccaggagcc

SEQ ID NO: 1968125 - RNA, 19 nt, Human
ccggcaauaaaagcccagg

SEQ ID NO: 1968126 - RNA, 23 nt, Human
ccgcagcccugcagagggcacag

SEQ ID NO: 1968127 - RNA, 18 nt, Human
ccgcagcccugcagaggg

SEQ ID NO: 1968128 - RNA, 14 nt, Human
ccgcagcccugcag

SEQ ID NO: 1968129 - RNA, 15 nt, Human
cccugugggccccca

SEQ ID NO: 1968130 - RNA, 15 nt, Human
cccugugauggggcc

SEQ ID NO: 1968131 - RNA, 23 nt, Human
cccugugaguacuacaguccucc

SEQ ID NO: 1968132 - RNA, 21 nt, Human
cccugugaguacuacaguccu

SEQ ID NO: 1968133 - RNA, 13 nt, Human
cccuccuucccac

SEQ ID NO: 1968134 - RNA, 19 nt, Human
cccuccuucccacucuucu

SEQ ID NO: 1968135 - RNA, 14 nt, Human
cccuccuuucacca

SEQ ID NO: 1968136 - RNA, 23 nt, Human
cccuuuuuuggcugcugaaggcu

SEQ ID NO: 1968137 - RNA, 22 nt, Human
cccuuuuuuggcugcugaaggc

SEQ ID NO: 1968138 - RNA, 21 nt, Human
cccuuuuuuggcugcugaagg

SEQ ID NO: 1968139 - RNA, 19 nt, Human
cccuucucuccagccccug

SEQ ID NO: 1968140 - RNA, 14 nt, Human
cccuucucuccagc

SEQ ID NO: 1968141 - RNA, 18 nt, Human
ccgaagccgccuguggac

SEQ ID NO: 1968142 - RNA, 17 nt, Human
ccgaacuguuguauaaa

SEQ ID NO: 1968143 - RNA, 18 nt, Human
ccgaacugggcauauuuc

SEQ ID NO: 1968144 - RNA, 15 nt, Human
ccgaaaugcugucuu

SEQ ID NO: 1968145 - RNA, 23 nt, Human
ccgaaaggucaccucacucagca

SEQ ID NO: 1968146 - RNA, 22 nt, Human
ccgaaaggucaccucacucagc

SEQ ID NO: 1968147 - RNA, 15 nt, Human
ccgacagccuggcac

SEQ ID NO: 1968148 - RNA, 22 nt, Human
ccgacagccuggcacagggcag

SEQ ID NO: 1968149 - RNA, 15 nt, Human
ccgacagcuuuccag

SEQ ID NO: 1968150 - RNA, 17 nt, Human
ccgacagcuuuccagua

SEQ ID NO: 1968151 - RNA, 23 nt, Human
ccgcagagaagugacgguuccua

SEQ ID NO: 1968152 - RNA, 13 nt, Human
ccgacagccuggc

SEQ ID NO: 1968153 - RNA, 14 nt, Human
ccgacagccuggca

SEQ ID NO: 1968154 - RNA, 12 nt, Human
ccgacagccugg

SEQ ID NO: 1968155 - RNA, 24 nt, Human
ccucaaauccaggacccugccagg

SEQ ID NO: 1968156 - RNA, 19 nt, Human
ccucaaaugaugugccugc

SEQ ID NO: 1968157 - RNA, 16 nt, Human
ccucaaauccaggacc

SEQ ID NO: 1968158 - RNA, 17 nt, Human
ccucaaauccaggaccc

SEQ ID NO: 1968159 - RNA, 18 nt, Human
ccucaaauccaggacccu

SEQ ID NO: 1968160 - RNA, 19 nt, Human
ccucaaauccaggacccug

SEQ ID NO: 1968161 - RNA, 23 nt, Human
ccucaaauccaggacccugccag

SEQ ID NO: 1968162 - RNA, 14 nt, Human
ccucaaauccagga

SEQ ID NO: 1968163 - RNA, 16 nt, Human
ccucaacaccucugca

SEQ ID NO: 1968164 - RNA, 23 nt, Human
ccucaaaugaugugccugcuuca

SEQ ID NO: 1968165 - RNA, 23 nt, Human
ccucaacucuccuccagagucag

SEQ ID NO: 1968166 - RNA, 21 nt, Human
ccucaacucuccuccagaguc

SEQ ID NO: 1968167 - RNA, 19 nt, Human
ccucaacucuccuccagag

SEQ ID NO: 1968168 - RNA, 15 nt, Human
ccucaaccuccuggg

SEQ ID NO: 1968169 - RNA, 18 nt, Human
ccucaggcaggugggaug

SEQ ID NO: 1968170 - RNA, 12 nt, Human
ccucaggcaggu

SEQ ID NO: 1968171 - RNA, 10 nt, Human
ccucaggccu

SEQ ID NO: 1968172 - RNA, 21 nt, Human
ccucauuccaccuucccaugc

SEQ ID NO: 1968173 - RNA, 15 nt, Human
ccucauucccucguc

SEQ ID NO: 1968174 - RNA, 21 nt, Human
ccucauucccucgucuuuccc

SEQ ID NO: 1968175 - RNA, 22 nt, Human
ccucauucccucgucuuuccca

SEQ ID NO: 1968176 - RNA, 23 nt, Human
ccucaagugauucuccugccuca

SEQ ID NO: 1968177 - RNA, 20 nt, Human
ccucaagugauucuccugcc

SEQ ID NO: 1968178 - RNA, 19 nt, Human
ccuccaagaccuucuccuu

SEQ ID NO: 1968179 - RNA, 17 nt, Human
ccuccaagaccuucucc

SEQ ID NO: 1968180 - RNA, 16 nt, Human
ccuccaagaccuucuc

SEQ ID NO: 1968181 - RNA, 12 nt, Human
ccucccaucacc

SEQ ID NO: 1968182 - RNA, 20 nt, Human
ccuccaagaccuucuccuuc

SEQ ID NO: 1968183 - RNA, 15 nt, Human
ccucccaggcucuca

SEQ ID NO: 1968184 - RNA, 18 nt, Human
ccucccagggagcaaggg

SEQ ID NO: 1968185 - RNA, 21 nt, Human
ccucccagggagcaagggcag

SEQ ID NO: 1968186 - RNA, 17 nt, Human
ccucccaucacccgcua

SEQ ID NO: 1968187 - RNA, 23 nt, Human
ccuccuuugugaggaagccgcug

SEQ ID NO: 1968188 - RNA, 19 nt, Human
ccuccuaucagaaguuucu

SEQ ID NO: 1968189 - RNA, 18 nt, Human
ccuccuuuucacaguucu

SEQ ID NO: 1968190 - RNA, 19 nt, Human
ccucgcaggccucccugcc

SEQ ID NO: 1968191 - RNA, 16 nt, Human
ccucgaacuccuggca

SEQ ID NO: 1968192 - RNA, 14 nt, Human
ccucgcuucuuuca

SEQ ID NO: 1968193 - RNA, 19 nt, Human
ccucggacuuagcugggag

SEQ ID NO: 1968194 - RNA, 20 nt, Human
ccucggacuuagcugggaga

SEQ ID NO: 1968195 - RNA, 20 nt, Human
ccucgcccagucccagcagc

SEQ ID NO: 1968196 - RNA, 23 nt, Human
ccucgcccagucccagcagccag

SEQ ID NO: 1968197 - RNA, 12 nt, Human
ccucgcccaguc

SEQ ID NO: 1968198 - RNA, 13 nt, Human
ccucgcccagucc

SEQ ID NO: 1968199 - RNA, 15 nt, Human
ccucgcccaguccca

SEQ ID NO: 1968200 - RNA, 16 nt, Human
ccucgcccagucccag

SEQ ID NO: 1968201 - RNA, 17 nt, Human
ccucgcccagucccagc

SEQ ID NO: 1968202 - RNA, 18 nt, Human
ccucgcccagucccagca

SEQ ID NO: 1968203 - RNA, 19 nt, Human
ccucgcccagucccagcag

SEQ ID NO: 1968204 - RNA, 21 nt, Human
ccucgcaggccucccugccag

SEQ ID NO: 1968205 - RNA, 22 nt, Human
ccucgcaggccucccugccagu

SEQ ID NO: 1968206 - RNA, 23 nt, Human
ccucgcaggccucccugccagua

SEQ ID NO: 1968207 - RNA, 16 nt, Human
ccucccuucucuucac

SEQ ID NO: 1968208 - RNA, 20 nt, Human
ccucccuuggggccuaugca

SEQ ID NO: 1968209 - RNA, 15 nt, Human
ccuccuagccaccca

SEQ ID NO: 1968210 - RNA, 20 nt, Human
ccuccuagggcauuguaucu

SEQ ID NO: 1968211 - RNA, 20 nt, Human
ccuccgcgugaucaaagcca

SEQ ID NO: 1968212 - RNA, 14 nt, Human
ccuccgcuucccug

SEQ ID NO: 1968213 - RNA, 14 nt, Human
ccuccgccucuugg

SEQ ID NO: 1968214 - RNA, 20 nt, Human
ccuccgaccacuuccagggg

SEQ ID NO: 1968215 - RNA, 22 nt, Human
ccuccgaccacuuccaggggaa

SEQ ID NO: 1968216 - RNA, 13 nt, Human
ccuccgccucuug

SEQ ID NO: 1968217 - RNA, 22 nt, Human
cccauccucuguacagagccca

SEQ ID NO: 1968218 - RNA, 21 nt, Human
cccauccucuguacagagccc

SEQ ID NO: 1968219 - RNA, 16 nt, Human
cccaggaaaggcucca

SEQ ID NO: 1968220 - RNA, 15 nt, Human
cccaggaaaggcucc

SEQ ID NO: 1968221 - RNA, 16 nt, Human
cccacuggacucaccu

SEQ ID NO: 1968222 - RNA, 13 nt, Human
cccacuggccggc

SEQ ID NO: 1968223 - RNA, 16 nt, Human
cccacugguuagaugu

SEQ ID NO: 1968224 - RNA, 12 nt, Human
cccaucagccca

SEQ ID NO: 1968225 - RNA, 18 nt, Human
cccaucagcccaaucccu

SEQ ID NO: 1968226 - RNA, 18 nt, Human
cccaggaaaggcuccagg

SEQ ID NO: 1968227 - RNA, 17 nt, Human
cccaggaaaggcuccag

SEQ ID NO: 1968228 - RNA, 15 nt, Human
cccaggcugagccuc

SEQ ID NO: 1968229 - RNA, 16 nt, Human
cccaggcugagccuca

SEQ ID NO: 1968230 - RNA, 17 nt, Human
cccaggcugagccucag

SEQ ID NO: 1968231 - RNA, 22 nt, Human
cccaggcuuagucacugagaca

SEQ ID NO: 1968232 - RNA, 13 nt, Human
cccaggcuggagu

SEQ ID NO: 1968233 - RNA, 18 nt, Human
cccaggcugagccucagu

SEQ ID NO: 1968234 - RNA, 14 nt, Human
ccccgcacugggcu

SEQ ID NO: 1968235 - RNA, 15 nt, Human
cccccuuucuuccuc

SEQ ID NO: 1968236 - RNA, 16 nt, Human
cccccuuucuuccuca

SEQ ID NO: 1968237 - RNA, 15 nt, Human
ccccagauugcaaca

SEQ ID NO: 1968238 - RNA, 17 nt, Human
ccccagaggcuggguga

SEQ ID NO: 1968239 - RNA, 20 nt, Human
ccccagauugcaacaggcug

SEQ ID NO: 1968240 - RNA, 24 nt, Human
ccccauggccggcuuucaggagcu

SEQ ID NO: 1968241 - RNA, 19 nt, Human
ccccauggccggcuuucag

SEQ ID NO: 1968242 - RNA, 15 nt, Human
cccauuugcuccuuu

SEQ ID NO: 1968243 - RNA, 14 nt, Human
cccauuuggagggc

SEQ ID NO: 1968244 - RNA, 19 nt, Human
cccauuuggagggccuggg

SEQ ID NO: 1968245 - RNA, 13 nt, Human
cccauuugggcag

SEQ ID NO: 1968246 - RNA, 20 nt, Human
cccauuugggcagagaggcu

SEQ ID NO: 1968247 - RNA, 13 nt, Human
ccccagaggcugg

SEQ ID NO: 1968248 - RNA, 19 nt, Human
cccauucugccugcccagg

SEQ ID NO: 1968249 - RNA, 14 nt, Human
cccauucugccugc

SEQ ID NO: 1968250 - RNA, 15 nt, Human
cccauucugccugcc

SEQ ID NO: 1968251 - RNA, 16 nt, Human
cccuccucucugcccu

SEQ ID NO: 1968252 - RNA, 15 nt, Human
cccuccucucugccc

SEQ ID NO: 1968253 - RNA, 17 nt, Human
cccuccucugagaggcg

SEQ ID NO: 1968254 - RNA, 16 nt, Human
cccuccucccucccag

SEQ ID NO: 1968255 - RNA, 15 nt, Human
cccucacucucagga

SEQ ID NO: 1968256 - RNA, 13 nt, Human
cccucacucucag

SEQ ID NO: 1968257 - RNA, 14 nt, Human
cccucacucucagg

SEQ ID NO: 1968258 - RNA, 21 nt, Human
cccgggaagggggcugggaca

SEQ ID NO: 1968259 - RNA, 18 nt, Human
cccgggaagggggcuggg

SEQ ID NO: 1968260 - RNA, 16 nt, Human
cccucaacaccucugc

SEQ ID NO: 1968261 - RNA, 22 nt, Human
cccgggaagggggcugggacau

SEQ ID NO: 1968262 - RNA, 16 nt, Human
cccucaacucuccucc

SEQ ID NO: 1968263 - RNA, 20 nt, Human
cccucaacucuccuccagag

SEQ ID NO: 1968264 - RNA, 16 nt, Human
cccucacccuggggcu

SEQ ID NO: 1968265 - RNA, 15 nt, Human
cccucacccuggggc

SEQ ID NO: 1968266 - RNA, 16 nt, Human
ccccuucugacccaug

SEQ ID NO: 1968267 - RNA, 14 nt, Human
ccccuucugaccca

SEQ ID NO: 1968268 - RNA, 13 nt, Human
ccccuucugaccc

SEQ ID NO: 1968269 - RNA, 16 nt, Human
cccgaauagcugggac

SEQ ID NO: 1968270 - RNA, 17 nt, Human
cccgaauagcugggacu

SEQ ID NO: 1968271 - RNA, 18 nt, Human
cccgaauagcugggacua

SEQ ID NO: 1968272 - RNA, 22 nt, Human
cccgaauagcugggacuacagg

SEQ ID NO: 1968273 - RNA, 15 nt, Human
cccgggaagggggcu

SEQ ID NO: 1968274 - RNA, 20 nt, Human
cccggcuaauuuuuguauuu

SEQ ID NO: 1968275 - RNA, 15 nt, Human
cccggccccugcugg

SEQ ID NO: 1968276 - RNA, 16 nt, Human
cccggccccugcuggu

SEQ ID NO: 1968277 - RNA, 16 nt, Human
cccggcccugccugcu

SEQ ID NO: 1968278 - RNA, 23 nt, Human
ccccugcccagaucagccagaag

SEQ ID NO: 1968279 - RNA, 10 nt, Human
ccccugccag

SEQ ID NO: 1968280 - RNA, 14 nt, Human
ccccugccacccug

SEQ ID NO: 1968281 - RNA, 16 nt, Human
ccccugccacccuggg

SEQ ID NO: 1968282 - RNA, 13 nt, Human
ccccugcacucca

SEQ ID NO: 1968283 - RNA, 21 nt, Human
ccccugcaaagcccagcuuga

SEQ ID NO: 1968284 - RNA, 17 nt, Human
ccccugaauuuaaauag

SEQ ID NO: 1968285 - RNA, 18 nt, Human
ccccugcaaagcccagcu

SEQ ID NO: 1968286 - RNA, 20 nt, Human
ccccugcaaagcccagcuug

SEQ ID NO: 1968287 - RNA, 13 nt, Human
ccccugaauuuaa

SEQ ID NO: 1968288 - RNA, 15 nt, Human
ccccugacaacacuc

SEQ ID NO: 1968289 - RNA, 16 nt, Human
ccccucuggcuccagc

SEQ ID NO: 1968290 - RNA, 18 nt, Human
ccccucuggcuccagcug

SEQ ID NO: 1968291 - RNA, 15 nt, Human
ccccucugcccugcg

SEQ ID NO: 1968292 - RNA, 20 nt, Human
ccccucugcccugcggguca

SEQ ID NO: 1968293 - RNA, 23 nt, Human
ccccucugcccugcgggucacag

SEQ ID NO: 1968294 - RNA, 14 nt, Human
ccccucugcccugc

SEQ ID NO: 1968295 - RNA, 23 nt, Human
ccagggggccagucccugaggca

SEQ ID NO: 1968296 - RNA, 13 nt, Human
ccagggggcuucc

SEQ ID NO: 1968297 - RNA, 22 nt, Human
ccagggggcuuccugaggggag

SEQ ID NO: 1968298 - RNA, 23 nt, Human
ccagggggcuuccugaggggaga

SEQ ID NO: 1968299 - RNA, 22 nt, Human
ccaggggucuugcaaaauuccu

SEQ ID NO: 1968300 - RNA, 21 nt, Human
ccagucauuauguuaauauuu

SEQ ID NO: 1968301 - RNA, 22 nt, Human
ccagucauuauguuaauauuuc

SEQ ID NO: 1968302 - RNA, 14 nt, Human
ccagucaggcucuc

SEQ ID NO: 1968303 - RNA, 15 nt, Human
ccagucccugaggca

SEQ ID NO: 1968304 - RNA, 14 nt, Human
ccaguccccuuccc

SEQ ID NO: 1968305 - RNA, 18 nt, Human
ccagucccccugccccag

SEQ ID NO: 1968306 - RNA, 18 nt, Human
ccaguccccuucccguga

SEQ ID NO: 1968307 - RNA, 16 nt, Human
ccaggauauauuuuau

SEQ ID NO: 1968308 - RNA, 23 nt, Human
ccaggauauauuuuauuuuuaga

SEQ ID NO: 1968309 - RNA, 23 nt, Human
ccaggcaggucuugaacuccugg

SEQ ID NO: 1968310 - RNA, 12 nt, Human
ccaggcaggucu

SEQ ID NO: 1968311 - RNA, 14 nt, Human
ccaggcaggucuug

SEQ ID NO: 1968312 - RNA, 21 nt, Human
ccaggcugcucuugaacuccu

SEQ ID NO: 1968313 - RNA, 14 nt, Human
ccaggcugcucuca

SEQ ID NO: 1968314 - RNA, 24 nt, Human
ccaggggaaccugccaugccagga

SEQ ID NO: 1968315 - RNA, 17 nt, Human
ccaggggaccuccuggg

SEQ ID NO: 1968316 - RNA, 21 nt, Human
ccaggggaaaaucagccugcu

SEQ ID NO: 1968317 - RNA, 12 nt, Human
ccaggggaaccu

SEQ ID NO: 1968318 - RNA, 13 nt, Human
ccaggggaaccug

SEQ ID NO: 1968319 - RNA, 15 nt, Human
ccaggggaaccugcc

SEQ ID NO: 1968320 - RNA, 16 nt, Human
ccaggggaaccugcca

SEQ ID NO: 1968321 - RNA, 17 nt, Human
ccaggggaaccugccau

SEQ ID NO: 1968322 - RNA, 12 nt, Human
ccaggcuggcgu

SEQ ID NO: 1968323 - RNA, 23 nt, Human
ccaggcugcucucaaaccccuga

SEQ ID NO: 1968324 - RNA, 15 nt, Human
ccagcuccaccccgc

SEQ ID NO: 1968325 - RNA, 14 nt, Human
ccagcuccccccac

SEQ ID NO: 1968326 - RNA, 19 nt, Human
ccagcuccccccaccuccc

SEQ ID NO: 1968327 - RNA, 12 nt, Human
ccagcuccaccc

SEQ ID NO: 1968328 - RNA, 13 nt, Human
ccagcuccacccc

SEQ ID NO: 1968329 - RNA, 24 nt, Human
ccagccccuucugacccaugcugc

SEQ ID NO: 1968330 - RNA, 23 nt, Human
ccagccccuucugacccaugcug

SEQ ID NO: 1968331 - RNA, 12 nt, Human
ccagcagaaaug

SEQ ID NO: 1968332 - RNA, 13 nt, Human
ccacuccugcucu

SEQ ID NO: 1968333 - RNA, 16 nt, Human
ccacuccugcucugcu

SEQ ID NO: 1968334 - RNA, 17 nt, Human
ccacuccugcucugcuc

SEQ ID NO: 1968335 - RNA, 17 nt, Human
ccagcacuucaggaggc

SEQ ID NO: 1968336 - RNA, 17 nt, Human
ccagccccauccucugu

SEQ ID NO: 1968337 - RNA, 15 nt, Human
ccagccccauccucu

SEQ ID NO: 1968338 - RNA, 18 nt, Human
ccagccccauccucugua

SEQ ID NO: 1968339 - RNA, 13 nt, Human
ccagcagagcacc

SEQ ID NO: 1968340 - RNA, 12 nt, Human
ccagcagagcac

SEQ ID NO: 1968341 - RNA, 14 nt, Human
ccagcagagcaccu

SEQ ID NO: 1968342 - RNA, 17 nt, Human
ccagccccagugcccac

SEQ ID NO: 1968343 - RNA, 16 nt, Human
ccagcuuuucauugcu

SEQ ID NO: 1968344 - RNA, 14 nt, Human
ccaggaaaaagaac

SEQ ID NO: 1968345 - RNA, 21 nt, Human
ccaucccauaugccugggcag

SEQ ID NO: 1968346 - RNA, 20 nt, Human
ccaucccauaugccugggca

SEQ ID NO: 1968347 - RNA, 19 nt, Human
ccaucccauaugccugggc

SEQ ID NO: 1968348 - RNA, 20 nt, Human
ccaucccaaacccuucagug

SEQ ID NO: 1968349 - RNA, 20 nt, Human
ccaguuggucccccuuccau

SEQ ID NO: 1968350 - RNA, 18 nt, Human
ccaguuggucccccuucc

SEQ ID NO: 1968351 - RNA, 19 nt, Human
ccauaauaaaaggcuuuga

SEQ ID NO: 1968352 - RNA, 18 nt, Human
ccauccagguucagcuug

SEQ ID NO: 1968353 - RNA, 19 nt, Human
ccauccagguucagcuugu

SEQ ID NO: 1968354 - RNA, 14 nt, Human
ccauaaucuggacu

SEQ ID NO: 1968355 - RNA, 21 nt, Human
ccauaaucuggacuccucugu

SEQ ID NO: 1968356 - RNA, 16 nt, Human
ccauaauguucugcua

SEQ ID NO: 1968357 - RNA, 13 nt, Human
ccaguuggucccc

SEQ ID NO: 1968358 - RNA, 23 nt, Human
ccaguuggguggaugccuggugg

SEQ ID NO: 1968359 - RNA, 20 nt, Human
ccaugaggaacaaggcaagg

SEQ ID NO: 1968360 - RNA, 23 nt, Human
ccaugaggaacaaggcaaggcug

SEQ ID NO: 1968361 - RNA, 17 nt, Human
ccaugaggaaggaacag

SEQ ID NO: 1968362 - RNA, 18 nt, Human
ccaugaguccccuguuug

SEQ ID NO: 1968363 - RNA, 12 nt, Human
ccaugucgccuc

SEQ ID NO: 1968364 - RNA, 15 nt, Human
ccaugucgccucugc

SEQ ID NO: 1968365 - RNA, 16 nt, Human
ccaugucgccucugca

SEQ ID NO: 1968366 - RNA, 17 nt, Human
ccaugucgccucugcau

SEQ ID NO: 1968367 - RNA, 19 nt, Human
ccaugucgccucugcauuc

SEQ ID NO: 1968368 - RNA, 12 nt, Human
cccacucccugc

SEQ ID NO: 1968369 - RNA, 15 nt, Human
cccacccuccccuuc

SEQ ID NO: 1968370 - RNA, 13 nt, Human
cccacucccugca

SEQ ID NO: 1968371 - RNA, 13 nt, Human
cccaccccauccu

SEQ ID NO: 1968372 - RNA, 23 nt, Human
cccacugcuuuuggucuguguga

SEQ ID NO: 1968373 - RNA, 12 nt, Human
cccacuccugcu

SEQ ID NO: 1968374 - RNA, 14 nt, Human
cccacuccugcucu

SEQ ID NO: 1968375 - RNA, 18 nt, Human
cccacuccugcucugcuc

SEQ ID NO: 1968376 - RNA, 21 nt, Human
cccacucgugauaagucaaca

SEQ ID NO: 1968377 - RNA, 11 nt, Human
cccacucucag

SEQ ID NO: 1968378 - RNA, 12 nt, Human
cccacucucaga

SEQ ID NO: 1968379 - RNA, 13 nt, Human
cccacucucagag

SEQ ID NO: 1968380 - RNA, 14 nt, Human
cccacucucagagg

SEQ ID NO: 1968381 - RNA, 15 nt, Human
cccacucucagaggc

SEQ ID NO: 1968382 - RNA, 17 nt, Human
cccacucucagaggccc

SEQ ID NO: 1968383 - RNA, 20 nt, Human
cccaacucaccccagcccca

SEQ ID NO: 1968384 - RNA, 17 nt, Human
cccaacucaccccagcc

SEQ ID NO: 1968385 - RNA, 20 nt, Human
cccaacuaauuuuuguauuu

SEQ ID NO: 1968386 - RNA, 13 nt, Human
cccaagcucugcu

SEQ ID NO: 1968387 - RNA, 14 nt, Human
cccaagcucugcuc

SEQ ID NO: 1968388 - RNA, 12 nt, Human
cccaagcucugc

SEQ ID NO: 1968389 - RNA, 15 nt, Human
cccaagcucugcucc

SEQ ID NO: 1968390 - RNA, 13 nt, Human
cccacccagccug

SEQ ID NO: 1968391 - RNA, 16 nt, Human
cccaacucaccccagc

SEQ ID NO: 1968392 - RNA, 15 nt, Human
cccaacucaccccag

SEQ ID NO: 1968393 - RNA, 21 nt, Human
ccauuucauuugugccagaau

SEQ ID NO: 1968394 - RNA, 22 nt, Human
ccauuucauuugugccagaaug

SEQ ID NO: 1968395 - RNA, 11 nt, Human
ccauuggaaau

SEQ ID NO: 1968396 - RNA, 14 nt, Human
ccauuggaaauuuc

SEQ ID NO: 1968397 - RNA, 15 nt, Human
ccauuggaaauuuca

SEQ ID NO: 1968398 - RNA, 21 nt, Human
ccauuucaguaaaccugucug

SEQ ID NO: 1968399 - RNA, 22 nt, Human
ccauuucaguaaaccugucuga

SEQ ID NO: 1968400 - RNA, 15 nt, Human
ccauuuaucuugaag

SEQ ID NO: 1968401 - RNA, 19 nt, Human
ccauucuguccuaccuuua

SEQ ID NO: 1968402 - RNA, 14 nt, Human
caccaacgucugug

SEQ ID NO: 1968403 - RNA, 13 nt, Human
caccaacccucag

SEQ ID NO: 1968404 - RNA, 16 nt, Human
caccaacgucugugcc

SEQ ID NO: 1968405 - RNA, 18 nt, Human
caccaaaauaagaaaaga

SEQ ID NO: 1968406 - RNA, 19 nt, Human
caccaaaauaagaaaagau

SEQ ID NO: 1968407 - RNA, 19 nt, Human
cacauuuuauuuuauuaug

SEQ ID NO: 1968408 - RNA, 20 nt, Human
cacauuuuauuuuauuaugc

SEQ ID NO: 1968409 - RNA, 15 nt, Human
cacaucuguuuugua

SEQ ID NO: 1968410 - RNA, 12 nt, Human
caccaaaauaag

SEQ ID NO: 1968411 - RNA, 17 nt, Human
caccaaaauaagaaaag

SEQ ID NO: 1968412 - RNA, 21 nt, Human
cacauuuuauuuuauuaugca

SEQ ID NO: 1968413 - RNA, 17 nt, Human
cacauuuuauuuuauua

SEQ ID NO: 1968414 - RNA, 13 nt, Human
caccagggaaggg

SEQ ID NO: 1968415 - RNA, 18 nt, Human
caccagggaaggggacaa

SEQ ID NO: 1968416 - RNA, 21 nt, Human
caccagggaaggggacaagga

SEQ ID NO: 1968417 - RNA, 17 nt, Human
cacccaccucagccucc

SEQ ID NO: 1968418 - RNA, 13 nt, Human
caccagccccagu

SEQ ID NO: 1968419 - RNA, 14 nt, Human
caccagcccagaag

SEQ ID NO: 1968420 - RNA, 15 nt, Human
caccagcccagaagu

SEQ ID NO: 1968421 - RNA, 16 nt, Human
caccagccccaaucca

SEQ ID NO: 1968422 - RNA, 16 nt, Human
caccagccccagugcc

SEQ ID NO: 1968423 - RNA, 18 nt, Human
cacccaccucagccuccc

SEQ ID NO: 1968424 - RNA, 16 nt, Human
cacccaggagccccga

SEQ ID NO: 1968425 - RNA, 11 nt, Human
cacccagccug

SEQ ID NO: 1968426 - RNA, 12 nt, Human
cacccagccugg

SEQ ID NO: 1968427 - RNA, 22 nt, Human
cacagggacugaaaaccucucc

SEQ ID NO: 1968428 - RNA, 19 nt, Human
cacaggcugggcugggcac

SEQ ID NO: 1968429 - RNA, 22 nt, Human
cacaggcugggcugggcacugc

SEQ ID NO: 1968430 - RNA, 13 nt, Human
cacaggcugggcu

SEQ ID NO: 1968431 - RNA, 16 nt, Human
cacaggcugggcuggg

SEQ ID NO: 1968432 - RNA, 17 nt, Human
cacaggcugggcugggc

SEQ ID NO: 1968433 - RNA, 18 nt, Human
cacaggcugggcugggca

SEQ ID NO: 1968434 - RNA, 14 nt, Human
cacaggcugagugc

SEQ ID NO: 1968435 - RNA, 17 nt, Human
cacaggcugagugcagg

SEQ ID NO: 1968436 - RNA, 18 nt, Human
cacaggcugagugcaggc

SEQ ID NO: 1968437 - RNA, 20 nt, Human
cacaggcugagugcaggccc

SEQ ID NO: 1968438 - RNA, 21 nt, Human
cacaggcugagugcaggccca

SEQ ID NO: 1968439 - RNA, 22 nt, Human
cacaggcugagugcaggcccac

SEQ ID NO: 1968440 - RNA, 12 nt, Human
cacacauuuuuu

SEQ ID NO: 1968441 - RNA, 16 nt, Human
cacacauuuuuuaaau

SEQ ID NO: 1968442 - RNA, 19 nt, Human
cacacauuuuuuaaaugca

SEQ ID NO: 1968443 - RNA, 20 nt, Human
cacacauuuuuuaaaugcac

SEQ ID NO: 1968444 - RNA, 10 nt, Human
cacacauuuu

SEQ ID NO: 1968445 - RNA, 11 nt, Human
cacacauuuuu

SEQ ID NO: 1968446 - RNA, 14 nt, Human
cacacauuucacug

SEQ ID NO: 1968447 - RNA, 16 nt, Human
cacacauuucacuguc

SEQ ID NO: 1968448 - RNA, 19 nt, Human
cacacauuucacugucugu

SEQ ID NO: 1968449 - RNA, 22 nt, Human
cacacauuucacugucugucug

SEQ ID NO: 1968450 - RNA, 13 nt, Human
cacagaacccuug

SEQ ID NO: 1968451 - RNA, 13 nt, Human
cacacauuugccu

SEQ ID NO: 1968452 - RNA, 21 nt, Human
cacaccaaucuuacuuuguaa

SEQ ID NO: 1968453 - RNA, 17 nt, Human
cacagcucuucuccagg

SEQ ID NO: 1968454 - RNA, 22 nt, Human
cacagcuccuuuuccagagcau

SEQ ID NO: 1968455 - RNA, 14 nt, Human
cacagcucuucucc

SEQ ID NO: 1968456 - RNA, 15 nt, Human
cacagcucuucucca

SEQ ID NO: 1968457 - RNA, 15 nt, Human
cacagcucuguccug

SEQ ID NO: 1968458 - RNA, 16 nt, Human
cacagcucuguccugg

SEQ ID NO: 1968459 - RNA, 18 nt, Human
cacagcucuguccuggga

SEQ ID NO: 1968460 - RNA, 19 nt, Human
cacagcucuguccugggag

SEQ ID NO: 1968461 - RNA, 18 nt, Human
cacagacccugcccugug

SEQ ID NO: 1968462 - RNA, 12 nt, Human
cacagcuccuuu

SEQ ID NO: 1968463 - RNA, 13 nt, Human
cacagcuccuuuu

SEQ ID NO: 1968464 - RNA, 21 nt, Human
cacagcuccuuuuccagagca

SEQ ID NO: 1968465 - RNA, 11 nt, Human
cacagcucugu

SEQ ID NO: 1968466 - RNA, 14 nt, Human
cacagcucuguccu

SEQ ID NO: 1968467 - RNA, 17 nt, Human
cacagacccugcccugu

SEQ ID NO: 1968468 - RNA, 16 nt, Human
cacagacccugcccug

SEQ ID NO: 1968469 - RNA, 14 nt, Human
cacagacccugccc

SEQ ID NO: 1968470 - RNA, 20 nt, Human
caaggccaaaggaagcacau

SEQ ID NO: 1968471 - RNA, 19 nt, Human
caaggccaaaggaagcaca

SEQ ID NO: 1968472 - RNA, 21 nt, Human
caaggccaaaggaagcacaug

SEQ ID NO: 1968473 - RNA, 12 nt, Human
caaggccaccuc

SEQ ID NO: 1968474 - RNA, 13 nt, Human
caaggccaccucu

SEQ ID NO: 1968475 - RNA, 14 nt, Human
caaggccaccucuu

SEQ ID NO: 1968476 - RNA, 19 nt, Human
caaggccaccucuuccugg

SEQ ID NO: 1968477 - RNA, 20 nt, Human
caaggccaccucuuccuggc

SEQ ID NO: 1968478 - RNA, 17 nt, Human
caaggcccccugccugc

SEQ ID NO: 1968479 - RNA, 20 nt, Human
caaggcccccugccugcccu

SEQ ID NO: 1968480 - RNA, 21 nt, Human
caaggccaccucuuccuggcc

SEQ ID NO: 1968481 - RNA, 22 nt, Human
caaggccaccucuuccuggccg

SEQ ID NO: 1968482 - RNA, 18 nt, Human
caaggcaaggcugucaau

SEQ ID NO: 1968483 - RNA, 16 nt, Human
caaggcaaggcuguca

SEQ ID NO: 1968484 - RNA, 17 nt, Human
caaggcaaggcugucaa

SEQ ID NO: 1968485 - RNA, 16 nt, Human
caagauugucauuagu

SEQ ID NO: 1968486 - RNA, 21 nt, Human
caagucagucauucagauaug

SEQ ID NO: 1968487 - RNA, 15 nt, Human
caaggcucugagcaa

SEQ ID NO: 1968488 - RNA, 15 nt, Human
caaggcgcuaacuug

SEQ ID NO: 1968489 - RNA, 17 nt, Human
caaguuuuccauauuuu

SEQ ID NO: 1968490 - RNA, 16 nt, Human
caaguuuucccugaag

SEQ ID NO: 1968491 - RNA, 18 nt, Human
caaguuuucccugaaguu

SEQ ID NO: 1968492 - RNA, 14 nt, Human
caauaaaagcccag

SEQ ID NO: 1968493 - RNA, 15 nt, Human
caauaaaagcccagg

SEQ ID NO: 1968494 - RNA, 16 nt, Human
caauaaaagcccagga

SEQ ID NO: 1968495 - RNA, 17 nt, Human
caauaaaagcccaggag

SEQ ID NO: 1968496 - RNA, 18 nt, Human
caauaaaagcccaggagc

SEQ ID NO: 1968497 - RNA, 19 nt, Human
caauaaaagcccaggagcc

SEQ ID NO: 1968498 - RNA, 22 nt, Human
caauaaaagcccaggagcccau

SEQ ID NO: 1968499 - RNA, 20 nt, Human
caauaaaaucuugaaaaugc

SEQ ID NO: 1968500 - RNA, 11 nt, Human
caaguuuugug

SEQ ID NO: 1968501 - RNA, 21 nt, Human
cacaagcuccaagcucccagg

SEQ ID NO: 1968502 - RNA, 20 nt, Human
cacaagcuccaagcucccag

SEQ ID NO: 1968503 - RNA, 15 nt, Human
caaugggagcucaug

SEQ ID NO: 1968504 - RNA, 19 nt, Human
cacaagcuccaagcuccca

SEQ ID NO: 1968505 - RNA, 18 nt, Human
cacaagcuccaagcuccc

SEQ ID NO: 1968506 - RNA, 20 nt, Human
cacaagagcccaggccuccu

SEQ ID NO: 1968507 - RNA, 19 nt, Human
cacaagagcccaggccucc

SEQ ID NO: 1968508 - RNA, 18 nt, Human
cacaagagcccaggccuc

SEQ ID NO: 1968509 - RNA, 17 nt, Human
caaucccagcuaccuca

SEQ ID NO: 1968510 - RNA, 12 nt, Human
caaucccagcua

SEQ ID NO: 1968511 - RNA, 23 nt, Human
caaucccaccaacccucagagcc

SEQ ID NO: 1968512 - RNA, 16 nt, Human
caaucccugaucccug

SEQ ID NO: 1968513 - RNA, 13 nt, Human
caaugcuggcugu

SEQ ID NO: 1968514 - RNA, 20 nt, Human
caaugcuggcuguuggcugg

SEQ ID NO: 1968515 - RNA, 21 nt, Human
caaugcuggcuguuggcuggg

SEQ ID NO: 1968516 - RNA, 16 nt, Human
caauggcagccuuggc

SEQ ID NO: 1968517 - RNA, 17 nt, Human
caaucaguagcuuaaga

SEQ ID NO: 1968518 - RNA, 21 nt, Human
caaucaguagcuuaagaaaaa

SEQ ID NO: 1968519 - RNA, 22 nt, Human
caaucaguagcuuaagaaaaaa

SEQ ID NO: 1968520 - RNA, 16 nt, Human
caauccaucagugcca

SEQ ID NO: 1968521 - RNA, 16 nt, Human
caaucccaccaacccu

SEQ ID NO: 1968522 - RNA, 17 nt, Human
caaucccaccaacccuc

SEQ ID NO: 1968523 - RNA, 22 nt, Human
caaucccaccaacccucagagc

SEQ ID NO: 1968524 - RNA, 15 nt, Human
cagaaauaauaaaaa

SEQ ID NO: 1968525 - RNA, 11 nt, Human
cagaaauacag

SEQ ID NO: 1968526 - RNA, 19 nt, Human
cagaaauacagauaaauga

SEQ ID NO: 1968527 - RNA, 16 nt, Human
cagaaauguacagcaa

SEQ ID NO: 1968528 - RNA, 23 nt, Human
cagaaaugucaugagauugcugu

SEQ ID NO: 1968529 - RNA, 16 nt, Human
cagaaaugucccuuuc

SEQ ID NO: 1968530 - RNA, 17 nt, Human
cagaaaugucccuuucu

SEQ ID NO: 1968531 - RNA, 22 nt, Human
cagaaaugucccuuucuucucc

SEQ ID NO: 1968532 - RNA, 12 nt, Human
cagaacagcugu

SEQ ID NO: 1968533 - RNA, 13 nt, Human
cagaacagcuguu

SEQ ID NO: 1968534 - RNA, 20 nt, Human
cagaacagcuguugacucua

SEQ ID NO: 1968535 - RNA, 14 nt, Human
cagaaaucugagga

SEQ ID NO: 1968536 - RNA, 15 nt, Human
cagaaaucugaggaa

SEQ ID NO: 1968537 - RNA, 18 nt, Human
cagaacagugauuaccag

SEQ ID NO: 1968538 - RNA, 15 nt, Human
cagaaguuucucagc

SEQ ID NO: 1968539 - RNA, 19 nt, Human
cagaaguuucucagcuccc

SEQ ID NO: 1968540 - RNA, 16 nt, Human
cagaaguuucugccgc

SEQ ID NO: 1968541 - RNA, 14 nt, Human
cagaaguuucugcc

SEQ ID NO: 1968542 - RNA, 12 nt, Human
cagaacagugau

SEQ ID NO: 1968543 - RNA, 17 nt, Human
cagaacagugauuacca

SEQ ID NO: 1968544 - RNA, 11 nt, Human
cagaacaguga

SEQ ID NO: 1968545 - RNA, 14 nt, Human
cagaacagcuucau

SEQ ID NO: 1968546 - RNA, 13 nt, Human
cacuuucuagcca

SEQ ID NO: 1968547 - RNA, 17 nt, Human
cacuuucuagccagagg

SEQ ID NO: 1968548 - RNA, 16 nt, Human
cacuuucuagccagag

SEQ ID NO: 1968549 - RNA, 18 nt, Human
cacuuguguuaugaagca

SEQ ID NO: 1968550 - RNA, 19 nt, Human
cacuuguugauuaauggaa

SEQ ID NO: 1968551 - RNA, 12 nt, Human
cacuuuaauggg

SEQ ID NO: 1968552 - RNA, 20 nt, Human
cacuuaaguuaguuccacug

SEQ ID NO: 1968553 - RNA, 22 nt, Human
cacuuaaguuaguuccacugag

SEQ ID NO: 1968554 - RNA, 15 nt, Human
cacuuaaaaaugguu

SEQ ID NO: 1968555 - RNA, 16 nt, Human
cacuuaaaacacguuu

SEQ ID NO: 1968556 - RNA, 22 nt, Human
cacuuaaaacacguuuuaagga

SEQ ID NO: 1968557 - RNA, 18 nt, Human
cacuguugcccaggcugg

SEQ ID NO: 1968558 - RNA, 19 nt, Human
cacuguugcccaggcuggc

SEQ ID NO: 1968559 - RNA, 23 nt, Human
cacuguugcccaggcuggcgugc

SEQ ID NO: 1968560 - RNA, 20 nt, Human
cacugggcuuggggaccaga

SEQ ID NO: 1968561 - RNA, 13 nt, Human
cacugggcuucua

SEQ ID NO: 1968562 - RNA, 19 nt, Human
cacugggagaaaugaaaaa

SEQ ID NO: 1968563 - RNA, 19 nt, Human
cacugcagccucaaccucc

SEQ ID NO: 1968564 - RNA, 14 nt, Human
cacugcagccucaa

SEQ ID NO: 1968565 - RNA, 20 nt, Human
cacugcagccucaaccuccu

SEQ ID NO: 1968566 - RNA, 21 nt, Human
cacugcagccucaaccuccug

SEQ ID NO: 1968567 - RNA, 22 nt, Human
cacugcagccucaaccuccugg

SEQ ID NO: 1968568 - RNA, 23 nt, Human
cacugcagccucaaccuccuggg

SEQ ID NO: 1968569 - RNA, 17 nt, Human
cacugccaugccagcuu

SEQ ID NO: 1968570 - RNA, 19 nt, Human
cacugcagccuccgcuucc

SEQ ID NO: 1968571 - RNA, 21 nt, Human
cacugcagccuccgcuucccu

SEQ ID NO: 1968572 - RNA, 22 nt, Human
cacugcagccuccgcuucccug

SEQ ID NO: 1968573 - RNA, 23 nt, Human
cacugcagccuccgcuucccugg

SEQ ID NO: 1968574 - RNA, 15 nt, Human
cacggcucacugcag

SEQ ID NO: 1968575 - RNA, 12 nt, Human
cacggccuccuu

SEQ ID NO: 1968576 - RNA, 14 nt, Human
cacggccuccuuuc

SEQ ID NO: 1968577 - RNA, 14 nt, Human
cacggcucacugca

SEQ ID NO: 1968578 - RNA, 17 nt, Human
cacggccaggccagagg

SEQ ID NO: 1968579 - RNA, 12 nt, Human
cacggccaggcc

SEQ ID NO: 1968580 - RNA, 13 nt, Human
cacggccaggcca

SEQ ID NO: 1968581 - RNA, 20 nt, Human
cacucugucgcccagucugg

SEQ ID NO: 1968582 - RNA, 23 nt, Human
cacuccagccugagcgacaguga

SEQ ID NO: 1968583 - RNA, 16 nt, Human
cacuaccccuugauuu

SEQ ID NO: 1968584 - RNA, 14 nt, Human
cacuccagccuggg

SEQ ID NO: 1968585 - RNA, 13 nt, Human
cacuccagccugg

SEQ ID NO: 1968586 - RNA, 13 nt, Human
cacuccagccuga

SEQ ID NO: 1968587 - RNA, 12 nt, Human
cacuccagccug

SEQ ID NO: 1968588 - RNA, 21 nt, Human
cacuacauucuguuaaucauu

SEQ ID NO: 1968589 - RNA, 17 nt, Human
cacuaccaaaggacacu

SEQ ID NO: 1968590 - RNA, 22 nt, Human
cacuaccaaaggacacuuaucc

SEQ ID NO: 1968591 - RNA, 15 nt, Human
cacuaccccuugauu

SEQ ID NO: 1968592 - RNA, 16 nt, Human
cacuacauucuguuaa

SEQ ID NO: 1968593 - RNA, 17 nt, Human
cacuacauucuguuaau

SEQ ID NO: 1968594 - RNA, 21 nt, Human
cacuacauuauaaaugucucu

SEQ ID NO: 1968595 - RNA, 20 nt, Human
cacucuuauugcccacgcug

SEQ ID NO: 1968596 - RNA, 21 nt, Human
cacucuuauugcccacgcugg

SEQ ID NO: 1968597 - RNA, 22 nt, Human
cacucuuauugcccacgcugga

SEQ ID NO: 1968598 - RNA, 18 nt, Human
caccugcccaaccugcuc

SEQ ID NO: 1968599 - RNA, 19 nt, Human
caccugcccaaccugcucu

SEQ ID NO: 1968600 - RNA, 13 nt, Human
caccugcccaacc

SEQ ID NO: 1968601 - RNA, 18 nt, Human
caccuuggcugcagggag

SEQ ID NO: 1968602 - RNA, 23 nt, Human
caccuuuauucuggcagaggagg

SEQ ID NO: 1968603 - RNA, 15 nt, Human
caccuuggcugcagg

SEQ ID NO: 1968604 - RNA, 16 nt, Human
caccuuggcugcaggg

SEQ ID NO: 1968605 - RNA, 14 nt, Human
caccuuucccaucu

SEQ ID NO: 1968606 - RNA, 12 nt, Human
caccucagccuc

SEQ ID NO: 1968607 - RNA, 13 nt, Human
caccucacucagc

SEQ ID NO: 1968608 - RNA, 14 nt, Human
caccucacucagca

SEQ ID NO: 1968609 - RNA, 15 nt, Human
caccucacucagcac

SEQ ID NO: 1968610 - RNA, 16 nt, Human
caccucacucagcacc

SEQ ID NO: 1968611 - RNA, 17 nt, Human
caccucacucagcacca

SEQ ID NO: 1968612 - RNA, 19 nt, Human
caccucacucagcaccacu

SEQ ID NO: 1968613 - RNA, 20 nt, Human
caccucacucagcaccacuc

SEQ ID NO: 1968614 - RNA, 21 nt, Human
caccucacucagcaccacuca

SEQ ID NO: 1968615 - RNA, 12 nt, Human
caccuacugagu

SEQ ID NO: 1968616 - RNA, 15 nt, Human
caacaccaaaaaaua

SEQ ID NO: 1968617 - RNA, 17 nt, Human
caacaccaaaaaauauc

SEQ ID NO: 1968618 - RNA, 23 nt, Human
caacaccaaaaaauaucuaguaa

SEQ ID NO: 1968619 - RNA, 19 nt, Human
caacaagaauaaaggcagc

SEQ ID NO: 1968620 - RNA, 18 nt, Human
caacaagaauaaaggcag

SEQ ID NO: 1968621 - RNA, 21 nt, Human
caacacacagauuugagcuca

SEQ ID NO: 1968622 - RNA, 22 nt, Human
caacacacagauuugagcucag

SEQ ID NO: 1968623 - RNA, 13 nt, Human
caaaucugucugc

SEQ ID NO: 1968624 - RNA, 14 nt, Human
caaaucuuaagaaa

SEQ ID NO: 1968625 - RNA, 13 nt, Human
caaaucuuccugg

SEQ ID NO: 1968626 - RNA, 14 nt, Human
caaaucugucugcu

SEQ ID NO: 1968627 - RNA, 13 nt, Human
caaaucuuaagaa

SEQ ID NO: 1968628 - RNA, 20 nt, Human
caaaucuuuccauauccaua

SEQ ID NO: 1968629 - RNA, 13 nt, Human
caaaugacuuuau

SEQ ID NO: 1968630 - RNA, 22 nt, Human
caaaucuuccuggucgaaaguu

SEQ ID NO: 1968631 - RNA, 23 nt, Human
caaaugcuguaacuuucugaaau

SEQ ID NO: 1968632 - RNA, 21 nt, Human
caaaugcuagaaaaauuguua

SEQ ID NO: 1968633 - RNA, 15 nt, Human
caaaugcaucuuuga

SEQ ID NO: 1968634 - RNA, 16 nt, Human
caaaugcaucuuugau

SEQ ID NO: 1968635 - RNA, 17 nt, Human
caaaugcaucuuugaug

SEQ ID NO: 1968636 - RNA, 21 nt, Human
caaaugcaucuuugauguguu

SEQ ID NO: 1968637 - RNA, 22 nt, Human
caaaugcaucuuugauguguug

SEQ ID NO: 1968638 - RNA, 18 nt, Human
caaaugacuuuauuauuu

SEQ ID NO: 1968639 - RNA, 20 nt, Human
caaaugacuuuauuauuuau

SEQ ID NO: 1968640 - RNA, 21 nt, Human
caaaugacuuuauuauuuauu

SEQ ID NO: 1968641 - RNA, 17 nt, Human
caaaugagacagcaguc

SEQ ID NO: 1968642 - RNA, 14 nt, Human
caaaugacuuuauu

SEQ ID NO: 1968643 - RNA, 15 nt, Human
caaaugacuuuauua

SEQ ID NO: 1968644 - RNA, 16 nt, Human
caaaugacuuuauuau

SEQ ID NO: 1968645 - RNA, 17 nt, Human
caaaugacuuuauuauu

SEQ ID NO: 1968646 - RNA, 21 nt, Human
caaagcagugcaugcuguccc

SEQ ID NO: 1968647 - RNA, 18 nt, Human
caaagcagugcaugcugu

SEQ ID NO: 1968648 - RNA, 14 nt, Human
caaagauauuuugc

SEQ ID NO: 1968649 - RNA, 16 nt, Human
caaagauauuuugcuu

SEQ ID NO: 1968650 - RNA, 22 nt, Human
caaagcagugcaugcugucccu

SEQ ID NO: 1968651 - RNA, 15 nt, Human
caaagcaguggagcc

SEQ ID NO: 1968652 - RNA, 21 nt, Human
caaagcaguggagcccaggag

SEQ ID NO: 1968653 - RNA, 14 nt, Human
caaagcaguugaau

SEQ ID NO: 1968654 - RNA, 19 nt, Human
caaaguaucccuacuguaa

SEQ ID NO: 1968655 - RNA, 21 nt, Human
caaaguaucccuacuguaauu

SEQ ID NO: 1968656 - RNA, 20 nt, Human
caaagucagaacaaauucag

SEQ ID NO: 1968657 - RNA, 15 nt, Human
caaagucaugauguu

SEQ ID NO: 1968658 - RNA, 17 nt, Human
caaagucaugauguuuu

SEQ ID NO: 1968659 - RNA, 18 nt, Human
caaagucaugauguuuuu

SEQ ID NO: 1968660 - RNA, 19 nt, Human
caaagucaugauguuuuua

SEQ ID NO: 1968661 - RNA, 22 nt, Human
caaagucaugauguuuuuaaaa

SEQ ID NO: 1968662 - RNA, 22 nt, Human
caaaguagaagucuuagaugua

SEQ ID NO: 1968663 - RNA, 14 nt, Human
caaagguaaaucag

SEQ ID NO: 1968664 - RNA, 22 nt, Human
caaagguaaaucagacuaugaa

SEQ ID NO: 1968665 - RNA, 22 nt, Human
caagaaugaagguuuuuguaaa

SEQ ID NO: 1968666 - RNA, 23 nt, Human
caacucuaaagugcuaauaauaa

SEQ ID NO: 1968667 - RNA, 22 nt, Human
caagaauugaagcaggacuaaa

SEQ ID NO: 1968668 - RNA, 14 nt, Human
caacucuccuccag

SEQ ID NO: 1968669 - RNA, 14 nt, Human
caacucauugcauc

SEQ ID NO: 1968670 - RNA, 17 nt, Human
caacuccaacauccacu

SEQ ID NO: 1968671 - RNA, 18 nt, Human
caacuccaacauccacuc

SEQ ID NO: 1968672 - RNA, 20 nt, Human
caacuccaacauccacucuc

SEQ ID NO: 1968673 - RNA, 17 nt, Human
caagaccacguuucuaa

SEQ ID NO: 1968674 - RNA, 18 nt, Human
caagaccacguuucuaaa

SEQ ID NO: 1968675 - RNA, 20 nt, Human
caagaauuucuaggacugaa

SEQ ID NO: 1968676 - RNA, 19 nt, Human
caagacccaaaaggcagaa

SEQ ID NO: 1968677 - RNA, 13 nt, Human
caagauggcacag

SEQ ID NO: 1968678 - RNA, 16 nt, Human
caagauggcacagggc

SEQ ID NO: 1968679 - RNA, 20 nt, Human
caagauggcacagggcauga

SEQ ID NO: 1968680 - RNA, 23 nt, Human
caagauggcacagggcaugaaau

SEQ ID NO: 1968681 - RNA, 17 nt, Human
caacucauauuuucaug

SEQ ID NO: 1968682 - RNA, 17 nt, Human
caacucaccccagcccc

SEQ ID NO: 1968683 - RNA, 18 nt, Human
caacucaccccagcccca

SEQ ID NO: 1968684 - RNA, 15 nt, Human
caacuaauuuuugua

SEQ ID NO: 1968685 - RNA, 19 nt, Human
caacuacuaccuguaauga

SEQ ID NO: 1968686 - RNA, 18 nt, Human
caacuaauuuuuguauuu

SEQ ID NO: 1968687 - RNA, 12 nt, Human
caaccccuggac

SEQ ID NO: 1968688 - RNA, 17 nt, Human
caaccccuggaccccag

SEQ ID NO: 1968689 - RNA, 18 nt, Human
caaccccuggaccccagc

SEQ ID NO: 1968690 - RNA, 22 nt, Human
caaccccuggaccccagccuca

SEQ ID NO: 1968691 - RNA, 15 nt, Human
caaccccucgcccag

SEQ ID NO: 1968692 - RNA, 17 nt, Human
caaccccucgcccaguc

SEQ ID NO: 1968693 - RNA, 21 nt, Human
caaccccucgcccagucccag

SEQ ID NO: 1968694 - RNA, 22 nt, Human
caaccccucgcccagucccagc

SEQ ID NO: 1968695 - RNA, 23 nt, Human
caaccccucgcccagucccagca

SEQ ID NO: 1968696 - RNA, 20 nt, Human
auuuugaagugagaaaauga

SEQ ID NO: 1968697 - RNA, 19 nt, Human
auuuuagggguagcauuug

SEQ ID NO: 1968698 - RNA, 15 nt, Human
auuuuaggcaaguuu

SEQ ID NO: 1968699 - RNA, 21 nt, Human
auuuuauaucaauuuaaaaaa

SEQ ID NO: 1968700 - RNA, 15 nt, Human
auuuuagcuaauuua

SEQ ID NO: 1968701 - RNA, 16 nt, Human
auuuuagcuaauuuag

SEQ ID NO: 1968702 - RNA, 13 nt, Human
auuuuaugucuuu

SEQ ID NO: 1968703 - RNA, 15 nt, Human
auuuuauguugacau

SEQ ID NO: 1968704 - RNA, 17 nt, Human
auuuuauguugacauuu

SEQ ID NO: 1968705 - RNA, 18 nt, Human
auuuuauguugacauuug

SEQ ID NO: 1968706 - RNA, 19 nt, Human
auuuuauguugacauuugu

SEQ ID NO: 1968707 - RNA, 13 nt, Human
auuuuauguugac

SEQ ID NO: 1968708 - RNA, 14 nt, Human
auuuuauguugaca

SEQ ID NO: 1968709 - RNA, 20 nt, Human
auuuuauguugacauuuguu

SEQ ID NO: 1968710 - RNA, 22 nt, Human
auuuuauguugacauuuguuug

SEQ ID NO: 1968711 - RNA, 16 nt, Human
auuuuuaagugcugca

SEQ ID NO: 1968712 - RNA, 18 nt, Human
auuuuuaagugcugcauu

SEQ ID NO: 1968713 - RNA, 19 nt, Human
auuuuuaagugcugcauuu

SEQ ID NO: 1968714 - RNA, 14 nt, Human
auuuuuaagugguu

SEQ ID NO: 1968715 - RNA, 16 nt, Human
auuuuuagccuguguc

SEQ ID NO: 1968716 - RNA, 22 nt, Human
auuuuuagccugugucauugcc

SEQ ID NO: 1968717 - RNA, 14 nt, Human
auuuuuauaagaaa

SEQ ID NO: 1968718 - RNA, 17 nt, Human
auuuuuaggacaugaaa

SEQ ID NO: 1968719 - RNA, 14 nt, Human
auuuuuagacagag

SEQ ID NO: 1968720 - RNA, 15 nt, Human
caaaagagaugaaag

SEQ ID NO: 1968721 - RNA, 19 nt, Human
caaaagcugggcagguugg

SEQ ID NO: 1968722 - RNA, 14 nt, Human
auuuuuuuguauga

SEQ ID NO: 1968723 - RNA, 17 nt, Human
auuuuuuuguaugaaaa

SEQ ID NO: 1968724 - RNA, 23 nt, Human
auuuuuuuuuccuucagugccuu

SEQ ID NO: 1968725 - RNA, 22 nt, Human
auuuuuuuuuccuucagugccu

SEQ ID NO: 1968726 - RNA, 20 nt, Human
auuuuuuuuuccuucagugc

SEQ ID NO: 1968727 - RNA, 18 nt, Human
auuuuuuuuuccuucagu

SEQ ID NO: 1968728 - RNA, 13 nt, Human
auuuuuuuguaug

SEQ ID NO: 1968729 - RNA, 16 nt, Human
auuuuuuugagacaga

SEQ ID NO: 1968730 - RNA, 21 nt, Human
auuuuuuugaacucuucucau

SEQ ID NO: 1968731 - RNA, 22 nt, Human
auuuuuuugaacucuucucauu

SEQ ID NO: 1968732 - RNA, 23 nt, Human
auuuuuuugaacucuucucauua

SEQ ID NO: 1968733 - RNA, 16 nt, Human
auuuuuauaccuguuu

SEQ ID NO: 1968734 - RNA, 14 nt, Human
caaacauuaauguu

SEQ ID NO: 1968735 - RNA, 15 nt, Human
caaacauuaauguug

SEQ ID NO: 1968736 - RNA, 14 nt, Human
caaaaggaauagau

SEQ ID NO: 1968737 - RNA, 21 nt, Human
caaaaggauaaugaauacuuu

SEQ ID NO: 1968738 - RNA, 13 nt, Human
caaaagcuucccu

SEQ ID NO: 1968739 - RNA, 20 nt, Human
caaaagcuucccucccugcu

SEQ ID NO: 1968740 - RNA, 18 nt, Human
caaaccccgaccaccugc

SEQ ID NO: 1968741 - RNA, 14 nt, Human
caaacccccauucu

SEQ ID NO: 1968742 - RNA, 19 nt, Human
caaacccccauucuguccu

SEQ ID NO: 1968743 - RNA, 21 nt, Human
caaaccccgaccaccugccca

SEQ ID NO: 1968744 - RNA, 13 nt, Human
caaaccccugacc

SEQ ID NO: 1968745 - RNA, 18 nt, Human
caaacccugucaaacauu

SEQ ID NO: 1968746 - RNA, 21 nt, Human
caaacccugucaaacauuagu

SEQ ID NO: 1968747 - RNA, 13 nt, Human
caaacccugucaa

SEQ ID NO: 1968748 - RNA, 17 nt, Human
caaacccugucaaacau

SEQ ID NO: 1968749 - RNA, 20 nt, Human
caaacauuuucucuuagaaa

SEQ ID NO: 1968750 - RNA, 21 nt, Human
caaacauuuucucuuagaaaa

SEQ ID NO: 1968751 - RNA, 17 nt, Human
caaacauuaauguugau

SEQ ID NO: 1968752 - RNA, 18 nt, Human
caaacauuaauguugauu

SEQ ID NO: 1968753 - RNA, 19 nt, Human
caaacauuaauguugauuu

SEQ ID NO: 1968754 - RNA, 20 nt, Human
caaacauuaauguugauuuc

SEQ ID NO: 1968755 - RNA, 21 nt, Human
caaacauuaauguugauuucu

SEQ ID NO: 1968756 - RNA, 22 nt, Human
caaacauuaauguugauuucua

SEQ ID NO: 1968757 - RNA, 15 nt, Human
caaacauuaguacuu

SEQ ID NO: 1968758 - RNA, 16 nt, Human
caaacauuaguacuuu

SEQ ID NO: 1968759 - RNA, 17 nt, Human
caaacauuaguacuuua

SEQ ID NO: 1968760 - RNA, 18 nt, Human
caaacauuaguacuuuau

SEQ ID NO: 1968761 - RNA, 19 nt, Human
caaacauuaguacuuuaua

SEQ ID NO: 1968762 - RNA, 14 nt, Human
caaacauuggaaga

SEQ ID NO: 1968763 - RNA, 19 nt, Human
caaacauuuucucuuagaa

SEQ ID NO: 1968764 - RNA, 19 nt, Human
auuccugcccugcuguuua

SEQ ID NO: 1968765 - RNA, 18 nt, Human
auuccugcauuugugaaa

SEQ ID NO: 1968766 - RNA, 18 nt, Human
auuccugcccugcuguuu

SEQ ID NO: 1968767 - RNA, 15 nt, Human
auuccugcauuugug

SEQ ID NO: 1968768 - RNA, 17 nt, Human
auucuccuuguguuacu

SEQ ID NO: 1968769 - RNA, 18 nt, Human
auucuccuuguguuacua

SEQ ID NO: 1968770 - RNA, 19 nt, Human
auucuccuuguguuacuaa

SEQ ID NO: 1968771 - RNA, 21 nt, Human
auucuccuuguguuacuaagu

SEQ ID NO: 1968772 - RNA, 22 nt, Human
auucuccuuguguuacuaaguu

SEQ ID NO: 1968773 - RNA, 17 nt, Human
auucucuaguuugauua

SEQ ID NO: 1968774 - RNA, 18 nt, Human
auucucuaguuugauuaa

SEQ ID NO: 1968775 - RNA, 19 nt, Human
auucucuaguuugauuaaa

SEQ ID NO: 1968776 - RNA, 11 nt, Human
auucucuguac

SEQ ID NO: 1968777 - RNA, 14 nt, Human
auucucuguacaua

SEQ ID NO: 1968778 - RNA, 19 nt, Human
auucuucugcuucagccuc

SEQ ID NO: 1968779 - RNA, 17 nt, Human
auucucuguacauauua

SEQ ID NO: 1968780 - RNA, 20 nt, Human
auucuucugcuucagccucc

SEQ ID NO: 1968781 - RNA, 22 nt, Human
auucuucuguacgucugacagg

SEQ ID NO: 1968782 - RNA, 15 nt, Human
auucuugcaaaguau

SEQ ID NO: 1968783 - RNA, 16 nt, Human
auucuugcaaaguauc

SEQ ID NO: 1968784 - RNA, 14 nt, Human
auucuugcaaagua

SEQ ID NO: 1968785 - RNA, 19 nt, Human
auuaaaugcccagccccuu

SEQ ID NO: 1968786 - RNA, 17 nt, Human
auuaaaugcccagcccc

SEQ ID NO: 1968787 - RNA, 12 nt, Human
auuaaauuacau

SEQ ID NO: 1968788 - RNA, 14 nt, Human
auuaaauuacauuu

SEQ ID NO: 1968789 - RNA, 15 nt, Human
auuaaauuacauuug

SEQ ID NO: 1968790 - RNA, 17 nt, Human
auuaaauuacauuugua

SEQ ID NO: 1968791 - RNA, 18 nt, Human
auuaaauuacauuuguaa

SEQ ID NO: 1968792 - RNA, 14 nt, Human
auuaggauuucaug

SEQ ID NO: 1968793 - RNA, 16 nt, Human
auuaggauuucaugau

SEQ ID NO: 1968794 - RNA, 16 nt, Human
auuaggcaugguuuug

SEQ ID NO: 1968795 - RNA, 17 nt, Human
auuaguacuggauuauu

SEQ ID NO: 1968796 - RNA, 13 nt, Human
auuaguacuuuau

SEQ ID NO: 1968797 - RNA, 15 nt, Human
auuaguacuuuauag

SEQ ID NO: 1968798 - RNA, 20 nt, Human
auuaguacuccccuccuuga

SEQ ID NO: 1968799 - RNA, 16 nt, Human
auucaaaugucuauaa

SEQ ID NO: 1968800 - RNA, 18 nt, Human
auucaacagguuuuccug

SEQ ID NO: 1968801 - RNA, 18 nt, Human
auucaacagcaaguguga

SEQ ID NO: 1968802 - RNA, 21 nt, Human
auucaacagcaagugugaaua

SEQ ID NO: 1968803 - RNA, 22 nt, Human
auucaacagcaagugugaauac

SEQ ID NO: 1968804 - RNA, 18 nt, Human
auucaaauguauuacagu

SEQ ID NO: 1968805 - RNA, 19 nt, Human
auuaugguaaaauuuugua

SEQ ID NO: 1968806 - RNA, 17 nt, Human
auuauggcauauauuaa

SEQ ID NO: 1968807 - RNA, 22 nt, Human
auuauggcauauauuaaaagca

SEQ ID NO: 1968808 - RNA, 11 nt, Human
auuaugcuaag

SEQ ID NO: 1968809 - RNA, 13 nt, Human
auuaugcuaagaa

SEQ ID NO: 1968810 - RNA, 16 nt, Human
auuaugcuaagaauuu

SEQ ID NO: 1968811 - RNA, 17 nt, Human
auucaauaguaauauaa

SEQ ID NO: 1968812 - RNA, 21 nt, Human
auucaauaguaauauaauaca

SEQ ID NO: 1968813 - RNA, 16 nt, Human
auuguugucugcaacu

SEQ ID NO: 1968814 - RNA, 15 nt, Human
auuguuaauugcuga

SEQ ID NO: 1968815 - RNA, 16 nt, Human
auuguuaauugcugag

SEQ ID NO: 1968816 - RNA, 19 nt, Human
auuguuaauugcugaggca

SEQ ID NO: 1968817 - RNA, 12 nt, Human
auuguaagaaau

SEQ ID NO: 1968818 - RNA, 14 nt, Human
auuguaagaaauac

SEQ ID NO: 1968819 - RNA, 20 nt, Human
auuguaagaaauacuguaca

SEQ ID NO: 1968820 - RNA, 21 nt, Human
auuguaagaaauacuguacaa

SEQ ID NO: 1968821 - RNA, 14 nt, Human
auugcuuucuuuca

SEQ ID NO: 1968822 - RNA, 17 nt, Human
auuguuguuuguaugua

SEQ ID NO: 1968823 - RNA, 18 nt, Human
auuguuguuuguauguau

SEQ ID NO: 1968824 - RNA, 20 nt, Human
auuguuguuuguauguauaa

SEQ ID NO: 1968825 - RNA, 21 nt, Human
auuguuguuuguauguauaau

SEQ ID NO: 1968826 - RNA, 19 nt, Human
auuucagaaguuuaaauau

SEQ ID NO: 1968827 - RNA, 22 nt, Human
auuucaguuauugucccuggcu

SEQ ID NO: 1968828 - RNA, 21 nt, Human
auuucaguuauugucccuggc

SEQ ID NO: 1968829 - RNA, 13 nt, Human
auuucagaaguuu

SEQ ID NO: 1968830 - RNA, 15 nt, Human
auuucagaaguuuaa

SEQ ID NO: 1968831 - RNA, 16 nt, Human
auuucagaaguuuaaa

SEQ ID NO: 1968832 - RNA, 18 nt, Human
auuucuguguccuguuuu

SEQ ID NO: 1968833 - RNA, 21 nt, Human
auuuaaugaaagacuguacaa

SEQ ID NO: 1968834 - RNA, 20 nt, Human
auuuaaugaaagacuguaca

SEQ ID NO: 1968835 - RNA, 15 nt, Human
auuuaaugaaagacu

SEQ ID NO: 1968836 - RNA, 16 nt, Human
auuuaaugaaagacug

SEQ ID NO: 1968837 - RNA, 19 nt, Human
auuuauaagaaaaauguga

SEQ ID NO: 1968838 - RNA, 11 nt, Human
auuuauaugua

SEQ ID NO: 1968839 - RNA, 21 nt, Human
auuuauauguauguguuuaga

SEQ ID NO: 1968840 - RNA, 17 nt, Human
auuuauauguauguguu

SEQ ID NO: 1968841 - RNA, 18 nt, Human
auuuauauguauguguuu

SEQ ID NO: 1968842 - RNA, 13 nt, Human
auuuauauguaug

SEQ ID NO: 1968843 - RNA, 14 nt, Human
auuuauauguaugu

SEQ ID NO: 1968844 - RNA, 16 nt, Human
auuuauauguaugugu

SEQ ID NO: 1968845 - RNA, 19 nt, Human
auuuaucuugaaggaaaaa

SEQ ID NO: 1968846 - RNA, 20 nt, Human
auuuaucuugaaggaaaaau

SEQ ID NO: 1968847 - RNA, 12 nt, Human
auuuaucuugaa

SEQ ID NO: 1968848 - RNA, 16 nt, Human
auuuaucuugaaggaa

SEQ ID NO: 1968849 - RNA, 16 nt, Human
auuuaugaagaaaaua

SEQ ID NO: 1968850 - RNA, 19 nt, Human
auuuaugaagaaaauacuu

SEQ ID NO: 1968851 - RNA, 23 nt, Human
auuuaucuugaaggaaaaauuca

SEQ ID NO: 1968852 - RNA, 13 nt, Human
auuuaucuuugau

SEQ ID NO: 1968853 - RNA, 15 nt, Human
auuuaugaagaaaau

SEQ ID NO: 1968854 - RNA, 14 nt, Human
auuuaucuuugaua

SEQ ID NO: 1968855 - RNA, 16 nt, Human
auuuaucuuugauaac

SEQ ID NO: 1968856 - RNA, 22 nt, Human
auuuaugcauauuauuuuaugu

SEQ ID NO: 1968857 - RNA, 16 nt, Human
auuuaugcauauuauu

SEQ ID NO: 1968858 - RNA, 14 nt, Human
auuucacugucugu

SEQ ID NO: 1968859 - RNA, 15 nt, Human
auuucacuugagugg

SEQ ID NO: 1968860 - RNA, 23 nt, Human
auuucacuugaguggagguuuau

SEQ ID NO: 1968861 - RNA, 13 nt, Human
auuucagaaauac

SEQ ID NO: 1968862 - RNA, 21 nt, Human
auuucagaaauacagauaaau

SEQ ID NO: 1968863 - RNA, 21 nt, Human
auuucagaaagccuuucauuu

SEQ ID NO: 1968864 - RNA, 19 nt, Human
cagucgccuuucagcaggc

SEQ ID NO: 1968865 - RNA, 21 nt, Human
cagucgccuuucagcaggcag

SEQ ID NO: 1968866 - RNA, 19 nt, Human
cagucucccccacccuugu

SEQ ID NO: 1968867 - RNA, 14 nt, Human
cagucucccucccu

SEQ ID NO: 1968868 - RNA, 21 nt, Human
cagucucaccauuuccccagg

SEQ ID NO: 1968869 - RNA, 22 nt, Human
cagucgccuuucagcaggcagc

SEQ ID NO: 1968870 - RNA, 23 nt, Human
cagucgccuuucagcaggcagcc

SEQ ID NO: 1968871 - RNA, 19 nt, Human
cagucgggggaacugaggc

SEQ ID NO: 1968872 - RNA, 23 nt, Human
cagugcaugcugucccuuacgug

SEQ ID NO: 1968873 - RNA, 22 nt, Human
cagugcaugcugucccuuacgu

SEQ ID NO: 1968874 - RNA, 19 nt, Human
cagugcaugcugucccuua

SEQ ID NO: 1968875 - RNA, 15 nt, Human
cagugcaccugggac

SEQ ID NO: 1968876 - RNA, 22 nt, Human
cagugcacuaauguguaagaca

SEQ ID NO: 1968877 - RNA, 19 nt, Human
cagucugauucccaagcuc

SEQ ID NO: 1968878 - RNA, 20 nt, Human
cagucugauucccaagcucu

SEQ ID NO: 1968879 - RNA, 11 nt, Human
cagugggagcu

SEQ ID NO: 1968880 - RNA, 12 nt, Human
cagugcccacag

SEQ ID NO: 1968881 - RNA, 19 nt, Human
cagugggacagggcauggc

SEQ ID NO: 1968882 - RNA, 16 nt, Human
cagugggacagggcau

SEQ ID NO: 1968883 - RNA, 15 nt, Human
cagugccaaaaacaa

SEQ ID NO: 1968884 - RNA, 18 nt, Human
cagguuugggaccccugg

SEQ ID NO: 1968885 - RNA, 23 nt, Human
cagguuugggaccccuggugguu

SEQ ID NO: 1968886 - RNA, 15 nt, Human
cagguuugggacccc

SEQ ID NO: 1968887 - RNA, 18 nt, Human
cagguuuaagcuguuacu

SEQ ID NO: 1968888 - RNA, 16 nt, Human
cagguuuaagcuguua

SEQ ID NO: 1968889 - RNA, 22 nt, Human
cagucaccccggccaccugcgg

SEQ ID NO: 1968890 - RNA, 19 nt, Human
cagucaccccggccaccug

SEQ ID NO: 1968891 - RNA, 20 nt, Human
cagucaccccggccaccugc

SEQ ID NO: 1968892 - RNA, 22 nt, Human
cagggucucacucugucgccca

SEQ ID NO: 1968893 - RNA, 21 nt, Human
cagggucucacucugucgccc

SEQ ID NO: 1968894 - RNA, 17 nt, Human
cagggucucacucuguc

SEQ ID NO: 1968895 - RNA, 18 nt, Human
cagggucucacucugucg

SEQ ID NO: 1968896 - RNA, 13 nt, Human
caggguuggcacc

SEQ ID NO: 1968897 - RNA, 20 nt, Human
caggguuggcaccuuccccc

SEQ ID NO: 1968898 - RNA, 23 nt, Human
cagggugucugcccccuccugag

SEQ ID NO: 1968899 - RNA, 24 nt, Human
cagggugucugcccccuccugagu

SEQ ID NO: 1968900 - RNA, 16 nt, Human
cagggugucugccccc

SEQ ID NO: 1968901 - RNA, 20 nt, Human
caggugcuaggaacacuccu

SEQ ID NO: 1968902 - RNA, 18 nt, Human
caggugcuaggaacacuc

SEQ ID NO: 1968903 - RNA, 14 nt, Human
caggugcgaaagga

SEQ ID NO: 1968904 - RNA, 14 nt, Human
cagguugguggggg

SEQ ID NO: 1968905 - RNA, 16 nt, Human
caggugauccacccac

SEQ ID NO: 1968906 - RNA, 17 nt, Human
caggugauccacccacc

SEQ ID NO: 1968907 - RNA, 12 nt, Human
caggguuggccc

SEQ ID NO: 1968908 - RNA, 14 nt, Human
caggguuggccccu

SEQ ID NO: 1968909 - RNA, 20 nt, Human
caggugauccacccaccuca

SEQ ID NO: 1968910 - RNA, 22 nt, Human
cagggaguccgaaagggacuug

SEQ ID NO: 1968911 - RNA, 18 nt, Human
cagggaggugaccccagg

SEQ ID NO: 1968912 - RNA, 14 nt, Human
cagggagggccugg

SEQ ID NO: 1968913 - RNA, 16 nt, Human
cagggagggccugggc

SEQ ID NO: 1968914 - RNA, 20 nt, Human
cagggaggugugaggcagga

SEQ ID NO: 1968915 - RNA, 22 nt, Human
cagggaggugugaggcaggaga

SEQ ID NO: 1968916 - RNA, 23 nt, Human
cagggaggugugaggcaggagag

SEQ ID NO: 1968917 - RNA, 15 nt, Human
caggccugacucuca

SEQ ID NO: 1968918 - RNA, 13 nt, Human
caggccucccugc

SEQ ID NO: 1968919 - RNA, 16 nt, Human
caggccucccugccag

SEQ ID NO: 1968920 - RNA, 17 nt, Human
caggccucccugccagu

SEQ ID NO: 1968921 - RNA, 18 nt, Human
caggccucccugccagua

SEQ ID NO: 1968922 - RNA, 20 nt, Human
caggccugccuguucccauu

SEQ ID NO: 1968923 - RNA, 15 nt, Human
caggcgccccuuccc

SEQ ID NO: 1968924 - RNA, 22 nt, Human
caggcgcaagggaggcccagcg

SEQ ID NO: 1968925 - RNA, 23 nt, Human
caggcgcaagggaggcccagcgc

SEQ ID NO: 1968926 - RNA, 20 nt, Human
caggccuacuccugucuucu

SEQ ID NO: 1968927 - RNA, 17 nt, Human
caggcuggcccugcccu

SEQ ID NO: 1968928 - RNA, 18 nt, Human
caggcuggcccugcccug

SEQ ID NO: 1968929 - RNA, 19 nt, Human
caggcuggcccugcccugg

SEQ ID NO: 1968930 - RNA, 17 nt, Human
caggcgccccuuccccc

SEQ ID NO: 1968931 - RNA, 16 nt, Human
caggcgcuagcacagc

SEQ ID NO: 1968932 - RNA, 20 nt, Human
caggcgcuagcacagcuccc

SEQ ID NO: 1968933 - RNA, 22 nt, Human
caggcgcuagcacagcucccuu

SEQ ID NO: 1968934 - RNA, 21 nt, Human
caggcuggccuggggucaggc

SEQ ID NO: 1968935 - RNA, 20 nt, Human
caggcuggcccugcccuggu

SEQ ID NO: 1968936 - RNA, 15 nt, Human
caggcuggcgugcag

SEQ ID NO: 1968937 - RNA, 16 nt, Human
caggcugggcuucagu

SEQ ID NO: 1968938 - RNA, 19 nt, Human
cagggaggacgcucucugg

SEQ ID NO: 1968939 - RNA, 12 nt, Human
cagggagggccu

SEQ ID NO: 1968940 - RNA, 13 nt, Human
cagggagggccug

SEQ ID NO: 1968941 - RNA, 17 nt, Human
cagggaggacgcucucu

SEQ ID NO: 1968942 - RNA, 18 nt, Human
cagggaggacgcucucug

SEQ ID NO: 1968943 - RNA, 17 nt, Human
caggcugggcuucagug

SEQ ID NO: 1968944 - RNA, 19 nt, Human
caggcugggcuucaguggc

SEQ ID NO: 1968945 - RNA, 23 nt, Human
caggccagagggagugacagagg

SEQ ID NO: 1968946 - RNA, 19 nt, Human
caggccagagggagugaca

SEQ ID NO: 1968947 - RNA, 21 nt, Human
caggccagagggagugacaga

SEQ ID NO: 1968948 - RNA, 17 nt, Human
caggagguuggagggaa

SEQ ID NO: 1968949 - RNA, 14 nt, Human
caggaguaaaagag

SEQ ID NO: 1968950 - RNA, 15 nt, Human
caggagguggucugg

SEQ ID NO: 1968951 - RNA, 18 nt, Human
caggcacccaccaucaug

SEQ ID NO: 1968952 - RNA, 22 nt, Human
caggcacccaccaucaugucug

SEQ ID NO: 1968953 - RNA, 23 nt, Human
caggcacccaccaucaugucugg

SEQ ID NO: 1968954 - RNA, 17 nt, Human
caggaggccagccuuga

SEQ ID NO: 1968955 - RNA, 12 nt, Human
caggagggacag

SEQ ID NO: 1968956 - RNA, 15 nt, Human
caggagggaggggga

SEQ ID NO: 1968957 - RNA, 20 nt, Human
caggagggacagucucacca

SEQ ID NO: 1968958 - RNA, 15 nt, Human
caggagggagcagag

SEQ ID NO: 1968959 - RNA, 16 nt, Human
caggagggacagucuc

SEQ ID NO: 1968960 - RNA, 17 nt, Human
caggagggacagucuca

SEQ ID NO: 1968961 - RNA, 19 nt, Human
caggagggacagucucacc

SEQ ID NO: 1968962 - RNA, 23 nt, Human
caggagggagggggaaggcaggg

SEQ ID NO: 1968963 - RNA, 12 nt, Human
caggaccccuga

SEQ ID NO: 1968964 - RNA, 14 nt, Human
caggaccccugagu

SEQ ID NO: 1968965 - RNA, 15 nt, Human
caggaccccugcagu

SEQ ID NO: 1968966 - RNA, 20 nt, Human
caggaccccugcaguucccc

SEQ ID NO: 1968967 - RNA, 16 nt, Human
caggaggccagccuug

SEQ ID NO: 1968968 - RNA, 15 nt, Human
caggaggccagccuu

SEQ ID NO: 1968969 - RNA, 14 nt, Human
caggaggccagccu

SEQ ID NO: 1968970 - RNA, 13 nt, Human
caggaggaagggg

SEQ ID NO: 1968971 - RNA, 15 nt, Human
cagauaugauucaaa

SEQ ID NO: 1968972 - RNA, 16 nt, Human
cagauaugauucaaau

SEQ ID NO: 1968973 - RNA, 17 nt, Human
cagauaugauucaaaug

SEQ ID NO: 1968974 - RNA, 19 nt, Human
cagauaugauucaaauguc

SEQ ID NO: 1968975 - RNA, 20 nt, Human
cagaggggguggccucccaa

SEQ ID NO: 1968976 - RNA, 19 nt, Human
cagaggggguggccuccca

SEQ ID NO: 1968977 - RNA, 17 nt, Human
cagaggggguggccucc

SEQ ID NO: 1968978 - RNA, 18 nt, Human
cagaggggguggccuccc

SEQ ID NO: 1968979 - RNA, 20 nt, Human
cagagucagaaguuucugcc

SEQ ID NO: 1968980 - RNA, 18 nt, Human
cagaguauuuuuguauuc

SEQ ID NO: 1968981 - RNA, 12 nt, Human
cagagcugccag

SEQ ID NO: 1968982 - RNA, 13 nt, Human
cagagcugccagu

SEQ ID NO: 1968983 - RNA, 18 nt, Human
cagagcugccaccugccu

SEQ ID NO: 1968984 - RNA, 16 nt, Human
cagagcugccaccugc

SEQ ID NO: 1968985 - RNA, 23 nt, Human
cagaaguuugagaucagccuggg

SEQ ID NO: 1968986 - RNA, 22 nt, Human
cagaaguuugagaucagccugg

SEQ ID NO: 1968987 - RNA, 20 nt, Human
cagaaguuugagaucagccu

SEQ ID NO: 1968988 - RNA, 19 nt, Human
cagaaguuucugccgcagc

SEQ ID NO: 1968989 - RNA, 23 nt, Human
cagaaguuucugccgcagcccug

SEQ ID NO: 1968990 - RNA, 22 nt, Human
cagagggccugcaagggaguga

SEQ ID NO: 1968991 - RNA, 23 nt, Human
cagcauauucaggaagcucaggg

SEQ ID NO: 1968992 - RNA, 22 nt, Human
cagcauauucaggaagcucagg

SEQ ID NO: 1968993 - RNA, 19 nt, Human
cagcauauucaggaagcuc

SEQ ID NO: 1968994 - RNA, 20 nt, Human
cagcagucuuaugcuuccag

SEQ ID NO: 1968995 - RNA, 21 nt, Human
cagcagucuuaugcuuccaga

SEQ ID NO: 1968996 - RNA, 22 nt, Human
cagcagucuuaugcuuccagaa

SEQ ID NO: 1968997 - RNA, 13 nt, Human
cagccaggccaca

SEQ ID NO: 1968998 - RNA, 12 nt, Human
cagccaggccac

SEQ ID NO: 1968999 - RNA, 22 nt, Human
cagccaggccacaagacccuug

SEQ ID NO: 1969000 - RNA, 13 nt, Human
cagcaccgccucu

SEQ ID NO: 1969001 - RNA, 14 nt, Human
cagcaccgccucuu

SEQ ID NO: 1969002 - RNA, 15 nt, Human
cagcaccgccucuuc

SEQ ID NO: 1969003 - RNA, 21 nt, Human
cagcagguccccagcuuuggc

SEQ ID NO: 1969004 - RNA, 17 nt, Human
cagcagucuuaugcuuc

SEQ ID NO: 1969005 - RNA, 19 nt, Human
cagcagucuuaugcuucca

SEQ ID NO: 1969006 - RNA, 15 nt, Human
cagcggggacagcuc

SEQ ID NO: 1969007 - RNA, 16 nt, Human
cagcggggacagcucc

SEQ ID NO: 1969008 - RNA, 17 nt, Human
cagcggggacagcuccu

SEQ ID NO: 1969009 - RNA, 19 nt, Human
cagccugagcgacagugag

SEQ ID NO: 1969010 - RNA, 22 nt, Human
cagccugagcgacagugagacu

SEQ ID NO: 1969011 - RNA, 18 nt, Human
cagccugagcgacaguga

SEQ ID NO: 1969012 - RNA, 20 nt, Human
cagccucuuucccuuccagu

SEQ ID NO: 1969013 - RNA, 13 nt, Human
cagccugagaguc

SEQ ID NO: 1969014 - RNA, 14 nt, Human
cagccccuggaugc

SEQ ID NO: 1969015 - RNA, 13 nt, Human
cagccccuggaug

SEQ ID NO: 1969016 - RNA, 12 nt, Human
cagccccuggau

SEQ ID NO: 1969017 - RNA, 21 nt, Human
cagccccuggaugcagccuca

SEQ ID NO: 1969018 - RNA, 19 nt, Human
cagccccuggaugcagccu

SEQ ID NO: 1969019 - RNA, 18 nt, Human
cagccccuggaugcagcc

SEQ ID NO: 1969020 - RNA, 17 nt, Human
cagccccuggaugcagc

SEQ ID NO: 1969021 - RNA, 15 nt, Human
cagcccuuagcaggg

SEQ ID NO: 1969022 - RNA, 22 nt, Human
cagccccuggaugcagccucac

SEQ ID NO: 1969023 - RNA, 16 nt, Human
cagcccuuagcaggga

SEQ ID NO: 1969024 - RNA, 21 nt, Human
cagcccuuagcagggaaacag

SEQ ID NO: 1969025 - RNA, 21 nt, Human
cagccgagauagccaaggcca

SEQ ID NO: 1969026 - RNA, 19 nt, Human
cagcccuuccucugcuccc

SEQ ID NO: 1969027 - RNA, 23 nt, Human
cagcccuuccucugcucccccuu

SEQ ID NO: 1969028 - RNA, 21 nt, Human
cagccgagcuuuuacucccug

SEQ ID NO: 1969029 - RNA, 13 nt, Human
cagcccuuccucu

SEQ ID NO: 1969030 - RNA, 16 nt, Human
cagcccuuccucugcu

SEQ ID NO: 1969031 - RNA, 17 nt, Human
cagcccuuccucugcuc

SEQ ID NO: 1969032 - RNA, 18 nt, Human
cagcccuuccucugcucc

SEQ ID NO: 1969033 - RNA, 18 nt, Human
cagccucuuucccuucca

SEQ ID NO: 1969034 - RNA, 19 nt, Human
cagccucuuucccuuccag

SEQ ID NO: 1969035 - RNA, 15 nt, Human
cagccucuuucccuu

SEQ ID NO: 1969036 - RNA, 16 nt, Human
cagccucuuucccuuc

SEQ ID NO: 1969037 - RNA, 16 nt, Human
cagcuccaagaauuuc

SEQ ID NO: 1969038 - RNA, 19 nt, Human
cagcuccaagaauuucuag

SEQ ID NO: 1969039 - RNA, 13 nt, Human
cagcuccagcuca

SEQ ID NO: 1969040 - RNA, 14 nt, Human
cagcuccagcucac

SEQ ID NO: 1969041 - RNA, 15 nt, Human
cagcuccagcucacc

SEQ ID NO: 1969042 - RNA, 22 nt, Human
cagcuccagcucaccagcccca

SEQ ID NO: 1969043 - RNA, 21 nt, Human
cagcucccaaggcucugagca

SEQ ID NO: 1969044 - RNA, 16 nt, Human
cagcuccagcucacca

SEQ ID NO: 1969045 - RNA, 17 nt, Human
cagcuccagcucaccag

SEQ ID NO: 1969046 - RNA, 18 nt, Human
cagcuccagcucaccagc

SEQ ID NO: 1969047 - RNA, 20 nt, Human
cagcuccagcucaccagccc

SEQ ID NO: 1969048 - RNA, 18 nt, Human
cagcugugcucuggacag

SEQ ID NO: 1969049 - RNA, 15 nt, Human
cagcuucauuuccug

SEQ ID NO: 1969050 - RNA, 22 nt, Human
cagcuucacuucugacucuucc

SEQ ID NO: 1969051 - RNA, 18 nt, Human
cagcuucauuuccugugu

SEQ ID NO: 1969052 - RNA, 19 nt, Human
cagcuucauuuccuguguc

SEQ ID NO: 1969053 - RNA, 18 nt, Human
caggaaaggcccagccac

SEQ ID NO: 1969054 - RNA, 15 nt, Human
caggaaaggcuccag

SEQ ID NO: 1969055 - RNA, 14 nt, Human
caggaaaggcucca

SEQ ID NO: 1969056 - RNA, 16 nt, Human
caggaaaugcugaccc

SEQ ID NO: 1969057 - RNA, 20 nt, Human
caggaaaugcugacccaugg

SEQ ID NO: 1969058 - RNA, 21 nt, Human
caggaaaugcugacccauggg

SEQ ID NO: 1969059 - RNA, 22 nt, Human
caggaaaugcugacccaugggc

SEQ ID NO: 1969060 - RNA, 23 nt, Human
caggaaaugcugacccaugggca

SEQ ID NO: 1969061 - RNA, 23 nt, Human
cagcugcaccccuuccugggcac

SEQ ID NO: 1969062 - RNA, 12 nt, Human
cagcugcacccc

SEQ ID NO: 1969063 - RNA, 14 nt, Human
cagcugcaccccuu

SEQ ID NO: 1969064 - RNA, 16 nt, Human
cagcugcaccccuucc

SEQ ID NO: 1969065 - RNA, 17 nt, Human
cagcugcaccccuuccu

SEQ ID NO: 1969066 - RNA, 20 nt, Human
cagcugcaccccuuccuggg

SEQ ID NO: 1969067 - RNA, 16 nt, Human
caucuggguagcugua

SEQ ID NO: 1969068 - RNA, 18 nt, Human
caucuggguagcuguaag

SEQ ID NO: 1969069 - RNA, 20 nt, Human
caucuggguagcuguaaggc

SEQ ID NO: 1969070 - RNA, 15 nt, Human
caucaggccaggccc

SEQ ID NO: 1969071 - RNA, 19 nt, Human
cauccauggggcugauugu

SEQ ID NO: 1969072 - RNA, 11 nt, Human
cauccaugggg

SEQ ID NO: 1969073 - RNA, 19 nt, Human
cauccauggggucucucac

SEQ ID NO: 1969074 - RNA, 20 nt, Human
cauccauggggucucucaca

SEQ ID NO: 1969075 - RNA, 21 nt, Human
cauccauggggucucucacag

SEQ ID NO: 1969076 - RNA, 22 nt, Human
cauccauggggucucucacaga

SEQ ID NO: 1969077 - RNA, 19 nt, Human
caucaggccaggcccucug

SEQ ID NO: 1969078 - RNA, 16 nt, Human
caucaggccaggcccu

SEQ ID NO: 1969079 - RNA, 17 nt, Human
cauccuucccacucugu

SEQ ID NO: 1969080 - RNA, 15 nt, Human
cauccuucccacucu

SEQ ID NO: 1969081 - RNA, 16 nt, Human
cauccuucccacucug

SEQ ID NO: 1969082 - RNA, 19 nt, Human
caucccauaugccugggca

SEQ ID NO: 1969083 - RNA, 14 nt, Human
cauccccuguagag

SEQ ID NO: 1969084 - RNA, 15 nt, Human
cauauucaggaagcu

SEQ ID NO: 1969085 - RNA, 14 nt, Human
cauauucaggaagc

SEQ ID NO: 1969086 - RNA, 20 nt, Human
cauauucaggaagcucaggg

SEQ ID NO: 1969087 - RNA, 22 nt, Human
cauauucaggaagcucagggcc

SEQ ID NO: 1969088 - RNA, 20 nt, Human
cauaugccugggcagaagga

SEQ ID NO: 1969089 - RNA, 15 nt, Human
cauaugccugggcag

SEQ ID NO: 1969090 - RNA, 22 nt, Human
cauaugccugggcagaaggaag

SEQ ID NO: 1969091 - RNA, 16 nt, Human
cauagcucuguacauc

SEQ ID NO: 1969092 - RNA, 19 nt, Human
cauagcagagaaugaaagg

SEQ ID NO: 1969093 - RNA, 22 nt, Human
cauagcagagaaugaaagggcc

SEQ ID NO: 1969094 - RNA, 22 nt, Human
cauagcaccuaacaacauugua

SEQ ID NO: 1969095 - RNA, 19 nt, Human
cauacacacgcugccuucg

SEQ ID NO: 1969096 - RNA, 16 nt, Human
cauacacacgcugccu

SEQ ID NO: 1969097 - RNA, 17 nt, Human
cauacacacgcugccuu

SEQ ID NO: 1969098 - RNA, 13 nt, Human
cauacacacgcug

SEQ ID NO: 1969099 - RNA, 15 nt, Human
cagugggagcugccu

SEQ ID NO: 1969100 - RNA, 17 nt, Human
cauaauucugaaguuau

SEQ ID NO: 1969101 - RNA, 18 nt, Human
cauaauucugaaguuaua

SEQ ID NO: 1969102 - RNA, 22 nt, Human
cauaauucugaaguuauauuuc

SEQ ID NO: 1969103 - RNA, 13 nt, Human
cauaauucuuauu

SEQ ID NO: 1969104 - RNA, 14 nt, Human
cauaauucuuauua

SEQ ID NO: 1969105 - RNA, 19 nt, Human
cauaauugccaauugaaac

SEQ ID NO: 1969106 - RNA, 15 nt, Human
caugcugcccuguga

SEQ ID NO: 1969107 - RNA, 14 nt, Human
caugcugcccugug

SEQ ID NO: 1969108 - RNA, 16 nt, Human
caugcugccccugccu

SEQ ID NO: 1969109 - RNA, 14 nt, Human
cauggccagguggc

SEQ ID NO: 1969110 - RNA, 13 nt, Human
cauggccaggugg

SEQ ID NO: 1969111 - RNA, 15 nt, Human
caugaaguaauaugc

SEQ ID NO: 1969112 - RNA, 19 nt, Human
caugaaguaauaugcacac

SEQ ID NO: 1969113 - RNA, 22 nt, Human
caugaaguaauaugcacacauu

SEQ ID NO: 1969114 - RNA, 23 nt, Human
caugaaguaauaugcacacauuu

SEQ ID NO: 1969115 - RNA, 23 nt, Human
caugacacgaauauugcugaugg

SEQ ID NO: 1969116 - RNA, 21 nt, Human
caugacacgaauauugcugau

SEQ ID NO: 1969117 - RNA, 14 nt, Human
caugaaggagugaa

SEQ ID NO: 1969118 - RNA, 22 nt, Human
caugaaggaugccaagaaguuu

SEQ ID NO: 1969119 - RNA, 24 nt, Human
caugauuaaccacuucagcugacu

SEQ ID NO: 1969120 - RNA, 12 nt, Human
caugcacaaauu

SEQ ID NO: 1969121 - RNA, 19 nt, Human
caugcacacucaugugcaa

SEQ ID NO: 1969122 - RNA, 14 nt, Human
caugcacacucaug

SEQ ID NO: 1969123 - RNA, 18 nt, Human
caugauguuuuuaaaauc

SEQ ID NO: 1969124 - RNA, 19 nt, Human
caugauguuuuuaaaaucu

SEQ ID NO: 1969125 - RNA, 20 nt, Human
caugauguuuuuaaaaucuu

SEQ ID NO: 1969126 - RNA, 21 nt, Human
caugauguuuuuaaaaucuua

SEQ ID NO: 1969127 - RNA, 22 nt, Human
caugauguuuuuaaaaucuuau

SEQ ID NO: 1969128 - RNA, 23 nt, Human
caugauuaaccacuucagcugac

SEQ ID NO: 1969129 - RNA, 22 nt, Human
caugauuaaccacuucagcuga

SEQ ID NO: 1969130 - RNA, 23 nt, Human
caugacaguucauucagggccga

SEQ ID NO: 1969131 - RNA, 17 nt, Human
caugauguuuuuaaaau

SEQ ID NO: 1969132 - RNA, 19 nt, Human
caugacagaaaauauguau

SEQ ID NO: 1969133 - RNA, 21 nt, Human
caugacagaaaauauguauua

SEQ ID NO: 1969134 - RNA, 14 nt, Human
caugacagaaaaua

SEQ ID NO: 1969135 - RNA, 15 nt, Human
caugacagaaaauau

SEQ ID NO: 1969136 - RNA, 16 nt, Human
caugacagaaaauaug

SEQ ID NO: 1969137 - RNA, 13 nt, Human
caugcugcccugu

SEQ ID NO: 1969138 - RNA, 12 nt, Human
caugcugcccug

SEQ ID NO: 1969139 - RNA, 13 nt, Human
caugcuccuggcc

SEQ ID NO: 1969140 - RNA, 18 nt, Human
caugcuccccugugccag

SEQ ID NO: 1969141 - RNA, 19 nt, Human
caugcuccccugugccagc

SEQ ID NO: 1969142 - RNA, 16 nt, Human
caugcacgugugugca

SEQ ID NO: 1969143 - RNA, 15 nt, Human
caugcuccccugugc

SEQ ID NO: 1969144 - RNA, 16 nt, Human
caugcuccccugugcc

SEQ ID NO: 1969145 - RNA, 16 nt, Human
cauguauccuuucaca

SEQ ID NO: 1969146 - RNA, 20 nt, Human
cauguccaagaagcccagga

SEQ ID NO: 1969147 - RNA, 19 nt, Human
cauguccaagaagcccagg

SEQ ID NO: 1969148 - RNA, 18 nt, Human
cauguccaagaagcccag

SEQ ID NO: 1969149 - RNA, 12 nt, Human
cauguuggccag

SEQ ID NO: 1969150 - RNA, 13 nt, Human
cauguuggccagg

SEQ ID NO: 1969151 - RNA, 17 nt, Human
cauguugccaaaauggu

SEQ ID NO: 1969152 - RNA, 23 nt, Human
cauuaucuagauacuguaucaug

SEQ ID NO: 1969153 - RNA, 21 nt, Human
cauuagugagacauauuuaca

SEQ ID NO: 1969154 - RNA, 13 nt, Human
cauuaguuuugaa

SEQ ID NO: 1969155 - RNA, 15 nt, Human
cauuaguacuuuaua

SEQ ID NO: 1969156 - RNA, 20 nt, Human
cauuaguacuuuauagaaga

SEQ ID NO: 1969157 - RNA, 22 nt, Human
cauuaguacuuuauagaagaau

SEQ ID NO: 1969158 - RNA, 14 nt, Human
cauuaguacuuuau

SEQ ID NO: 1969159 - RNA, 22 nt, Human
cauuaggugugacugaauuucu

SEQ ID NO: 1969160 - RNA, 13 nt, Human
cauuagugggaaa

SEQ ID NO: 1969161 - RNA, 12 nt, Human
cauuccuguucc

SEQ ID NO: 1969162 - RNA, 22 nt, Human
cauucgcuacuaugauuuaauu

SEQ ID NO: 1969163 - RNA, 18 nt, Human
cauuccuuuuuauuuaua

SEQ ID NO: 1969164 - RNA, 22 nt, Human
cauucgaagauccccagacuuc

SEQ ID NO: 1969165 - RNA, 13 nt, Human
cauucucacuccu

SEQ ID NO: 1969166 - RNA, 22 nt, Human
cauucucaagggacguccucca

SEQ ID NO: 1969167 - RNA, 16 nt, Human
cauucucaagggacgu

SEQ ID NO: 1969168 - RNA, 21 nt, Human
cauucucaagggacguccucc

SEQ ID NO: 1969169 - RNA, 22 nt, Human
cauucgggccccaccugcagcu

SEQ ID NO: 1969170 - RNA, 14 nt, Human
cauucucaagggac

SEQ ID NO: 1969171 - RNA, 18 nt, Human
cauucuagguuugcaaga

SEQ ID NO: 1969172 - RNA, 21 nt, Human
cauucgggccccaccugcagc

SEQ ID NO: 1969173 - RNA, 14 nt, Human
cauucucacuccua

SEQ ID NO: 1969174 - RNA, 15 nt, Human
ccaaggccaaaggaa

SEQ ID NO: 1969175 - RNA, 18 nt, Human
ccaaggaugccccguccc

SEQ ID NO: 1969176 - RNA, 14 nt, Human
ccaagaagcccagg

SEQ ID NO: 1969177 - RNA, 12 nt, Human
ccaagcuggucc

SEQ ID NO: 1969178 - RNA, 19 nt, Human
ccaagcuggucccacucag

SEQ ID NO: 1969179 - RNA, 15 nt, Human
ccaacgucugugcca

SEQ ID NO: 1969180 - RNA, 13 nt, Human
ccaacgucugugc

SEQ ID NO: 1969181 - RNA, 22 nt, Human
ccaaauggaaaugggcagagca

SEQ ID NO: 1969182 - RNA, 17 nt, Human
ccaaauggaaacagagg

SEQ ID NO: 1969183 - RNA, 15 nt, Human
ccaacggccccagcu

SEQ ID NO: 1969184 - RNA, 21 nt, Human
ccaaauggaaacagaggacca

SEQ ID NO: 1969185 - RNA, 16 nt, Human
ccaacgucugugccau

SEQ ID NO: 1969186 - RNA, 13 nt, Human
ccaagaagcccag

SEQ ID NO: 1969187 - RNA, 21 nt, Human
ccaaauaauauguuuccuucc

SEQ ID NO: 1969188 - RNA, 23 nt, Human
ccaaauaauauguuuccuucccu

SEQ ID NO: 1969189 - RNA, 12 nt, Human
ccaaaugcagcu

SEQ ID NO: 1969190 - RNA, 13 nt, Human
ccaaaugcagcuu

SEQ ID NO: 1969191 - RNA, 15 nt, Human
ccaaaugcagcuuua

SEQ ID NO: 1969192 - RNA, 18 nt, Human
ccaaaugcagcuuuaaaa

SEQ ID NO: 1969193 - RNA, 18 nt, Human
ccaaauaucaccaggacu

SEQ ID NO: 1969194 - RNA, 18 nt, Human
ccaaucccagcuaccuca

SEQ ID NO: 1969195 - RNA, 16 nt, Human
ccaaggccaaaggaag

SEQ ID NO: 1969196 - RNA, 14 nt, Human
ccaaucuuacuuug

SEQ ID NO: 1969197 - RNA, 15 nt, Human
ccaaucccugauccc

SEQ ID NO: 1969198 - RNA, 20 nt, Human
ccaaucuuacuuuguaaauu

SEQ ID NO: 1969199 - RNA, 21 nt, Human
ccaaucuuacuuuguaaauuc

SEQ ID NO: 1969200 - RNA, 15 nt, Human
ccaaucuuacuuugu

SEQ ID NO: 1969201 - RNA, 16 nt, Human
ccaaucuuacuuugua

SEQ ID NO: 1969202 - RNA, 17 nt, Human
ccaaucuuacuuuguaa

SEQ ID NO: 1969203 - RNA, 21 nt, Human
cauugcuuuuaaaacuacuua

SEQ ID NO: 1969204 - RNA, 17 nt, Human
cauugcuuuuaaaacua

SEQ ID NO: 1969205 - RNA, 13 nt, Human
cauugcuucuucu

SEQ ID NO: 1969206 - RNA, 15 nt, Human
cauugcuucuucuga

SEQ ID NO: 1969207 - RNA, 16 nt, Human
cauugcuucuucugag

SEQ ID NO: 1969208 - RNA, 15 nt, Human
cauuguaaaagcauu

SEQ ID NO: 1969209 - RNA, 20 nt, Human
cauuguaaaagcauuuugua

SEQ ID NO: 1969210 - RNA, 21 nt, Human
cauuguaaaagcauuuuguaa

SEQ ID NO: 1969211 - RNA, 22 nt, Human
cauuguaaaagcauuuuguaau

SEQ ID NO: 1969212 - RNA, 23 nt, Human
cauuguaaaagcauuuuguaaua

SEQ ID NO: 1969213 - RNA, 13 nt, Human
cauuggaaauuuc

SEQ ID NO: 1969214 - RNA, 19 nt, Human
cauuggaaauuucacguca

SEQ ID NO: 1969215 - RNA, 14 nt, Human
cauuggaaauuuca

SEQ ID NO: 1969216 - RNA, 16 nt, Human
cauuggaaauuucacg

SEQ ID NO: 1969217 - RNA, 14 nt, Human
cauuuauucugcuc

SEQ ID NO: 1969218 - RNA, 15 nt, Human
cauuuauucugcuca

SEQ ID NO: 1969219 - RNA, 16 nt, Human
cauuuaugguaaucau

SEQ ID NO: 1969220 - RNA, 19 nt, Human
cauuuaugguaaucauauu

SEQ ID NO: 1969221 - RNA, 20 nt, Human
cauuuaugguaaucauauua

SEQ ID NO: 1969222 - RNA, 22 nt, Human
cauuuaugguaaucauauuaga

SEQ ID NO: 1969223 - RNA, 21 nt, Human
cauuucaguaaaccugucuga

SEQ ID NO: 1969224 - RNA, 14 nt, Human
cauuucauccuuuc

SEQ ID NO: 1969225 - RNA, 17 nt, Human
cauuucauccuuucacu

SEQ ID NO: 1969226 - RNA, 16 nt, Human
cauuucauguccugug

SEQ ID NO: 1969227 - RNA, 17 nt, Human
cauuuggagggccuggg

SEQ ID NO: 1969228 - RNA, 18 nt, Human
cauuuggagggccugggc

SEQ ID NO: 1969229 - RNA, 15 nt, Human
cauuuggauuggaug

SEQ ID NO: 1969230 - RNA, 17 nt, Human
cauuugucacacacuuu

SEQ ID NO: 1969231 - RNA, 12 nt, Human
cauuugucauuu

SEQ ID NO: 1969232 - RNA, 14 nt, Human
cauuugucauuuuc

SEQ ID NO: 1969233 - RNA, 15 nt, Human
cauuugucauuuuca

SEQ ID NO: 1969234 - RNA, 17 nt, Human
cauuugucauuuucauu

SEQ ID NO: 1969235 - RNA, 18 nt, Human
cauuugucauuuucauua

SEQ ID NO: 1969236 - RNA, 20 nt, Human
cauuugucauuuucauuagc

SEQ ID NO: 1969237 - RNA, 16 nt, Human
cauuugugaaaugaug

SEQ ID NO: 1969238 - RNA, 14 nt, Human
cauuugugaaauga

SEQ ID NO: 1969239 - RNA, 15 nt, Human
cauuuuuuaaaugca

SEQ ID NO: 1969240 - RNA, 16 nt, Human
cauuuuuuaaaugcac

SEQ ID NO: 1969241 - RNA, 19 nt, Human
cauuuuuuaaaugcaccug

SEQ ID NO: 1969242 - RNA, 16 nt, Human
ccacacuucaggcucu

SEQ ID NO: 1969243 - RNA, 20 nt, Human
ccacacuucaggcucuucuc

SEQ ID NO: 1969244 - RNA, 21 nt, Human
ccacacuucaggcucuucucc

SEQ ID NO: 1969245 - RNA, 22 nt, Human
ccacagagaaaguacuucucca

SEQ ID NO: 1969246 - RNA, 13 nt, Human
ccacagaggacac

SEQ ID NO: 1969247 - RNA, 15 nt, Human
ccaccacgcccggcu

SEQ ID NO: 1969248 - RNA, 16 nt, Human
ccaccacgccuagccu

SEQ ID NO: 1969249 - RNA, 18 nt, Human
ccaccaucaugucuggcu

SEQ ID NO: 1969250 - RNA, 19 nt, Human
ccaccaucaugucuggcua

SEQ ID NO: 1969251 - RNA, 19 nt, Human
ccaccgggcugggagcucu

SEQ ID NO: 1969252 - RNA, 11 nt, Human
ccaccaucugc

SEQ ID NO: 1969253 - RNA, 13 nt, Human
ccaccaucugcug

SEQ ID NO: 1969254 - RNA, 14 nt, Human
ccaccaucugcugu

SEQ ID NO: 1969255 - RNA, 15 nt, Human
ccaccaucugcuguc

SEQ ID NO: 1969256 - RNA, 18 nt, Human
ccaccaucugcugucuuu

SEQ ID NO: 1969257 - RNA, 22 nt, Human
ccaccgggcugggagcucugca

SEQ ID NO: 1969258 - RNA, 12 nt, Human
ccaccuuggcug

SEQ ID NO: 1969259 - RNA, 14 nt, Human
ccaccuuggcugca

SEQ ID NO: 1969260 - RNA, 15 nt, Human
ccaccuuggcugcag

SEQ ID NO: 1969261 - RNA, 16 nt, Human
ccaccuuggcugcagg

SEQ ID NO: 1969262 - RNA, 13 nt, Human
ccacgcuggagug

SEQ ID NO: 1969263 - RNA, 19 nt, Human
ccacgcugacuacagggcc

SEQ ID NO: 1969264 - RNA, 20 nt, Human
ccacgcugacuacagggccg

SEQ ID NO: 1969265 - RNA, 18 nt, Human
ccacgcuggaccuugaac

SEQ ID NO: 1969266 - RNA, 15 nt, Human
ccacgccuagccuca

SEQ ID NO: 1969267 - RNA, 13 nt, Human
ccacgcugacuac

SEQ ID NO: 1969268 - RNA, 18 nt, Human
ccaccuuggcugcaggga

SEQ ID NO: 1969269 - RNA, 19 nt, Human
ccaccuuggcugcagggag

SEQ ID NO: 1969270 - RNA, 16 nt, Human
ccacgagagcgcagca

SEQ ID NO: 1969271 - RNA, 15 nt, Human
ccacgagagcgcagc

SEQ ID NO: 1969272 - RNA, 13 nt, Human
ccacgcccccacu

SEQ ID NO: 1969273 - RNA, 22 nt, Human
cugcuaguguucuuucucuuuc

SEQ ID NO: 1969274 - RNA, 22 nt, Human
cugccuguugggccaggagccu

SEQ ID NO: 1969275 - RNA, 21 nt, Human
cugccuguugggccaggagcc

SEQ ID NO: 1969276 - RNA, 23 nt, Human
cugccuguugggccaggagccuc

SEQ ID NO: 1969277 - RNA, 22 nt, Human
cugcucagggaaaagcagcucu

SEQ ID NO: 1969278 - RNA, 23 nt, Human
cugcucagggaaaagcagcucuc

SEQ ID NO: 1969279 - RNA, 21 nt, Human
cugcugacuguuuucucuuga

SEQ ID NO: 1969280 - RNA, 18 nt, Human
cugcugacuguuuucucu

SEQ ID NO: 1969281 - RNA, 20 nt, Human
cugccuccccucuccuuccu

SEQ ID NO: 1969282 - RNA, 20 nt, Human
cugaucugaugcaagcaaga

SEQ ID NO: 1969283 - RNA, 13 nt, Human
cugaucuguuaua

SEQ ID NO: 1969284 - RNA, 14 nt, Human
cugaucuguuauag

SEQ ID NO: 1969285 - RNA, 22 nt, Human
cugccucucccaucacuucccu

SEQ ID NO: 1969286 - RNA, 15 nt, Human
cugccucucccauca

SEQ ID NO: 1969287 - RNA, 23 nt, Human
cugccucucccaucacuucccua

SEQ ID NO: 1969288 - RNA, 23 nt, Human
cugccuccgcgugaucaaagcca

SEQ ID NO: 1969289 - RNA, 13 nt, Human
cugccuccucuuc

SEQ ID NO: 1969290 - RNA, 14 nt, Human
cugccuccucuuca

SEQ ID NO: 1969291 - RNA, 15 nt, Human
cugccuccucuucaa

SEQ ID NO: 1969292 - RNA, 24 nt, Human
cugccuccucuucaacugaccagc

SEQ ID NO: 1969293 - RNA, 17 nt, Human
cugccugguccucacac

SEQ ID NO: 1969294 - RNA, 19 nt, Human
cugccugguccucacacuc

SEQ ID NO: 1969295 - RNA, 23 nt, Human
cugccugguccucacacucaccc

SEQ ID NO: 1969296 - RNA, 17 nt, Human
cugccuguucagcucca

SEQ ID NO: 1969297 - RNA, 18 nt, Human
cugccuguucagcuccag

SEQ ID NO: 1969298 - RNA, 20 nt, Human
cugccuguugggccaggagc

SEQ ID NO: 1969299 - RNA, 19 nt, Human
cugccuguucagcuccagc

SEQ ID NO: 1969300 - RNA, 20 nt, Human
cugcuuuugucuaugggacu

SEQ ID NO: 1969301 - RNA, 23 nt, Human
cugcuucaaggauccugagccag

SEQ ID NO: 1969302 - RNA, 22 nt, Human
cugcuucaaggauccugagcca

SEQ ID NO: 1969303 - RNA, 21 nt, Human
cugcuucaaggauccugagcc

SEQ ID NO: 1969304 - RNA, 13 nt, Human
cugcuucaaggau

SEQ ID NO: 1969305 - RNA, 12 nt, Human
cugcuucaagga

SEQ ID NO: 1969306 - RNA, 19 nt, Human
cugcuucaaauauuucccu

SEQ ID NO: 1969307 - RNA, 14 nt, Human
cugcuucaaauauu

SEQ ID NO: 1969308 - RNA, 16 nt, Human
cuggaguuggggcaga

SEQ ID NO: 1969309 - RNA, 13 nt, Human
cuggauagugaag

SEQ ID NO: 1969310 - RNA, 14 nt, Human
cuggaagcacagcu

SEQ ID NO: 1969311 - RNA, 14 nt, Human
cuggacucuggacu

SEQ ID NO: 1969312 - RNA, 16 nt, Human
cuggacucuggacuuu

SEQ ID NO: 1969313 - RNA, 21 nt, Human
cuggacucuggacuuucucua

SEQ ID NO: 1969314 - RNA, 17 nt, Human
cuggaagagcuaggcag

SEQ ID NO: 1969315 - RNA, 19 nt, Human
cuggaagagcuaggcaggg

SEQ ID NO: 1969316 - RNA, 19 nt, Human
cugcuuuuuaaagaaugcu

SEQ ID NO: 1969317 - RNA, 21 nt, Human
cugcuuuugucuaugggacuc

SEQ ID NO: 1969318 - RNA, 14 nt, Human
cuggagaaaaauau

SEQ ID NO: 1969319 - RNA, 13 nt, Human
cuggacuuucucu

SEQ ID NO: 1969320 - RNA, 18 nt, Human
cuggacuuucucuaauaa

SEQ ID NO: 1969321 - RNA, 19 nt, Human
cuggacuuucucuaauaau

SEQ ID NO: 1969322 - RNA, 21 nt, Human
cuggacuuucucuaauaauaa

SEQ ID NO: 1969323 - RNA, 22 nt, Human
cuggacuuucucuaauaauaaa

SEQ ID NO: 1969324 - RNA, 13 nt, Human
cuggagaaaaaua

SEQ ID NO: 1969325 - RNA, 14 nt, Human
cuggagaaaaugga

SEQ ID NO: 1969326 - RNA, 13 nt, Human
cuggacuuggagg

SEQ ID NO: 1969327 - RNA, 20 nt, Human
cugggcaccggggccucgga

SEQ ID NO: 1969328 - RNA, 15 nt, Human
cugggcagaaggaag

SEQ ID NO: 1969329 - RNA, 12 nt, Human
cugggcagaagg

SEQ ID NO: 1969330 - RNA, 17 nt, Human
cugggcacugcucucac

SEQ ID NO: 1969331 - RNA, 18 nt, Human
cugggcacugcucucacc

SEQ ID NO: 1969332 - RNA, 19 nt, Human
cugggcacugcucucaccu

SEQ ID NO: 1969333 - RNA, 16 nt, Human
cuggggaugucucuca

SEQ ID NO: 1969334 - RNA, 17 nt, Human
cuggggaugucucucau

SEQ ID NO: 1969335 - RNA, 14 nt, Human
cuggggcagccucu

SEQ ID NO: 1969336 - RNA, 19 nt, Human
cuggggcagccucugggcc

SEQ ID NO: 1969337 - RNA, 14 nt, Human
cuggggagaaagua

SEQ ID NO: 1969338 - RNA, 20 nt, Human
cugggccaggggagguuaca

SEQ ID NO: 1969339 - RNA, 23 nt, Human
cuggggagaauggggcugggccc

SEQ ID NO: 1969340 - RNA, 14 nt, Human
cugggccagaauuu

SEQ ID NO: 1969341 - RNA, 12 nt, Human
cugggccagaau

SEQ ID NO: 1969342 - RNA, 15 nt, Human
cuggggccaggcugg

SEQ ID NO: 1969343 - RNA, 19 nt, Human
cuggggcauccaugggguc

SEQ ID NO: 1969344 - RNA, 17 nt, Human
cuggggcauccaugggg

SEQ ID NO: 1969345 - RNA, 15 nt, Human
cuggguucacugcaa

SEQ ID NO: 1969346 - RNA, 18 nt, Human
cuggguucacugcaaccu

SEQ ID NO: 1969347 - RNA, 20 nt, Human
cuggguucacugcaaccucc

SEQ ID NO: 1969348 - RNA, 18 nt, Human
cuggcagaguugaagaca

SEQ ID NO: 1969349 - RNA, 17 nt, Human
cuggcagaguugaagac

SEQ ID NO: 1969350 - RNA, 13 nt, Human
cuggcagccccug

SEQ ID NO: 1969351 - RNA, 19 nt, Human
cuggcagccgugccuucag

SEQ ID NO: 1969352 - RNA, 20 nt, Human
cuggcagccgugccuucagc

SEQ ID NO: 1969353 - RNA, 21 nt, Human
cuggcagccgugccuucagcu

SEQ ID NO: 1969354 - RNA, 22 nt, Human
cuggcagccgugccuucagcuc

SEQ ID NO: 1969355 - RNA, 12 nt, Human
cuggcagccccu

SEQ ID NO: 1969356 - RNA, 11 nt, Human
cuggcagccca

SEQ ID NO: 1969357 - RNA, 19 nt, Human
cuggcagaguugaagacag

SEQ ID NO: 1969358 - RNA, 14 nt, Human
cuggcagaggaggg

SEQ ID NO: 1969359 - RNA, 21 nt, Human
cuggcagcaccgccucuuccc

SEQ ID NO: 1969360 - RNA, 18 nt, Human
cugggaauaagugccagg

SEQ ID NO: 1969361 - RNA, 14 nt, Human
cugggaauguauag

SEQ ID NO: 1969362 - RNA, 11 nt, Human
cugggacacag

SEQ ID NO: 1969363 - RNA, 19 nt, Human
cugggaauguauaguauuu

SEQ ID NO: 1969364 - RNA, 20 nt, Human
cugggaauguauaguauuug

SEQ ID NO: 1969365 - RNA, 21 nt, Human
cugggaauguauaguauuuga

SEQ ID NO: 1969366 - RNA, 23 nt, Human
cugggaauguauaguauuugaaa

SEQ ID NO: 1969367 - RNA, 13 nt, Human
cugggacugggaa

SEQ ID NO: 1969368 - RNA, 18 nt, Human
cuggccccugagaucucu

SEQ ID NO: 1969369 - RNA, 22 nt, Human
cuggccccugagaucucugcag

SEQ ID NO: 1969370 - RNA, 23 nt, Human
cuggccccugagaucucugcagg

SEQ ID NO: 1969371 - RNA, 22 nt, Human
cuggccccucagggucccuggu

SEQ ID NO: 1969372 - RNA, 11 nt, Human
cuggcccugcc

SEQ ID NO: 1969373 - RNA, 13 nt, Human
cuggcccugcccu

SEQ ID NO: 1969374 - RNA, 14 nt, Human
cuggcccugcccug

SEQ ID NO: 1969375 - RNA, 21 nt, Human
cuggcccucucugaaggaggc

SEQ ID NO: 1969376 - RNA, 22 nt, Human
cuggcccucucugaaggaggcc

SEQ ID NO: 1969377 - RNA, 23 nt, Human
cuggcccucucugaaggaggcca

SEQ ID NO: 1969378 - RNA, 15 nt, Human
cuggcccugcccugg

SEQ ID NO: 1969379 - RNA, 16 nt, Human
cuggccgggagccuga

SEQ ID NO: 1969380 - RNA, 14 nt, Human
cuggccuagcauac

SEQ ID NO: 1969381 - RNA, 20 nt, Human
cuggccggugugggggcccc

SEQ ID NO: 1969382 - RNA, 20 nt, Human
cuuagggaagcuggccugag

SEQ ID NO: 1969383 - RNA, 13 nt, Human
cuuagggaagcug

SEQ ID NO: 1969384 - RNA, 17 nt, Human
cuuagggaagcuggccu

SEQ ID NO: 1969385 - RNA, 21 nt, Human
cuuagggaaggauacaaaagc

SEQ ID NO: 1969386 - RNA, 19 nt, Human
cuuagggaaggauacaaaa

SEQ ID NO: 1969387 - RNA, 15 nt, Human
cuuaggccagcacca

SEQ ID NO: 1969388 - RNA, 23 nt, Human
cuuaggcaauggugaacugucau

SEQ ID NO: 1969389 - RNA, 23 nt, Human
cuuagcucauucuccuuguguua

SEQ ID NO: 1969390 - RNA, 13 nt, Human
cuuagcugggaga

SEQ ID NO: 1969391 - RNA, 14 nt, Human
cuuagcuggagaug

SEQ ID NO: 1969392 - RNA, 16 nt, Human
cuuaccagcagagcac

SEQ ID NO: 1969393 - RNA, 22 nt, Human
cuuagcucauucuccuuguguu

SEQ ID NO: 1969394 - RNA, 14 nt, Human
cuuagccuuucuuu

SEQ ID NO: 1969395 - RNA, 14 nt, Human
cuguuauucuuugc

SEQ ID NO: 1969396 - RNA, 15 nt, Human
cuguuauucuuugca

SEQ ID NO: 1969397 - RNA, 16 nt, Human
cuguuauucuuugcac

SEQ ID NO: 1969398 - RNA, 14 nt, Human
cuguuggcuggggg

SEQ ID NO: 1969399 - RNA, 19 nt, Human
cuguuggcugggggccuca

SEQ ID NO: 1969400 - RNA, 22 nt, Human
cuguuggcugggggccucagug

SEQ ID NO: 1969401 - RNA, 22 nt, Human
cuguuguauaaauuuauuuacu

SEQ ID NO: 1969402 - RNA, 21 nt, Human
cuuaaaaaugguuuaaauggu

SEQ ID NO: 1969403 - RNA, 14 nt, Human
cuguuuaagagaca

SEQ ID NO: 1969404 - RNA, 12 nt, Human
cuguuuaagaga

SEQ ID NO: 1969405 - RNA, 11 nt, Human
cuguuuaaauu

SEQ ID NO: 1969406 - RNA, 14 nt, Human
cuguuuaaauugcu

SEQ ID NO: 1969407 - RNA, 21 nt, Human
cuguuuaaauugcucacaguu

SEQ ID NO: 1969408 - RNA, 18 nt, Human
cuguuuaagacacuuccg

SEQ ID NO: 1969409 - RNA, 15 nt, Human
cuuaccagcagagca

SEQ ID NO: 1969410 - RNA, 20 nt, Human
cuuacaaaugauugcuuuua

SEQ ID NO: 1969411 - RNA, 21 nt, Human
cuuacaaaugauugcuuuuaa

SEQ ID NO: 1969412 - RNA, 22 nt, Human
cuuacaaaugauugcuuuuaaa

SEQ ID NO: 1969413 - RNA, 21 nt, Human
cuuacauuagcaguuugcuuu

SEQ ID NO: 1969414 - RNA, 22 nt, Human
cuuacauuagcaguuugcuuug

SEQ ID NO: 1969415 - RNA, 14 nt, Human
cuuaaaacaacacu

SEQ ID NO: 1969416 - RNA, 13 nt, Human
cuuaaaacaucau

SEQ ID NO: 1969417 - RNA, 17 nt, Human
cuuaaaacaucauuccu

SEQ ID NO: 1969418 - RNA, 18 nt, Human
cuuaaaacaucauuccuu

SEQ ID NO: 1969419 - RNA, 18 nt, Human
cuuacaaaugauugcuuu

SEQ ID NO: 1969420 - RNA, 16 nt, Human
cuuacaaaugauugcu

SEQ ID NO: 1969421 - RNA, 19 nt, Human
cuuaaaacaucauuccuuu

SEQ ID NO: 1969422 - RNA, 20 nt, Human
cuuaaaacaucauuccuuuu

SEQ ID NO: 1969423 - RNA, 22 nt, Human
cuggugacaugucuuuucuugc

SEQ ID NO: 1969424 - RNA, 19 nt, Human
cuggucuuugagcucccac

SEQ ID NO: 1969425 - RNA, 12 nt, Human
cuggucuuugag

SEQ ID NO: 1969426 - RNA, 18 nt, Human
cuggucuuugagcuccca

SEQ ID NO: 1969427 - RNA, 13 nt, Human
cugguuuccugcc

SEQ ID NO: 1969428 - RNA, 14 nt, Human
cugguuuccugccc

SEQ ID NO: 1969429 - RNA, 14 nt, Human
cuguaacaguucuu

SEQ ID NO: 1969430 - RNA, 18 nt, Human
cuguaacaguucuuuuug

SEQ ID NO: 1969431 - RNA, 15 nt, Human
cuguaacgugugcug

SEQ ID NO: 1969432 - RNA, 16 nt, Human
cuguaacgugugcugu

SEQ ID NO: 1969433 - RNA, 12 nt, Human
cuguaacugucc

SEQ ID NO: 1969434 - RNA, 13 nt, Human
cuguagaguggga

SEQ ID NO: 1969435 - RNA, 15 nt, Human
cugucgcccagucug

SEQ ID NO: 1969436 - RNA, 16 nt, Human
cugucgcccagucugg

SEQ ID NO: 1969437 - RNA, 17 nt, Human
cuguccuccaagccagc

SEQ ID NO: 1969438 - RNA, 22 nt, Human
cugucaucugagaaugaacaaa

SEQ ID NO: 1969439 - RNA, 15 nt, Human
cuguccuccaagcca

SEQ ID NO: 1969440 - RNA, 19 nt, Human
cugucaucugagaaugaac

SEQ ID NO: 1969441 - RNA, 15 nt, Human
cugucaucugagaau

SEQ ID NO: 1969442 - RNA, 16 nt, Human
cugucaucugagaaug

SEQ ID NO: 1969443 - RNA, 17 nt, Human
cugucaucugagaauga

SEQ ID NO: 1969444 - RNA, 21 nt, Human
cuguccugggagugagcuggu

SEQ ID NO: 1969445 - RNA, 22 nt, Human
cugucaguuaugacauccacaa

SEQ ID NO: 1969446 - RNA, 23 nt, Human
cugucaauuacaggaaguacugg

SEQ ID NO: 1969447 - RNA, 20 nt, Human
cugucaauuacaggaaguac

SEQ ID NO: 1969448 - RNA, 19 nt, Human
cugucaauuacaggaagua

SEQ ID NO: 1969449 - RNA, 16 nt, Human
cugugccuuuugccau

SEQ ID NO: 1969450 - RNA, 14 nt, Human
cugugcugcccugc

SEQ ID NO: 1969451 - RNA, 13 nt, Human
cugugcugcccug

SEQ ID NO: 1969452 - RNA, 12 nt, Human
cugugcugcccu

SEQ ID NO: 1969453 - RNA, 20 nt, Human
cugugccuuuuuuauaucuu

SEQ ID NO: 1969454 - RNA, 20 nt, Human
cugugcgcauaggccugcuu

SEQ ID NO: 1969455 - RNA, 21 nt, Human
cugugcgcauaggccugcuuu

SEQ ID NO: 1969456 - RNA, 19 nt, Human
cugugcugcccugcccacc

SEQ ID NO: 1969457 - RNA, 18 nt, Human
cugugcugcccugcccac

SEQ ID NO: 1969458 - RNA, 17 nt, Human
cugugcugcccugccca

SEQ ID NO: 1969459 - RNA, 15 nt, Human
cugugcugcccugcc

SEQ ID NO: 1969460 - RNA, 19 nt, Human
cugugucagcauagaagua

SEQ ID NO: 1969461 - RNA, 17 nt, Human
cugugucagcauagaag

SEQ ID NO: 1969462 - RNA, 21 nt, Human
cugugcugcccugcccaccug

SEQ ID NO: 1969463 - RNA, 17 nt, Human
cuguuagugcacugauu

SEQ ID NO: 1969464 - RNA, 15 nt, Human
cuguguccggcccag

SEQ ID NO: 1969465 - RNA, 17 nt, Human
cuuucuaaugugugaau

SEQ ID NO: 1969466 - RNA, 15 nt, Human
cuuucuacccagcga

SEQ ID NO: 1969467 - RNA, 16 nt, Human
cuuucuacccagcgag

SEQ ID NO: 1969468 - RNA, 14 nt, Human
cuuugaccuguugg

SEQ ID NO: 1969469 - RNA, 17 nt, Human
cuuugacgccaucccag

SEQ ID NO: 1969470 - RNA, 16 nt, Human
cuuugacgccauccca

SEQ ID NO: 1969471 - RNA, 16 nt, Human
cuuuguauucugucuu

SEQ ID NO: 1969472 - RNA, 19 nt, Human
cuuuguauucugucuucau

SEQ ID NO: 1969473 - RNA, 20 nt, Human
cuuuuauaaacuuuaccuuu

SEQ ID NO: 1969474 - RNA, 21 nt, Human
cuuuuauaaacuuuaccuuuu

SEQ ID NO: 1969475 - RNA, 19 nt, Human
cuuuuauaaacuuuaccuu

SEQ ID NO: 1969476 - RNA, 19 nt, Human
cuuuguacagagugcuuuu

SEQ ID NO: 1969477 - RNA, 22 nt, Human
cuuuguauucucuccuguaccu

SEQ ID NO: 1969478 - RNA, 17 nt, Human
cuuuguauucucuccug

SEQ ID NO: 1969479 - RNA, 12 nt, Human
cuuuguaugcac

SEQ ID NO: 1969480 - RNA, 22 nt, Human
cuuuguacacccaugaaagaaa

SEQ ID NO: 1969481 - RNA, 15 nt, Human
cuuuguacagagugc

SEQ ID NO: 1969482 - RNA, 16 nt, Human
cuuuguaaugaaaacc

SEQ ID NO: 1969483 - RNA, 20 nt, Human
cuuuguacacccaugaaaga

SEQ ID NO: 1969484 - RNA, 21 nt, Human
cuuugguucuggguuguuucc

SEQ ID NO: 1969485 - RNA, 15 nt, Human
cuuuguaaugaaaac

SEQ ID NO: 1969486 - RNA, 14 nt, Human
cuuuguaaugaaaa

SEQ ID NO: 1969487 - RNA, 15 nt, Human
cuuugcaaaggagcu

SEQ ID NO: 1969488 - RNA, 16 nt, Human
cuuugcaaaggagcuc

SEQ ID NO: 1969489 - RNA, 14 nt, Human
cuuucagcaggcag

SEQ ID NO: 1969490 - RNA, 15 nt, Human
cuuucagcaggcagc

SEQ ID NO: 1969491 - RNA, 16 nt, Human
cuuucagcaggcagcc

SEQ ID NO: 1969492 - RNA, 18 nt, Human
cuuucagcaggcagccuu

SEQ ID NO: 1969493 - RNA, 20 nt, Human
cuuucacccuuuucuguuug

SEQ ID NO: 1969494 - RNA, 15 nt, Human
cuuucacccuuuucu

SEQ ID NO: 1969495 - RNA, 14 nt, Human
cuuucacccuuuuc

SEQ ID NO: 1969496 - RNA, 23 nt, Human
cuuuaaugucacaggcaggucca

SEQ ID NO: 1969497 - RNA, 15 nt, Human
cuuuaauuccaugaa

SEQ ID NO: 1969498 - RNA, 16 nt, Human
cuuuaauuccaugaau

SEQ ID NO: 1969499 - RNA, 23 nt, Human
cuuuaauuccaugaauguuccug

SEQ ID NO: 1969500 - RNA, 22 nt, Human
cuuuaauuaaaaccugggauua

SEQ ID NO: 1969501 - RNA, 13 nt, Human
cuuuaauuuuagc

SEQ ID NO: 1969502 - RNA, 13 nt, Human
cuuggggucaggu

SEQ ID NO: 1969503 - RNA, 22 nt, Human
cuuggggucagguugacaggag

SEQ ID NO: 1969504 - RNA, 19 nt, Human
cuuggucugugagaugcua

SEQ ID NO: 1969505 - RNA, 17 nt, Human
cuuggucacagccaggc

SEQ ID NO: 1969506 - RNA, 16 nt, Human
cuuggucugugagaug

SEQ ID NO: 1969507 - RNA, 14 nt, Human
cuugguccugcugc

SEQ ID NO: 1969508 - RNA, 22 nt, Human
cuugguagaagcccuucuaccu

SEQ ID NO: 1969509 - RNA, 16 nt, Human
cuuggucacagccagg

SEQ ID NO: 1969510 - RNA, 20 nt, Human
cuuggugucgggcaugacac

SEQ ID NO: 1969511 - RNA, 19 nt, Human
cuuggugucgggcaugaca

SEQ ID NO: 1969512 - RNA, 19 nt, Human
cuuggugccuaauguucca

SEQ ID NO: 1969513 - RNA, 17 nt, Human
cuuggugccucugcagu

SEQ ID NO: 1969514 - RNA, 14 nt, Human
cuugucggcuccag

SEQ ID NO: 1969515 - RNA, 16 nt, Human
cuugucggcuccaguc

SEQ ID NO: 1969516 - RNA, 19 nt, Human
cuugucuuuggacccugag

SEQ ID NO: 1969517 - RNA, 18 nt, Human
cuugucuuuggacccuga

SEQ ID NO: 1969518 - RNA, 15 nt, Human
cuugucuuuggaccc

SEQ ID NO: 1969519 - RNA, 13 nt, Human
cuugucuuuggac

SEQ ID NO: 1969520 - RNA, 15 nt, Human
cuugucuuucugggg

SEQ ID NO: 1969521 - RNA, 16 nt, Human
cuugucuuucuggggu

SEQ ID NO: 1969522 - RNA, 21 nt, Human
cuugugaaaauaauugacagg

SEQ ID NO: 1969523 - RNA, 14 nt, Human
cuucuucagagacu

SEQ ID NO: 1969524 - RNA, 13 nt, Human
cuucuucagagac

SEQ ID NO: 1969525 - RNA, 16 nt, Human
cuucucuuccaggcag

SEQ ID NO: 1969526 - RNA, 17 nt, Human
cuucucuuccaggcagc

SEQ ID NO: 1969527 - RNA, 13 nt, Human
cuuccuccuggug

SEQ ID NO: 1969528 - RNA, 14 nt, Human
cuuccucugagccu

SEQ ID NO: 1969529 - RNA, 15 nt, Human
cuuccucugagccuu

SEQ ID NO: 1969530 - RNA, 13 nt, Human
cuuccucuccacu

SEQ ID NO: 1969531 - RNA, 14 nt, Human
cuuccucuccacug

SEQ ID NO: 1969532 - RNA, 15 nt, Human
cuuccucuccacugc

SEQ ID NO: 1969533 - RNA, 21 nt, Human
cuuccucuuuccaucuacccu

SEQ ID NO: 1969534 - RNA, 16 nt, Human
cuuccucugaggcuga

SEQ ID NO: 1969535 - RNA, 22 nt, Human
cuuccucuuuccaucuacccuc

SEQ ID NO: 1969536 - RNA, 22 nt, Human
cuuccucugaggcugaaauuca

SEQ ID NO: 1969537 - RNA, 13 nt, Human
cuucucacauuua

SEQ ID NO: 1969538 - RNA, 20 nt, Human
cuucucacauuuauauuuuu

SEQ ID NO: 1969539 - RNA, 13 nt, Human
cuuccugagggga

SEQ ID NO: 1969540 - RNA, 21 nt, Human
cuuccugaggggagacagagc

SEQ ID NO: 1969541 - RNA, 22 nt, Human
cuuccugaggggagacagagca

SEQ ID NO: 1969542 - RNA, 12 nt, Human
cuugauucauaa

SEQ ID NO: 1969543 - RNA, 16 nt, Human
cuugauuugagauuuu

SEQ ID NO: 1969544 - RNA, 16 nt, Human
cuugcaaaauuccuga

SEQ ID NO: 1969545 - RNA, 13 nt, Human
cuugauuuuccau

SEQ ID NO: 1969546 - RNA, 14 nt, Human
cuugauuuuccauc

SEQ ID NO: 1969547 - RNA, 22 nt, Human
cuugauuuuccaucuaaaaaua

SEQ ID NO: 1969548 - RNA, 23 nt, Human
cuugauuuuccaucuaaaaauau

SEQ ID NO: 1969549 - RNA, 12 nt, Human
cuugcaaaguau

SEQ ID NO: 1969550 - RNA, 17 nt, Human
cuugcaaaauuccugac

SEQ ID NO: 1969551 - RNA, 22 nt, Human
cuugcuaccacggccuccuuuc

SEQ ID NO: 1969552 - RNA, 13 nt, Human
cuuggccucagag

SEQ ID NO: 1969553 - RNA, 17 nt, Human
cuugcucccugacuggg

SEQ ID NO: 1969554 - RNA, 20 nt, Human
cuuggcaauaaauuuugaaa

SEQ ID NO: 1969555 - RNA, 22 nt, Human
cuuggcaauaaauuuugaaaag

SEQ ID NO: 1969556 - RNA, 21 nt, Human
cuuggcaauaaauuuugaaaa

SEQ ID NO: 1969557 - RNA, 20 nt, Human
cuuggccucacccucuggcu

SEQ ID NO: 1969558 - RNA, 24 nt, Human
cuuggauuguccccgacccuugcc

SEQ ID NO: 1969559 - RNA, 23 nt, Human
cuuggauuguccccgacccuugc

SEQ ID NO: 1969560 - RNA, 15 nt, Human
cuugcucccugacug

SEQ ID NO: 1969561 - RNA, 21 nt, Human
cuugaauggcaauguuuugcu

SEQ ID NO: 1969562 - RNA, 23 nt, Human
cuugaauggcaauguuuugcuuu

SEQ ID NO: 1969563 - RNA, 15 nt, Human
cuugaauuaagaaga

SEQ ID NO: 1969564 - RNA, 16 nt, Human
cuugacaucaacugca

SEQ ID NO: 1969565 - RNA, 20 nt, Human
cuugauuaagaucucagugg

SEQ ID NO: 1969566 - RNA, 18 nt, Human
cuugauguguuaucucuu

SEQ ID NO: 1969567 - RNA, 22 nt, Human
cuugaucaguaguuugcauuuc

SEQ ID NO: 1969568 - RNA, 20 nt, Human
cuugaucaguaguuugcauu

SEQ ID NO: 1969569 - RNA, 21 nt, Human
cuugaucaguaguuugcauuu

SEQ ID NO: 1969570 - RNA, 18 nt, Human
cuugaucaguaguuugca

SEQ ID NO: 1969571 - RNA, 23 nt, Human
cuugauauuuguauuuauucuuu

SEQ ID NO: 1969572 - RNA, 13 nt, Human
cuugauauuugua

SEQ ID NO: 1969573 - RNA, 14 nt, Human
cuugauauuuguau

SEQ ID NO: 1969574 - RNA, 16 nt, Human
cuugauauuuguauuu

SEQ ID NO: 1969575 - RNA, 18 nt, Human
cuugauauuuguauuuau

SEQ ID NO: 1969576 - RNA, 17 nt, Human
cuugauauccucuuuga

SEQ ID NO: 1969577 - RNA, 22 nt, Human
cuugauauccucuuugagugaa

SEQ ID NO: 1969578 - RNA, 22 nt, Human
gaaaaaaaugucaaaaguagaa

SEQ ID NO: 1969579 - RNA, 22 nt, Human
gaaaaaaccguguuugucucuu

SEQ ID NO: 1969580 - RNA, 10 nt, Human
gaaaaaagag

SEQ ID NO: 1969581 - RNA, 16 nt, Human
gaaaaaagagaaaaga

SEQ ID NO: 1969582 - RNA, 21 nt, Human
gaaaacuuuaugcuaagugaa

SEQ ID NO: 1969583 - RNA, 18 nt, Human
gaaaacuuguauuaugug

SEQ ID NO: 1969584 - RNA, 23 nt, Human
gaaaagaaaaaugagccuggcaa

SEQ ID NO: 1969585 - RNA, 22 nt, Human
gaaaacuuguauuauguguguu

SEQ ID NO: 1969586 - RNA, 19 nt, Human
gaaaacuuguauuaugugu

SEQ ID NO: 1969587 - RNA, 23 nt, Human
gaaaaaaguuguaggcgaaucau

SEQ ID NO: 1969588 - RNA, 14 nt, Human
gaaaaaaguuguag

SEQ ID NO: 1969589 - RNA, 22 nt, Human
gaaaaaaguuguaggcgaauca

SEQ ID NO: 1969590 - RNA, 17 nt, Human
gaaaaaagagaaaagaa

SEQ ID NO: 1969591 - RNA, 18 nt, Human
gaaaaaagagaaaagaaa

SEQ ID NO: 1969592 - RNA, 22 nt, Human
gaaaagaaaucuaugauuccag

SEQ ID NO: 1969593 - RNA, 13 nt, Human
gaaaagaaaucua

SEQ ID NO: 1969594 - RNA, 14 nt, Human
gaaaagaaacucua

SEQ ID NO: 1969595 - RNA, 22 nt, Human
gaaaagaaacucuauggucuua

SEQ ID NO: 1969596 - RNA, 21 nt, Human
gaaaagaaaucuauagaaagu

SEQ ID NO: 1969597 - RNA, 22 nt, Human
gaaaagaaaucuauagaaagug

SEQ ID NO: 1969598 - RNA, 23 nt, Human
gaaaagaaaucuauagaaagugu

SEQ ID NO: 1969599 - RNA, 24 nt, Human
gaaaagaaaucuauagaaaguguu

SEQ ID NO: 1969600 - RNA, 14 nt, Human
gaaaagaauagaag

SEQ ID NO: 1969601 - RNA, 17 nt, Human
gaaaagacuaagaucgg

SEQ ID NO: 1969602 - RNA, 15 nt, Human
gaaaauguucuucca

SEQ ID NO: 1969603 - RNA, 21 nt, Human
gaaaagauguagauuuauuuc

SEQ ID NO: 1969604 - RNA, 14 nt, Human
gaaaagauguagau

SEQ ID NO: 1969605 - RNA, 17 nt, Human
gaaaagauguagauuua

SEQ ID NO: 1969606 - RNA, 18 nt, Human
gaaaagauguagauuuau

SEQ ID NO: 1969607 - RNA, 19 nt, Human
gaaaagauguagauuuauu

SEQ ID NO: 1969608 - RNA, 12 nt, Human
gaaaaugugugu

SEQ ID NO: 1969609 - RNA, 15 nt, Human
gaaaaugugugugug

SEQ ID NO: 1969610 - RNA, 21 nt, Human
gaaacaagucagucauucaga

SEQ ID NO: 1969611 - RNA, 21 nt, Human
gaaacaacagcuuuaaaagaa

SEQ ID NO: 1969612 - RNA, 15 nt, Human
gaaacaacagcuuua

SEQ ID NO: 1969613 - RNA, 24 nt, Human
gaaacaaagcauuugacuuucugu

SEQ ID NO: 1969614 - RNA, 13 nt, Human
gaaacuggauuaa

SEQ ID NO: 1969615 - RNA, 17 nt, Human
gaaacuggauuaaacuu

SEQ ID NO: 1969616 - RNA, 18 nt, Human
gaaagaaaaucaggcugg

SEQ ID NO: 1969617 - RNA, 22 nt, Human
gaaacuggaaauacuagauuug

SEQ ID NO: 1969618 - RNA, 15 nt, Human
gaaaggcuccaggag

SEQ ID NO: 1969619 - RNA, 14 nt, Human
gaaaggcuccagga

SEQ ID NO: 1969620 - RNA, 13 nt, Human
gaaaggcuccagg

SEQ ID NO: 1969621 - RNA, 13 nt, Human
gaaagaaagagga

SEQ ID NO: 1969622 - RNA, 15 nt, Human
gaaagaaagaggaaa

SEQ ID NO: 1969623 - RNA, 16 nt, Human
gaaaggcuccaggagc

SEQ ID NO: 1969624 - RNA, 20 nt, Human
gaaagaacgcugauuuaaag

SEQ ID NO: 1969625 - RNA, 13 nt, Human
gaaagggcccaga

SEQ ID NO: 1969626 - RNA, 14 nt, Human
gaacaaaucuuccu

SEQ ID NO: 1969627 - RNA, 16 nt, Human
gaacaaagaccaauuu

SEQ ID NO: 1969628 - RNA, 13 nt, Human
gaacaaaucuucc

SEQ ID NO: 1969629 - RNA, 20 nt, Human
gaacaaguugagcuaugacu

SEQ ID NO: 1969630 - RNA, 21 nt, Human
gaacaaguugagcuaugacuu

SEQ ID NO: 1969631 - RNA, 22 nt, Human
gaacaaguugagcuaugacuua

SEQ ID NO: 1969632 - RNA, 22 nt, Human
gaacacauuucuuuuuaaaaaa

SEQ ID NO: 1969633 - RNA, 23 nt, Human
gaacacauuucuuuuuaaaaaaa

SEQ ID NO: 1969634 - RNA, 17 nt, Human
gaacacauaauucagga

SEQ ID NO: 1969635 - RNA, 20 nt, Human
gaacacauaauucaggaagc

SEQ ID NO: 1969636 - RNA, 11 nt, Human
gaaaugaaaaa

SEQ ID NO: 1969637 - RNA, 15 nt, Human
gaaaucucuuugccc

SEQ ID NO: 1969638 - RNA, 23 nt, Human
gaaaucugaggaauggacauuuc

SEQ ID NO: 1969639 - RNA, 16 nt, Human
gaacaaaauaaauugg

SEQ ID NO: 1969640 - RNA, 14 nt, Human
gaacaaaauaaauu

SEQ ID NO: 1969641 - RNA, 15 nt, Human
gaacaaaauaaauug

SEQ ID NO: 1969642 - RNA, 17 nt, Human
gaaaggggauuacaguu

SEQ ID NO: 1969643 - RNA, 20 nt, Human
gaaaucuaugauuccaggug

SEQ ID NO: 1969644 - RNA, 19 nt, Human
gaaaucuauagaaaguguu

SEQ ID NO: 1969645 - RNA, 23 nt, Human
gaaaucuauagaaaguguucugu

SEQ ID NO: 1969646 - RNA, 18 nt, Human
gaaaucuaugauuccagg

SEQ ID NO: 1969647 - RNA, 14 nt, Human
gaaaucuauagaaa

SEQ ID NO: 1969648 - RNA, 15 nt, Human
gaaagggcccagaga

SEQ ID NO: 1969649 - RNA, 16 nt, Human
gaaagggcccagagag

SEQ ID NO: 1969650 - RNA, 18 nt, Human
gaaccaccacacccagcc

SEQ ID NO: 1969651 - RNA, 20 nt, Human
gaaccaccacacccagccca

SEQ ID NO: 1969652 - RNA, 21 nt, Human
gaaccaccacacccagcccac

SEQ ID NO: 1969653 - RNA, 22 nt, Human
gaaccaccacacccagcccacu

SEQ ID NO: 1969654 - RNA, 13 nt, Human
gaagacagcucuu

SEQ ID NO: 1969655 - RNA, 12 nt, Human
gaagacagcucu

SEQ ID NO: 1969656 - RNA, 15 nt, Human
gaagacagagcuaca

SEQ ID NO: 1969657 - RNA, 13 nt, Human
gaagacagagcua

SEQ ID NO: 1969658 - RNA, 21 nt, Human
gaagacacugaugggcaaccc

SEQ ID NO: 1969659 - RNA, 17 nt, Human
gaacugcagucacugca

SEQ ID NO: 1969660 - RNA, 16 nt, Human
gaagacacugaugggc

SEQ ID NO: 1969661 - RNA, 20 nt, Human
gaagaccuaaccagggccag

SEQ ID NO: 1969662 - RNA, 23 nt, Human
gaagaccuaaccagggccagaag

SEQ ID NO: 1969663 - RNA, 13 nt, Human
gaagaccuaacca

SEQ ID NO: 1969664 - RNA, 18 nt, Human
gaagaccuaaccagggcc

SEQ ID NO: 1969665 - RNA, 15 nt, Human
gaagacagcucuuau

SEQ ID NO: 1969666 - RNA, 14 nt, Human
gaagacagcucuua

SEQ ID NO: 1969667 - RNA, 17 nt, Human
gaagcagguuaaauguu

SEQ ID NO: 1969668 - RNA, 18 nt, Human
gaagcagguuaaauguuu

SEQ ID NO: 1969669 - RNA, 19 nt, Human
gaagcagguuaaauguuuu

SEQ ID NO: 1969670 - RNA, 19 nt, Human
gaagcaggugugagggcag

SEQ ID NO: 1969671 - RNA, 15 nt, Human
gaagcagguuaaaug

SEQ ID NO: 1969672 - RNA, 16 nt, Human
gaagcagguuaaaugu

SEQ ID NO: 1969673 - RNA, 16 nt, Human
gaagcaccauaacuuu

SEQ ID NO: 1969674 - RNA, 21 nt, Human
gaagcacaugccucucucagg

SEQ ID NO: 1969675 - RNA, 22 nt, Human
gaagcacaugccucucucaggc

SEQ ID NO: 1969676 - RNA, 17 nt, Human
gaagcacagugaucaag

SEQ ID NO: 1969677 - RNA, 14 nt, Human
gaagcacaugccuc

SEQ ID NO: 1969678 - RNA, 13 nt, Human
gaagcacagcuuc

SEQ ID NO: 1969679 - RNA, 14 nt, Human
gaagcacagcuuca

SEQ ID NO: 1969680 - RNA, 17 nt, Human
gaagacucauucuucug

SEQ ID NO: 1969681 - RNA, 18 nt, Human
gaagacucauucuucugu

SEQ ID NO: 1969682 - RNA, 16 nt, Human
gaagacucauucuucu

SEQ ID NO: 1969683 - RNA, 17 nt, Human
gaacugauguaaguaaa

SEQ ID NO: 1969684 - RNA, 15 nt, Human
gaacugagcuuggaa

SEQ ID NO: 1969685 - RNA, 16 nt, Human
gaacugagcuuggaag

SEQ ID NO: 1969686 - RNA, 21 nt, Human
gaacugagcuuggaagcuucu

SEQ ID NO: 1969687 - RNA, 22 nt, Human
gaacugagcuuggaagcuucug

SEQ ID NO: 1969688 - RNA, 14 nt, Human
gaacugagcuugga

SEQ ID NO: 1969689 - RNA, 19 nt, Human
gaacucuucucauuacuug

SEQ ID NO: 1969690 - RNA, 15 nt, Human
gaacucuugacagcu

SEQ ID NO: 1969691 - RNA, 22 nt, Human
gaacugaaaggcuuuucaacca

SEQ ID NO: 1969692 - RNA, 17 nt, Human
gaacccgggaggcagag

SEQ ID NO: 1969693 - RNA, 19 nt, Human
gaacccgggaggcagaggu

SEQ ID NO: 1969694 - RNA, 14 nt, Human
gaacuccugaccuc

SEQ ID NO: 1969695 - RNA, 13 nt, Human
gaacuccuggccu

SEQ ID NO: 1969696 - RNA, 15 nt, Human
gaacuccuggccuca

SEQ ID NO: 1969697 - RNA, 14 nt, Human
gaacuccuggccuc

SEQ ID NO: 1969698 - RNA, 12 nt, Human
gaacucuuccuc

SEQ ID NO: 1969699 - RNA, 22 nt, Human
gaacucuuccuccaaggacaga

SEQ ID NO: 1969700 - RNA, 14 nt, Human
gaacucuucucauu

SEQ ID NO: 1969701 - RNA, 17 nt, Human
gaacucuucucauuacu

SEQ ID NO: 1969702 - RNA, 23 nt, Human
gaaccaccacacccagcccacuu

SEQ ID NO: 1969703 - RNA, 13 nt, Human
gaaccacuuguag

SEQ ID NO: 1969704 - RNA, 14 nt, Human
gaaccacuuguaga

SEQ ID NO: 1969705 - RNA, 20 nt, Human
gaaccacuuguagauuugau

SEQ ID NO: 1969706 - RNA, 15 nt, Human
gaaccacuuguagau

SEQ ID NO: 1969707 - RNA, 18 nt, Human
gaaccacuuguagauuug

SEQ ID NO: 1969708 - RNA, 22 nt, Human
gaaccauaguugacaguuccaa

SEQ ID NO: 1969709 - RNA, 22 nt, Human
gaaccauggucggaaaacaugc

SEQ ID NO: 1969710 - RNA, 14 nt, Human
gaaccauaaaaugu

SEQ ID NO: 1969711 - RNA, 18 nt, Human
gaaccauaaaauguccag

SEQ ID NO: 1969712 - RNA, 19 nt, Human
gaaccauaaaauguccagu

SEQ ID NO: 1969713 - RNA, 20 nt, Human
gaaccauaguuacuguaaaa

SEQ ID NO: 1969714 - RNA, 21 nt, Human
gaaccauaguuacuguaaaau

SEQ ID NO: 1969715 - RNA, 23 nt, Human
gaaccauaguuacuguaaaaugc

SEQ ID NO: 1969716 - RNA, 18 nt, Human
gaaccccuggcuccaggc

SEQ ID NO: 1969717 - RNA, 22 nt, Human
gaaccccuggcuccaggccagg

SEQ ID NO: 1969718 - RNA, 17 nt, Human
gagaagcggcuggcagc

SEQ ID NO: 1969719 - RNA, 23 nt, Human
gacuuuucuguccgagcuuugaa

SEQ ID NO: 1969720 - RNA, 21 nt, Human
gacuuuucuguccgagcuuug

SEQ ID NO: 1969721 - RNA, 17 nt, Human
gacuuuuccaauaugug

SEQ ID NO: 1969722 - RNA, 22 nt, Human
gacuuuuccaauaugugauuuu

SEQ ID NO: 1969723 - RNA, 22 nt, Human
gacuuuguuaguuucuccaagc

SEQ ID NO: 1969724 - RNA, 14 nt, Human
gacuuuggaaagag

SEQ ID NO: 1969725 - RNA, 14 nt, Human
gacuuuggaaagac

SEQ ID NO: 1969726 - RNA, 18 nt, Human
gacuuugaaaauauauac

SEQ ID NO: 1969727 - RNA, 18 nt, Human
gacuuugaugucagcagu

SEQ ID NO: 1969728 - RNA, 22 nt, Human
gacuuugaugucagcaguugcu

SEQ ID NO: 1969729 - RNA, 18 nt, Human
gacuguuuucucuugaga

SEQ ID NO: 1969730 - RNA, 16 nt, Human
gacuguuuucucuuga

SEQ ID NO: 1969731 - RNA, 14 nt, Human
gacucaaugcacug

SEQ ID NO: 1969732 - RNA, 17 nt, Human
gacucaaugcacugaca

SEQ ID NO: 1969733 - RNA, 22 nt, Human
gacuguacaaaguagaagucuu

SEQ ID NO: 1969734 - RNA, 16 nt, Human
gacuguacuccuccca

SEQ ID NO: 1969735 - RNA, 17 nt, Human
gacuguacuccucccag

SEQ ID NO: 1969736 - RNA, 20 nt, Human
gacugugugcucaggagccc

SEQ ID NO: 1969737 - RNA, 17 nt, Human
gacugugugcucaggag

SEQ ID NO: 1969738 - RNA, 16 nt, Human
gacugugugcucagga

SEQ ID NO: 1969739 - RNA, 14 nt, Human
gacugugugcucag

SEQ ID NO: 1969740 - RNA, 22 nt, Human
gacugucucaagagggcacugg

SEQ ID NO: 1969741 - RNA, 23 nt, Human
gacugucucaagagggcacuggu

SEQ ID NO: 1969742 - RNA, 21 nt, Human
gacugucucaagagggcacug

SEQ ID NO: 1969743 - RNA, 22 nt, Human
gacucaaaugcucagaccagcu

SEQ ID NO: 1969744 - RNA, 15 nt, Human
gacuauggagcugag

SEQ ID NO: 1969745 - RNA, 18 nt, Human
gacuaugcuuuucucaaa

SEQ ID NO: 1969746 - RNA, 13 nt, Human
gacgcugugcugc

SEQ ID NO: 1969747 - RNA, 12 nt, Human
gacgcugugcug

SEQ ID NO: 1969748 - RNA, 13 nt, Human
gacgcucugcugu

SEQ ID NO: 1969749 - RNA, 22 nt, Human
gacgcucugcugugggcacagg

SEQ ID NO: 1969750 - RNA, 22 nt, Human
gacccuccaaggccaggccuug

SEQ ID NO: 1969751 - RNA, 18 nt, Human
gacaggggcaggaggaag

SEQ ID NO: 1969752 - RNA, 20 nt, Human
gacaggggagggggcaaagg

SEQ ID NO: 1969753 - RNA, 20 nt, Human
gacaggggcaggaggaaggg

SEQ ID NO: 1969754 - RNA, 17 nt, Human
gacagggggccagaaca

SEQ ID NO: 1969755 - RNA, 14 nt, Human
gacagggguuccuu

SEQ ID NO: 1969756 - RNA, 20 nt, Human
gacagggguuccuucugggc

SEQ ID NO: 1969757 - RNA, 21 nt, Human
gacagggguuccuucugggca

SEQ ID NO: 1969758 - RNA, 13 nt, Human
gacagcuccuucu

SEQ ID NO: 1969759 - RNA, 11 nt, Human
gacagccuggc

SEQ ID NO: 1969760 - RNA, 12 nt, Human
gacagccuggca

SEQ ID NO: 1969761 - RNA, 14 nt, Human
gacagcuccuucug

SEQ ID NO: 1969762 - RNA, 15 nt, Human
gacagcuccuucugu

SEQ ID NO: 1969763 - RNA, 20 nt, Human
gacagaaagcagaacaguga

SEQ ID NO: 1969764 - RNA, 14 nt, Human
gacacuuuuucuuu

SEQ ID NO: 1969765 - RNA, 13 nt, Human
gacagaaaauaug

SEQ ID NO: 1969766 - RNA, 17 nt, Human
gacagaaaauauguauu

SEQ ID NO: 1969767 - RNA, 22 nt, Human
gacagaaaauauguauuaacac

SEQ ID NO: 1969768 - RNA, 14 nt, Human
gacagaaagcagaa

SEQ ID NO: 1969769 - RNA, 18 nt, Human
gaagcaugaacagugcac

SEQ ID NO: 1969770 - RNA, 12 nt, Human
gaagcagugccc

SEQ ID NO: 1969771 - RNA, 15 nt, Human
gaagcagugcccagg

SEQ ID NO: 1969772 - RNA, 16 nt, Human
gaagcagugcccaggu

SEQ ID NO: 1969773 - RNA, 18 nt, Human
gaagcagugcccaggugg

SEQ ID NO: 1969774 - RNA, 20 nt, Human
gacaguauggcagcuuuccu

SEQ ID NO: 1969775 - RNA, 22 nt, Human
gacagguuugggaccccuggug

SEQ ID NO: 1969776 - RNA, 19 nt, Human
gacagguuugggaccccug

SEQ ID NO: 1969777 - RNA, 17 nt, Human
gacaggguuucaccaug

SEQ ID NO: 1969778 - RNA, 15 nt, Human
gaccaucccugaagg

SEQ ID NO: 1969779 - RNA, 14 nt, Human
gaccaucccugaag

SEQ ID NO: 1969780 - RNA, 18 nt, Human
gaccagggcuggggcagc

SEQ ID NO: 1969781 - RNA, 19 nt, Human
gaccagggcuggggcagcc

SEQ ID NO: 1969782 - RNA, 22 nt, Human
gaccagggcuggggcagccucu

SEQ ID NO: 1969783 - RNA, 20 nt, Human
gaccaggguuggcaccuucc

SEQ ID NO: 1969784 - RNA, 16 nt, Human
gacccuauugcugcuu

SEQ ID NO: 1969785 - RNA, 12 nt, Human
gacccggcugcg

SEQ ID NO: 1969786 - RNA, 13 nt, Human
gacccggcugcgu

SEQ ID NO: 1969787 - RNA, 21 nt, Human
gaccccuggcuuuucacugcu

SEQ ID NO: 1969788 - RNA, 22 nt, Human
gaccccuggcuuuucacugcug

SEQ ID NO: 1969789 - RNA, 13 nt, Human
gaccccuggcuuu

SEQ ID NO: 1969790 - RNA, 16 nt, Human
gaccauucuccaccug

SEQ ID NO: 1969791 - RNA, 23 nt, Human
gaccaugcugucuggcacagccu

SEQ ID NO: 1969792 - RNA, 17 nt, Human
gaccaucccugaaggcc

SEQ ID NO: 1969793 - RNA, 16 nt, Human
gaccaucccugaaggc

SEQ ID NO: 1969794 - RNA, 15 nt, Human
gaccaugcugucugg

SEQ ID NO: 1969795 - RNA, 19 nt, Human
gaccaugcugucuggcaca

SEQ ID NO: 1969796 - RNA, 20 nt, Human
gaccaugcugucuggcacag

SEQ ID NO: 1969797 - RNA, 22 nt, Human
gaccaugcugucuggcacagcc

SEQ ID NO: 1969798 - RNA, 18 nt, Human
gagguggaauuauuuuaa

SEQ ID NO: 1969799 - RNA, 13 nt, Human
gaggugggauccu

SEQ ID NO: 1969800 - RNA, 16 nt, Human
gaggugggauccucca

SEQ ID NO: 1969801 - RNA, 15 nt, Human
gaggugggauccucc

SEQ ID NO: 1969802 - RNA, 21 nt, Human
gagucacuggaacacuaauga

SEQ ID NO: 1969803 - RNA, 14 nt, Human
gagucacuggaaca

SEQ ID NO: 1969804 - RNA, 17 nt, Human
gaggugggauccuccag

SEQ ID NO: 1969805 - RNA, 21 nt, Human
gagucauuuuguguugaagag

SEQ ID NO: 1969806 - RNA, 16 nt, Human
gaguccaaacuggaau

SEQ ID NO: 1969807 - RNA, 14 nt, Human
gagucauuucugau

SEQ ID NO: 1969808 - RNA, 18 nt, Human
gagucagaaguuucugcc

SEQ ID NO: 1969809 - RNA, 15 nt, Human
gagucauuucugauu

SEQ ID NO: 1969810 - RNA, 19 nt, Human
gaguccaaacuggaaugag

SEQ ID NO: 1969811 - RNA, 14 nt, Human
gagugagacagacu

SEQ ID NO: 1969812 - RNA, 14 nt, Human
gagugagacucugu

SEQ ID NO: 1969813 - RNA, 18 nt, Human
gagugagacucugucuca

SEQ ID NO: 1969814 - RNA, 19 nt, Human
gagugccgcaucucacagc

SEQ ID NO: 1969815 - RNA, 19 nt, Human
gaguugauacuacaguuug

SEQ ID NO: 1969816 - RNA, 21 nt, Human
gaguugauagcacagacccug

SEQ ID NO: 1969817 - RNA, 22 nt, Human
gaguugauacuacaguuuguua

SEQ ID NO: 1969818 - RNA, 13 nt, Human
gagugcagugagc

SEQ ID NO: 1969819 - RNA, 18 nt, Human
gagugcagugagccgaga

SEQ ID NO: 1969820 - RNA, 15 nt, Human
gagugagaggggagg

SEQ ID NO: 1969821 - RNA, 18 nt, Human
gagugagaggggaggcca

SEQ ID NO: 1969822 - RNA, 19 nt, Human
gagugagaggggaggccaa

SEQ ID NO: 1969823 - RNA, 20 nt, Human
gagugagaggggaggccaag

SEQ ID NO: 1969824 - RNA, 18 nt, Human
gagugccaacuucuuuca

SEQ ID NO: 1969825 - RNA, 20 nt, Human
gaggccagagacacaagccu

SEQ ID NO: 1969826 - RNA, 17 nt, Human
gaggcucugcccuuggu

SEQ ID NO: 1969827 - RNA, 15 nt, Human
gaggcucugcccuug

SEQ ID NO: 1969828 - RNA, 19 nt, Human
gaggcucuggagcccacug

SEQ ID NO: 1969829 - RNA, 14 nt, Human
gaggcucuggagcc

SEQ ID NO: 1969830 - RNA, 14 nt, Human
gaggcucugcccuu

SEQ ID NO: 1969831 - RNA, 13 nt, Human
gaggcucugcccu

SEQ ID NO: 1969832 - RNA, 12 nt, Human
gaggcucugccc

SEQ ID NO: 1969833 - RNA, 14 nt, Human
gaggcuccaggcag

SEQ ID NO: 1969834 - RNA, 15 nt, Human
gaggcuccaggcagc

SEQ ID NO: 1969835 - RNA, 15 nt, Human
gagggcuccagacac

SEQ ID NO: 1969836 - RNA, 14 nt, Human
gagggcuccagaca

SEQ ID NO: 1969837 - RNA, 13 nt, Human
gagggcuccagac

SEQ ID NO: 1969838 - RNA, 12 nt, Human
gagggcuccaga

SEQ ID NO: 1969839 - RNA, 12 nt, Human
gaggggaacaga

SEQ ID NO: 1969840 - RNA, 14 nt, Human
gaggcugccucucc

SEQ ID NO: 1969841 - RNA, 13 nt, Human
gagggccugggcc

SEQ ID NO: 1969842 - RNA, 15 nt, Human
gagggccugggccug

SEQ ID NO: 1969843 - RNA, 17 nt, Human
gagggccugggccuggc

SEQ ID NO: 1969844 - RNA, 20 nt, Human
gagggccugggccuggcucc

SEQ ID NO: 1969845 - RNA, 16 nt, Human
gaggcuccaggcagca

SEQ ID NO: 1969846 - RNA, 22 nt, Human
gagcugugggcaaaagagugua

SEQ ID NO: 1969847 - RNA, 20 nt, Human
gagcugugcaucagcuagaa

SEQ ID NO: 1969848 - RNA, 20 nt, Human
gagcugccuguucagcucca

SEQ ID NO: 1969849 - RNA, 17 nt, Human
gagcggagaaaggaagg

SEQ ID NO: 1969850 - RNA, 15 nt, Human
gagcugccuguucag

SEQ ID NO: 1969851 - RNA, 16 nt, Human
gagcugccuguucagc

SEQ ID NO: 1969852 - RNA, 19 nt, Human
gagcugccuguucagcucc

SEQ ID NO: 1969853 - RNA, 13 nt, Human
gagcgacagugag

SEQ ID NO: 1969854 - RNA, 15 nt, Human
gagcgacagugagac

SEQ ID NO: 1969855 - RNA, 13 nt, Human
gagccuuccaggg

SEQ ID NO: 1969856 - RNA, 12 nt, Human
gagccuuccagg

SEQ ID NO: 1969857 - RNA, 17 nt, Human
gagcaucaggccaggcc

SEQ ID NO: 1969858 - RNA, 14 nt, Human
gagccuuaaaacau

SEQ ID NO: 1969859 - RNA, 15 nt, Human
gagcagugggccugg

SEQ ID NO: 1969860 - RNA, 17 nt, Human
gagcagugggccuggcc

SEQ ID NO: 1969861 - RNA, 18 nt, Human
gagcagugggccuggcca

SEQ ID NO: 1969862 - RNA, 22 nt, Human
gagcaucaggccaggcccucug

SEQ ID NO: 1969863 - RNA, 20 nt, Human
gagcaucaggccaggcccuc

SEQ ID NO: 1969864 - RNA, 20 nt, Human
gagcagugauauucuuuguu

SEQ ID NO: 1969865 - RNA, 22 nt, Human
gcacuauagccuaggugacaga

SEQ ID NO: 1969866 - RNA, 17 nt, Human
gcacuccagccugggug

SEQ ID NO: 1969867 - RNA, 15 nt, Human
gcacuauugagucuu

SEQ ID NO: 1969868 - RNA, 18 nt, Human
gcacucaaaucuuaagaa

SEQ ID NO: 1969869 - RNA, 20 nt, Human
gcacucaaaucuuaagaaau

SEQ ID NO: 1969870 - RNA, 21 nt, Human
gcacucaaaucuuaagaaaua

SEQ ID NO: 1969871 - RNA, 11 nt, Human
gcaccuccucg

SEQ ID NO: 1969872 - RNA, 20 nt, Human
gcaccuccucggcuggcugu

SEQ ID NO: 1969873 - RNA, 21 nt, Human
gcaccuccucggcuggcuguc

SEQ ID NO: 1969874 - RNA, 12 nt, Human
gcaccuccugcc

SEQ ID NO: 1969875 - RNA, 16 nt, Human
gcaccggcuggccugg

SEQ ID NO: 1969876 - RNA, 15 nt, Human
gcaccggcuggccug

SEQ ID NO: 1969877 - RNA, 17 nt, Human
gcaccggcuggccuggc

SEQ ID NO: 1969878 - RNA, 17 nt, Human
gcaccuaccaccacgcc

SEQ ID NO: 1969879 - RNA, 18 nt, Human
gcaccuaccaccacgccc

SEQ ID NO: 1969880 - RNA, 12 nt, Human
gcacacauuuuu

SEQ ID NO: 1969881 - RNA, 15 nt, Human
gcacacaucaucugu

SEQ ID NO: 1969882 - RNA, 16 nt, Human
gcacacaucaucugua

SEQ ID NO: 1969883 - RNA, 17 nt, Human
gcacacaucaucuguaa

SEQ ID NO: 1969884 - RNA, 20 nt, Human
gcacacaucaucuguaagcu

SEQ ID NO: 1969885 - RNA, 11 nt, Human
gcacacauuuu

SEQ ID NO: 1969886 - RNA, 20 nt, Human
gcacacaccagagcccaccu

SEQ ID NO: 1969887 - RNA, 23 nt, Human
gcacacagcacgggggccaagga

SEQ ID NO: 1969888 - RNA, 11 nt, Human
gcacacagcac

SEQ ID NO: 1969889 - RNA, 19 nt, Human
gcaaguuuucccugaaguu

SEQ ID NO: 1969890 - RNA, 20 nt, Human
gcaaguuuucccugaaguua

SEQ ID NO: 1969891 - RNA, 11 nt, Human
gcaauaaagca

SEQ ID NO: 1969892 - RNA, 16 nt, Human
gcaauaaaagcccagg

SEQ ID NO: 1969893 - RNA, 17 nt, Human
gcaauaaaagcccagga

SEQ ID NO: 1969894 - RNA, 18 nt, Human
gcaauaaaagcccaggag

SEQ ID NO: 1969895 - RNA, 19 nt, Human
gcaauaaaagcccaggagc

SEQ ID NO: 1969896 - RNA, 23 nt, Human
gcaauaaggggagaguaacccug

SEQ ID NO: 1969897 - RNA, 22 nt, Human
gcaauaaaagcccaggagccca

SEQ ID NO: 1969898 - RNA, 12 nt, Human
gcacacaccaga

SEQ ID NO: 1969899 - RNA, 14 nt, Human
gcacacaccagagc

SEQ ID NO: 1969900 - RNA, 15 nt, Human
gcacacaccagagcc

SEQ ID NO: 1969901 - RNA, 16 nt, Human
gcacacaccagagccc

SEQ ID NO: 1969902 - RNA, 17 nt, Human
gcacacaccagagccca

SEQ ID NO: 1969903 - RNA, 18 nt, Human
gcacacaccagagcccac

SEQ ID NO: 1969904 - RNA, 19 nt, Human
gcacacaccagagcccacc

SEQ ID NO: 1969905 - RNA, 15 nt, Human
gcaaaagaugcuucu

SEQ ID NO: 1969906 - RNA, 21 nt, Human
gcaaaaccagguuuuguuccg

SEQ ID NO: 1969907 - RNA, 19 nt, Human
gcaaaacacaaaacaaauc

SEQ ID NO: 1969908 - RNA, 16 nt, Human
gcaaaagaugcuucuc

SEQ ID NO: 1969909 - RNA, 17 nt, Human
gcaacccccagccugcu

SEQ ID NO: 1969910 - RNA, 18 nt, Human
gcaacccccagccugcua

SEQ ID NO: 1969911 - RNA, 22 nt, Human
gcaaccccuggaccccagccuc

SEQ ID NO: 1969912 - RNA, 19 nt, Human
gcaaccccuggaccccagc

SEQ ID NO: 1969913 - RNA, 21 nt, Human
gcaaccccuggaccccagccu

SEQ ID NO: 1969914 - RNA, 12 nt, Human
gcaaaagagugu

SEQ ID NO: 1969915 - RNA, 21 nt, Human
gcaaaagaguguaaaauauuu

SEQ ID NO: 1969916 - RNA, 13 nt, Human
gcaaccccuggac

SEQ ID NO: 1969917 - RNA, 14 nt, Human
gcaaccccuggacc

SEQ ID NO: 1969918 - RNA, 22 nt, Human
gcaacccuggugaccagcacca

SEQ ID NO: 1969919 - RNA, 18 nt, Human
gcaaccuccgccucuugg

SEQ ID NO: 1969920 - RNA, 19 nt, Human
gauucuccugccucagccu

SEQ ID NO: 1969921 - RNA, 20 nt, Human
gauucuccugccucagccuc

SEQ ID NO: 1969922 - RNA, 21 nt, Human
gauucuccugccucagccucc

SEQ ID NO: 1969923 - RNA, 20 nt, Human
gauuuaacagaaauguacag

SEQ ID NO: 1969924 - RNA, 23 nt, Human
gauuuaacagaaauguacagcaa

SEQ ID NO: 1969925 - RNA, 15 nt, Human
gauucuuuagagaag

SEQ ID NO: 1969926 - RNA, 20 nt, Human
gauucuuguuuugcuucccc

SEQ ID NO: 1969927 - RNA, 21 nt, Human
gauucuuguuuugcuuccccu

SEQ ID NO: 1969928 - RNA, 15 nt, Human
gauucuuguuuugcu

SEQ ID NO: 1969929 - RNA, 16 nt, Human
gauucuuguuuugcuu

SEQ ID NO: 1969930 - RNA, 23 nt, Human
gauucuuauggacaaugacccag

SEQ ID NO: 1969931 - RNA, 21 nt, Human
gauucuucugcuucagccucc

SEQ ID NO: 1969932 - RNA, 23 nt, Human
gauuuuuuuuuccuucagugccu

SEQ ID NO: 1969933 - RNA, 22 nt, Human
gauuuuuuuuuccuucagugcc

SEQ ID NO: 1969934 - RNA, 12 nt, Human
gauuucagaaac

SEQ ID NO: 1969935 - RNA, 12 nt, Human
gcaaaaaaaguu

SEQ ID NO: 1969936 - RNA, 17 nt, Human
gcaaaaaaaguuguaug

SEQ ID NO: 1969937 - RNA, 18 nt, Human
gcaaaaaaaguuguauga

SEQ ID NO: 1969938 - RNA, 19 nt, Human
gcaaaaaaaguuguaugau

SEQ ID NO: 1969939 - RNA, 18 nt, Human
gauuucacucuccuuggu

SEQ ID NO: 1969940 - RNA, 17 nt, Human
gauuucacucuccuugg

SEQ ID NO: 1969941 - RNA, 15 nt, Human
gauuucagcucacug

SEQ ID NO: 1969942 - RNA, 17 nt, Human
gauuucagcucacugca

SEQ ID NO: 1969943 - RNA, 20 nt, Human
gauuucagcucacugcaacc

SEQ ID NO: 1969944 - RNA, 16 nt, Human
gauuucacucuccuug

SEQ ID NO: 1969945 - RNA, 13 nt, Human
gauuucacucucc

SEQ ID NO: 1969946 - RNA, 22 nt, Human
gaugugagaaaaccccuuccca

SEQ ID NO: 1969947 - RNA, 14 nt, Human
gaugugagaaaacc

SEQ ID NO: 1969948 - RNA, 20 nt, Human
gaucuggguucacugcaacc

SEQ ID NO: 1969949 - RNA, 22 nt, Human
gaguugauagcacagacccugc

SEQ ID NO: 1969950 - RNA, 18 nt, Human
gaucuggguucacugcaa

SEQ ID NO: 1969951 - RNA, 13 nt, Human
gaugaggcaaccc

SEQ ID NO: 1969952 - RNA, 14 nt, Human
gaugaugacuaugg

SEQ ID NO: 1969953 - RNA, 23 nt, Human
gaugcuucucacugccaugccag

SEQ ID NO: 1969954 - RNA, 14 nt, Human
gaugauugaagaaa

SEQ ID NO: 1969955 - RNA, 15 nt, Human
gaugauugaagaaac

SEQ ID NO: 1969956 - RNA, 14 nt, Human
gaugcuuguacaua

SEQ ID NO: 1969957 - RNA, 16 nt, Human
gaugcuuguacauaau

SEQ ID NO: 1969958 - RNA, 23 nt, Human
gauggaggaaaaccaagccgugg

SEQ ID NO: 1969959 - RNA, 14 nt, Human
gauguaaagauguu

SEQ ID NO: 1969960 - RNA, 13 nt, Human
gauguaaagaugu

SEQ ID NO: 1969961 - RNA, 18 nt, Human
gaugucccaacuuguaaa

SEQ ID NO: 1969962 - RNA, 17 nt, Human
gaugucccaacuuguaa

SEQ ID NO: 1969963 - RNA, 19 nt, Human
gaugucagcaguugcuggu

SEQ ID NO: 1969964 - RNA, 13 nt, Human
gauguaauuuugu

SEQ ID NO: 1969965 - RNA, 19 nt, Human
gauggauauauguuuuuga

SEQ ID NO: 1969966 - RNA, 12 nt, Human
gauguaaauuuu

SEQ ID NO: 1969967 - RNA, 19 nt, Human
gauguaauuuuguguaaga

SEQ ID NO: 1969968 - RNA, 21 nt, Human
gccaaggagggugagugcaag

SEQ ID NO: 1969969 - RNA, 20 nt, Human
gccaaggagggugagugcaa

SEQ ID NO: 1969970 - RNA, 11 nt, Human
gccaaggccaa

SEQ ID NO: 1969971 - RNA, 17 nt, Human
gccaaggccaaaggaag

SEQ ID NO: 1969972 - RNA, 19 nt, Human
gccaaggccaaaggaagca

SEQ ID NO: 1969973 - RNA, 17 nt, Human
gccaagaggcugcagcc

SEQ ID NO: 1969974 - RNA, 18 nt, Human
gccaagagcccgucugcu

SEQ ID NO: 1969975 - RNA, 21 nt, Human
gccaagagguuuggcuccugc

SEQ ID NO: 1969976 - RNA, 22 nt, Human
gccaagagguuuggcuccugcc

SEQ ID NO: 1969977 - RNA, 14 nt, Human
gccaagaguggccc

SEQ ID NO: 1969978 - RNA, 18 nt, Human
gccaagaguggccccacc

SEQ ID NO: 1969979 - RNA, 20 nt, Human
gccaagaguggccccaccug

SEQ ID NO: 1969980 - RNA, 21 nt, Human
gccaagaguggccccaccugg

SEQ ID NO: 1969981 - RNA, 22 nt, Human
gccaagaguggccccaccuggc

SEQ ID NO: 1969982 - RNA, 22 nt, Human
gccaagcaccuagccucgcucu

SEQ ID NO: 1969983 - RNA, 17 nt, Human
gcauccuggcacccggc

SEQ ID NO: 1969984 - RNA, 21 nt, Human
gcauccuggcacccggccccu

SEQ ID NO: 1969985 - RNA, 13 nt, Human
gcaucgcaaugua

SEQ ID NO: 1969986 - RNA, 22 nt, Human
gcauccuggcacccggccccug

SEQ ID NO: 1969987 - RNA, 23 nt, Human
gcauccuggcacccggccccugc

SEQ ID NO: 1969988 - RNA, 14 nt, Human
gcauggccaggugg

SEQ ID NO: 1969989 - RNA, 17 nt, Human
gcauggccagguggcca

SEQ ID NO: 1969990 - RNA, 13 nt, Human
gcauggccaggug

SEQ ID NO: 1969991 - RNA, 14 nt, Human
gcauggcagcccuc

SEQ ID NO: 1969992 - RNA, 17 nt, Human
gcaugugaugagaggaa

SEQ ID NO: 1969993 - RNA, 16 nt, Human
gcaugucuuauuuaaa

SEQ ID NO: 1969994 - RNA, 23 nt, Human
gcaugucccuaccgagucucuuc

SEQ ID NO: 1969995 - RNA, 22 nt, Human
gcaugucccaugugagcugcug

SEQ ID NO: 1969996 - RNA, 20 nt, Human
gcauuguaaaagcauuuugu

SEQ ID NO: 1969997 - RNA, 12 nt, Human
gcauuguaagcg

SEQ ID NO: 1969998 - RNA, 21 nt, Human
gcauuguaagcguauggcuuu

SEQ ID NO: 1969999 - RNA, 22 nt, Human
gcauuguaagcguauggcuuua

SEQ ID NO: 1970000 - RNA, 18 nt, Human
gcauuguaucugucuuuc

SEQ ID NO: 1970001 - RNA, 19 nt, Human
gcauuguaucugucuuucc

SEQ ID NO: 1970002 - RNA, 19 nt, Human
gcauuggggauguuuuucu

SEQ ID NO: 1970003 - RNA, 16 nt, Human
gcauugggugaucauu

SEQ ID NO: 1970004 - RNA, 16 nt, Human
gcaugggaaugaaugu

SEQ ID NO: 1970005 - RNA, 13 nt, Human
gcaugggaaugaa

SEQ ID NO: 1970006 - RNA, 19 nt, Human
gcaugggaaugaaugucag

SEQ ID NO: 1970007 - RNA, 19 nt, Human
gcaugggcaguuucaguuu

SEQ ID NO: 1970008 - RNA, 14 nt, Human
gcaugggccaccac

SEQ ID NO: 1970009 - RNA, 12 nt, Human
gccaagaggcug

SEQ ID NO: 1970010 - RNA, 13 nt, Human
gccaagaggcugc

SEQ ID NO: 1970011 - RNA, 14 nt, Human
gccaagaggcugca

SEQ ID NO: 1970012 - RNA, 15 nt, Human
gccaagaauuagauu

SEQ ID NO: 1970013 - RNA, 21 nt, Human
gccaacuuuccccacguuaaa

SEQ ID NO: 1970014 - RNA, 18 nt, Human
gccaagaaguuuaaggaa

SEQ ID NO: 1970015 - RNA, 18 nt, Human
gccaagaauucuuaaaua

SEQ ID NO: 1970016 - RNA, 14 nt, Human
gccaagaauucuua

SEQ ID NO: 1970017 - RNA, 19 nt, Human
gccaacuauggccugugga

SEQ ID NO: 1970018 - RNA, 17 nt, Human
gccaacugaucuguuau

SEQ ID NO: 1970019 - RNA, 14 nt, Human
gccaaccucgcucc

SEQ ID NO: 1970020 - RNA, 15 nt, Human
gccaaccucgcucca

SEQ ID NO: 1970021 - RNA, 23 nt, Human
gccaaccucgcuccaacuccaac

SEQ ID NO: 1970022 - RNA, 18 nt, Human
gccaacggccccagcuuc

SEQ ID NO: 1970023 - RNA, 15 nt, Human
gccaacuauggccug

SEQ ID NO: 1970024 - RNA, 14 nt, Human
gccaacuauggccu

SEQ ID NO: 1970025 - RNA, 15 nt, Human
gcauuucccacccug

SEQ ID NO: 1970026 - RNA, 21 nt, Human
gcauuucagaaagccuuucau

SEQ ID NO: 1970027 - RNA, 12 nt, Human
gcauuucagaaa

SEQ ID NO: 1970028 - RNA, 19 nt, Human
gcauuucacuugaguggag

SEQ ID NO: 1970029 - RNA, 23 nt, Human
gcauuuaugguaaucauauuaga

SEQ ID NO: 1970030 - RNA, 22 nt, Human
gcauuuagggaguauucuaaua

SEQ ID NO: 1970031 - RNA, 23 nt, Human
gcauuuagggaguauucuaauaa

SEQ ID NO: 1970032 - RNA, 18 nt, Human
gcauuuaugguaaucaua

SEQ ID NO: 1970033 - RNA, 20 nt, Human
gcauuuaugguaaucauauu

SEQ ID NO: 1970034 - RNA, 12 nt, Human
gcauuuaaaaga

SEQ ID NO: 1970035 - RNA, 15 nt, Human
gcauuuaaaagauac

SEQ ID NO: 1970036 - RNA, 21 nt, Human
gccaacagguagcauagcucu

SEQ ID NO: 1970037 - RNA, 14 nt, Human
gcauuugaaaauuu

SEQ ID NO: 1970038 - RNA, 16 nt, Human
gcauuugaaaauuuug

SEQ ID NO: 1970039 - RNA, 16 nt, Human
gcacuuuguucuggcu

SEQ ID NO: 1970040 - RNA, 18 nt, Human
gcacuuucuucuucccau

SEQ ID NO: 1970041 - RNA, 23 nt, Human
gcacuuugacagcgcacagcugc

SEQ ID NO: 1970042 - RNA, 9 nt, Human
gcacugaag

SEQ ID NO: 1970043 - RNA, 13 nt, Human
gcacucuggcagc

SEQ ID NO: 1970044 - RNA, 14 nt, Human
gcacucuggcagca

SEQ ID NO: 1970045 - RNA, 22 nt, Human
gcagcugcgguccacccaggag

SEQ ID NO: 1970046 - RNA, 23 nt, Human
gcagcugcgguccacccaggagc

SEQ ID NO: 1970047 - RNA, 13 nt, Human
gcagcugcuuuug

SEQ ID NO: 1970048 - RNA, 20 nt, Human
gcagcugcuuuugucuaugg

SEQ ID NO: 1970049 - RNA, 15 nt, Human
gcagcuuauucacaa

SEQ ID NO: 1970050 - RNA, 16 nt, Human
gcagcuugaggguugg

SEQ ID NO: 1970051 - RNA, 20 nt, Human
gcagcuguugucucuucucc

SEQ ID NO: 1970052 - RNA, 10 nt, Human
gcagcuguug

SEQ ID NO: 1970053 - RNA, 16 nt, Human
gcagcuguugucucuu

SEQ ID NO: 1970054 - RNA, 18 nt, Human
gcagcuguugucucuucu

SEQ ID NO: 1970055 - RNA, 19 nt, Human
gcagcuguugucucuucuc

SEQ ID NO: 1970056 - RNA, 17 nt, Human
gcaggcucucaggccag

SEQ ID NO: 1970057 - RNA, 18 nt, Human
gcaggcucucaggccagc

SEQ ID NO: 1970058 - RNA, 22 nt, Human
gcagggaaacagcuaaugggac

SEQ ID NO: 1970059 - RNA, 14 nt, Human
gcagggaaggccug

SEQ ID NO: 1970060 - RNA, 15 nt, Human
gcagggaaggccuga

SEQ ID NO: 1970061 - RNA, 13 nt, Human
gcaggcuggcccu

SEQ ID NO: 1970062 - RNA, 16 nt, Human
gcaggcucucaggcca

SEQ ID NO: 1970063 - RNA, 15 nt, Human
gcaggcucucaggcc

SEQ ID NO: 1970064 - RNA, 14 nt, Human
gcaggcucucaggc

SEQ ID NO: 1970065 - RNA, 13 nt, Human
gcaggcucucagg

SEQ ID NO: 1970066 - RNA, 12 nt, Human
gcaggcucucag

SEQ ID NO: 1970067 - RNA, 22 nt, Human
gcaggcucgggcuccccagccc

SEQ ID NO: 1970068 - RNA, 19 nt, Human
gcagcuugaggguugggcu

SEQ ID NO: 1970069 - RNA, 21 nt, Human
gcagcuugaggguugggcugg

SEQ ID NO: 1970070 - RNA, 15 nt, Human
gcaguugcccagccu

SEQ ID NO: 1970071 - RNA, 15 nt, Human
gcauaccacuuuugu

SEQ ID NO: 1970072 - RNA, 16 nt, Human
gcauaccacuuuuguu

SEQ ID NO: 1970073 - RNA, 23 nt, Human
gcaguugccagucaccccggcca

SEQ ID NO: 1970074 - RNA, 14 nt, Human
gcaguugccaguca

SEQ ID NO: 1970075 - RNA, 15 nt, Human
gcauaaaaauuagcc

SEQ ID NO: 1970076 - RNA, 14 nt, Human
gcaguugcccagcc

SEQ ID NO: 1970077 - RNA, 18 nt, Human
gcauacaaacaagcauau

SEQ ID NO: 1970078 - RNA, 12 nt, Human
gcauacaaacaa

SEQ ID NO: 1970079 - RNA, 23 nt, Human
gcagguuaaauguuuuguaaacu

SEQ ID NO: 1970080 - RNA, 13 nt, Human
gcagguucaguuu

SEQ ID NO: 1970081 - RNA, 21 nt, Human
gcaguugagaggacacucccg

SEQ ID NO: 1970082 - RNA, 18 nt, Human
gcaguugaauuuuuauau

SEQ ID NO: 1970083 - RNA, 16 nt, Human
gcagggaaggccugac

SEQ ID NO: 1970084 - RNA, 15 nt, Human
gcagggacagggccg

SEQ ID NO: 1970085 - RNA, 18 nt, Human
gcaggugugagggcagug

SEQ ID NO: 1970086 - RNA, 13 nt, Human
gcagguuaaaugu

SEQ ID NO: 1970087 - RNA, 14 nt, Human
gcagguuaaauguu

SEQ ID NO: 1970088 - RNA, 15 nt, Human
gcagguuaaauguuu

SEQ ID NO: 1970089 - RNA, 18 nt, Human
gcagguuaaauguuuugu

SEQ ID NO: 1970090 - RNA, 19 nt, Human
gcagguuaaauguuuugua

SEQ ID NO: 1970091 - RNA, 19 nt, Human
gcucuaaaauauuuaugaa

SEQ ID NO: 1970092 - RNA, 23 nt, Human
gcucuaaaauauuuaugaagaaa

SEQ ID NO: 1970093 - RNA, 13 nt, Human
gcucuaaaauauu

SEQ ID NO: 1970094 - RNA, 15 nt, Human
gcucuaaaauauuua

SEQ ID NO: 1970095 - RNA, 11 nt, Human
gcucugcccuu

SEQ ID NO: 1970096 - RNA, 22 nt, Human
gcucugccccagcuugggcaga

SEQ ID NO: 1970097 - RNA, 13 nt, Human
gcucugccccagc

SEQ ID NO: 1970098 - RNA, 23 nt, Human
gcucugcaagaauugaagcagga

SEQ ID NO: 1970099 - RNA, 23 nt, Human
gcucugaucauccacugugccau

SEQ ID NO: 1970100 - RNA, 17 nt, Human
gcucugaucauccacug

SEQ ID NO: 1970101 - RNA, 23 nt, Human
gcuccaccccgcaagcaccaucc

SEQ ID NO: 1970102 - RNA, 15 nt, Human
gcuccacuuggucug

SEQ ID NO: 1970103 - RNA, 20 nt, Human
gcuccagcucaccagcccca

SEQ ID NO: 1970104 - RNA, 21 nt, Human
gcuccagcucaccagccccag

SEQ ID NO: 1970105 - RNA, 16 nt, Human
gcucccacaggcccuu

SEQ ID NO: 1970106 - RNA, 17 nt, Human
gcucccacaggcccuuc

SEQ ID NO: 1970107 - RNA, 20 nt, Human
gcucccacaggcccuuccuc

SEQ ID NO: 1970108 - RNA, 21 nt, Human
gcucccacaggcccuuccucu

SEQ ID NO: 1970109 - RNA, 18 nt, Human
gcuccacuuggucuguga

SEQ ID NO: 1970110 - RNA, 19 nt, Human
gcuccacuuggucugugag

SEQ ID NO: 1970111 - RNA, 18 nt, Human
gcuccagcucaccagccc

SEQ ID NO: 1970112 - RNA, 13 nt, Human
gcucccaggagcc

SEQ ID NO: 1970113 - RNA, 22 nt, Human
gcucccacaggcccuuccucuc

SEQ ID NO: 1970114 - RNA, 17 nt, Human
gcucccacuucugccag

SEQ ID NO: 1970115 - RNA, 18 nt, Human
gcucccacuucugccaga

SEQ ID NO: 1970116 - RNA, 17 nt, Human
gcucccaggcauucccc

SEQ ID NO: 1970117 - RNA, 20 nt, Human
gcucccaggagccugcccag

SEQ ID NO: 1970118 - RNA, 21 nt, Human
gcucccaggagccugcccagc

SEQ ID NO: 1970119 - RNA, 13 nt, Human
gcucccccagcuc

SEQ ID NO: 1970120 - RNA, 14 nt, Human
gcucccccagcucc

SEQ ID NO: 1970121 - RNA, 20 nt, Human
gcucccccagcuccccccac

SEQ ID NO: 1970122 - RNA, 11 nt, Human
gcuccccccag

SEQ ID NO: 1970123 - RNA, 19 nt, Human
gcuccuggcccacugcauc

SEQ ID NO: 1970124 - RNA, 18 nt, Human
gcuccuggcccacugcau

SEQ ID NO: 1970125 - RNA, 20 nt, Human
gcuccuggcccacugcaucg

SEQ ID NO: 1970126 - RNA, 15 nt, Human
gcuccuggcccacug

SEQ ID NO: 1970127 - RNA, 14 nt, Human
gcuccuggcccacu

SEQ ID NO: 1970128 - RNA, 21 nt, Human
gcuccugccaccacgcccggc

SEQ ID NO: 1970129 - RNA, 12 nt, Human
gcuccugagccc

SEQ ID NO: 1970130 - RNA, 16 nt, Human
gcuccugagcccccag

SEQ ID NO: 1970131 - RNA, 12 nt, Human
gcuccugccacc

SEQ ID NO: 1970132 - RNA, 18 nt, Human
gcuccugccaccacgccc

SEQ ID NO: 1970133 - RNA, 17 nt, Human
gcucccccuccaccugc

SEQ ID NO: 1970134 - RNA, 18 nt, Human
gcucccccuccaccugcu

SEQ ID NO: 1970135 - RNA, 12 nt, Human
gcuccccucuuc

SEQ ID NO: 1970136 - RNA, 13 nt, Human
gcuccccucuucc

SEQ ID NO: 1970137 - RNA, 15 nt, Human
gcuccccucuuccuc

SEQ ID NO: 1970138 - RNA, 16 nt, Human
gcuccccucuuccucu

SEQ ID NO: 1970139 - RNA, 13 nt, Human
gcucccgccucca

SEQ ID NO: 1970140 - RNA, 19 nt, Human
gcucccgccuccaaccccu

SEQ ID NO: 1970141 - RNA, 13 nt, Human
gcuccccuucccc

SEQ ID NO: 1970142 - RNA, 16 nt, Human
gcuccccuuccccuuc

SEQ ID NO: 1970143 - RNA, 20 nt, Human
gcuccccuuccccuuccuuc

SEQ ID NO: 1970144 - RNA, 16 nt, Human
gcuaggccuggccaga

SEQ ID NO: 1970145 - RNA, 17 nt, Human
gcuaggccuggccagau

SEQ ID NO: 1970146 - RNA, 23 nt, Human
gcuaggccuggccagaugcacca

SEQ ID NO: 1970147 - RNA, 16 nt, Human
gcuagucuuaagaacu

SEQ ID NO: 1970148 - RNA, 22 nt, Human
gcuagugugguguuuccuggca

SEQ ID NO: 1970149 - RNA, 21 nt, Human
gcuagugugguguuuccuggc

SEQ ID NO: 1970150 - RNA, 14 nt, Human
gcuaugagggccuu

SEQ ID NO: 1970151 - RNA, 12 nt, Human
gcuaugcauuug

SEQ ID NO: 1970152 - RNA, 19 nt, Human
gcuauucaguaauaacucu

SEQ ID NO: 1970153 - RNA, 18 nt, Human
gcuaugauguuaguuuuc

SEQ ID NO: 1970154 - RNA, 13 nt, Human
gcuaugcauuuga

SEQ ID NO: 1970155 - RNA, 16 nt, Human
gcucagaccagcucuu

SEQ ID NO: 1970156 - RNA, 13 nt, Human
gcucagagagggu

SEQ ID NO: 1970157 - RNA, 20 nt, Human
gcucacugcauccuccgccu

SEQ ID NO: 1970158 - RNA, 17 nt, Human
gcucacugcagccuccg

SEQ ID NO: 1970159 - RNA, 14 nt, Human
gcucagagagggug

SEQ ID NO: 1970160 - RNA, 17 nt, Human
gcucagggaaaagcagc

SEQ ID NO: 1970161 - RNA, 15 nt, Human
gcucagggaaaagca

SEQ ID NO: 1970162 - RNA, 23 nt, Human
gcucagguggggucacucuggca

SEQ ID NO: 1970163 - RNA, 14 nt, Human
gcucaggugucccu

SEQ ID NO: 1970164 - RNA, 16 nt, Human
gcucaggugucccugc

SEQ ID NO: 1970165 - RNA, 17 nt, Human
gcucaggugucccugca

SEQ ID NO: 1970166 - RNA, 17 nt, Human
gcucacugcagccucaa

SEQ ID NO: 1970167 - RNA, 16 nt, Human
gcucacugcauccucc

SEQ ID NO: 1970168 - RNA, 15 nt, Human
gcucacugcagccuc

SEQ ID NO: 1970169 - RNA, 16 nt, Human
gcucacugcagccuca

SEQ ID NO: 1970170 - RNA, 11 nt, Human
gcucacugcag

SEQ ID NO: 1970171 - RNA, 12 nt, Human
gcucacugcagc

SEQ ID NO: 1970172 - RNA, 13 nt, Human
gcucacugcagcc

SEQ ID NO: 1970173 - RNA, 14 nt, Human
gcucacugcagccu

SEQ ID NO: 1970174 - RNA, 21 nt, Human
gcuauuuuaaaccaauugcag

SEQ ID NO: 1970175 - RNA, 20 nt, Human
gcuauucaguaauaacucua

SEQ ID NO: 1970176 - RNA, 15 nt, Human
gcuauggccugugcg

SEQ ID NO: 1970177 - RNA, 16 nt, Human
gcuagaacucccuuuc

SEQ ID NO: 1970178 - RNA, 18 nt, Human
gcuagaacucccuuucaa

SEQ ID NO: 1970179 - RNA, 20 nt, Human
gcuacugccaaccucgcucc

SEQ ID NO: 1970180 - RNA, 12 nt, Human
gcuagaacuccc

SEQ ID NO: 1970181 - RNA, 13 nt, Human
gcuagaacucccu

SEQ ID NO: 1970182 - RNA, 14 nt, Human
gcuagaacucccuu

SEQ ID NO: 1970183 - RNA, 15 nt, Human
gcuagaacucccuuu

SEQ ID NO: 1970184 - RNA, 19 nt, Human
gcuacucgugagcgccagu

SEQ ID NO: 1970185 - RNA, 19 nt, Human
gcuacugaaaggcaguagu

SEQ ID NO: 1970186 - RNA, 20 nt, Human
gcgugcacacaccagagccc

SEQ ID NO: 1970187 - RNA, 21 nt, Human
gcgggaggauguucugggaca

SEQ ID NO: 1970188 - RNA, 22 nt, Human
gcgggaggauguucugggacac

SEQ ID NO: 1970189 - RNA, 20 nt, Human
gcgggaggauguucugggac

SEQ ID NO: 1970190 - RNA, 18 nt, Human
gcguuucuaugacacaug

SEQ ID NO: 1970191 - RNA, 19 nt, Human
gcgugcacacaccagagcc

SEQ ID NO: 1970192 - RNA, 23 nt, Human
gcgugcacacaccagagcccacc

SEQ ID NO: 1970193 - RNA, 22 nt, Human
gcuaauucuuugaccuguuggg

SEQ ID NO: 1970194 - RNA, 13 nt, Human
gcuaauucuuugc

SEQ ID NO: 1970195 - RNA, 15 nt, Human
gcuaaugggacacua

SEQ ID NO: 1970196 - RNA, 13 nt, Human
gcuaaugggacac

SEQ ID NO: 1970197 - RNA, 17 nt, Human
gcuaaucuugugaaaau

SEQ ID NO: 1970198 - RNA, 23 nt, Human
gcuaagugauccucccaccucag

SEQ ID NO: 1970199 - RNA, 22 nt, Human
gcuaaacguguauguuuuucag

SEQ ID NO: 1970200 - RNA, 18 nt, Human
gcuaaacguguauguuuu

SEQ ID NO: 1970201 - RNA, 19 nt, Human
gcuaaacguguauguuuuu

SEQ ID NO: 1970202 - RNA, 12 nt, Human
gcuaaaauguuu

SEQ ID NO: 1970203 - RNA, 13 nt, Human
gcuaaaauguuuu

SEQ ID NO: 1970204 - RNA, 14 nt, Human
gcuaaaauguuuuc

SEQ ID NO: 1970205 - RNA, 15 nt, Human
gcuaaaauguuuuca

SEQ ID NO: 1970206 - RNA, 16 nt, Human
gcuaaaauguuuucag

SEQ ID NO: 1970207 - RNA, 17 nt, Human
gcuaaaauguuuucagc

SEQ ID NO: 1970208 - RNA, 14 nt, Human
gcuaaucagcauuc

SEQ ID NO: 1970209 - RNA, 16 nt, Human
gcuaaucagcauucuc

SEQ ID NO: 1970210 - RNA, 17 nt, Human
gcuaaucagcauucuca

SEQ ID NO: 1970211 - RNA, 22 nt, Human
gcuaaucagcauucucacuccu

SEQ ID NO: 1970212 - RNA, 22 nt, Human
gccugcccaggccccugccacc

SEQ ID NO: 1970213 - RNA, 15 nt, Human
gccugcccaggcccc

SEQ ID NO: 1970214 - RNA, 12 nt, Human
gccuccauccug

SEQ ID NO: 1970215 - RNA, 17 nt, Human
gccucgaacuggcugca

SEQ ID NO: 1970216 - RNA, 19 nt, Human
gccuccugugugugcgccu

SEQ ID NO: 1970217 - RNA, 23 nt, Human
gccuccugugugugcgccuacag

SEQ ID NO: 1970218 - RNA, 16 nt, Human
gccucccaaagugcug

SEQ ID NO: 1970219 - RNA, 17 nt, Human
gccucccaaagugcugg

SEQ ID NO: 1970220 - RNA, 21 nt, Human
gccucuuaugggcuggguucu

SEQ ID NO: 1970221 - RNA, 14 nt, Human
gccucuuggguuca

SEQ ID NO: 1970222 - RNA, 20 nt, Human
gccucuucccgccgcccagc

SEQ ID NO: 1970223 - RNA, 12 nt, Human
gccucuugucuu

SEQ ID NO: 1970224 - RNA, 13 nt, Human
gccugcccaggcc

SEQ ID NO: 1970225 - RNA, 14 nt, Human
gccugcccaggccc

SEQ ID NO: 1970226 - RNA, 14 nt, Human
gccucuuucccuuc

SEQ ID NO: 1970227 - RNA, 17 nt, Human
gccucuuucccuuccag

SEQ ID NO: 1970228 - RNA, 16 nt, Human
gccucuugucuuccua

SEQ ID NO: 1970229 - RNA, 23 nt, Human
gccucuugucuuccuauuucaga

SEQ ID NO: 1970230 - RNA, 12 nt, Human
gccucuuucccu

SEQ ID NO: 1970231 - RNA, 16 nt, Human
gccucuuaugggcugg

SEQ ID NO: 1970232 - RNA, 18 nt, Human
gccucuuaugggcugggu

SEQ ID NO: 1970233 - RNA, 17 nt, Human
gccucuuaugggcuggg

SEQ ID NO: 1970234 - RNA, 17 nt, Human
gccucgacacagagugg

SEQ ID NO: 1970235 - RNA, 20 nt, Human
gccucgaacuggcugcaaag

SEQ ID NO: 1970236 - RNA, 22 nt, Human
gccucgaacuggcugcaaaggg

SEQ ID NO: 1970237 - RNA, 20 nt, Human
gcgcagcauauucaggaagc

SEQ ID NO: 1970238 - RNA, 19 nt, Human
gcgcaagggaggcccagcg

SEQ ID NO: 1970239 - RNA, 14 nt, Human
gcgcacagcugcuc

SEQ ID NO: 1970240 - RNA, 22 nt, Human
gcgaucuggguucacugcaacc

SEQ ID NO: 1970241 - RNA, 18 nt, Human
gcgcaagggaggcccagc

SEQ ID NO: 1970242 - RNA, 21 nt, Human
gccuucggccuccauccugag

SEQ ID NO: 1970243 - RNA, 23 nt, Human
gccuucggccuccauccugaggc

SEQ ID NO: 1970244 - RNA, 20 nt, Human
gccuucggccuccauccuga

SEQ ID NO: 1970245 - RNA, 21 nt, Human
gccuguugggccaggagccuc

SEQ ID NO: 1970246 - RNA, 21 nt, Human
gccuugaccauucuccaccug

SEQ ID NO: 1970247 - RNA, 20 nt, Human
gccuugaccauucuccaccu

SEQ ID NO: 1970248 - RNA, 19 nt, Human
gccuugaccauucuccacc

SEQ ID NO: 1970249 - RNA, 17 nt, Human
gccuugaccauucucca

SEQ ID NO: 1970250 - RNA, 17 nt, Human
gccuugcccacuccugc

SEQ ID NO: 1970251 - RNA, 18 nt, Human
gccuugcccacuccugcu

SEQ ID NO: 1970252 - RNA, 22 nt, Human
gccuugcccacuccugcucugc

SEQ ID NO: 1970253 - RNA, 23 nt, Human
gccuugcccacuccugcucugcu

SEQ ID NO: 1970254 - RNA, 17 nt, Human
gcgagcccugguggcag

SEQ ID NO: 1970255 - RNA, 15 nt, Human
gcgagcccugguggc

SEQ ID NO: 1970256 - RNA, 20 nt, Human
gccuggccugagcugggaug

SEQ ID NO: 1970257 - RNA, 23 nt, Human
gccuggcucacacuuggcucuga

SEQ ID NO: 1970258 - RNA, 18 nt, Human
gccuggccugagcuggga

SEQ ID NO: 1970259 - RNA, 14 nt, Human
gccuggccugagcu

SEQ ID NO: 1970260 - RNA, 13 nt, Human
gccuggccugagc

SEQ ID NO: 1970261 - RNA, 20 nt, Human
gccuguugggccaggagccu

SEQ ID NO: 1970262 - RNA, 18 nt, Human
gccuguugggccaggagc

SEQ ID NO: 1970263 - RNA, 16 nt, Human
gccuguugggccagga

SEQ ID NO: 1970264 - RNA, 15 nt, Human
gccuguugggccagg

SEQ ID NO: 1970265 - RNA, 14 nt, Human
gccuguugggccag

SEQ ID NO: 1970266 - RNA, 23 nt, Human
gccuguucccauucuugcauggc

SEQ ID NO: 1970267 - RNA, 19 nt, Human
gccuguucccauucuugca

SEQ ID NO: 1970268 - RNA, 18 nt, Human
gccugugccucugggacu

SEQ ID NO: 1970269 - RNA, 17 nt, Human
gccugugccucugggac

SEQ ID NO: 1970270 - RNA, 16 nt, Human
gccugugccucuggga

SEQ ID NO: 1970271 - RNA, 13 nt, Human
gccuggcucaggu

SEQ ID NO: 1970272 - RNA, 12 nt, Human
gcccccacuggu

SEQ ID NO: 1970273 - RNA, 11 nt, Human
gccccugccag

SEQ ID NO: 1970274 - RNA, 16 nt, Human
gccccugccagacccc

SEQ ID NO: 1970275 - RNA, 17 nt, Human
gccccugccacccuggg

SEQ ID NO: 1970276 - RNA, 16 nt, Human
gccccugccacccugg

SEQ ID NO: 1970277 - RNA, 23 nt, Human
gcccgggcucugccucccaucac

SEQ ID NO: 1970278 - RNA, 19 nt, Human
gcccggugggggggcagag

SEQ ID NO: 1970279 - RNA, 23 nt, Human
gccccugccucucugcagguccc

SEQ ID NO: 1970280 - RNA, 20 nt, Human
gccccugccucucugcaggu

SEQ ID NO: 1970281 - RNA, 14 nt, Human
gccccugcuacugc

SEQ ID NO: 1970282 - RNA, 17 nt, Human
gccccugcuacugccaa

SEQ ID NO: 1970283 - RNA, 21 nt, Human
gccccugccuuggggucaggu

SEQ ID NO: 1970284 - RNA, 15 nt, Human
gcccucacccugggg

SEQ ID NO: 1970285 - RNA, 16 nt, Human
gcccuaaugcgcaggc

SEQ ID NO: 1970286 - RNA, 17 nt, Human
gcccuaaugcgcaggcu

SEQ ID NO: 1970287 - RNA, 19 nt, Human
gcccuaaugcgcaggcugg

SEQ ID NO: 1970288 - RNA, 20 nt, Human
gcccuaaugcgcaggcuggc

SEQ ID NO: 1970289 - RNA, 14 nt, Human
gcccuaagggagug

SEQ ID NO: 1970290 - RNA, 19 nt, Human
gccuauaagccaaaauuaa

SEQ ID NO: 1970291 - RNA, 20 nt, Human
gccuaggugacagagugaga

SEQ ID NO: 1970292 - RNA, 18 nt, Human
gccuaggauucacacccc

SEQ ID NO: 1970293 - RNA, 21 nt, Human
gccuaggauucacaccccacc

SEQ ID NO: 1970294 - RNA, 22 nt, Human
gccuaggauucacaccccaccu

SEQ ID NO: 1970295 - RNA, 23 nt, Human
gccuaggauucacaccccaccug

SEQ ID NO: 1970296 - RNA, 13 nt, Human
gccuaggugacag

SEQ ID NO: 1970297 - RNA, 14 nt, Human
gccuaggugacaga

SEQ ID NO: 1970298 - RNA, 15 nt, Human
gccuaggugacagag

SEQ ID NO: 1970299 - RNA, 23 nt, Human
gccuagcauacguacacauuuua

SEQ ID NO: 1970300 - RNA, 23 nt, Human
gccgccgcuagguagagucugag

SEQ ID NO: 1970301 - RNA, 22 nt, Human
gccgccggcaauaaaagcccag

SEQ ID NO: 1970302 - RNA, 23 nt, Human
gccgccggcaauaaaagcccagg

SEQ ID NO: 1970303 - RNA, 21 nt, Human
gccuagcauacguacacauuu

SEQ ID NO: 1970304 - RNA, 22 nt, Human
gccuagcauacguacacauuuu

SEQ ID NO: 1970305 - RNA, 20 nt, Human
gccuagcauacguacacauu

SEQ ID NO: 1970306 - RNA, 20 nt, Human
gccgccgcuagguagagucu

SEQ ID NO: 1970307 - RNA, 22 nt, Human
gcccugcccaccuggccucugc

SEQ ID NO: 1970308 - RNA, 21 nt, Human
gcccugcccaccuggccucug

SEQ ID NO: 1970309 - RNA, 20 nt, Human
gcccugcccaccuggccucu

SEQ ID NO: 1970310 - RNA, 17 nt, Human
gcccugcccaccuggcc

SEQ ID NO: 1970311 - RNA, 11 nt, Human
gcccugccucc

SEQ ID NO: 1970312 - RNA, 12 nt, Human
gcccugcccugg

SEQ ID NO: 1970313 - RNA, 16 nt, Human
gcccugcccugguuuc

SEQ ID NO: 1970314 - RNA, 11 nt, Human
gcccugcccug

SEQ ID NO: 1970315 - RNA, 18 nt, Human
gcccugcagagggcacag

SEQ ID NO: 1970316 - RNA, 12 nt, Human
gcccugcagcuc

SEQ ID NO: 1970317 - RNA, 16 nt, Human
gcccugcagagggcac

SEQ ID NO: 1970318 - RNA, 13 nt, Human
gcccugcagcucu

SEQ ID NO: 1970319 - RNA, 19 nt, Human
gcccugcagcucucaugcu

SEQ ID NO: 1970320 - RNA, 13 nt, Human
gcccugccuccuu

SEQ ID NO: 1970321 - RNA, 12 nt, Human
gcccugccuccu

SEQ ID NO: 1970322 - RNA, 14 nt, Human
gcccugccuccuuu

SEQ ID NO: 1970323 - RNA, 18 nt, Human
gcccugcccugguuuccu

SEQ ID NO: 1970324 - RNA, 20 nt, Human
gcccuuagcagggaaacagc

SEQ ID NO: 1970325 - RNA, 22 nt, Human
gcccuguccugccuaaggcuga

SEQ ID NO: 1970326 - RNA, 20 nt, Human
gccgcagcccugcagagggc

SEQ ID NO: 1970327 - RNA, 19 nt, Human
gccgcagcccugcagaggg

SEQ ID NO: 1970328 - RNA, 22 nt, Human
gcccuuagcagggaaacagcua

SEQ ID NO: 1970329 - RNA, 15 nt, Human
gccgcaucucacagc

SEQ ID NO: 1970330 - RNA, 18 nt, Human
gccgcaucucacagcuau

SEQ ID NO: 1970331 - RNA, 23 nt, Human
gccgcaucucacagcuaugcaaa

SEQ ID NO: 1970332 - RNA, 13 nt, Human
ggaagagaaaaaa

SEQ ID NO: 1970333 - RNA, 18 nt, Human
ggaagacuuuggaaagag

SEQ ID NO: 1970334 - RNA, 15 nt, Human
ggaagagaaaaaaua

SEQ ID NO: 1970335 - RNA, 12 nt, Human
ggaagacuuugg

SEQ ID NO: 1970336 - RNA, 17 nt, Human
ggaagacuuuggaaaga

SEQ ID NO: 1970337 - RNA, 13 nt, Human
ggaagacuuugga

SEQ ID NO: 1970338 - RNA, 22 nt, Human
ggaagacaaugugaaaagaaaa

SEQ ID NO: 1970339 - RNA, 14 nt, Human
ggaagacagcucuu

SEQ ID NO: 1970340 - RNA, 13 nt, Human
ggaagacagcucu

SEQ ID NO: 1970341 - RNA, 14 nt, Human
ggaacacucugaga

SEQ ID NO: 1970342 - RNA, 12 nt, Human
ggaacacucuga

SEQ ID NO: 1970343 - RNA, 20 nt, Human
ggaacugcugggcuuggcag

SEQ ID NO: 1970344 - RNA, 16 nt, Human
ggaacacucugagacu

SEQ ID NO: 1970345 - RNA, 15 nt, Human
ggaacacucugagac

SEQ ID NO: 1970346 - RNA, 23 nt, Human
ggaacagaagaggaaagagagac

SEQ ID NO: 1970347 - RNA, 21 nt, Human
ggaagcggcccuaagggagug

SEQ ID NO: 1970348 - RNA, 15 nt, Human
ggaagccgcuggggc

SEQ ID NO: 1970349 - RNA, 23 nt, Human
ggaagcucagggccuggcucagg

SEQ ID NO: 1970350 - RNA, 15 nt, Human
ggaagcucagggccu

SEQ ID NO: 1970351 - RNA, 11 nt, Human
ggaagcuccgc

SEQ ID NO: 1970352 - RNA, 16 nt, Human
ggaaggaaacccagcu

SEQ ID NO: 1970353 - RNA, 15 nt, Human
ggaagcuggccugag

SEQ ID NO: 1970354 - RNA, 13 nt, Human
ggaagcugcuacu

SEQ ID NO: 1970355 - RNA, 12 nt, Human
ggaagugugggu

SEQ ID NO: 1970356 - RNA, 21 nt, Human
ggaagugugggucugugugug

SEQ ID NO: 1970357 - RNA, 22 nt, Human
ggaagugugggucugugugugu

SEQ ID NO: 1970358 - RNA, 16 nt, Human
ggaaguuaaaagcaca

SEQ ID NO: 1970359 - RNA, 22 nt, Human
ggaaguuaaagggaagaaaaca

SEQ ID NO: 1970360 - RNA, 20 nt, Human
ggaaggaaacccagcucugg

SEQ ID NO: 1970361 - RNA, 19 nt, Human
ggaaggaaacccagcucug

SEQ ID NO: 1970362 - RNA, 14 nt, Human
ggacacagcucuuc

SEQ ID NO: 1970363 - RNA, 17 nt, Human
ggacaaggugcaggcag

SEQ ID NO: 1970364 - RNA, 18 nt, Human
ggacaaggugcaggcagg

SEQ ID NO: 1970365 - RNA, 19 nt, Human
ggacaaggacuaggguccu

SEQ ID NO: 1970366 - RNA, 22 nt, Human
ggacaagggaaaauaaaaaaag

SEQ ID NO: 1970367 - RNA, 21 nt, Human
ggacacagcucuucuccaggc

SEQ ID NO: 1970368 - RNA, 15 nt, Human
ggacacagcucuucu

SEQ ID NO: 1970369 - RNA, 18 nt, Human
ggacacagcucuucucca

SEQ ID NO: 1970370 - RNA, 20 nt, Human
ggacagcuccuucuguccua

SEQ ID NO: 1970371 - RNA, 22 nt, Human
ggacacuaaccacgcuggaccu

SEQ ID NO: 1970372 - RNA, 19 nt, Human
ggacagcuccuucuguccu

SEQ ID NO: 1970373 - RNA, 17 nt, Human
ggacacuaaccacgcug

SEQ ID NO: 1970374 - RNA, 19 nt, Human
ggaaugaagauacugaaau

SEQ ID NO: 1970375 - RNA, 21 nt, Human
ggaaucuagccagugaacaua

SEQ ID NO: 1970376 - RNA, 22 nt, Human
ggaaucuagccagugaacauaa

SEQ ID NO: 1970377 - RNA, 23 nt, Human
ggacaaggaugaucuaggaagac

SEQ ID NO: 1970378 - RNA, 22 nt, Human
ggacaaggaugaucuaggaaga

SEQ ID NO: 1970379 - RNA, 13 nt, Human
ggacaagagcagg

SEQ ID NO: 1970380 - RNA, 16 nt, Human
ggaauccagacccggc

SEQ ID NO: 1970381 - RNA, 17 nt, Human
ggaaucauuguccagag

SEQ ID NO: 1970382 - RNA, 20 nt, Human
ggaaucauuguccagagcug

SEQ ID NO: 1970383 - RNA, 18 nt, Human
ggaauaacauguaauuaa

SEQ ID NO: 1970384 - RNA, 23 nt, Human
ggacaggcauguucucugaggac

SEQ ID NO: 1970385 - RNA, 18 nt, Human
ggacaggagaugcugugc

SEQ ID NO: 1970386 - RNA, 19 nt, Human
ggacaggagaugcugugcc

SEQ ID NO: 1970387 - RNA, 12 nt, Human
ggacccccugaa

SEQ ID NO: 1970388 - RNA, 11 nt, Human
ggacccugagg

SEQ ID NO: 1970389 - RNA, 17 nt, Human
ggacccuccaaggccag

SEQ ID NO: 1970390 - RNA, 18 nt, Human
ggacccuccaaggccagg

SEQ ID NO: 1970391 - RNA, 21 nt, Human
ggacccuccaaggccaggccu

SEQ ID NO: 1970392 - RNA, 14 nt, Human
ggacccugaaaugu

SEQ ID NO: 1970393 - RNA, 16 nt, Human
ggacccugaaaugugu

SEQ ID NO: 1970394 - RNA, 17 nt, Human
ggacccugccaggcaca

SEQ ID NO: 1970395 - RNA, 24 nt, Human
ggacccugccaggcacaggcaggg

SEQ ID NO: 1970396 - RNA, 18 nt, Human
ggacccugccaggcacag

SEQ ID NO: 1970397 - RNA, 20 nt, Human
ggacccugccaggcacaggc

SEQ ID NO: 1970398 - RNA, 21 nt, Human
ggacccugccaggcacaggca

SEQ ID NO: 1970399 - RNA, 22 nt, Human
ggacccugccaggcacaggcag

SEQ ID NO: 1970400 - RNA, 13 nt, Human
ggacccugaggcc

SEQ ID NO: 1970401 - RNA, 12 nt, Human
ggacccugaggc

SEQ ID NO: 1970402 - RNA, 13 nt, Human
ggaccucaggccu

SEQ ID NO: 1970403 - RNA, 15 nt, Human
ggaccucaggccugg

SEQ ID NO: 1970404 - RNA, 14 nt, Human
ggaccucaggccug

SEQ ID NO: 1970405 - RNA, 20 nt, Human
ggaccucaggccugggggcu

SEQ ID NO: 1970406 - RNA, 13 nt, Human
ggacguccuccaa

SEQ ID NO: 1970407 - RNA, 20 nt, Human
ggacguguuaugacuccaga

SEQ ID NO: 1970408 - RNA, 13 nt, Human
ggagaaacuggaa

SEQ ID NO: 1970409 - RNA, 16 nt, Human
ggagaaaggaagggcu

SEQ ID NO: 1970410 - RNA, 9 nt, Human
ggacuuugu

SEQ ID NO: 1970411 - RNA, 14 nt, Human
ggacuuggaagcuc

SEQ ID NO: 1970412 - RNA, 17 nt, Human
ggacuuucucuaauaau

SEQ ID NO: 1970413 - RNA, 20 nt, Human
ggacuuucucuaauaauaaa

SEQ ID NO: 1970414 - RNA, 22 nt, Human
ggacuuucucuaauaauaaaua

SEQ ID NO: 1970415 - RNA, 16 nt, Human
ggacucaaugcacuga

SEQ ID NO: 1970416 - RNA, 18 nt, Human
ggacucaaugcacugaca

SEQ ID NO: 1970417 - RNA, 15 nt, Human
ggacucaaugcacug

SEQ ID NO: 1970418 - RNA, 24 nt, Human
ggacuaacuugucuuuggacccug

SEQ ID NO: 1970419 - RNA, 14 nt, Human
ggacuacaggugug

SEQ ID NO: 1970420 - RNA, 20 nt, Human
ggacuaacuugucuuuggac

SEQ ID NO: 1970421 - RNA, 10 nt, Human
ggacuaaauu

SEQ ID NO: 1970422 - RNA, 16 nt, Human
ggacguggcaccuccu

SEQ ID NO: 1970423 - RNA, 20 nt, Human
gcuggccuggggucaggccg

SEQ ID NO: 1970424 - RNA, 15 nt, Human
gcuggagugcagugg

SEQ ID NO: 1970425 - RNA, 20 nt, Human
gcuggcgugcaguggugcga

SEQ ID NO: 1970426 - RNA, 18 nt, Human
gcuggagugcagugagcc

SEQ ID NO: 1970427 - RNA, 17 nt, Human
gcuggagugcagugagc

SEQ ID NO: 1970428 - RNA, 20 nt, Human
gcuggccuggccccucaggg

SEQ ID NO: 1970429 - RNA, 22 nt, Human
gcuggagugcagugagccgaga

SEQ ID NO: 1970430 - RNA, 18 nt, Human
gcugcugaaggcucgagc

SEQ ID NO: 1970431 - RNA, 13 nt, Human
gcugcuggcuggu

SEQ ID NO: 1970432 - RNA, 15 nt, Human
gcugcugaaggcucg

SEQ ID NO: 1970433 - RNA, 14 nt, Human
gcugcugaaggcuc

SEQ ID NO: 1970434 - RNA, 13 nt, Human
gcugcugaaggcu

SEQ ID NO: 1970435 - RNA, 23 nt, Human
gcucugguccauagagagcaaga

SEQ ID NO: 1970436 - RNA, 16 nt, Human
gcucugguccauagag

SEQ ID NO: 1970437 - RNA, 15 nt, Human
gcucugguccauaga

SEQ ID NO: 1970438 - RNA, 13 nt, Human
gcucugcccuugg

SEQ ID NO: 1970439 - RNA, 23 nt, Human
gcuggguggcaccagcagccugg

SEQ ID NO: 1970440 - RNA, 22 nt, Human
gcuggguggcaccagcagccug

SEQ ID NO: 1970441 - RNA, 21 nt, Human
gcuggguggcaccagcagccu

SEQ ID NO: 1970442 - RNA, 12 nt, Human
gcugggucgccc

SEQ ID NO: 1970443 - RNA, 22 nt, Human
gcugggccccugccucucugca

SEQ ID NO: 1970444 - RNA, 21 nt, Human
gcugggccccugccucucugc

SEQ ID NO: 1970445 - RNA, 23 nt, Human
gcugggccccugccucucugcag

SEQ ID NO: 1970446 - RNA, 13 nt, Human
gcugggcucccgu

SEQ ID NO: 1970447 - RNA, 15 nt, Human
gcuggcuguuggcug

SEQ ID NO: 1970448 - RNA, 16 nt, Human
gcuggcuguuggcugg

SEQ ID NO: 1970449 - RNA, 17 nt, Human
gcuggcuguuggcuggg

SEQ ID NO: 1970450 - RNA, 14 nt, Human
gcuggcuccagccu

SEQ ID NO: 1970451 - RNA, 15 nt, Human
gcuggcuccagccug

SEQ ID NO: 1970452 - RNA, 22 nt, Human
gcuuccucauaguaugguggcu

SEQ ID NO: 1970453 - RNA, 17 nt, Human
gcuuccuauaauuuuga

SEQ ID NO: 1970454 - RNA, 18 nt, Human
gcuuccuauaauuuugau

SEQ ID NO: 1970455 - RNA, 23 nt, Human
gcuuccuauaauuuugauagugg

SEQ ID NO: 1970456 - RNA, 16 nt, Human
gcuucuucugaggccu

SEQ ID NO: 1970457 - RNA, 20 nt, Human
gcuuucuuucguuuguuugu

SEQ ID NO: 1970458 - RNA, 21 nt, Human
gcuuucuuucguuuguuuguu

SEQ ID NO: 1970459 - RNA, 12 nt, Human
gcuuguacauaa

SEQ ID NO: 1970460 - RNA, 13 nt, Human
gcuuguaguucuu

SEQ ID NO: 1970461 - RNA, 16 nt, Human
gcuugucauagccagu

SEQ ID NO: 1970462 - RNA, 17 nt, Human
gcuugucauagccagug

SEQ ID NO: 1970463 - RNA, 16 nt, Human
gcuuguaguucuuuaa

SEQ ID NO: 1970464 - RNA, 17 nt, Human
gcuuguaguucuuuaaa

SEQ ID NO: 1970465 - RNA, 17 nt, Human
gcuucuucugaggccug

SEQ ID NO: 1970466 - RNA, 14 nt, Human
gcuugagcucagga

SEQ ID NO: 1970467 - RNA, 20 nt, Human
gcuuguaaauagcucaggug

SEQ ID NO: 1970468 - RNA, 17 nt, Human
gcuuguaacuaaaauaa

SEQ ID NO: 1970469 - RNA, 22 nt, Human
gcuuguaacuaaaauaauuuug

SEQ ID NO: 1970470 - RNA, 23 nt, Human
gcuuguaacuaaaauaauuuugu

SEQ ID NO: 1970471 - RNA, 21 nt, Human
gcuucagccucccacagugcu

SEQ ID NO: 1970472 - RNA, 18 nt, Human
gcuucacggaagagccuu

SEQ ID NO: 1970473 - RNA, 19 nt, Human
gcuucacggaagagccuug

SEQ ID NO: 1970474 - RNA, 12 nt, Human
gcuucagccucc

SEQ ID NO: 1970475 - RNA, 14 nt, Human
gcuucagccuccca

SEQ ID NO: 1970476 - RNA, 18 nt, Human
gcuucagccucccacagu

SEQ ID NO: 1970477 - RNA, 19 nt, Human
gcuucagccucccacagug

SEQ ID NO: 1970478 - RNA, 15 nt, Human
gcuucacggaagagc

SEQ ID NO: 1970479 - RNA, 17 nt, Human
gcuucacggaagagccu

SEQ ID NO: 1970480 - RNA, 21 nt, Human
gcuucaaggauccugagccag

SEQ ID NO: 1970481 - RNA, 20 nt, Human
gcuucaaggauccugagcca

SEQ ID NO: 1970482 - RNA, 19 nt, Human
gcuucaaggauccugagcc

SEQ ID NO: 1970483 - RNA, 18 nt, Human
gcuucaaggauccugagc

SEQ ID NO: 1970484 - RNA, 17 nt, Human
ggccaguuggucccccu

SEQ ID NO: 1970485 - RNA, 14 nt, Human
ggccaguugguccc

SEQ ID NO: 1970486 - RNA, 13 nt, Human
ggccauaagcaac

SEQ ID NO: 1970487 - RNA, 23 nt, Human
ggccauaagcaacaauuuucaga

SEQ ID NO: 1970488 - RNA, 23 nt, Human
ggccagucccugaggcagguccc

SEQ ID NO: 1970489 - RNA, 17 nt, Human
ggccagucccugaggca

SEQ ID NO: 1970490 - RNA, 20 nt, Human
ggccagugugacaaggauug

SEQ ID NO: 1970491 - RNA, 13 nt, Human
ggccccugcuggu

SEQ ID NO: 1970492 - RNA, 14 nt, Human
ggccccugcugguu

SEQ ID NO: 1970493 - RNA, 13 nt, Human
ggcccggcuccag

SEQ ID NO: 1970494 - RNA, 23 nt, Human
ggccccugcugguucaggguugg

SEQ ID NO: 1970495 - RNA, 22 nt, Human
ggcccuccgaccacuuccaggg

SEQ ID NO: 1970496 - RNA, 15 nt, Human
ggcccggcuccaggc

SEQ ID NO: 1970497 - RNA, 21 nt, Human
ggcccuucucuccagccccug

SEQ ID NO: 1970498 - RNA, 20 nt, Human
ggcccuucucuccagccccu

SEQ ID NO: 1970499 - RNA, 19 nt, Human
ggcccuucucuccagcccc

SEQ ID NO: 1970500 - RNA, 14 nt, Human
ggccuccauccuga

SEQ ID NO: 1970501 - RNA, 15 nt, Human
ggccuccauccugag

SEQ ID NO: 1970502 - RNA, 16 nt, Human
ggccuccauccugagg

SEQ ID NO: 1970503 - RNA, 23 nt, Human
ggccucaagugauucuccugccu

SEQ ID NO: 1970504 - RNA, 19 nt, Human
ggccucacuaggcuucugg

SEQ ID NO: 1970505 - RNA, 23 nt, Human
ggcccuucucuccagccccugga

SEQ ID NO: 1970506 - RNA, 22 nt, Human
ggcccuucucuccagccccugg

SEQ ID NO: 1970507 - RNA, 19 nt, Human
ggcccuuuccuuccagauc

SEQ ID NO: 1970508 - RNA, 19 nt, Human
ggcacagaaaauggaagac

SEQ ID NO: 1970509 - RNA, 21 nt, Human
ggcacagaaaauggaagacag

SEQ ID NO: 1970510 - RNA, 20 nt, Human
ggcacagaaaauggaagaca

SEQ ID NO: 1970511 - RNA, 23 nt, Human
ggcacagaaaauggaagacagcu

SEQ ID NO: 1970512 - RNA, 13 nt, Human
ggcacaucagcac

SEQ ID NO: 1970513 - RNA, 19 nt, Human
ggcacugagagagcgcagc

SEQ ID NO: 1970514 - RNA, 23 nt, Human
ggcacucagaagacacugauggg

SEQ ID NO: 1970515 - RNA, 23 nt, Human
ggcagccccauucugccugccca

SEQ ID NO: 1970516 - RNA, 11 nt, Human
ggcagccccug

SEQ ID NO: 1970517 - RNA, 16 nt, Human
ggcagacauggugggg

SEQ ID NO: 1970518 - RNA, 21 nt, Human
ggcagacaugguggggucucc

SEQ ID NO: 1970519 - RNA, 15 nt, Human
ggcacugguggcccg

SEQ ID NO: 1970520 - RNA, 21 nt, Human
ggcacugccgccgcuagguag

SEQ ID NO: 1970521 - RNA, 13 nt, Human
ggcacuucugccu

SEQ ID NO: 1970522 - RNA, 15 nt, Human
ggcacuucugccuga

SEQ ID NO: 1970523 - RNA, 16 nt, Human
ggagagaagagaaugc

SEQ ID NO: 1970524 - RNA, 15 nt, Human
ggagagaaauauuuu

SEQ ID NO: 1970525 - RNA, 18 nt, Human
ggagagaaauauuuuaau

SEQ ID NO: 1970526 - RNA, 19 nt, Human
ggagacuuugaugucagca

SEQ ID NO: 1970527 - RNA, 21 nt, Human
ggagacuuugaugucagcagu

SEQ ID NO: 1970528 - RNA, 18 nt, Human
ggagacugcuccugagcc

SEQ ID NO: 1970529 - RNA, 19 nt, Human
ggagacugcuccugagccc

SEQ ID NO: 1970530 - RNA, 20 nt, Human
ggagacugcuccugagcccc

SEQ ID NO: 1970531 - RNA, 21 nt, Human
ggagacugcuccugagccccc

SEQ ID NO: 1970532 - RNA, 16 nt, Human
ggcaggggaggccauc

SEQ ID NO: 1970533 - RNA, 15 nt, Human
ggcagggcugaggcc

SEQ ID NO: 1970534 - RNA, 22 nt, Human
ggcagccccuguucuggcagag

SEQ ID NO: 1970535 - RNA, 17 nt, Human
ggcagcccgcaucagcu

SEQ ID NO: 1970536 - RNA, 19 nt, Human
ggcagccgcggugcccaac

SEQ ID NO: 1970537 - RNA, 16 nt, Human
ggcaguugcccagccu

SEQ ID NO: 1970538 - RNA, 20 nt, Human
ggcaguggugguuuucuguu

SEQ ID NO: 1970539 - RNA, 21 nt, Human
ggcaguggugguuuucuguuc

SEQ ID NO: 1970540 - RNA, 23 nt, Human
ggcuccacacacacaaaaaaaga

SEQ ID NO: 1970541 - RNA, 14 nt, Human
ggcuccacuugguc

SEQ ID NO: 1970542 - RNA, 14 nt, Human
ggcuccacacacac

SEQ ID NO: 1970543 - RNA, 22 nt, Human
ggcuccacacacacaaaaaaag

SEQ ID NO: 1970544 - RNA, 14 nt, Human
ggcucagagugggg

SEQ ID NO: 1970545 - RNA, 18 nt, Human
ggcucagcggggacagcu

SEQ ID NO: 1970546 - RNA, 20 nt, Human
ggcucagguggggucacucu

SEQ ID NO: 1970547 - RNA, 19 nt, Human
ggcucagguggggucacuc

SEQ ID NO: 1970548 - RNA, 19 nt, Human
ggcucagcggggacagcuc

SEQ ID NO: 1970549 - RNA, 20 nt, Human
ggcucagcggggacagcucc

SEQ ID NO: 1970550 - RNA, 16 nt, Human
ggcucagauuguaaua

SEQ ID NO: 1970551 - RNA, 15 nt, Human
ggcucaggcugagcu

SEQ ID NO: 1970552 - RNA, 16 nt, Human
ggcugggagagccuuc

SEQ ID NO: 1970553 - RNA, 15 nt, Human
ggcugggagagccuu

SEQ ID NO: 1970554 - RNA, 14 nt, Human
ggcugggagagccu

SEQ ID NO: 1970555 - RNA, 13 nt, Human
ggcugcugaaggc

SEQ ID NO: 1970556 - RNA, 13 nt, Human
ggcugggagagcc

SEQ ID NO: 1970557 - RNA, 17 nt, Human
ggcugcggggcgggcac

SEQ ID NO: 1970558 - RNA, 11 nt, Human
ggcucucaggc

SEQ ID NO: 1970559 - RNA, 22 nt, Human
ggcuccuuaggguuuucucucu

SEQ ID NO: 1970560 - RNA, 12 nt, Human
ggcucuuccagg

SEQ ID NO: 1970561 - RNA, 12 nt, Human
ggcucuucuccu

SEQ ID NO: 1970562 - RNA, 13 nt, Human
ggcucuucuccuu

SEQ ID NO: 1970563 - RNA, 13 nt, Human
ggcucucaggcca

SEQ ID NO: 1970564 - RNA, 14 nt, Human
ggcucucaggccag

SEQ ID NO: 1970565 - RNA, 17 nt, Human
ggcucucaaugcuguuu

SEQ ID NO: 1970566 - RNA, 21 nt, Human
ggcugccaaugggagcucaug

SEQ ID NO: 1970567 - RNA, 13 nt, Human
ggcugcccuggug

SEQ ID NO: 1970568 - RNA, 14 nt, Human
ggcugcccuggugc

SEQ ID NO: 1970569 - RNA, 15 nt, Human
ggcugcccuggugcu

SEQ ID NO: 1970570 - RNA, 16 nt, Human
ggcugcccuggugcug

SEQ ID NO: 1970571 - RNA, 19 nt, Human
ggcugcccuggugcugcca

SEQ ID NO: 1970572 - RNA, 22 nt, Human
ggcugcggaaugaaccacaucu

SEQ ID NO: 1970573 - RNA, 16 nt, Human
ggcugccuuagaaccu

SEQ ID NO: 1970574 - RNA, 22 nt, Human
ggcugcccuggugcugccacac

SEQ ID NO: 1970575 - RNA, 20 nt, Human
ggcugccaaugggagcucau

SEQ ID NO: 1970576 - RNA, 19 nt, Human
ggcugccaaugggagcuca

SEQ ID NO: 1970577 - RNA, 16 nt, Human
ggcucuucuccuuuca

SEQ ID NO: 1970578 - RNA, 22 nt, Human
ggcugacagacagcccuccauc

SEQ ID NO: 1970579 - RNA, 14 nt, Human
ggcucuucuccuuu

SEQ ID NO: 1970580 - RNA, 15 nt, Human
ggcucuucuccuuuc

SEQ ID NO: 1970581 - RNA, 23 nt, Human
ggcucuucuccuuucacaaccuu

SEQ ID NO: 1970582 - RNA, 9 nt, Human
ggcuucaua

SEQ ID NO: 1970583 - RNA, 11 nt, Human
ggcuucauaca

SEQ ID NO: 1970584 - RNA, 18 nt, Human
ggcuucauccuccucaga

SEQ ID NO: 1970585 - RNA, 22 nt, Human
ggcuucauccuccucagaucuu

SEQ ID NO: 1970586 - RNA, 12 nt, Human
ggcuucauacac

SEQ ID NO: 1970587 - RNA, 14 nt, Human
ggcuucccgcucag

SEQ ID NO: 1970588 - RNA, 16 nt, Human
ggcuuccucauaguau

SEQ ID NO: 1970589 - RNA, 19 nt, Human
ggcuucccgcucagcccuc

SEQ ID NO: 1970590 - RNA, 21 nt, Human
ggcuucccgcucagcccuccc

SEQ ID NO: 1970591 - RNA, 15 nt, Human
ggcuucccgcucagc

SEQ ID NO: 1970592 - RNA, 16 nt, Human
ggcuucccgcucagcc

SEQ ID NO: 1970593 - RNA, 17 nt, Human
ggcuucccgcucagccc

SEQ ID NO: 1970594 - RNA, 18 nt, Human
ggcuucccgcucagcccu

SEQ ID NO: 1970595 - RNA, 18 nt, Human
ggcuucaguggcagcugc

SEQ ID NO: 1970596 - RNA, 17 nt, Human
ggcuucaguggcagcug

SEQ ID NO: 1970597 - RNA, 19 nt, Human
ggcuucaguggcagcugcu

SEQ ID NO: 1970598 - RNA, 20 nt, Human
ggcuucaguggcagcugcuu

SEQ ID NO: 1970599 - RNA, 18 nt, Human
ggcuguaucccaugagcc

SEQ ID NO: 1970600 - RNA, 21 nt, Human
ggcuggguucuacccaggugc

SEQ ID NO: 1970601 - RNA, 19 nt, Human
ggcuggguucuacccaggu

SEQ ID NO: 1970602 - RNA, 19 nt, Human
ggcuggguggcaccagcag

SEQ ID NO: 1970603 - RNA, 20 nt, Human
ggcugggucgcccuggacug

SEQ ID NO: 1970604 - RNA, 17 nt, Human
ggcugggucgcccugga

SEQ ID NO: 1970605 - RNA, 14 nt, Human
ggcugggucgcccu

SEQ ID NO: 1970606 - RNA, 15 nt, Human
ggcugggggccucag

SEQ ID NO: 1970607 - RNA, 16 nt, Human
ggcugggggccucagu

SEQ ID NO: 1970608 - RNA, 17 nt, Human
ggcugggggccucagug

SEQ ID NO: 1970609 - RNA, 19 nt, Human
ggcugggggccucagugcc

SEQ ID NO: 1970610 - RNA, 18 nt, Human
aaaaauaacuguaauuau

SEQ ID NO: 1970611 - RNA, 19 nt, Human
aaaaauaacuguaauuauu

SEQ ID NO: 1970612 - RNA, 11 nt, Human
aaaaauaaagc

SEQ ID NO: 1970613 - RNA, 12 nt, Human
aaaaauaaagca

SEQ ID NO: 1970614 - RNA, 14 nt, Human
aaaaauaacaauga

SEQ ID NO: 1970615 - RNA, 21 nt, Human
ggcuuccuccugguguggaag

SEQ ID NO: 1970616 - RNA, 22 nt, Human
ggcuucccgcucagcccucccu

SEQ ID NO: 1970617 - RNA, 16 nt, Human
ggcuucugugcccaga

SEQ ID NO: 1970618 - RNA, 12 nt, Human
gggaacgcccac

SEQ ID NO: 1970619 - RNA, 16 nt, Human
gggaacgcccacuucc

SEQ ID NO: 1970620 - RNA, 19 nt, Human
gggaacgcccacuucccug

SEQ ID NO: 1970621 - RNA, 20 nt, Human
gggaacgcccacuucccugg

SEQ ID NO: 1970622 - RNA, 15 nt, Human
gggaacguucucuuu

SEQ ID NO: 1970623 - RNA, 18 nt, Human
gggaagaagcucucuccu

SEQ ID NO: 1970624 - RNA, 13 nt, Human
gggaaccugaccc

SEQ ID NO: 1970625 - RNA, 17 nt, Human
gggacaggggcaggagg

SEQ ID NO: 1970626 - RNA, 18 nt, Human
gggacaggggcaggagga

SEQ ID NO: 1970627 - RNA, 15 nt, Human
gggacagcuccuucu

SEQ ID NO: 1970628 - RNA, 12 nt, Human
gggacagucuca

SEQ ID NO: 1970629 - RNA, 15 nt, Human
gggacagucucacca

SEQ ID NO: 1970630 - RNA, 22 nt, Human
gggacauccugucaucugagaa

SEQ ID NO: 1970631 - RNA, 13 nt, Human
gggacagagcaga

SEQ ID NO: 1970632 - RNA, 12 nt, Human
gggacagcuccu

SEQ ID NO: 1970633 - RNA, 13 nt, Human
gggacagcuccuu

SEQ ID NO: 1970634 - RNA, 13 nt, Human
gggaagagacuug

SEQ ID NO: 1970635 - RNA, 17 nt, Human
aaaaaugguuuaaaugg

SEQ ID NO: 1970636 - RNA, 12 nt, Human
gggaccagcuug

SEQ ID NO: 1970637 - RNA, 21 nt, Human
gggaccacaggugcccgccac

SEQ ID NO: 1970638 - RNA, 20 nt, Human
gggaccagagcugccaccug

SEQ ID NO: 1970639 - RNA, 14 nt, Human
gggaccagagcugc

SEQ ID NO: 1970640 - RNA, 11 nt, Human
aaaaccaggcc

SEQ ID NO: 1970641 - RNA, 12 nt, Human
aaaacccaagug

SEQ ID NO: 1970642 - RNA, 22 nt, Human
aaaacaucauuccuuuuuauuu

SEQ ID NO: 1970643 - RNA, 13 nt, Human
aaaacaugcuaca

SEQ ID NO: 1970644 - RNA, 14 nt, Human
aaaacaugcuacac

SEQ ID NO: 1970645 - RNA, 23 nt, Human
aaaagauguagauuuauuucauc

SEQ ID NO: 1970646 - RNA, 15 nt, Human
aaaacuucagacaua

SEQ ID NO: 1970647 - RNA, 23 nt, Human
aaaacugaaagugaaaguccaga

SEQ ID NO: 1970648 - RNA, 21 nt, Human
aaaacucuuuaacuuguaaua

SEQ ID NO: 1970649 - RNA, 13 nt, Human
aaaacucuuuaac

SEQ ID NO: 1970650 - RNA, 12 nt, Human
aaaacucuuuaa

SEQ ID NO: 1970651 - RNA, 18 nt, Human
aaaacucuccucugcugc

SEQ ID NO: 1970652 - RNA, 15 nt, Human
aaaacgauuuaauuu

SEQ ID NO: 1970653 - RNA, 16 nt, Human
aaaacgauuuaauuua

SEQ ID NO: 1970654 - RNA, 17 nt, Human
aaaacgauuuaauuuau

SEQ ID NO: 1970655 - RNA, 18 nt, Human
aaaaccugggauuauaua

SEQ ID NO: 1970656 - RNA, 14 nt, Human
aaaaccaggcuuuc

SEQ ID NO: 1970657 - RNA, 16 nt, Human
aaaaccaggcuuucua

SEQ ID NO: 1970658 - RNA, 13 nt, Human
aaaagcuuuguuu

SEQ ID NO: 1970659 - RNA, 19 nt, Human
aaaagcuuuguuuguucuu

SEQ ID NO: 1970660 - RNA, 18 nt, Human
aaaagccaagaggcugca

SEQ ID NO: 1970661 - RNA, 16 nt, Human
aaaagcauuuuguaau

SEQ ID NO: 1970662 - RNA, 14 nt, Human
aaaagcauuuugua

SEQ ID NO: 1970663 - RNA, 15 nt, Human
aaaagcauuuuguaa

SEQ ID NO: 1970664 - RNA, 23 nt, Human
aaaagccagguuccacagaggac

SEQ ID NO: 1970665 - RNA, 14 nt, Human
aaaagcccaggagc

SEQ ID NO: 1970666 - RNA, 17 nt, Human
aaaagcccaggagccca

SEQ ID NO: 1970667 - RNA, 13 nt, Human
aaaagcccaaccu

SEQ ID NO: 1970668 - RNA, 15 nt, Human
aaaagcccaaccucu

SEQ ID NO: 1970669 - RNA, 20 nt, Human
aaaagcccaaccucuuccuc

SEQ ID NO: 1970670 - RNA, 21 nt, Human
gggagaaccaaaaagaggcua

SEQ ID NO: 1970671 - RNA, 15 nt, Human
gggacuuggaagcuc

SEQ ID NO: 1970672 - RNA, 17 nt, Human
gggacuuggaagcuccg

SEQ ID NO: 1970673 - RNA, 18 nt, Human
gggacuuggaagcuccgc

SEQ ID NO: 1970674 - RNA, 23 nt, Human
gggacuuggaagcuccgcuuucu

SEQ ID NO: 1970675 - RNA, 13 nt, Human
gggagccaggagg

SEQ ID NO: 1970676 - RNA, 15 nt, Human
gggagcagggaaggc

SEQ ID NO: 1970677 - RNA, 19 nt, Human
gggagagccuuccaggggu

SEQ ID NO: 1970678 - RNA, 15 nt, Human
gggagagccuuccag

SEQ ID NO: 1970679 - RNA, 23 nt, Human
gggagcaggcucgggcuccccag

SEQ ID NO: 1970680 - RNA, 12 nt, Human
gggagagcugaa

SEQ ID NO: 1970681 - RNA, 16 nt, Human
gggagggagggcucca

SEQ ID NO: 1970682 - RNA, 15 nt, Human
gggagggagggcucc

SEQ ID NO: 1970683 - RNA, 18 nt, Human
gggaggucaaggcugcag

SEQ ID NO: 1970684 - RNA, 15 nt, Human
gggaggucgaggcag

SEQ ID NO: 1970685 - RNA, 14 nt, Human
guagacuacuguuc

SEQ ID NO: 1970686 - RNA, 18 nt, Human
guagacuggccugaacca

SEQ ID NO: 1970687 - RNA, 11 nt, Human
guagagacagg

SEQ ID NO: 1970688 - RNA, 12 nt, Human
guagagacaggg

SEQ ID NO: 1970689 - RNA, 15 nt, Human
guagagccagggucu

SEQ ID NO: 1970690 - RNA, 18 nt, Human
guagagccagggucucac

SEQ ID NO: 1970691 - RNA, 21 nt, Human
guagccucaaucgagugagac

SEQ ID NO: 1970692 - RNA, 13 nt, Human
guagagacagggu

SEQ ID NO: 1970693 - RNA, 10 nt, Human
guagagccag

SEQ ID NO: 1970694 - RNA, 15 nt, Human
guagagccagagguc

SEQ ID NO: 1970695 - RNA, 23 nt, Human
guagagacaggguuucaccaugu

SEQ ID NO: 1970696 - RNA, 11 nt, Human
guagagccagg

SEQ ID NO: 1970697 - RNA, 14 nt, Human
guagaauguuuuca

SEQ ID NO: 1970698 - RNA, 18 nt, Human
guagaaugaccuuguaau

SEQ ID NO: 1970699 - RNA, 20 nt, Human
guagaaugaccuuguaaugu

SEQ ID NO: 1970700 - RNA, 22 nt, Human
guagaaugaccuuguaauguaa

SEQ ID NO: 1970701 - RNA, 23 nt, Human
guagaaugaccuuguaauguaac

SEQ ID NO: 1970702 - RNA, 18 nt, Human
guagaagcccuucuaccu

SEQ ID NO: 1970703 - RNA, 21 nt, Human
guagaacuuuguauaguuaug

SEQ ID NO: 1970704 - RNA, 21 nt, Human
guagaagucuuagauguauau

SEQ ID NO: 1970705 - RNA, 16 nt, Human
guagaacgccagggac

SEQ ID NO: 1970706 - RNA, 22 nt, Human
guagaacgccagggaccccaga

SEQ ID NO: 1970707 - RNA, 13 nt, Human
guagaacuuugua

SEQ ID NO: 1970708 - RNA, 14 nt, Human
guagaacuuuguau

SEQ ID NO: 1970709 - RNA, 15 nt, Human
guagaacuuuguaua

SEQ ID NO: 1970710 - RNA, 23 nt, Human
guagaaauaucugaaaauguaug

SEQ ID NO: 1970711 - RNA, 21 nt, Human
guagaaauaucugaaaaugua

SEQ ID NO: 1970712 - RNA, 20 nt, Human
guagaaauaucugaaaaugu

SEQ ID NO: 1970713 - RNA, 19 nt, Human
guacuccacauauuucagu

SEQ ID NO: 1970714 - RNA, 14 nt, Human
guacuccucccagg

SEQ ID NO: 1970715 - RNA, 17 nt, Human
guacuauguaucaauga

SEQ ID NO: 1970716 - RNA, 15 nt, Human
guacuauguaucaau

SEQ ID NO: 1970717 - RNA, 19 nt, Human
guacuaguggcauggagaa

SEQ ID NO: 1970718 - RNA, 17 nt, Human
guacuacaguccuccca

SEQ ID NO: 1970719 - RNA, 13 nt, Human
guacuauguauca

SEQ ID NO: 1970720 - RNA, 20 nt, Human
guacuaguggcauggagaau

SEQ ID NO: 1970721 - RNA, 19 nt, Human
guacuaucuuaucucagau

SEQ ID NO: 1970722 - RNA, 19 nt, Human
guacuacaguccucccauc

SEQ ID NO: 1970723 - RNA, 18 nt, Human
guacuacaguccucccau

SEQ ID NO: 1970724 - RNA, 13 nt, Human
guacccacugcuc

SEQ ID NO: 1970725 - RNA, 14 nt, Human
guacccacugcucu

SEQ ID NO: 1970726 - RNA, 16 nt, Human
guacuggagaaaaugg

SEQ ID NO: 1970727 - RNA, 14 nt, Human
guacuggauuuaac

SEQ ID NO: 1970728 - RNA, 17 nt, Human
guacugagcagugauau

SEQ ID NO: 1970729 - RNA, 23 nt, Human
guacugaaagccuuagggaagcu

SEQ ID NO: 1970730 - RNA, 14 nt, Human
guacugaaagccuu

SEQ ID NO: 1970731 - RNA, 22 nt, Human
guacugaaagccuuagggaagc

SEQ ID NO: 1970732 - RNA, 21 nt, Human
guacugccccccaugaggaag

SEQ ID NO: 1970733 - RNA, 22 nt, Human
guacugccccccaugaggaagg

SEQ ID NO: 1970734 - RNA, 23 nt, Human
guacugccccccaugaggaagga

SEQ ID NO: 1970735 - RNA, 19 nt, Human
guacugccccccaugagga

SEQ ID NO: 1970736 - RNA, 11 nt, Human
guacugugaau

SEQ ID NO: 1970737 - RNA, 21 nt, Human
aaaucagacuaugaaguuuuu

SEQ ID NO: 1970738 - RNA, 14 nt, Human
aaaucagacuauga

SEQ ID NO: 1970739 - RNA, 15 nt, Human
aaauauuccugcauu

SEQ ID NO: 1970740 - RNA, 14 nt, Human
aaauauuagcaaag

SEQ ID NO: 1970741 - RNA, 21 nt, Human
aaauauacauguuuauguaaa

SEQ ID NO: 1970742 - RNA, 23 nt, Human
aaauauacauguuuauguaaaca

SEQ ID NO: 1970743 - RNA, 17 nt, Human
aaauauacauguuuaug

SEQ ID NO: 1970744 - RNA, 18 nt, Human
aaauauacauguuuaugu

SEQ ID NO: 1970745 - RNA, 19 nt, Human
aaauauacauguuuaugua

SEQ ID NO: 1970746 - RNA, 20 nt, Human
aaauauacauguuuauguaa

SEQ ID NO: 1970747 - RNA, 18 nt, Human
aaaucagccugcuccagc

SEQ ID NO: 1970748 - RNA, 16 nt, Human
aaaucagcugcuacua

SEQ ID NO: 1970749 - RNA, 12 nt, Human
aaaucagccugc

SEQ ID NO: 1970750 - RNA, 19 nt, Human
aaaucagccguguaaccau

SEQ ID NO: 1970751 - RNA, 15 nt, Human
aaaucaguaaacacu

SEQ ID NO: 1970752 - RNA, 15 nt, Human
aaauccacuuuaucu

SEQ ID NO: 1970753 - RNA, 15 nt, Human
aaauccaaauauugu

SEQ ID NO: 1970754 - RNA, 14 nt, Human
aaauccaaauauug

SEQ ID NO: 1970755 - RNA, 16 nt, Human
aaauccaaauauuguu

SEQ ID NO: 1970756 - RNA, 17 nt, Human
aaauccaaauauuguua

SEQ ID NO: 1970757 - RNA, 18 nt, Human
aaauccaaauauuguuaa

SEQ ID NO: 1970758 - RNA, 22 nt, Human
aaaucauacuccuaugcuuuag

SEQ ID NO: 1970759 - RNA, 14 nt, Human
guaccauuaaaaua

SEQ ID NO: 1970760 - RNA, 15 nt, Human
guaccauuaaaauau

SEQ ID NO: 1970761 - RNA, 22 nt, Human
guaccauuuaauggggaggaca

SEQ ID NO: 1970762 - RNA, 16 nt, Human
guaccauuaaaauaug

SEQ ID NO: 1970763 - RNA, 17 nt, Human
guaccauuaaaauaugc

SEQ ID NO: 1970764 - RNA, 21 nt, Human
guaccaguucuuuaagaagau

SEQ ID NO: 1970765 - RNA, 18 nt, Human
guaccauuaaaauaugca

SEQ ID NO: 1970766 - RNA, 23 nt, Human
guaccauuuaauggggaggacaa

SEQ ID NO: 1970767 - RNA, 12 nt, Human
guacccacugcu

SEQ ID NO: 1970768 - RNA, 18 nt, Human
guaccacugaaucuguac

SEQ ID NO: 1970769 - RNA, 19 nt, Human
guaccacugaaucuguaca

SEQ ID NO: 1970770 - RNA, 13 nt, Human
guaccagccccac

SEQ ID NO: 1970771 - RNA, 16 nt, Human
guaccagccccacccu

SEQ ID NO: 1970772 - RNA, 23 nt, Human
guaccaagacuacuagggaaaug

SEQ ID NO: 1970773 - RNA, 20 nt, Human
guaccaagacuacuagggaa

SEQ ID NO: 1970774 - RNA, 17 nt, Human
guaccacugaaucugua

SEQ ID NO: 1970775 - RNA, 22 nt, Human
guaccaaugcagaacucccaag

SEQ ID NO: 1970776 - RNA, 14 nt, Human
guacauuuuuugaa

SEQ ID NO: 1970777 - RNA, 20 nt, Human
guacauuuuuugaaaugcug

SEQ ID NO: 1970778 - RNA, 19 nt, Human
guacauuuuuugaaaugcu

SEQ ID NO: 1970779 - RNA, 18 nt, Human
guacauuucuaagucaaa

SEQ ID NO: 1970780 - RNA, 15 nt, Human
guacauucucaguuu

SEQ ID NO: 1970781 - RNA, 14 nt, Human
guacaugaaaacac

SEQ ID NO: 1970782 - RNA, 15 nt, Human
guacaugaaaacaca

SEQ ID NO: 1970783 - RNA, 16 nt, Human
guacaugaaaacacau

SEQ ID NO: 1970784 - RNA, 11 nt, Human
aaauccagaaa

SEQ ID NO: 1970785 - RNA, 22 nt, Human
aaauccagaaacuuguucuucc

SEQ ID NO: 1970786 - RNA, 23 nt, Human
aaauccagaaacuuguucuucca

SEQ ID NO: 1970787 - RNA, 11 nt, Human
aaauccaggac

SEQ ID NO: 1970788 - RNA, 12 nt, Human
aaauccaggacc

SEQ ID NO: 1970789 - RNA, 13 nt, Human
aaauccaggaccc

SEQ ID NO: 1970790 - RNA, 19 nt, Human
aaauccaggacccugccag

SEQ ID NO: 1970791 - RNA, 21 nt, Human
aaauccaggacccugccaggc

SEQ ID NO: 1970792 - RNA, 17 nt, Human
guacaugaaaacacauu

SEQ ID NO: 1970793 - RNA, 18 nt, Human
guacaugaaaacacauuu

SEQ ID NO: 1970794 - RNA, 19 nt, Human
guacaugaaaacacauuuu

SEQ ID NO: 1970795 - RNA, 20 nt, Human
guacaugaaaacacauuuuu

SEQ ID NO: 1970796 - RNA, 12 nt, Human
guacaugggacu

SEQ ID NO: 1970797 - RNA, 19 nt, Human
guacauggaauaacaugua

SEQ ID NO: 1970798 - RNA, 22 nt, Human
guacaugggacuaugcuuuucu

SEQ ID NO: 1970799 - RNA, 13 nt, Human
guacauguauuaa

SEQ ID NO: 1970800 - RNA, 16 nt, Human
guacauguauuaaauu

SEQ ID NO: 1970801 - RNA, 20 nt, Human
aaagguauuuuaaucaccaa

SEQ ID NO: 1970802 - RNA, 20 nt, Human
aaaguacacuguuucaaacu

SEQ ID NO: 1970803 - RNA, 20 nt, Human
aaaggucaccucacucagca

SEQ ID NO: 1970804 - RNA, 24 nt, Human
aaaggucaccucacucagcaccac

SEQ ID NO: 1970805 - RNA, 16 nt, Human
aaaggucaccucacuc

SEQ ID NO: 1970806 - RNA, 19 nt, Human
aaaggucaccucacucagc

SEQ ID NO: 1970807 - RNA, 18 nt, Human
aaaguacagguacuuugu

SEQ ID NO: 1970808 - RNA, 20 nt, Human
aaaguacagguacuuugucu

SEQ ID NO: 1970809 - RNA, 22 nt, Human
aaaguacagguacuuugucuaa

SEQ ID NO: 1970810 - RNA, 23 nt, Human
aaaggucuuggugccucugcagu

SEQ ID NO: 1970811 - RNA, 14 nt, Human
aaaguacagguacu

SEQ ID NO: 1970812 - RNA, 16 nt, Human
aaaguacagguacuuu

SEQ ID NO: 1970813 - RNA, 19 nt, Human
aaaguacuucuccacccug

SEQ ID NO: 1970814 - RNA, 15 nt, Human
aaaguacauuuuuug

SEQ ID NO: 1970815 - RNA, 18 nt, Human
aaaguacauuuuuugaaa

SEQ ID NO: 1970816 - RNA, 19 nt, Human
aaaguacauuuuuugaaau

SEQ ID NO: 1970817 - RNA, 18 nt, Human
aaaguacugagcagugau

SEQ ID NO: 1970818 - RNA, 18 nt, Human
aaaguaucccuacuguaa

SEQ ID NO: 1970819 - RNA, 23 nt, Human
aaaguacuucuccacccugcucu

SEQ ID NO: 1970820 - RNA, 21 nt, Human
aaaguacugagcagugauauu

SEQ ID NO: 1970821 - RNA, 20 nt, Human
aaaguacuucuccacccugc

SEQ ID NO: 1970822 - RNA, 21 nt, Human
aaaguacuucuccacccugcu

SEQ ID NO: 1970823 - RNA, 16 nt, Human
aaaguauucucuuuuc

SEQ ID NO: 1970824 - RNA, 13 nt, Human
aaaguauugccaa

SEQ ID NO: 1970825 - RNA, 14 nt, Human
aaaguauugccaaa

SEQ ID NO: 1970826 - RNA, 15 nt, Human
aaaguauugccaaac

SEQ ID NO: 1970827 - RNA, 18 nt, Human
aaaguauugccaaacauu

SEQ ID NO: 1970828 - RNA, 16 nt, Human
aaaguuaccagugccu

SEQ ID NO: 1970829 - RNA, 22 nt, Human
aaaguuaccagugccuuaaacu

SEQ ID NO: 1970830 - RNA, 14 nt, Human
aaaguauucucuuu

SEQ ID NO: 1970831 - RNA, 16 nt, Human
aaaguauguuuuacuu

SEQ ID NO: 1970832 - RNA, 19 nt, Human
aaaguauugccaaacauua

SEQ ID NO: 1970833 - RNA, 15 nt, Human
aaaguuauuaaaauu

SEQ ID NO: 1970834 - RNA, 16 nt, Human
aaaguuauuaaaauug

SEQ ID NO: 1970835 - RNA, 23 nt, Human
aaaguucugcagauaaacaguag

SEQ ID NO: 1970836 - RNA, 12 nt, Human
aaauaagaaaag

SEQ ID NO: 1970837 - RNA, 13 nt, Human
aaauaagaaaaga

SEQ ID NO: 1970838 - RNA, 22 nt, Human
aaauaagaaaagauguagauuu

SEQ ID NO: 1970839 - RNA, 18 nt, Human
aaauaauaucucuaauau

SEQ ID NO: 1970840 - RNA, 19 nt, Human
aaauaauaccuuagaaggu

SEQ ID NO: 1970841 - RNA, 12 nt, Human
aaauaauuuugu

SEQ ID NO: 1970842 - RNA, 16 nt, Human
aaauaauuuacuguga

SEQ ID NO: 1970843 - RNA, 13 nt, Human
aaauaauuuugua

SEQ ID NO: 1970844 - RNA, 14 nt, Human
aaauaauuuuguaa

SEQ ID NO: 1970845 - RNA, 22 nt, Human
aaauaauucuuuuuuauuaauc

SEQ ID NO: 1970846 - RNA, 18 nt, Human
aaauaauuuuauuccaga

SEQ ID NO: 1970847 - RNA, 15 nt, Human
guaaacaucucagag

SEQ ID NO: 1970848 - RNA, 14 nt, Human
guaaaccugucuga

SEQ ID NO: 1970849 - RNA, 13 nt, Human
aaauaacuguaau

SEQ ID NO: 1970850 - RNA, 15 nt, Human
aaauaacuguaauua

SEQ ID NO: 1970851 - RNA, 16 nt, Human
aaauaacuguaauuau

SEQ ID NO: 1970852 - RNA, 21 nt, Human
aaauaacuguaauuauuugaa

SEQ ID NO: 1970853 - RNA, 22 nt, Human
aaauaacuguaauuauuugaau

SEQ ID NO: 1970854 - RNA, 18 nt, Human
aaaguuguaugaucugug

SEQ ID NO: 1970855 - RNA, 19 nt, Human
aaaguuguaugaucugugc

SEQ ID NO: 1970856 - RNA, 14 nt, Human
aaaguuguacuuua

SEQ ID NO: 1970857 - RNA, 15 nt, Human
aaaguuguacuuuaa

SEQ ID NO: 1970858 - RNA, 16 nt, Human
aaaguuguacuuuaaa

SEQ ID NO: 1970859 - RNA, 19 nt, Human
aaaguuguacuuuaaaaau

SEQ ID NO: 1970860 - RNA, 17 nt, Human
aaaguuguaugaucugu

SEQ ID NO: 1970861 - RNA, 17 nt, Human
aaaguugguaaaccuuu

SEQ ID NO: 1970862 - RNA, 16 nt, Human
aaaguugguaaaccuu

SEQ ID NO: 1970863 - RNA, 14 nt, Human
guaauaugcacaca

SEQ ID NO: 1970864 - RNA, 16 nt, Human
guaauaugcacacauu

SEQ ID NO: 1970865 - RNA, 17 nt, Human
guaauaugcacacauuu

SEQ ID NO: 1970866 - RNA, 18 nt, Human
guaauaugcacacauuuu

SEQ ID NO: 1970867 - RNA, 21 nt, Human
guaauccaagcaaaugugaau

SEQ ID NO: 1970868 - RNA, 12 nt, Human
guaauauauuua

SEQ ID NO: 1970869 - RNA, 19 nt, Human
guaauuuaaaauugugaug

SEQ ID NO: 1970870 - RNA, 20 nt, Human
guaauuuaaaauugugaugu

SEQ ID NO: 1970871 - RNA, 17 nt, Human
guaauuguuguuuguau

SEQ ID NO: 1970872 - RNA, 19 nt, Human
guaauuguuguuuguaugu

SEQ ID NO: 1970873 - RNA, 21 nt, Human
guaauuguuguuuguauguau

SEQ ID NO: 1970874 - RNA, 23 nt, Human
guaauuguuguuuguauguauaa

SEQ ID NO: 1970875 - RNA, 12 nt, Human
guaauuguucca

SEQ ID NO: 1970876 - RNA, 21 nt, Human
guaauuguuccagagacaaau

SEQ ID NO: 1970877 - RNA, 23 nt, Human
guaauuuaaaauugugauguguc

SEQ ID NO: 1970878 - RNA, 22 nt, Human
guaauuugugauacaaugcugu

SEQ ID NO: 1970879 - RNA, 20 nt, Human
guaauaggcguaacuaauuu

SEQ ID NO: 1970880 - RNA, 14 nt, Human
guaauauaauacac

SEQ ID NO: 1970881 - RNA, 21 nt, Human
guaauauaauacacaaaauca

SEQ ID NO: 1970882 - RNA, 22 nt, Human
guaauauaauacacaaaaucaa

SEQ ID NO: 1970883 - RNA, 15 nt, Human
guaauaaagacucua

SEQ ID NO: 1970884 - RNA, 14 nt, Human
guaaacuuugaaau

SEQ ID NO: 1970885 - RNA, 16 nt, Human
guaaacuuugaaauau

SEQ ID NO: 1970886 - RNA, 14 nt, Human
guaaagaaaaauau

SEQ ID NO: 1970887 - RNA, 15 nt, Human
guaaagaaaaauauu

SEQ ID NO: 1970888 - RNA, 17 nt, Human
guaaagaaaaauauuua

SEQ ID NO: 1970889 - RNA, 21 nt, Human
guaaagaaaaauauuuaaugu

SEQ ID NO: 1970890 - RNA, 22 nt, Human
guaacugcucuugggcaauauu

SEQ ID NO: 1970891 - RNA, 13 nt, Human
aaauauacauguu

SEQ ID NO: 1970892 - RNA, 14 nt, Human
aaauauacauguuu

SEQ ID NO: 1970893 - RNA, 15 nt, Human
aaauauacauguuua

SEQ ID NO: 1970894 - RNA, 16 nt, Human
aaauauacauguuuau

SEQ ID NO: 1970895 - RNA, 14 nt, Human
aaauacuguacaau

SEQ ID NO: 1970896 - RNA, 15 nt, Human
aaauacuguacaaug

SEQ ID NO: 1970897 - RNA, 22 nt, Human
aaauacgugggcauucaaaugu

SEQ ID NO: 1970898 - RNA, 17 nt, Human
aaauacauuuaaaacau

SEQ ID NO: 1970899 - RNA, 19 nt, Human
aaauacauucuuuuugcuc

SEQ ID NO: 1970900 - RNA, 23 nt, Human
aaauaccaaaccuucugacuuug

SEQ ID NO: 1970901 - RNA, 20 nt, Human
aaauaccacaaucaccgaug

SEQ ID NO: 1970902 - RNA, 18 nt, Human
aaauaccagccaguaaau

SEQ ID NO: 1970903 - RNA, 18 nt, Human
aaauacauucuuuuugcu

SEQ ID NO: 1970904 - RNA, 13 nt, Human
aaauacauucuuu

SEQ ID NO: 1970905 - RNA, 17 nt, Human
aaauacagauagauaua

SEQ ID NO: 1970906 - RNA, 15 nt, Human
aaauacagacuggau

SEQ ID NO: 1970907 - RNA, 16 nt, Human
aaauacagauaaauga

SEQ ID NO: 1970908 - RNA, 20 nt, Human
aaauacagauaaaugauuca

SEQ ID NO: 1970909 - RNA, 22 nt, Human
aaauacagauaaaugauucaaa

SEQ ID NO: 1970910 - RNA, 14 nt, Human
aaauacaugaugau

SEQ ID NO: 1970911 - RNA, 20 nt, Human
aaauacaugaugauuucaga

SEQ ID NO: 1970912 - RNA, 17 nt, Human
guacacugaauuuuuau

SEQ ID NO: 1970913 - RNA, 13 nt, Human
guacacugccugc

SEQ ID NO: 1970914 - RNA, 17 nt, Human
guacacugccugccuua

SEQ ID NO: 1970915 - RNA, 14 nt, Human
guaauuuuguguaa

SEQ ID NO: 1970916 - RNA, 16 nt, Human
guaauuuuguguaaga

SEQ ID NO: 1970917 - RNA, 20 nt, Human
guaauuuuguguaagaaaua

SEQ ID NO: 1970918 - RNA, 13 nt, Human
guaauuuuucugu

SEQ ID NO: 1970919 - RNA, 15 nt, Human
guaauuuuucuguau

SEQ ID NO: 1970920 - RNA, 16 nt, Human
guaauuuuucuguaua

SEQ ID NO: 1970921 - RNA, 21 nt, Human
guaauuuuucuguauagacag

SEQ ID NO: 1970922 - RNA, 16 nt, Human
guacacccaugaaaga

SEQ ID NO: 1970923 - RNA, 17 nt, Human
guacacccaugaaagaa

SEQ ID NO: 1970924 - RNA, 18 nt, Human
guacacccaugaaagaaa

SEQ ID NO: 1970925 - RNA, 15 nt, Human
ggggccucagugcca

SEQ ID NO: 1970926 - RNA, 12 nt, Human
gggggccucagu

SEQ ID NO: 1970927 - RNA, 15 nt, Human
gggggccucagugcc

SEQ ID NO: 1970928 - RNA, 17 nt, Human
gggggccucagugccac

SEQ ID NO: 1970929 - RNA, 18 nt, Human
gggggccucagugccacu

SEQ ID NO: 1970930 - RNA, 11 nt, Human
ggggagaaagu

SEQ ID NO: 1970931 - RNA, 15 nt, Human
ggggacugccaccuc

SEQ ID NO: 1970932 - RNA, 17 nt, Human
ggggacugccaccuccc

SEQ ID NO: 1970933 - RNA, 14 nt, Human
ggggacugccaccu

SEQ ID NO: 1970934 - RNA, 12 nt, Human
aaacauguaugu

SEQ ID NO: 1970935 - RNA, 13 nt, Human
aaacauguaugug

SEQ ID NO: 1970936 - RNA, 17 nt, Human
aaacauggccuuugcuu

SEQ ID NO: 1970937 - RNA, 17 nt, Human
aaacaugguuugacucu

SEQ ID NO: 1970938 - RNA, 16 nt, Human
aaacauggccuuugcu

SEQ ID NO: 1970939 - RNA, 14 nt, Human
aaacaguagugaua

SEQ ID NO: 1970940 - RNA, 20 nt, Human
ggggacaaccuuggcuuggc

SEQ ID NO: 1970941 - RNA, 16 nt, Human
ggggaccagagcugcc

SEQ ID NO: 1970942 - RNA, 15 nt, Human
ggggaccagagcugc

SEQ ID NO: 1970943 - RNA, 15 nt, Human
ggggaccagcuuggc

SEQ ID NO: 1970944 - RNA, 18 nt, Human
ggggaauguuugccucug

SEQ ID NO: 1970945 - RNA, 22 nt, Human
ggggaauguuugccucugccuc

SEQ ID NO: 1970946 - RNA, 13 nt, Human
ggggaaggcaggg

SEQ ID NO: 1970947 - RNA, 11 nt, Human
aaacacauuuu

SEQ ID NO: 1970948 - RNA, 14 nt, Human
aaacacauaauuaa

SEQ ID NO: 1970949 - RNA, 18 nt, Human
aaacacauaauuaacacu

SEQ ID NO: 1970950 - RNA, 19 nt, Human
aaacacauaauuaacacuu

SEQ ID NO: 1970951 - RNA, 17 nt, Human
aaacaaaucuuuccaua

SEQ ID NO: 1970952 - RNA, 18 nt, Human
aaacacaaaacaaauccu

SEQ ID NO: 1970953 - RNA, 13 nt, Human
aaacaauucaaag

SEQ ID NO: 1970954 - RNA, 19 nt, Human
aaacacaaacgggcucagc

SEQ ID NO: 1970955 - RNA, 20 nt, Human
aaaauuuugauguuuuaagg

SEQ ID NO: 1970956 - RNA, 19 nt, Human
aaaauuuuaggcaaguuuu

SEQ ID NO: 1970957 - RNA, 20 nt, Human
aaacaaaggccuaauucuau

SEQ ID NO: 1970958 - RNA, 19 nt, Human
aaaauuuagaaauauaauu

SEQ ID NO: 1970959 - RNA, 19 nt, Human
aaaauuuacuacaauaugu

SEQ ID NO: 1970960 - RNA, 21 nt, Human
aaaauuuacuacaauauguac

SEQ ID NO: 1970961 - RNA, 12 nt, Human
aaaauuuuaagc

SEQ ID NO: 1970962 - RNA, 13 nt, Human
aaaauuuuaagcu

SEQ ID NO: 1970963 - RNA, 12 nt, Human
aaaauguuuuca

SEQ ID NO: 1970964 - RNA, 14 nt, Human
aaaauguuuucagc

SEQ ID NO: 1970965 - RNA, 17 nt, Human
gggaugauugaagaaac

SEQ ID NO: 1970966 - RNA, 15 nt, Human
gggaugauugaagaa

SEQ ID NO: 1970967 - RNA, 16 nt, Human
gggaugauugaagaaa

SEQ ID NO: 1970968 - RNA, 13 nt, Human
gggaugagaaagg

SEQ ID NO: 1970969 - RNA, 13 nt, Human
aaacucaucugga

SEQ ID NO: 1970970 - RNA, 18 nt, Human
aaacuauuuaaagaaaua

SEQ ID NO: 1970971 - RNA, 17 nt, Human
aaacucaaccaaauggu

SEQ ID NO: 1970972 - RNA, 18 nt, Human
aaacucaaccaaauggua

SEQ ID NO: 1970973 - RNA, 20 nt, Human
aaacucaaccaaaugguaca

SEQ ID NO: 1970974 - RNA, 22 nt, Human
aaacucaaccaaaugguacaaa

SEQ ID NO: 1970975 - RNA, 14 nt, Human
aaacucaagcuucu

SEQ ID NO: 1970976 - RNA, 13 nt, Human
aaacgucuuaaau

SEQ ID NO: 1970977 - RNA, 18 nt, Human
aaacguauaauauguaca

SEQ ID NO: 1970978 - RNA, 14 nt, Human
aaacgucuuaaaua

SEQ ID NO: 1970979 - RNA, 18 nt, Human
aaacuaggugcauauuua

SEQ ID NO: 1970980 - RNA, 15 nt, Human
aaacuaggcuccuuc

SEQ ID NO: 1970981 - RNA, 22 nt, Human
aaacuaggugcauauuuauaaa

SEQ ID NO: 1970982 - RNA, 20 nt, Human
ggguggcaucauuccaggcc

SEQ ID NO: 1970983 - RNA, 19 nt, Human
ggguggcaccagcagccug

SEQ ID NO: 1970984 - RNA, 17 nt, Human
aaacuuaaucuaaaugg

SEQ ID NO: 1970985 - RNA, 18 nt, Human
aaacuuaaucuaaaugga

SEQ ID NO: 1970986 - RNA, 16 nt, Human
aaacuuaaucuaaaug

SEQ ID NO: 1970987 - RNA, 14 nt, Human
aaacuuaaucuaaa

SEQ ID NO: 1970988 - RNA, 13 nt, Human
aaacucuccucug

SEQ ID NO: 1970989 - RNA, 22 nt, Human
aaacugcccccucugcccugcg

SEQ ID NO: 1970990 - RNA, 13 nt, Human
aaacucuaugguc

SEQ ID NO: 1970991 - RNA, 17 nt, Human
aaacucuauggucuuau

SEQ ID NO: 1970992 - RNA, 18 nt, Human
aaacucuauuuagaugca

SEQ ID NO: 1970993 - RNA, 19 nt, Human
aaacugcuuccuuucuuga

SEQ ID NO: 1970994 - RNA, 20 nt, Human
aaacugcuuccuuucuugau

SEQ ID NO: 1970995 - RNA, 14 nt, Human
aaacuggaaauacu

SEQ ID NO: 1970996 - RNA, 21 nt, Human
aaacuggaaauacuagauuug

SEQ ID NO: 1970997 - RNA, 13 nt, Human
aaacuggaaugag

SEQ ID NO: 1970998 - RNA, 15 nt, Human
aaacuggaaugagca

SEQ ID NO: 1970999 - RNA, 14 nt, Human
aaacuggaaugagc

SEQ ID NO: 1971000 - RNA, 21 nt, Human
aaacugucgugucauacucga

SEQ ID NO: 1971001 - RNA, 23 nt, Human
aaaccaagucaagugaaaaagga

SEQ ID NO: 1971002 - RNA, 16 nt, Human
aaaccaagccguggcu

SEQ ID NO: 1971003 - RNA, 15 nt, Human
aaacauuaugaugug

SEQ ID NO: 1971004 - RNA, 17 nt, Human
aaacauuaguacuuuau

SEQ ID NO: 1971005 - RNA, 21 nt, Human
aaacauuaguacuuuauagaa

SEQ ID NO: 1971006 - RNA, 24 nt, Human
aaacauuaguacuuuauagaagaa

SEQ ID NO: 1971007 - RNA, 14 nt, Human
aaacauuaauguug

SEQ ID NO: 1971008 - RNA, 15 nt, Human
aaacauuaauguuga

SEQ ID NO: 1971009 - RNA, 16 nt, Human
aaacauuaauguugau

SEQ ID NO: 1971010 - RNA, 19 nt, Human
aaacauuaauguugauuuc

SEQ ID NO: 1971011 - RNA, 20 nt, Human
aaacauuaauguugauuucu

SEQ ID NO: 1971012 - RNA, 22 nt, Human
aaacauuaauguugauuucuag

SEQ ID NO: 1971013 - RNA, 24 nt, Human
aaacauuaauguugauuucuaguu

SEQ ID NO: 1971014 - RNA, 14 nt, Human
aaacauuaguacuu

SEQ ID NO: 1971015 - RNA, 22 nt, Human
aaaccucuccucauguucugcu

SEQ ID NO: 1971016 - RNA, 11 nt, Human
aaaccucuccu

SEQ ID NO: 1971017 - RNA, 12 nt, Human
aaaccuuucccc

SEQ ID NO: 1971018 - RNA, 18 nt, Human
aaaccuuucuauaauuuu

SEQ ID NO: 1971019 - RNA, 18 nt, Human
aaaccuuuuauauuuagu

SEQ ID NO: 1971020 - RNA, 18 nt, Human
aaaccuuuguuugcaucu

SEQ ID NO: 1971021 - RNA, 15 nt, Human
aaacgggcucagcaa

SEQ ID NO: 1971022 - RNA, 21 nt, Human
aaaccuuucuauaauuuuaca

SEQ ID NO: 1971023 - RNA, 19 nt, Human
ggguccaguggaugccaca

SEQ ID NO: 1971024 - RNA, 20 nt, Human
ggguccaggccuacuccugu

SEQ ID NO: 1971025 - RNA, 19 nt, Human
gggggugcugggccccugc

SEQ ID NO: 1971026 - RNA, 11 nt, Human
ggggggcagag

SEQ ID NO: 1971027 - RNA, 13 nt, Human
ggggggcagagcc

SEQ ID NO: 1971028 - RNA, 15 nt, Human
gggucgcccuggacu

SEQ ID NO: 1971029 - RNA, 13 nt, Human
gggucgcccugga

SEQ ID NO: 1971030 - RNA, 14 nt, Human
gggucgccuguccu

SEQ ID NO: 1971031 - RNA, 17 nt, Human
ggguccccuccaggagu

SEQ ID NO: 1971032 - RNA, 16 nt, Human
ggguccccagcccuuc

SEQ ID NO: 1971033 - RNA, 16 nt, Human
ggguccccuccaggag

SEQ ID NO: 1971034 - RNA, 15 nt, Human
ggguccuucuccaca

SEQ ID NO: 1971035 - RNA, 15 nt, Human
aaagaggaaugaagu

SEQ ID NO: 1971036 - RNA, 21 nt, Human
aaagagauuuaaacucugaau

SEQ ID NO: 1971037 - RNA, 14 nt, Human
aaagaugcuucuca

SEQ ID NO: 1971038 - RNA, 17 nt, Human
aaagaugcuucucacug

SEQ ID NO: 1971039 - RNA, 19 nt, Human
aaagaugcuucucacugcc

SEQ ID NO: 1971040 - RNA, 13 nt, Human
aaagacuguacaa

SEQ ID NO: 1971041 - RNA, 23 nt, Human
aaagacugaguacguugugcauu

SEQ ID NO: 1971042 - RNA, 14 nt, Human
aaagacugaucuca

SEQ ID NO: 1971043 - RNA, 11 nt, Human
aaagacuggca

SEQ ID NO: 1971044 - RNA, 19 nt, Human
aaagagaugaugaaaauau

SEQ ID NO: 1971045 - RNA, 20 nt, Human
aaagagaugaugaaaauauu

SEQ ID NO: 1971046 - RNA, 22 nt, Human
aaagagaugaugaaaauauuua

SEQ ID NO: 1971047 - RNA, 15 nt, Human
aaagagauuuaaacu

SEQ ID NO: 1971048 - RNA, 14 nt, Human
aaagacuguacaaa

SEQ ID NO: 1971049 - RNA, 14 nt, Human
gguccugcugcagu

SEQ ID NO: 1971050 - RNA, 12 nt, Human
gguccugcugca

SEQ ID NO: 1971051 - RNA, 11 nt, Human
gguccugcugc

SEQ ID NO: 1971052 - RNA, 14 nt, Human
gguccuucuccaca

SEQ ID NO: 1971053 - RNA, 13 nt, Human
gguccugcucagc

SEQ ID NO: 1971054 - RNA, 23 nt, Human
aaagauggcugugccucugccug

SEQ ID NO: 1971055 - RNA, 21 nt, Human
aaagauggcugugccucugcc

SEQ ID NO: 1971056 - RNA, 22 nt, Human
aaagauggcugugccucugccu

SEQ ID NO: 1971057 - RNA, 22 nt, Human
aaagacagggcugauaagcuaa

SEQ ID NO: 1971058 - RNA, 14 nt, Human
aaagacaugaaauu

SEQ ID NO: 1971059 - RNA, 15 nt, Human
aaagacccaggggga

SEQ ID NO: 1971060 - RNA, 16 nt, Human
aaagacccagggggag

SEQ ID NO: 1971061 - RNA, 22 nt, Human
aaagaccuggggcugcugugaa

SEQ ID NO: 1971062 - RNA, 13 nt, Human
aaagacagugaaa

SEQ ID NO: 1971063 - RNA, 19 nt, Human
ggguggggggcuucauaca

SEQ ID NO: 1971064 - RNA, 19 nt, Human
aaacuucagacauagaauu

SEQ ID NO: 1971065 - RNA, 17 nt, Human
ggguggggggcuucaua

SEQ ID NO: 1971066 - RNA, 14 nt, Human
ggguggccucccaa

SEQ ID NO: 1971067 - RNA, 19 nt, Human
aaacuuguaaauaaaggaa

SEQ ID NO: 1971068 - RNA, 16 nt, Human
aaacuuguauuaugug

SEQ ID NO: 1971069 - RNA, 21 nt, Human
aaacuuugagaucuaaaaaua

SEQ ID NO: 1971070 - RNA, 22 nt, Human
aaacuuugagaucuaaaaauaa

SEQ ID NO: 1971071 - RNA, 20 nt, Human
aaacuuugagaucuaaaaau

SEQ ID NO: 1971072 - RNA, 13 nt, Human
aaacuuugaaaua

SEQ ID NO: 1971073 - RNA, 15 nt, Human
aaacuuugaaauaua

SEQ ID NO: 1971074 - RNA, 12 nt, Human
aaacuuuguagu

SEQ ID NO: 1971075 - RNA, 21 nt, Human
aaacuuucuacucauuuuaau

SEQ ID NO: 1971076 - RNA, 15 nt, Human
aaacuuucuuaauau

SEQ ID NO: 1971077 - RNA, 12 nt, Human
aaacuuugaaau

SEQ ID NO: 1971078 - RNA, 22 nt, Human
aaaggaaagagggagguaagga

SEQ ID NO: 1971079 - RNA, 21 nt, Human
aaaggagagcuagcagcaggg

SEQ ID NO: 1971080 - RNA, 17 nt, Human
aaaggagauuggaagga

SEQ ID NO: 1971081 - RNA, 23 nt, Human
aaaggaagguaguucaagaaaug

SEQ ID NO: 1971082 - RNA, 14 nt, Human
aaagguaaaucaga

SEQ ID NO: 1971083 - RNA, 22 nt, Human
aaagggucuccgaaaugcuguc

SEQ ID NO: 1971084 - RNA, 16 nt, Human
aaaggagcaagaacuu

SEQ ID NO: 1971085 - RNA, 20 nt, Human
aaagggacugagaaauuuau

SEQ ID NO: 1971086 - RNA, 22 nt, Human
aaagggacuuggaagcuccgcu

SEQ ID NO: 1971087 - RNA, 21 nt, Human
aaagcugcucagggaaaagca

SEQ ID NO: 1971088 - RNA, 14 nt, Human
aaagcugcugugau

SEQ ID NO: 1971089 - RNA, 13 nt, Human
aaagcugcugaca

SEQ ID NO: 1971090 - RNA, 12 nt, Human
aaagcugaaaac

SEQ ID NO: 1971091 - RNA, 20 nt, Human
aaagcuuuguuuguucuugu

SEQ ID NO: 1971092 - RNA, 14 nt, Human
aaagcuuuguuugu

SEQ ID NO: 1971093 - RNA, 15 nt, Human
aaagcuuguuaagau

SEQ ID NO: 1971094 - RNA, 15 nt, Human
aaagcucacuuuacu

SEQ ID NO: 1971095 - RNA, 15 nt, Human
aaagcugaaaacugc

SEQ ID NO: 1971096 - RNA, 16 nt, Human
ggugcaaugaccuuuc

SEQ ID NO: 1971097 - RNA, 13 nt, Human
ggugcaaugaccu

SEQ ID NO: 1971098 - RNA, 18 nt, Human
ggugcaaaguucccuacu

SEQ ID NO: 1971099 - RNA, 12 nt, Human
ggugcaaugacc

SEQ ID NO: 1971100 - RNA, 18 nt, Human
ggugauccacccaccuca

SEQ ID NO: 1971101 - RNA, 23 nt, Human
ggugauccacccaccucagccuc

SEQ ID NO: 1971102 - RNA, 24 nt, Human
ggugauccacccaccucagccucc

SEQ ID NO: 1971103 - RNA, 13 nt, Human
ggugaacagaaca

SEQ ID NO: 1971104 - RNA, 13 nt, Human
ggucgaggcagga

SEQ ID NO: 1971105 - RNA, 14 nt, Human
ggucgcccuggacu

SEQ ID NO: 1971106 - RNA, 13 nt, Human
gguccuuuagaaa

SEQ ID NO: 1971107 - RNA, 15 nt, Human
gguggaauuauuuua

SEQ ID NO: 1971108 - RNA, 13 nt, Human
gguggaugccugg

SEQ ID NO: 1971109 - RNA, 10 nt, Human
ggugcuuucc

SEQ ID NO: 1971110 - RNA, 16 nt, Human
ggugcugggccccugc

SEQ ID NO: 1971111 - RNA, 15 nt, Human
ggugcugggccccug

SEQ ID NO: 1971112 - RNA, 13 nt, Human
ggugcugggcccc

SEQ ID NO: 1971113 - RNA, 11 nt, Human
ggugcugggcc

SEQ ID NO: 1971114 - RNA, 21 nt, Human
ggugcauuugaggucuguucu

SEQ ID NO: 1971115 - RNA, 21 nt, Human
ggugcauauuuauaaaaauaa

SEQ ID NO: 1971116 - RNA, 12 nt, Human
ggugcaggcagg

SEQ ID NO: 1971117 - RNA, 20 nt, Human
auuuuaaaagauaaauauua

SEQ ID NO: 1971118 - RNA, 20 nt, Human
auuuuaaaagaugcaaugua

SEQ ID NO: 1971119 - RNA, 23 nt, Human
auuuuaaaacuucaucugucugu

SEQ ID NO: 1971120 - RNA, 13 nt, Human
auuuuaaaacaau

SEQ ID NO: 1971121 - RNA, 18 nt, Human
auuuuaaaacaauaggau

SEQ ID NO: 1971122 - RNA, 14 nt, Human
auuuuaaaauaaac

SEQ ID NO: 1971123 - RNA, 16 nt, Human
auuuuaaaauaaacuu

SEQ ID NO: 1971124 - RNA, 17 nt, Human
auuuuaaaauaaacuuu

SEQ ID NO: 1971125 - RNA, 19 nt, Human
auuuuaaaauaaacuuucu

SEQ ID NO: 1971126 - RNA, 13 nt, Human
auuuuaacuuaga

SEQ ID NO: 1971127 - RNA, 12 nt, Human
auuuuaaaaugu

SEQ ID NO: 1971128 - RNA, 13 nt, Human
auuuuaaaaugua

SEQ ID NO: 1971129 - RNA, 14 nt, Human
auuuuaaaauguac

SEQ ID NO: 1971130 - RNA, 15 nt, Human
auuuuaaaauguaca

SEQ ID NO: 1971131 - RNA, 18 nt, Human
auuuuaaaauguacaugu

SEQ ID NO: 1971132 - RNA, 22 nt, Human
auuuuaaaauguacauguauua

SEQ ID NO: 1971133 - RNA, 22 nt, Human
auuuuaaaaauacagauagaua

SEQ ID NO: 1971134 - RNA, 23 nt, Human
auuugugaaaugauggugaaagu

SEQ ID NO: 1971135 - RNA, 15 nt, Human
auuugucauuuucau

SEQ ID NO: 1971136 - RNA, 17 nt, Human
auuugucauuuucauua

SEQ ID NO: 1971137 - RNA, 21 nt, Human
auuugucauuuucauuagcaa

SEQ ID NO: 1971138 - RNA, 21 nt, Human
auuugugaagguggaaauaaa

SEQ ID NO: 1971139 - RNA, 18 nt, Human
auuugugaagguggaaau

SEQ ID NO: 1971140 - RNA, 18 nt, Human
auuugggagaagggcaga

SEQ ID NO: 1971141 - RNA, 22 nt, Human
auuugggagaagggcagaguua

SEQ ID NO: 1971142 - RNA, 18 nt, Human
auuuguaaauuuauguga

SEQ ID NO: 1971143 - RNA, 14 nt, Human
auuugggcagagag

SEQ ID NO: 1971144 - RNA, 19 nt, Human
auuuguaaauuuaugugau

SEQ ID NO: 1971145 - RNA, 18 nt, Human
auuugacuuucugucugu

SEQ ID NO: 1971146 - RNA, 15 nt, Human
auuugacuguuauuu

SEQ ID NO: 1971147 - RNA, 16 nt, Human
auuugucacugcuuca

SEQ ID NO: 1971148 - RNA, 22 nt, Human
auuugucaguguagaucaacuc

SEQ ID NO: 1971149 - RNA, 14 nt, Human
auuugucauuuuca

SEQ ID NO: 1971150 - RNA, 20 nt, Human
auuuguauuaauuuguaaga

SEQ ID NO: 1971151 - RNA, 16 nt, Human
auuuguauuuauucuu

SEQ ID NO: 1971152 - RNA, 17 nt, Human
auuuguauuuauucuuu

SEQ ID NO: 1971153 - RNA, 19 nt, Human
auuucccaaagcagugcau

SEQ ID NO: 1971154 - RNA, 23 nt, Human
auuucccagcccucuucuucuca

SEQ ID NO: 1971155 - RNA, 18 nt, Human
auuucccaacacaaagau

SEQ ID NO: 1971156 - RNA, 19 nt, Human
auuucccaacacaaagauu

SEQ ID NO: 1971157 - RNA, 14 nt, Human
auuuauuuaaauuu

SEQ ID NO: 1971158 - RNA, 12 nt, Human
auuuauuuaaau

SEQ ID NO: 1971159 - RNA, 16 nt, Human
auuuauuuauuuauuc

SEQ ID NO: 1971160 - RNA, 20 nt, Human
auuuauuucuuuuuugccaa

SEQ ID NO: 1971161 - RNA, 14 nt, Human
auuuauuucaucau

SEQ ID NO: 1971162 - RNA, 17 nt, Human
auuucuaggacugaauu

SEQ ID NO: 1971163 - RNA, 18 nt, Human
auuucuaggacugaauua

SEQ ID NO: 1971164 - RNA, 17 nt, Human
auuucccugaaggaacc

SEQ ID NO: 1971165 - RNA, 23 nt, Human
auuucccugaaggaaccaaagcg

SEQ ID NO: 1971166 - RNA, 20 nt, Human
auuucuaggacugaauuaug

SEQ ID NO: 1971167 - RNA, 23 nt, Human
auuucuaggacugaauuaugaaa

SEQ ID NO: 1971168 - RNA, 15 nt, Human
auuucuaguuauuua

SEQ ID NO: 1971169 - RNA, 16 nt, Human
auuucuaguuauuuau

SEQ ID NO: 1971170 - RNA, 17 nt, Human
auuucuaguuauuuauu

SEQ ID NO: 1971171 - RNA, 23 nt, Human
auuucuuccacaagagcccaggc

SEQ ID NO: 1971172 - RNA, 20 nt, Human
auuucuuccacaagagccca

SEQ ID NO: 1971173 - RNA, 18 nt, Human
auuugaaacacuuugcau

SEQ ID NO: 1971174 - RNA, 13 nt, Human
auuugaaacauug

SEQ ID NO: 1971175 - RNA, 17 nt, Human
auuugaaacauugcuuu

SEQ ID NO: 1971176 - RNA, 19 nt, Human
auuugaaacauugcuuuua

SEQ ID NO: 1971177 - RNA, 20 nt, Human
auuugaaacauugcuuuuaa

SEQ ID NO: 1971178 - RNA, 13 nt, Human
auuugaaagugcc

SEQ ID NO: 1971179 - RNA, 14 nt, Human
auuugaaagugccu

SEQ ID NO: 1971180 - RNA, 16 nt, Human
auuugaaaauuuugau

SEQ ID NO: 1971181 - RNA, 15 nt, Human
auuugaaaauuuuga

SEQ ID NO: 1971182 - RNA, 18 nt, Human
auuucuaguuauuuauuc

SEQ ID NO: 1971183 - RNA, 23 nt, Human
auuggguggggggcuucauacac

SEQ ID NO: 1971184 - RNA, 18 nt, Human
auugguaaagaauggaag

SEQ ID NO: 1971185 - RNA, 15 nt, Human
auugguaccuugcac

SEQ ID NO: 1971186 - RNA, 17 nt, Human
auugguaccuugcacac

SEQ ID NO: 1971187 - RNA, 18 nt, Human
auugguaccuugcacaca

SEQ ID NO: 1971188 - RNA, 19 nt, Human
auugguaccuugcacacau

SEQ ID NO: 1971189 - RNA, 23 nt, Human
auugguacugccuuaaagauaca

SEQ ID NO: 1971190 - RNA, 14 nt, Human
auugguuucucuuc

SEQ ID NO: 1971191 - RNA, 15 nt, Human
auugguuucucuucu

SEQ ID NO: 1971192 - RNA, 16 nt, Human
auugguuucucuucuc

SEQ ID NO: 1971193 - RNA, 17 nt, Human
auugguuucucuucucc

SEQ ID NO: 1971194 - RNA, 18 nt, Human
auugguuucucuucuccc

SEQ ID NO: 1971195 - RNA, 19 nt, Human
auugguuucucuucucccc

SEQ ID NO: 1971196 - RNA, 14 nt, Human
auugguuuuaugau

SEQ ID NO: 1971197 - RNA, 15 nt, Human
auugguuuuaugaug

SEQ ID NO: 1971198 - RNA, 17 nt, Human
auugguuuuaugaugac

SEQ ID NO: 1971199 - RNA, 18 nt, Human
auugguuuuaugaugacg

SEQ ID NO: 1971200 - RNA, 17 nt, Human
auuggauuuuauguuga

SEQ ID NO: 1971201 - RNA, 18 nt, Human
auuggauuuuauguugac

SEQ ID NO: 1971202 - RNA, 21 nt, Human
auuggauuuuauguugacauu

SEQ ID NO: 1971203 - RNA, 22 nt, Human
auuggauuuuauguugacauuu

SEQ ID NO: 1971204 - RNA, 19 nt, Human
auuggauucugagagcugu

SEQ ID NO: 1971205 - RNA, 22 nt, Human
auuggauucugagagcugugca

SEQ ID NO: 1971206 - RNA, 13 nt, Human
auuggauuuuaug

SEQ ID NO: 1971207 - RNA, 14 nt, Human
auugauugcuuuuu

SEQ ID NO: 1971208 - RNA, 15 nt, Human
auugauuguauauag

SEQ ID NO: 1971209 - RNA, 21 nt, Human
auugauuuccguuaaaauacc

SEQ ID NO: 1971210 - RNA, 12 nt, Human
auugcuuuuaaa

SEQ ID NO: 1971211 - RNA, 13 nt, Human
auugcuuuuaaaa

SEQ ID NO: 1971212 - RNA, 15 nt, Human
auugcuuuuaaaacu

SEQ ID NO: 1971213 - RNA, 16 nt, Human
auugcuuuuaaaacua

SEQ ID NO: 1971214 - RNA, 18 nt, Human
auugcuuuuaaaacuacu

SEQ ID NO: 1971215 - RNA, 16 nt, Human
auugcuuuuaaaauuu

SEQ ID NO: 1971216 - RNA, 17 nt, Human
auugcuuuuaaaauuuu

SEQ ID NO: 1971217 - RNA, 19 nt, Human
auugcuuuuaaaauuuuaa

SEQ ID NO: 1971218 - RNA, 19 nt, Human
auuggacaguaaaauccac

SEQ ID NO: 1971219 - RNA, 21 nt, Human
auugcuuuuaaaauuuuaagc

SEQ ID NO: 1971220 - RNA, 15 nt, Human
auuggaaaagacuaa

SEQ ID NO: 1971221 - RNA, 21 nt, Human
auuggaguuggaguagaaugu

SEQ ID NO: 1971222 - RNA, 20 nt, Human
auuggaguuggaguagaaug

SEQ ID NO: 1971223 - RNA, 18 nt, Human
auugucccuggcuuccuu

SEQ ID NO: 1971224 - RNA, 14 nt, Human
auuguccuauuagu

SEQ ID NO: 1971225 - RNA, 18 nt, Human
auuguccuauuaguguua

SEQ ID NO: 1971226 - RNA, 20 nt, Human
auuguccuauuaguguuaua

SEQ ID NO: 1971227 - RNA, 21 nt, Human
auuguccuauuaguguuauau

SEQ ID NO: 1971228 - RNA, 23 nt, Human
auuguccuauuaguguuauauga

SEQ ID NO: 1971229 - RNA, 14 nt, Human
auugucauuaguga

SEQ ID NO: 1971230 - RNA, 13 nt, Human
auugugggaaggg

SEQ ID NO: 1971231 - RNA, 14 nt, Human
auugugggaagggg

SEQ ID NO: 1971232 - RNA, 16 nt, Human
auugucaaagugguga

SEQ ID NO: 1971233 - RNA, 23 nt, Human
auugucaaaguggugagaggcau

SEQ ID NO: 1971234 - RNA, 19 nt, Human
auugucaaugcuggagaaa

SEQ ID NO: 1971235 - RNA, 21 nt, Human
auugucaaugcuggagaaaaa

SEQ ID NO: 1971236 - RNA, 16 nt, Human
auugucaccugcuucu

SEQ ID NO: 1971237 - RNA, 17 nt, Human
auugucaccugcuucuc

SEQ ID NO: 1971238 - RNA, 19 nt, Human
auugucaccugcuucucug

SEQ ID NO: 1971239 - RNA, 21 nt, Human
auugucaccugcuucucugcc

SEQ ID NO: 1971240 - RNA, 14 nt, Human
auuuaaaagauaca

SEQ ID NO: 1971241 - RNA, 16 nt, Human
auuuaaaagauacagu

SEQ ID NO: 1971242 - RNA, 17 nt, Human
auuuaaaagauacaguu

SEQ ID NO: 1971243 - RNA, 13 nt, Human
auuuaaaagauac

SEQ ID NO: 1971244 - RNA, 21 nt, Human
auuguuuggggaugagaaagg

SEQ ID NO: 1971245 - RNA, 18 nt, Human
auuuaaagaaauauguau

SEQ ID NO: 1971246 - RNA, 23 nt, Human
auuuaaagaaauauguauucugu

SEQ ID NO: 1971247 - RNA, 15 nt, Human
auuuaaacucugaau

SEQ ID NO: 1971248 - RNA, 18 nt, Human
auuuaaacucugaauuua

SEQ ID NO: 1971249 - RNA, 21 nt, Human
auuuaaacucugaauuuaucu

SEQ ID NO: 1971250 - RNA, 23 nt, Human
auuuaaacucugaauuuaucuuu

SEQ ID NO: 1971251 - RNA, 18 nt, Human
auuuaaagaaaaaaaugu

SEQ ID NO: 1971252 - RNA, 19 nt, Human
auuuaaagaaaaaaauguc

SEQ ID NO: 1971253 - RNA, 16 nt, Human
auuugaaagugccuuu

SEQ ID NO: 1971254 - RNA, 20 nt, Human
auuuuggaaaauaaauuauu

SEQ ID NO: 1971255 - RNA, 12 nt, Human
auuuugcuuuaa

SEQ ID NO: 1971256 - RNA, 16 nt, Human
auuuugcuuuaauuuu

SEQ ID NO: 1971257 - RNA, 19 nt, Human
auuuuggaaaauaaauuau

SEQ ID NO: 1971258 - RNA, 14 nt, Human
auuuuggaaaauaa

SEQ ID NO: 1971259 - RNA, 12 nt, Human
auuuugcuuugu

SEQ ID NO: 1971260 - RNA, 11 nt, Human
auuuugcuuua

SEQ ID NO: 1971261 - RNA, 18 nt, Human
auuuugcuuugugauuuu

SEQ ID NO: 1971262 - RNA, 20 nt, Human
auuuugcuuugugauuuuug

SEQ ID NO: 1971263 - RNA, 14 nt, Human
auuuuguaauaaua

SEQ ID NO: 1971264 - RNA, 19 nt, Human
auuuuguaauaauaaagaa

SEQ ID NO: 1971265 - RNA, 22 nt, Human
auuuuguaauaauaaagaauag

SEQ ID NO: 1971266 - RNA, 20 nt, Human
auuuuguaauguaucaaaua

SEQ ID NO: 1971267 - RNA, 23 nt, Human
auuuuguaauguaucaaauacau

SEQ ID NO: 1971268 - RNA, 20 nt, Human
auuuuguaugcaagcaguuu

SEQ ID NO: 1971269 - RNA, 23 nt, Human
auuuuguaugcaagcaguuucaa

SEQ ID NO: 1971270 - RNA, 12 nt, Human
auuuuguaugca

SEQ ID NO: 1971271 - RNA, 13 nt, Human
auuuuguaugcaa

SEQ ID NO: 1971272 - RNA, 19 nt, Human
auuuugugcccccauguaa

SEQ ID NO: 1971273 - RNA, 15 nt, Human
auuuugugaguuugu

SEQ ID NO: 1971274 - RNA, 18 nt, Human
auuuugugaguuuguuuc

SEQ ID NO: 1971275 - RNA, 19 nt, Human
auuuugugaguuuguuucu

SEQ ID NO: 1971276 - RNA, 23 nt, Human
auuuugugaguuuguuucuuuga

SEQ ID NO: 1971277 - RNA, 16 nt, Human
auuuuguguaagaaau

SEQ ID NO: 1971278 - RNA, 17 nt, Human
auuuuguguaagaaaua

SEQ ID NO: 1971279 - RNA, 18 nt, Human
auuuuguguaagaaauac

SEQ ID NO: 1971280 - RNA, 20 nt, Human
auuuuguguaagaaauacag

SEQ ID NO: 1971281 - RNA, 19 nt, Human
auuuugugaaacagacuug

SEQ ID NO: 1971282 - RNA, 20 nt, Human
auuuugugaaacagacuugu

SEQ ID NO: 1971283 - RNA, 21 nt, Human
auuuugugaaacagacuugua

SEQ ID NO: 1971284 - RNA, 22 nt, Human
auuuugugaaacagacuuguau

SEQ ID NO: 1971285 - RNA, 24 nt, Human
auuuugugaaacagacuuguauau

SEQ ID NO: 1971286 - RNA, 18 nt, Human
auuuugugaagugaagga

SEQ ID NO: 1971287 - RNA, 23 nt, Human
auuuugucauauaagauucauau

SEQ ID NO: 1971288 - RNA, 20 nt, Human
auuuugucugccccaaguuu

SEQ ID NO: 1971289 - RNA, 16 nt, Human
auuuuguuucagugca

SEQ ID NO: 1971290 - RNA, 19 nt, Human
auuuuguguuuauucuuga

SEQ ID NO: 1971291 - RNA, 20 nt, Human
auuuuguguuuauucuugau

SEQ ID NO: 1971292 - RNA, 17 nt, Human
auuuuguguuuaggaac

SEQ ID NO: 1971293 - RNA, 17 nt, Human
auuuuguguugaagagc

SEQ ID NO: 1971294 - RNA, 17 nt, Human
auuuuguguuuauucuu

SEQ ID NO: 1971295 - RNA, 18 nt, Human
auuuuguguuuauucuug

SEQ ID NO: 1971296 - RNA, 20 nt, Human
auuuugcuaaaugugaauga

SEQ ID NO: 1971297 - RNA, 17 nt, Human
auuuugcgucagagaaa

SEQ ID NO: 1971298 - RNA, 21 nt, Human
auuuugcugucccuuuuccuu

SEQ ID NO: 1971299 - RNA, 18 nt, Human
auuuugcgucagagaaau

SEQ ID NO: 1971300 - RNA, 23 nt, Human
auuuugcuaaguaaaucucuucu

SEQ ID NO: 1971301 - RNA, 20 nt, Human
auuuugcauauccuuuuagu

SEQ ID NO: 1971302 - RNA, 22 nt, Human
auuuugcagaggcuaugggaag

SEQ ID NO: 1971303 - RNA, 15 nt, Human
auuuugcccuugaca

SEQ ID NO: 1971304 - RNA, 23 nt, Human
auuuugcccuugacaaagucaag

SEQ ID NO: 1971305 - RNA, 18 nt, Human
auuuugccagugggaacu

SEQ ID NO: 1971306 - RNA, 18 nt, Human
auuuugauguaaagaugu

SEQ ID NO: 1971307 - RNA, 17 nt, Human
auuuugauguaaagaug

SEQ ID NO: 1971308 - RNA, 15 nt, Human
auuuugauguuuuaa

SEQ ID NO: 1971309 - RNA, 17 nt, Human
auuuugauguuuuaagg

SEQ ID NO: 1971310 - RNA, 20 nt, Human
auuuugaucucacauuuuua

SEQ ID NO: 1971311 - RNA, 19 nt, Human
auuuugauccaagcugguc

SEQ ID NO: 1971312 - RNA, 19 nt, Human
auuuuccuguugucaagaa

SEQ ID NO: 1971313 - RNA, 20 nt, Human
auuuuccaucuaaaaauaua

SEQ ID NO: 1971314 - RNA, 19 nt, Human
auuuucccccuuggcucuc

SEQ ID NO: 1971315 - RNA, 17 nt, Human
auuuuaauaaacacucu

SEQ ID NO: 1971316 - RNA, 16 nt, Human
auuuuaauaaacacuc

SEQ ID NO: 1971317 - RNA, 15 nt, Human
auuuuaauaaacacu

SEQ ID NO: 1971318 - RNA, 19 nt, Human
auuuucccuauuagagaag

SEQ ID NO: 1971319 - RNA, 16 nt, Human
auuuuccugccaggca

SEQ ID NO: 1971320 - RNA, 22 nt, Human
auuuucccucagaaaaugagua

SEQ ID NO: 1971321 - RNA, 12 nt, Human
auuuuccugaua

SEQ ID NO: 1971322 - RNA, 14 nt, Human
auuuucuauaauuu

SEQ ID NO: 1971323 - RNA, 15 nt, Human
auuuucuauaauuua

SEQ ID NO: 1971324 - RNA, 22 nt, Human
auuuuucuuagggaaggauaca

SEQ ID NO: 1971325 - RNA, 20 nt, Human
auuuuucuuaaaaaguaacu

SEQ ID NO: 1971326 - RNA, 14 nt, Human
auuuuugcaggagc

SEQ ID NO: 1971327 - RNA, 10 nt, Human
auuuuugcuu

SEQ ID NO: 1971328 - RNA, 18 nt, Human
auuuuugagcccuuguuu

SEQ ID NO: 1971329 - RNA, 22 nt, Human
auuuuuggugggugaaaggaau

SEQ ID NO: 1971330 - RNA, 15 nt, Human
auuuuugguugaaua

SEQ ID NO: 1971331 - RNA, 17 nt, Human
auuuuugguugaauaaa

SEQ ID NO: 1971332 - RNA, 19 nt, Human
auuuuugguugaauaaacu

SEQ ID NO: 1971333 - RNA, 21 nt, Human
auuuuugcuuuugauaagaaa

SEQ ID NO: 1971334 - RNA, 14 nt, Human
auuuuugcuuuuga

SEQ ID NO: 1971335 - RNA, 15 nt, Human
auuuuugcuuuugau

SEQ ID NO: 1971336 - RNA, 12 nt, Human
auuuuucauauu

SEQ ID NO: 1971337 - RNA, 12 nt, Human
auuuuucucaug

SEQ ID NO: 1971338 - RNA, 21 nt, Human
auuuuucuuagggaaggauac

SEQ ID NO: 1971339 - RNA, 18 nt, Human
auuuuucuacugcucuuu

SEQ ID NO: 1971340 - RNA, 21 nt, Human
auuuuguuuuugucuuaaaaa

SEQ ID NO: 1971341 - RNA, 12 nt, Human
auuuuuguaauu

SEQ ID NO: 1971342 - RNA, 19 nt, Human
auuuuuguagagccagggu

SEQ ID NO: 1971343 - RNA, 18 nt, Human
auuuuuguauucaauuaa

SEQ ID NO: 1971344 - RNA, 19 nt, Human
auuuuuguauucaauuaaa

SEQ ID NO: 1971345 - RNA, 12 nt, Human
auuuuuguuguu

SEQ ID NO: 1971346 - RNA, 22 nt, Human
auuuuugugauuuugugauuga

SEQ ID NO: 1971347 - RNA, 13 nt, Human
auuuuuuaaaugc

SEQ ID NO: 1971348 - RNA, 14 nt, Human
auuuuuuaaaugca

SEQ ID NO: 1971349 - RNA, 18 nt, Human
auuuuuuaaauugaauuc

SEQ ID NO: 1971350 - RNA, 12 nt, Human
auuuuuugugug

SEQ ID NO: 1971351 - RNA, 18 nt, Human
auuuuuugguauuggcca

SEQ ID NO: 1971352 - RNA, 18 nt, Human
auuuuuuguuaaaugauu

SEQ ID NO: 1971353 - RNA, 13 nt, Human
auuuuuugaaaug

SEQ ID NO: 1971354 - RNA, 14 nt, Human
auuuuuugaaaugc

SEQ ID NO: 1971355 - RNA, 15 nt, Human
auuuuuugaaaugcu

SEQ ID NO: 1971356 - RNA, 16 nt, Human
auuuuuugaaaugcug

SEQ ID NO: 1971357 - RNA, 19 nt, Human
auuuuuugaaaugcugaaa

SEQ ID NO: 1971358 - RNA, 21 nt, Human
auuuuuugaaaugcugaaaau

SEQ ID NO: 1971359 - RNA, 19 nt, Human
auuuuuuacagcugccugc

SEQ ID NO: 1971360 - RNA, 21 nt, Human
auuuuuuaagugaaaauauag

SEQ ID NO: 1971361 - RNA, 20 nt, Human
auuuuuuauauauaugcaua

SEQ ID NO: 1971362 - RNA, 18 nt, Human
auuuuuuauauuucaagu

SEQ ID NO: 1971363 - RNA, 14 nt, Human
auuuuuuccuguuu

SEQ ID NO: 1971364 - RNA, 19 nt, Human
auucagacagcugccuggg

SEQ ID NO: 1971365 - RNA, 21 nt, Human
auuaguuuugaagauucuaug

SEQ ID NO: 1971366 - RNA, 21 nt, Human
auuaguuuagaacagguuuuu

SEQ ID NO: 1971367 - RNA, 15 nt, Human
auuaguuuagaacag

SEQ ID NO: 1971368 - RNA, 17 nt, Human
auuaguuuagaacaggu

SEQ ID NO: 1971369 - RNA, 19 nt, Human
auuaguguuauaugaacau

SEQ ID NO: 1971370 - RNA, 21 nt, Human
auuaguguuauaugaacauac

SEQ ID NO: 1971371 - RNA, 15 nt, Human
auuaguguuauauga

SEQ ID NO: 1971372 - RNA, 16 nt, Human
auuaguguuauaugaa

SEQ ID NO: 1971373 - RNA, 17 nt, Human
auuaguguuauaugaac

SEQ ID NO: 1971374 - RNA, 12 nt, Human
auuaguuuagaa

SEQ ID NO: 1971375 - RNA, 13 nt, Human
auuaguuuagaac

SEQ ID NO: 1971376 - RNA, 11 nt, Human
uuuguggaaaa

SEQ ID NO: 1971377 - RNA, 14 nt, Human
auuauauuaugaag

SEQ ID NO: 1971378 - RNA, 16 nt, Human
auuauauucauucuuu

SEQ ID NO: 1971379 - RNA, 20 nt, Human
auuauauuccucuugcauuu

SEQ ID NO: 1971380 - RNA, 15 nt, Human
auuauauuuacaaau

SEQ ID NO: 1971381 - RNA, 19 nt, Human
auuauacccccugcaaagc

SEQ ID NO: 1971382 - RNA, 15 nt, Human
auuauaccuguugcu

SEQ ID NO: 1971383 - RNA, 22 nt, Human
auuauacagaccgaacuguugu

SEQ ID NO: 1971384 - RNA, 17 nt, Human
auuauacaugaaauuca

SEQ ID NO: 1971385 - RNA, 16 nt, Human
auuccccacccucccc

SEQ ID NO: 1971386 - RNA, 13 nt, Human
auucaggaagcuc

SEQ ID NO: 1971387 - RNA, 21 nt, Human
auuccagagaguggcuccucc

SEQ ID NO: 1971388 - RNA, 19 nt, Human
auuccagagaguggcuccu

SEQ ID NO: 1971389 - RNA, 12 nt, Human
auuccagaggaa

SEQ ID NO: 1971390 - RNA, 20 nt, Human
auuccagcacuucaggaggc

SEQ ID NO: 1971391 - RNA, 17 nt, Human
auuccagagcugccagu

SEQ ID NO: 1971392 - RNA, 20 nt, Human
auucuaauaagcuaguugaa

SEQ ID NO: 1971393 - RNA, 14 nt, Human
auucuaauaagcua

SEQ ID NO: 1971394 - RNA, 16 nt, Human
auucuaauaagcuagu

SEQ ID NO: 1971395 - RNA, 19 nt, Human
auucuaauaagcuaguuga

SEQ ID NO: 1971396 - RNA, 14 nt, Human
auuccccuuccugu

SEQ ID NO: 1971397 - RNA, 23 nt, Human
auuccccgucucugguuccuccc

SEQ ID NO: 1971398 - RNA, 20 nt, Human
auucccgggugcagaauugu

SEQ ID NO: 1971399 - RNA, 17 nt, Human
auucagacagcugccug

SEQ ID NO: 1971400 - RNA, 16 nt, Human
auucagacagcugccu

SEQ ID NO: 1971401 - RNA, 15 nt, Human
auucagacagcugcc

SEQ ID NO: 1971402 - RNA, 14 nt, Human
auucagacagcugc

SEQ ID NO: 1971403 - RNA, 12 nt, Human
auucaggaagcu

SEQ ID NO: 1971404 - RNA, 22 nt, Human
auucaggaagcagcuuucccca

SEQ ID NO: 1971405 - RNA, 18 nt, Human
auucagacagcugccugg

SEQ ID NO: 1971406 - RNA, 20 nt, Human
auucacauuguauucagagu

SEQ ID NO: 1971407 - RNA, 13 nt, Human
auucacauuguau

SEQ ID NO: 1971408 - RNA, 21 nt, Human
auucacauguuuucaaaugga

SEQ ID NO: 1971409 - RNA, 16 nt, Human
auucaccaguacauuc

SEQ ID NO: 1971410 - RNA, 13 nt, Human
auucagacagcug

SEQ ID NO: 1971411 - RNA, 12 nt, Human
auucagacagcu

SEQ ID NO: 1971412 - RNA, 11 nt, Human
auucagacagc

SEQ ID NO: 1971413 - RNA, 15 nt, Human
auuauuauuuggccc

SEQ ID NO: 1971414 - RNA, 14 nt, Human
auuauuauucagaa

SEQ ID NO: 1971415 - RNA, 13 nt, Human
auuauguuaauau

SEQ ID NO: 1971416 - RNA, 14 nt, Human
auuauguuaauauu

SEQ ID NO: 1971417 - RNA, 16 nt, Human
auuauguuaauauuuc

SEQ ID NO: 1971418 - RNA, 17 nt, Human
auuauguuaauauuucu

SEQ ID NO: 1971419 - RNA, 14 nt, Human
auuaucuagauacu

SEQ ID NO: 1971420 - RNA, 18 nt, Human
auuaucuagauacuguau

SEQ ID NO: 1971421 - RNA, 16 nt, Human
auuauauuuggaugca

SEQ ID NO: 1971422 - RNA, 17 nt, Human
auuauauuuggaugcag

SEQ ID NO: 1971423 - RNA, 12 nt, Human
auuauauuugga

SEQ ID NO: 1971424 - RNA, 15 nt, Human
auuauauuuggaugc

SEQ ID NO: 1971425 - RNA, 15 nt, Human
auucacauguuuuca

SEQ ID NO: 1971426 - RNA, 16 nt, Human
auucacauguuuucaa

SEQ ID NO: 1971427 - RNA, 17 nt, Human
auucacauguuuucaaa

SEQ ID NO: 1971428 - RNA, 18 nt, Human
auucacauguuuucaaau

SEQ ID NO: 1971429 - RNA, 19 nt, Human
auucacauguuuucaaaug

SEQ ID NO: 1971430 - RNA, 13 nt, Human
auuauuuugauua

SEQ ID NO: 1971431 - RNA, 16 nt, Human
auuauuugaaugacua

SEQ ID NO: 1971432 - RNA, 14 nt, Human
auucuuaaauaugu

SEQ ID NO: 1971433 - RNA, 23 nt, Human
auucuucccaacuugccuuugaa

SEQ ID NO: 1971434 - RNA, 20 nt, Human
auucuucccaacuugccuuu

SEQ ID NO: 1971435 - RNA, 21 nt, Human
auucuucccaacuugccuuug

SEQ ID NO: 1971436 - RNA, 13 nt, Human
auucuuccucccu

SEQ ID NO: 1971437 - RNA, 18 nt, Human
auugaaaucuuuuugcuu

SEQ ID NO: 1971438 - RNA, 17 nt, Human
auugaaaucuuuuugcu

SEQ ID NO: 1971439 - RNA, 20 nt, Human
auugaaaucuuuuugcuuug

SEQ ID NO: 1971440 - RNA, 13 nt, Human
auucuuuuugcuc

SEQ ID NO: 1971441 - RNA, 14 nt, Human
auucuuuuugcucu

SEQ ID NO: 1971442 - RNA, 15 nt, Human
auucuuuuugcucua

SEQ ID NO: 1971443 - RNA, 19 nt, Human
auucuuuuugcucuaaaau

SEQ ID NO: 1971444 - RNA, 20 nt, Human
auucuuuuugcucuaaaaua

SEQ ID NO: 1971445 - RNA, 21 nt, Human
auucuuuuugcucuaaaauau

SEQ ID NO: 1971446 - RNA, 22 nt, Human
auucuuuuugcucuaaaauauu

SEQ ID NO: 1971447 - RNA, 14 nt, Human
auucuuuuuuauua

SEQ ID NO: 1971448 - RNA, 15 nt, Human
auucuuuuuuauuaa

SEQ ID NO: 1971449 - RNA, 16 nt, Human
auucuuuuuuauuaau

SEQ ID NO: 1971450 - RNA, 17 nt, Human
auucuuuuuuauuaauc

SEQ ID NO: 1971451 - RNA, 19 nt, Human
auucuuuuuuauuaaucac

SEQ ID NO: 1971452 - RNA, 20 nt, Human
auucuuuuuuauuaaucacu

SEQ ID NO: 1971453 - RNA, 21 nt, Human
auucuuuuuuauuaaucacug

SEQ ID NO: 1971454 - RNA, 15 nt, Human
auugaaaaaccauuu

SEQ ID NO: 1971455 - RNA, 22 nt, Human
auucuuuuuuauuaaucacugu

SEQ ID NO: 1971456 - RNA, 18 nt, Human
auucuuuuuuucucuaga

SEQ ID NO: 1971457 - RNA, 18 nt, Human
auugacacaguaccauuu

SEQ ID NO: 1971458 - RNA, 14 nt, Human
auugacaaguuuaa

SEQ ID NO: 1971459 - RNA, 19 nt, Human
auugacacuuaaaaauggu

SEQ ID NO: 1971460 - RNA, 17 nt, Human
auugaccugaggcccuu

SEQ ID NO: 1971461 - RNA, 11 nt, Human
auugacuucuu

SEQ ID NO: 1971462 - RNA, 16 nt, Human
auugacucuugaguug

SEQ ID NO: 1971463 - RNA, 19 nt, Human
auugacucuugaguuguuu

SEQ ID NO: 1971464 - RNA, 22 nt, Human
auugacucuugaguuguuuuug

SEQ ID NO: 1971465 - RNA, 13 nt, Human
auugacucuugag

SEQ ID NO: 1971466 - RNA, 14 nt, Human
auugacucuugagu

SEQ ID NO: 1971467 - RNA, 15 nt, Human
auugacucuugaguu

SEQ ID NO: 1971468 - RNA, 12 nt, Human
auugacaaguuu

SEQ ID NO: 1971469 - RNA, 15 nt, Human
auugacacuuaaaaa

SEQ ID NO: 1971470 - RNA, 17 nt, Human
auugacacuuaaaaaug

SEQ ID NO: 1971471 - RNA, 15 nt, Human
auugaacucugagag

SEQ ID NO: 1971472 - RNA, 18 nt, Human
auucugcucacauaucug

SEQ ID NO: 1971473 - RNA, 20 nt, Human
auucugccugcccaggcccc

SEQ ID NO: 1971474 - RNA, 21 nt, Human
auucugccugcccaggccccu

SEQ ID NO: 1971475 - RNA, 19 nt, Human
auucugcucacauaucugu

SEQ ID NO: 1971476 - RNA, 20 nt, Human
auucugcucacauaucuguc

SEQ ID NO: 1971477 - RNA, 21 nt, Human
auucugcucacauaucuguca

SEQ ID NO: 1971478 - RNA, 22 nt, Human
auucugcucacauaucugucau

SEQ ID NO: 1971479 - RNA, 15 nt, Human
auucuguaaaagaaa

SEQ ID NO: 1971480 - RNA, 17 nt, Human
auucuguaaaagaaaaa

SEQ ID NO: 1971481 - RNA, 19 nt, Human
auucuguuggccaguguga

SEQ ID NO: 1971482 - RNA, 21 nt, Human
auucuguuggccagugugaca

SEQ ID NO: 1971483 - RNA, 14 nt, Human
auucuguuggccag

SEQ ID NO: 1971484 - RNA, 11 nt, Human
auucugccugc

SEQ ID NO: 1971485 - RNA, 13 nt, Human
auucugccugccc

SEQ ID NO: 1971486 - RNA, 14 nt, Human
auucugccugccca

SEQ ID NO: 1971487 - RNA, 15 nt, Human
auucugccugcccag

SEQ ID NO: 1971488 - RNA, 16 nt, Human
auucugccugcccagg

SEQ ID NO: 1971489 - RNA, 17 nt, Human
auucugccugcccaggc

SEQ ID NO: 1971490 - RNA, 18 nt, Human
auucugccugcccaggcc

SEQ ID NO: 1971491 - RNA, 19 nt, Human
auucugccugcccaggccc

SEQ ID NO: 1971492 - RNA, 17 nt, Human
auucucauuugucacac

SEQ ID NO: 1971493 - RNA, 22 nt, Human
auucucaugccucagccuccug

SEQ ID NO: 1971494 - RNA, 12 nt, Human
auucucauucuu

SEQ ID NO: 1971495 - RNA, 21 nt, Human
auucucaugccucagccuccu

SEQ ID NO: 1971496 - RNA, 17 nt, Human
auucuaggaccuguguc

SEQ ID NO: 1971497 - RNA, 15 nt, Human
auucuagcuuugagc

SEQ ID NO: 1971498 - RNA, 16 nt, Human
auucuaggaccugugu

SEQ ID NO: 1971499 - RNA, 18 nt, Human
augggccuccugugugug

SEQ ID NO: 1971500 - RNA, 12 nt, Human
augggccugagu

SEQ ID NO: 1971501 - RNA, 20 nt, Human
uuugaaaugcugaaaauugc

SEQ ID NO: 1971502 - RNA, 13 nt, Human
uuugaaauggaaa

SEQ ID NO: 1971503 - RNA, 20 nt, Human
auggggauagauguguggac

SEQ ID NO: 1971504 - RNA, 14 nt, Human
auggggcagaaauc

SEQ ID NO: 1971505 - RNA, 20 nt, Human
augggcuggguucuacccag

SEQ ID NO: 1971506 - RNA, 15 nt, Human
augggcucaggaucu

SEQ ID NO: 1971507 - RNA, 20 nt, Human
uuucuuuuugaaucuuuaau

SEQ ID NO: 1971508 - RNA, 16 nt, Human
uuucuuuuugaaucuu

SEQ ID NO: 1971509 - RNA, 17 nt, Human
uuucuuuuugaaucuuu

SEQ ID NO: 1971510 - RNA, 19 nt, Human
uuucuuuuugaaucuuuaa

SEQ ID NO: 1971511 - RNA, 22 nt, Human
uuucuuugccaucucugcucca

SEQ ID NO: 1971512 - RNA, 20 nt, Human
uuucuuuuguuuuuugaagu

SEQ ID NO: 1971513 - RNA, 21 nt, Human
uuucuuuuguuuuuugaagug

SEQ ID NO: 1971514 - RNA, 14 nt, Human
uuugaaaucaguaa

SEQ ID NO: 1971515 - RNA, 15 nt, Human
uuugaaaucaguaaa

SEQ ID NO: 1971516 - RNA, 20 nt, Human
uuugaaaucaguaaacacug

SEQ ID NO: 1971517 - RNA, 21 nt, Human
uuugaaaucaguaaacacugu

SEQ ID NO: 1971518 - RNA, 12 nt, Human
uuugaaaugcug

SEQ ID NO: 1971519 - RNA, 14 nt, Human
uuugaaaacagaaa

SEQ ID NO: 1971520 - RNA, 16 nt, Human
uuugaaaacagaaauu

SEQ ID NO: 1971521 - RNA, 12 nt, Human
auggggcugcac

SEQ ID NO: 1971522 - RNA, 24 nt, Human
auggggcugcaccggcuggccugg

SEQ ID NO: 1971523 - RNA, 14 nt, Human
augggggugcauuu

SEQ ID NO: 1971524 - RNA, 17 nt, Human
augggggcacugaggac

SEQ ID NO: 1971525 - RNA, 16 nt, Human
auggggucucucacag

SEQ ID NO: 1971526 - RNA, 19 nt, Human
auggggucucucacagaca

SEQ ID NO: 1971527 - RNA, 20 nt, Human
auggggucucucacagacag

SEQ ID NO: 1971528 - RNA, 21 nt, Human
auggggucucucacagacagg

SEQ ID NO: 1971529 - RNA, 15 nt, Human
augggggugcauuug

SEQ ID NO: 1971530 - RNA, 22 nt, Human
auggguagggcucugacaaagc

SEQ ID NO: 1971531 - RNA, 23 nt, Human
auggguagggcucugacaaagcu

SEQ ID NO: 1971532 - RNA, 10 nt, Human
uuucuccccc

SEQ ID NO: 1971533 - RNA, 19 nt, Human
uuucugcagccacuauugu

SEQ ID NO: 1971534 - RNA, 15 nt, Human
uuucuggcuaugcau

SEQ ID NO: 1971535 - RNA, 16 nt, Human
uuucuggcuaugcauu

SEQ ID NO: 1971536 - RNA, 18 nt, Human
uuucuggcuaugcauuug

SEQ ID NO: 1971537 - RNA, 19 nt, Human
uuucuggcuaugcauuuga

SEQ ID NO: 1971538 - RNA, 15 nt, Human
augggauccuggagu

SEQ ID NO: 1971539 - RNA, 19 nt, Human
augggaugauugaagaaac

SEQ ID NO: 1971540 - RNA, 16 nt, Human
augggaugauugaaga

SEQ ID NO: 1971541 - RNA, 17 nt, Human
augggaugauugaagaa

SEQ ID NO: 1971542 - RNA, 18 nt, Human
augggaugauugaagaaa

SEQ ID NO: 1971543 - RNA, 12 nt, Human
uuucuguauaga

SEQ ID NO: 1971544 - RNA, 21 nt, Human
uuucugcagccacuauuguua

SEQ ID NO: 1971545 - RNA, 23 nt, Human
uuucugggcaccggggccucgga

SEQ ID NO: 1971546 - RNA, 16 nt, Human
uuucugggguuuuucu

SEQ ID NO: 1971547 - RNA, 19 nt, Human
uuucugggguuuuucuguu

SEQ ID NO: 1971548 - RNA, 11 nt, Human
uuucuuucagu

SEQ ID NO: 1971549 - RNA, 11 nt, Human
uuucuuugaaa

SEQ ID NO: 1971550 - RNA, 16 nt, Human
uuucuuugaauuuuca

SEQ ID NO: 1971551 - RNA, 17 nt, Human
uuucuuugaauuuucau

SEQ ID NO: 1971552 - RNA, 20 nt, Human
uuucuuugaauuuucauuuu

SEQ ID NO: 1971553 - RNA, 12 nt, Human
uuucuuugauca

SEQ ID NO: 1971554 - RNA, 16 nt, Human
uuucuuugaucaugaa

SEQ ID NO: 1971555 - RNA, 15 nt, Human
uuucuuugccaucuc

SEQ ID NO: 1971556 - RNA, 19 nt, Human
uuucuuugccaucucugcu

SEQ ID NO: 1971557 - RNA, 14 nt, Human
uuucuguauagaca

SEQ ID NO: 1971558 - RNA, 20 nt, Human
uuucuguucagcguuuugca

SEQ ID NO: 1971559 - RNA, 13 nt, Human
uuucuguguuuau

SEQ ID NO: 1971560 - RNA, 14 nt, Human
uuucuguuaaaaug

SEQ ID NO: 1971561 - RNA, 17 nt, Human
uuucuguuaaaaugcau

SEQ ID NO: 1971562 - RNA, 22 nt, Human
uuucuguucagcguuuugcaag

SEQ ID NO: 1971563 - RNA, 17 nt, Human
auggugcaaugaccuuu

SEQ ID NO: 1971564 - RNA, 16 nt, Human
auggugcaaugaccuu

SEQ ID NO: 1971565 - RNA, 16 nt, Human
auggugauuuuaaaug

SEQ ID NO: 1971566 - RNA, 17 nt, Human
auggugauuuuaaaugu

SEQ ID NO: 1971567 - RNA, 19 nt, Human
auggugauuuuaaaugugu

SEQ ID NO: 1971568 - RNA, 19 nt, Human
auggugcaaugaccuuuca

SEQ ID NO: 1971569 - RNA, 15 nt, Human
auggugcaaugaccu

SEQ ID NO: 1971570 - RNA, 13 nt, Human
auggugcaaugac

SEQ ID NO: 1971571 - RNA, 12 nt, Human
auggugcaauga

SEQ ID NO: 1971572 - RNA, 19 nt, Human
auggugaugcagucuuaga

SEQ ID NO: 1971573 - RNA, 20 nt, Human
auggugaugcagucuuagau

SEQ ID NO: 1971574 - RNA, 13 nt, Human
auggugauguuga

SEQ ID NO: 1971575 - RNA, 12 nt, Human
auggugauuuua

SEQ ID NO: 1971576 - RNA, 14 nt, Human
auggugauuuuaaa

SEQ ID NO: 1971577 - RNA, 20 nt, Human
auggugagggauacccaucc

SEQ ID NO: 1971578 - RNA, 15 nt, Human
augggugcuuggagg

SEQ ID NO: 1971579 - RNA, 16 nt, Human
auggugaugaaaugua

SEQ ID NO: 1971580 - RNA, 17 nt, Human
auggugaugaaauguaa

SEQ ID NO: 1971581 - RNA, 14 nt, Human
auggugaugaaaug

SEQ ID NO: 1971582 - RNA, 19 nt, Human
augguguucaaaaaacuug

SEQ ID NO: 1971583 - RNA, 24 nt, Human
auggugguugggacccaguggcag

SEQ ID NO: 1971584 - RNA, 21 nt, Human
augguuaccucugcauaaaua

SEQ ID NO: 1971585 - RNA, 12 nt, Human
augguggcuggg

SEQ ID NO: 1971586 - RNA, 13 nt, Human
augguggcugggu

SEQ ID NO: 1971587 - RNA, 15 nt, Human
augguggcuggguug

SEQ ID NO: 1971588 - RNA, 16 nt, Human
augguggggucuccuc

SEQ ID NO: 1971589 - RNA, 23 nt, Human
augguggggucuccucaggacca

SEQ ID NO: 1971590 - RNA, 17 nt, Human
augguggcuggguugga

SEQ ID NO: 1971591 - RNA, 15 nt, Human
augguuuucaaaaua

SEQ ID NO: 1971592 - RNA, 14 nt, Human
augguuuucaaaau

SEQ ID NO: 1971593 - RNA, 14 nt, Human
augguuuucuugug

SEQ ID NO: 1971594 - RNA, 16 nt, Human
augguuuucaaaauaa

SEQ ID NO: 1971595 - RNA, 11 nt, Human
auguaaaaagg

SEQ ID NO: 1971596 - RNA, 14 nt, Human
auguaaaaauaacc

SEQ ID NO: 1971597 - RNA, 16 nt, Human
augguucucaggccug

SEQ ID NO: 1971598 - RNA, 19 nt, Human
augguuccccuguucacuc

SEQ ID NO: 1971599 - RNA, 20 nt, Human
augguuccccuguucacucu

SEQ ID NO: 1971600 - RNA, 13 nt, Human
augguuguacaua

SEQ ID NO: 1971601 - RNA, 13 nt, Human
auguaaaagccua

SEQ ID NO: 1971602 - RNA, 13 nt, Human
auguaaacaaauc

SEQ ID NO: 1971603 - RNA, 15 nt, Human
auguaaacaaaucuu

SEQ ID NO: 1971604 - RNA, 16 nt, Human
auguaaacaaaucuuu

SEQ ID NO: 1971605 - RNA, 22 nt, Human
auguaaacaaaucuuuccauau

SEQ ID NO: 1971606 - RNA, 21 nt, Human
auguaaagcaaccaaaaagaa

SEQ ID NO: 1971607 - RNA, 13 nt, Human
auguaaauaauuc

SEQ ID NO: 1971608 - RNA, 14 nt, Human
auguaaauaauucu

SEQ ID NO: 1971609 - RNA, 16 nt, Human
auguaaauaauucuuu

SEQ ID NO: 1971610 - RNA, 13 nt, Human
auguacauguauu

SEQ ID NO: 1971611 - RNA, 14 nt, Human
auguacauguauua

SEQ ID NO: 1971612 - RNA, 19 nt, Human
augugaugagaggaaauca

SEQ ID NO: 1971613 - RNA, 17 nt, Human
augugaugagaggaaau

SEQ ID NO: 1971614 - RNA, 16 nt, Human
augugaugagaggaaa

SEQ ID NO: 1971615 - RNA, 23 nt, Human
augucucuuuaaugucacaggca

SEQ ID NO: 1971616 - RNA, 23 nt, Human
augugacauuugucauuuucauu

SEQ ID NO: 1971617 - RNA, 14 nt, Human
augugaugcuggaa

SEQ ID NO: 1971618 - RNA, 23 nt, Human
augugcacaugcacgugugugca

SEQ ID NO: 1971619 - RNA, 19 nt, Human
uuuguaauaauaaagaaua

SEQ ID NO: 1971620 - RNA, 19 nt, Human
augugcacaucuguuuugu

SEQ ID NO: 1971621 - RNA, 21 nt, Human
augugcaaacccacucagaga

SEQ ID NO: 1971622 - RNA, 12 nt, Human
uuuguauaaaag

SEQ ID NO: 1971623 - RNA, 14 nt, Human
uuuguaaugaaaac

SEQ ID NO: 1971624 - RNA, 13 nt, Human
uuuguaaugaaaa

SEQ ID NO: 1971625 - RNA, 21 nt, Human
uuuguaauaauaaagaauagc

SEQ ID NO: 1971626 - RNA, 18 nt, Human
uuugugaaacagacuugu

SEQ ID NO: 1971627 - RNA, 20 nt, Human
uuugugaaacagacuuguau

SEQ ID NO: 1971628 - RNA, 22 nt, Human
uuugugaaaugauggugaaagu

SEQ ID NO: 1971629 - RNA, 12 nt, Human
uuugugaaauuu

SEQ ID NO: 1971630 - RNA, 17 nt, Human
uuugugaaauuuuucau

SEQ ID NO: 1971631 - RNA, 18 nt, Human
uuugugaaauuuuucaua

SEQ ID NO: 1971632 - RNA, 20 nt, Human
uuugugaaauuuuucauauu

SEQ ID NO: 1971633 - RNA, 22 nt, Human
uuugugaacaagucccuguaau

SEQ ID NO: 1971634 - RNA, 21 nt, Human
uuugugaaauuuuucauauuu

SEQ ID NO: 1971635 - RNA, 20 nt, Human
uuugugaagguggaaauaaa

SEQ ID NO: 1971636 - RNA, 23 nt, Human
uuugugaagugaaggauuugugu

SEQ ID NO: 1971637 - RNA, 17 nt, Human
augucucugagcauuag

SEQ ID NO: 1971638 - RNA, 13 nt, Human
augucgccucugc

SEQ ID NO: 1971639 - RNA, 14 nt, Human
augucgccucugca

SEQ ID NO: 1971640 - RNA, 21 nt, Human
auguccugugucaguuuaugu

SEQ ID NO: 1971641 - RNA, 18 nt, Human
auguccugugucaguuua

SEQ ID NO: 1971642 - RNA, 20 nt, Human
auguccugugucaguuuaug

SEQ ID NO: 1971643 - RNA, 11 nt, Human
auguccugugu

SEQ ID NO: 1971644 - RNA, 13 nt, Human
auguccuguguca

SEQ ID NO: 1971645 - RNA, 17 nt, Human
augucucaggucccugc

SEQ ID NO: 1971646 - RNA, 22 nt, Human
augucucaggucccugcagggc

SEQ ID NO: 1971647 - RNA, 17 nt, Human
auguccacugguucuuc

SEQ ID NO: 1971648 - RNA, 13 nt, Human
augucagugugac

SEQ ID NO: 1971649 - RNA, 12 nt, Human
augucaguguga

SEQ ID NO: 1971650 - RNA, 16 nt, Human
auguccaguaagauca

SEQ ID NO: 1971651 - RNA, 18 nt, Human
auguccaguaagaucacu

SEQ ID NO: 1971652 - RNA, 19 nt, Human
auguccaguaagaucacug

SEQ ID NO: 1971653 - RNA, 20 nt, Human
auguccaguaagaucacugu

SEQ ID NO: 1971654 - RNA, 16 nt, Human
augucaguauguggaa

SEQ ID NO: 1971655 - RNA, 22 nt, Human
auguauuacaguggggaaugaa

SEQ ID NO: 1971656 - RNA, 21 nt, Human
auguauuaaauuacauuugua

SEQ ID NO: 1971657 - RNA, 12 nt, Human
auguauuaaauu

SEQ ID NO: 1971658 - RNA, 16 nt, Human
auguauuaaauuacau

SEQ ID NO: 1971659 - RNA, 23 nt, Human
auguauuaacacuacucaaagca

SEQ ID NO: 1971660 - RNA, 21 nt, Human
auguauguguuuagaauugaa

SEQ ID NO: 1971661 - RNA, 18 nt, Human
auguauguguuuagaauu

SEQ ID NO: 1971662 - RNA, 20 nt, Human
auguauguguuuagaauuga

SEQ ID NO: 1971663 - RNA, 16 nt, Human
auguauguguaaguau

SEQ ID NO: 1971664 - RNA, 12 nt, Human
auguauguguuu

SEQ ID NO: 1971665 - RNA, 14 nt, Human
auguauguguuuag

SEQ ID NO: 1971666 - RNA, 15 nt, Human
auguauguguuuaga

SEQ ID NO: 1971667 - RNA, 16 nt, Human
auguauguguuuagaa

SEQ ID NO: 1971668 - RNA, 17 nt, Human
auguauguguuuagaau

SEQ ID NO: 1971669 - RNA, 14 nt, Human
auguaugcuucaua

SEQ ID NO: 1971670 - RNA, 13 nt, Human
auguaugcauaau

SEQ ID NO: 1971671 - RNA, 17 nt, Human
auguaugcauaauaauc

SEQ ID NO: 1971672 - RNA, 15 nt, Human
auguaugcuucauac

SEQ ID NO: 1971673 - RNA, 16 nt, Human
auguaugcuucauaca

SEQ ID NO: 1971674 - RNA, 15 nt, Human
auguauguguaagua

SEQ ID NO: 1971675 - RNA, 15 nt, Human
uuuggcacucugacu

SEQ ID NO: 1971676 - RNA, 18 nt, Human
auguaugagguacaaccu

SEQ ID NO: 1971677 - RNA, 19 nt, Human
uuugacagcgcacagcugc

SEQ ID NO: 1971678 - RNA, 12 nt, Human
uuugaccucugc

SEQ ID NO: 1971679 - RNA, 18 nt, Human
uuugacagcgcacagcug

SEQ ID NO: 1971680 - RNA, 23 nt, Human
auguagcaaacccugucaaacau

SEQ ID NO: 1971681 - RNA, 20 nt, Human
auguagcaaacccugucaaa

SEQ ID NO: 1971682 - RNA, 20 nt, Human
auguagauuuauuucaucau

SEQ ID NO: 1971683 - RNA, 16 nt, Human
auguagauuuauuuca

SEQ ID NO: 1971684 - RNA, 17 nt, Human
auguagauuuauuucau

SEQ ID NO: 1971685 - RNA, 19 nt, Human
auguagccccucuccugga

SEQ ID NO: 1971686 - RNA, 19 nt, Human
auguagaggggaaaagaga

SEQ ID NO: 1971687 - RNA, 17 nt, Human
auguagaggagaaacug

SEQ ID NO: 1971688 - RNA, 19 nt, Human
auguagaggagaaacugga

SEQ ID NO: 1971689 - RNA, 12 nt, Human
auguagaggaga

SEQ ID NO: 1971690 - RNA, 13 nt, Human
auguagaggagaa

SEQ ID NO: 1971691 - RNA, 20 nt, Human
auguagagcacaauggaauu

SEQ ID NO: 1971692 - RNA, 14 nt, Human
auguacuauaacau

SEQ ID NO: 1971693 - RNA, 17 nt, Human
auguacuauaacauaga

SEQ ID NO: 1971694 - RNA, 17 nt, Human
auguacauguauuaaau

SEQ ID NO: 1971695 - RNA, 22 nt, Human
uuugauucagacagcugccugg

SEQ ID NO: 1971696 - RNA, 15 nt, Human
uuugccguuauuaaa

SEQ ID NO: 1971697 - RNA, 13 nt, Human
uuugccucugccu

SEQ ID NO: 1971698 - RNA, 21 nt, Human
uuugcuccccuuccccuuccu

SEQ ID NO: 1971699 - RNA, 19 nt, Human
uuugcucuaaaauauuuau

SEQ ID NO: 1971700 - RNA, 22 nt, Human
uuugcuccccuuccccuuccuu

SEQ ID NO: 1971701 - RNA, 23 nt, Human
uuugcuccccuuccccuuccuuc

SEQ ID NO: 1971702 - RNA, 15 nt, Human
uuugcucuaaaauau

SEQ ID NO: 1971703 - RNA, 23 nt, Human
uuuggcaaacucuccaccacacg

SEQ ID NO: 1971704 - RNA, 14 nt, Human
uuuggcacucugac

SEQ ID NO: 1971705 - RNA, 18 nt, Human
uuugcugaacauuggaga

SEQ ID NO: 1971706 - RNA, 22 nt, Human
uuugauguucuuucacccuuuu

SEQ ID NO: 1971707 - RNA, 13 nt, Human
uuugauuaaauuc

SEQ ID NO: 1971708 - RNA, 14 nt, Human
uuugaugucagcag

SEQ ID NO: 1971709 - RNA, 16 nt, Human
uuugaugucagcaguu

SEQ ID NO: 1971710 - RNA, 17 nt, Human
uuugaugucagcaguug

SEQ ID NO: 1971711 - RNA, 20 nt, Human
uuugaugucagcaguugcug

SEQ ID NO: 1971712 - RNA, 21 nt, Human
uuugaugucagcaguugcugg

SEQ ID NO: 1971713 - RNA, 21 nt, Human
uuugauguguuguucuuggca

SEQ ID NO: 1971714 - RNA, 18 nt, Human
uuugauuaaauucuugca

SEQ ID NO: 1971715 - RNA, 21 nt, Human
uuugauuaaauucuugcaaag

SEQ ID NO: 1971716 - RNA, 21 nt, Human
uuugauucagacagcugccug

SEQ ID NO: 1971717 - RNA, 23 nt, Human
uuugauuaaauucuugcaaagua

SEQ ID NO: 1971718 - RNA, 19 nt, Human
uuugacgccaucccagccc

SEQ ID NO: 1971719 - RNA, 16 nt, Human
uuugacgccaucccag

SEQ ID NO: 1971720 - RNA, 14 nt, Human
uuugacgccauccc

SEQ ID NO: 1971721 - RNA, 13 nt, Human
uuugacgccaucc

SEQ ID NO: 1971722 - RNA, 20 nt, Human
uuugacgccaucccagcccc

SEQ ID NO: 1971723 - RNA, 20 nt, Human
uuugauguaaagauguucug

SEQ ID NO: 1971724 - RNA, 18 nt, Human
augcagccucacaguccu

SEQ ID NO: 1971725 - RNA, 14 nt, Human
augcagcucuuccu

SEQ ID NO: 1971726 - RNA, 15 nt, Human
augcagcucuuccug

SEQ ID NO: 1971727 - RNA, 16 nt, Human
augcagcucuuccugg

SEQ ID NO: 1971728 - RNA, 22 nt, Human
augcagauuuugcccuugacaa

SEQ ID NO: 1971729 - RNA, 16 nt, Human
uuuacaaccuagaagu

SEQ ID NO: 1971730 - RNA, 15 nt, Human
augcagaugccuggg

SEQ ID NO: 1971731 - RNA, 17 nt, Human
augcagcaucuaaguaa

SEQ ID NO: 1971732 - RNA, 17 nt, Human
augcagccacuuaggac

SEQ ID NO: 1971733 - RNA, 18 nt, Human
augcagccacuuaggaca

SEQ ID NO: 1971734 - RNA, 17 nt, Human
uuuacaaacaaaagcau

SEQ ID NO: 1971735 - RNA, 22 nt, Human
uuuaauuugaagguagaauguu

SEQ ID NO: 1971736 - RNA, 20 nt, Human
uuuacaacacuuuaaugggu

SEQ ID NO: 1971737 - RNA, 14 nt, Human
uuuacaacacuuua

SEQ ID NO: 1971738 - RNA, 19 nt, Human
uuuacaacacuuuaauggg

SEQ ID NO: 1971739 - RNA, 13 nt, Human
uuuacaaaggcug

SEQ ID NO: 1971740 - RNA, 23 nt, Human
uuuacaaaggcuguauucagcaa

SEQ ID NO: 1971741 - RNA, 19 nt, Human
uuuaauuuuuuugagacag

SEQ ID NO: 1971742 - RNA, 16 nt, Human
uuuaauuugaaauaug

SEQ ID NO: 1971743 - RNA, 23 nt, Human
uuuaauuucaagcuuauuuugga

SEQ ID NO: 1971744 - RNA, 13 nt, Human
uuuaauuucaagc

SEQ ID NO: 1971745 - RNA, 20 nt, Human
uuuaauuucaagcuuauuuu

SEQ ID NO: 1971746 - RNA, 17 nt, Human
uuuaaggucuguuugcu

SEQ ID NO: 1971747 - RNA, 13 nt, Human
uuuaagugaaauu

SEQ ID NO: 1971748 - RNA, 14 nt, Human
uuuaagugaaauuu

SEQ ID NO: 1971749 - RNA, 18 nt, Human
uuuaaauauaugcuaagu

SEQ ID NO: 1971750 - RNA, 18 nt, Human
uuuaauguugaacaaaau

SEQ ID NO: 1971751 - RNA, 23 nt, Human
uuuaauguugaacaaaauaaauu

SEQ ID NO: 1971752 - RNA, 13 nt, Human
uuuaauguugaac

SEQ ID NO: 1971753 - RNA, 12 nt, Human
uuuaauucaguu

SEQ ID NO: 1971754 - RNA, 21 nt, Human
augccaaagaaugaauuucaa

SEQ ID NO: 1971755 - RNA, 18 nt, Human
augccaaaaaaagacagg

SEQ ID NO: 1971756 - RNA, 13 nt, Human
augcauuuggaac

SEQ ID NO: 1971757 - RNA, 13 nt, Human
augcagugcuucc

SEQ ID NO: 1971758 - RNA, 23 nt, Human
augcagugguaugaucacggcuc

SEQ ID NO: 1971759 - RNA, 22 nt, Human
augcaguuacaaauuauaaugu

SEQ ID NO: 1971760 - RNA, 19 nt, Human
augcaguuacaaauuauaa

SEQ ID NO: 1971761 - RNA, 20 nt, Human
augcaguuacaaauuauaau

SEQ ID NO: 1971762 - RNA, 13 nt, Human
augccaauuucuc

SEQ ID NO: 1971763 - RNA, 11 nt, Human
augcccagccc

SEQ ID NO: 1971764 - RNA, 21 nt, Human
augcgguguuugguuuuuugu

SEQ ID NO: 1971765 - RNA, 14 nt, Human
augcccagccccuu

SEQ ID NO: 1971766 - RNA, 13 nt, Human
augcccagccccu

SEQ ID NO: 1971767 - RNA, 12 nt, Human
augcccagcccc

SEQ ID NO: 1971768 - RNA, 14 nt, Human
augcccuggaucca

SEQ ID NO: 1971769 - RNA, 16 nt, Human
augccucagccuccug

SEQ ID NO: 1971770 - RNA, 15 nt, Human
uuguugaaagaaagu

SEQ ID NO: 1971771 - RNA, 15 nt, Human
uuguugaacuguuag

SEQ ID NO: 1971772 - RNA, 18 nt, Human
uuguugaacuguuagaau

SEQ ID NO: 1971773 - RNA, 15 nt, Human
uuguucuuuguucuu

SEQ ID NO: 1971774 - RNA, 20 nt, Human
uuguucuuguuuuuaaguuu

SEQ ID NO: 1971775 - RNA, 15 nt, Human
uuguucuuguuuuua

SEQ ID NO: 1971776 - RNA, 12 nt, Human
uuguuccagaga

SEQ ID NO: 1971777 - RNA, 11 nt, Human
uuguuccaguu

SEQ ID NO: 1971778 - RNA, 22 nt, Human
uuguugaacuguuagaauguaa

SEQ ID NO: 1971779 - RNA, 21 nt, Human
uuguuccacaaguuaaauaaa

SEQ ID NO: 1971780 - RNA, 21 nt, Human
uuguucauuucauccuuucac

SEQ ID NO: 1971781 - RNA, 13 nt, Human
uuguguucaccuu

SEQ ID NO: 1971782 - RNA, 15 nt, Human
uuguguuacuaaguu

SEQ ID NO: 1971783 - RNA, 20 nt, Human
uuguguuacuaaguuuuuau

SEQ ID NO: 1971784 - RNA, 13 nt, Human
uuguguuacuaag

SEQ ID NO: 1971785 - RNA, 15 nt, Human
augaucuaggaagac

SEQ ID NO: 1971786 - RNA, 20 nt, Human
augaucuaggaagacuuugg

SEQ ID NO: 1971787 - RNA, 17 nt, Human
augaucuaggaagacuu

SEQ ID NO: 1971788 - RNA, 17 nt, Human
augauacuugaaaauua

SEQ ID NO: 1971789 - RNA, 21 nt, Human
augauacuugaaaauuaacau

SEQ ID NO: 1971790 - RNA, 17 nt, Human
augauaugcuuguaacu

SEQ ID NO: 1971791 - RNA, 23 nt, Human
augauaugcuuguaacuaaaaua

SEQ ID NO: 1971792 - RNA, 12 nt, Human
augauugaaaau

SEQ ID NO: 1971793 - RNA, 13 nt, Human
augauugaagaaa

SEQ ID NO: 1971794 - RNA, 12 nt, Human
augauugcagaa

SEQ ID NO: 1971795 - RNA, 19 nt, Human
augauugcagaauuguuua

SEQ ID NO: 1971796 - RNA, 21 nt, Human
augauugcagaauuguuuaga

SEQ ID NO: 1971797 - RNA, 13 nt, Human
augauugcuuuua

SEQ ID NO: 1971798 - RNA, 14 nt, Human
augauugcuuuuaa

SEQ ID NO: 1971799 - RNA, 15 nt, Human
augauugcuuuuaaa

SEQ ID NO: 1971800 - RNA, 15 nt, Human
augcaaccauuugaa

SEQ ID NO: 1971801 - RNA, 17 nt, Human
augauugcuuuuaaaau

SEQ ID NO: 1971802 - RNA, 13 nt, Human
augcaagcaguuu

SEQ ID NO: 1971803 - RNA, 15 nt, Human
augcaagcaguuuca

SEQ ID NO: 1971804 - RNA, 16 nt, Human
augcaagcaguuucaa

SEQ ID NO: 1971805 - RNA, 22 nt, Human
augcaagcaguuucaauaaagu

SEQ ID NO: 1971806 - RNA, 23 nt, Human
augcaagcaguuucaauaaaguu

SEQ ID NO: 1971807 - RNA, 20 nt, Human
augcacuuuguucuggcucu

SEQ ID NO: 1971808 - RNA, 19 nt, Human
augcacuuuguucuggcuc

SEQ ID NO: 1971809 - RNA, 17 nt, Human
augcacuuuguucuggc

SEQ ID NO: 1971810 - RNA, 16 nt, Human
augcacuuuguucugg

SEQ ID NO: 1971811 - RNA, 13 nt, Human
augcaccuggaau

SEQ ID NO: 1971812 - RNA, 22 nt, Human
augcaccagcccuuagcaggga

SEQ ID NO: 1971813 - RNA, 13 nt, Human
uuuaaagaaugcu

SEQ ID NO: 1971814 - RNA, 15 nt, Human
uuuaaagaauuucuu

SEQ ID NO: 1971815 - RNA, 16 nt, Human
uuuaaauaaaacccuu

SEQ ID NO: 1971816 - RNA, 21 nt, Human
uuuaaagguuucuauuuucuc

SEQ ID NO: 1971817 - RNA, 13 nt, Human
uuguuuugcuucc

SEQ ID NO: 1971818 - RNA, 14 nt, Human
uuguuuugcuuccc

SEQ ID NO: 1971819 - RNA, 16 nt, Human
uuguuuugcuuccccu

SEQ ID NO: 1971820 - RNA, 14 nt, Human
uuguuuugcuuuuu

SEQ ID NO: 1971821 - RNA, 14 nt, Human
uuuaaaaauuuacu

SEQ ID NO: 1971822 - RNA, 23 nt, Human
uuuaaaaauuagccuaagauaua

SEQ ID NO: 1971823 - RNA, 12 nt, Human
uuuaaaaauuua

SEQ ID NO: 1971824 - RNA, 19 nt, Human
augcuguucaugaaagauu

SEQ ID NO: 1971825 - RNA, 13 nt, Human
augcuuccagaaa

SEQ ID NO: 1971826 - RNA, 14 nt, Human
augcuuccagaaac

SEQ ID NO: 1971827 - RNA, 22 nt, Human
augcuuccagaaacacccacag

SEQ ID NO: 1971828 - RNA, 13 nt, Human
augcuucucacug

SEQ ID NO: 1971829 - RNA, 16 nt, Human
augcuccccugugcca

SEQ ID NO: 1971830 - RNA, 17 nt, Human
augcuccccugugccag

SEQ ID NO: 1971831 - RNA, 22 nt, Human
augcugugcccuaaaguguauu

SEQ ID NO: 1971832 - RNA, 17 nt, Human
augcuguucaugaaaga

SEQ ID NO: 1971833 - RNA, 18 nt, Human
uuucaaaauaaaauauca

SEQ ID NO: 1971834 - RNA, 22 nt, Human
uuucaaaauuguuacaaauugu

SEQ ID NO: 1971835 - RNA, 16 nt, Human
uuucaaacuuuacuau

SEQ ID NO: 1971836 - RNA, 22 nt, Human
uuucaaacuuuacuauggcccu

SEQ ID NO: 1971837 - RNA, 20 nt, Human
uuuauuuuguguuuaggaac

SEQ ID NO: 1971838 - RNA, 18 nt, Human
uuuauuuuuaaauuaugu

SEQ ID NO: 1971839 - RNA, 16 nt, Human
uuuauuuuguguuuag

SEQ ID NO: 1971840 - RNA, 23 nt, Human
uuuauuuuuagaauuuugugaaa

SEQ ID NO: 1971841 - RNA, 16 nt, Human
uuuauuuuuaagaaag

SEQ ID NO: 1971842 - RNA, 17 nt, Human
uuuauuuuuaagaaaga

SEQ ID NO: 1971843 - RNA, 16 nt, Human
uuuauuuuuagaauuu

SEQ ID NO: 1971844 - RNA, 19 nt, Human
uuuauuuuuagaauuuugu

SEQ ID NO: 1971845 - RNA, 13 nt, Human
uuucaaaaaucug

SEQ ID NO: 1971846 - RNA, 19 nt, Human
uuucaaaaaucugaagauu

SEQ ID NO: 1971847 - RNA, 21 nt, Human
uuucaaaaaucugaagauugu

SEQ ID NO: 1971848 - RNA, 23 nt, Human
uuucaaaaaucugaagauuguuu

SEQ ID NO: 1971849 - RNA, 24 nt, Human
uuucaaaaaucugaagauuguuua

SEQ ID NO: 1971850 - RNA, 14 nt, Human
augcuaugucauuu

SEQ ID NO: 1971851 - RNA, 17 nt, Human
augcuaugucauuucau

SEQ ID NO: 1971852 - RNA, 20 nt, Human
uuuauuaagcacguauuuau

SEQ ID NO: 1971853 - RNA, 15 nt, Human
uuuauuaaucacugu

SEQ ID NO: 1971854 - RNA, 13 nt, Human
uuuauuaaucacu

SEQ ID NO: 1971855 - RNA, 19 nt, Human
uuuauuaaucacuguguau

SEQ ID NO: 1971856 - RNA, 21 nt, Human
uuuauuaaucacuguguauau

SEQ ID NO: 1971857 - RNA, 20 nt, Human
augcuagaacucccuuucaa

SEQ ID NO: 1971858 - RNA, 21 nt, Human
augcuagaacucccuuucaac

SEQ ID NO: 1971859 - RNA, 22 nt, Human
augcuagaacucccuuucaaca

SEQ ID NO: 1971860 - RNA, 17 nt, Human
uuuaucaugugaaauca

SEQ ID NO: 1971861 - RNA, 18 nt, Human
uuuaucaugugaaaucau

SEQ ID NO: 1971862 - RNA, 18 nt, Human
uuuauauuucaaguacac

SEQ ID NO: 1971863 - RNA, 20 nt, Human
uuuauauuucaaguacacug

SEQ ID NO: 1971864 - RNA, 21 nt, Human
uuuauauuucaaguacacuga

SEQ ID NO: 1971865 - RNA, 14 nt, Human
uuuauauuuggaug

SEQ ID NO: 1971866 - RNA, 16 nt, Human
augcuaagaauuuuuu

SEQ ID NO: 1971867 - RNA, 20 nt, Human
uuuauauguauguguuuaga

SEQ ID NO: 1971868 - RNA, 21 nt, Human
uuuauauguauguguuuagaa

SEQ ID NO: 1971869 - RNA, 16 nt, Human
augcuaagacucagug

SEQ ID NO: 1971870 - RNA, 13 nt, Human
augcuaagaauuu

SEQ ID NO: 1971871 - RNA, 21 nt, Human
uuuauauuuauugacucuuga

SEQ ID NO: 1971872 - RNA, 13 nt, Human
uuuauauuucaag

SEQ ID NO: 1971873 - RNA, 14 nt, Human
uuuauauuucaagu

SEQ ID NO: 1971874 - RNA, 15 nt, Human
uuuauauuucaagua

SEQ ID NO: 1971875 - RNA, 16 nt, Human
uuuccaucuaaaaaua

SEQ ID NO: 1971876 - RNA, 17 nt, Human
uuucccccuuggcucuc

SEQ ID NO: 1971877 - RNA, 13 nt, Human
uuucccccuuucu

SEQ ID NO: 1971878 - RNA, 14 nt, Human
uuucccccuuucuu

SEQ ID NO: 1971879 - RNA, 17 nt, Human
uuucccccuuucuuccu

SEQ ID NO: 1971880 - RNA, 18 nt, Human
uuucccccuuucuuccuc

SEQ ID NO: 1971881 - RNA, 21 nt, Human
uuucccccuuucuuccucauu

SEQ ID NO: 1971882 - RNA, 13 nt, Human
uuuccaucuaaaa

SEQ ID NO: 1971883 - RNA, 22 nt, Human
uuuccauauuuuuuuccuuaca

SEQ ID NO: 1971884 - RNA, 18 nt, Human
uuuccaugaguccccugu

SEQ ID NO: 1971885 - RNA, 17 nt, Human
uuuccaugaguccccug

SEQ ID NO: 1971886 - RNA, 12 nt, Human
uuucauuagcaa

SEQ ID NO: 1971887 - RNA, 13 nt, Human
uuucauuagcaaa

SEQ ID NO: 1971888 - RNA, 17 nt, Human
uuucaacaguuucaaaa

SEQ ID NO: 1971889 - RNA, 14 nt, Human
uuucauuagcaaaa

SEQ ID NO: 1971890 - RNA, 15 nt, Human
uuucauuagcaaaaa

SEQ ID NO: 1971891 - RNA, 16 nt, Human
uuucauuagcaaaaaa

SEQ ID NO: 1971892 - RNA, 19 nt, Human
uuucauuagcaaaaaaagu

SEQ ID NO: 1971893 - RNA, 21 nt, Human
uuucauuagcaaaaaaaguug

SEQ ID NO: 1971894 - RNA, 23 nt, Human
uuucauuagcaaaaaaaguugua

SEQ ID NO: 1971895 - RNA, 14 nt, Human
uuucaaauguucuc

SEQ ID NO: 1971896 - RNA, 19 nt, Human
auggacuaacuugucuuug

SEQ ID NO: 1971897 - RNA, 18 nt, Human
auggacucagaaacucca

SEQ ID NO: 1971898 - RNA, 18 nt, Human
auggaauuuuuuuguacg

SEQ ID NO: 1971899 - RNA, 15 nt, Human
auggaauuuuuuugu

SEQ ID NO: 1971900 - RNA, 16 nt, Human
auggaauuuuuuugua

SEQ ID NO: 1971901 - RNA, 17 nt, Human
auggaauuuuuuuguac

SEQ ID NO: 1971902 - RNA, 12 nt, Human
auggacuuuguu

SEQ ID NO: 1971903 - RNA, 11 nt, Human
auggacuuugu

SEQ ID NO: 1971904 - RNA, 19 nt, Human
auggcuaagcaaaauguga

SEQ ID NO: 1971905 - RNA, 18 nt, Human
auggcuaauguacugcau

SEQ ID NO: 1971906 - RNA, 15 nt, Human
augggagagaagaga

SEQ ID NO: 1971907 - RNA, 22 nt, Human
augggagaaauaguguggaaau

SEQ ID NO: 1971908 - RNA, 17 nt, Human
augggaggggaaauggg

SEQ ID NO: 1971909 - RNA, 15 nt, Human
augggaggcuggagu

SEQ ID NO: 1971910 - RNA, 19 nt, Human
augggagagaagagaaugc

SEQ ID NO: 1971911 - RNA, 18 nt, Human
auggagacugucucaaga

SEQ ID NO: 1971912 - RNA, 14 nt, Human
auggcagcugccac

SEQ ID NO: 1971913 - RNA, 22 nt, Human
uucugaacuuggcgcugccccu

SEQ ID NO: 1971914 - RNA, 19 nt, Human
uucugaacuuggcgcugcc

SEQ ID NO: 1971915 - RNA, 23 nt, Human
uucugaacuuggcgcugccccug

SEQ ID NO: 1971916 - RNA, 15 nt, Human
uucugccauauucug

SEQ ID NO: 1971917 - RNA, 21 nt, Human
uucugccugcccaggccccug

SEQ ID NO: 1971918 - RNA, 15 nt, Human
uucuggcucuuccag

SEQ ID NO: 1971919 - RNA, 17 nt, Human
uucugccugcccaggcc

SEQ ID NO: 1971920 - RNA, 18 nt, Human
uucugccugcccaggccc

SEQ ID NO: 1971921 - RNA, 17 nt, Human
uucuggcucuuccaggc

SEQ ID NO: 1971922 - RNA, 16 nt, Human
uucuggcucuuccagg

SEQ ID NO: 1971923 - RNA, 15 nt, Human
uucucuaguuugauu

SEQ ID NO: 1971924 - RNA, 17 nt, Human
uucucuaguuugauuaa

SEQ ID NO: 1971925 - RNA, 23 nt, Human
aucagggaggaaaguuucuuuga

SEQ ID NO: 1971926 - RNA, 20 nt, Human
uucucuaguuugauuaaauu

SEQ ID NO: 1971927 - RNA, 22 nt, Human
uucucuuccaaccauuuaucuu

SEQ ID NO: 1971928 - RNA, 15 nt, Human
uucucuuccaggcag

SEQ ID NO: 1971929 - RNA, 16 nt, Human
uucucuuccaggcagc

SEQ ID NO: 1971930 - RNA, 19 nt, Human
uucucuucuccccuuccau

SEQ ID NO: 1971931 - RNA, 20 nt, Human
uucucuucuccccuuccauu

SEQ ID NO: 1971932 - RNA, 21 nt, Human
uucucuucuccccuuccauuu

SEQ ID NO: 1971933 - RNA, 14 nt, Human
uucucuugccucag

SEQ ID NO: 1971934 - RNA, 22 nt, Human
uucucuugccucagcuucccca

SEQ ID NO: 1971935 - RNA, 12 nt, Human
uucucuugccuc

SEQ ID NO: 1971936 - RNA, 23 nt, Human
uucucuucuccccuuccauuucu

SEQ ID NO: 1971937 - RNA, 23 nt, Human
aucaguaguuugcauuucagaaa

SEQ ID NO: 1971938 - RNA, 18 nt, Human
aucaguaguuugcauuuc

SEQ ID NO: 1971939 - RNA, 19 nt, Human
aucaguaguuugcauuuca

SEQ ID NO: 1971940 - RNA, 21 nt, Human
aucaguaguuugcauuucaga

SEQ ID NO: 1971941 - RNA, 20 nt, Human
uucuccugcguguucucaga

SEQ ID NO: 1971942 - RNA, 20 nt, Human
uucuccuuaagagacaauuu

SEQ ID NO: 1971943 - RNA, 21 nt, Human
uucuccuuguguuacuaaguu

SEQ ID NO: 1971944 - RNA, 15 nt, Human
aucaguacuuguuuc

SEQ ID NO: 1971945 - RNA, 17 nt, Human
aucaguagcuuaagaaa

SEQ ID NO: 1971946 - RNA, 19 nt, Human
aucaguaaacacuguguau

SEQ ID NO: 1971947 - RNA, 14 nt, Human
aucaggugcugcca

SEQ ID NO: 1971948 - RNA, 17 nt, Human
aucagguuaggcaguau

SEQ ID NO: 1971949 - RNA, 22 nt, Human
aucagguuaggcaguauaaaga

SEQ ID NO: 1971950 - RNA, 13 nt, Human
aucaguaaacacu

SEQ ID NO: 1971951 - RNA, 14 nt, Human
aucaguaaacacug

SEQ ID NO: 1971952 - RNA, 15 nt, Human
aucaguaaacacugu

SEQ ID NO: 1971953 - RNA, 20 nt, Human
aucccaaacccuucagugcc

SEQ ID NO: 1971954 - RNA, 19 nt, Human
aucccaaacccuucagugc

SEQ ID NO: 1971955 - RNA, 12 nt, Human
aucccagcccca

SEQ ID NO: 1971956 - RNA, 15 nt, Human
auccaucagugccaa

SEQ ID NO: 1971957 - RNA, 22 nt, Human
auccauuuuuuauauuucaagu

SEQ ID NO: 1971958 - RNA, 18 nt, Human
aucccauaugccugggca

SEQ ID NO: 1971959 - RNA, 20 nt, Human
aucccagcuucggcauuuga

SEQ ID NO: 1971960 - RNA, 22 nt, Human
aucccagcuucggcauuugauc

SEQ ID NO: 1971961 - RNA, 19 nt, Human
auccauagcaccuccacau

SEQ ID NO: 1971962 - RNA, 21 nt, Human
auccaguaucuugaagacuuu

SEQ ID NO: 1971963 - RNA, 19 nt, Human
auccauauuaaguaagucu

SEQ ID NO: 1971964 - RNA, 21 nt, Human
auccauauuaaguaagucuca

SEQ ID NO: 1971965 - RNA, 21 nt, Human
auccauacuaacccuuuucca

SEQ ID NO: 1971966 - RNA, 14 nt, Human
auccauagugacuu

SEQ ID NO: 1971967 - RNA, 15 nt, Human
auccauagugacuuu

SEQ ID NO: 1971968 - RNA, 16 nt, Human
auccauagugacuuuu

SEQ ID NO: 1971969 - RNA, 22 nt, Human
auccauagugacuuuucaagua

SEQ ID NO: 1971970 - RNA, 13 nt, Human
auccaucaggcca

SEQ ID NO: 1971971 - RNA, 13 nt, Human
auccaucagugcc

SEQ ID NO: 1971972 - RNA, 14 nt, Human
auccaucagugcca

SEQ ID NO: 1971973 - RNA, 13 nt, Human
auccacccaccuc

SEQ ID NO: 1971974 - RNA, 15 nt, Human
auccacccaccucag

SEQ ID NO: 1971975 - RNA, 16 nt, Human
auccaguaucuugaag

SEQ ID NO: 1971976 - RNA, 16 nt, Human
auccacccaccucagc

SEQ ID NO: 1971977 - RNA, 18 nt, Human
auccaagcuggucccacu

SEQ ID NO: 1971978 - RNA, 21 nt, Human
auccaagcuggucccacucag

SEQ ID NO: 1971979 - RNA, 18 nt, Human
auccaagcaaaugugaau

SEQ ID NO: 1971980 - RNA, 20 nt, Human
aucauuuuaccuuugacaaa

SEQ ID NO: 1971981 - RNA, 23 nt, Human
uucuggggagcuggacaguggag

SEQ ID NO: 1971982 - RNA, 11 nt, Human
uugaaaugcug

SEQ ID NO: 1971983 - RNA, 13 nt, Human
uugaaaugcugaa

SEQ ID NO: 1971984 - RNA, 17 nt, Human
uugaaaugcugaaaauu

SEQ ID NO: 1971985 - RNA, 15 nt, Human
uugaaauggaaauua

SEQ ID NO: 1971986 - RNA, 15 nt, Human
uugaaagugccuuug

SEQ ID NO: 1971987 - RNA, 17 nt, Human
uugaaagugccuuugca

SEQ ID NO: 1971988 - RNA, 19 nt, Human
uugaacccgggaggcagag

SEQ ID NO: 1971989 - RNA, 17 nt, Human
uugaaauuguauuacaa

SEQ ID NO: 1971990 - RNA, 16 nt, Human
auccggggccagcucc

SEQ ID NO: 1971991 - RNA, 17 nt, Human
auccggggccagcuccg

SEQ ID NO: 1971992 - RNA, 12 nt, Human
auccuaagcuau

SEQ ID NO: 1971993 - RNA, 21 nt, Human
auccuaagcuauucaguaaua

SEQ ID NO: 1971994 - RNA, 18 nt, Human
auccuacaagacacagug

SEQ ID NO: 1971995 - RNA, 19 nt, Human
auccuacaagacacaguga

SEQ ID NO: 1971996 - RNA, 16 nt, Human
auccuaggcauuugcu

SEQ ID NO: 1971997 - RNA, 16 nt, Human
auccuccucagaucuu

SEQ ID NO: 1971998 - RNA, 24 nt, Human
auccuacgaguaauugcauuugcu

SEQ ID NO: 1971999 - RNA, 21 nt, Human
auccuacgaguaauugcauuu

SEQ ID NO: 1972000 - RNA, 15 nt, Human
uucuuuguaaugaaa

SEQ ID NO: 1972001 - RNA, 12 nt, Human
uucuuuuugaau

SEQ ID NO: 1972002 - RNA, 18 nt, Human
uucuuuuugaaucuuuaa

SEQ ID NO: 1972003 - RNA, 17 nt, Human
uucuuuuugaucaucuu

SEQ ID NO: 1972004 - RNA, 12 nt, Human
uucuuuuugcuc

SEQ ID NO: 1972005 - RNA, 13 nt, Human
uucuuuuugcucu

SEQ ID NO: 1972006 - RNA, 14 nt, Human
uucuuuuugcucua

SEQ ID NO: 1972007 - RNA, 20 nt, Human
uucuuuuugcucuaaaauau

SEQ ID NO: 1972008 - RNA, 21 nt, Human
uucuuuuugcucuaaaauauu

SEQ ID NO: 1972009 - RNA, 14 nt, Human
uucuuuuuuuguga

SEQ ID NO: 1972010 - RNA, 17 nt, Human
uugaaagaauguaaagc

SEQ ID NO: 1972011 - RNA, 22 nt, Human
uucuuuuuuauuaaucacugug

SEQ ID NO: 1972012 - RNA, 20 nt, Human
uucuuuuuuauuaaucacug

SEQ ID NO: 1972013 - RNA, 21 nt, Human
uucuuuuuuauuaaucacugu

SEQ ID NO: 1972014 - RNA, 14 nt, Human
uucuuuuuuauuaa

SEQ ID NO: 1972015 - RNA, 15 nt, Human
uucuuuuuuauuaau

SEQ ID NO: 1972016 - RNA, 16 nt, Human
uucuuuuuuauuaauc

SEQ ID NO: 1972017 - RNA, 23 nt, Human
uucuugaauggcaauguuuugcu

SEQ ID NO: 1972018 - RNA, 14 nt, Human
uucuuugcccuuua

SEQ ID NO: 1972019 - RNA, 20 nt, Human
uucuucugcuucagccuccc

SEQ ID NO: 1972020 - RNA, 14 nt, Human
uucuucugaggccu

SEQ ID NO: 1972021 - RNA, 19 nt, Human
uucuucugaucacugaaau

SEQ ID NO: 1972022 - RNA, 20 nt, Human
uucuucugaucacugaaaua

SEQ ID NO: 1972023 - RNA, 24 nt, Human
aucccauaugccugggcagaagga

SEQ ID NO: 1972024 - RNA, 14 nt, Human
aucccucauccuca

SEQ ID NO: 1972025 - RNA, 13 nt, Human
aucccaugagccu

SEQ ID NO: 1972026 - RNA, 23 nt, Human
aucccucauccucauacccaccc

SEQ ID NO: 1972027 - RNA, 21 nt, Human
aucccucauccucauacccac

SEQ ID NO: 1972028 - RNA, 13 nt, Human
aucccucauccuc

SEQ ID NO: 1972029 - RNA, 13 nt, Human
uucuuaaccaucu

SEQ ID NO: 1972030 - RNA, 14 nt, Human
uucuucucccucag

SEQ ID NO: 1972031 - RNA, 13 nt, Human
uucuucugcuuca

SEQ ID NO: 1972032 - RNA, 15 nt, Human
uucuucugcuucagc

SEQ ID NO: 1972033 - RNA, 18 nt, Human
uucuuaauauauagcauu

SEQ ID NO: 1972034 - RNA, 14 nt, Human
uucuuaaucauuuu

SEQ ID NO: 1972035 - RNA, 13 nt, Human
uucuucucccuca

SEQ ID NO: 1972036 - RNA, 22 nt, Human
uuccucuuuccaucuacccucc

SEQ ID NO: 1972037 - RNA, 17 nt, Human
uuccucuuuccaucuac

SEQ ID NO: 1972038 - RNA, 13 nt, Human
uuccucuuuccau

SEQ ID NO: 1972039 - RNA, 14 nt, Human
uuccucugcuaaau

SEQ ID NO: 1972040 - RNA, 16 nt, Human
uuccucugcuaaauug

SEQ ID NO: 1972041 - RNA, 19 nt, Human
uuccucugcuaaauugaug

SEQ ID NO: 1972042 - RNA, 15 nt, Human
uuccugaacaggaua

SEQ ID NO: 1972043 - RNA, 18 nt, Human
uuccugaagaauugaaaa

SEQ ID NO: 1972044 - RNA, 14 nt, Human
uuccugaacaggau

SEQ ID NO: 1972045 - RNA, 17 nt, Human
uuccucugcuaaauuga

SEQ ID NO: 1972046 - RNA, 14 nt, Human
uuccugaaccgaug

SEQ ID NO: 1972047 - RNA, 20 nt, Human
uuccuaaauauauuuuaaga

SEQ ID NO: 1972048 - RNA, 17 nt, Human
uuccuaauccucuagga

SEQ ID NO: 1972049 - RNA, 22 nt, Human
uuccguuugauuugucacugcu

SEQ ID NO: 1972050 - RNA, 12 nt, Human
uuccuaaaacag

SEQ ID NO: 1972051 - RNA, 16 nt, Human
uuccuaauuccacagc

SEQ ID NO: 1972052 - RNA, 17 nt, Human
uuccuaauuccacagcu

SEQ ID NO: 1972053 - RNA, 18 nt, Human
uuccuaauuccacagcug

SEQ ID NO: 1972054 - RNA, 14 nt, Human
uuccucugagccuu

SEQ ID NO: 1972055 - RNA, 17 nt, Human
uuccucugagccuuggg

SEQ ID NO: 1972056 - RNA, 21 nt, Human
uuccucugaggcugaaauuca

SEQ ID NO: 1972057 - RNA, 14 nt, Human
uuccuacacaggac

SEQ ID NO: 1972058 - RNA, 15 nt, Human
uuccuacacaggaca

SEQ ID NO: 1972059 - RNA, 20 nt, Human
uucccucaccuuucccaucu

SEQ ID NO: 1972060 - RNA, 15 nt, Human
uucccuauuagagaa

SEQ ID NO: 1972061 - RNA, 16 nt, Human
uucccgcucagcccuc

SEQ ID NO: 1972062 - RNA, 18 nt, Human
uucccgcucagcccuccc

SEQ ID NO: 1972063 - RNA, 21 nt, Human
uucccgcucagcccucccugc

SEQ ID NO: 1972064 - RNA, 22 nt, Human
uucccgcucagcccucccugcc

SEQ ID NO: 1972065 - RNA, 15 nt, Human
auagcaaaaucaaga

SEQ ID NO: 1972066 - RNA, 19 nt, Human
auagauugugaauaaugau

SEQ ID NO: 1972067 - RNA, 14 nt, Human
uuccgucacauccc

SEQ ID NO: 1972068 - RNA, 19 nt, Human
uuccgucacaucccacccc

SEQ ID NO: 1972069 - RNA, 14 nt, Human
uuccguuaaaauac

SEQ ID NO: 1972070 - RNA, 16 nt, Human
uuccguuaaaauacca

SEQ ID NO: 1972071 - RNA, 19 nt, Human
uuccguagguuauuuucag

SEQ ID NO: 1972072 - RNA, 13 nt, Human
uucccucccugcu

SEQ ID NO: 1972073 - RNA, 23 nt, Human
uucccucccugcugucauugcuu

SEQ ID NO: 1972074 - RNA, 15 nt, Human
uucccucccugcugu

SEQ ID NO: 1972075 - RNA, 16 nt, Human
uucccucccugcuguc

SEQ ID NO: 1972076 - RNA, 17 nt, Human
aucaaauuaauugugug

SEQ ID NO: 1972077 - RNA, 16 nt, Human
aucaaauuaauugugu

SEQ ID NO: 1972078 - RNA, 20 nt, Human
auauuuuuuguuaaaugauu

SEQ ID NO: 1972079 - RNA, 18 nt, Human
auauuuuuuguuaaauga

SEQ ID NO: 1972080 - RNA, 21 nt, Human
aucaagaugugacauguuuua

SEQ ID NO: 1972081 - RNA, 14 nt, Human
aucaacagauaaau

SEQ ID NO: 1972082 - RNA, 16 nt, Human
aucaacacacauuuua

SEQ ID NO: 1972083 - RNA, 11 nt, Human
uuccugugucu

SEQ ID NO: 1972084 - RNA, 14 nt, Human
uuccugugccaggu

SEQ ID NO: 1972085 - RNA, 16 nt, Human
uuccuguguccaugug

SEQ ID NO: 1972086 - RNA, 16 nt, Human
uuccugugccagguga

SEQ ID NO: 1972087 - RNA, 18 nt, Human
aucacggcucacugcagc

SEQ ID NO: 1972088 - RNA, 19 nt, Human
aucacggcucacugcagcc

SEQ ID NO: 1972089 - RNA, 13 nt, Human
aucacgccacugc

SEQ ID NO: 1972090 - RNA, 14 nt, Human
aucacgccacugca

SEQ ID NO: 1972091 - RNA, 15 nt, Human
aucacggcucacugc

SEQ ID NO: 1972092 - RNA, 14 nt, Human
aucaaugaguaaca

SEQ ID NO: 1972093 - RNA, 14 nt, Human
aucaaugaguguga

SEQ ID NO: 1972094 - RNA, 15 nt, Human
aucaaucuuuagaaa

SEQ ID NO: 1972095 - RNA, 21 nt, Human
aucaaucuuuagaaaaggcau

SEQ ID NO: 1972096 - RNA, 21 nt, Human
aucaagggccuaucuuggaga

SEQ ID NO: 1972097 - RNA, 11 nt, Human
aucagaauucu

SEQ ID NO: 1972098 - RNA, 18 nt, Human
aucagaaguuucucagcu

SEQ ID NO: 1972099 - RNA, 13 nt, Human
uucuaggacugaa

SEQ ID NO: 1972100 - RNA, 14 nt, Human
uucuaggacugaau

SEQ ID NO: 1972101 - RNA, 16 nt, Human
uucuaggacugaauua

SEQ ID NO: 1972102 - RNA, 13 nt, Human
uucucaccagcug

SEQ ID NO: 1972103 - RNA, 16 nt, Human
uucucacuccuaccug

SEQ ID NO: 1972104 - RNA, 14 nt, Human
uucucaccagcugu

SEQ ID NO: 1972105 - RNA, 16 nt, Human
uucuaggaccuguguc

SEQ ID NO: 1972106 - RNA, 18 nt, Human
uucucacuccuaccuggu

SEQ ID NO: 1972107 - RNA, 18 nt, Human
aucaggccaggcccucug

SEQ ID NO: 1972108 - RNA, 16 nt, Human
aucaggccaggcccuc

SEQ ID NO: 1972109 - RNA, 15 nt, Human
aucaggccaggcccu

SEQ ID NO: 1972110 - RNA, 13 nt, Human
aucagcacgauuu

SEQ ID NO: 1972111 - RNA, 20 nt, Human
aucagaauaaccuucaaaua

SEQ ID NO: 1972112 - RNA, 12 nt, Human
aucagaauucuc

SEQ ID NO: 1972113 - RNA, 13 nt, Human
aucaggccauugu

SEQ ID NO: 1972114 - RNA, 16 nt, Human
aucaggccauuguccc

SEQ ID NO: 1972115 - RNA, 13 nt, Human
aucaggcucccag

SEQ ID NO: 1972116 - RNA, 14 nt, Human
aucaggcucccagg

SEQ ID NO: 1972117 - RNA, 18 nt, Human
aucagggaccaccagagg

SEQ ID NO: 1972118 - RNA, 13 nt, Human
aucagguccugcu

SEQ ID NO: 1972119 - RNA, 14 nt, Human
aucagguccugcuc

SEQ ID NO: 1972120 - RNA, 19 nt, Human
aucagguccugcucagcag

SEQ ID NO: 1972121 - RNA, 21 nt, Human
aucagguccugcucagcagug

SEQ ID NO: 1972122 - RNA, 23 nt, Human
uucuaagaagugaaaaucuacac

SEQ ID NO: 1972123 - RNA, 13 nt, Human
uucuaagaaguga

SEQ ID NO: 1972124 - RNA, 16 nt, Human
uucuagcauggcugcc

SEQ ID NO: 1972125 - RNA, 15 nt, Human
uucgcuccugugucu

SEQ ID NO: 1972126 - RNA, 19 nt, Human
uucgcuccugugucuugca

SEQ ID NO: 1972127 - RNA, 14 nt, Human
uucggccuccaucc

SEQ ID NO: 1972128 - RNA, 15 nt, Human
uucggccuccauccu

SEQ ID NO: 1972129 - RNA, 19 nt, Human
uucuaaaggcuaccuuugu

SEQ ID NO: 1972130 - RNA, 12 nt, Human
uucggcauuuga

SEQ ID NO: 1972131 - RNA, 20 nt, Human
uucuaaaggcuaccuuugua

SEQ ID NO: 1972132 - RNA, 21 nt, Human
uucuaaaggcuaccuuuguau

SEQ ID NO: 1972133 - RNA, 21 nt, Human
uucuaaaucuccaaaauaaaa

SEQ ID NO: 1972134 - RNA, 15 nt, Human
aucucuugagccugg

SEQ ID NO: 1972135 - RNA, 14 nt, Human
aucugaaaauguau

SEQ ID NO: 1972136 - RNA, 18 nt, Human
aucucuugagccugggag

SEQ ID NO: 1972137 - RNA, 22 nt, Human
aucugaaaauguauguguaagu

SEQ ID NO: 1972138 - RNA, 20 nt, Human
aucugaaaauguauguguaa

SEQ ID NO: 1972139 - RNA, 19 nt, Human
aucugaaaauguaugugua

SEQ ID NO: 1972140 - RNA, 16 nt, Human
aucugaaaauguaugu

SEQ ID NO: 1972141 - RNA, 17 nt, Human
aucucccccagccccau

SEQ ID NO: 1972142 - RNA, 16 nt, Human
aucucccccagcccca

SEQ ID NO: 1972143 - RNA, 21 nt, Human
aucucuucuggguuccuuccu

SEQ ID NO: 1972144 - RNA, 13 nt, Human
aucucuucugugu

SEQ ID NO: 1972145 - RNA, 18 nt, Human
aucuccaagaccagagau

SEQ ID NO: 1972146 - RNA, 15 nt, Human
aucucccccagcccc

SEQ ID NO: 1972147 - RNA, 17 nt, Human
aucuccaaaauaaaacu

SEQ ID NO: 1972148 - RNA, 20 nt, Human
aucuccaaaauaaaacuuuu

SEQ ID NO: 1972149 - RNA, 21 nt, Human
aucuccaaaauaaaacuuuuu

SEQ ID NO: 1972150 - RNA, 20 nt, Human
aucucauuguucaauuccca

SEQ ID NO: 1972151 - RNA, 14 nt, Human
aucuccaaaauaaa

SEQ ID NO: 1972152 - RNA, 16 nt, Human
aucucagggccugguc

SEQ ID NO: 1972153 - RNA, 18 nt, Human
aucuacugcauuuaggga

SEQ ID NO: 1972154 - RNA, 12 nt, Human
aucugaaaaugu

SEQ ID NO: 1972155 - RNA, 23 nt, Human
aucugaaaauguauguguaagua

SEQ ID NO: 1972156 - RNA, 16 nt, Human
aucugaauuggaaugc

SEQ ID NO: 1972157 - RNA, 13 nt, Human
uugauuaaagaug

SEQ ID NO: 1972158 - RNA, 13 nt, Human
uugauuaaauucu

SEQ ID NO: 1972159 - RNA, 23 nt, Human
uugauguuuuaaggaugcuugua

SEQ ID NO: 1972160 - RNA, 13 nt, Human
uugauucacaugu

SEQ ID NO: 1972161 - RNA, 16 nt, Human
uugcaagccuccugau

SEQ ID NO: 1972162 - RNA, 22 nt, Human
uugauuaagaucucagugguua

SEQ ID NO: 1972163 - RNA, 14 nt, Human
uugauuaaagauga

SEQ ID NO: 1972164 - RNA, 14 nt, Human
uugauuaaauucuu

SEQ ID NO: 1972165 - RNA, 18 nt, Human
uugcaccacugcacucca

SEQ ID NO: 1972166 - RNA, 16 nt, Human
uugcaccacugcacuc

SEQ ID NO: 1972167 - RNA, 15 nt, Human
uugcaccacugcacu

SEQ ID NO: 1972168 - RNA, 14 nt, Human
uugcaccacugcac

SEQ ID NO: 1972169 - RNA, 16 nt, Human
uugcaauggcagccuu

SEQ ID NO: 1972170 - RNA, 21 nt, Human
uugcaagggcggccuuuccca

SEQ ID NO: 1972171 - RNA, 22 nt, Human
uugcaagggcggccuuucccac

SEQ ID NO: 1972172 - RNA, 23 nt, Human
uugcaagggcggccuuucccacu

SEQ ID NO: 1972173 - RNA, 18 nt, Human
uugcaagguaaaauuuua

SEQ ID NO: 1972174 - RNA, 17 nt, Human
uugcaauggcagccuug

SEQ ID NO: 1972175 - RNA, 19 nt, Human
uugcaauggcagccuuggc

SEQ ID NO: 1972176 - RNA, 22 nt, Human
uugcauauauuucaugaauaca

SEQ ID NO: 1972177 - RNA, 16 nt, Human
uugcauucuuauucau

SEQ ID NO: 1972178 - RNA, 23 nt, Human
uugcauauaacuuauauuguaag

SEQ ID NO: 1972179 - RNA, 17 nt, Human
uugcauaguucuagugc

SEQ ID NO: 1972180 - RNA, 14 nt, Human
uugcauauaacuua

SEQ ID NO: 1972181 - RNA, 17 nt, Human
uugcauauaacuuauau

SEQ ID NO: 1972182 - RNA, 22 nt, Human
uugcauauaacuuauauuguaa

SEQ ID NO: 1972183 - RNA, 12 nt, Human
uugaauacuuga

SEQ ID NO: 1972184 - RNA, 14 nt, Human
uugaauacuugaac

SEQ ID NO: 1972185 - RNA, 16 nt, Human
uugaauacuugaacca

SEQ ID NO: 1972186 - RNA, 17 nt, Human
uugaauacuugaaccau

SEQ ID NO: 1972187 - RNA, 13 nt, Human
uugaaucacagua

SEQ ID NO: 1972188 - RNA, 15 nt, Human
uugaaggcagaaagc

SEQ ID NO: 1972189 - RNA, 17 nt, Human
uugaaggcagaaagcaa

SEQ ID NO: 1972190 - RNA, 13 nt, Human
uugaagccuuugu

SEQ ID NO: 1972191 - RNA, 19 nt, Human
uugaagccugcuccuuccc

SEQ ID NO: 1972192 - RNA, 13 nt, Human
uugaagccugcuc

SEQ ID NO: 1972193 - RNA, 15 nt, Human
uugaagccugcuccu

SEQ ID NO: 1972194 - RNA, 16 nt, Human
uugaagccugcuccuu

SEQ ID NO: 1972195 - RNA, 23 nt, Human
uugaauaaacaccacuggauuaa

SEQ ID NO: 1972196 - RNA, 21 nt, Human
uugaauaaacaccacuggauu

SEQ ID NO: 1972197 - RNA, 22 nt, Human
uugaauaaacaccacuggauua

SEQ ID NO: 1972198 - RNA, 12 nt, Human
uugaauaaacua

SEQ ID NO: 1972199 - RNA, 17 nt, Human
uugaagggaaauuucag

SEQ ID NO: 1972200 - RNA, 17 nt, Human
aucuaaauggaaccacu

SEQ ID NO: 1972201 - RNA, 18 nt, Human
aucuaaauggaaccacuc

SEQ ID NO: 1972202 - RNA, 13 nt, Human
aucuaaauggaac

SEQ ID NO: 1972203 - RNA, 16 nt, Human
aucuaaaaauaacugu

SEQ ID NO: 1972204 - RNA, 18 nt, Human
aucuaaaaauaacuguaa

SEQ ID NO: 1972205 - RNA, 20 nt, Human
aucuaaaaauaacuguaauu

SEQ ID NO: 1972206 - RNA, 16 nt, Human
aucuaaaucuguccaa

SEQ ID NO: 1972207 - RNA, 17 nt, Human
auccucuguacagagcc

SEQ ID NO: 1972208 - RNA, 16 nt, Human
auccucuguacagagc

SEQ ID NO: 1972209 - RNA, 14 nt, Human
auccuccuccuucc

SEQ ID NO: 1972210 - RNA, 17 nt, Human
auccuccuccuuccuag

SEQ ID NO: 1972211 - RNA, 18 nt, Human
auccuccuccuuccuagu

SEQ ID NO: 1972212 - RNA, 13 nt, Human
auccuccuccuuc

SEQ ID NO: 1972213 - RNA, 12 nt, Human
uugacagcucag

SEQ ID NO: 1972214 - RNA, 23 nt, Human
uugacagagagagauacucuggg

SEQ ID NO: 1972215 - RNA, 17 nt, Human
uugacagagccugcccc

SEQ ID NO: 1972216 - RNA, 19 nt, Human
uugacagagccugccccag

SEQ ID NO: 1972217 - RNA, 23 nt, Human
uugacagagccugccccagcgcu

SEQ ID NO: 1972218 - RNA, 12 nt, Human
uugagacagagu

SEQ ID NO: 1972219 - RNA, 16 nt, Human
uugagaucagccuggg

SEQ ID NO: 1972220 - RNA, 15 nt, Human
uugagaucagccugg

SEQ ID NO: 1972221 - RNA, 16 nt, Human
uugagaccgugaagau

SEQ ID NO: 1972222 - RNA, 21 nt, Human
uugagaccgugaagauacuuu

SEQ ID NO: 1972223 - RNA, 22 nt, Human
uugagaccgugaagauacuuug

SEQ ID NO: 1972224 - RNA, 18 nt, Human
uugaguauauuauaauag

SEQ ID NO: 1972225 - RNA, 13 nt, Human
uugagucauuuua

SEQ ID NO: 1972226 - RNA, 16 nt, Human
uugagauguguucaca

SEQ ID NO: 1972227 - RNA, 11 nt, Human
uugagucuuuu

SEQ ID NO: 1972228 - RNA, 21 nt, Human
uugagucuuuuuuuuuuaagu

SEQ ID NO: 1972229 - RNA, 20 nt, Human
uugagugaagcugggagaac

SEQ ID NO: 1972230 - RNA, 20 nt, Human
uugaguugauucagcucugc

SEQ ID NO: 1972231 - RNA, 17 nt, Human
uugaguuguuuuuguau

SEQ ID NO: 1972232 - RNA, 18 nt, Human
uugaguuguuuuuguaua

SEQ ID NO: 1972233 - RNA, 19 nt, Human
uugaguuguuuuuguauau

SEQ ID NO: 1972234 - RNA, 14 nt, Human
uugauaauuuuccu

SEQ ID NO: 1972235 - RNA, 16 nt, Human
uugauaauuuuccuuu

SEQ ID NO: 1972236 - RNA, 17 nt, Human
uugauaauuuuccuuua

SEQ ID NO: 1972237 - RNA, 18 nt, Human
uugauaauuuuccuuuaa

SEQ ID NO: 1972238 - RNA, 19 nt, Human
aucuacacuccagugagac

SEQ ID NO: 1972239 - RNA, 12 nt, Human
aucuaccaacuu

SEQ ID NO: 1972240 - RNA, 13 nt, Human
aucuacugcauuu

SEQ ID NO: 1972241 - RNA, 14 nt, Human
aucuacugcauuua

SEQ ID NO: 1972242 - RNA, 18 nt, Human
aucuacacuccagugaga

SEQ ID NO: 1972243 - RNA, 12 nt, Human
aucuaauuucaa

SEQ ID NO: 1972244 - RNA, 18 nt, Human
aucuaauauguaacaagc

SEQ ID NO: 1972245 - RNA, 19 nt, Human
augaaagggcccagagagg

SEQ ID NO: 1972246 - RNA, 13 nt, Human
augaaauguaugu

SEQ ID NO: 1972247 - RNA, 14 nt, Human
augaaaugcuaugu

SEQ ID NO: 1972248 - RNA, 22 nt, Human
augaaaugcuaugucauuucau

SEQ ID NO: 1972249 - RNA, 23 nt, Human
augaaaugcuaugucauuucaug

SEQ ID NO: 1972250 - RNA, 16 nt, Human
augaaagucaguuuaa

SEQ ID NO: 1972251 - RNA, 15 nt, Human
augaaagguauguag

SEQ ID NO: 1972252 - RNA, 16 nt, Human
augaagaauuuaaaga

SEQ ID NO: 1972253 - RNA, 13 nt, Human
augaagaauuuaa

SEQ ID NO: 1972254 - RNA, 16 nt, Human
augaauauuuaguguu

SEQ ID NO: 1972255 - RNA, 16 nt, Human
augaagagcuguugau

SEQ ID NO: 1972256 - RNA, 11 nt, Human
augaagaggag

SEQ ID NO: 1972257 - RNA, 23 nt, Human
augaauggcuaagcaaaauguga

SEQ ID NO: 1972258 - RNA, 21 nt, Human
augaauauuuaguguucauaa

SEQ ID NO: 1972259 - RNA, 23 nt, Human
uuggggacaggggcaggaggaag

SEQ ID NO: 1972260 - RNA, 18 nt, Human
uuggggaccagagcugcc

SEQ ID NO: 1972261 - RNA, 17 nt, Human
uuggugaauuucacaag

SEQ ID NO: 1972262 - RNA, 17 nt, Human
uuggcucccaucuuuug

SEQ ID NO: 1972263 - RNA, 22 nt, Human
uuggcucccaucuuuuguuacu

SEQ ID NO: 1972264 - RNA, 22 nt, Human
uuggcuccugcccacugauagc

SEQ ID NO: 1972265 - RNA, 15 nt, Human
aucuuugauguguug

SEQ ID NO: 1972266 - RNA, 16 nt, Human
aucuuugauguguugu

SEQ ID NO: 1972267 - RNA, 17 nt, Human
aucuuugauguguuguu

SEQ ID NO: 1972268 - RNA, 19 nt, Human
aucuuugauguguuguucu

SEQ ID NO: 1972269 - RNA, 12 nt, Human
aucuuugaugug

SEQ ID NO: 1972270 - RNA, 14 nt, Human
aucuuugauguguu

SEQ ID NO: 1972271 - RNA, 22 nt, Human
aucuuuucauuuaggugaggaa

SEQ ID NO: 1972272 - RNA, 17 nt, Human
aucuuugcagacaggca

SEQ ID NO: 1972273 - RNA, 21 nt, Human
aucuuugauguguuguucuug

SEQ ID NO: 1972274 - RNA, 16 nt, Human
aucuuuucugaaucuu

SEQ ID NO: 1972275 - RNA, 18 nt, Human
aucuuuucugaaucuucu

SEQ ID NO: 1972276 - RNA, 18 nt, Human
augaaagggcccagagag

SEQ ID NO: 1972277 - RNA, 14 nt, Human
uuggagggccuggg

SEQ ID NO: 1972278 - RNA, 15 nt, Human
uuggagggccugggc

SEQ ID NO: 1972279 - RNA, 14 nt, Human
uugcuugaaagaaa

SEQ ID NO: 1972280 - RNA, 21 nt, Human
uugcuugaagcaaacaguuga

SEQ ID NO: 1972281 - RNA, 11 nt, Human
uuggagacaga

SEQ ID NO: 1972282 - RNA, 16 nt, Human
uuggagggugucccaa

SEQ ID NO: 1972283 - RNA, 17 nt, Human
uuggaguagaauguagu

SEQ ID NO: 1972284 - RNA, 14 nt, Human
uuggaguagaaugu

SEQ ID NO: 1972285 - RNA, 21 nt, Human
uuggcccagggggcuuccuga

SEQ ID NO: 1972286 - RNA, 18 nt, Human
uuggccccugcccggcug

SEQ ID NO: 1972287 - RNA, 23 nt, Human
uuggccugagaugccuggugagc

SEQ ID NO: 1972288 - RNA, 14 nt, Human
uuggcccuuuccuu

SEQ ID NO: 1972289 - RNA, 19 nt, Human
uuggcccuuuccuuccaga

SEQ ID NO: 1972290 - RNA, 22 nt, Human
uuggccucugcaaaggaaauac

SEQ ID NO: 1972291 - RNA, 13 nt, Human
uuggccucagagg

SEQ ID NO: 1972292 - RNA, 14 nt, Human
aucuugugaaaaua

SEQ ID NO: 1972293 - RNA, 15 nt, Human
aucuugugaaaauaa

SEQ ID NO: 1972294 - RNA, 18 nt, Human
aucuugugaaaauaauug

SEQ ID NO: 1972295 - RNA, 19 nt, Human
aucuugugaaaauaauuga

SEQ ID NO: 1972296 - RNA, 13 nt, Human
uugcuucuucuga

SEQ ID NO: 1972297 - RNA, 21 nt, Human
uugcucucuuuuauucugugc

SEQ ID NO: 1972298 - RNA, 12 nt, Human
uugcuccuugac

SEQ ID NO: 1972299 - RNA, 18 nt, Human
uugcucuaaaauauuuau

SEQ ID NO: 1972300 - RNA, 20 nt, Human
uugcucuaaaauauuuauga

SEQ ID NO: 1972301 - RNA, 21 nt, Human
uugcucuaaaauauuuaugaa

SEQ ID NO: 1972302 - RNA, 22 nt, Human
uugcucuaaaauauuuaugaag

SEQ ID NO: 1972303 - RNA, 20 nt, Human
uugcucacaguuauuacaua

SEQ ID NO: 1972304 - RNA, 19 nt, Human
uugcucacaguuauuacau

SEQ ID NO: 1972305 - RNA, 21 nt, Human
aucuguuuuauaccuugcuua

SEQ ID NO: 1972306 - RNA, 15 nt, Human
aucuguuuacagugu

SEQ ID NO: 1972307 - RNA, 17 nt, Human
aucuguuuacaguguuc

SEQ ID NO: 1972308 - RNA, 11 nt, Human
aucugucuuuc

SEQ ID NO: 1972309 - RNA, 13 nt, Human
aucugucuuucca

SEQ ID NO: 1972310 - RNA, 17 nt, Human
aucugucuuuccacucu

SEQ ID NO: 1972311 - RNA, 20 nt, Human
aucugucuuuccacucugga

SEQ ID NO: 1972312 - RNA, 21 nt, Human
aucugucuuuccacucuggau

SEQ ID NO: 1972313 - RNA, 18 nt, Human
aucugugaaaggaaagag

SEQ ID NO: 1972314 - RNA, 20 nt, Human
aucuuggucagauuugaacu

SEQ ID NO: 1972315 - RNA, 13 nt, Human
aucuugcucugcu

SEQ ID NO: 1972316 - RNA, 17 nt, Human
aucuugcucucuuuuau

SEQ ID NO: 1972317 - RNA, 14 nt, Human
aucuuauaauuuaa

SEQ ID NO: 1972318 - RNA, 14 nt, Human
uugcauuucagaaa

SEQ ID NO: 1972319 - RNA, 20 nt, Human
uugcauuucagaaagccuuu

SEQ ID NO: 1972320 - RNA, 14 nt, Human
uugcauuugcuuuu

SEQ ID NO: 1972321 - RNA, 13 nt, Human
uugcauuucagaa

SEQ ID NO: 1972322 - RNA, 12 nt, Human
uugcauuuuugc

SEQ ID NO: 1972323 - RNA, 17 nt, Human
uugccaaaacccagcug

SEQ ID NO: 1972324 - RNA, 18 nt, Human
uugccaaaacccagcugc

SEQ ID NO: 1972325 - RNA, 19 nt, Human
uugccaaaacccagcugca

SEQ ID NO: 1972326 - RNA, 21 nt, Human
uugccaaaacccagcugcacc

SEQ ID NO: 1972327 - RNA, 22 nt, Human
uugccaaaacccagcugcaccc

SEQ ID NO: 1972328 - RNA, 19 nt, Human
uugccaaacauuaauguug

SEQ ID NO: 1972329 - RNA, 20 nt, Human
uugccaaacauuaauguuga

SEQ ID NO: 1972330 - RNA, 23 nt, Human
uugccaaaacccagcugcacccc

SEQ ID NO: 1972331 - RNA, 13 nt, Human
uugccaaaauggu

SEQ ID NO: 1972332 - RNA, 13 nt, Human
uugccaaacauua

SEQ ID NO: 1972333 - RNA, 14 nt, Human
uugccaaacauuaa

SEQ ID NO: 1972334 - RNA, 15 nt, Human
uugccaaacauuaau

SEQ ID NO: 1972335 - RNA, 14 nt, Human
aucuguaugauucu

SEQ ID NO: 1972336 - RNA, 15 nt, Human
aucuguaugauucua

SEQ ID NO: 1972337 - RNA, 19 nt, Human
aucuguaugauucuaugga

SEQ ID NO: 1972338 - RNA, 11 nt, Human
aucugucugcu

SEQ ID NO: 1972339 - RNA, 14 nt, Human
aucugucugcuggu

SEQ ID NO: 1972340 - RNA, 17 nt, Human
aucugugaaaggaaaga

SEQ ID NO: 1972341 - RNA, 23 nt, Human
aucugucugcuggucacuucuuc

SEQ ID NO: 1972342 - RNA, 17 nt, Human
aucuggugacuuuccuc

SEQ ID NO: 1972343 - RNA, 16 nt, Human
aucuggugacuuuccu

SEQ ID NO: 1972344 - RNA, 10 nt, Human
aucuggugac

SEQ ID NO: 1972345 - RNA, 13 nt, Human
aucugguuuucuc

SEQ ID NO: 1972346 - RNA, 15 nt, Human
aucugguuuucucuc

SEQ ID NO: 1972347 - RNA, 13 nt, Human
auaauuuuaaaug

SEQ ID NO: 1972348 - RNA, 12 nt, Human
auaauuuuaaau

SEQ ID NO: 1972349 - RNA, 14 nt, Human
auaauuuuaaaugu

SEQ ID NO: 1972350 - RNA, 18 nt, Human
auaauuugguauccuuau

SEQ ID NO: 1972351 - RNA, 18 nt, Human
uuagaugugcugcuuuga

SEQ ID NO: 1972352 - RNA, 23 nt, Human
auaauucacauuguauucagagu

SEQ ID NO: 1972353 - RNA, 19 nt, Human
auaauuauuugucucagau

SEQ ID NO: 1972354 - RNA, 20 nt, Human
auaauucaggaagcagcuuu

SEQ ID NO: 1972355 - RNA, 13 nt, Human
auaauuuacugug

SEQ ID NO: 1972356 - RNA, 21 nt, Human
auaauuuacugugacuuuauu

SEQ ID NO: 1972357 - RNA, 18 nt, Human
auaauauguuuccuuccc

SEQ ID NO: 1972358 - RNA, 19 nt, Human
auaauauguuuccuucccu

SEQ ID NO: 1972359 - RNA, 16 nt, Human
auaauaucucuaauau

SEQ ID NO: 1972360 - RNA, 20 nt, Human
auaaucaagagccuuaaaac

SEQ ID NO: 1972361 - RNA, 21 nt, Human
auaaucaagagccuuaaaaca

SEQ ID NO: 1972362 - RNA, 22 nt, Human
auaaucaagagccuuaaaacau

SEQ ID NO: 1972363 - RNA, 20 nt, Human
auaauauguuuccuucccuc

SEQ ID NO: 1972364 - RNA, 17 nt, Human
auaaucaagagccuuaa

SEQ ID NO: 1972365 - RNA, 16 nt, Human
auaaucaagagccuua

SEQ ID NO: 1972366 - RNA, 18 nt, Human
auaaucacaacccuucag

SEQ ID NO: 1972367 - RNA, 22 nt, Human
auaaucuggacuccucugucca

SEQ ID NO: 1972368 - RNA, 22 nt, Human
auaagccaaaaaaugcuugcuu

SEQ ID NO: 1972369 - RNA, 21 nt, Human
auaagauucauauuuacuucu

SEQ ID NO: 1972370 - RNA, 15 nt, Human
auaagcaguuaugug

SEQ ID NO: 1972371 - RNA, 14 nt, Human
auaagccagacauc

SEQ ID NO: 1972372 - RNA, 14 nt, Human
auaagccaaaauua

SEQ ID NO: 1972373 - RNA, 18 nt, Human
uuagguuggcaaaaaggc

SEQ ID NO: 1972374 - RNA, 13 nt, Human
uuaguaaucauau

SEQ ID NO: 1972375 - RNA, 14 nt, Human
uuaguaaucauauu

SEQ ID NO: 1972376 - RNA, 13 nt, Human
uuaguaagucuug

SEQ ID NO: 1972377 - RNA, 15 nt, Human
uuaggugaggaagca

SEQ ID NO: 1972378 - RNA, 19 nt, Human
uuaggugugggggaagcac

SEQ ID NO: 1972379 - RNA, 15 nt, Human
uuagauuaagaaaua

SEQ ID NO: 1972380 - RNA, 19 nt, Human
uuagauuaagaaauagaca

SEQ ID NO: 1972381 - RNA, 20 nt, Human
uuagaugugcugcuuugaua

SEQ ID NO: 1972382 - RNA, 14 nt, Human
uuagggaguauucu

SEQ ID NO: 1972383 - RNA, 17 nt, Human
uuagggaguauucuaau

SEQ ID NO: 1972384 - RNA, 18 nt, Human
uuagggaguauucuaaua

SEQ ID NO: 1972385 - RNA, 15 nt, Human
uuagggcucuaauuu

SEQ ID NO: 1972386 - RNA, 22 nt, Human
uuauaaaacguguuuguauugu

SEQ ID NO: 1972387 - RNA, 19 nt, Human
uuauaaaacagaguaaucu

SEQ ID NO: 1972388 - RNA, 22 nt, Human
uuauaaaacagaguaaucuugu

SEQ ID NO: 1972389 - RNA, 22 nt, Human
uuauaaaaauaaaaaacacugg

SEQ ID NO: 1972390 - RNA, 21 nt, Human
uuauaaaaauaaaaaacacug

SEQ ID NO: 1972391 - RNA, 15 nt, Human
uuauaaaauuuacug

SEQ ID NO: 1972392 - RNA, 13 nt, Human
uuauaaacaagaa

SEQ ID NO: 1972393 - RNA, 13 nt, Human
uuauaaacuuuac

SEQ ID NO: 1972394 - RNA, 20 nt, Human
uuauaaacaagaaugaaggu

SEQ ID NO: 1972395 - RNA, 21 nt, Human
uuauaaacaagaaugaagguu

SEQ ID NO: 1972396 - RNA, 18 nt, Human
uuauaaacucauuuugcu

SEQ ID NO: 1972397 - RNA, 15 nt, Human
uuauaaaaauaaaaa

SEQ ID NO: 1972398 - RNA, 21 nt, Human
uuaguacuuuauagaagaaug

SEQ ID NO: 1972399 - RNA, 14 nt, Human
uuaguagagacagg

SEQ ID NO: 1972400 - RNA, 19 nt, Human
uuaguacuccccuccuuga

SEQ ID NO: 1972401 - RNA, 13 nt, Human
uuaguagagacag

SEQ ID NO: 1972402 - RNA, 12 nt, Human
uuaguacuuuau

SEQ ID NO: 1972403 - RNA, 13 nt, Human
uuaguacuuuaua

SEQ ID NO: 1972404 - RNA, 16 nt, Human
uuaguacuuuauagaa

SEQ ID NO: 1972405 - RNA, 17 nt, Human
uuaguacuuuauagaag

SEQ ID NO: 1972406 - RNA, 19 nt, Human
uuaguacuuuauagaagaa

SEQ ID NO: 1972407 - RNA, 17 nt, Human
uuagaaucccuguguua

SEQ ID NO: 1972408 - RNA, 20 nt, Human
uuagaaucccuguguuaauu

SEQ ID NO: 1972409 - RNA, 23 nt, Human
uuagaaucccuguguuaauuuaa

SEQ ID NO: 1972410 - RNA, 13 nt, Human
uuagaauguugaa

SEQ ID NO: 1972411 - RNA, 18 nt, Human
uuagaauggugauuuuaa

SEQ ID NO: 1972412 - RNA, 19 nt, Human
uuagaauggugauuuuaaa

SEQ ID NO: 1972413 - RNA, 21 nt, Human
uuagaauggugauuuuaaaug

SEQ ID NO: 1972414 - RNA, 13 nt, Human
uuagaagguauua

SEQ ID NO: 1972415 - RNA, 18 nt, Human
uuagaagguauuaagauu

SEQ ID NO: 1972416 - RNA, 16 nt, Human
uuagaagucacacagu

SEQ ID NO: 1972417 - RNA, 14 nt, Human
auaagauucauauu

SEQ ID NO: 1972418 - RNA, 22 nt, Human
auaagaaaagauguagauuuau

SEQ ID NO: 1972419 - RNA, 11 nt, Human
auaagaaaaga

SEQ ID NO: 1972420 - RNA, 12 nt, Human
auaagaaaagau

SEQ ID NO: 1972421 - RNA, 18 nt, Human
auaagaaaagauguagau

SEQ ID NO: 1972422 - RNA, 21 nt, Human
auaagaaaagauguagauuua

SEQ ID NO: 1972423 - RNA, 13 nt, Human
uuacuguacauga

SEQ ID NO: 1972424 - RNA, 14 nt, Human
uuacuguacaugaa

SEQ ID NO: 1972425 - RNA, 22 nt, Human
uuacuguacaugaaaacacauu

SEQ ID NO: 1972426 - RNA, 23 nt, Human
uuacuguacaugaaaacacauuu

SEQ ID NO: 1972427 - RNA, 12 nt, Human
uuacuguacaug

SEQ ID NO: 1972428 - RNA, 23 nt, Human
uuacuguacagacagaaaaaacu

SEQ ID NO: 1972429 - RNA, 18 nt, Human
uuaccagugccuuaaacu

SEQ ID NO: 1972430 - RNA, 17 nt, Human
uuaccauaguuuucuca

SEQ ID NO: 1972431 - RNA, 15 nt, Human
uuacugcagcuuugu

SEQ ID NO: 1972432 - RNA, 23 nt, Human
uuacuccauauauauauaugugu

SEQ ID NO: 1972433 - RNA, 18 nt, Human
uuacaaaggcuguauuca

SEQ ID NO: 1972434 - RNA, 17 nt, Human
uuacaaaauguaacugu

SEQ ID NO: 1972435 - RNA, 18 nt, Human
uuacaaaauguaacuguu

SEQ ID NO: 1972436 - RNA, 19 nt, Human
uuacaaaauguaacuguua

SEQ ID NO: 1972437 - RNA, 21 nt, Human
uuaaucuacugcauuuaggga

SEQ ID NO: 1972438 - RNA, 21 nt, Human
auaaaucuaaugacauucaau

SEQ ID NO: 1972439 - RNA, 21 nt, Human
uuacaaaugauugcuuuuaaa

SEQ ID NO: 1972440 - RNA, 23 nt, Human
uuacaaaugauugcuuuuaaaau

SEQ ID NO: 1972441 - RNA, 14 nt, Human
uuacaaaugauugc

SEQ ID NO: 1972442 - RNA, 17 nt, Human
uuacaaaugauugcuuu

SEQ ID NO: 1972443 - RNA, 19 nt, Human
uuacaaaugauugcuuuua

SEQ ID NO: 1972444 - RNA, 20 nt, Human
uuacaaaugauugcuuuuaa

SEQ ID NO: 1972445 - RNA, 12 nt, Human
uuacaaaugauu

SEQ ID NO: 1972446 - RNA, 13 nt, Human
auaaauugcuccu

SEQ ID NO: 1972447 - RNA, 16 nt, Human
auaaauugcuccuuga

SEQ ID NO: 1972448 - RNA, 18 nt, Human
auaaaugauucaaaaagu

SEQ ID NO: 1972449 - RNA, 17 nt, Human
uuacaguggggaaugaa

SEQ ID NO: 1972450 - RNA, 17 nt, Human
uuacagugccuaaaaua

SEQ ID NO: 1972451 - RNA, 20 nt, Human
uuacaggugauuaacuugga

SEQ ID NO: 1972452 - RNA, 13 nt, Human
uuacaguguuccg

SEQ ID NO: 1972453 - RNA, 18 nt, Human
uuacagugccuaaaauaa

SEQ ID NO: 1972454 - RNA, 13 nt, Human
uuacaguuacuuu

SEQ ID NO: 1972455 - RNA, 14 nt, Human
uuacaguuacuuuu

SEQ ID NO: 1972456 - RNA, 16 nt, Human
uuacaguuacuuuucc

SEQ ID NO: 1972457 - RNA, 18 nt, Human
uuacaguuacuuuuccuu

SEQ ID NO: 1972458 - RNA, 19 nt, Human
uuacaguuacuuuuccuug

SEQ ID NO: 1972459 - RNA, 19 nt, Human
uuaccagcagagcaccuua

SEQ ID NO: 1972460 - RNA, 14 nt, Human
uuacauaaacauca

SEQ ID NO: 1972461 - RNA, 18 nt, Human
uuacauaaacaucagguu

SEQ ID NO: 1972462 - RNA, 16 nt, Human
uuacaguuauagaaag

SEQ ID NO: 1972463 - RNA, 17 nt, Human
uuacagguaccaguucu

SEQ ID NO: 1972464 - RNA, 13 nt, Human
uuacaggugauua

SEQ ID NO: 1972465 - RNA, 15 nt, Human
uuacaggugauuaac

SEQ ID NO: 1972466 - RNA, 14 nt, Human
uuacaggugugaac

SEQ ID NO: 1972467 - RNA, 18 nt, Human
auaaauugcuccuugaca

SEQ ID NO: 1972468 - RNA, 15 nt, Human
auaacuauguugaua

SEQ ID NO: 1972469 - RNA, 11 nt, Human
uuaaucacugu

SEQ ID NO: 1972470 - RNA, 13 nt, Human
uuaaucacugugu

SEQ ID NO: 1972471 - RNA, 14 nt, Human
uuaaucacugugua

SEQ ID NO: 1972472 - RNA, 15 nt, Human
uuaaucacuguguau

SEQ ID NO: 1972473 - RNA, 17 nt, Human
uuaaucacuguguauau

SEQ ID NO: 1972474 - RNA, 20 nt, Human
uuaaucacuguguauauuug

SEQ ID NO: 1972475 - RNA, 15 nt, Human
uuaaucagaagaaaa

SEQ ID NO: 1972476 - RNA, 15 nt, Human
uuaaucuaaauggaa

SEQ ID NO: 1972477 - RNA, 14 nt, Human
uuaaucuacugcau

SEQ ID NO: 1972478 - RNA, 15 nt, Human
uuaaucuacugcauu

SEQ ID NO: 1972479 - RNA, 16 nt, Human
uuaaucuacugcauuu

SEQ ID NO: 1972480 - RNA, 12 nt, Human
uuaaucauuuuu

SEQ ID NO: 1972481 - RNA, 22 nt, Human
uuaagagagucuauuuacggaa

SEQ ID NO: 1972482 - RNA, 22 nt, Human
uuaagacgaaacauuuguucua

SEQ ID NO: 1972483 - RNA, 20 nt, Human
uuaaguuuugacaagcuggc

SEQ ID NO: 1972484 - RNA, 13 nt, Human
uuaaguuugcacu

SEQ ID NO: 1972485 - RNA, 16 nt, Human
uuaauuugguuuucac

SEQ ID NO: 1972486 - RNA, 13 nt, Human
uuaauuuggacca

SEQ ID NO: 1972487 - RNA, 18 nt, Human
uuaauuuggaccauuuuc

SEQ ID NO: 1972488 - RNA, 19 nt, Human
uuaauuuggaccauuuucc

SEQ ID NO: 1972489 - RNA, 21 nt, Human
uuaauuuggaccauuuuccug

SEQ ID NO: 1972490 - RNA, 15 nt, Human
uuaauuuuuaaaugc

SEQ ID NO: 1972491 - RNA, 16 nt, Human
uuaauuuuuaaaugca

SEQ ID NO: 1972492 - RNA, 12 nt, Human
uuaauuuugucu

SEQ ID NO: 1972493 - RNA, 23 nt, Human
uuaauuuugucugccccaaguuu

SEQ ID NO: 1972494 - RNA, 14 nt, Human
uuaauuuuuaaaug

SEQ ID NO: 1972495 - RNA, 13 nt, Human
uuaaucuuuaauu

SEQ ID NO: 1972496 - RNA, 17 nt, Human
uuaaucuuuaauuuuac

SEQ ID NO: 1972497 - RNA, 14 nt, Human
uuaauuucaagcuu

SEQ ID NO: 1972498 - RNA, 14 nt, Human
uuaauuucaguaag

SEQ ID NO: 1972499 - RNA, 13 nt, Human
uuaauuugaaaua

SEQ ID NO: 1972500 - RNA, 15 nt, Human
uuaauuugaaauaug

SEQ ID NO: 1972501 - RNA, 23 nt, Human
uuaacuuuuauaaacuuuaccuu

SEQ ID NO: 1972502 - RNA, 22 nt, Human
uuaacuuuuauaaacuuuaccu

SEQ ID NO: 1972503 - RNA, 20 nt, Human
auaaaagccuguuuaagaga

SEQ ID NO: 1972504 - RNA, 13 nt, Human
auaaaaaaaagaa

SEQ ID NO: 1972505 - RNA, 19 nt, Human
auaaaagccuguuuaagag

SEQ ID NO: 1972506 - RNA, 22 nt, Human
uuaagacacuuccgucacaucc

SEQ ID NO: 1972507 - RNA, 18 nt, Human
uuaagacauuuuuggaag

SEQ ID NO: 1972508 - RNA, 23 nt, Human
uuaagacauuuuuggaaggggac

SEQ ID NO: 1972509 - RNA, 19 nt, Human
uuaagacgaaacauuuguu

SEQ ID NO: 1972510 - RNA, 11 nt, Human
uuaagaaaaaa

SEQ ID NO: 1972511 - RNA, 22 nt, Human
uuaagaaugaguuucuuagacu

SEQ ID NO: 1972512 - RNA, 23 nt, Human
uuaagaaugaguuucuuagacuu

SEQ ID NO: 1972513 - RNA, 16 nt, Human
uuaagaauuucacaag

SEQ ID NO: 1972514 - RNA, 18 nt, Human
uuaagaaugaguuucuua

SEQ ID NO: 1972515 - RNA, 20 nt, Human
uuaagaaugaguuucuuaga

SEQ ID NO: 1972516 - RNA, 20 nt, Human
aguuuuucauaagauauuuu

SEQ ID NO: 1972517 - RNA, 11 nt, Human
aguuuuucugu

SEQ ID NO: 1972518 - RNA, 13 nt, Human
aguuuuucugucc

SEQ ID NO: 1972519 - RNA, 15 nt, Human
aguuuuuuuuauaca

SEQ ID NO: 1972520 - RNA, 12 nt, Human
aguuuuucuuaa

SEQ ID NO: 1972521 - RNA, 16 nt, Human
aguuuugugaaauuuu

SEQ ID NO: 1972522 - RNA, 18 nt, Human
aguuuugugaaauuuuuc

SEQ ID NO: 1972523 - RNA, 19 nt, Human
aguuuugugaaauuuuuca

SEQ ID NO: 1972524 - RNA, 20 nt, Human
aguuuugugaaauuuuucau

SEQ ID NO: 1972525 - RNA, 21 nt, Human
aguuuugugaaauuuuucaua

SEQ ID NO: 1972526 - RNA, 17 nt, Human
aguuuuacccuauaucu

SEQ ID NO: 1972527 - RNA, 19 nt, Human
aguuuuacccuauaucuau

SEQ ID NO: 1972528 - RNA, 18 nt, Human
aguuuuaggguacaugug

SEQ ID NO: 1972529 - RNA, 19 nt, Human
aguuuuaggguacaugugc

SEQ ID NO: 1972530 - RNA, 12 nt, Human
uuaaaguuucaa

SEQ ID NO: 1972531 - RNA, 13 nt, Human
uuaaaguuucaaa

SEQ ID NO: 1972532 - RNA, 14 nt, Human
uuaaaguuucaaaa

SEQ ID NO: 1972533 - RNA, 16 nt, Human
uuaaaguuucaaaaau

SEQ ID NO: 1972534 - RNA, 18 nt, Human
uuaaaguuucaaaaaucu

SEQ ID NO: 1972535 - RNA, 19 nt, Human
uuaaaguuucaaaaaucug

SEQ ID NO: 1972536 - RNA, 20 nt, Human
uuaaaguuucaaaaaucuga

SEQ ID NO: 1972537 - RNA, 21 nt, Human
uuaaaguuucaaaaaucugaa

SEQ ID NO: 1972538 - RNA, 12 nt, Human
uuaacagaaaug

SEQ ID NO: 1972539 - RNA, 17 nt, Human
uuaaauuuuuuuguaug

SEQ ID NO: 1972540 - RNA, 20 nt, Human
uuaaauuuuuuuguaugaaa

SEQ ID NO: 1972541 - RNA, 21 nt, Human
uuaaauuuuuuuguaugaaaa

SEQ ID NO: 1972542 - RNA, 22 nt, Human
uuaaauuuuuuuguaugaaaac

SEQ ID NO: 1972543 - RNA, 13 nt, Human
uuaacagaaaugu

SEQ ID NO: 1972544 - RNA, 14 nt, Human
uuaacagaaaugua

SEQ ID NO: 1972545 - RNA, 17 nt, Human
aguuuaugucucaguuu

SEQ ID NO: 1972546 - RNA, 23 nt, Human
uuaaauuuuuuuguaugaaaaca

SEQ ID NO: 1972547 - RNA, 16 nt, Human
uuaacagaaauguaca

SEQ ID NO: 1972548 - RNA, 19 nt, Human
aguuucugccgcagcccug

SEQ ID NO: 1972549 - RNA, 22 nt, Human
aguuuguuaguaugaggcauuu

SEQ ID NO: 1972550 - RNA, 15 nt, Human
aguuuuacaguguuu

SEQ ID NO: 1972551 - RNA, 22 nt, Human
aguuuguuucuuugaauuuuca

SEQ ID NO: 1972552 - RNA, 23 nt, Human
aguuuguuucuuugaauuuucau

SEQ ID NO: 1972553 - RNA, 15 nt, Human
aguuuguugaaacac

SEQ ID NO: 1972554 - RNA, 16 nt, Human
aguuuguuucuuugaa

SEQ ID NO: 1972555 - RNA, 17 nt, Human
aguuuguuucuuugaau

SEQ ID NO: 1972556 - RNA, 18 nt, Human
aguuuguuucuuugaauu

SEQ ID NO: 1972557 - RNA, 20 nt, Human
aguuuguuucuuugaauuuu

SEQ ID NO: 1972558 - RNA, 15 nt, Human
aguuucugccgcagc

SEQ ID NO: 1972559 - RNA, 14 nt, Human
aguuucucuuuuca

SEQ ID NO: 1972560 - RNA, 13 nt, Human
aguuucucagcuc

SEQ ID NO: 1972561 - RNA, 12 nt, Human
aguuuauguuuu

SEQ ID NO: 1972562 - RNA, 14 nt, Human
aguuuauguuuugg

SEQ ID NO: 1972563 - RNA, 16 nt, Human
aguuuauguuuugguc

SEQ ID NO: 1972564 - RNA, 16 nt, Human
aguuuauuccagagcu

SEQ ID NO: 1972565 - RNA, 21 nt, Human
aguuuauuccagagcugccag

SEQ ID NO: 1972566 - RNA, 22 nt, Human
aguuuauuccagagcugccagu

SEQ ID NO: 1972567 - RNA, 19 nt, Human
uuaaaaugagaaaucuaaa

SEQ ID NO: 1972568 - RNA, 12 nt, Human
uuaaaaugagaa

SEQ ID NO: 1972569 - RNA, 21 nt, Human
uuaaaaugcaugauugcagaa

SEQ ID NO: 1972570 - RNA, 13 nt, Human
uuaaaaucuuauu

SEQ ID NO: 1972571 - RNA, 15 nt, Human
uuaaaaucuuauuaa

SEQ ID NO: 1972572 - RNA, 16 nt, Human
uuaaaaucuuauuaaa

SEQ ID NO: 1972573 - RNA, 19 nt, Human
uuaaaaucuuauuaaaguu

SEQ ID NO: 1972574 - RNA, 20 nt, Human
uuaaaaucuuauuaaaguuu

SEQ ID NO: 1972575 - RNA, 19 nt, Human
uuaaaaugauugaaaauaa

SEQ ID NO: 1972576 - RNA, 14 nt, Human
uuaaaauguacaug

SEQ ID NO: 1972577 - RNA, 15 nt, Human
uuaaaauguacaugu

SEQ ID NO: 1972578 - RNA, 17 nt, Human
uuaaaauguacauguau

SEQ ID NO: 1972579 - RNA, 19 nt, Human
uuaaaauguacauguauua

SEQ ID NO: 1972580 - RNA, 21 nt, Human
uuaaaauguacauguauuaaa

SEQ ID NO: 1972581 - RNA, 19 nt, Human
uuaaaaaucucaaauuucu

SEQ ID NO: 1972582 - RNA, 20 nt, Human
uuaaaaaucucaaauuucua

SEQ ID NO: 1972583 - RNA, 17 nt, Human
aguuuaaauuguaauag

SEQ ID NO: 1972584 - RNA, 20 nt, Human
aguuuaaauuguaauaggcg

SEQ ID NO: 1972585 - RNA, 15 nt, Human
aguuuacugagaaug

SEQ ID NO: 1972586 - RNA, 12 nt, Human
aguuuagaacag

SEQ ID NO: 1972587 - RNA, 16 nt, Human
aguuuagaacagguuu

SEQ ID NO: 1972588 - RNA, 17 nt, Human
aguuuagaacagguuuu

SEQ ID NO: 1972589 - RNA, 16 nt, Human
auacagggaugguguu

SEQ ID NO: 1972590 - RNA, 20 nt, Human
auacaggcuggaaaguaagg

SEQ ID NO: 1972591 - RNA, 17 nt, Human
auacaggauuauuuuga

SEQ ID NO: 1972592 - RNA, 19 nt, Human
auacaggauuauuuugauu

SEQ ID NO: 1972593 - RNA, 21 nt, Human
auacaggaugaugacuaugga

SEQ ID NO: 1972594 - RNA, 18 nt, Human
auacaguuacucagaauu

SEQ ID NO: 1972595 - RNA, 23 nt, Human
auacagauagauauaugcucugc

SEQ ID NO: 1972596 - RNA, 13 nt, Human
auacagauaaaug

SEQ ID NO: 1972597 - RNA, 17 nt, Human
auacagauaaaugauuc

SEQ ID NO: 1972598 - RNA, 18 nt, Human
auacagauaaaugauuca

SEQ ID NO: 1972599 - RNA, 23 nt, Human
auacaggaaaagcugcugacagu

SEQ ID NO: 1972600 - RNA, 16 nt, Human
auacaugaugauuuca

SEQ ID NO: 1972601 - RNA, 19 nt, Human
auacaugaugauuucagaa

SEQ ID NO: 1972602 - RNA, 20 nt, Human
auacaguuacucagaauucu

SEQ ID NO: 1972603 - RNA, 20 nt, Human
auacauaaacaagaccacgu

SEQ ID NO: 1972604 - RNA, 17 nt, Human
auacagaggcaacugca

SEQ ID NO: 1972605 - RNA, 16 nt, Human
auacagaggcaacugc

SEQ ID NO: 1972606 - RNA, 21 nt, Human
auacagaccgaacuguuguau

SEQ ID NO: 1972607 - RNA, 18 nt, Human
auacagaccgaacuguug

SEQ ID NO: 1972608 - RNA, 20 nt, Human
auacagaccgaacuguugua

SEQ ID NO: 1972609 - RNA, 17 nt, Human
uuauaaacuuuaccuuu

SEQ ID NO: 1972610 - RNA, 18 nt, Human
uuauaaacuuuaccuuuu

SEQ ID NO: 1972611 - RNA, 16 nt, Human
uuauaaacuuuuuucu

SEQ ID NO: 1972612 - RNA, 12 nt, Human
uuauaaacuuuu

SEQ ID NO: 1972613 - RNA, 22 nt, Human
uuauaaacuuuuuucuuacugu

SEQ ID NO: 1972614 - RNA, 12 nt, Human
uuauaaaggaau

SEQ ID NO: 1972615 - RNA, 20 nt, Human
auacaacaccaaaaaauauc

SEQ ID NO: 1972616 - RNA, 21 nt, Human
auacaacaccaaaaaauaucu

SEQ ID NO: 1972617 - RNA, 17 nt, Human
auaccacuuuuguucuu

SEQ ID NO: 1972618 - RNA, 18 nt, Human
auaccacuuuuguucuug

SEQ ID NO: 1972619 - RNA, 22 nt, Human
auacauguuuauguaaacaaau

SEQ ID NO: 1972620 - RNA, 19 nt, Human
auacauguuuauguaaaca

SEQ ID NO: 1972621 - RNA, 21 nt, Human
auacauguuuauguaaacaaa

SEQ ID NO: 1972622 - RNA, 14 nt, Human
auacauguuuaugu

SEQ ID NO: 1972623 - RNA, 16 nt, Human
auacauguuuauguaa

SEQ ID NO: 1972624 - RNA, 17 nt, Human
auaccagccaguaaaug

SEQ ID NO: 1972625 - RNA, 14 nt, Human
auaccuuuuuuaga

SEQ ID NO: 1972626 - RNA, 14 nt, Human
auacguacacauuu

SEQ ID NO: 1972627 - RNA, 15 nt, Human
auacguacacauuuu

SEQ ID NO: 1972628 - RNA, 18 nt, Human
auacgugggcauucaaau

SEQ ID NO: 1972629 - RNA, 19 nt, Human
auacgugggcauucaaaug

SEQ ID NO: 1972630 - RNA, 16 nt, Human
auacguacacauuuua

SEQ ID NO: 1972631 - RNA, 13 nt, Human
auacguacacauu

SEQ ID NO: 1972632 - RNA, 13 nt, Human
auacuaaccagca

SEQ ID NO: 1972633 - RNA, 21 nt, Human
auacguuucaaaaacaccccc

SEQ ID NO: 1972634 - RNA, 18 nt, Human
auacguuuuucaguuuca

SEQ ID NO: 1972635 - RNA, 19 nt, Human
auacuaaccagcagaaaug

SEQ ID NO: 1972636 - RNA, 20 nt, Human
auacuaaccagcagaaaugc

SEQ ID NO: 1972637 - RNA, 16 nt, Human
uuaucaauagcccagg

SEQ ID NO: 1972638 - RNA, 17 nt, Human
uuauauuuuucuuaaaa

SEQ ID NO: 1972639 - RNA, 20 nt, Human
uuauauuuuucuuaaaaagu

SEQ ID NO: 1972640 - RNA, 21 nt, Human
uuauauuuuucuuaaaaagua

SEQ ID NO: 1972641 - RNA, 17 nt, Human
uuaucaauagcccagga

SEQ ID NO: 1972642 - RNA, 15 nt, Human
uuauauuuggaugca

SEQ ID NO: 1972643 - RNA, 20 nt, Human
uuauauuuggaugcagaguu

SEQ ID NO: 1972644 - RNA, 22 nt, Human
uuauauuuggaugcagaguuca

SEQ ID NO: 1972645 - RNA, 14 nt, Human
uuauauuuuucuua

SEQ ID NO: 1972646 - RNA, 15 nt, Human
uuauauuuuucuuaa

SEQ ID NO: 1972647 - RNA, 16 nt, Human
uuauauuuuucuuaaa

SEQ ID NO: 1972648 - RNA, 10 nt, Human
uuaugugugu

SEQ ID NO: 1972649 - RNA, 12 nt, Human
uuaugugugugu

SEQ ID NO: 1972650 - RNA, 14 nt, Human
uuaugugugugugu

SEQ ID NO: 1972651 - RNA, 13 nt, Human
uuauguguaugug

SEQ ID NO: 1972652 - RNA, 20 nt, Human
uuauguguaugugaguauuc

SEQ ID NO: 1972653 - RNA, 22 nt, Human
uuaugugccagauuuaugcaua

SEQ ID NO: 1972654 - RNA, 15 nt, Human
uuaugugaaacaugu

SEQ ID NO: 1972655 - RNA, 13 nt, Human
uuauguauauggu

SEQ ID NO: 1972656 - RNA, 15 nt, Human
uuauguaaauaauuc

SEQ ID NO: 1972657 - RNA, 16 nt, Human
uuauguaaauaauucu

SEQ ID NO: 1972658 - RNA, 13 nt, Human
uuaugugaaacau

SEQ ID NO: 1972659 - RNA, 20 nt, Human
uuaugucauucucuuucuca

SEQ ID NO: 1972660 - RNA, 22 nt, Human
uuaugggcuggguucuacccag

SEQ ID NO: 1972661 - RNA, 16 nt, Human
uuaugguaaucauauu

SEQ ID NO: 1972662 - RNA, 15 nt, Human
uuauguaaacaaauc

SEQ ID NO: 1972663 - RNA, 17 nt, Human
uuauguaaacaaaucuu

SEQ ID NO: 1972664 - RNA, 18 nt, Human
uuaugguaaucauauuag

SEQ ID NO: 1972665 - RNA, 22 nt, Human
uuauguaaacaaaucuuuccau

SEQ ID NO: 1972666 - RNA, 23 nt, Human
uuauguaaacaaaucuuuccaua

SEQ ID NO: 1972667 - RNA, 12 nt, Human
uuauguaaauaa

SEQ ID NO: 1972668 - RNA, 13 nt, Human
uuauguaaauaau

SEQ ID NO: 1972669 - RNA, 19 nt, Human
uuauggcuuuugugcauua

SEQ ID NO: 1972670 - RNA, 13 nt, Human
uuaugggcugggu

SEQ ID NO: 1972671 - RNA, 15 nt, Human
uuaugaugacguaca

SEQ ID NO: 1972672 - RNA, 22 nt, Human
uuaugaugacguacaaguaguu

SEQ ID NO: 1972673 - RNA, 23 nt, Human
uuaugaugacguacaaguaguuc

SEQ ID NO: 1972674 - RNA, 13 nt, Human
uuaugagccaggc

SEQ ID NO: 1972675 - RNA, 20 nt, Human
uuaugauacuugaaaauuaa

SEQ ID NO: 1972676 - RNA, 22 nt, Human
uuaugauagcaaauggccucau

SEQ ID NO: 1972677 - RNA, 11 nt, Human
uuaugacucca

SEQ ID NO: 1972678 - RNA, 23 nt, Human
uuaugaagaaaauacuuaaaugu

SEQ ID NO: 1972679 - RNA, 17 nt, Human
uuaugaaacuuuuggaa

SEQ ID NO: 1972680 - RNA, 18 nt, Human
uuaugaaacuuuuggaag

SEQ ID NO: 1972681 - RNA, 14 nt, Human
uuaugaaacuuuug

SEQ ID NO: 1972682 - RNA, 19 nt, Human
uuaugaaacuuuuggaagg

SEQ ID NO: 1972683 - RNA, 12 nt, Human
uuaugaagaaaa

SEQ ID NO: 1972684 - RNA, 20 nt, Human
uuaugaagcuuuuaugugaa

SEQ ID NO: 1972685 - RNA, 23 nt, Human
uuaugaagaugggggccucuuuc

SEQ ID NO: 1972686 - RNA, 21 nt, Human
uuaugaagaaaaauuugaaaa

SEQ ID NO: 1972687 - RNA, 13 nt, Human
uuaugaagaaaau

SEQ ID NO: 1972688 - RNA, 20 nt, Human
uuaugaagaaaauacuuaaa

SEQ ID NO: 1972689 - RNA, 22 nt, Human
uuaugaagaaaauacuuaaaug

SEQ ID NO: 1972690 - RNA, 17 nt, Human
uuaucacccagaagaaa

SEQ ID NO: 1972691 - RNA, 18 nt, Human
uuaucacccagaagaaaa

SEQ ID NO: 1972692 - RNA, 19 nt, Human
uuaucacccagaagaaaau

SEQ ID NO: 1972693 - RNA, 21 nt, Human
uuaucacccagaagaaaauag

SEQ ID NO: 1972694 - RNA, 19 nt, Human
uuaucauuuuuuccuguuu

SEQ ID NO: 1972695 - RNA, 20 nt, Human
auacugccuuguuuaauggu

SEQ ID NO: 1972696 - RNA, 13 nt, Human
auacugccucccc

SEQ ID NO: 1972697 - RNA, 15 nt, Human
auacugccuccccca

SEQ ID NO: 1972698 - RNA, 18 nt, Human
auacugccuuguuuaaug

SEQ ID NO: 1972699 - RNA, 19 nt, Human
auacugcuugaauaaacac

SEQ ID NO: 1972700 - RNA, 12 nt, Human
auacugaaccac

SEQ ID NO: 1972701 - RNA, 18 nt, Human
auacugaaccacuuguag

SEQ ID NO: 1972702 - RNA, 19 nt, Human
auacugaaccacuuguaga

SEQ ID NO: 1972703 - RNA, 23 nt, Human
auacugaaccacuuguagauuug

SEQ ID NO: 1972704 - RNA, 22 nt, Human
auacugauggaauuuuuuugua

SEQ ID NO: 1972705 - RNA, 13 nt, Human
auacugauguguu

SEQ ID NO: 1972706 - RNA, 21 nt, Human
auacugcaaacuauuuaaaga

SEQ ID NO: 1972707 - RNA, 13 nt, Human
auacugauggaau

SEQ ID NO: 1972708 - RNA, 14 nt, Human
auacugauggaauu

SEQ ID NO: 1972709 - RNA, 16 nt, Human
auacuccuaugcuuua

SEQ ID NO: 1972710 - RNA, 17 nt, Human
auacuccuaugcuuuag

SEQ ID NO: 1972711 - RNA, 14 nt, Human
auacucccaucugu

SEQ ID NO: 1972712 - RNA, 17 nt, Human
auacuccuccaagguua

SEQ ID NO: 1972713 - RNA, 16 nt, Human
auacucugcuuagaau

SEQ ID NO: 1972714 - RNA, 14 nt, Human
auacucuuauaucu

SEQ ID NO: 1972715 - RNA, 18 nt, Human
auacucuuauaucuauau

SEQ ID NO: 1972716 - RNA, 18 nt, Human
auacucuuauagacaaca

SEQ ID NO: 1972717 - RNA, 12 nt, Human
uuauuccauauu

SEQ ID NO: 1972718 - RNA, 17 nt, Human
uuauuccauauuagaaa

SEQ ID NO: 1972719 - RNA, 19 nt, Human
uuauuccauauuagaaaac

SEQ ID NO: 1972720 - RNA, 20 nt, Human
uuauuccauauuagaaaacu

SEQ ID NO: 1972721 - RNA, 23 nt, Human
uuauuccauauuagaaaacuuug

SEQ ID NO: 1972722 - RNA, 16 nt, Human
auacucauuaggaugg

SEQ ID NO: 1972723 - RNA, 11 nt, Human
auacucccauc

SEQ ID NO: 1972724 - RNA, 12 nt, Human
uuauuauuuauu

SEQ ID NO: 1972725 - RNA, 13 nt, Human
uuauucaacagca

SEQ ID NO: 1972726 - RNA, 14 nt, Human
uuauucaacagcaa

SEQ ID NO: 1972727 - RNA, 13 nt, Human
uuauuaugcauga

SEQ ID NO: 1972728 - RNA, 22 nt, Human
uuauucaacagcaagugugaau

SEQ ID NO: 1972729 - RNA, 20 nt, Human
uuauucacuuuuauuuagca

SEQ ID NO: 1972730 - RNA, 12 nt, Human
uuauucauaauu

SEQ ID NO: 1972731 - RNA, 21 nt, Human
uuauucauuaguuuugaagau

SEQ ID NO: 1972732 - RNA, 18 nt, Human
uuauucauuaguuuugaa

SEQ ID NO: 1972733 - RNA, 16 nt, Human
uuauguugacauuugu

SEQ ID NO: 1972734 - RNA, 17 nt, Human
uuauguugacauuuguu

SEQ ID NO: 1972735 - RNA, 10 nt, Human
uuauguugac

SEQ ID NO: 1972736 - RNA, 13 nt, Human
uuauguugacauu

SEQ ID NO: 1972737 - RNA, 14 nt, Human
uuauguugacauuu

SEQ ID NO: 1972738 - RNA, 15 nt, Human
uuauguugacauuug

SEQ ID NO: 1972739 - RNA, 14 nt, Human
uuauuauauuuaca

SEQ ID NO: 1972740 - RNA, 13 nt, Human
uuauguuaauauu

SEQ ID NO: 1972741 - RNA, 12 nt, Human
uuauuaugcaug

SEQ ID NO: 1972742 - RNA, 22 nt, Human
uuauuaucauuguucuuuucaa

SEQ ID NO: 1972743 - RNA, 17 nt, Human
uuauuaucaaguagacu

SEQ ID NO: 1972744 - RNA, 15 nt, Human
uuauuauauuuacaa

SEQ ID NO: 1972745 - RNA, 16 nt, Human
auagacaauuuauuau

SEQ ID NO: 1972746 - RNA, 22 nt, Human
auagacaauuuauuauggcaca

SEQ ID NO: 1972747 - RNA, 18 nt, Human
auagaauugcaaucuaua

SEQ ID NO: 1972748 - RNA, 15 nt, Human
auagacagcaugaga

SEQ ID NO: 1972749 - RNA, 22 nt, Human
auagacaggagaagaaagaacu

SEQ ID NO: 1972750 - RNA, 23 nt, Human
auagacaauuuauuauggcacau

SEQ ID NO: 1972751 - RNA, 23 nt, Human
auagaagucuucaugaaaugcua

SEQ ID NO: 1972752 - RNA, 17 nt, Human
auagaauuaacacauga

SEQ ID NO: 1972753 - RNA, 22 nt, Human
auagaauaaaauuuuuaaucuu

SEQ ID NO: 1972754 - RNA, 19 nt, Human
auagaauaaaauuuuuaau

SEQ ID NO: 1972755 - RNA, 14 nt, Human
auagaauaaaauuu

SEQ ID NO: 1972756 - RNA, 14 nt, Human
auagaacaacauau

SEQ ID NO: 1972757 - RNA, 18 nt, Human
auagaacaacauauacaa

SEQ ID NO: 1972758 - RNA, 17 nt, Human
auagaaauguuugcuga

SEQ ID NO: 1972759 - RNA, 20 nt, Human
auacuguacaaugacuuuau

SEQ ID NO: 1972760 - RNA, 18 nt, Human
auacuguagauaauuaac

SEQ ID NO: 1972761 - RNA, 19 nt, Human
auagaaggcuauggggaua

SEQ ID NO: 1972762 - RNA, 16 nt, Human
auagaagaaugcaugc

SEQ ID NO: 1972763 - RNA, 17 nt, Human
auagaagaaugcaugcu

SEQ ID NO: 1972764 - RNA, 18 nt, Human
auagaagaaugcaugcuu

SEQ ID NO: 1972765 - RNA, 23 nt, Human
auagaagaaugcaugcuuuccau

SEQ ID NO: 1972766 - RNA, 12 nt, Human
auagaagaaugc

SEQ ID NO: 1972767 - RNA, 13 nt, Human
auagaagaaugca

SEQ ID NO: 1972768 - RNA, 13 nt, Human
auagaaguaaaaa

SEQ ID NO: 1972769 - RNA, 18 nt, Human
auagaagucuucaugaaa

SEQ ID NO: 1972770 - RNA, 19 nt, Human
auagaagucuucaugaaau

SEQ ID NO: 1972771 - RNA, 20 nt, Human
auagaagucuucaugaaaug

SEQ ID NO: 1972772 - RNA, 21 nt, Human
auagaagucuucaugaaaugc

SEQ ID NO: 1972773 - RNA, 13 nt, Human
auagaagucuuca

SEQ ID NO: 1972774 - RNA, 14 nt, Human
auagaagucuucau

SEQ ID NO: 1972775 - RNA, 15 nt, Human
auagaagucuucaug

SEQ ID NO: 1972776 - RNA, 17 nt, Human
auagaagucuucaugaa

SEQ ID NO: 1972777 - RNA, 14 nt, Human
auagagagagacca

SEQ ID NO: 1972778 - RNA, 18 nt, Human
auagacccacaagaggca

SEQ ID NO: 1972779 - RNA, 16 nt, Human
auagagcagaaauucu

SEQ ID NO: 1972780 - RNA, 19 nt, Human
auagagcagaaauucuguu

SEQ ID NO: 1972781 - RNA, 14 nt, Human
auagagcagaaauu

SEQ ID NO: 1972782 - RNA, 15 nt, Human
auagagcagaaauuc

SEQ ID NO: 1972783 - RNA, 17 nt, Human
auagaguacacugccug

SEQ ID NO: 1972784 - RNA, 23 nt, Human
auagaguaaaaagaaaacaaaac

SEQ ID NO: 1972785 - RNA, 14 nt, Human
auagaguacacugc

SEQ ID NO: 1972786 - RNA, 18 nt, Human
auagauaggucagugcaa

SEQ ID NO: 1972787 - RNA, 14 nt, Human
auagauguguggac

SEQ ID NO: 1972788 - RNA, 12 nt, Human
auagauuaaauc

SEQ ID NO: 1972789 - RNA, 14 nt, Human
auagauuaaaucau

SEQ ID NO: 1972790 - RNA, 20 nt, Human
auagauuaaaucauacuccu

SEQ ID NO: 1972791 - RNA, 13 nt, Human
auagauugugaau

SEQ ID NO: 1972792 - RNA, 15 nt, Human
auagauugugaauaa

SEQ ID NO: 1972793 - RNA, 18 nt, Human
auagauugugaauaauga

SEQ ID NO: 1972794 - RNA, 12 nt, Human
auagaugugugg

SEQ ID NO: 1972795 - RNA, 13 nt, Human
auagaugugugga

SEQ ID NO: 1972796 - RNA, 11 nt, Human
auagaugugug

SEQ ID NO: 1972797 - RNA, 23 nt, Human
agugcaaaaggcuugcagaacuu

SEQ ID NO: 1972798 - RNA, 12 nt, Human
agugcaaaaggc

SEQ ID NO: 1972799 - RNA, 13 nt, Human
agugaggcucugc

SEQ ID NO: 1972800 - RNA, 14 nt, Human
agugaggaugucug

SEQ ID NO: 1972801 - RNA, 14 nt, Human
agugaggagaauga

SEQ ID NO: 1972802 - RNA, 12 nt, Human
agugaggcucug

SEQ ID NO: 1972803 - RNA, 16 nt, Human
agugaggaugaaaaaa

SEQ ID NO: 1972804 - RNA, 20 nt, Human
agugaggaaaucaaagugcu

SEQ ID NO: 1972805 - RNA, 17 nt, Human
agugaggaauggcagug

SEQ ID NO: 1972806 - RNA, 22 nt, Human
uguggauucugaggcccugccc

SEQ ID NO: 1972807 - RNA, 17 nt, Human
uguggauucugaggccc

SEQ ID NO: 1972808 - RNA, 14 nt, Human
agugaggaaaucaa

SEQ ID NO: 1972809 - RNA, 15 nt, Human
agugaggaaaucaaa

SEQ ID NO: 1972810 - RNA, 17 nt, Human
agugaggaaaucaaagu

SEQ ID NO: 1972811 - RNA, 18 nt, Human
agugccaggauggaauga

SEQ ID NO: 1972812 - RNA, 14 nt, Human
agugccaaaaacaa

SEQ ID NO: 1972813 - RNA, 18 nt, Human
agugcauguacuaucuua

SEQ ID NO: 1972814 - RNA, 14 nt, Human
agugcaugcugucc

SEQ ID NO: 1972815 - RNA, 16 nt, Human
agugcaugcugucccu

SEQ ID NO: 1972816 - RNA, 14 nt, Human
agugcacuaaugug

SEQ ID NO: 1972817 - RNA, 17 nt, Human
agugcaagccccugcuc

SEQ ID NO: 1972818 - RNA, 15 nt, Human
agugcaagccccugc

SEQ ID NO: 1972819 - RNA, 18 nt, Human
agugcaagccccugcucc

SEQ ID NO: 1972820 - RNA, 17 nt, Human
agugcacuaauguguaa

SEQ ID NO: 1972821 - RNA, 21 nt, Human
agugcacuaauguguaagaca

SEQ ID NO: 1972822 - RNA, 12 nt, Human
agugcagaacug

SEQ ID NO: 1972823 - RNA, 12 nt, Human
agugcacugauu

SEQ ID NO: 1972824 - RNA, 17 nt, Human
agugcagugagccgaga

SEQ ID NO: 1972825 - RNA, 15 nt, Human
agugcagcagggcag

SEQ ID NO: 1972826 - RNA, 16 nt, Human
agugcagcagggcagu

SEQ ID NO: 1972827 - RNA, 22 nt, Human
agugcaguggcgaaaucccugc

SEQ ID NO: 1972828 - RNA, 14 nt, Human
agugcaauauauuu

SEQ ID NO: 1972829 - RNA, 21 nt, Human
ugugcugcccugcccaccugg

SEQ ID NO: 1972830 - RNA, 20 nt, Human
ugugcugcccugcccaccug

SEQ ID NO: 1972831 - RNA, 19 nt, Human
ugugcugcccugcccaccu

SEQ ID NO: 1972832 - RNA, 18 nt, Human
ugugcugcccugcccacc

SEQ ID NO: 1972833 - RNA, 19 nt, Human
ugugcuguguuugcucccc

SEQ ID NO: 1972834 - RNA, 21 nt, Human
uguggaucaaauccagccugc

SEQ ID NO: 1972835 - RNA, 14 nt, Human
uguggaugauaaaa

SEQ ID NO: 1972836 - RNA, 15 nt, Human
ugugcuguguuugcu

SEQ ID NO: 1972837 - RNA, 19 nt, Human
uguggauuuaacagaaaug

SEQ ID NO: 1972838 - RNA, 20 nt, Human
uguggauuuaacagaaaugu

SEQ ID NO: 1972839 - RNA, 22 nt, Human
uguggauuuaacagaaauguac

SEQ ID NO: 1972840 - RNA, 23 nt, Human
agugagcugguuuuuagcggaga

SEQ ID NO: 1972841 - RNA, 14 nt, Human
ugugauucaaugcc

SEQ ID NO: 1972842 - RNA, 16 nt, Human
ugugauucaaugccuc

SEQ ID NO: 1972843 - RNA, 20 nt, Human
ugugcucaggagcccuggga

SEQ ID NO: 1972844 - RNA, 17 nt, Human
ugugccuaauguguuug

SEQ ID NO: 1972845 - RNA, 18 nt, Human
ugugccuaauguguuuga

SEQ ID NO: 1972846 - RNA, 14 nt, Human
ugugccgagcccuu

SEQ ID NO: 1972847 - RNA, 23 nt, Human
ugugccuaaauaaguuauaaaga

SEQ ID NO: 1972848 - RNA, 14 nt, Human
ugugccuaaugugu

SEQ ID NO: 1972849 - RNA, 15 nt, Human
ugugccuaauguguu

SEQ ID NO: 1972850 - RNA, 12 nt, Human
ugugcugcccug

SEQ ID NO: 1972851 - RNA, 13 nt, Human
ugugcugcagugc

SEQ ID NO: 1972852 - RNA, 19 nt, Human
ugugcugagucugaaggcu

SEQ ID NO: 1972853 - RNA, 18 nt, Human
ugugcugagucugaaggc

SEQ ID NO: 1972854 - RNA, 21 nt, Human
ugugcucaggagcccugggag

SEQ ID NO: 1972855 - RNA, 16 nt, Human
ugugcucaucagaaac

SEQ ID NO: 1972856 - RNA, 19 nt, Human
ugugcucuccaagcccagu

SEQ ID NO: 1972857 - RNA, 14 nt, Human
ugugcucuccaagc

SEQ ID NO: 1972858 - RNA, 22 nt, Human
agugaacaaauuuacagagaca

SEQ ID NO: 1972859 - RNA, 23 nt, Human
agugaacaaauuuacagagacag

SEQ ID NO: 1972860 - RNA, 16 nt, Human
agugaacuugggccac

SEQ ID NO: 1972861 - RNA, 20 nt, Human
agugaacauaauucuuauua

SEQ ID NO: 1972862 - RNA, 21 nt, Human
agugacugauggcuaauguac

SEQ ID NO: 1972863 - RNA, 21 nt, Human
agugaacaaauuuacagagac

SEQ ID NO: 1972864 - RNA, 18 nt, Human
agucuuucacauuuaaau

SEQ ID NO: 1972865 - RNA, 16 nt, Human
agucuuucacauuuaa

SEQ ID NO: 1972866 - RNA, 14 nt, Human
agugagcacuaagg

SEQ ID NO: 1972867 - RNA, 22 nt, Human
agugagcacuaaggugugcucu

SEQ ID NO: 1972868 - RNA, 16 nt, Human
agugagaaaaugaaca

SEQ ID NO: 1972869 - RNA, 17 nt, Human
agugagaggggaggcca

SEQ ID NO: 1972870 - RNA, 20 nt, Human
agugacuuuucaaguauuua

SEQ ID NO: 1972871 - RNA, 12 nt, Human
agugagcugguu

SEQ ID NO: 1972872 - RNA, 19 nt, Human
agugagaggggaggccaag

SEQ ID NO: 1972873 - RNA, 19 nt, Human
ugugaugagaggaaaucac

SEQ ID NO: 1972874 - RNA, 22 nt, Human
ugugaugaugaaaugaggucag

SEQ ID NO: 1972875 - RNA, 22 nt, Human
ugugagaaaaccccuucccauu

SEQ ID NO: 1972876 - RNA, 11 nt, Human
ugugaggaagc

SEQ ID NO: 1972877 - RNA, 16 nt, Human
ugugagcugcugccau

SEQ ID NO: 1972878 - RNA, 12 nt, Human
ugugagcugcac

SEQ ID NO: 1972879 - RNA, 15 nt, Human
ugugagcugcaccag

SEQ ID NO: 1972880 - RNA, 20 nt, Human
ugugagcugcaccagguaga

SEQ ID NO: 1972881 - RNA, 16 nt, Human
ugugacugaucucucg

SEQ ID NO: 1972882 - RNA, 15 nt, Human
ugucuccuacugagg

SEQ ID NO: 1972883 - RNA, 18 nt, Human
ugugacuucagcucuguu

SEQ ID NO: 1972884 - RNA, 19 nt, Human
ugugacuucagcucuguuu

SEQ ID NO: 1972885 - RNA, 18 nt, Human
ugugacuuccuuggaaau

SEQ ID NO: 1972886 - RNA, 13 nt, Human
ugugacuuugaaa

SEQ ID NO: 1972887 - RNA, 14 nt, Human
ugugacuuugaaaa

SEQ ID NO: 1972888 - RNA, 20 nt, Human
ugugacuuugaaaauauaua

SEQ ID NO: 1972889 - RNA, 16 nt, Human
ugucuccuacugagga

SEQ ID NO: 1972890 - RNA, 20 nt, Human
ugugagaaaaccccuuccca

SEQ ID NO: 1972891 - RNA, 14 nt, Human
ugugacuuuugcuu

SEQ ID NO: 1972892 - RNA, 16 nt, Human
ugugacuuuugcuuua

SEQ ID NO: 1972893 - RNA, 17 nt, Human
ugugacuuuugcuuuaa

SEQ ID NO: 1972894 - RNA, 23 nt, Human
ugugacuuuugcuuuaauuccau

SEQ ID NO: 1972895 - RNA, 17 nt, Human
agucucuugauucauaa

SEQ ID NO: 1972896 - RNA, 16 nt, Human
agucucuugauucaua

SEQ ID NO: 1972897 - RNA, 21 nt, Human
agucucuucuccacuggaugg

SEQ ID NO: 1972898 - RNA, 19 nt, Human
agucucgcucuguugccca

SEQ ID NO: 1972899 - RNA, 21 nt, Human
agucucgcucuguugcccagg

SEQ ID NO: 1972900 - RNA, 23 nt, Human
agucucgcucuguugcccaggcu

SEQ ID NO: 1972901 - RNA, 19 nt, Human
agucucuucuccacuggau

SEQ ID NO: 1972902 - RNA, 23 nt, Human
agucuuagauguauauauuuccu

SEQ ID NO: 1972903 - RNA, 16 nt, Human
agucuuagauguauau

SEQ ID NO: 1972904 - RNA, 14 nt, Human
agucuuagauguau

SEQ ID NO: 1972905 - RNA, 13 nt, Human
agucuuagaugua

SEQ ID NO: 1972906 - RNA, 12 nt, Human
agucugaaggcu

SEQ ID NO: 1972907 - RNA, 16 nt, Human
agucucuuuuuuacaa

SEQ ID NO: 1972908 - RNA, 17 nt, Human
agucucuuuuuuacaaa

SEQ ID NO: 1972909 - RNA, 18 nt, Human
agucucuuuuuuacaaag

SEQ ID NO: 1972910 - RNA, 19 nt, Human
agucucuuuuuuacaaagg

SEQ ID NO: 1972911 - RNA, 20 nt, Human
agucucuuuuuuacaaaggc

SEQ ID NO: 1972912 - RNA, 21 nt, Human
agucucuuuuuuacaaaggcu

SEQ ID NO: 1972913 - RNA, 22 nt, Human
agucucuuuuuuacaaaggcug

SEQ ID NO: 1972914 - RNA, 9 nt, Human
aguguguaa

SEQ ID NO: 1972915 - RNA, 22 nt, Human
agugugguuaugaacuuuauag

SEQ ID NO: 1972916 - RNA, 13 nt, Human
agugugguuucuu

SEQ ID NO: 1972917 - RNA, 14 nt, Human
agugugguuucuuu

SEQ ID NO: 1972918 - RNA, 21 nt, Human
agugugguuucuuuuugaauc

SEQ ID NO: 1972919 - RNA, 22 nt, Human
agugugguguuuccuggcacug

SEQ ID NO: 1972920 - RNA, 22 nt, Human
agugugguuucuuuuugaaucu

SEQ ID NO: 1972921 - RNA, 17 nt, Human
uguuaugacuccagaau

SEQ ID NO: 1972922 - RNA, 13 nt, Human
uguuaugacucca

SEQ ID NO: 1972923 - RNA, 21 nt, Human
uguucgauuacgucaucaaaa

SEQ ID NO: 1972924 - RNA, 19 nt, Human
uguuccacaaguuaaauaa

SEQ ID NO: 1972925 - RNA, 21 nt, Human
uguuccugccuccuugauauu

SEQ ID NO: 1972926 - RNA, 17 nt, Human
aguguggaaauuaagaa

SEQ ID NO: 1972927 - RNA, 19 nt, Human
aguguggaaauuaagaaga

SEQ ID NO: 1972928 - RNA, 21 nt, Human
agugugccugaagucccagau

SEQ ID NO: 1972929 - RNA, 18 nt, Human
aguguggccucuucugag

SEQ ID NO: 1972930 - RNA, 15 nt, Human
agugugggggguccu

SEQ ID NO: 1972931 - RNA, 16 nt, Human
aguguggcaguuuggc

SEQ ID NO: 1972932 - RNA, 17 nt, Human
aguguggcaguuuggca

SEQ ID NO: 1972933 - RNA, 20 nt, Human
agugugccugaagucccaga

SEQ ID NO: 1972934 - RNA, 20 nt, Human
agugugacugaucucucgug

SEQ ID NO: 1972935 - RNA, 15 nt, Human
uguucuaagaaguga

SEQ ID NO: 1972936 - RNA, 22 nt, Human
uguucuaaauaucccuuggaca

SEQ ID NO: 1972937 - RNA, 13 nt, Human
uguugcacugaag

SEQ ID NO: 1972938 - RNA, 15 nt, Human
uguugcacugaaguu

SEQ ID NO: 1972939 - RNA, 15 nt, Human
uguugcauagaauaa

SEQ ID NO: 1972940 - RNA, 19 nt, Human
uguugcacugaaguuugau

SEQ ID NO: 1972941 - RNA, 22 nt, Human
uguugcacugaaguuugauaaa

SEQ ID NO: 1972942 - RNA, 23 nt, Human
uguugcacugaaguuugauaaau

SEQ ID NO: 1972943 - RNA, 18 nt, Human
uguugcauagguuagaua

SEQ ID NO: 1972944 - RNA, 21 nt, Human
uguugccaaaaugguggccug

SEQ ID NO: 1972945 - RNA, 16 nt, Human
uguugccaagagcccg

SEQ ID NO: 1972946 - RNA, 16 nt, Human
uguugccacuuuccaa

SEQ ID NO: 1972947 - RNA, 18 nt, Human
uguugccacuuuccaagu

SEQ ID NO: 1972948 - RNA, 23 nt, Human
uguugcccaggcuggcgugcagu

SEQ ID NO: 1972949 - RNA, 20 nt, Human
uguugcccaggcuggcgugc

SEQ ID NO: 1972950 - RNA, 19 nt, Human
aguguguggucaacauuuc

SEQ ID NO: 1972951 - RNA, 23 nt, Human
uguugccuauaagccaaaauuaa

SEQ ID NO: 1972952 - RNA, 17 nt, Human
uguugccuauaagccaa

SEQ ID NO: 1972953 - RNA, 18 nt, Human
uguugccuauaagccaaa

SEQ ID NO: 1972954 - RNA, 22 nt, Human
uguugccuauaagccaaaauua

SEQ ID NO: 1972955 - RNA, 19 nt, Human
aguguuguggauuuaacag

SEQ ID NO: 1972956 - RNA, 20 nt, Human
aguguuguggauuuaacaga

SEQ ID NO: 1972957 - RNA, 22 nt, Human
aguguugggguuugguuuuguu

SEQ ID NO: 1972958 - RNA, 13 nt, Human
aguuacucagaau

SEQ ID NO: 1972959 - RNA, 23 nt, Human
aguuacuaucaugucaaacguga

SEQ ID NO: 1972960 - RNA, 14 nt, Human
aguuagagaaucug

SEQ ID NO: 1972961 - RNA, 16 nt, Human
aguuagccuuuaucua

SEQ ID NO: 1972962 - RNA, 23 nt, Human
aguuagccuuuaucuaccaacuu

SEQ ID NO: 1972963 - RNA, 15 nt, Human
aguguucuguuacaa

SEQ ID NO: 1972964 - RNA, 16 nt, Human
aguguucuguuacaaa

SEQ ID NO: 1972965 - RNA, 17 nt, Human
aguguucuguuacaaaa

SEQ ID NO: 1972966 - RNA, 18 nt, Human
aguguucuguuacaaaau

SEQ ID NO: 1972967 - RNA, 20 nt, Human
aguguucuguuacaaaaugu

SEQ ID NO: 1972968 - RNA, 21 nt, Human
aguguucuguuacaaaaugua

SEQ ID NO: 1972969 - RNA, 22 nt, Human
aguguucuguuacaaaauguaa

SEQ ID NO: 1972970 - RNA, 23 nt, Human
aguguucuguuacaaaauguaac

SEQ ID NO: 1972971 - RNA, 16 nt, Human
aguguuguggauuuaa

SEQ ID NO: 1972972 - RNA, 16 nt, Human
aguguucuuucucuuu

SEQ ID NO: 1972973 - RNA, 21 nt, Human
aguguucauaaauaaaguuug

SEQ ID NO: 1972974 - RNA, 18 nt, Human
aguguguguuuuucauaa

SEQ ID NO: 1972975 - RNA, 21 nt, Human
aguguuccgugguuaaacucg

SEQ ID NO: 1972976 - RNA, 19 nt, Human
aguggacccugaaaugugu

SEQ ID NO: 1972977 - RNA, 21 nt, Human
aguggacccugaaaugugugu

SEQ ID NO: 1972978 - RNA, 21 nt, Human
aguggacuguucccugaggug

SEQ ID NO: 1972979 - RNA, 20 nt, Human
aguggacuggaggagcuggg

SEQ ID NO: 1972980 - RNA, 22 nt, Human
aguggcaaagcuguucuuccug

SEQ ID NO: 1972981 - RNA, 13 nt, Human
aguggcaccuguc

SEQ ID NO: 1972982 - RNA, 16 nt, Human
aguggcaccugucugc

SEQ ID NO: 1972983 - RNA, 17 nt, Human
aguggcaccugucugcu

SEQ ID NO: 1972984 - RNA, 21 nt, Human
aguggcaccugucugcuccag

SEQ ID NO: 1972985 - RNA, 22 nt, Human
aguggcaccugucugcuccagc

SEQ ID NO: 1972986 - RNA, 17 nt, Human
aguggauggaaggggcu

SEQ ID NO: 1972987 - RNA, 16 nt, Human
agugggguagguuggg

SEQ ID NO: 1972988 - RNA, 19 nt, Human
aguggggggaacgcccacu

SEQ ID NO: 1972989 - RNA, 22 nt, Human
aguggggggaacgcccacuucc

SEQ ID NO: 1972990 - RNA, 17 nt, Human
aguggggggaacgccca

SEQ ID NO: 1972991 - RNA, 18 nt, Human
aguggggggaacgcccac

SEQ ID NO: 1972992 - RNA, 16 nt, Human
aguggggaaugaagau

SEQ ID NO: 1972993 - RNA, 15 nt, Human
aguggggacagagca

SEQ ID NO: 1972994 - RNA, 14 nt, Human
aguggggaggggcu

SEQ ID NO: 1972995 - RNA, 22 nt, Human
agugggcccaaugcacuuuguu

SEQ ID NO: 1972996 - RNA, 19 nt, Human
uguuacauaagauaaaugu

SEQ ID NO: 1972997 - RNA, 18 nt, Human
uguuacacuuuuuggaag

SEQ ID NO: 1972998 - RNA, 15 nt, Human
uguuacaauguaacu

SEQ ID NO: 1972999 - RNA, 22 nt, Human
uguuaauaaagugcacugccac

SEQ ID NO: 1973000 - RNA, 18 nt, Human
uguuacaaauuguagaag

SEQ ID NO: 1973001 - RNA, 17 nt, Human
uguuacaaauuguagaa

SEQ ID NO: 1973002 - RNA, 13 nt, Human
uguuaauauuuua

SEQ ID NO: 1973003 - RNA, 22 nt, Human
uguuaaguugauggugaugaaa

SEQ ID NO: 1973004 - RNA, 13 nt, Human
uguuaagcaucua

SEQ ID NO: 1973005 - RNA, 23 nt, Human
uguguuaucacccagaagaaaau

SEQ ID NO: 1973006 - RNA, 22 nt, Human
uguguuaucacccagaagaaaa

SEQ ID NO: 1973007 - RNA, 13 nt, Human
uguguuaauuuaa

SEQ ID NO: 1973008 - RNA, 14 nt, Human
uguguuaauuuaag

SEQ ID NO: 1973009 - RNA, 18 nt, Human
uguguuaauuuaaguuuu

SEQ ID NO: 1973010 - RNA, 16 nt, Human
uguuaacugagugccu

SEQ ID NO: 1973011 - RNA, 22 nt, Human
uguuaacugagugccuuuuggu

SEQ ID NO: 1973012 - RNA, 21 nt, Human
agugccccgucuacagcuccc

SEQ ID NO: 1973013 - RNA, 23 nt, Human
agugccccgucuacagcuccccc

SEQ ID NO: 1973014 - RNA, 16 nt, Human
agugcccuccaggaua

SEQ ID NO: 1973015 - RNA, 22 nt, Human
uguggucaacauuucucauguu

SEQ ID NO: 1973016 - RNA, 16 nt, Human
ugugguuucuuuuuga

SEQ ID NO: 1973017 - RNA, 12 nt, Human
ugugguuucuuu

SEQ ID NO: 1973018 - RNA, 15 nt, Human
uguguaaauuauuga

SEQ ID NO: 1973019 - RNA, 13 nt, Human
ugugucaguuuau

SEQ ID NO: 1973020 - RNA, 15 nt, Human
ugugucaguuuaugu

SEQ ID NO: 1973021 - RNA, 22 nt, Human
ugugucaucuagcauuagguau

SEQ ID NO: 1973022 - RNA, 18 nt, Human
ugugucaguuuauguuuu

SEQ ID NO: 1973023 - RNA, 19 nt, Human
ugugucaguuuauguuuug

SEQ ID NO: 1973024 - RNA, 20 nt, Human
ugugucaguuuauguuuugg

SEQ ID NO: 1973025 - RNA, 16 nt, Human
uguguccaaaacugcc

SEQ ID NO: 1973026 - RNA, 15 nt, Human
uguguccaccguugu

SEQ ID NO: 1973027 - RNA, 15 nt, Human
uguguccggcccagu

SEQ ID NO: 1973028 - RNA, 14 nt, Human
uguguccucaggga

SEQ ID NO: 1973029 - RNA, 18 nt, Human
uguguguuguguguggga

SEQ ID NO: 1973030 - RNA, 11 nt, Human
uguguguuuau

SEQ ID NO: 1973031 - RNA, 12 nt, Human
uguguguugcuu

SEQ ID NO: 1973032 - RNA, 18 nt, Human
uguguguugcuuauguug

SEQ ID NO: 1973033 - RNA, 20 nt, Human
ugugucuugcaauggcagcc

SEQ ID NO: 1973034 - RNA, 22 nt, Human
ugugucucuugguccugcugca

SEQ ID NO: 1973035 - RNA, 16 nt, Human
ugugucugccacauua

SEQ ID NO: 1973036 - RNA, 16 nt, Human
aguaauugcauuugcu

SEQ ID NO: 1973037 - RNA, 17 nt, Human
aguaauugcauuugcuu

SEQ ID NO: 1973038 - RNA, 18 nt, Human
aguaauugcauuugcuuu

SEQ ID NO: 1973039 - RNA, 22 nt, Human
aguaauugcauuugcuuuugua

SEQ ID NO: 1973040 - RNA, 23 nt, Human
aguacacuguuucaaacuuuacu

SEQ ID NO: 1973041 - RNA, 21 nt, Human
aguacacuguuucaaacuuua

SEQ ID NO: 1973042 - RNA, 18 nt, Human
aguaauuguuccagagac

SEQ ID NO: 1973043 - RNA, 23 nt, Human
aguaauugguuaucaugggaaag

SEQ ID NO: 1973044 - RNA, 16 nt, Human
aguaauuguuccagag

SEQ ID NO: 1973045 - RNA, 23 nt, Human
aguaaaaacaaagaaauuaugug

SEQ ID NO: 1973046 - RNA, 16 nt, Human
aguaaaaacaaagaaa

SEQ ID NO: 1973047 - RNA, 21 nt, Human
uguacauggaauaacauguaa

SEQ ID NO: 1973048 - RNA, 20 nt, Human
uguacauguauuaaauuaca

SEQ ID NO: 1973049 - RNA, 21 nt, Human
uguacauguauuaaauuacau

SEQ ID NO: 1973050 - RNA, 14 nt, Human
uguacaugggacua

SEQ ID NO: 1973051 - RNA, 19 nt, Human
uguacaugggacuaugcuu

SEQ ID NO: 1973052 - RNA, 20 nt, Human
uguacaugggacuaugcuuu

SEQ ID NO: 1973053 - RNA, 23 nt, Human
uguacaugggacuaugcuuuucu

SEQ ID NO: 1973054 - RNA, 13 nt, Human
uguacauguauua

SEQ ID NO: 1973055 - RNA, 14 nt, Human
uguacauguauuaa

SEQ ID NO: 1973056 - RNA, 18 nt, Human
aguaauacaggauuauuu

SEQ ID NO: 1973057 - RNA, 14 nt, Human
aguaauaaagacuc

SEQ ID NO: 1973058 - RNA, 15 nt, Human
aguaagucucaaggu

SEQ ID NO: 1973059 - RNA, 16 nt, Human
aguaagucucaaggua

SEQ ID NO: 1973060 - RNA, 23 nt, Human
aguaagucuugccuauauuuucc

SEQ ID NO: 1973061 - RNA, 19 nt, Human
aguaaaaagaaaacaaaac

SEQ ID NO: 1973062 - RNA, 19 nt, Human
uguauaguuauguaaauaa

SEQ ID NO: 1973063 - RNA, 13 nt, Human
uguauaguuaugu

SEQ ID NO: 1973064 - RNA, 14 nt, Human
uguauaguuaugua

SEQ ID NO: 1973065 - RNA, 15 nt, Human
uguauaguuauguaa

SEQ ID NO: 1973066 - RNA, 16 nt, Human
uguauaguuauguaaa

SEQ ID NO: 1973067 - RNA, 17 nt, Human
uguauaguuauguaaau

SEQ ID NO: 1973068 - RNA, 18 nt, Human
uguauaguuauguaaaua

SEQ ID NO: 1973069 - RNA, 15 nt, Human
uguauaguauuugaa

SEQ ID NO: 1973070 - RNA, 16 nt, Human
uguauaguauuugaaa

SEQ ID NO: 1973071 - RNA, 17 nt, Human
uguauaguauuugaaaa

SEQ ID NO: 1973072 - RNA, 19 nt, Human
uguauaguauuugaaaaca

SEQ ID NO: 1973073 - RNA, 20 nt, Human
uguauaguauuugaaaacag

SEQ ID NO: 1973074 - RNA, 21 nt, Human
uguauaguauuugaaaacaga

SEQ ID NO: 1973075 - RNA, 22 nt, Human
uguauauauuuccuauauuguu

SEQ ID NO: 1973076 - RNA, 18 nt, Human
uguauauauuuccuauau

SEQ ID NO: 1973077 - RNA, 20 nt, Human
uguauauauaccugcgcuug

SEQ ID NO: 1973078 - RNA, 17 nt, Human
uguaggguuauaauaau

SEQ ID NO: 1973079 - RNA, 16 nt, Human
uguaggguuauaauaa

SEQ ID NO: 1973080 - RNA, 13 nt, Human
aguagcaggcccg

SEQ ID NO: 1973081 - RNA, 22 nt, Human
aguagcacaggcugagugcagg

SEQ ID NO: 1973082 - RNA, 16 nt, Human
aguagcacaggcugag

SEQ ID NO: 1973083 - RNA, 21 nt, Human
aguagcacaggcugagugcag

SEQ ID NO: 1973084 - RNA, 14 nt, Human
aguagcacaggcug

SEQ ID NO: 1973085 - RNA, 15 nt, Human
aguagcacaggcuga

SEQ ID NO: 1973086 - RNA, 20 nt, Human
aguagcaaaugagacagcag

SEQ ID NO: 1973087 - RNA, 16 nt, Human
aguaccagccccaccc

SEQ ID NO: 1973088 - RNA, 13 nt, Human
aguacauuuuuug

SEQ ID NO: 1973089 - RNA, 15 nt, Human
aguacauuuuuugaa

SEQ ID NO: 1973090 - RNA, 18 nt, Human
aguacauuuuuugaaaug

SEQ ID NO: 1973091 - RNA, 20 nt, Human
aguacauuuuuugaaaugcu

SEQ ID NO: 1973092 - RNA, 21 nt, Human
aguacauuuuuugaaaugcug

SEQ ID NO: 1973093 - RNA, 22 nt, Human
aguacauuuuuugaaaugcuga

SEQ ID NO: 1973094 - RNA, 12 nt, Human
aggugggaggau

SEQ ID NO: 1973095 - RNA, 13 nt, Human
ugggcugcccugg

SEQ ID NO: 1973096 - RNA, 14 nt, Human
ugggcugcccuggu

SEQ ID NO: 1973097 - RNA, 15 nt, Human
ugggcugcccuggug

SEQ ID NO: 1973098 - RNA, 16 nt, Human
ugggcugcccuggugc

SEQ ID NO: 1973099 - RNA, 15 nt, Human
ugggcucugcugagu

SEQ ID NO: 1973100 - RNA, 12 nt, Human
ugggcucugcug

SEQ ID NO: 1973101 - RNA, 13 nt, Human
ugggcucugcuga

SEQ ID NO: 1973102 - RNA, 16 nt, Human
aggugucccugcacuu

SEQ ID NO: 1973103 - RNA, 20 nt, Human
aggugucccugcacuugcag

SEQ ID NO: 1973104 - RNA, 21 nt, Human
aggugugagucaccaagccca

SEQ ID NO: 1973105 - RNA, 22 nt, Human
aggugugagucaccaagcccag

SEQ ID NO: 1973106 - RNA, 13 nt, Human
agguucuuugugu

SEQ ID NO: 1973107 - RNA, 20 nt, Human
agguugaagaccuaaccagg

SEQ ID NO: 1973108 - RNA, 22 nt, Human
agguugaagaccuaaccagggc

SEQ ID NO: 1973109 - RNA, 23 nt, Human
agguugaagaccuaaccagggcc

SEQ ID NO: 1973110 - RNA, 14 nt, Human
aggugugcaagaga

SEQ ID NO: 1973111 - RNA, 12 nt, Human
aggugugcucug

SEQ ID NO: 1973112 - RNA, 14 nt, Human
agguugcagugagc

SEQ ID NO: 1973113 - RNA, 14 nt, Human
agguugaagcacca

SEQ ID NO: 1973114 - RNA, 16 nt, Human
uguacaugaaaacaca

SEQ ID NO: 1973115 - RNA, 14 nt, Human
uguacaugaaaaca

SEQ ID NO: 1973116 - RNA, 20 nt, Human
uguaauuuuuuuaucgucac

SEQ ID NO: 1973117 - RNA, 19 nt, Human
uguaauuuuucuguauaga

SEQ ID NO: 1973118 - RNA, 20 nt, Human
uguaauuuuucuguauagac

SEQ ID NO: 1973119 - RNA, 15 nt, Human
uguaauuuuguguaa

SEQ ID NO: 1973120 - RNA, 16 nt, Human
uguaauuguuguuugu

SEQ ID NO: 1973121 - RNA, 16 nt, Human
uguaauuuuguguaag

SEQ ID NO: 1973122 - RNA, 20 nt, Human
uguaauuuuguguaagaaau

SEQ ID NO: 1973123 - RNA, 15 nt, Human
uguaauuuuucugua

SEQ ID NO: 1973124 - RNA, 16 nt, Human
uguaauuuuucuguau

SEQ ID NO: 1973125 - RNA, 17 nt, Human
uguaauuuuucuguaua

SEQ ID NO: 1973126 - RNA, 19 nt, Human
uguacauaaugcgugcaua

SEQ ID NO: 1973127 - RNA, 20 nt, Human
uguacauaaugcgugcauac

SEQ ID NO: 1973128 - RNA, 22 nt, Human
uguaaggccaaguacacugaga

SEQ ID NO: 1973129 - RNA, 14 nt, Human
agguuucuauuuuc

SEQ ID NO: 1973130 - RNA, 20 nt, Human
agguuggcaaaaaggcagga

SEQ ID NO: 1973131 - RNA, 18 nt, Human
uguaauuaaguacuaugu

SEQ ID NO: 1973132 - RNA, 21 nt, Human
uguaauuaaguacuauguauc

SEQ ID NO: 1973133 - RNA, 19 nt, Human
uguaauuaaguacuaugua

SEQ ID NO: 1973134 - RNA, 16 nt, Human
uguaauuauuugaaug

SEQ ID NO: 1973135 - RNA, 13 nt, Human
uguaauugauugu

SEQ ID NO: 1973136 - RNA, 15 nt, Human
uguccaaaacugccu

SEQ ID NO: 1973137 - RNA, 20 nt, Human
ugucagcaguugcugguaaa

SEQ ID NO: 1973138 - RNA, 16 nt, Human
uguccaaaacugccuc

SEQ ID NO: 1973139 - RNA, 15 nt, Human
uguccaagaagccca

SEQ ID NO: 1973140 - RNA, 14 nt, Human
uguccaagaagccc

SEQ ID NO: 1973141 - RNA, 23 nt, Human
uguccaacugagaaguaccuuau

SEQ ID NO: 1973142 - RNA, 17 nt, Human
ugucagguggggcagcu

SEQ ID NO: 1973143 - RNA, 18 nt, Human
ugucagguggggcagcuu

SEQ ID NO: 1973144 - RNA, 20 nt, Human
ugucagguggggcagcuuga

SEQ ID NO: 1973145 - RNA, 20 nt, Human
ugucauuugagcagggcuca

SEQ ID NO: 1973146 - RNA, 21 nt, Human
ugucauuugagcagggcucag

SEQ ID NO: 1973147 - RNA, 22 nt, Human
ugucauuugagcagggcucagc

SEQ ID NO: 1973148 - RNA, 22 nt, Human
uguccaagaagcccaggaaagg

SEQ ID NO: 1973149 - RNA, 18 nt, Human
uguccaagaagcccagga

SEQ ID NO: 1973150 - RNA, 17 nt, Human
uguccaagaagcccagg

SEQ ID NO: 1973151 - RNA, 16 nt, Human
uguccaagaagcccag

SEQ ID NO: 1973152 - RNA, 20 nt, Human
uguccagagcugcuuccccg

SEQ ID NO: 1973153 - RNA, 20 nt, Human
ugucccugcacuugcagacu

SEQ ID NO: 1973154 - RNA, 22 nt, Human
ugucccugcacuugcagacucu

SEQ ID NO: 1973155 - RNA, 23 nt, Human
ugucccugcacuugcagacucua

SEQ ID NO: 1973156 - RNA, 16 nt, Human
aguauuaauucucuuu

SEQ ID NO: 1973157 - RNA, 17 nt, Human
aguauacucuuaggcca

SEQ ID NO: 1973158 - RNA, 14 nt, Human
aguauguuuuacuu

SEQ ID NO: 1973159 - RNA, 12 nt, Human
uguauauuugau

SEQ ID NO: 1973160 - RNA, 14 nt, Human
uguauauuugauuu

SEQ ID NO: 1973161 - RNA, 16 nt, Human
uguauauuugauuuau

SEQ ID NO: 1973162 - RNA, 17 nt, Human
uguauauuugauuuauu

SEQ ID NO: 1973163 - RNA, 22 nt, Human
uguauauuugauuuauuaacuu

SEQ ID NO: 1973164 - RNA, 19 nt, Human
uguauauuugauuuauuaa

SEQ ID NO: 1973165 - RNA, 21 nt, Human
uguauauugguuuuaugauga

SEQ ID NO: 1973166 - RNA, 18 nt, Human
uguauauucuauuuuaca

SEQ ID NO: 1973167 - RNA, 13 nt, Human
uguauauugguuu

SEQ ID NO: 1973168 - RNA, 14 nt, Human
uguauauugguuuu

SEQ ID NO: 1973169 - RNA, 20 nt, Human
uguauauugguuuuaugaug

SEQ ID NO: 1973170 - RNA, 17 nt, Human
agucaccccggccaccu

SEQ ID NO: 1973171 - RNA, 15 nt, Human
agucaccaagcccag

SEQ ID NO: 1973172 - RNA, 21 nt, Human
aguauuuuccuguugucaaga

SEQ ID NO: 1973173 - RNA, 21 nt, Human
aguauuuuaguggacccugaa

SEQ ID NO: 1973174 - RNA, 12 nt, Human
aguauuuuagug

SEQ ID NO: 1973175 - RNA, 14 nt, Human
aguauuugugggga

SEQ ID NO: 1973176 - RNA, 19 nt, Human
aguauucuuauuuaaugaa

SEQ ID NO: 1973177 - RNA, 16 nt, Human
aguauucuaauaagcu

SEQ ID NO: 1973178 - RNA, 17 nt, Human
aguauucuaauaagcua

SEQ ID NO: 1973179 - RNA, 21 nt, Human
aguauucuaauaagcuaguug

SEQ ID NO: 1973180 - RNA, 23 nt, Human
aguauucuaauaagcuaguugaa

SEQ ID NO: 1973181 - RNA, 15 nt, Human
aguauucucauucuu

SEQ ID NO: 1973182 - RNA, 16 nt, Human
aguauucucauucuuc

SEQ ID NO: 1973183 - RNA, 16 nt, Human
aguauucucuuuucaa

SEQ ID NO: 1973184 - RNA, 15 nt, Human
agucuauuuacggaa

SEQ ID NO: 1973185 - RNA, 20 nt, Human
agucuauuuacggaacucaa

SEQ ID NO: 1973186 - RNA, 23 nt, Human
agucucacuguugcccaggcugg

SEQ ID NO: 1973187 - RNA, 14 nt, Human
agucuaucauuguu

SEQ ID NO: 1973188 - RNA, 20 nt, Human
agucuaaauuuauuauuuaa

SEQ ID NO: 1973189 - RNA, 23 nt, Human
agucuaacaacugcccaguuucc

SEQ ID NO: 1973190 - RNA, 12 nt, Human
aguccuccagaa

SEQ ID NO: 1973191 - RNA, 14 nt, Human
aguccuccagaacu

SEQ ID NO: 1973192 - RNA, 19 nt, Human
aguccuccagaacucuucc

SEQ ID NO: 1973193 - RNA, 20 nt, Human
aguccuccagaacucuuccu

SEQ ID NO: 1973194 - RNA, 21 nt, Human
aguccuccagaacucuuccuc

SEQ ID NO: 1973195 - RNA, 16 nt, Human
agucccccugccccag

SEQ ID NO: 1973196 - RNA, 16 nt, Human
aguccucccaucucac

SEQ ID NO: 1973197 - RNA, 14 nt, Human
aguccucccaucuc

SEQ ID NO: 1973198 - RNA, 21 nt, Human
agucgccuuucagcaggcagc

SEQ ID NO: 1973199 - RNA, 22 nt, Human
agucgccuuucagcaggcagcc

SEQ ID NO: 1973200 - RNA, 22 nt, Human
aguccuccagaacucuuccucc

SEQ ID NO: 1973201 - RNA, 16 nt, Human
agucggcacagccugg

SEQ ID NO: 1973202 - RNA, 18 nt, Human
agucccaccuuggcugca

SEQ ID NO: 1973203 - RNA, 19 nt, Human
agucccaccuuggcugcag

SEQ ID NO: 1973204 - RNA, 12 nt, Human
agucccagcagc

SEQ ID NO: 1973205 - RNA, 14 nt, Human
agucccagcagcca

SEQ ID NO: 1973206 - RNA, 15 nt, Human
agucccagcagccag

SEQ ID NO: 1973207 - RNA, 16 nt, Human
agucccagcagccagc

SEQ ID NO: 1973208 - RNA, 17 nt, Human
agucccaggcugagccu

SEQ ID NO: 1973209 - RNA, 18 nt, Human
agucccaggcugagccuc

SEQ ID NO: 1973210 - RNA, 17 nt, Human
agucccagcagccagcc

SEQ ID NO: 1973211 - RNA, 18 nt, Human
agucccagcagccagcca

SEQ ID NO: 1973212 - RNA, 19 nt, Human
agucccagcagccagccaa

SEQ ID NO: 1973213 - RNA, 19 nt, Human
agucccaggcugagccuca

SEQ ID NO: 1973214 - RNA, 14 nt, Human
aguccccccacucc

SEQ ID NO: 1973215 - RNA, 15 nt, Human
agucccaccuuggcu

SEQ ID NO: 1973216 - RNA, 16 nt, Human
agucccaccuuggcug

SEQ ID NO: 1973217 - RNA, 23 nt, Human
ugucccuuacgugaguccuggca

SEQ ID NO: 1973218 - RNA, 19 nt, Human
ugucccuuacgugaguccu

SEQ ID NO: 1973219 - RNA, 16 nt, Human
ugucccuggcuuccuu

SEQ ID NO: 1973220 - RNA, 17 nt, Human
ugucccuggcuuccuua

SEQ ID NO: 1973221 - RNA, 15 nt, Human
ugucccuggcuuccu

SEQ ID NO: 1973222 - RNA, 14 nt, Human
ugucgccucugcau

SEQ ID NO: 1973223 - RNA, 13 nt, Human
ugucgccucugca

SEQ ID NO: 1973224 - RNA, 17 nt, Human
agucagaaacuguuucu

SEQ ID NO: 1973225 - RNA, 16 nt, Human
agucagccucgcaggc

SEQ ID NO: 1973226 - RNA, 23 nt, Human
agucagccucgcaggccucccug

SEQ ID NO: 1973227 - RNA, 14 nt, Human
ugggcauucucucu

SEQ ID NO: 1973228 - RNA, 17 nt, Human
agggagggagggcucca

SEQ ID NO: 1973229 - RNA, 19 nt, Human
agggagggcuccagacaca

SEQ ID NO: 1973230 - RNA, 17 nt, Human
agggagggcuccagaca

SEQ ID NO: 1973231 - RNA, 12 nt, Human
agggagggcucc

SEQ ID NO: 1973232 - RNA, 13 nt, Human
agggagggccugg

SEQ ID NO: 1973233 - RNA, 15 nt, Human
agggagggccugggc

SEQ ID NO: 1973234 - RNA, 22 nt, Human
agggagggcuccagacacaugu

SEQ ID NO: 1973235 - RNA, 19 nt, Human
agggaggugugaggcagga

SEQ ID NO: 1973236 - RNA, 20 nt, Human
agggaguccgaaagggacuu

SEQ ID NO: 1973237 - RNA, 23 nt, Human
agggaguccgaaagggacuugga

SEQ ID NO: 1973238 - RNA, 15 nt, Human
agggaguauucuaau

SEQ ID NO: 1973239 - RNA, 14 nt, Human
agggagucagcugu

SEQ ID NO: 1973240 - RNA, 20 nt, Human
agggagugaguugauagcac

SEQ ID NO: 1973241 - RNA, 20 nt, Human
agggagugacagaggcagcc

SEQ ID NO: 1973242 - RNA, 12 nt, Human
agggcccagaga

SEQ ID NO: 1973243 - RNA, 13 nt, Human
agggcccagagag

SEQ ID NO: 1973244 - RNA, 17 nt, Human
agggcauggccaggugg

SEQ ID NO: 1973245 - RNA, 23 nt, Human
agggcauuguaucugucuuucca

SEQ ID NO: 1973246 - RNA, 14 nt, Human
agggccaaaagcuu

SEQ ID NO: 1973247 - RNA, 18 nt, Human
agggccaaaagcuucccu

SEQ ID NO: 1973248 - RNA, 19 nt, Human
agggccaaaagcuucccuc

SEQ ID NO: 1973249 - RNA, 21 nt, Human
agggccaaaagcuucccuccc

SEQ ID NO: 1973250 - RNA, 17 nt, Human
agggcacugguggcccg

SEQ ID NO: 1973251 - RNA, 16 nt, Human
agggcagugcaaggag

SEQ ID NO: 1973252 - RNA, 19 nt, Human
agggcagugcaaggaggga

SEQ ID NO: 1973253 - RNA, 20 nt, Human
agggcuccagacacaugucc

SEQ ID NO: 1973254 - RNA, 14 nt, Human
agggcccagagagg

SEQ ID NO: 1973255 - RNA, 18 nt, Human
agggcuggggcagccucu

SEQ ID NO: 1973256 - RNA, 19 nt, Human
agggcuguggccucccugc

SEQ ID NO: 1973257 - RNA, 14 nt, Human
ugggcucccuuccc

SEQ ID NO: 1973258 - RNA, 13 nt, Human
ugggcuccccucu

SEQ ID NO: 1973259 - RNA, 14 nt, Human
ugggcuccccucuu

SEQ ID NO: 1973260 - RNA, 16 nt, Human
ugggcuccccucuucc

SEQ ID NO: 1973261 - RNA, 14 nt, Human
ugggcucagcacau

SEQ ID NO: 1973262 - RNA, 10 nt, Human
ugggcucagc

SEQ ID NO: 1973263 - RNA, 15 nt, Human
ugggcucccuuccca

SEQ ID NO: 1973264 - RNA, 21 nt, Human
ugggcucccuucccaccucuc

SEQ ID NO: 1973265 - RNA, 18 nt, Human
agggacuuggaagcuccg

SEQ ID NO: 1973266 - RNA, 19 nt, Human
agggacuuggaagcuccgc

SEQ ID NO: 1973267 - RNA, 15 nt, Human
agggacuuggaagcu

SEQ ID NO: 1973268 - RNA, 12 nt, Human
agggaaagacug

SEQ ID NO: 1973269 - RNA, 16 nt, Human
agggaaagacuggcaa

SEQ ID NO: 1973270 - RNA, 16 nt, Human
agggaaagcauuuaaa

SEQ ID NO: 1973271 - RNA, 20 nt, Human
agggacuuggaagcuccgcu

SEQ ID NO: 1973272 - RNA, 16 nt, Human
agggagcagggaaggc

SEQ ID NO: 1973273 - RNA, 23 nt, Human
agggagcagacuuuuaaagacuu

SEQ ID NO: 1973274 - RNA, 15 nt, Human
ugggagaaaugaaaa

SEQ ID NO: 1973275 - RNA, 14 nt, Human
ugggacuggccucu

SEQ ID NO: 1973276 - RNA, 16 nt, Human
ugggacuggccucugc

SEQ ID NO: 1973277 - RNA, 20 nt, Human
ugggacugggaacagaacuc

SEQ ID NO: 1973278 - RNA, 18 nt, Human
ugggacucaaugcacuga

SEQ ID NO: 1973279 - RNA, 13 nt, Human
ugggacuggccuc

SEQ ID NO: 1973280 - RNA, 19 nt, Human
ugggacuaugcuuuucuca

SEQ ID NO: 1973281 - RNA, 20 nt, Human
ugggacuaugcuuuucucaa

SEQ ID NO: 1973282 - RNA, 16 nt, Human
ugggacuacaggugug

SEQ ID NO: 1973283 - RNA, 18 nt, Human
agggagcaucagugcccu

SEQ ID NO: 1973284 - RNA, 19 nt, Human
agggagcagggaaggccug

SEQ ID NO: 1973285 - RNA, 14 nt, Human
agggagcaguggcu

SEQ ID NO: 1973286 - RNA, 18 nt, Human
ugggacuacaggcaccca

SEQ ID NO: 1973287 - RNA, 21 nt, Human
ugggagaaccaaaaagaggcu

SEQ ID NO: 1973288 - RNA, 16 nt, Human
ugggagaaaugaaaaa

SEQ ID NO: 1973289 - RNA, 21 nt, Human
ugggaggauugcuugagcuca

SEQ ID NO: 1973290 - RNA, 18 nt, Human
ugggaggauugcuugagc

SEQ ID NO: 1973291 - RNA, 22 nt, Human
ugggaggauugcuugagcucag

SEQ ID NO: 1973292 - RNA, 15 nt, Human
ugggaggcuggaguu

SEQ ID NO: 1973293 - RNA, 19 nt, Human
ugggaggcugagaugggag

SEQ ID NO: 1973294 - RNA, 23 nt, Human
ugggaggcucuggagcccacugu

SEQ ID NO: 1973295 - RNA, 17 nt, Human
ugggaggcucuggagcc

SEQ ID NO: 1973296 - RNA, 14 nt, Human
ugggaggcucugga

SEQ ID NO: 1973297 - RNA, 20 nt, Human
ugggcagaaggaagacuuca

SEQ ID NO: 1973298 - RNA, 16 nt, Human
ugggcagaaggaagac

SEQ ID NO: 1973299 - RNA, 14 nt, Human
ugggcauucaaaug

SEQ ID NO: 1973300 - RNA, 13 nt, Human
ugggcauucaaau

SEQ ID NO: 1973301 - RNA, 23 nt, Human
ugggcagaaggaagacuucaucc

SEQ ID NO: 1973302 - RNA, 13 nt, Human
ugggcaauauucu

SEQ ID NO: 1973303 - RNA, 17 nt, Human
ugggcaauauucucugu

SEQ ID NO: 1973304 - RNA, 18 nt, Human
ugggcaauauucucugua

SEQ ID NO: 1973305 - RNA, 19 nt, Human
ugggcaauauucucuguac

SEQ ID NO: 1973306 - RNA, 20 nt, Human
ugggcaauauucucuguaca

SEQ ID NO: 1973307 - RNA, 21 nt, Human
ugggcaauauucucuguacau

SEQ ID NO: 1973308 - RNA, 13 nt, Human
ugggcagaaggaa

SEQ ID NO: 1973309 - RNA, 16 nt, Human
ugggauuuggucaaca

SEQ ID NO: 1973310 - RNA, 15 nt, Human
ugggcaaaagagugu

SEQ ID NO: 1973311 - RNA, 21 nt, Human
ugggcaacccccagccugcua

SEQ ID NO: 1973312 - RNA, 17 nt, Human
uggcucaagucuggccc

SEQ ID NO: 1973313 - RNA, 13 nt, Human
uggcucacgccug

SEQ ID NO: 1973314 - RNA, 19 nt, Human
uggcuaauguacugcauau

SEQ ID NO: 1973315 - RNA, 17 nt, Human
uggcuaauguacugcau

SEQ ID NO: 1973316 - RNA, 23 nt, Human
aggcuccaggagcagccacauuc

SEQ ID NO: 1973317 - RNA, 19 nt, Human
aggcuccaggagcagccac

SEQ ID NO: 1973318 - RNA, 18 nt, Human
aggcuccaggagcagcca

SEQ ID NO: 1973319 - RNA, 17 nt, Human
aggcuccaggagcagcc

SEQ ID NO: 1973320 - RNA, 14 nt, Human
uggcuaaauucaug

SEQ ID NO: 1973321 - RNA, 18 nt, Human
uggcuaagcaaaauguga

SEQ ID NO: 1973322 - RNA, 13 nt, Human
aggcuccaggcag

SEQ ID NO: 1973323 - RNA, 14 nt, Human
aggcuccaggcagc

SEQ ID NO: 1973324 - RNA, 15 nt, Human
aggcuccaggcagca

SEQ ID NO: 1973325 - RNA, 13 nt, Human
aggcuccugccac

SEQ ID NO: 1973326 - RNA, 16 nt, Human
uggcuguggagugugg

SEQ ID NO: 1973327 - RNA, 22 nt, Human
uggcugugccucugccugucuc

SEQ ID NO: 1973328 - RNA, 18 nt, Human
uggcugugccucugccug

SEQ ID NO: 1973329 - RNA, 19 nt, Human
uggcugugccucugccugu

SEQ ID NO: 1973330 - RNA, 21 nt, Human
uggcuguggaauaggaacgcu

SEQ ID NO: 1973331 - RNA, 16 nt, Human
uggcuguuggcugggg

SEQ ID NO: 1973332 - RNA, 18 nt, Human
uggcuguuggcugggggc

SEQ ID NO: 1973333 - RNA, 14 nt, Human
uggcuucacggaag

SEQ ID NO: 1973334 - RNA, 23 nt, Human
uggcuguuggcugggggccucag

SEQ ID NO: 1973335 - RNA, 15 nt, Human
uggcugcagagcagu

SEQ ID NO: 1973336 - RNA, 18 nt, Human
uggcugcagagcaguggg

SEQ ID NO: 1973337 - RNA, 22 nt, Human
uggcugcagagcagugggccug

SEQ ID NO: 1973338 - RNA, 23 nt, Human
uggcugcaaaggguaucaggugc

SEQ ID NO: 1973339 - RNA, 14 nt, Human
uggcugugccucug

SEQ ID NO: 1973340 - RNA, 15 nt, Human
uggcugugccucugc

SEQ ID NO: 1973341 - RNA, 16 nt, Human
uggcugugccucugcc

SEQ ID NO: 1973342 - RNA, 17 nt, Human
uggcugugccucugccu

SEQ ID NO: 1973343 - RNA, 15 nt, Human
ugggaaacagaggcu

SEQ ID NO: 1973344 - RNA, 20 nt, Human
ugggaacaccauaggucacc

SEQ ID NO: 1973345 - RNA, 23 nt, Human
ugggaaaugcugauuuaaacuuc

SEQ ID NO: 1973346 - RNA, 17 nt, Human
ugggaaagagauuuaaa

SEQ ID NO: 1973347 - RNA, 20 nt, Human
uggcuucacggaagagccuu

SEQ ID NO: 1973348 - RNA, 17 nt, Human
uggcuucacggaagagc

SEQ ID NO: 1973349 - RNA, 15 nt, Human
uggcuuuugugcauu

SEQ ID NO: 1973350 - RNA, 16 nt, Human
uggcuuuugugcauua

SEQ ID NO: 1973351 - RNA, 21 nt, Human
uggcuuuugugcauuaucuag

SEQ ID NO: 1973352 - RNA, 18 nt, Human
uggcuuaaaaaaaacucu

SEQ ID NO: 1973353 - RNA, 18 nt, Human
ugggaaacaaaaggauaa

SEQ ID NO: 1973354 - RNA, 12 nt, Human
aggcuugcagaa

SEQ ID NO: 1973355 - RNA, 15 nt, Human
aggcuugcugcagau

SEQ ID NO: 1973356 - RNA, 23 nt, Human
aggcuucugguugaugccuguga

SEQ ID NO: 1973357 - RNA, 21 nt, Human
aggcuuagucacugagacagc

SEQ ID NO: 1973358 - RNA, 22 nt, Human
aggcuuagucacugagacagcc

SEQ ID NO: 1973359 - RNA, 23 nt, Human
aggcuuagucacugagacagccc

SEQ ID NO: 1973360 - RNA, 14 nt, Human
aggcuuauaaaaca

SEQ ID NO: 1973361 - RNA, 16 nt, Human
aggcuuauaaaacaga

SEQ ID NO: 1973362 - RNA, 14 nt, Human
aggcuuauauuugu

SEQ ID NO: 1973363 - RNA, 22 nt, Human
aggcuuauauuuguguaauuuu

SEQ ID NO: 1973364 - RNA, 16 nt, Human
agggaaaagcagcucu

SEQ ID NO: 1973365 - RNA, 22 nt, Human
agggaaaauaaaaaaagaaaaa

SEQ ID NO: 1973366 - RNA, 23 nt, Human
agggaaaauaaaaaaagaaaaaa

SEQ ID NO: 1973367 - RNA, 15 nt, Human
aggcuuuuuuaucau

SEQ ID NO: 1973368 - RNA, 21 nt, Human
aggcuuuuuuaucaugugaaa

SEQ ID NO: 1973369 - RNA, 18 nt, Human
aggcuuuuuuaucaugug

SEQ ID NO: 1973370 - RNA, 23 nt, Human
agggaaaaaucaaguauuauaaa

SEQ ID NO: 1973371 - RNA, 22 nt, Human
aggcugggggaagaagcucucu

SEQ ID NO: 1973372 - RNA, 10 nt, Human
aggcuggguc

SEQ ID NO: 1973373 - RNA, 18 nt, Human
aggcugggucgcccugga

SEQ ID NO: 1973374 - RNA, 15 nt, Human
aggcugggucgcccu

SEQ ID NO: 1973375 - RNA, 17 nt, Human
aggcuggguucugaucc

SEQ ID NO: 1973376 - RNA, 14 nt, Human
aggcuggguucuga

SEQ ID NO: 1973377 - RNA, 21 nt, Human
aggcugggucgcccuggacug

SEQ ID NO: 1973378 - RNA, 20 nt, Human
aggcugggucgcccuggacu

SEQ ID NO: 1973379 - RNA, 18 nt, Human
aggcugggcuucaguggc

SEQ ID NO: 1973380 - RNA, 19 nt, Human
aggcugggcuucaguggca

SEQ ID NO: 1973381 - RNA, 20 nt, Human
aggcugggcuucaguggcag

SEQ ID NO: 1973382 - RNA, 21 nt, Human
aggcugggcuucaguggcagc

SEQ ID NO: 1973383 - RNA, 17 nt, Human
aggcugggggaagaagc

SEQ ID NO: 1973384 - RNA, 19 nt, Human
aggcugggcugggcacugc

SEQ ID NO: 1973385 - RNA, 21 nt, Human
aggcugggcugggcacugcuc

SEQ ID NO: 1973386 - RNA, 22 nt, Human
aggcugggcugggcacugcucu

SEQ ID NO: 1973387 - RNA, 22 nt, Human
aggcugggcuucaguggcagcu

SEQ ID NO: 1973388 - RNA, 23 nt, Human
aggcugggcuucaguggcagcug

SEQ ID NO: 1973389 - RNA, 18 nt, Human
aggcugggcucccuuccc

SEQ ID NO: 1973390 - RNA, 14 nt, Human
aggcugggcucccu

SEQ ID NO: 1973391 - RNA, 13 nt, Human
aggcugggcuccc

SEQ ID NO: 1973392 - RNA, 23 nt, Human
aggcugggcucccuucccaccuc

SEQ ID NO: 1973393 - RNA, 21 nt, Human
aggcugggcucccuucccacc

SEQ ID NO: 1973394 - RNA, 15 nt, Human
aggcugggcugggca

SEQ ID NO: 1973395 - RNA, 16 nt, Human
aggcugggcugggcac

SEQ ID NO: 1973396 - RNA, 18 nt, Human
aggcugggcugggcacug

SEQ ID NO: 1973397 - RNA, 14 nt, Human
aggcugggcuucag

SEQ ID NO: 1973398 - RNA, 21 nt, Human
aggcugggagagccuuccagg

SEQ ID NO: 1973399 - RNA, 20 nt, Human
aggcugggagagccuuccag

SEQ ID NO: 1973400 - RNA, 22 nt, Human
aggcugggagagccuuccaggg

SEQ ID NO: 1973401 - RNA, 16 nt, Human
aggcugggagagccuu

SEQ ID NO: 1973402 - RNA, 19 nt, Human
aggcugggagagccuucca

SEQ ID NO: 1973403 - RNA, 13 nt, Human
aggccuggccaga

SEQ ID NO: 1973404 - RNA, 16 nt, Human
aggccugacucucagc

SEQ ID NO: 1973405 - RNA, 20 nt, Human
aggccugaauccaaaagaaa

SEQ ID NO: 1973406 - RNA, 23 nt, Human
aggccugaauccaaaagaaaaac

SEQ ID NO: 1973407 - RNA, 12 nt, Human
aggccuggccag

SEQ ID NO: 1973408 - RNA, 19 nt, Human
aggccuaauucuaugccug

SEQ ID NO: 1973409 - RNA, 22 nt, Human
aggccuaauucuaugccugucu

SEQ ID NO: 1973410 - RNA, 22 nt, Human
aggccuacaugcuuugugaaca

SEQ ID NO: 1973411 - RNA, 21 nt, Human
aggccguugccgcugauguuu

SEQ ID NO: 1973412 - RNA, 18 nt, Human
aggccguugcugacuuag

SEQ ID NO: 1973413 - RNA, 21 nt, Human
aggccguugcugacuuagaau

SEQ ID NO: 1973414 - RNA, 23 nt, Human
aggccguugcugacuuagaaucc

SEQ ID NO: 1973415 - RNA, 17 nt, Human
aggccuacuccugucuu

SEQ ID NO: 1973416 - RNA, 13 nt, Human
aggccuacuccug

SEQ ID NO: 1973417 - RNA, 14 nt, Human
aggccuacuccugu

SEQ ID NO: 1973418 - RNA, 15 nt, Human
aggccuacuccuguc

SEQ ID NO: 1973419 - RNA, 23 nt, Human
aggccuacaugcuuugugaacaa

SEQ ID NO: 1973420 - RNA, 17 nt, Human
aggcccggcuccaggcu

SEQ ID NO: 1973421 - RNA, 13 nt, Human
aggccgggcagag

SEQ ID NO: 1973422 - RNA, 14 nt, Human
aggccgggcagagc

SEQ ID NO: 1973423 - RNA, 16 nt, Human
aggccgggcagagcac

SEQ ID NO: 1973424 - RNA, 19 nt, Human
aggccgggcagagcacagc

SEQ ID NO: 1973425 - RNA, 14 nt, Human
aggcccggcuccag

SEQ ID NO: 1973426 - RNA, 15 nt, Human
aggcccggcuccagg

SEQ ID NO: 1973427 - RNA, 16 nt, Human
aggcccggcuccaggc

SEQ ID NO: 1973428 - RNA, 20 nt, Human
aggcccagagggccugcaag

SEQ ID NO: 1973429 - RNA, 19 nt, Human
aggcccagagggccugcaa

SEQ ID NO: 1973430 - RNA, 13 nt, Human
aggccccugccac

SEQ ID NO: 1973431 - RNA, 15 nt, Human
aggccccugccaccc

SEQ ID NO: 1973432 - RNA, 17 nt, Human
aggccccugccacccug

SEQ ID NO: 1973433 - RNA, 18 nt, Human
aggccccugccacccugg

SEQ ID NO: 1973434 - RNA, 21 nt, Human
aggccccugccacccugggga

SEQ ID NO: 1973435 - RNA, 17 nt, Human
aggcauaugcuucuuua

SEQ ID NO: 1973436 - RNA, 18 nt, Human
aggcauaugcuucuuuaa

SEQ ID NO: 1973437 - RNA, 19 nt, Human
aggcauaugcuucuuuaaa

SEQ ID NO: 1973438 - RNA, 14 nt, Human
uggcacagccugca

SEQ ID NO: 1973439 - RNA, 16 nt, Human
uggcacagggcagugg

SEQ ID NO: 1973440 - RNA, 15 nt, Human
uggcacagggcagug

SEQ ID NO: 1973441 - RNA, 17 nt, Human
uggcacagccugcacuu

SEQ ID NO: 1973442 - RNA, 13 nt, Human
uggcagaugcagc

SEQ ID NO: 1973443 - RNA, 15 nt, Human
uggcagaugcagcuc

SEQ ID NO: 1973444 - RNA, 16 nt, Human
uggcagaugcagcucu

SEQ ID NO: 1973445 - RNA, 17 nt, Human
uggcagaugcagcucuu

SEQ ID NO: 1973446 - RNA, 21 nt, Human
uggcagaugcagcucuuccug

SEQ ID NO: 1973447 - RNA, 17 nt, Human
uggcaccagcagccugg

SEQ ID NO: 1973448 - RNA, 16 nt, Human
uggcaccagcagccug

SEQ ID NO: 1973449 - RNA, 20 nt, Human
uggcagcaccgccucuuccc

SEQ ID NO: 1973450 - RNA, 23 nt, Human
uggcagcaccgccucuucccgcc

SEQ ID NO: 1973451 - RNA, 17 nt, Human
uggcagccgugccuuca

SEQ ID NO: 1973452 - RNA, 18 nt, Human
aggccagagacacaagcc

SEQ ID NO: 1973453 - RNA, 13 nt, Human
aggccagagacac

SEQ ID NO: 1973454 - RNA, 18 nt, Human
uggcagcucagagagggu

SEQ ID NO: 1973455 - RNA, 16 nt, Human
uggcagcucagagagg

SEQ ID NO: 1973456 - RNA, 15 nt, Human
uggcagcucagagag

SEQ ID NO: 1973457 - RNA, 14 nt, Human
uggcagcucagaga

SEQ ID NO: 1973458 - RNA, 18 nt, Human
uggcagccgugccuucag

SEQ ID NO: 1973459 - RNA, 19 nt, Human
uggcagccgugccuucagc

SEQ ID NO: 1973460 - RNA, 20 nt, Human
uggcagccgugccuucagcu

SEQ ID NO: 1973461 - RNA, 21 nt, Human
uggcagccgugccuucagcuc

SEQ ID NO: 1973462 - RNA, 16 nt, Human
aggcccagagggccug

SEQ ID NO: 1973463 - RNA, 15 nt, Human
aggcccagagggccu

SEQ ID NO: 1973464 - RNA, 20 nt, Human
aggccauuccccgucucugg

SEQ ID NO: 1973465 - RNA, 23 nt, Human
aggccagagacacaagccuucgg

SEQ ID NO: 1973466 - RNA, 22 nt, Human
uggcagccgugccuucagcucu

SEQ ID NO: 1973467 - RNA, 18 nt, Human
aggccaugggccuccugu

SEQ ID NO: 1973468 - RNA, 21 nt, Human
uggccugaugaccaauuuuaa

SEQ ID NO: 1973469 - RNA, 21 nt, Human
uggccugugcgaucccacccg

SEQ ID NO: 1973470 - RNA, 22 nt, Human
uggccugugcgaucccacccgu

SEQ ID NO: 1973471 - RNA, 19 nt, Human
uggccucugcacuccccug

SEQ ID NO: 1973472 - RNA, 20 nt, Human
uggccucugcacuccccugc

SEQ ID NO: 1973473 - RNA, 21 nt, Human
uggccucugcugauccuccca

SEQ ID NO: 1973474 - RNA, 13 nt, Human
uggcccugcccug

SEQ ID NO: 1973475 - RNA, 13 nt, Human
uggcccuuuccuu

SEQ ID NO: 1973476 - RNA, 18 nt, Human
uggcccuuuccuuccaga

SEQ ID NO: 1973477 - RNA, 12 nt, Human
uggcccugcccu

SEQ ID NO: 1973478 - RNA, 24 nt, Human
uggcccucucugaaggaggccacc

SEQ ID NO: 1973479 - RNA, 14 nt, Human
uggcccacugcauc

SEQ ID NO: 1973480 - RNA, 13 nt, Human
uggcccacugcau

SEQ ID NO: 1973481 - RNA, 19 nt, Human
uggcccacgcacuucggga

SEQ ID NO: 1973482 - RNA, 22 nt, Human
uggcaugggaaugaaugucagu

SEQ ID NO: 1973483 - RNA, 21 nt, Human
uggcauggugguugggaccca

SEQ ID NO: 1973484 - RNA, 22 nt, Human
uggcauggugguugggacccag

SEQ ID NO: 1973485 - RNA, 21 nt, Human
aggcuauuguccccuaaacca

SEQ ID NO: 1973486 - RNA, 14 nt, Human
aggcucaaauuuug

SEQ ID NO: 1973487 - RNA, 20 nt, Human
aggcgcaagggaggcccagc

SEQ ID NO: 1973488 - RNA, 19 nt, Human
aggcgcaagggaggcccag

SEQ ID NO: 1973489 - RNA, 14 nt, Human
aggcgccccuuccc

SEQ ID NO: 1973490 - RNA, 13 nt, Human
aggcgcuaacuug

SEQ ID NO: 1973491 - RNA, 15 nt, Human
aggcgcuaacuugcu

SEQ ID NO: 1973492 - RNA, 23 nt, Human
aggcgcuaacuugcuuaaaugug

SEQ ID NO: 1973493 - RNA, 15 nt, Human
aggcgcuagcacagc

SEQ ID NO: 1973494 - RNA, 19 nt, Human
aggcgcuagcacagcuccc

SEQ ID NO: 1973495 - RNA, 18 nt, Human
aggccuugggcucugcug

SEQ ID NO: 1973496 - RNA, 19 nt, Human
aggccuugggcucugcuga

SEQ ID NO: 1973497 - RNA, 23 nt, Human
aggccuuuaguuauaaaggaauc

SEQ ID NO: 1973498 - RNA, 21 nt, Human
aggcgaaagaaaacucuauuu

SEQ ID NO: 1973499 - RNA, 22 nt, Human
aggcgaggaggccguugccgcu

SEQ ID NO: 1973500 - RNA, 17 nt, Human
aggccuucucugaagga

SEQ ID NO: 1973501 - RNA, 18 nt, Human
aggccuucucugaaggac

SEQ ID NO: 1973502 - RNA, 17 nt, Human
aggccuugggcucugcu

SEQ ID NO: 1973503 - RNA, 11 nt, Human
aggcuccacuu

SEQ ID NO: 1973504 - RNA, 17 nt, Human
aggcuccacuuggucug

SEQ ID NO: 1973505 - RNA, 21 nt, Human
aggcuccacuuggucugugag

SEQ ID NO: 1973506 - RNA, 22 nt, Human
aggcuccacuuggucugugaga

SEQ ID NO: 1973507 - RNA, 16 nt, Human
aggcuccaggagcagc

SEQ ID NO: 1973508 - RNA, 14 nt, Human
aggcuccaggagca

SEQ ID NO: 1973509 - RNA, 13 nt, Human
aggcuccaggagc

SEQ ID NO: 1973510 - RNA, 12 nt, Human
aggcaggucccc

SEQ ID NO: 1973511 - RNA, 13 nt, Human
aggcaggucccca

SEQ ID NO: 1973512 - RNA, 14 nt, Human
aggcagguccccag

SEQ ID NO: 1973513 - RNA, 15 nt, Human
aggcagguccccaga

SEQ ID NO: 1973514 - RNA, 16 nt, Human
aggcagguccccagac

SEQ ID NO: 1973515 - RNA, 23 nt, Human
aggcaguaggacaaggugcaggc

SEQ ID NO: 1973516 - RNA, 21 nt, Human
aggcaggucuugaacuccugg

SEQ ID NO: 1973517 - RNA, 16 nt, Human
aggcaguauaaagaau

SEQ ID NO: 1973518 - RNA, 17 nt, Human
aggcaguugcccagccu

SEQ ID NO: 1973519 - RNA, 19 nt, Human
aggcaguugcccagccucu

SEQ ID NO: 1973520 - RNA, 20 nt, Human
aggcaguugcccagccucuu

SEQ ID NO: 1973521 - RNA, 15 nt, Human
aggcaguuugaggau

SEQ ID NO: 1973522 - RNA, 20 nt, Human
aggcaguuugaggauuaguu

SEQ ID NO: 1973523 - RNA, 15 nt, Human
aggcagggugucugc

SEQ ID NO: 1973524 - RNA, 20 nt, Human
aggcagggcaggaccagccc

SEQ ID NO: 1973525 - RNA, 21 nt, Human
aggcagggcaggaccagccca

SEQ ID NO: 1973526 - RNA, 22 nt, Human
aggcagggcaggaccagcccac

SEQ ID NO: 1973527 - RNA, 22 nt, Human
aggcagggucucacucugucgc

SEQ ID NO: 1973528 - RNA, 11 nt, Human
aggcagguccc

SEQ ID NO: 1973529 - RNA, 19 nt, Human
aggcagggugucugccccc

SEQ ID NO: 1973530 - RNA, 14 nt, Human
aggcagguccaggg

SEQ ID NO: 1973531 - RNA, 19 nt, Human
aggcagggucucacucugu

SEQ ID NO: 1973532 - RNA, 18 nt, Human
aggcagggucucacucug

SEQ ID NO: 1973533 - RNA, 20 nt, Human
aggcagggucucacucuguc

SEQ ID NO: 1973534 - RNA, 21 nt, Human
aggcagggucucacucugucg

SEQ ID NO: 1973535 - RNA, 21 nt, Human
aggcaggaccuucgggcugug

SEQ ID NO: 1973536 - RNA, 22 nt, Human
aggcaggaccuucgggcugugc

SEQ ID NO: 1973537 - RNA, 23 nt, Human
aggcaggaccuucgggcugugcc

SEQ ID NO: 1973538 - RNA, 12 nt, Human
aggcaggauggc

SEQ ID NO: 1973539 - RNA, 20 nt, Human
aggcaggaguuucguuuuca

SEQ ID NO: 1973540 - RNA, 16 nt, Human
aggcagggagggccug

SEQ ID NO: 1973541 - RNA, 12 nt, Human
aggcagggcagg

SEQ ID NO: 1973542 - RNA, 15 nt, Human
aggcagggcaggacc

SEQ ID NO: 1973543 - RNA, 16 nt, Human
aggcagggcaggacca

SEQ ID NO: 1973544 - RNA, 17 nt, Human
aggcagggcaggaccag

SEQ ID NO: 1973545 - RNA, 15 nt, Human
aggcaggagagacag

SEQ ID NO: 1973546 - RNA, 15 nt, Human
aggcacccaccauca

SEQ ID NO: 1973547 - RNA, 19 nt, Human
aggcagccccauucugccu

SEQ ID NO: 1973548 - RNA, 20 nt, Human
aggcagccccauucugccug

SEQ ID NO: 1973549 - RNA, 21 nt, Human
aggcagccccauucugccugc

SEQ ID NO: 1973550 - RNA, 22 nt, Human
aggcagccccauucugccugcc

SEQ ID NO: 1973551 - RNA, 17 nt, Human
aggcagccugagagucu

SEQ ID NO: 1973552 - RNA, 24 nt, Human
uggacuuuguuaguuucuccaagc

SEQ ID NO: 1973553 - RNA, 17 nt, Human
uggagaaaaauaucugu

SEQ ID NO: 1973554 - RNA, 23 nt, Human
uggagaaaaauaucuguaagagu

SEQ ID NO: 1973555 - RNA, 16 nt, Human
uggagcccacuguacu

SEQ ID NO: 1973556 - RNA, 23 nt, Human
uggagcccacuguacuugcucuu

SEQ ID NO: 1973557 - RNA, 19 nt, Human
uggagcccacuguacuugc

SEQ ID NO: 1973558 - RNA, 11 nt, Human
uggacuuuguu

SEQ ID NO: 1973559 - RNA, 22 nt, Human
uggacuuuguuaguuucuccaa

SEQ ID NO: 1973560 - RNA, 14 nt, Human
uggacccugaaaug

SEQ ID NO: 1973561 - RNA, 15 nt, Human
uggacccugaaaugu

SEQ ID NO: 1973562 - RNA, 16 nt, Human
uggacccugaaaugug

SEQ ID NO: 1973563 - RNA, 17 nt, Human
uggacccugaaaugugu

SEQ ID NO: 1973564 - RNA, 13 nt, Human
uggaccccagccu

SEQ ID NO: 1973565 - RNA, 14 nt, Human
uggaccccagccuc

SEQ ID NO: 1973566 - RNA, 15 nt, Human
uggaccccagccuca

SEQ ID NO: 1973567 - RNA, 16 nt, Human
uggaccccaucuguga

SEQ ID NO: 1973568 - RNA, 18 nt, Human
uggaccccaucugugaau

SEQ ID NO: 1973569 - RNA, 20 nt, Human
uggaccccaucugugaauaa

SEQ ID NO: 1973570 - RNA, 21 nt, Human
uggaccccaucugugaauaag

SEQ ID NO: 1973571 - RNA, 14 nt, Human
uggagcccaggagu

SEQ ID NO: 1973572 - RNA, 11 nt, Human
uggagccugca

SEQ ID NO: 1973573 - RNA, 13 nt, Human
uggagccugacag

SEQ ID NO: 1973574 - RNA, 16 nt, Human
uggagccugcagagcu

SEQ ID NO: 1973575 - RNA, 17 nt, Human
uggagccugacagccag

SEQ ID NO: 1973576 - RNA, 18 nt, Human
uggagccugacagccaga

SEQ ID NO: 1973577 - RNA, 21 nt, Human
uggagcugaggacucucacga

SEQ ID NO: 1973578 - RNA, 15 nt, Human
aggcaaugcuggcug

SEQ ID NO: 1973579 - RNA, 21 nt, Human
uggaggaaaaccaagccgugg

SEQ ID NO: 1973580 - RNA, 23 nt, Human
uggaggaaaaccaagccguggcu

SEQ ID NO: 1973581 - RNA, 16 nt, Human
aggcaaugcuggcugu

SEQ ID NO: 1973582 - RNA, 18 nt, Human
aggcacauggaauauauu

SEQ ID NO: 1973583 - RNA, 21 nt, Human
aggcacauggaauauauuuua

SEQ ID NO: 1973584 - RNA, 15 nt, Human
aggcacaggcagggc

SEQ ID NO: 1973585 - RNA, 16 nt, Human
aggcacaggcagggca

SEQ ID NO: 1973586 - RNA, 17 nt, Human
aggcacaggcagggcag

SEQ ID NO: 1973587 - RNA, 18 nt, Human
aggcacaggcagggcagg

SEQ ID NO: 1973588 - RNA, 13 nt, Human
uggaagugugggu

SEQ ID NO: 1973589 - RNA, 14 nt, Human
uggaaguguggguc

SEQ ID NO: 1973590 - RNA, 14 nt, Human
uggaagugcuaauu

SEQ ID NO: 1973591 - RNA, 18 nt, Human
uggaagugaaaacuuugu

SEQ ID NO: 1973592 - RNA, 19 nt, Human
uggaagugaaaacuuugua

SEQ ID NO: 1973593 - RNA, 20 nt, Human
uggaagugugggucugugug

SEQ ID NO: 1973594 - RNA, 14 nt, Human
aggaggccaccucc

SEQ ID NO: 1973595 - RNA, 15 nt, Human
aggaggccagccuug

SEQ ID NO: 1973596 - RNA, 21 nt, Human
aggaguuugagaccaaccugg

SEQ ID NO: 1973597 - RNA, 19 nt, Human
aggaguuucguuuucaaaa

SEQ ID NO: 1973598 - RNA, 20 nt, Human
aggaggccuugggcucugcu

SEQ ID NO: 1973599 - RNA, 22 nt, Human
aggaguuucuuuagcugacaga

SEQ ID NO: 1973600 - RNA, 17 nt, Human
aggauaugccugcucuu

SEQ ID NO: 1973601 - RNA, 16 nt, Human
aggauauggacacugg

SEQ ID NO: 1973602 - RNA, 18 nt, Human
aggauauggacacuggug

SEQ ID NO: 1973603 - RNA, 20 nt, Human
uggaaguacuauaauuuacc

SEQ ID NO: 1973604 - RNA, 12 nt, Human
uggaacacucug

SEQ ID NO: 1973605 - RNA, 14 nt, Human
uggaacacucugag

SEQ ID NO: 1973606 - RNA, 13 nt, Human
uggaagcuccgcu

SEQ ID NO: 1973607 - RNA, 12 nt, Human
ugcugcccugcc

SEQ ID NO: 1973608 - RNA, 10 nt, Human
ugcugcccug

SEQ ID NO: 1973609 - RNA, 15 nt, Human
ugcugccccugccuu

SEQ ID NO: 1973610 - RNA, 14 nt, Human
uggaauuugaaaca

SEQ ID NO: 1973611 - RNA, 16 nt, Human
aggcaacuugggaacu

SEQ ID NO: 1973612 - RNA, 19 nt, Human
aggcaacugcauuggcuuu

SEQ ID NO: 1973613 - RNA, 14 nt, Human
aggcaagcaccucc

SEQ ID NO: 1973614 - RNA, 16 nt, Human
aggcaagauggcacag

SEQ ID NO: 1973615 - RNA, 16 nt, Human
aggcaagauugauguu

SEQ ID NO: 1973616 - RNA, 14 nt, Human
uggacaaaauggaa

SEQ ID NO: 1973617 - RNA, 18 nt, Human
uggaauuuuuuuguacga

SEQ ID NO: 1973618 - RNA, 17 nt, Human
uggacaaaauggaauac

SEQ ID NO: 1973619 - RNA, 15 nt, Human
uggacaccggaaaca

SEQ ID NO: 1973620 - RNA, 13 nt, Human
uggacaagaaagu

SEQ ID NO: 1973621 - RNA, 12 nt, Human
aggaucucuuga

SEQ ID NO: 1973622 - RNA, 15 nt, Human
aggaugcuuguacau

SEQ ID NO: 1973623 - RNA, 16 nt, Human
aggaugcuuguacaua

SEQ ID NO: 1973624 - RNA, 21 nt, Human
aggauccugagccagauuuca

SEQ ID NO: 1973625 - RNA, 12 nt, Human
aggaucagucug

SEQ ID NO: 1973626 - RNA, 18 nt, Human
aggaugcuuguacauaau

SEQ ID NO: 1973627 - RNA, 22 nt, Human
aggauugcuacuguccuaccca

SEQ ID NO: 1973628 - RNA, 13 nt, Human
aggaauuuugcua

SEQ ID NO: 1973629 - RNA, 22 nt, Human
aggaauuuuauuuuuuucugaa

SEQ ID NO: 1973630 - RNA, 11 nt, Human
ugcugccaucc

SEQ ID NO: 1973631 - RNA, 22 nt, Human
ugcugccacacuucaggcucuu

SEQ ID NO: 1973632 - RNA, 20 nt, Human
aggacaaaucugcaaagcau

SEQ ID NO: 1973633 - RNA, 21 nt, Human
aggacaaaucugcaaagcaug

SEQ ID NO: 1973634 - RNA, 15 nt, Human
ugcugccacacuuca

SEQ ID NO: 1973635 - RNA, 16 nt, Human
ugcugccacacuucag

SEQ ID NO: 1973636 - RNA, 19 nt, Human
ugcugccacacuucaggcu

SEQ ID NO: 1973637 - RNA, 21 nt, Human
ugcugccauccagguucagcu

SEQ ID NO: 1973638 - RNA, 22 nt, Human
ugcugccauccagguucagcuu

SEQ ID NO: 1973639 - RNA, 14 nt, Human
ugcugcccagccuc

SEQ ID NO: 1973640 - RNA, 17 nt, Human
ugcugccaguaccagcc

SEQ ID NO: 1973641 - RNA, 19 nt, Human
ugcugccaguaccagcccc

SEQ ID NO: 1973642 - RNA, 20 nt, Human
ugcugccaguaccagcccca

SEQ ID NO: 1973643 - RNA, 16 nt, Human
ugcugcccagccucca

SEQ ID NO: 1973644 - RNA, 12 nt, Human
ugcugccaucca

SEQ ID NO: 1973645 - RNA, 13 nt, Human
ugcugccauccag

SEQ ID NO: 1973646 - RNA, 14 nt, Human
ugcugccauccagg

SEQ ID NO: 1973647 - RNA, 15 nt, Human
ugcugccauccaggu

SEQ ID NO: 1973648 - RNA, 15 nt, Human
aggaagacuuuggaa

SEQ ID NO: 1973649 - RNA, 13 nt, Human
aggaaaucaaagu

SEQ ID NO: 1973650 - RNA, 14 nt, Human
aggaaaucaaagug

SEQ ID NO: 1973651 - RNA, 19 nt, Human
aggaaaucaaagugcuauu

SEQ ID NO: 1973652 - RNA, 14 nt, Human
aggaagagaaaaaa

SEQ ID NO: 1973653 - RNA, 22 nt, Human
aggaagcucagggccuggcuca

SEQ ID NO: 1973654 - RNA, 18 nt, Human
aggaagcucagggccugg

SEQ ID NO: 1973655 - RNA, 17 nt, Human
aggaagcucagggccug

SEQ ID NO: 1973656 - RNA, 19 nt, Human
aggaauugacccacaagaa

SEQ ID NO: 1973657 - RNA, 23 nt, Human
aggaauccagacccggcugcgug

SEQ ID NO: 1973658 - RNA, 22 nt, Human
aggaaaggcuccaggagcagcc

SEQ ID NO: 1973659 - RNA, 20 nt, Human
aggaaaggcuccaggagcag

SEQ ID NO: 1973660 - RNA, 18 nt, Human
aggaaaggcuccaggagc

SEQ ID NO: 1973661 - RNA, 24 nt, Human
ugcugacuguuuucucuugagagg

SEQ ID NO: 1973662 - RNA, 21 nt, Human
ugcugacuguuuucucuugag

SEQ ID NO: 1973663 - RNA, 15 nt, Human
ugcugagucccaggc

SEQ ID NO: 1973664 - RNA, 18 nt, Human
ugcugagucccaggcuga

SEQ ID NO: 1973665 - RNA, 22 nt, Human
ugcugagucccaggcugagccu

SEQ ID NO: 1973666 - RNA, 20 nt, Human
ugcugaguccgaccuggccu

SEQ ID NO: 1973667 - RNA, 13 nt, Human
aggaaagcacaga

SEQ ID NO: 1973668 - RNA, 22 nt, Human
ugcucugaucauccacugugcc

SEQ ID NO: 1973669 - RNA, 18 nt, Human
ugcucugaugaagaggag

SEQ ID NO: 1973670 - RNA, 19 nt, Human
ugcucugaugaagaggagu

SEQ ID NO: 1973671 - RNA, 19 nt, Human
ugcucugaucauccacugu

SEQ ID NO: 1973672 - RNA, 15 nt, Human
ugcuaucaguuuuau

SEQ ID NO: 1973673 - RNA, 18 nt, Human
ugcuaucaguuuuauagc

SEQ ID NO: 1973674 - RNA, 18 nt, Human
ugcucugcauguuacaua

SEQ ID NO: 1973675 - RNA, 15 nt, Human
ugcucugcauguuac

SEQ ID NO: 1973676 - RNA, 15 nt, Human
ugcucugccccagcu

SEQ ID NO: 1973677 - RNA, 14 nt, Human
ugcucugccccagc

SEQ ID NO: 1973678 - RNA, 17 nt, Human
ugcucuggacaggcaug

SEQ ID NO: 1973679 - RNA, 19 nt, Human
ugcucugugcccacccucc

SEQ ID NO: 1973680 - RNA, 17 nt, Human
ugcugacuguuuucucu

SEQ ID NO: 1973681 - RNA, 15 nt, Human
agcuuaucucagggg

SEQ ID NO: 1973682 - RNA, 14 nt, Human
agcuuaucucaggg

SEQ ID NO: 1973683 - RNA, 12 nt, Human
agcuuaucucag

SEQ ID NO: 1973684 - RNA, 20 nt, Human
agcuuaaaggggcuagagug

SEQ ID NO: 1973685 - RNA, 20 nt, Human
agcuguuugguuuuaaaaua

SEQ ID NO: 1973686 - RNA, 23 nt, Human
agcuguuugguuuuaaaauacug

SEQ ID NO: 1973687 - RNA, 24 nt, Human
agcuguuugguuuuaaaauacugu

SEQ ID NO: 1973688 - RNA, 17 nt, Human
agcuguuugguuuuaaa

SEQ ID NO: 1973689 - RNA, 19 nt, Human
agcuguuugguuuuaaaau

SEQ ID NO: 1973690 - RNA, 20 nt, Human
ugcggacagccacggccagg

SEQ ID NO: 1973691 - RNA, 21 nt, Human
ugcggacagccacggccaggc

SEQ ID NO: 1973692 - RNA, 23 nt, Human
agcuuucugagcaagaggauuuu

SEQ ID NO: 1973693 - RNA, 14 nt, Human
agcuuucugagcaa

SEQ ID NO: 1973694 - RNA, 22 nt, Human
agcuuucugagcaagaggauuu

SEQ ID NO: 1973695 - RNA, 19 nt, Human
agcuuguaaauagcucagg

SEQ ID NO: 1973696 - RNA, 17 nt, Human
agcuuggcccuuuccuu

SEQ ID NO: 1973697 - RNA, 16 nt, Human
agcuuggcucaggcug

SEQ ID NO: 1973698 - RNA, 20 nt, Human
agcuuguaaauagcucaggu

SEQ ID NO: 1973699 - RNA, 21 nt, Human
agcuuguaaauagcucaggug

SEQ ID NO: 1973700 - RNA, 19 nt, Human
agcuuugaaaauucagugg

SEQ ID NO: 1973701 - RNA, 18 nt, Human
agcuuugaaaauucagug

SEQ ID NO: 1973702 - RNA, 16 nt, Human
agcuuugaaaauucag

SEQ ID NO: 1973703 - RNA, 12 nt, Human
agcuuugaaaau

SEQ ID NO: 1973704 - RNA, 17 nt, Human
aggaaacccagcucugg

SEQ ID NO: 1973705 - RNA, 16 nt, Human
aggaaacccagcucug

SEQ ID NO: 1973706 - RNA, 15 nt, Human
aggaaacccagcucu

SEQ ID NO: 1973707 - RNA, 20 nt, Human
aggaaacccagcucuggucc

SEQ ID NO: 1973708 - RNA, 18 nt, Human
aggaaacccagcucuggu

SEQ ID NO: 1973709 - RNA, 21 nt, Human
aggaaacccagcucuggucca

SEQ ID NO: 1973710 - RNA, 23 nt, Human
aggaaaccaguuaggucucaaua

SEQ ID NO: 1973711 - RNA, 21 nt, Human
ugcuauaacuauguugauaaa

SEQ ID NO: 1973712 - RNA, 16 nt, Human
ugcuagucuuaagaac

SEQ ID NO: 1973713 - RNA, 19 nt, Human
aggaaagcaaaggagauug

SEQ ID NO: 1973714 - RNA, 16 nt, Human
aggaaagaagcauuuc

SEQ ID NO: 1973715 - RNA, 17 nt, Human
aggaaagcaaaggagau

SEQ ID NO: 1973716 - RNA, 16 nt, Human
aggaaagaggcucugg

SEQ ID NO: 1973717 - RNA, 13 nt, Human
aggaaagaggcuc

SEQ ID NO: 1973718 - RNA, 12 nt, Human
aggaaagaggcu

SEQ ID NO: 1973719 - RNA, 15 nt, Human
agcuggggaugucuc

SEQ ID NO: 1973720 - RNA, 20 nt, Human
agcuggggccaggcuggguc

SEQ ID NO: 1973721 - RNA, 19 nt, Human
ugccuugugaaggaauuau

SEQ ID NO: 1973722 - RNA, 21 nt, Human
ugccuuagaaccuuucuuaca

SEQ ID NO: 1973723 - RNA, 14 nt, Human
ugccuuagaaccuu

SEQ ID NO: 1973724 - RNA, 17 nt, Human
ugccuuagaaccuuucu

SEQ ID NO: 1973725 - RNA, 15 nt, Human
ugccuguucagcucc

SEQ ID NO: 1973726 - RNA, 16 nt, Human
ugccuguucagcucca

SEQ ID NO: 1973727 - RNA, 17 nt, Human
ugccuguucagcuccag

SEQ ID NO: 1973728 - RNA, 13 nt, Human
ugcgaaaggauga

SEQ ID NO: 1973729 - RNA, 18 nt, Human
ugcggacagccacggcca

SEQ ID NO: 1973730 - RNA, 15 nt, Human
ugcgaggcuaugagu

SEQ ID NO: 1973731 - RNA, 19 nt, Human
ugcgaaaggaugaaaguga

SEQ ID NO: 1973732 - RNA, 19 nt, Human
agcugccugggaucccuca

SEQ ID NO: 1973733 - RNA, 13 nt, Human
agcugccugggau

SEQ ID NO: 1973734 - RNA, 21 nt, Human
agcugccugggaucccucauc

SEQ ID NO: 1973735 - RNA, 10 nt, Human
agcugccugu

SEQ ID NO: 1973736 - RNA, 22 nt, Human
ugccucugacacacagcucugu

SEQ ID NO: 1973737 - RNA, 20 nt, Human
agcugccuccccucuccuuc

SEQ ID NO: 1973738 - RNA, 23 nt, Human
agcugccuccccucuccuuccug

SEQ ID NO: 1973739 - RNA, 17 nt, Human
agcugccugaaaaucaa

SEQ ID NO: 1973740 - RNA, 19 nt, Human
agcugccugaaaaucaaga

SEQ ID NO: 1973741 - RNA, 14 nt, Human
agcugggcagguug

SEQ ID NO: 1973742 - RNA, 22 nt, Human
agcugggauuacaggcuccugc

SEQ ID NO: 1973743 - RNA, 23 nt, Human
agcugggauuacaggcuccugcc

SEQ ID NO: 1973744 - RNA, 17 nt, Human
agcuggggccaggcugg

SEQ ID NO: 1973745 - RNA, 23 nt, Human
agcugggaugauuggagggggga

SEQ ID NO: 1973746 - RNA, 18 nt, Human
agcugggauuacaggcuc

SEQ ID NO: 1973747 - RNA, 21 nt, Human
agcugggauuacaggcuccug

SEQ ID NO: 1973748 - RNA, 22 nt, Human
agcugggaucacauguggacuu

SEQ ID NO: 1973749 - RNA, 17 nt, Human
agcugggacuacaggug

SEQ ID NO: 1973750 - RNA, 19 nt, Human
agcugggacuacaggugug

SEQ ID NO: 1973751 - RNA, 15 nt, Human
agcuggagaggagcc

SEQ ID NO: 1973752 - RNA, 16 nt, Human
agcuggagaggagccc

SEQ ID NO: 1973753 - RNA, 19 nt, Human
agcuggagaggagcccugc

SEQ ID NO: 1973754 - RNA, 17 nt, Human
agcuggagaggagcccu

SEQ ID NO: 1973755 - RNA, 18 nt, Human
agcuggagaggagcccug

SEQ ID NO: 1973756 - RNA, 20 nt, Human
ugcccuccaagaccuucucc

SEQ ID NO: 1973757 - RNA, 19 nt, Human
ugcccuccaagaccuucuc

SEQ ID NO: 1973758 - RNA, 22 nt, Human
ugcccuccaagaccuucuccuu

SEQ ID NO: 1973759 - RNA, 15 nt, Human
agcucuccccucaga

SEQ ID NO: 1973760 - RNA, 22 nt, Human
agcucucaugcugccccugccu

SEQ ID NO: 1973761 - RNA, 17 nt, Human
agcucuaucaccaagga

SEQ ID NO: 1973762 - RNA, 22 nt, Human
agcucuaucaccaaggagccaa

SEQ ID NO: 1973763 - RNA, 16 nt, Human
agcucucuccucccuu

SEQ ID NO: 1973764 - RNA, 20 nt, Human
agcucugguccauagagagc

SEQ ID NO: 1973765 - RNA, 22 nt, Human
agcucugcuccucuccccagca

SEQ ID NO: 1973766 - RNA, 12 nt, Human
agcucugcuccu

SEQ ID NO: 1973767 - RNA, 11 nt, Human
agcucugccuu

SEQ ID NO: 1973768 - RNA, 22 nt, Human
agcugcacccucaggcaggugg

SEQ ID NO: 1973769 - RNA, 20 nt, Human
agcugcacccucaggcaggu

SEQ ID NO: 1973770 - RNA, 19 nt, Human
agcugcacccucaggcagg

SEQ ID NO: 1973771 - RNA, 18 nt, Human
agcugcacccucaggcag

SEQ ID NO: 1973772 - RNA, 20 nt, Human
agcugauguguugccacuuu

SEQ ID NO: 1973773 - RNA, 17 nt, Human
agcugcacccucaggca

SEQ ID NO: 1973774 - RNA, 13 nt, Human
agcugcacccuca

SEQ ID NO: 1973775 - RNA, 18 nt, Human
agcucuucuccaggcugu

SEQ ID NO: 1973776 - RNA, 12 nt, Human
agcucuguccug

SEQ ID NO: 1973777 - RNA, 14 nt, Human
ugccucucucaggc

SEQ ID NO: 1973778 - RNA, 13 nt, Human
ugccucucucagg

SEQ ID NO: 1973779 - RNA, 19 nt, Human
ugccucccaucacccgcua

SEQ ID NO: 1973780 - RNA, 14 nt, Human
ugccucccaucacc

SEQ ID NO: 1973781 - RNA, 13 nt, Human
ugccucccaucac

SEQ ID NO: 1973782 - RNA, 15 nt, Human
ugccucucucaggcc

SEQ ID NO: 1973783 - RNA, 16 nt, Human
ugccucucucaggcca

SEQ ID NO: 1973784 - RNA, 18 nt, Human
ugccucucugcagguccc

SEQ ID NO: 1973785 - RNA, 16 nt, Human
ugccucucugcagguc

SEQ ID NO: 1973786 - RNA, 20 nt, Human
ugccucucugcaggucccua

SEQ ID NO: 1973787 - RNA, 19 nt, Human
ugccucucugcaggucccu

SEQ ID NO: 1973788 - RNA, 20 nt, Human
ugccucugacacacagcucu

SEQ ID NO: 1973789 - RNA, 21 nt, Human
ugccucugacacacagcucug

SEQ ID NO: 1973790 - RNA, 20 nt, Human
ugccgcgucgcccucccagg

SEQ ID NO: 1973791 - RNA, 13 nt, Human
ugccgcugauguu

SEQ ID NO: 1973792 - RNA, 18 nt, Human
ugccgggugcagcaucug

SEQ ID NO: 1973793 - RNA, 22 nt, Human
ugccgcugauguuuggccguga

SEQ ID NO: 1973794 - RNA, 21 nt, Human
ugccgcgucgcccucccaggc

SEQ ID NO: 1973795 - RNA, 16 nt, Human
ugccgcgucgcccucc

SEQ ID NO: 1973796 - RNA, 15 nt, Human
ugcccuuucugggca

SEQ ID NO: 1973797 - RNA, 21 nt, Human
ugcccuuuacuugucuuucug

SEQ ID NO: 1973798 - RNA, 15 nt, Human
ugcccuuuguccucc

SEQ ID NO: 1973799 - RNA, 17 nt, Human
ugcccuuuguccuccug

SEQ ID NO: 1973800 - RNA, 19 nt, Human
ugcccuuuguccuccugcu

SEQ ID NO: 1973801 - RNA, 20 nt, Human
ugcccuuuguccuccugcug

SEQ ID NO: 1973802 - RNA, 18 nt, Human
agcugcauacaguuugca

SEQ ID NO: 1973803 - RNA, 17 nt, Human
agcugcaccccuuccug

SEQ ID NO: 1973804 - RNA, 21 nt, Human
agcugcaccccuuccugggca

SEQ ID NO: 1973805 - RNA, 17 nt, Human
agcugcauaucuucauc

SEQ ID NO: 1973806 - RNA, 13 nt, Human
agcugccaccugc

SEQ ID NO: 1973807 - RNA, 14 nt, Human
agcugccagccgag

SEQ ID NO: 1973808 - RNA, 17 nt, Human
agcggcucaagcccagg

SEQ ID NO: 1973809 - RNA, 18 nt, Human
agcggcucaagcccagga

SEQ ID NO: 1973810 - RNA, 19 nt, Human
agcggcucaagcccaggag

SEQ ID NO: 1973811 - RNA, 17 nt, Human
agcggcccuaagggagu

SEQ ID NO: 1973812 - RNA, 14 nt, Human
agcgcucuggugcu

SEQ ID NO: 1973813 - RNA, 22 nt, Human
agcgcugacgugucaggaaaac

SEQ ID NO: 1973814 - RNA, 16 nt, Human
agcggauugcaaagca

SEQ ID NO: 1973815 - RNA, 11 nt, Human
agcgcucccuu

SEQ ID NO: 1973816 - RNA, 17 nt, Human
agcgcggacauccccug

SEQ ID NO: 1973817 - RNA, 19 nt, Human
agcgcggacauccccugcu

SEQ ID NO: 1973818 - RNA, 21 nt, Human
agccugcgccaccgcccagag

SEQ ID NO: 1973819 - RNA, 18 nt, Human
agccugccccagcgcuga

SEQ ID NO: 1973820 - RNA, 19 nt, Human
agccugccccagcgcugac

SEQ ID NO: 1973821 - RNA, 15 nt, Human
agccugccuugccca

SEQ ID NO: 1973822 - RNA, 23 nt, Human
agccugccuugcccacuccugcu

SEQ ID NO: 1973823 - RNA, 20 nt, Human
agcgcccacuagacccacug

SEQ ID NO: 1973824 - RNA, 14 nt, Human
agccugcuccagcu

SEQ ID NO: 1973825 - RNA, 14 nt, Human
agcgcccaguuggg

SEQ ID NO: 1973826 - RNA, 22 nt, Human
agcgcccaguuggguggaugcc

SEQ ID NO: 1973827 - RNA, 20 nt, Human
agcggcuggaauuggguggg

SEQ ID NO: 1973828 - RNA, 17 nt, Human
agcggcuggacuuggag

SEQ ID NO: 1973829 - RNA, 15 nt, Human
ugcauucuuauucau

SEQ ID NO: 1973830 - RNA, 17 nt, Human
ugcauucuuauucauca

SEQ ID NO: 1973831 - RNA, 15 nt, Human
ugcauucuucugauc

SEQ ID NO: 1973832 - RNA, 19 nt, Human
ugcauuugaaaauuuugau

SEQ ID NO: 1973833 - RNA, 23 nt, Human
ugcauuugaaaauuuugauguuu

SEQ ID NO: 1973834 - RNA, 13 nt, Human
ugcauuuccugac

SEQ ID NO: 1973835 - RNA, 14 nt, Human
ugcauuuccugaca

SEQ ID NO: 1973836 - RNA, 15 nt, Human
agcgugagccacugc

SEQ ID NO: 1973837 - RNA, 16 nt, Human
agcggggacagcuccu

SEQ ID NO: 1973838 - RNA, 17 nt, Human
agcggggacagcuccuu

SEQ ID NO: 1973839 - RNA, 15 nt, Human
agcggggacagcucc

SEQ ID NO: 1973840 - RNA, 20 nt, Human
ugccauauucuguuggccag

SEQ ID NO: 1973841 - RNA, 21 nt, Human
ugccauauucuguuggccagu

SEQ ID NO: 1973842 - RNA, 20 nt, Human
agcgugguggacaugcacag

SEQ ID NO: 1973843 - RNA, 16 nt, Human
agcgugagccacugca

SEQ ID NO: 1973844 - RNA, 17 nt, Human
agcgugagccacugcac

SEQ ID NO: 1973845 - RNA, 23 nt, Human
agcgugguggacaugcacagcua

SEQ ID NO: 1973846 - RNA, 20 nt, Human
ugccagucaccccggccacc

SEQ ID NO: 1973847 - RNA, 18 nt, Human
ugccagucaccccggcca

SEQ ID NO: 1973848 - RNA, 16 nt, Human
ugccagucaccccggc

SEQ ID NO: 1973849 - RNA, 15 nt, Human
ugccagucaccccgg

SEQ ID NO: 1973850 - RNA, 23 nt, Human
ugccacugccucuuccucccuca

SEQ ID NO: 1973851 - RNA, 12 nt, Human
ugccacacuuca

SEQ ID NO: 1973852 - RNA, 20 nt, Human
ugccacuggcaaauguaacu

SEQ ID NO: 1973853 - RNA, 23 nt, Human
ugccagucaccccggccaccugc

SEQ ID NO: 1973854 - RNA, 22 nt, Human
ugccagucaccccggccaccug

SEQ ID NO: 1973855 - RNA, 19 nt, Human
ugccagucccccugcccca

SEQ ID NO: 1973856 - RNA, 17 nt, Human
ugccagucccccugccc

SEQ ID NO: 1973857 - RNA, 16 nt, Human
ugccauauucuguugg

SEQ ID NO: 1973858 - RNA, 17 nt, Human
ugccauauucuguuggc

SEQ ID NO: 1973859 - RNA, 15 nt, Human
ugccauauucuguug

SEQ ID NO: 1973860 - RNA, 13 nt, Human
ugccacuuuccaa

SEQ ID NO: 1973861 - RNA, 18 nt, Human
ugcccaaccugcucuccu

SEQ ID NO: 1973862 - RNA, 22 nt, Human
ugcccaaccugcucuccucuug

SEQ ID NO: 1973863 - RNA, 23 nt, Human
ugcccaaccugcucuccucuugc

SEQ ID NO: 1973864 - RNA, 24 nt, Human
ugcccaaccugcucuccucuugcc

SEQ ID NO: 1973865 - RNA, 18 nt, Human
agcucagggccuggcuca

SEQ ID NO: 1973866 - RNA, 20 nt, Human
ugccauguuggccaggcugg

SEQ ID NO: 1973867 - RNA, 21 nt, Human
ugccauguuggccaggcuggu

SEQ ID NO: 1973868 - RNA, 16 nt, Human
agcucagggccuggcu

SEQ ID NO: 1973869 - RNA, 15 nt, Human
agcucagggccuggc

SEQ ID NO: 1973870 - RNA, 17 nt, Human
agcucagggccuggcuc

SEQ ID NO: 1973871 - RNA, 17 nt, Human
ugccauguuggccaggc

SEQ ID NO: 1973872 - RNA, 18 nt, Human
ugccauguuggccaggcu

SEQ ID NO: 1973873 - RNA, 19 nt, Human
ugccauguuggccaggcug

SEQ ID NO: 1973874 - RNA, 19 nt, Human
agcuaguugaauacuugaa

SEQ ID NO: 1973875 - RNA, 20 nt, Human
agcuaguugaauacuugaac

SEQ ID NO: 1973876 - RNA, 16 nt, Human
agcuauaaauuauauu

SEQ ID NO: 1973877 - RNA, 18 nt, Human
agcuauaauuauuauuca

SEQ ID NO: 1973878 - RNA, 24 nt, Human
agcuaguugaauacuugaaccaua

SEQ ID NO: 1973879 - RNA, 22 nt, Human
agcuaguugaauacuugaacca

SEQ ID NO: 1973880 - RNA, 23 nt, Human
agcuaguugaauacuugaaccau

SEQ ID NO: 1973881 - RNA, 19 nt, Human
agcuauggugucauaggcu

SEQ ID NO: 1973882 - RNA, 13 nt, Human
agcuauaggaaau

SEQ ID NO: 1973883 - RNA, 12 nt, Human
agcuaugacuua

SEQ ID NO: 1973884 - RNA, 16 nt, Human
agcuaugacuuaacau

SEQ ID NO: 1973885 - RNA, 13 nt, Human
agcuaugagagga

SEQ ID NO: 1973886 - RNA, 13 nt, Human
agcuaugcaaaaa

SEQ ID NO: 1973887 - RNA, 17 nt, Human
agcuaugcaaaaagcua

SEQ ID NO: 1973888 - RNA, 20 nt, Human
agcuauggacagcauugcca

SEQ ID NO: 1973889 - RNA, 15 nt, Human
ugcccaggccugccu

SEQ ID NO: 1973890 - RNA, 17 nt, Human
ugcccaggccugccugu

SEQ ID NO: 1973891 - RNA, 12 nt, Human
ugcccaggcccc

SEQ ID NO: 1973892 - RNA, 14 nt, Human
ugcccaggccccug

SEQ ID NO: 1973893 - RNA, 20 nt, Human
ugcccaggccccugccaccc

SEQ ID NO: 1973894 - RNA, 22 nt, Human
ugcccaggccccugccacccug

SEQ ID NO: 1973895 - RNA, 14 nt, Human
ugcccacaggauca

SEQ ID NO: 1973896 - RNA, 15 nt, Human
ugcccaggcaggucu

SEQ ID NO: 1973897 - RNA, 20 nt, Human
ugcccaaugagacucuaggg

SEQ ID NO: 1973898 - RNA, 21 nt, Human
ugcccaaugagacucuagggu

SEQ ID NO: 1973899 - RNA, 16 nt, Human
ugcccaggcaggucuu

SEQ ID NO: 1973900 - RNA, 17 nt, Human
ugcccaggcaggucuug

SEQ ID NO: 1973901 - RNA, 20 nt, Human
ugcccaggcaggucuugaac

SEQ ID NO: 1973902 - RNA, 11 nt, Human
ugcccaggccc

SEQ ID NO: 1973903 - RNA, 12 nt, Human
ugccccccagcc

SEQ ID NO: 1973904 - RNA, 19 nt, Human
ugccccucaacucuccucc

SEQ ID NO: 1973905 - RNA, 16 nt, Human
ugccccgucccccucu

SEQ ID NO: 1973906 - RNA, 18 nt, Human
ugccccgucccccucugg

SEQ ID NO: 1973907 - RNA, 19 nt, Human
ugccccgucuacagcuccc

SEQ ID NO: 1973908 - RNA, 20 nt, Human
ugccccgucuacagcucccc

SEQ ID NO: 1973909 - RNA, 18 nt, Human
agccuaaaaauaaagcac

SEQ ID NO: 1973910 - RNA, 23 nt, Human
agccuaaaaauaaagcacaaacc

SEQ ID NO: 1973911 - RNA, 12 nt, Human
agccuaaagauu

SEQ ID NO: 1973912 - RNA, 16 nt, Human
agccuaaagauuuuga

SEQ ID NO: 1973913 - RNA, 20 nt, Human
agccuaaagauuuugaucuc

SEQ ID NO: 1973914 - RNA, 17 nt, Human
agccuaagauauacuug

SEQ ID NO: 1973915 - RNA, 18 nt, Human
agccuaagauauacuugu

SEQ ID NO: 1973916 - RNA, 21 nt, Human
agccuaagauauacuuguuuu

SEQ ID NO: 1973917 - RNA, 23 nt, Human
agccguuuguuccccaagacauu

SEQ ID NO: 1973918 - RNA, 13 nt, Human
agccuaaaaauaa

SEQ ID NO: 1973919 - RNA, 14 nt, Human
agccuaaaaauaaa

SEQ ID NO: 1973920 - RNA, 16 nt, Human
agccuaaaaauaaagc

SEQ ID NO: 1973921 - RNA, 17 nt, Human
agccuaaaaauaaagca

SEQ ID NO: 1973922 - RNA, 15 nt, Human
agccuaggugacaga

SEQ ID NO: 1973923 - RNA, 17 nt, Human
agccuaggugacagagu

SEQ ID NO: 1973924 - RNA, 18 nt, Human
agccucaaaacaaaggcc

SEQ ID NO: 1973925 - RNA, 15 nt, Human
agccucaaccuccug

SEQ ID NO: 1973926 - RNA, 20 nt, Human
agccucaaaacaaaggccua

SEQ ID NO: 1973927 - RNA, 16 nt, Human
agccucaaauccagga

SEQ ID NO: 1973928 - RNA, 18 nt, Human
agccucaaauccaggacc

SEQ ID NO: 1973929 - RNA, 19 nt, Human
agccucaaauccaggaccc

SEQ ID NO: 1973930 - RNA, 20 nt, Human
agccucaaauccaggacccu

SEQ ID NO: 1973931 - RNA, 21 nt, Human
agccucaaauccaggacccug

SEQ ID NO: 1973932 - RNA, 22 nt, Human
agccucaaauccaggacccugc

SEQ ID NO: 1973933 - RNA, 22 nt, Human
ugcagacucuacagaggccaug

SEQ ID NO: 1973934 - RNA, 19 nt, Human
agcccuuccaugucgccuc

SEQ ID NO: 1973935 - RNA, 22 nt, Human
agcccuuccaugucgccucugc

SEQ ID NO: 1973936 - RNA, 23 nt, Human
agcccuuccaugucgccucugca

SEQ ID NO: 1973937 - RNA, 12 nt, Human
agcccuuccucu

SEQ ID NO: 1973938 - RNA, 13 nt, Human
agcccuucauuug

SEQ ID NO: 1973939 - RNA, 14 nt, Human
agcccuucauuugg

SEQ ID NO: 1973940 - RNA, 15 nt, Human
ugcacuccccugcug

SEQ ID NO: 1973941 - RNA, 21 nt, Human
ugcacuuuucuaaacuaggcu

SEQ ID NO: 1973942 - RNA, 14 nt, Human
ugcacuuuuucuua

SEQ ID NO: 1973943 - RNA, 20 nt, Human
ugcacuuuuucuuaaucauu

SEQ ID NO: 1973944 - RNA, 19 nt, Human
ugcagacucuacagaggcc

SEQ ID NO: 1973945 - RNA, 20 nt, Human
ugcagacucuacagaggcca

SEQ ID NO: 1973946 - RNA, 16 nt, Human
ugcacuaagucucuuu

SEQ ID NO: 1973947 - RNA, 16 nt, Human
ugcacguuuucaucuc

SEQ ID NO: 1973948 - RNA, 23 nt, Human
ugcacuaagucucuuuuuuacaa

SEQ ID NO: 1973949 - RNA, 13 nt, Human
ugcacuccccugc

SEQ ID NO: 1973950 - RNA, 12 nt, Human
ugcacuccccug

SEQ ID NO: 1973951 - RNA, 22 nt, Human
ugcacuauagccuaggugacag

SEQ ID NO: 1973952 - RNA, 15 nt, Human
ugcaccacugcacuc

SEQ ID NO: 1973953 - RNA, 14 nt, Human
ugcaccacugcacu

SEQ ID NO: 1973954 - RNA, 14 nt, Human
ugcacaagcugcac

SEQ ID NO: 1973955 - RNA, 15 nt, Human
ugcacacaccagagc

SEQ ID NO: 1973956 - RNA, 13 nt, Human
ugcacaauuccau

SEQ ID NO: 1973957 - RNA, 21 nt, Human
ugcacaauuccaugacaauau

SEQ ID NO: 1973958 - RNA, 22 nt, Human
ugcacaugauuucacaaauauu

SEQ ID NO: 1973959 - RNA, 23 nt, Human
ugcacaugauuucacaaauauua

SEQ ID NO: 1973960 - RNA, 18 nt, Human
ugcacaugauuucacaaa

SEQ ID NO: 1973961 - RNA, 19 nt, Human
ugcacaugauuucacaaau

SEQ ID NO: 1973962 - RNA, 20 nt, Human
ugcacaugauuucacaaaua

SEQ ID NO: 1973963 - RNA, 21 nt, Human
ugcacaugauuucacaaauau

SEQ ID NO: 1973964 - RNA, 12 nt, Human
ugcacaugauuu

SEQ ID NO: 1973965 - RNA, 14 nt, Human
ugcacaugauuuca

SEQ ID NO: 1973966 - RNA, 15 nt, Human
ugcacaugauuucac

SEQ ID NO: 1973967 - RNA, 16 nt, Human
ugcacaugauuucaca

SEQ ID NO: 1973968 - RNA, 17 nt, Human
ugcacaugauuucacaa

SEQ ID NO: 1973969 - RNA, 23 nt, Human
ugcacaagcuccaagcucccagg

SEQ ID NO: 1973970 - RNA, 22 nt, Human
ugcacaagcuccaagcucccag

SEQ ID NO: 1973971 - RNA, 20 nt, Human
ugcacaagcuccaagcuccc

SEQ ID NO: 1973972 - RNA, 18 nt, Human
ugcacaagcuccaagcuc

SEQ ID NO: 1973973 - RNA, 16 nt, Human
ugcacaagcuccaagc

SEQ ID NO: 1973974 - RNA, 15 nt, Human
ugcacaagcuccaag

SEQ ID NO: 1973975 - RNA, 23 nt, Human
agcagcaaggucuugcucuccua

SEQ ID NO: 1973976 - RNA, 13 nt, Human
agcagcacccauc

SEQ ID NO: 1973977 - RNA, 14 nt, Human
agcagcaaggucuu

SEQ ID NO: 1973978 - RNA, 18 nt, Human
agcagcaaggucuugcuc

SEQ ID NO: 1973979 - RNA, 12 nt, Human
agccugcagagc

SEQ ID NO: 1973980 - RNA, 13 nt, Human
agccugcagagcu

SEQ ID NO: 1973981 - RNA, 14 nt, Human
agccugcagagcug

SEQ ID NO: 1973982 - RNA, 15 nt, Human
agccugcagagcugc

SEQ ID NO: 1973983 - RNA, 20 nt, Human
agccugcacuugggggcuca

SEQ ID NO: 1973984 - RNA, 16 nt, Human
ugcaugcugucccuua

SEQ ID NO: 1973985 - RNA, 18 nt, Human
agccugaucaccugcccu

SEQ ID NO: 1973986 - RNA, 19 nt, Human
agccugaucaccugcccug

SEQ ID NO: 1973987 - RNA, 19 nt, Human
agccugccucuucucuacu

SEQ ID NO: 1973988 - RNA, 16 nt, Human
agccugccucuucucu

SEQ ID NO: 1973989 - RNA, 18 nt, Human
agccugccacucaggccc

SEQ ID NO: 1973990 - RNA, 12 nt, Human
agccugcccucc

SEQ ID NO: 1973991 - RNA, 12 nt, Human
agccugcccagc

SEQ ID NO: 1973992 - RNA, 23 nt, Human
agccugcccagcccccuggucuu

SEQ ID NO: 1973993 - RNA, 14 nt, Human
agccugccccagcg

SEQ ID NO: 1973994 - RNA, 16 nt, Human
agccugccccagcgcu

SEQ ID NO: 1973995 - RNA, 23 nt, Human
agccugcaguuauuaacacuaac

SEQ ID NO: 1973996 - RNA, 23 nt, Human
agccugcacuugggggcucagca

SEQ ID NO: 1973997 - RNA, 21 nt, Human
ugcaugaggcuaguguggugu

SEQ ID NO: 1973998 - RNA, 22 nt, Human
ugcaugaaguaauaugcacaca

SEQ ID NO: 1973999 - RNA, 20 nt, Human
ugcaugaaguaauaugcaca

SEQ ID NO: 1974000 - RNA, 20 nt, Human
ugcaucuggguagcuguaag

SEQ ID NO: 1974001 - RNA, 21 nt, Human
ugcaucuggguagcuguaagg

SEQ ID NO: 1974002 - RNA, 15 nt, Human
ugcaugcugucccuu

SEQ ID NO: 1974003 - RNA, 14 nt, Human
ugcaugcugucccu

SEQ ID NO: 1974004 - RNA, 13 nt, Human
ugcaugcuguccc

SEQ ID NO: 1974005 - RNA, 18 nt, Human
ugcaucuggguagcugua

SEQ ID NO: 1974006 - RNA, 19 nt, Human
ugcaucuggguagcuguaa

SEQ ID NO: 1974007 - RNA, 12 nt, Human
ugcauacaaaca

SEQ ID NO: 1974008 - RNA, 13 nt, Human
ugcauacaaacaa

SEQ ID NO: 1974009 - RNA, 20 nt, Human
ugcauacaaacaagcauaua

SEQ ID NO: 1974010 - RNA, 22 nt, Human
ugcauacaaacaagcauauaaa

SEQ ID NO: 1974011 - RNA, 23 nt, Human
ugcauacaaacaagcauauaaaa

SEQ ID NO: 1974012 - RNA, 21 nt, Human
ugcauaccacuuuuguucuug

SEQ ID NO: 1974013 - RNA, 22 nt, Human
ugcauaccacuuuuguucuugg

SEQ ID NO: 1974014 - RNA, 17 nt, Human
agccucaaccuccuggg

SEQ ID NO: 1974015 - RNA, 18 nt, Human
agccucaaccuccugggc

SEQ ID NO: 1974016 - RNA, 13 nt, Human
agccucagcaucc

SEQ ID NO: 1974017 - RNA, 14 nt, Human
agccucagcauccu

SEQ ID NO: 1974018 - RNA, 16 nt, Human
agccucagcauccugg

SEQ ID NO: 1974019 - RNA, 15 nt, Human
agccucagcauccug

SEQ ID NO: 1974020 - RNA, 18 nt, Human
agccugagcgacagugag

SEQ ID NO: 1974021 - RNA, 18 nt, Human
ugcagccucaaccuccug

SEQ ID NO: 1974022 - RNA, 19 nt, Human
ugcagccucaaccuccugg

SEQ ID NO: 1974023 - RNA, 19 nt, Human
agccugagcgacagugaga

SEQ ID NO: 1974024 - RNA, 13 nt, Human
agccugagagucu

SEQ ID NO: 1974025 - RNA, 19 nt, Human
ugcagugagccgagauugu

SEQ ID NO: 1974026 - RNA, 11 nt, Human
ugcauaaaaug

SEQ ID NO: 1974027 - RNA, 22 nt, Human
ugcagucuuagaucauaguuuu

SEQ ID NO: 1974028 - RNA, 15 nt, Human
ugcauaauggucaga

SEQ ID NO: 1974029 - RNA, 19 nt, Human
ugcauaauucugaaguuau

SEQ ID NO: 1974030 - RNA, 23 nt, Human
ugcauaauucugaaguuauauuu

SEQ ID NO: 1974031 - RNA, 11 nt, Human
ugcauaauaau

SEQ ID NO: 1974032 - RNA, 23 nt, Human
ugcauaauaauccugcaaaguac

SEQ ID NO: 1974033 - RNA, 20 nt, Human
ugcaggucccuaauaaagcu

SEQ ID NO: 1974034 - RNA, 19 nt, Human
ugcaggucccuaauaaagc

SEQ ID NO: 1974035 - RNA, 18 nt, Human
ugcaggucccuaauaaag

SEQ ID NO: 1974036 - RNA, 14 nt, Human
ugcagugagccgag

SEQ ID NO: 1974037 - RNA, 17 nt, Human
ugcaggucccuaauaaa

SEQ ID NO: 1974038 - RNA, 21 nt, Human
ugcaggucccuaauaaagcug

SEQ ID NO: 1974039 - RNA, 18 nt, Human
acuuuaccuuuuuuauac

SEQ ID NO: 1974040 - RNA, 13 nt, Human
acuuguuguuuaa

SEQ ID NO: 1974041 - RNA, 16 nt, Human
acuuguuguuuaaugu

SEQ ID NO: 1974042 - RNA, 18 nt, Human
acuuguuguuuaauguuu

SEQ ID NO: 1974043 - RNA, 20 nt, Human
acuuguuguuuaauguuuaa

SEQ ID NO: 1974044 - RNA, 13 nt, Human
acuuguuuaauaa

SEQ ID NO: 1974045 - RNA, 16 nt, Human
acuuguugccuauaag

SEQ ID NO: 1974046 - RNA, 21 nt, Human
acuuguugccuauaagccaaa

SEQ ID NO: 1974047 - RNA, 19 nt, Human
acuuuaccuuuuuuauaca

SEQ ID NO: 1974048 - RNA, 22 nt, Human
acuuuaccuuuuuuauacauaa

SEQ ID NO: 1974049 - RNA, 23 nt, Human
acuuuaccuuuuuuauacauaaa

SEQ ID NO: 1974050 - RNA, 12 nt, Human
acuuguuucuau

SEQ ID NO: 1974051 - RNA, 14 nt, Human
acuuguuuaauaaa

SEQ ID NO: 1974052 - RNA, 19 nt, Human
acuuugaccucugcagcaa

SEQ ID NO: 1974053 - RNA, 23 nt, Human
acuuugaccucugcagcaauaaa

SEQ ID NO: 1974054 - RNA, 14 nt, Human
acuuuggaaagacu

SEQ ID NO: 1974055 - RNA, 13 nt, Human
acuuuggaaagac

SEQ ID NO: 1974056 - RNA, 16 nt, Human
acuuugagaucuaaaa

SEQ ID NO: 1974057 - RNA, 17 nt, Human
acuuugagaucuaaaaa

SEQ ID NO: 1974058 - RNA, 18 nt, Human
acuuugagaucuaaaaau

SEQ ID NO: 1974059 - RNA, 19 nt, Human
acuuugagaucuaaaaaua

SEQ ID NO: 1974060 - RNA, 21 nt, Human
acuuugagaucuaaaaauaac

SEQ ID NO: 1974061 - RNA, 17 nt, Human
acuuuggaaagacuuuu

SEQ ID NO: 1974062 - RNA, 18 nt, Human
acuuuuuugaaaucagua

SEQ ID NO: 1974063 - RNA, 16 nt, Human
acuuuuuugaaaucag

SEQ ID NO: 1974064 - RNA, 22 nt, Human
acuuuuuuuuuuuaagaguaaa

SEQ ID NO: 1974065 - RNA, 14 nt, Human
acuuuuggaaggua

SEQ ID NO: 1974066 - RNA, 14 nt, Human
acuuuuggcauuuu

SEQ ID NO: 1974067 - RNA, 19 nt, Human
acuuuuucuuaaucauuuu

SEQ ID NO: 1974068 - RNA, 18 nt, Human
ucucccuuggauuguccc

SEQ ID NO: 1974069 - RNA, 11 nt, Human
ucucccuugga

SEQ ID NO: 1974070 - RNA, 18 nt, Human
ucucccaaagugcuggga

SEQ ID NO: 1974071 - RNA, 19 nt, Human
ucuccauuuuggugucuuu

SEQ ID NO: 1974072 - RNA, 22 nt, Human
ucuccauuuuggugucuuucuc

SEQ ID NO: 1974073 - RNA, 14 nt, Human
ucucccacaugcca

SEQ ID NO: 1974074 - RNA, 17 nt, Human
ucuccauuucacuggcu

SEQ ID NO: 1974075 - RNA, 20 nt, Human
acuguauagcucuuuuccua

SEQ ID NO: 1974076 - RNA, 23 nt, Human
acuguagauaauuaaccaaggua

SEQ ID NO: 1974077 - RNA, 21 nt, Human
ucucccuuggauuguccccga

SEQ ID NO: 1974078 - RNA, 19 nt, Human
ucucccuuggauugucccc

SEQ ID NO: 1974079 - RNA, 15 nt, Human
ucuccgccccugagc

SEQ ID NO: 1974080 - RNA, 16 nt, Human
ucuccgccccugagcc

SEQ ID NO: 1974081 - RNA, 17 nt, Human
ucuccgccccugagccc

SEQ ID NO: 1974082 - RNA, 18 nt, Human
ucuccgccccugagccca

SEQ ID NO: 1974083 - RNA, 19 nt, Human
ucuccgccccugagcccac

SEQ ID NO: 1974084 - RNA, 20 nt, Human
ucuccgccccugagcccacu

SEQ ID NO: 1974085 - RNA, 12 nt, Human
ucuccucugcug

SEQ ID NO: 1974086 - RNA, 21 nt, Human
ucuccgccccugagcccacug

SEQ ID NO: 1974087 - RNA, 14 nt, Human
ucuccucugcugcu

SEQ ID NO: 1974088 - RNA, 13 nt, Human
ucuccucugcugc

SEQ ID NO: 1974089 - RNA, 19 nt, Human
acuuguugauuaauggaaa

SEQ ID NO: 1974090 - RNA, 12 nt, Human
acuuguucuucc

SEQ ID NO: 1974091 - RNA, 13 nt, Human
acuuguucuucca

SEQ ID NO: 1974092 - RNA, 19 nt, Human
acuuguucuuccaaagcag

SEQ ID NO: 1974093 - RNA, 21 nt, Human
acuuguucuuccaaagcagag

SEQ ID NO: 1974094 - RNA, 21 nt, Human
acuuguugauuaauggaaaug

SEQ ID NO: 1974095 - RNA, 14 nt, Human
acuuguugaauuua

SEQ ID NO: 1974096 - RNA, 15 nt, Human
acuuguugccuauaa

SEQ ID NO: 1974097 - RNA, 15 nt, Human
ucucuccagccccug

SEQ ID NO: 1974098 - RNA, 20 nt, Human
ucucuccuguaccucuugag

SEQ ID NO: 1974099 - RNA, 22 nt, Human
ucucuccuguaccucuugagcc

SEQ ID NO: 1974100 - RNA, 13 nt, Human
ucuccuuccugug

SEQ ID NO: 1974101 - RNA, 14 nt, Human
ucuccuuccugugu

SEQ ID NO: 1974102 - RNA, 16 nt, Human
ucuccuuccugugugu

SEQ ID NO: 1974103 - RNA, 14 nt, Human
ucucuccagccccu

SEQ ID NO: 1974104 - RNA, 13 nt, Human
ucucuccagcccc

SEQ ID NO: 1974105 - RNA, 18 nt, Human
acuuuuuuuuuauuuuau

SEQ ID NO: 1974106 - RNA, 14 nt, Human
agaaaaaaaaagaa

SEQ ID NO: 1974107 - RNA, 15 nt, Human
agaaaaaaaaagaaa

SEQ ID NO: 1974108 - RNA, 16 nt, Human
agaaaaaaaaagaaaa

SEQ ID NO: 1974109 - RNA, 18 nt, Human
ucuccuucaccuuugucc

SEQ ID NO: 1974110 - RNA, 20 nt, Human
ucuccuucaccuuugucccc

SEQ ID NO: 1974111 - RNA, 14 nt, Human
ucucuugagagggu

SEQ ID NO: 1974112 - RNA, 21 nt, Human
ucucuucuggguuccuuccuc

SEQ ID NO: 1974113 - RNA, 13 nt, Human
ucucuucuguguu

SEQ ID NO: 1974114 - RNA, 14 nt, Human
ucucuucuguguuu

SEQ ID NO: 1974115 - RNA, 18 nt, Human
ucucuucuggguuccuuc

SEQ ID NO: 1974116 - RNA, 19 nt, Human
ucucuucuggguuccuucc

SEQ ID NO: 1974117 - RNA, 20 nt, Human
ucucuucuggguuccuuccu

SEQ ID NO: 1974118 - RNA, 13 nt, Human
ucucuggccuucg

SEQ ID NO: 1974119 - RNA, 16 nt, Human
ucucuggccuucggcc

SEQ ID NO: 1974120 - RNA, 17 nt, Human
ucucuggccuucggccu

SEQ ID NO: 1974121 - RNA, 22 nt, Human
ucucugcccuaaugcgcaggcu

SEQ ID NO: 1974122 - RNA, 11 nt, Human
ucucugcccua

SEQ ID NO: 1974123 - RNA, 15 nt, Human
ucucugcccagcuuu

SEQ ID NO: 1974124 - RNA, 19 nt, Human
ucucugcccagcuuuucau

SEQ ID NO: 1974125 - RNA, 22 nt, Human
agaaaaccaaacaaaaauguua

SEQ ID NO: 1974126 - RNA, 19 nt, Human
agaaaccaggaguaaaaga

SEQ ID NO: 1974127 - RNA, 13 nt, Human
agaaacuggaacu

SEQ ID NO: 1974128 - RNA, 15 nt, Human
agaaacuggaacucu

SEQ ID NO: 1974129 - RNA, 19 nt, Human
agaaacucuauggucuuau

SEQ ID NO: 1974130 - RNA, 12 nt, Human
agaaagaaauua

SEQ ID NO: 1974131 - RNA, 16 nt, Human
agaaagaacuaucuuc

SEQ ID NO: 1974132 - RNA, 14 nt, Human
agaaagaacuaucu

SEQ ID NO: 1974133 - RNA, 17 nt, Human
agaaacuggaaauacua

SEQ ID NO: 1974134 - RNA, 18 nt, Human
agaaaacacuguuaucau

SEQ ID NO: 1974135 - RNA, 21 nt, Human
agaaaacacuguuaucauuuu

SEQ ID NO: 1974136 - RNA, 14 nt, Human
agaaaacaauggaa

SEQ ID NO: 1974137 - RNA, 13 nt, Human
agaaaacacuguu

SEQ ID NO: 1974138 - RNA, 14 nt, Human
agaaaacacuguua

SEQ ID NO: 1974139 - RNA, 17 nt, Human
agaaaaaugagccuggc

SEQ ID NO: 1974140 - RNA, 11 nt, Human
agaaaaauauu

SEQ ID NO: 1974141 - RNA, 15 nt, Human
agaaaaauaucugua

SEQ ID NO: 1974142 - RNA, 18 nt, Human
agaaaaauaucuguaaga

SEQ ID NO: 1974143 - RNA, 12 nt, Human
agaaaaauauuu

SEQ ID NO: 1974144 - RNA, 13 nt, Human
agaaaaauauuua

SEQ ID NO: 1974145 - RNA, 18 nt, Human
agaaaaaggaugcacaga

SEQ ID NO: 1974146 - RNA, 19 nt, Human
agaaaaauaugaccacacu

SEQ ID NO: 1974147 - RNA, 15 nt, Human
ucucuugagccuggg

SEQ ID NO: 1974148 - RNA, 14 nt, Human
ucucuugagccugg

SEQ ID NO: 1974149 - RNA, 13 nt, Human
ucucuugagccug

SEQ ID NO: 1974150 - RNA, 22 nt, Human
ucucuuuaaugucacaggcagg

SEQ ID NO: 1974151 - RNA, 11 nt, Human
ucuggcccuau

SEQ ID NO: 1974152 - RNA, 21 nt, Human
ucuggccccacaccagcccca

SEQ ID NO: 1974153 - RNA, 16 nt, Human
ucuggcagcucagaga

SEQ ID NO: 1974154 - RNA, 18 nt, Human
agaagcuaagguuuagau

SEQ ID NO: 1974155 - RNA, 16 nt, Human
agaagcggcuggcagc

SEQ ID NO: 1974156 - RNA, 15 nt, Human
agaagcggcuggcag

SEQ ID NO: 1974157 - RNA, 22 nt, Human
ucuggcagcaccgccucuuccc

SEQ ID NO: 1974158 - RNA, 13 nt, Human
ucuggauucagcc

SEQ ID NO: 1974159 - RNA, 14 nt, Human
ucuggauucagccu

SEQ ID NO: 1974160 - RNA, 15 nt, Human
ucuggauucagccuu

SEQ ID NO: 1974161 - RNA, 16 nt, Human
ucuggauucagccuuc

SEQ ID NO: 1974162 - RNA, 17 nt, Human
ucuggauucagccuucu

SEQ ID NO: 1974163 - RNA, 18 nt, Human
ucuggauucagccuucuu

SEQ ID NO: 1974164 - RNA, 19 nt, Human
ucuggauucagccuucuuu

SEQ ID NO: 1974165 - RNA, 15 nt, Human
ucuggauucauauuu

SEQ ID NO: 1974166 - RNA, 15 nt, Human
ucuggcagcucagag

SEQ ID NO: 1974167 - RNA, 14 nt, Human
ucuggcagcucaga

SEQ ID NO: 1974168 - RNA, 18 nt, Human
ucuggauuauauuaugaa

SEQ ID NO: 1974169 - RNA, 12 nt, Human
ucuggauuauau

SEQ ID NO: 1974170 - RNA, 23 nt, Human
ucugcuuuuuaaagaaugcucuu

SEQ ID NO: 1974171 - RNA, 18 nt, Human
ucuggagguacgaaaaga

SEQ ID NO: 1974172 - RNA, 12 nt, Human
ucugcuuaaaaa

SEQ ID NO: 1974173 - RNA, 16 nt, Human
ucugcuuaaaaacuca

SEQ ID NO: 1974174 - RNA, 22 nt, Human
ucugcugugggcacaggucagg

SEQ ID NO: 1974175 - RNA, 23 nt, Human
ucugcugugggcacaggucaggc

SEQ ID NO: 1974176 - RNA, 17 nt, Human
ucugcucacauaucugu

SEQ ID NO: 1974177 - RNA, 13 nt, Human
ucugcuagagagu

SEQ ID NO: 1974178 - RNA, 16 nt, Human
ucugcucacauaucug

SEQ ID NO: 1974179 - RNA, 13 nt, Human
ucugccuuugcuc

SEQ ID NO: 1974180 - RNA, 21 nt, Human
ucugccuuuuguucauuucau

SEQ ID NO: 1974181 - RNA, 14 nt, Human
ucugcccuccaaga

SEQ ID NO: 1974182 - RNA, 13 nt, Human
agaagaaagaacu

SEQ ID NO: 1974183 - RNA, 15 nt, Human
agaagaaagaacuau

SEQ ID NO: 1974184 - RNA, 13 nt, Human
agaagaaacuagg

SEQ ID NO: 1974185 - RNA, 19 nt, Human
ucugagggcuuguaguucu

SEQ ID NO: 1974186 - RNA, 20 nt, Human
ucugagggcuuguaguucuu

SEQ ID NO: 1974187 - RNA, 17 nt, Human
ucugagggcuuguaguu

SEQ ID NO: 1974188 - RNA, 16 nt, Human
ucugauacagaaaagu

SEQ ID NO: 1974189 - RNA, 17 nt, Human
ucugauacagaaaaguu

SEQ ID NO: 1974190 - RNA, 13 nt, Human
ucugauacuuuuu

SEQ ID NO: 1974191 - RNA, 17 nt, Human
ucugauacuuuuuugaa

SEQ ID NO: 1974192 - RNA, 19 nt, Human
ucugauacuuuuuugaaau

SEQ ID NO: 1974193 - RNA, 16 nt, Human
ucugaucacugaaaua

SEQ ID NO: 1974194 - RNA, 22 nt, Human
ucugaucacugaaauaaaagcu

SEQ ID NO: 1974195 - RNA, 14 nt, Human
ucugauauguuugu

SEQ ID NO: 1974196 - RNA, 19 nt, Human
ucugauucccaagcucugc

SEQ ID NO: 1974197 - RNA, 20 nt, Human
ucugauucccaagcucugcu

SEQ ID NO: 1974198 - RNA, 21 nt, Human
ucugauucccaagcucugcuc

SEQ ID NO: 1974199 - RNA, 22 nt, Human
ucugcacuccccugcugggugu

SEQ ID NO: 1974200 - RNA, 18 nt, Human
ucugaucacugaaauaaa

SEQ ID NO: 1974201 - RNA, 19 nt, Human
ucugacccugcuucaaaua

SEQ ID NO: 1974202 - RNA, 19 nt, Human
ucugacuuuagccuaccua

SEQ ID NO: 1974203 - RNA, 11 nt, Human
agaaauguguu

SEQ ID NO: 1974204 - RNA, 12 nt, Human
ucugcagagcag

SEQ ID NO: 1974205 - RNA, 19 nt, Human
agaaaugucccuuucuucu

SEQ ID NO: 1974206 - RNA, 12 nt, Human
agaaauuaacuu

SEQ ID NO: 1974207 - RNA, 13 nt, Human
agaaauuaacuua

SEQ ID NO: 1974208 - RNA, 14 nt, Human
agaaauugguaccu

SEQ ID NO: 1974209 - RNA, 17 nt, Human
agaaauguacagcaagg

SEQ ID NO: 1974210 - RNA, 16 nt, Human
agaaauguacagcaag

SEQ ID NO: 1974211 - RNA, 20 nt, Human
agaacaaaggggcuuaauua

SEQ ID NO: 1974212 - RNA, 23 nt, Human
agaaauugguaccuugcacacau

SEQ ID NO: 1974213 - RNA, 21 nt, Human
agaaauugguaccuugcacac

SEQ ID NO: 1974214 - RNA, 22 nt, Human
agaaauugguaccuugcacaca

SEQ ID NO: 1974215 - RNA, 16 nt, Human
agaaauugguaccuug

SEQ ID NO: 1974216 - RNA, 18 nt, Human
agaaauugguaccuugca

SEQ ID NO: 1974217 - RNA, 19 nt, Human
agaaauugguaccuugcac

SEQ ID NO: 1974218 - RNA, 20 nt, Human
agaaauugguaccuugcaca

SEQ ID NO: 1974219 - RNA, 17 nt, Human
agaacuaaaauguucua

SEQ ID NO: 1974220 - RNA, 15 nt, Human
agaacucaugugauu

SEQ ID NO: 1974221 - RNA, 18 nt, Human
agaacucaugugauuuac

SEQ ID NO: 1974222 - RNA, 14 nt, Human
agaacucccuuuca

SEQ ID NO: 1974223 - RNA, 20 nt, Human
agaacucgguguccccacca

SEQ ID NO: 1974224 - RNA, 12 nt, Human
agaacucugccu

SEQ ID NO: 1974225 - RNA, 18 nt, Human
agaacucgguguccccac

SEQ ID NO: 1974226 - RNA, 19 nt, Human
agaacucgguguccccacc

SEQ ID NO: 1974227 - RNA, 13 nt, Human
agaacucugccug

SEQ ID NO: 1974228 - RNA, 14 nt, Human
agaacucugccugc

SEQ ID NO: 1974229 - RNA, 17 nt, Human
agaacucugccugcccu

SEQ ID NO: 1974230 - RNA, 23 nt, Human
agaacucugccugcccuuugucc

SEQ ID NO: 1974231 - RNA, 13 nt, Human
agaacucuuccuc

SEQ ID NO: 1974232 - RNA, 22 nt, Human
agaacucuuccuccaaggacag

SEQ ID NO: 1974233 - RNA, 12 nt, Human
agaacucuuccu

SEQ ID NO: 1974234 - RNA, 16 nt, Human
agaacugaaaggcuuu

SEQ ID NO: 1974235 - RNA, 20 nt, Human
agaacugaaaggcuuuucaa

SEQ ID NO: 1974236 - RNA, 14 nt, Human
agaaggaagcaggu

SEQ ID NO: 1974237 - RNA, 15 nt, Human
ucuggggaccagcuu

SEQ ID NO: 1974238 - RNA, 23 nt, Human
ucuggggaccagcuuggcucagg

SEQ ID NO: 1974239 - RNA, 17 nt, Human
ucuggggagcuggacag

SEQ ID NO: 1974240 - RNA, 18 nt, Human
ucugguccauagagagca

SEQ ID NO: 1974241 - RNA, 16 nt, Human
ucuggguuccuuccuc

SEQ ID NO: 1974242 - RNA, 22 nt, Human
ucugggugcaggagcgcucccu

SEQ ID NO: 1974243 - RNA, 11 nt, Human
ucuggggcugu

SEQ ID NO: 1974244 - RNA, 14 nt, Human
ucuggguucacugc

SEQ ID NO: 1974245 - RNA, 16 nt, Human
ucuggguucacugcaa

SEQ ID NO: 1974246 - RNA, 20 nt, Human
ucugucauuugagcagggcu

SEQ ID NO: 1974247 - RNA, 23 nt, Human
ucugucauuugagcagggcucag

SEQ ID NO: 1974248 - RNA, 18 nt, Human
ucuguccaacugagaagu

SEQ ID NO: 1974249 - RNA, 15 nt, Human
ucugucauuugagca

SEQ ID NO: 1974250 - RNA, 20 nt, Human
ucuguauagacaggagaaga

SEQ ID NO: 1974251 - RNA, 23 nt, Human
ucuguauagacaggagaagaaag

SEQ ID NO: 1974252 - RNA, 20 nt, Human
ucuggucuauaccuuaagaa

SEQ ID NO: 1974253 - RNA, 20 nt, Human
agaauugucuuucugucucu

SEQ ID NO: 1974254 - RNA, 12 nt, Human
agaauuggaaaa

SEQ ID NO: 1974255 - RNA, 18 nt, Human
agaauuggaaaagacuaa

SEQ ID NO: 1974256 - RNA, 14 nt, Human
agaauuguuuagau

SEQ ID NO: 1974257 - RNA, 23 nt, Human
ucuguuggguggcaucauuccag

SEQ ID NO: 1974258 - RNA, 14 nt, Human
ucuguuugcuguug

SEQ ID NO: 1974259 - RNA, 15 nt, Human
agaauuguuuagauu

SEQ ID NO: 1974260 - RNA, 12 nt, Human
agaauuuaaaga

SEQ ID NO: 1974261 - RNA, 13 nt, Human
agaauuuaaagaa

SEQ ID NO: 1974262 - RNA, 21 nt, Human
agaauuuaaagaaaaaaaugu

SEQ ID NO: 1974263 - RNA, 18 nt, Human
agaauuucccaaagcagu

SEQ ID NO: 1974264 - RNA, 17 nt, Human
agaauuucccaaagcag

SEQ ID NO: 1974265 - RNA, 13 nt, Human
agaauuucuagga

SEQ ID NO: 1974266 - RNA, 21 nt, Human
agaauuucuaggacugaauua

SEQ ID NO: 1974267 - RNA, 23 nt, Human
agaauuucccaaagcagugcaug

SEQ ID NO: 1974268 - RNA, 20 nt, Human
ucugugccuuuuuuauaucu

SEQ ID NO: 1974269 - RNA, 21 nt, Human
ucugugaaaggaaagagggag

SEQ ID NO: 1974270 - RNA, 15 nt, Human
ucugugaaaggaaag

SEQ ID NO: 1974271 - RNA, 24 nt, Human
ucuguccaggcacugcugcccagc

SEQ ID NO: 1974272 - RNA, 12 nt, Human
ucugucuuucca

SEQ ID NO: 1974273 - RNA, 16 nt, Human
ucugucuuuccacucu

SEQ ID NO: 1974274 - RNA, 17 nt, Human
ucugucuuuccacucug

SEQ ID NO: 1974275 - RNA, 19 nt, Human
ucuguccaacugagaagua

SEQ ID NO: 1974276 - RNA, 24 nt, Human
ucuguuccauaguuaaagaagaca

SEQ ID NO: 1974277 - RNA, 17 nt, Human
ucuguuccauaguuaaa

SEQ ID NO: 1974278 - RNA, 18 nt, Human
ucuguuggccagugugac

SEQ ID NO: 1974279 - RNA, 19 nt, Human
ucuguuggccagugugaca

SEQ ID NO: 1974280 - RNA, 20 nt, Human
ucuguuggccagugugacaa

SEQ ID NO: 1974281 - RNA, 17 nt, Human
agacacccuuggagcuc

SEQ ID NO: 1974282 - RNA, 18 nt, Human
agacacccuuggagcucu

SEQ ID NO: 1974283 - RNA, 20 nt, Human
agaauuugauaugugaacag

SEQ ID NO: 1974284 - RNA, 18 nt, Human
agaauuugauaugugaac

SEQ ID NO: 1974285 - RNA, 19 nt, Human
agaauuugauaugugaaca

SEQ ID NO: 1974286 - RNA, 17 nt, Human
agaauuugauaugugaa

SEQ ID NO: 1974287 - RNA, 13 nt, Human
agaauuucuuuau

SEQ ID NO: 1974288 - RNA, 14 nt, Human
agacagacuagaag

SEQ ID NO: 1974289 - RNA, 18 nt, Human
agacagaaucucgcucug

SEQ ID NO: 1974290 - RNA, 22 nt, Human
agacagaaucucgcucugucgc

SEQ ID NO: 1974291 - RNA, 17 nt, Human
agacagucccugccaau

SEQ ID NO: 1974292 - RNA, 16 nt, Human
agacagucccugccaa

SEQ ID NO: 1974293 - RNA, 15 nt, Human
agacagucccugcca

SEQ ID NO: 1974294 - RNA, 19 nt, Human
agacagucccugccaaugg

SEQ ID NO: 1974295 - RNA, 14 nt, Human
ucuuaauacuguua

SEQ ID NO: 1974296 - RNA, 15 nt, Human
ucuuaauacuguuau

SEQ ID NO: 1974297 - RNA, 18 nt, Human
ucuuaauacuguuauucu

SEQ ID NO: 1974298 - RNA, 19 nt, Human
ucuuaauacuguuauucuu

SEQ ID NO: 1974299 - RNA, 22 nt, Human
ucuuaauacuguuauucuuugc

SEQ ID NO: 1974300 - RNA, 21 nt, Human
agacaggguuuugccauguug

SEQ ID NO: 1974301 - RNA, 15 nt, Human
agacaggaccaggga

SEQ ID NO: 1974302 - RNA, 23 nt, Human
agacaggcaagcaccuccugccu

SEQ ID NO: 1974303 - RNA, 20 nt, Human
agacaggcaggugaucugcu

SEQ ID NO: 1974304 - RNA, 13 nt, Human
ucuucacucacag

SEQ ID NO: 1974305 - RNA, 22 nt, Human
ucuucaaaauauaaaaugccaa

SEQ ID NO: 1974306 - RNA, 23 nt, Human
ucuuagacuuuuccaauauguga

SEQ ID NO: 1974307 - RNA, 16 nt, Human
ucuuagaucauaguuu

SEQ ID NO: 1974308 - RNA, 17 nt, Human
ucuuagaucauaguuuu

SEQ ID NO: 1974309 - RNA, 17 nt, Human
ucuucaaaaugagcccu

SEQ ID NO: 1974310 - RNA, 22 nt, Human
ucuuccaggcugggagagccuu

SEQ ID NO: 1974311 - RNA, 19 nt, Human
ucuuccaguuacuuuccaa

SEQ ID NO: 1974312 - RNA, 18 nt, Human
ucuuccaguuacuuucca

SEQ ID NO: 1974313 - RNA, 19 nt, Human
ucuucccugguaagaaaaa

SEQ ID NO: 1974314 - RNA, 20 nt, Human
ucuucccugguaagaaaaag

SEQ ID NO: 1974315 - RNA, 18 nt, Human
ucuucccugguaagaaaa

SEQ ID NO: 1974316 - RNA, 14 nt, Human
ucuuaugggcuggg

SEQ ID NO: 1974317 - RNA, 16 nt, Human
ucuuaugggcuggguu

SEQ ID NO: 1974318 - RNA, 15 nt, Human
ucuuaugggcugggu

SEQ ID NO: 1974319 - RNA, 18 nt, Human
ucuuaugggcuggguucu

SEQ ID NO: 1974320 - RNA, 16 nt, Human
ucuuagacuuuuccaa

SEQ ID NO: 1974321 - RNA, 17 nt, Human
ucuuagacuuuuccaau

SEQ ID NO: 1974322 - RNA, 14 nt, Human
ucuuauugcccacg

SEQ ID NO: 1974323 - RNA, 18 nt, Human
ucuuauugcccacgcugg

SEQ ID NO: 1974324 - RNA, 22 nt, Human
ucuuauugcccacgcuggagug

SEQ ID NO: 1974325 - RNA, 22 nt, Human
ucuuaauauuuuuacaugcaga

SEQ ID NO: 1974326 - RNA, 14 nt, Human
ucuuaaucauuuuu

SEQ ID NO: 1974327 - RNA, 20 nt, Human
ucuuaaucauuuuuuauaua

SEQ ID NO: 1974328 - RNA, 22 nt, Human
ucuuaaucauuuuuuauauaua

SEQ ID NO: 1974329 - RNA, 14 nt, Human
ucuuaauccagucu

SEQ ID NO: 1974330 - RNA, 17 nt, Human
agacuguguuugguccu

SEQ ID NO: 1974331 - RNA, 21 nt, Human
agacuguguuugguccuguag

SEQ ID NO: 1974332 - RNA, 23 nt, Human
agacuguguuugguccuguagga

SEQ ID NO: 1974333 - RNA, 19 nt, Human
agacuguggagacugcucc

SEQ ID NO: 1974334 - RNA, 20 nt, Human
agacuguggagacugcuccu

SEQ ID NO: 1974335 - RNA, 18 nt, Human
agacuguggagacugcuc

SEQ ID NO: 1974336 - RNA, 17 nt, Human
agacuucaucccucugg

SEQ ID NO: 1974337 - RNA, 22 nt, Human
agacuucagggagucagcuguu

SEQ ID NO: 1974338 - RNA, 13 nt, Human
agacuucuguuuu

SEQ ID NO: 1974339 - RNA, 14 nt, Human
agacuucaucccuc

SEQ ID NO: 1974340 - RNA, 14 nt, Human
agacuucagggagu

SEQ ID NO: 1974341 - RNA, 17 nt, Human
agacuuauuuucacaug

SEQ ID NO: 1974342 - RNA, 11 nt, Human
agacuuugaug

SEQ ID NO: 1974343 - RNA, 13 nt, Human
agacuuugauguc

SEQ ID NO: 1974344 - RNA, 22 nt, Human
agacuugaaaagagacaggcag

SEQ ID NO: 1974345 - RNA, 20 nt, Human
agacuugaaaagagacaggc

SEQ ID NO: 1974346 - RNA, 21 nt, Human
agacuugaaaagagacaggca

SEQ ID NO: 1974347 - RNA, 15 nt, Human
agacuucuguuuuca

SEQ ID NO: 1974348 - RNA, 17 nt, Human
agacuucuguuuucaau

SEQ ID NO: 1974349 - RNA, 18 nt, Human
agacuucuguuuucaauc

SEQ ID NO: 1974350 - RNA, 12 nt, Human
agacuugaaaag

SEQ ID NO: 1974351 - RNA, 15 nt, Human
agacuugaaaagaga

SEQ ID NO: 1974352 - RNA, 17 nt, Human
agacuugaaaagagaca

SEQ ID NO: 1974353 - RNA, 18 nt, Human
agacuugaaaagagacag

SEQ ID NO: 1974354 - RNA, 19 nt, Human
agacuugaaaagagacagg

SEQ ID NO: 1974355 - RNA, 14 nt, Human
agagaccaucccug

SEQ ID NO: 1974356 - RNA, 13 nt, Human
agagaccaucccu

SEQ ID NO: 1974357 - RNA, 15 nt, Human
agagaccaucccuga

SEQ ID NO: 1974358 - RNA, 12 nt, Human
agacuuuggaaa

SEQ ID NO: 1974359 - RNA, 18 nt, Human
agacuuugaugucagcag

SEQ ID NO: 1974360 - RNA, 14 nt, Human
agacuuugauguca

SEQ ID NO: 1974361 - RNA, 17 nt, Human
agacuuugaugucagca

SEQ ID NO: 1974362 - RNA, 14 nt, Human
agacuuuggaaaga

SEQ ID NO: 1974363 - RNA, 18 nt, Human
agagaaugaaagggccca

SEQ ID NO: 1974364 - RNA, 15 nt, Human
agacuuuggaaagac

SEQ ID NO: 1974365 - RNA, 17 nt, Human
agacuccugcaggcagc

SEQ ID NO: 1974366 - RNA, 16 nt, Human
agacuccugcaggcag

SEQ ID NO: 1974367 - RNA, 15 nt, Human
agacuccugcaggca

SEQ ID NO: 1974368 - RNA, 14 nt, Human
agacuccugcaggc

SEQ ID NO: 1974369 - RNA, 16 nt, Human
ucuuuccugaggcugg

SEQ ID NO: 1974370 - RNA, 15 nt, Human
ucuuuccugaggcug

SEQ ID NO: 1974371 - RNA, 14 nt, Human
ucuuuccugaggcu

SEQ ID NO: 1974372 - RNA, 13 nt, Human
ucuuuccugaggc

SEQ ID NO: 1974373 - RNA, 23 nt, Human
agacuccugcaggcagccaggcc

SEQ ID NO: 1974374 - RNA, 20 nt, Human
agacuccugcaggcagccag

SEQ ID NO: 1974375 - RNA, 19 nt, Human
agacuccugcaggcagcca

SEQ ID NO: 1974376 - RNA, 18 nt, Human
agacuccugcaggcagcc

SEQ ID NO: 1974377 - RNA, 19 nt, Human
agacucuacagaggccaug

SEQ ID NO: 1974378 - RNA, 21 nt, Human
agacucgcgacaaugcaaacc

SEQ ID NO: 1974379 - RNA, 17 nt, Human
agacucuacagaggcca

SEQ ID NO: 1974380 - RNA, 15 nt, Human
ucuuggagccugcag

SEQ ID NO: 1974381 - RNA, 18 nt, Human
ucuuggagccugcagagc

SEQ ID NO: 1974382 - RNA, 19 nt, Human
ucuuggagccugcagagcu

SEQ ID NO: 1974383 - RNA, 24 nt, Human
ucuuggcaauaaauuuugaaaagu

SEQ ID NO: 1974384 - RNA, 17 nt, Human
ucuuggcaauaaauuuu

SEQ ID NO: 1974385 - RNA, 19 nt, Human
ucuuggcaauaaauuuuga

SEQ ID NO: 1974386 - RNA, 20 nt, Human
ucuuggcaauaaauuuugaa

SEQ ID NO: 1974387 - RNA, 22 nt, Human
ucuuggcaauaaauuuugaaaa

SEQ ID NO: 1974388 - RNA, 16 nt, Human
ucuuggcaauaaauuu

SEQ ID NO: 1974389 - RNA, 15 nt, Human
ucuuuaaacugucgu

SEQ ID NO: 1974390 - RNA, 15 nt, Human
ucuuuacuucaugga

SEQ ID NO: 1974391 - RNA, 15 nt, Human
ucuuuagaaaaggca

SEQ ID NO: 1974392 - RNA, 16 nt, Human
ucuuuagaaaaggcau

SEQ ID NO: 1974393 - RNA, 23 nt, Human
agacccugcccugugggccccca

SEQ ID NO: 1974394 - RNA, 21 nt, Human
agacccugcccugugggcccc

SEQ ID NO: 1974395 - RNA, 19 nt, Human
agacccugcccugugggcc

SEQ ID NO: 1974396 - RNA, 16 nt, Human
agacccugcccugugg

SEQ ID NO: 1974397 - RNA, 15 nt, Human
agacccuuguggucc

SEQ ID NO: 1974398 - RNA, 13 nt, Human
agacccuuguggu

SEQ ID NO: 1974399 - RNA, 13 nt, Human
agacccuggagga

SEQ ID NO: 1974400 - RNA, 23 nt, Human
agacccuuguggucccaccccac

SEQ ID NO: 1974401 - RNA, 22 nt, Human
agacccuuguggucccacccca

SEQ ID NO: 1974402 - RNA, 20 nt, Human
agacccuuguggucccaccc

SEQ ID NO: 1974403 - RNA, 19 nt, Human
agacccuuguggucccacc

SEQ ID NO: 1974404 - RNA, 17 nt, Human
agaccuaaccagggcca

SEQ ID NO: 1974405 - RNA, 20 nt, Human
agaccgugaagauacuuugu

SEQ ID NO: 1974406 - RNA, 21 nt, Human
agaccgugaagauacuuugua

SEQ ID NO: 1974407 - RNA, 12 nt, Human
agaccuaaccag

SEQ ID NO: 1974408 - RNA, 16 nt, Human
agaccuaaccagggcc

SEQ ID NO: 1974409 - RNA, 14 nt, Human
agacccugcccugu

SEQ ID NO: 1974410 - RNA, 13 nt, Human
agacccugcccug

SEQ ID NO: 1974411 - RNA, 12 nt, Human
agacccugcccu

SEQ ID NO: 1974412 - RNA, 16 nt, Human
ucuuccuacucuucuc

SEQ ID NO: 1974413 - RNA, 22 nt, Human
ucuuccuacucuucucucugcu

SEQ ID NO: 1974414 - RNA, 22 nt, Human
ucuuccuaucaaaaagauauca

SEQ ID NO: 1974415 - RNA, 14 nt, Human
ucuuccuauuucag

SEQ ID NO: 1974416 - RNA, 15 nt, Human
ucuuccuauuucaga

SEQ ID NO: 1974417 - RNA, 16 nt, Human
ucuuccuauuucagaa

SEQ ID NO: 1974418 - RNA, 17 nt, Human
ucuuccuauuucagaag

SEQ ID NO: 1974419 - RNA, 20 nt, Human
ucuuccuauuucagaaguuu

SEQ ID NO: 1974420 - RNA, 18 nt, Human
agacaugguggggucucc

SEQ ID NO: 1974421 - RNA, 17 nt, Human
agacauguaauuugugu

SEQ ID NO: 1974422 - RNA, 18 nt, Human
agacauguaauuugugua

SEQ ID NO: 1974423 - RNA, 21 nt, Human
agacauguaauuuguguaaau

SEQ ID NO: 1974424 - RNA, 18 nt, Human
agacuaucuaaauguuga

SEQ ID NO: 1974425 - RNA, 17 nt, Human
agacuaucuaaauguug

SEQ ID NO: 1974426 - RNA, 19 nt, Human
agacuaucuaaauguugaa

SEQ ID NO: 1974427 - RNA, 12 nt, Human
agaccugccccu

SEQ ID NO: 1974428 - RNA, 17 nt, Human
agacucauucuucugua

SEQ ID NO: 1974429 - RNA, 18 nt, Human
agacucauucuucuguac

SEQ ID NO: 1974430 - RNA, 16 nt, Human
ucuugaugaaaagcuu

SEQ ID NO: 1974431 - RNA, 22 nt, Human
ucuugaugaaaagcuuuguuug

SEQ ID NO: 1974432 - RNA, 14 nt, Human
ucuugaugccuggc

SEQ ID NO: 1974433 - RNA, 20 nt, Human
ucuugaugccuggcggggug

SEQ ID NO: 1974434 - RNA, 17 nt, Human
ucuugcaaaauuccuga

SEQ ID NO: 1974435 - RNA, 17 nt, Human
ucuugcaauggcagccu

SEQ ID NO: 1974436 - RNA, 13 nt, Human
ucuugcaauggca

SEQ ID NO: 1974437 - RNA, 16 nt, Human
ucuugcaauggcagcc

SEQ ID NO: 1974438 - RNA, 13 nt, Human
ucuuggagccugc

SEQ ID NO: 1974439 - RNA, 14 nt, Human
ucuuggagccugca

SEQ ID NO: 1974440 - RNA, 12 nt, Human
ucuuggagccug

SEQ ID NO: 1974441 - RNA, 18 nt, Human
ugaagguggaaauaaacu

SEQ ID NO: 1974442 - RNA, 15 nt, Human
ugaaugcauaaaaug

SEQ ID NO: 1974443 - RNA, 16 nt, Human
ugaaugcauaaaaugu

SEQ ID NO: 1974444 - RNA, 22 nt, Human
ugaauggacgguuuaggugaaa

SEQ ID NO: 1974445 - RNA, 13 nt, Human
agaguccucugaa

SEQ ID NO: 1974446 - RNA, 12 nt, Human
agaguccucuga

SEQ ID NO: 1974447 - RNA, 14 nt, Human
agaguccucugaau

SEQ ID NO: 1974448 - RNA, 18 nt, Human
ugaaugucagugugacug

SEQ ID NO: 1974449 - RNA, 15 nt, Human
ugaaugucaguguga

SEQ ID NO: 1974450 - RNA, 19 nt, Human
ugaauggcaauguuuugcu

SEQ ID NO: 1974451 - RNA, 14 nt, Human
ugaaugucagugug

SEQ ID NO: 1974452 - RNA, 18 nt, Human
agagucuauuuacggaac

SEQ ID NO: 1974453 - RNA, 22 nt, Human
agagugaacaaauuuacagaga

SEQ ID NO: 1974454 - RNA, 15 nt, Human
agagugagacucugu

SEQ ID NO: 1974455 - RNA, 16 nt, Human
agagugagacucuguc

SEQ ID NO: 1974456 - RNA, 20 nt, Human
agagucucacuguugcccag

SEQ ID NO: 1974457 - RNA, 14 nt, Human
agagugaacaaauu

SEQ ID NO: 1974458 - RNA, 22 nt, Human
agagucucacuguugcccaggc

SEQ ID NO: 1974459 - RNA, 21 nt, Human
agaucaaccccuucgcuccug

SEQ ID NO: 1974460 - RNA, 15 nt, Human
agaucaacucauguu

SEQ ID NO: 1974461 - RNA, 18 nt, Human
agaucacuguuuagauuu

SEQ ID NO: 1974462 - RNA, 19 nt, Human
agaucacuguuuagauuug

SEQ ID NO: 1974463 - RNA, 15 nt, Human
agaucacuguuuaga

SEQ ID NO: 1974464 - RNA, 16 nt, Human
agaucacuguuuagau

SEQ ID NO: 1974465 - RNA, 17 nt, Human
agaucacuguuuagauu

SEQ ID NO: 1974466 - RNA, 14 nt, Human
agaucaaccccuuc

SEQ ID NO: 1974467 - RNA, 19 nt, Human
agaucaaccccuucgcucc

SEQ ID NO: 1974468 - RNA, 22 nt, Human
agauauuuugcuuugugauuuu

SEQ ID NO: 1974469 - RNA, 18 nt, Human
agauaccuuaaaauuuga

SEQ ID NO: 1974470 - RNA, 20 nt, Human
agauaccuuaaaauuugaaa

SEQ ID NO: 1974471 - RNA, 22 nt, Human
agauaccuuaaaauuugaaaca

SEQ ID NO: 1974472 - RNA, 19 nt, Human
agauacaggaaaagcugcu

SEQ ID NO: 1974473 - RNA, 15 nt, Human
agauaccaagcaugu

SEQ ID NO: 1974474 - RNA, 19 nt, Human
agauaaggguaucugguga

SEQ ID NO: 1974475 - RNA, 17 nt, Human
agauaaggguaucuggu

SEQ ID NO: 1974476 - RNA, 19 nt, Human
agauaaaccuagauaaaga

SEQ ID NO: 1974477 - RNA, 18 nt, Human
agauaaaaaaacagcuuu

SEQ ID NO: 1974478 - RNA, 13 nt, Human
agauaaagauugu

SEQ ID NO: 1974479 - RNA, 19 nt, Human
agagugagacucugucuca

SEQ ID NO: 1974480 - RNA, 17 nt, Human
agauaaaaaaacagcuu

SEQ ID NO: 1974481 - RNA, 14 nt, Human
agauaaguuggaaa

SEQ ID NO: 1974482 - RNA, 15 nt, Human
agauaaguggccuug

SEQ ID NO: 1974483 - RNA, 16 nt, Human
agauaaagauugugug

SEQ ID NO: 1974484 - RNA, 23 nt, Human
agauaaguggccuugacacauua

SEQ ID NO: 1974485 - RNA, 15 nt, Human
agauaaguuggaaac

SEQ ID NO: 1974486 - RNA, 16 nt, Human
agauaaguuggaaaca

SEQ ID NO: 1974487 - RNA, 18 nt, Human
agauaaguuggaaacacu

SEQ ID NO: 1974488 - RNA, 19 nt, Human
agauaaguuggaaacacua

SEQ ID NO: 1974489 - RNA, 20 nt, Human
agauaaguuggaaacacuaa

SEQ ID NO: 1974490 - RNA, 21 nt, Human
agauaaguuggaaacacuaaa

SEQ ID NO: 1974491 - RNA, 22 nt, Human
agauaaguuggaaacacuaaau

SEQ ID NO: 1974492 - RNA, 18 nt, Human
agauaauucuagcuuuga

SEQ ID NO: 1974493 - RNA, 11 nt, Human
ugaagacaaug

SEQ ID NO: 1974494 - RNA, 13 nt, Human
ugaagacaaugac

SEQ ID NO: 1974495 - RNA, 17 nt, Human
ugaagacaaugacuuac

SEQ ID NO: 1974496 - RNA, 16 nt, Human
ugaacuuugaccucug

SEQ ID NO: 1974497 - RNA, 17 nt, Human
ugaacuuugaccucugc

SEQ ID NO: 1974498 - RNA, 21 nt, Human
ucuuuggucuacacugugcug

SEQ ID NO: 1974499 - RNA, 14 nt, Human
ucuuuggucuacac

SEQ ID NO: 1974500 - RNA, 12 nt, Human
ucuuuguaauga

SEQ ID NO: 1974501 - RNA, 11 nt, Human
ugaacuuugac

SEQ ID NO: 1974502 - RNA, 15 nt, Human
ucuuuguaaugaaaa

SEQ ID NO: 1974503 - RNA, 13 nt, Human
ucuuuguaaugaa

SEQ ID NO: 1974504 - RNA, 18 nt, Human
agaggcaacugcauuggc

SEQ ID NO: 1974505 - RNA, 21 nt, Human
agaggaaaucaccgaaaacgu

SEQ ID NO: 1974506 - RNA, 17 nt, Human
agaggaaaguacauuuu

SEQ ID NO: 1974507 - RNA, 12 nt, Human
agaggaaaucac

SEQ ID NO: 1974508 - RNA, 11 nt, Human
agaggaaauca

SEQ ID NO: 1974509 - RNA, 19 nt, Human
agaggaaagcaaaggagau

SEQ ID NO: 1974510 - RNA, 18 nt, Human
agaggaaagcaaaggaga

SEQ ID NO: 1974511 - RNA, 16 nt, Human
agaggaaagcaaagga

SEQ ID NO: 1974512 - RNA, 12 nt, Human
agaggaaagcaa

SEQ ID NO: 1974513 - RNA, 21 nt, Human
ugaagacaaugacuuacugua

SEQ ID NO: 1974514 - RNA, 19 nt, Human
agagcugggugucaagagg

SEQ ID NO: 1974515 - RNA, 15 nt, Human
agagcuucuggcacu

SEQ ID NO: 1974516 - RNA, 19 nt, Human
agagcuucuguugcugccu

SEQ ID NO: 1974517 - RNA, 20 nt, Human
agagcuucuguugcugccuc

SEQ ID NO: 1974518 - RNA, 21 nt, Human
agagcuucuguugcugccuca

SEQ ID NO: 1974519 - RNA, 21 nt, Human
agaggccuuuaguuauaaagg

SEQ ID NO: 1974520 - RNA, 14 nt, Human
agaggcuaaaaugu

SEQ ID NO: 1974521 - RNA, 15 nt, Human
agaggcuaaaauguu

SEQ ID NO: 1974522 - RNA, 16 nt, Human
agaggcuaaaauguuu

SEQ ID NO: 1974523 - RNA, 17 nt, Human
agaggcuaaaauguuuu

SEQ ID NO: 1974524 - RNA, 21 nt, Human
agaggcgcaugaauuugugaa

SEQ ID NO: 1974525 - RNA, 19 nt, Human
agagggaccucucccaggg

SEQ ID NO: 1974526 - RNA, 16 nt, Human
agagggaccucuccca

SEQ ID NO: 1974527 - RNA, 15 nt, Human
agagggaccucuccc

SEQ ID NO: 1974528 - RNA, 20 nt, Human
agagggagggagggcuccag

SEQ ID NO: 1974529 - RNA, 21 nt, Human
agagggagggagggcuccaga

SEQ ID NO: 1974530 - RNA, 16 nt, Human
agaggugcacuugggg

SEQ ID NO: 1974531 - RNA, 22 nt, Human
agagggagggagggcuccagac

SEQ ID NO: 1974532 - RNA, 17 nt, Human
ugaagauguagaggaga

SEQ ID NO: 1974533 - RNA, 14 nt, Human
agaggugggagggc

SEQ ID NO: 1974534 - RNA, 17 nt, Human
agaggugggagggcccu

SEQ ID NO: 1974535 - RNA, 22 nt, Human
agaggugcacuuggggcacagg

SEQ ID NO: 1974536 - RNA, 18 nt, Human
ugaagauguagaggagaa

SEQ ID NO: 1974537 - RNA, 21 nt, Human
ugaagauucuauguuaauauu

SEQ ID NO: 1974538 - RNA, 18 nt, Human
ugaagccugcuccuuccc

SEQ ID NO: 1974539 - RNA, 13 nt, Human
ugaagccugcucc

SEQ ID NO: 1974540 - RNA, 15 nt, Human
ugaagccugcuccuu

SEQ ID NO: 1974541 - RNA, 17 nt, Human
ugaagccugcuccuucc

SEQ ID NO: 1974542 - RNA, 23 nt, Human
agaugcuagaacucccuuucaac

SEQ ID NO: 1974543 - RNA, 16 nt, Human
agaugcuucucacugc

SEQ ID NO: 1974544 - RNA, 18 nt, Human
agaugcuucucacugcca

SEQ ID NO: 1974545 - RNA, 16 nt, Human
agauggcacagggcau

SEQ ID NO: 1974546 - RNA, 22 nt, Human
agauggcacagggcaugaaaug

SEQ ID NO: 1974547 - RNA, 23 nt, Human
agauggcacagggcaugaaauga

SEQ ID NO: 1974548 - RNA, 17 nt, Human
agauggauaugaccagu

SEQ ID NO: 1974549 - RNA, 14 nt, Human
agaugucucuaaaa

SEQ ID NO: 1974550 - RNA, 13 nt, Human
agaugucuuccua

SEQ ID NO: 1974551 - RNA, 20 nt, Human
agaugugggccaccauugca

SEQ ID NO: 1974552 - RNA, 17 nt, Human
agauguccuaaugguga

SEQ ID NO: 1974553 - RNA, 20 nt, Human
agaugugguuaauuuugcau

SEQ ID NO: 1974554 - RNA, 16 nt, Human
agauguguaauuuuuc

SEQ ID NO: 1974555 - RNA, 17 nt, Human
agauguguaauuuuucu

SEQ ID NO: 1974556 - RNA, 21 nt, Human
agauguguaauuuuucuguau

SEQ ID NO: 1974557 - RNA, 18 nt, Human
agauguguucacaaugga

SEQ ID NO: 1974558 - RNA, 15 nt, Human
agauguguucacaau

SEQ ID NO: 1974559 - RNA, 12 nt, Human
ugaccugaggcc

SEQ ID NO: 1974560 - RNA, 14 nt, Human
ugaccucugccuga

SEQ ID NO: 1974561 - RNA, 13 nt, Human
ugaccucugccug

SEQ ID NO: 1974562 - RNA, 19 nt, Human
ugaccccucauagcccuca

SEQ ID NO: 1974563 - RNA, 20 nt, Human
ugaccccucauagcccucac

SEQ ID NO: 1974564 - RNA, 22 nt, Human
ugacccccaaccaaguggcucc

SEQ ID NO: 1974565 - RNA, 15 nt, Human
ugacccccccagcuu

SEQ ID NO: 1974566 - RNA, 19 nt, Human
ugacccccccagcuucacu

SEQ ID NO: 1974567 - RNA, 17 nt, Human
ugaccccucauagcccu

SEQ ID NO: 1974568 - RNA, 17 nt, Human
ugacagguuugggaccc

SEQ ID NO: 1974569 - RNA, 15 nt, Human
ugaauuuaucuuuga

SEQ ID NO: 1974570 - RNA, 16 nt, Human
ugaauuuaucuuugau

SEQ ID NO: 1974571 - RNA, 14 nt, Human
agaucagccagaag

SEQ ID NO: 1974572 - RNA, 13 nt, Human
ugaauuuaucuuu

SEQ ID NO: 1974573 - RNA, 20 nt, Human
agaucacuguuuagauuugc

SEQ ID NO: 1974574 - RNA, 12 nt, Human
agaucagccaga

SEQ ID NO: 1974575 - RNA, 18 nt, Human
ugacauuguagagcuucu

SEQ ID NO: 1974576 - RNA, 24 nt, Human
ugacauuuguuugguuauagugca

SEQ ID NO: 1974577 - RNA, 14 nt, Human
agaucgguuaacaa

SEQ ID NO: 1974578 - RNA, 15 nt, Human
agaucgguuaacaaa

SEQ ID NO: 1974579 - RNA, 17 nt, Human
agaucgguuaacaaaua

SEQ ID NO: 1974580 - RNA, 18 nt, Human
agaucgguuaacaaauaa

SEQ ID NO: 1974581 - RNA, 17 nt, Human
agaucauuugaguucag

SEQ ID NO: 1974582 - RNA, 21 nt, Human
agaucauugugaaauuauuca

SEQ ID NO: 1974583 - RNA, 12 nt, Human
ugaccacacucc

SEQ ID NO: 1974584 - RNA, 17 nt, Human
ugaccacacuccagcug

SEQ ID NO: 1974585 - RNA, 19 nt, Human
ugaccacacuccagcuggg

SEQ ID NO: 1974586 - RNA, 20 nt, Human
ugaccacacuccagcuggga

SEQ ID NO: 1974587 - RNA, 13 nt, Human
ugaccaauuuuaa

SEQ ID NO: 1974588 - RNA, 16 nt, Human
ugaccaauuuuaacuu

SEQ ID NO: 1974589 - RNA, 19 nt, Human
ugaccaaauaucaccagga

SEQ ID NO: 1974590 - RNA, 21 nt, Human
ugaccaaauaucaccaggacu

SEQ ID NO: 1974591 - RNA, 22 nt, Human
ugaccaaauaucaccaggacug

SEQ ID NO: 1974592 - RNA, 22 nt, Human
agcaaccauauagaaagcuuug

SEQ ID NO: 1974593 - RNA, 18 nt, Human
agcaaccccuggacccca

SEQ ID NO: 1974594 - RNA, 19 nt, Human
agcaaccccuggaccccag

SEQ ID NO: 1974595 - RNA, 20 nt, Human
agcaaccccuggaccccagc

SEQ ID NO: 1974596 - RNA, 22 nt, Human
agcaacauuuuacccacacaca

SEQ ID NO: 1974597 - RNA, 14 nt, Human
agcaaccaaaaaga

SEQ ID NO: 1974598 - RNA, 20 nt, Human
agcaacauuuuacccacaca

SEQ ID NO: 1974599 - RNA, 14 nt, Human
agcaacaauuuuca

SEQ ID NO: 1974600 - RNA, 15 nt, Human
agcaacaauuuucag

SEQ ID NO: 1974601 - RNA, 16 nt, Human
agcaacaauuuucaga

SEQ ID NO: 1974602 - RNA, 17 nt, Human
agcaacaauuuucagau

SEQ ID NO: 1974603 - RNA, 14 nt, Human
agauuucacucucc

SEQ ID NO: 1974604 - RNA, 13 nt, Human
agauuucacucuc

SEQ ID NO: 1974605 - RNA, 21 nt, Human
agauuugccauagaguacacu

SEQ ID NO: 1974606 - RNA, 12 nt, Human
agauuugggaga

SEQ ID NO: 1974607 - RNA, 12 nt, Human
agauuugcacaa

SEQ ID NO: 1974608 - RNA, 14 nt, Human
agauuugcacaaaa

SEQ ID NO: 1974609 - RNA, 15 nt, Human
agauuugcacaaaaa

SEQ ID NO: 1974610 - RNA, 17 nt, Human
agauuugcacaaaaaga

SEQ ID NO: 1974611 - RNA, 18 nt, Human
agauuugccauagaguac

SEQ ID NO: 1974612 - RNA, 19 nt, Human
agauuugccauagaguaca

SEQ ID NO: 1974613 - RNA, 14 nt, Human
agauuuaugcauau

SEQ ID NO: 1974614 - RNA, 13 nt, Human
agauugugaauaa

SEQ ID NO: 1974615 - RNA, 14 nt, Human
agauugugaauaau

SEQ ID NO: 1974616 - RNA, 18 nt, Human
agauugugaauaaugauu

SEQ ID NO: 1974617 - RNA, 16 nt, Human
agauugugccccugca

SEQ ID NO: 1974618 - RNA, 21 nt, Human
agauugugccccugcacucca

SEQ ID NO: 1974619 - RNA, 21 nt, Human
ugacugugguagccagcaucg

SEQ ID NO: 1974620 - RNA, 23 nt, Human
ugacuccagaauuucccaaagca

SEQ ID NO: 1974621 - RNA, 20 nt, Human
ugacuccagaauuucccaaa

SEQ ID NO: 1974622 - RNA, 15 nt, Human
ugaccugaggcccuu

SEQ ID NO: 1974623 - RNA, 14 nt, Human
ugaccugaggcccu

SEQ ID NO: 1974624 - RNA, 17 nt, Human
ugaccugaggcccuucu

SEQ ID NO: 1974625 - RNA, 19 nt, Human
ugacuccagaauuucccaa

SEQ ID NO: 1974626 - RNA, 17 nt, Human
ugacuccagaauuuccc

SEQ ID NO: 1974627 - RNA, 23 nt, Human
agauuauauauauuuuuuucuga

SEQ ID NO: 1974628 - RNA, 20 nt, Human
agauuauaggcaccuaccac

SEQ ID NO: 1974629 - RNA, 15 nt, Human
ugacuuuauuauuua

SEQ ID NO: 1974630 - RNA, 16 nt, Human
ugacuuuauuauuuau

SEQ ID NO: 1974631 - RNA, 17 nt, Human
ugacuuuauuauuuauu

SEQ ID NO: 1974632 - RNA, 20 nt, Human
ugacuuuauuauuuauuuuu

SEQ ID NO: 1974633 - RNA, 22 nt, Human
ugacuuucaaaguggaugcaau

SEQ ID NO: 1974634 - RNA, 15 nt, Human
ugacuuucaggaauu

SEQ ID NO: 1974635 - RNA, 21 nt, Human
ugacuuucaggaauugcccau

SEQ ID NO: 1974636 - RNA, 22 nt, Human
agauucaaugccccugaauuua

SEQ ID NO: 1974637 - RNA, 21 nt, Human
agauucaaugccccugaauuu

SEQ ID NO: 1974638 - RNA, 16 nt, Human
agauucaaucccagga

SEQ ID NO: 1974639 - RNA, 21 nt, Human
ugacuucugcuggcaucaaga

SEQ ID NO: 1974640 - RNA, 20 nt, Human
ugacuuccccaauaucuugc

SEQ ID NO: 1974641 - RNA, 21 nt, Human
ugacuuccccaauaucuugcu

SEQ ID NO: 1974642 - RNA, 21 nt, Human
agcacagcagccccugcacaa

SEQ ID NO: 1974643 - RNA, 22 nt, Human
agcaagugagagcuggguguca

SEQ ID NO: 1974644 - RNA, 15 nt, Human
agcaagugugaauac

SEQ ID NO: 1974645 - RNA, 21 nt, Human
agcaagugugaauacugcuug

SEQ ID NO: 1974646 - RNA, 23 nt, Human
agcaagugugaauacugcuugaa

SEQ ID NO: 1974647 - RNA, 18 nt, Human
agcaagugagagcugggu

SEQ ID NO: 1974648 - RNA, 14 nt, Human
agcaagugagagcu

SEQ ID NO: 1974649 - RNA, 22 nt, Human
ugagccagauuucacucuccuu

SEQ ID NO: 1974650 - RNA, 17 nt, Human
ugagccagauuucacuc

SEQ ID NO: 1974651 - RNA, 20 nt, Human
agcaagugagacccugucuc

SEQ ID NO: 1974652 - RNA, 13 nt, Human
agcaagugagagc

SEQ ID NO: 1974653 - RNA, 16 nt, Human
agcaccaaaauaagaa

SEQ ID NO: 1974654 - RNA, 17 nt, Human
agcaccaaaauaagaaa

SEQ ID NO: 1974655 - RNA, 18 nt, Human
agcaccaaaauaagaaaa

SEQ ID NO: 1974656 - RNA, 19 nt, Human
agcaccaaaauaagaaaag

SEQ ID NO: 1974657 - RNA, 20 nt, Human
agcaccaaaauaagaaaaga

SEQ ID NO: 1974658 - RNA, 21 nt, Human
agcaccaaaauaagaaaagau

SEQ ID NO: 1974659 - RNA, 14 nt, Human
agcacaugccucuc

SEQ ID NO: 1974660 - RNA, 22 nt, Human
agcaccaaaagcuuaccaaggg

SEQ ID NO: 1974661 - RNA, 13 nt, Human
agcacaugccucu

SEQ ID NO: 1974662 - RNA, 15 nt, Human
agcacagugaucaag

SEQ ID NO: 1974663 - RNA, 15 nt, Human
agcacagcucccuuc

SEQ ID NO: 1974664 - RNA, 16 nt, Human
agcacagcucccuucu

SEQ ID NO: 1974665 - RNA, 18 nt, Human
agcacagucagguugaag

SEQ ID NO: 1974666 - RNA, 16 nt, Human
agcacagcuucauuuc

SEQ ID NO: 1974667 - RNA, 12 nt, Human
agcacagcuccc

SEQ ID NO: 1974668 - RNA, 14 nt, Human
agcacagcucccuu

SEQ ID NO: 1974669 - RNA, 21 nt, Human
ugagcaucaggccaggcccuc

SEQ ID NO: 1974670 - RNA, 24 nt, Human
ugagcaucaggccaggcccucugc

SEQ ID NO: 1974671 - RNA, 22 nt, Human
ugagcaucaggccaggcccucu

SEQ ID NO: 1974672 - RNA, 15 nt, Human
ugagccaccacgccc

SEQ ID NO: 1974673 - RNA, 14 nt, Human
ugagccaccgugcc

SEQ ID NO: 1974674 - RNA, 23 nt, Human
ugagcaucgcuuaggagaagucu

SEQ ID NO: 1974675 - RNA, 21 nt, Human
ugagccacugcaccgggccac

SEQ ID NO: 1974676 - RNA, 18 nt, Human
ugagccacugcaccgggc

SEQ ID NO: 1974677 - RNA, 18 nt, Human
ugagccaccgugccuggc

SEQ ID NO: 1974678 - RNA, 19 nt, Human
ugagccaccgugccuggcc

SEQ ID NO: 1974679 - RNA, 20 nt, Human
ugagccaccgugccuggcca

SEQ ID NO: 1974680 - RNA, 21 nt, Human
ugagccaccgugccuggccac

SEQ ID NO: 1974681 - RNA, 16 nt, Human
ugagccagauuucacu

SEQ ID NO: 1974682 - RNA, 14 nt, Human
ugagccagauuuca

SEQ ID NO: 1974683 - RNA, 13 nt, Human
ugagccagauuuc

SEQ ID NO: 1974684 - RNA, 23 nt, Human
ugagccacugcaccgggccacag

SEQ ID NO: 1974685 - RNA, 15 nt, Human
ugagcaauccugcaa

SEQ ID NO: 1974686 - RNA, 15 nt, Human
ugagcaaauguggcu

SEQ ID NO: 1974687 - RNA, 15 nt, Human
ugagcaacaagaauc

SEQ ID NO: 1974688 - RNA, 16 nt, Human
ugagcaaauguggcuc

SEQ ID NO: 1974689 - RNA, 19 nt, Human
agcaacgaucacaaaugac

SEQ ID NO: 1974690 - RNA, 20 nt, Human
agcaacgaucacaaaugacu

SEQ ID NO: 1974691 - RNA, 21 nt, Human
agcaacgaucacaaaugacuu

SEQ ID NO: 1974692 - RNA, 22 nt, Human
agcaacgaucacaaaugacuuu

SEQ ID NO: 1974693 - RNA, 18 nt, Human
ugagcaaauguggcuccu

SEQ ID NO: 1974694 - RNA, 19 nt, Human
ugagcaaauguggcuccug

SEQ ID NO: 1974695 - RNA, 18 nt, Human
agcaacgaucacaaauga

SEQ ID NO: 1974696 - RNA, 24 nt, Human
agcaaccccuggaccccagccuca

SEQ ID NO: 1974697 - RNA, 21 nt, Human
agcaaccccuggaccccagcc

SEQ ID NO: 1974698 - RNA, 23 nt, Human
agcaaccccuggaccccagccuc

SEQ ID NO: 1974699 - RNA, 20 nt, Human
ugagcacuaaggugugcucu

SEQ ID NO: 1974700 - RNA, 21 nt, Human
ugagcacuaaggugugcucug

SEQ ID NO: 1974701 - RNA, 22 nt, Human
ugagcacuaaggugugcucuga

SEQ ID NO: 1974702 - RNA, 23 nt, Human
ugagcacuaaggugugcucugau

SEQ ID NO: 1974703 - RNA, 14 nt, Human
ugagcaagcccagg

SEQ ID NO: 1974704 - RNA, 15 nt, Human
ugagcaagcccagga

SEQ ID NO: 1974705 - RNA, 13 nt, Human
agcagaaggaagg

SEQ ID NO: 1974706 - RNA, 14 nt, Human
agcagaacagugau

SEQ ID NO: 1974707 - RNA, 21 nt, Human
agcagaaauucuguuuuuaaa

SEQ ID NO: 1974708 - RNA, 19 nt, Human
agcagaaaugccuuacccu

SEQ ID NO: 1974709 - RNA, 14 nt, Human
agcagaaauucugu

SEQ ID NO: 1974710 - RNA, 16 nt, Human
agcagaaauucuguuu

SEQ ID NO: 1974711 - RNA, 20 nt, Human
agcagaaauucuguuuuuaa

SEQ ID NO: 1974712 - RNA, 12 nt, Human
agcagaaaugcc

SEQ ID NO: 1974713 - RNA, 13 nt, Human
agcagaaaugccu

SEQ ID NO: 1974714 - RNA, 14 nt, Human
agcacuuuuuaaaa

SEQ ID NO: 1974715 - RNA, 23 nt, Human
agcacuuugggaggccaaggugg

SEQ ID NO: 1974716 - RNA, 22 nt, Human
agcacuuugggaggccaaggug

SEQ ID NO: 1974717 - RNA, 22 nt, Human
agcaccuuagacagucccugcc

SEQ ID NO: 1974718 - RNA, 21 nt, Human
agcaccuuagacagucccugc

SEQ ID NO: 1974719 - RNA, 20 nt, Human
agcaccuuagacagucccug

SEQ ID NO: 1974720 - RNA, 19 nt, Human
agcaccuuagacagucccu

SEQ ID NO: 1974721 - RNA, 10 nt, Human
agcaccaggg

SEQ ID NO: 1974722 - RNA, 12 nt, Human
agcaccagggaa

SEQ ID NO: 1974723 - RNA, 13 nt, Human
agcaccagggaag

SEQ ID NO: 1974724 - RNA, 18 nt, Human
agcaccacucaagaccaa

SEQ ID NO: 1974725 - RNA, 15 nt, Human
agcaccacccuccuu

SEQ ID NO: 1974726 - RNA, 16 nt, Human
agcaccacccuccuuc

SEQ ID NO: 1974727 - RNA, 18 nt, Human
agcaccacccuccuuccc

SEQ ID NO: 1974728 - RNA, 23 nt, Human
agcaccuuagacagucccugcca

SEQ ID NO: 1974729 - RNA, 13 nt, Human
agcacgauuucug

SEQ ID NO: 1974730 - RNA, 14 nt, Human
agcacgauuucugu

SEQ ID NO: 1974731 - RNA, 15 nt, Human
agcacgauuucuguu

SEQ ID NO: 1974732 - RNA, 16 nt, Human
agcacgauuucuguuu

SEQ ID NO: 1974733 - RNA, 13 nt, Human
ugagcgacaguga

SEQ ID NO: 1974734 - RNA, 14 nt, Human
ugagcgacagugag

SEQ ID NO: 1974735 - RNA, 16 nt, Human
ugagcgacagugagac

SEQ ID NO: 1974736 - RNA, 20 nt, Human
ugagcgacagugagacucug

SEQ ID NO: 1974737 - RNA, 15 nt, Human
ugagccuugaacuuu

SEQ ID NO: 1974738 - RNA, 17 nt, Human
ugagccuugaacuuuga

SEQ ID NO: 1974739 - RNA, 18 nt, Human
ugagccuugaacuuugac

SEQ ID NO: 1974740 - RNA, 19 nt, Human
ugagccuugaacuuugacc

SEQ ID NO: 1974741 - RNA, 14 nt, Human
ugagccuugaacuu

SEQ ID NO: 1974742 - RNA, 22 nt, Human
ugagccugggaggucaaggcug

SEQ ID NO: 1974743 - RNA, 19 nt, Human
ugagccugggaggucaagg

SEQ ID NO: 1974744 - RNA, 16 nt, Human
ugagccuggcaagaau

SEQ ID NO: 1974745 - RNA, 11 nt, Human
ugagccuggca

SEQ ID NO: 1974746 - RNA, 14 nt, Human
ugagccugggaggu

SEQ ID NO: 1974747 - RNA, 10 nt, Human
ugagccuggc

SEQ ID NO: 1974748 - RNA, 18 nt, Human
agcagacuuuuaaagacu

SEQ ID NO: 1974749 - RNA, 16 nt, Human
agcagagaccaucccu

SEQ ID NO: 1974750 - RNA, 15 nt, Human
agcagagaccauccc

SEQ ID NO: 1974751 - RNA, 21 nt, Human
agcagagaauucucuuaucca

SEQ ID NO: 1974752 - RNA, 14 nt, Human
agcagagaauucuc

SEQ ID NO: 1974753 - RNA, 22 nt, Human
agcagagaaugaaagggcccag

SEQ ID NO: 1974754 - RNA, 23 nt, Human
agcagagaaugaaagggcccaga

SEQ ID NO: 1974755 - RNA, 21 nt, Human
agcagagaaugaaagggccca

SEQ ID NO: 1974756 - RNA, 17 nt, Human
agcagacacccuuggag

SEQ ID NO: 1974757 - RNA, 18 nt, Human
agcagaauugaccgacag

SEQ ID NO: 1974758 - RNA, 13 nt, Human
agcagaauuggaa

SEQ ID NO: 1974759 - RNA, 14 nt, Human
agcagaauuggaaa

SEQ ID NO: 1974760 - RNA, 17 nt, Human
agcagaauuggaaaaga

SEQ ID NO: 1974761 - RNA, 19 nt, Human
agcagaauuggaaaagacu

SEQ ID NO: 1974762 - RNA, 20 nt, Human
ugaggcccagagggccugca

SEQ ID NO: 1974763 - RNA, 18 nt, Human
ugaggcccagagggccug

SEQ ID NO: 1974764 - RNA, 17 nt, Human
ugaggcccagagggccu

SEQ ID NO: 1974765 - RNA, 15 nt, Human
ugaggcccagagggc

SEQ ID NO: 1974766 - RNA, 22 nt, Human
ugaggcccagagggccugcaag

SEQ ID NO: 1974767 - RNA, 21 nt, Human
ugaggcccagagggccugcaa

SEQ ID NO: 1974768 - RNA, 23 nt, Human
ugaggcccagagggccugcaagg

SEQ ID NO: 1974769 - RNA, 16 nt, Human
ugaggccagagacaca

SEQ ID NO: 1974770 - RNA, 14 nt, Human
ugaggccagagaca

SEQ ID NO: 1974771 - RNA, 20 nt, Human
ugaggccagagacacaagcc

SEQ ID NO: 1974772 - RNA, 13 nt, Human
ugaggcccagagg

SEQ ID NO: 1974773 - RNA, 12 nt, Human
ugaggcccagag

SEQ ID NO: 1974774 - RNA, 17 nt, Human
ugaggacauaaaucuuc

SEQ ID NO: 1974775 - RNA, 19 nt, Human
ugaggacauggcuucugaa

SEQ ID NO: 1974776 - RNA, 12 nt, Human
ugaggccagaga

SEQ ID NO: 1974777 - RNA, 21 nt, Human
ugaggacacuaaccacgcugg

SEQ ID NO: 1974778 - RNA, 21 nt, Human
ugaggaauccagacccggcug

SEQ ID NO: 1974779 - RNA, 22 nt, Human
ugaggaauccagacccggcugc

SEQ ID NO: 1974780 - RNA, 18 nt, Human
ugaggaauggacauuucu

SEQ ID NO: 1974781 - RNA, 13 nt, Human
ugaggacaagaga

SEQ ID NO: 1974782 - RNA, 22 nt, Human
ugaggacaagagaaaaaagcca

SEQ ID NO: 1974783 - RNA, 17 nt, Human
ugaggaagagggacugu

SEQ ID NO: 1974784 - RNA, 21 nt, Human
ugaggaagccgcuggggccag

SEQ ID NO: 1974785 - RNA, 19 nt, Human
ugaggaagccgcuggggcc

SEQ ID NO: 1974786 - RNA, 18 nt, Human
ugaggaagccgcuggggc

SEQ ID NO: 1974787 - RNA, 17 nt, Human
ugaggaagccgcugggg

SEQ ID NO: 1974788 - RNA, 14 nt, Human
ugaggaagccgcug

SEQ ID NO: 1974789 - RNA, 22 nt, Human
ugaggaagcaaaagcaucuaug

SEQ ID NO: 1974790 - RNA, 16 nt, Human
ugaggaaacaacagcu

SEQ ID NO: 1974791 - RNA, 18 nt, Human
ugaggaaaaauaugugaa

SEQ ID NO: 1974792 - RNA, 19 nt, Human
ugaggaaaaauaugugaag

SEQ ID NO: 1974793 - RNA, 15 nt, Human
ugaggaaaaauaugu

SEQ ID NO: 1974794 - RNA, 16 nt, Human
ugaggaaaaauaugug

SEQ ID NO: 1974795 - RNA, 15 nt, Human
ugaggaagcaaaagc

SEQ ID NO: 1974796 - RNA, 15 nt, Human
ugaggaaaucaaagu

SEQ ID NO: 1974797 - RNA, 16 nt, Human
ugaggaaaucaaagug

SEQ ID NO: 1974798 - RNA, 18 nt, Human
ugaggaaaucaaagugcu

SEQ ID NO: 1974799 - RNA, 22 nt, Human
ugaggaaaucaaagugcuauua

SEQ ID NO: 1974800 - RNA, 14 nt, Human
ugaggaaauuugca

SEQ ID NO: 1974801 - RNA, 15 nt, Human
ugaggaaauuugcag

SEQ ID NO: 1974802 - RNA, 16 nt, Human
ugaggaaauuugcagc

SEQ ID NO: 1974803 - RNA, 13 nt, Human
ugagcuacaaaug

SEQ ID NO: 1974804 - RNA, 14 nt, Human
ugagcuacaaaugc

SEQ ID NO: 1974805 - RNA, 14 nt, Human
ugagccuucugagc

SEQ ID NO: 1974806 - RNA, 14 nt, Human
ugagcuaggaauug

SEQ ID NO: 1974807 - RNA, 14 nt, Human
ugagcuaugacuua

SEQ ID NO: 1974808 - RNA, 15 nt, Human
ugagcuaugacuuaa

SEQ ID NO: 1974809 - RNA, 19 nt, Human
ugagcuaugacuuaacaua

SEQ ID NO: 1974810 - RNA, 16 nt, Human
ugagcuacaaaugcau

SEQ ID NO: 1974811 - RNA, 20 nt, Human
agcagagcaccuuagacagu

SEQ ID NO: 1974812 - RNA, 20 nt, Human
agcagagaccaucccugaag

SEQ ID NO: 1974813 - RNA, 19 nt, Human
ugagguacaaccuguucug

SEQ ID NO: 1974814 - RNA, 19 nt, Human
agcagagagcauuauaauc

SEQ ID NO: 1974815 - RNA, 19 nt, Human
agcagagaccaucccugaa

SEQ ID NO: 1974816 - RNA, 18 nt, Human
agcagagaccaucccuga

SEQ ID NO: 1974817 - RNA, 17 nt, Human
agcagagaccaucccug

SEQ ID NO: 1974818 - RNA, 17 nt, Human
ugaggucagagccugca

SEQ ID NO: 1974819 - RNA, 14 nt, Human
ugaggucagagccu

SEQ ID NO: 1974820 - RNA, 16 nt, Human
ugaggucagagccugc

SEQ ID NO: 1974821 - RNA, 22 nt, Human
ugagguacugagagugaacaaa

SEQ ID NO: 1974822 - RNA, 13 nt, Human
ugaggucagagcc

SEQ ID NO: 1974823 - RNA, 17 nt, Human
ugagguacugagaguga

SEQ ID NO: 1974824 - RNA, 18 nt, Human
ugaggguuucagagagcc

SEQ ID NO: 1974825 - RNA, 22 nt, Human
ugagggugacuauggagcugag

SEQ ID NO: 1974826 - RNA, 20 nt, Human
ugaggguugggcugguguca

SEQ ID NO: 1974827 - RNA, 19 nt, Human
agcagaugcaaugacucag

SEQ ID NO: 1974828 - RNA, 19 nt, Human
agcagauggagaccccuug

SEQ ID NO: 1974829 - RNA, 17 nt, Human
agcagaggaaggagagg

SEQ ID NO: 1974830 - RNA, 24 nt, Human
ugaggcccuucucuccagccccug

SEQ ID NO: 1974831 - RNA, 23 nt, Human
ugaggcccuucucuccagccccu

SEQ ID NO: 1974832 - RNA, 22 nt, Human
ugaggcccuucucuccagcccc

SEQ ID NO: 1974833 - RNA, 20 nt, Human
ugaggcccuucucuccagcc

SEQ ID NO: 1974834 - RNA, 19 nt, Human
ugaggcccuucucuccagc

SEQ ID NO: 1974835 - RNA, 18 nt, Human
ugaggcccuucucuccag

SEQ ID NO: 1974836 - RNA, 16 nt, Human
ugaggcccuucucucc

SEQ ID NO: 1974837 - RNA, 19 nt, Human
ugagggauacccaucccau

SEQ ID NO: 1974838 - RNA, 15 nt, Human
ugagggauuaucuuu

SEQ ID NO: 1974839 - RNA, 14 nt, Human
ugaggcccugccca

SEQ ID NO: 1974840 - RNA, 14 nt, Human
ugaggccguugcug

SEQ ID NO: 1974841 - RNA, 17 nt, Human
ugaggccguugcugacu

SEQ ID NO: 1974842 - RNA, 19 nt, Human
ugaggccguugcugacuua

SEQ ID NO: 1974843 - RNA, 20 nt, Human
ugaggccguugcugacuuag

SEQ ID NO: 1974844 - RNA, 21 nt, Human
ugaggccguugcugacuuaga

SEQ ID NO: 1974845 - RNA, 22 nt, Human
ugaggccguugcugacuuagaa

SEQ ID NO: 1974846 - RNA, 12 nt, Human
ugaggggccucu

SEQ ID NO: 1974847 - RNA, 18 nt, Human
ugaggggcagccugccuu

SEQ ID NO: 1974848 - RNA, 14 nt, Human
ugaggggagccagg

SEQ ID NO: 1974849 - RNA, 15 nt, Human
ugaggggagccagga

SEQ ID NO: 1974850 - RNA, 18 nt, Human
ugaggggagccaggaggg

SEQ ID NO: 1974851 - RNA, 23 nt, Human
ugaggggagacagagcaaccccu

SEQ ID NO: 1974852 - RNA, 13 nt, Human
ugagggcuuguag

SEQ ID NO: 1974853 - RNA, 14 nt, Human
ugagggcagugcaa

SEQ ID NO: 1974854 - RNA, 15 nt, Human
ugagggcagugcaag

SEQ ID NO: 1974855 - RNA, 13 nt, Human
ugaggggccucuu

SEQ ID NO: 1974856 - RNA, 14 nt, Human
ugaggguaaguauu

SEQ ID NO: 1974857 - RNA, 13 nt, Human
ucaccucccccau

SEQ ID NO: 1974858 - RNA, 15 nt, Human
ucaccucccccaucu

SEQ ID NO: 1974859 - RNA, 15 nt, Human
accaggccccccugu

SEQ ID NO: 1974860 - RNA, 19 nt, Human
ucaccugaagacucauucu

SEQ ID NO: 1974861 - RNA, 23 nt, Human
ucaccugaagacucauucuucug

SEQ ID NO: 1974862 - RNA, 19 nt, Human
accaggcaacuugggaacu

SEQ ID NO: 1974863 - RNA, 19 nt, Human
accaggcaccuccccuccc

SEQ ID NO: 1974864 - RNA, 15 nt, Human
accaggcaccucccc

SEQ ID NO: 1974865 - RNA, 23 nt, Human
accaggcaccuccccucccgccc

SEQ ID NO: 1974866 - RNA, 23 nt, Human
accagcgcacugauggucacugg

SEQ ID NO: 1974867 - RNA, 19 nt, Human
accagagcccaccuuggcu

SEQ ID NO: 1974868 - RNA, 22 nt, Human
accagagcccaccuuggcucaa

SEQ ID NO: 1974869 - RNA, 22 nt, Human
accagacaccuugacagggcac

SEQ ID NO: 1974870 - RNA, 23 nt, Human
accagacaccuugacagggcaca

SEQ ID NO: 1974871 - RNA, 12 nt, Human
accacuuuuguu

SEQ ID NO: 1974872 - RNA, 17 nt, Human
accagacaccuugacag

SEQ ID NO: 1974873 - RNA, 13 nt, Human
accacugcagaag

SEQ ID NO: 1974874 - RNA, 14 nt, Human
accacugaaucugu

SEQ ID NO: 1974875 - RNA, 14 nt, Human
accacugcagaaga

SEQ ID NO: 1974876 - RNA, 19 nt, Human
accacugcagaagacagua

SEQ ID NO: 1974877 - RNA, 14 nt, Human
accacuucagcuga

SEQ ID NO: 1974878 - RNA, 13 nt, Human
accacuucagcug

SEQ ID NO: 1974879 - RNA, 15 nt, Human
accacuucagcugac

SEQ ID NO: 1974880 - RNA, 16 nt, Human
accacucaagaccaaa

SEQ ID NO: 1974881 - RNA, 20 nt, Human
accacucuaucaaguauuau

SEQ ID NO: 1974882 - RNA, 16 nt, Human
accacaucuugcucug

SEQ ID NO: 1974883 - RNA, 20 nt, Human
accacaucuugcucugcuga

SEQ ID NO: 1974884 - RNA, 21 nt, Human
accacaucuugcucugcugac

SEQ ID NO: 1974885 - RNA, 24 nt, Human
accacaucuugcucugcugacaga

SEQ ID NO: 1974886 - RNA, 20 nt, Human
accacacuugucggcuccag

SEQ ID NO: 1974887 - RNA, 22 nt, Human
uauuucauucgggccccaccug

SEQ ID NO: 1974888 - RNA, 20 nt, Human
uauuucaugaauacauugua

SEQ ID NO: 1974889 - RNA, 19 nt, Human
uauuucaucagaacagcug

SEQ ID NO: 1974890 - RNA, 22 nt, Human
uauuucaguuauugucccuggc

SEQ ID NO: 1974891 - RNA, 18 nt, Human
uauuucagcaaacuuguu

SEQ ID NO: 1974892 - RNA, 23 nt, Human
uauuucaguuauugucccuggcu

SEQ ID NO: 1974893 - RNA, 20 nt, Human
uauuucaucagaacagcugu

SEQ ID NO: 1974894 - RNA, 20 nt, Human
uauuucaucauauuauacag

SEQ ID NO: 1974895 - RNA, 21 nt, Human
uauuucaucauauuauacaga

SEQ ID NO: 1974896 - RNA, 14 nt, Human
uauuucagaaguuu

SEQ ID NO: 1974897 - RNA, 16 nt, Human
uauuucagaaguuuaa

SEQ ID NO: 1974898 - RNA, 23 nt, Human
uauuucagaaguuuaaauauuaa

SEQ ID NO: 1974899 - RNA, 16 nt, Human
uauuucagcaaacuug

SEQ ID NO: 1974900 - RNA, 20 nt, Human
uauuucacuuuaguuuuuga

SEQ ID NO: 1974901 - RNA, 12 nt, Human
uauuucagaaau

SEQ ID NO: 1974902 - RNA, 13 nt, Human
uauuucagaaaua

SEQ ID NO: 1974903 - RNA, 14 nt, Human
uauuucagaaauac

SEQ ID NO: 1974904 - RNA, 12 nt, Human
accacagacuuu

SEQ ID NO: 1974905 - RNA, 23 nt, Human
accacagacuuuagcuuucugag

SEQ ID NO: 1974906 - RNA, 23 nt, Human
accacagcaacgaucacaaauga

SEQ ID NO: 1974907 - RNA, 21 nt, Human
accacagacauacuaaccagc

SEQ ID NO: 1974908 - RNA, 22 nt, Human
accacagacauacuaaccagca

SEQ ID NO: 1974909 - RNA, 14 nt, Human
accacaucuugcuc

SEQ ID NO: 1974910 - RNA, 18 nt, Human
accacauacguaaaaauc

SEQ ID NO: 1974911 - RNA, 22 nt, Human
accacaguguaccauuaaaaua

SEQ ID NO: 1974912 - RNA, 15 nt, Human
ucacugagacagccc

SEQ ID NO: 1974913 - RNA, 14 nt, Human
ucacugagacagcc

SEQ ID NO: 1974914 - RNA, 13 nt, Human
ucacugagacagc

SEQ ID NO: 1974915 - RNA, 16 nt, Human
ucaccugccccucaac

SEQ ID NO: 1974916 - RNA, 23 nt, Human
ucaccugcuucucugcccagcuu

SEQ ID NO: 1974917 - RNA, 13 nt, Human
ucaccugcuucuc

SEQ ID NO: 1974918 - RNA, 15 nt, Human
ucaccugcuucucug

SEQ ID NO: 1974919 - RNA, 17 nt, Human
ucaccugcuucucugcc

SEQ ID NO: 1974920 - RNA, 22 nt, Human
ucaccugcuucucugcccagcu

SEQ ID NO: 1974921 - RNA, 16 nt, Human
ucacuguccuccaagc

SEQ ID NO: 1974922 - RNA, 15 nt, Human
ucacuguccuccaag

SEQ ID NO: 1974923 - RNA, 19 nt, Human
ucacuguccuccaagccag

SEQ ID NO: 1974924 - RNA, 14 nt, Human
ucacugucugucug

SEQ ID NO: 1974925 - RNA, 16 nt, Human
ucacuguugcccaggc

SEQ ID NO: 1974926 - RNA, 13 nt, Human
ucacugcagccuc

SEQ ID NO: 1974927 - RNA, 12 nt, Human
ucacugcagccu

SEQ ID NO: 1974928 - RNA, 20 nt, Human
ucacugcacagugcaucuca

SEQ ID NO: 1974929 - RNA, 22 nt, Human
ucacugcacagugcaucucagc

SEQ ID NO: 1974930 - RNA, 24 nt, Human
ucacugcacagugcaucucagccc

SEQ ID NO: 1974931 - RNA, 15 nt, Human
accagggccagaagu

SEQ ID NO: 1974932 - RNA, 22 nt, Human
accagggccagaaguagcuuug

SEQ ID NO: 1974933 - RNA, 19 nt, Human
ucacuguugcccaggcugg

SEQ ID NO: 1974934 - RNA, 17 nt, Human
ucacuguugcccaggcu

SEQ ID NO: 1974935 - RNA, 18 nt, Human
ucacuguugcccaggcug

SEQ ID NO: 1974936 - RNA, 21 nt, Human
accaguguuguggauuuaaca

SEQ ID NO: 1974937 - RNA, 12 nt, Human
accagugccuua

SEQ ID NO: 1974938 - RNA, 15 nt, Human
accaguucugggcaa

SEQ ID NO: 1974939 - RNA, 18 nt, Human
accauucuccaccugcca

SEQ ID NO: 1974940 - RNA, 16 nt, Human
accauucuccaccugc

SEQ ID NO: 1974941 - RNA, 13 nt, Human
accauucuccacc

SEQ ID NO: 1974942 - RNA, 22 nt, Human
accaugauuaaccacuucagcu

SEQ ID NO: 1974943 - RNA, 23 nt, Human
accaugauuaaccacuucagcug

SEQ ID NO: 1974944 - RNA, 15 nt, Human
accauuccccauggg

SEQ ID NO: 1974945 - RNA, 12 nt, Human
accauuccccau

SEQ ID NO: 1974946 - RNA, 13 nt, Human
accauuuaucuug

SEQ ID NO: 1974947 - RNA, 15 nt, Human
accauuuaucuugaa

SEQ ID NO: 1974948 - RNA, 16 nt, Human
accauuuaucuugaag

SEQ ID NO: 1974949 - RNA, 23 nt, Human
accauuucaguaaaccugucuga

SEQ ID NO: 1974950 - RNA, 16 nt, Human
accauuuccccagggc

SEQ ID NO: 1974951 - RNA, 17 nt, Human
accauuuccccagggca

SEQ ID NO: 1974952 - RNA, 18 nt, Human
accauuuccccagggcac

SEQ ID NO: 1974953 - RNA, 19 nt, Human
accauuuccccagggcacg

SEQ ID NO: 1974954 - RNA, 19 nt, Human
accauuuccguaauucuua

SEQ ID NO: 1974955 - RNA, 22 nt, Human
accauuuugggguacccacugc

SEQ ID NO: 1974956 - RNA, 13 nt, Human
acccaaaaggcag

SEQ ID NO: 1974957 - RNA, 15 nt, Human
acccaaaaggcagaa

SEQ ID NO: 1974958 - RNA, 23 nt, Human
accauuuugggguacccacugcu

SEQ ID NO: 1974959 - RNA, 16 nt, Human
acccagcccacuucug

SEQ ID NO: 1974960 - RNA, 17 nt, Human
acccagcccacuucugc

SEQ ID NO: 1974961 - RNA, 20 nt, Human
acccagaaacgccacauccc

SEQ ID NO: 1974962 - RNA, 21 nt, Human
acccagaaacgccacaucccc

SEQ ID NO: 1974963 - RNA, 21 nt, Human
acccagaaaaucugaauugga

SEQ ID NO: 1974964 - RNA, 18 nt, Human
acccagcccacuucugcc

SEQ ID NO: 1974965 - RNA, 14 nt, Human
ucagaacaaauuca

SEQ ID NO: 1974966 - RNA, 14 nt, Human
ucagaacagcuguu

SEQ ID NO: 1974967 - RNA, 16 nt, Human
ucagaacagcuguuga

SEQ ID NO: 1974968 - RNA, 12 nt, Human
ucagaacagcug

SEQ ID NO: 1974969 - RNA, 16 nt, Human
ucagaacaaauucagg

SEQ ID NO: 1974970 - RNA, 21 nt, Human
acccaaauguucaucaaugaa

SEQ ID NO: 1974971 - RNA, 18 nt, Human
acccaaaaggcagaagca

SEQ ID NO: 1974972 - RNA, 16 nt, Human
acccagaagaaaauag

SEQ ID NO: 1974973 - RNA, 19 nt, Human
acccacuugcuuuuaaaau

SEQ ID NO: 1974974 - RNA, 15 nt, Human
acccaagcaggaggc

SEQ ID NO: 1974975 - RNA, 19 nt, Human
accccuggcuccaggccag

SEQ ID NO: 1974976 - RNA, 20 nt, Human
accccuggcuccaggccagg

SEQ ID NO: 1974977 - RNA, 22 nt, Human
accccuggcuccaggccagggg

SEQ ID NO: 1974978 - RNA, 12 nt, Human
accccuggcuuu

SEQ ID NO: 1974979 - RNA, 18 nt, Human
accccuggaccccagccu

SEQ ID NO: 1974980 - RNA, 20 nt, Human
accccuggaccccagccuca

SEQ ID NO: 1974981 - RNA, 23 nt, Human
accccuggaccccagccucaaau

SEQ ID NO: 1974982 - RNA, 12 nt, Human
ucagccugggca

SEQ ID NO: 1974983 - RNA, 10 nt, Human
ucagccuggg

SEQ ID NO: 1974984 - RNA, 19 nt, Human
ucagccuggcuucaaauug

SEQ ID NO: 1974985 - RNA, 17 nt, Human
accccuucccauuccau

SEQ ID NO: 1974986 - RNA, 15 nt, Human
accccuggcuuuuca

SEQ ID NO: 1974987 - RNA, 17 nt, Human
accccuggcuuuucacu

SEQ ID NO: 1974988 - RNA, 15 nt, Human
acccccauucugucc

SEQ ID NO: 1974989 - RNA, 16 nt, Human
acccccauucuguccu

SEQ ID NO: 1974990 - RNA, 16 nt, Human
acccccaggaccccug

SEQ ID NO: 1974991 - RNA, 12 nt, Human
acccccagcucc

SEQ ID NO: 1974992 - RNA, 13 nt, Human
acccccagcuccc

SEQ ID NO: 1974993 - RNA, 15 nt, Human
accccaucugugaau

SEQ ID NO: 1974994 - RNA, 16 nt, Human
accccaucugugaaua

SEQ ID NO: 1974995 - RNA, 18 nt, Human
accccaucugugaauaag

SEQ ID NO: 1974996 - RNA, 14 nt, Human
accccauggccggc

SEQ ID NO: 1974997 - RNA, 20 nt, Human
accccauggccggcuuucag

SEQ ID NO: 1974998 - RNA, 14 nt, Human
acccccagccugcu

SEQ ID NO: 1974999 - RNA, 15 nt, Human
acccccagccugcua

SEQ ID NO: 1975000 - RNA, 19 nt, Human
ucagcccucccugccccuc

SEQ ID NO: 1975001 - RNA, 18 nt, Human
ucagcccucccugccccu

SEQ ID NO: 1975002 - RNA, 22 nt, Human
acccagcuaugguucucucgca

SEQ ID NO: 1975003 - RNA, 15 nt, Human
acccagcucuggucc

SEQ ID NO: 1975004 - RNA, 13 nt, Human
acccagcucuggu

SEQ ID NO: 1975005 - RNA, 16 nt, Human
acccagguguggccua

SEQ ID NO: 1975006 - RNA, 13 nt, Human
acccagcugcacc

SEQ ID NO: 1975007 - RNA, 14 nt, Human
acccagcugcaccc

SEQ ID NO: 1975008 - RNA, 20 nt, Human
acccagcugcaccccuuccu

SEQ ID NO: 1975009 - RNA, 20 nt, Human
acccagguuuugcacucuug

SEQ ID NO: 1975010 - RNA, 15 nt, Human
ucagaacuguuuuug

SEQ ID NO: 1975011 - RNA, 13 nt, Human
ucagaucuucugu

SEQ ID NO: 1975012 - RNA, 13 nt, Human
ucagaagacacug

SEQ ID NO: 1975013 - RNA, 14 nt, Human
ucagaagaaaauua

SEQ ID NO: 1975014 - RNA, 13 nt, Human
ucagauguuuaaa

SEQ ID NO: 1975015 - RNA, 15 nt, Human
ucagauguuuaaaac

SEQ ID NO: 1975016 - RNA, 17 nt, Human
ucagauguuuaaaacac

SEQ ID NO: 1975017 - RNA, 16 nt, Human
ucagauguuuaaaaca

SEQ ID NO: 1975018 - RNA, 13 nt, Human
ucagauucaggca

SEQ ID NO: 1975019 - RNA, 16 nt, Human
ucagauucaggcauuu

SEQ ID NO: 1975020 - RNA, 15 nt, Human
ucaggccgaaggagg

SEQ ID NO: 1975021 - RNA, 14 nt, Human
ucaggcccaaagcc

SEQ ID NO: 1975022 - RNA, 22 nt, Human
ucaggcauuuucccccuuggcu

SEQ ID NO: 1975023 - RNA, 12 nt, Human
ucaggccaggcc

SEQ ID NO: 1975024 - RNA, 11 nt, Human
ucaggccaggc

SEQ ID NO: 1975025 - RNA, 20 nt, Human
ucaggccagcugcuugggcu

SEQ ID NO: 1975026 - RNA, 15 nt, Human
ucaggccagcugcuu

SEQ ID NO: 1975027 - RNA, 18 nt, Human
ucagggucccugguggca

SEQ ID NO: 1975028 - RNA, 14 nt, Human
ucagggucccuggu

SEQ ID NO: 1975029 - RNA, 13 nt, Human
ucagggucccugg

SEQ ID NO: 1975030 - RNA, 13 nt, Human
ucagguaacaggc

SEQ ID NO: 1975031 - RNA, 15 nt, Human
ucagguaacaggcag

SEQ ID NO: 1975032 - RNA, 16 nt, Human
ucagguaacaggcaga

SEQ ID NO: 1975033 - RNA, 19 nt, Human
accccuucgcuccuguguc

SEQ ID NO: 1975034 - RNA, 20 nt, Human
ucaggaagcucagggccugg

SEQ ID NO: 1975035 - RNA, 19 nt, Human
ucaggaagcucagggccug

SEQ ID NO: 1975036 - RNA, 17 nt, Human
ucaggaagcucagggcc

SEQ ID NO: 1975037 - RNA, 16 nt, Human
ucaggaagcucagggc

SEQ ID NO: 1975038 - RNA, 17 nt, Human
ucaggcauuuucccccu

SEQ ID NO: 1975039 - RNA, 23 nt, Human
ucaggccaaacucaccugccccu

SEQ ID NO: 1975040 - RNA, 20 nt, Human
ucaggccaaacucaccugcc

SEQ ID NO: 1975041 - RNA, 15 nt, Human
ucagcggggacagcu

SEQ ID NO: 1975042 - RNA, 16 nt, Human
ucagcggggacagcuc

SEQ ID NO: 1975043 - RNA, 17 nt, Human
ucagcggggacagcucc

SEQ ID NO: 1975044 - RNA, 18 nt, Human
ucagcggggacagcuccu

SEQ ID NO: 1975045 - RNA, 23 nt, Human
acccuuccaucugauuccagcac

SEQ ID NO: 1975046 - RNA, 15 nt, Human
acccuugugguccca

SEQ ID NO: 1975047 - RNA, 19 nt, Human
acccuuguggucccacccc

SEQ ID NO: 1975048 - RNA, 17 nt, Human
acccuuguggucccacc

SEQ ID NO: 1975049 - RNA, 16 nt, Human
acccuuguggucccac

SEQ ID NO: 1975050 - RNA, 12 nt, Human
acccugcccugu

SEQ ID NO: 1975051 - RNA, 11 nt, Human
acccugcccug

SEQ ID NO: 1975052 - RNA, 13 nt, Human
acccugcccugug

SEQ ID NO: 1975053 - RNA, 14 nt, Human
acccugcccugugg

SEQ ID NO: 1975054 - RNA, 14 nt, Human
acccucuuagaaaa

SEQ ID NO: 1975055 - RNA, 15 nt, Human
acccuccacucuccu

SEQ ID NO: 1975056 - RNA, 23 nt, Human
acccucccucuacugggagccua

SEQ ID NO: 1975057 - RNA, 12 nt, Human
acccuccaaggc

SEQ ID NO: 1975058 - RNA, 14 nt, Human
acccuccaaggcca

SEQ ID NO: 1975059 - RNA, 15 nt, Human
acccgagcugggacc

SEQ ID NO: 1975060 - RNA, 15 nt, Human
acccgacuccagucc

SEQ ID NO: 1975061 - RNA, 20 nt, Human
accccuucgcuccugugucu

SEQ ID NO: 1975062 - RNA, 14 nt, Human
accccuugauuuuc

SEQ ID NO: 1975063 - RNA, 22 nt, Human
ucaugauagaaggcuaugggga

SEQ ID NO: 1975064 - RNA, 22 nt, Human
accuccucggcuggcuguccac

SEQ ID NO: 1975065 - RNA, 19 nt, Human
ucaugacaaagacugagua

SEQ ID NO: 1975066 - RNA, 19 nt, Human
ucauccacugugccaugug

SEQ ID NO: 1975067 - RNA, 21 nt, Human
ucauccacugugccaugugcc

SEQ ID NO: 1975068 - RNA, 23 nt, Human
ucauccacugugccaugugccag

SEQ ID NO: 1975069 - RNA, 11 nt, Human
ucauguucuua

SEQ ID NO: 1975070 - RNA, 17 nt, Human
ucauguucuuaauucuu

SEQ ID NO: 1975071 - RNA, 22 nt, Human
ucauuaaccuuaucauaaauuc

SEQ ID NO: 1975072 - RNA, 14 nt, Human
ucaugugaaaucau

SEQ ID NO: 1975073 - RNA, 13 nt, Human
ucaugucuggcua

SEQ ID NO: 1975074 - RNA, 20 nt, Human
ucauguccugugucaguuua

SEQ ID NO: 1975075 - RNA, 15 nt, Human
ucauguccuguguca

SEQ ID NO: 1975076 - RNA, 16 nt, Human
ucauguccugugucag

SEQ ID NO: 1975077 - RNA, 18 nt, Human
ucauguccugugucaguu

SEQ ID NO: 1975078 - RNA, 19 nt, Human
ucauguccugugucaguuu

SEQ ID NO: 1975079 - RNA, 18 nt, Human
ucauguuaauugauagaa

SEQ ID NO: 1975080 - RNA, 19 nt, Human
ucauguucccacuucaaaa

SEQ ID NO: 1975081 - RNA, 22 nt, Human
ucauguucccacuucaaaacaa

SEQ ID NO: 1975082 - RNA, 23 nt, Human
ucauguucccacuucaaaacaaa

SEQ ID NO: 1975083 - RNA, 22 nt, Human
ucauugaccugaggcccuucuc

SEQ ID NO: 1975084 - RNA, 12 nt, Human
ucauugcuucuu

SEQ ID NO: 1975085 - RNA, 14 nt, Human
ucauugcuucuucu

SEQ ID NO: 1975086 - RNA, 16 nt, Human
ucauugcuucuucuga

SEQ ID NO: 1975087 - RNA, 17 nt, Human
ucauugcuucuucugag

SEQ ID NO: 1975088 - RNA, 22 nt, Human
ucauucuaaagauagaguaaaa

SEQ ID NO: 1975089 - RNA, 12 nt, Human
ucauucuaaaga

SEQ ID NO: 1975090 - RNA, 13 nt, Human
ucauucuaaagau

SEQ ID NO: 1975091 - RNA, 23 nt, Human
ucauucgcuacuaugauuuaauu

SEQ ID NO: 1975092 - RNA, 18 nt, Human
ucauuccuuuuuauuuau

SEQ ID NO: 1975093 - RNA, 20 nt, Human
ucauuccuuuuuauuuauau

SEQ ID NO: 1975094 - RNA, 18 nt, Human
ucauucgggccccaccug

SEQ ID NO: 1975095 - RNA, 21 nt, Human
ucauucgggccccaccugcag

SEQ ID NO: 1975096 - RNA, 21 nt, Human
ucauucuccuuguguuacuaa

SEQ ID NO: 1975097 - RNA, 19 nt, Human
ucauugaccugaggcccuu

SEQ ID NO: 1975098 - RNA, 21 nt, Human
ucauuggauucugagagcugu

SEQ ID NO: 1975099 - RNA, 13 nt, Human
ucauuguaauguu

SEQ ID NO: 1975100 - RNA, 22 nt, Human
ucauugggccauguuuaagugu

SEQ ID NO: 1975101 - RNA, 18 nt, Human
accucuaaauucuuucau

SEQ ID NO: 1975102 - RNA, 17 nt, Human
accucggugccuuccuc

SEQ ID NO: 1975103 - RNA, 18 nt, Human
accucgcuccaacuccaa

SEQ ID NO: 1975104 - RNA, 19 nt, Human
accucgcuccaacuccaac

SEQ ID NO: 1975105 - RNA, 14 nt, Human
accucuccucaugu

SEQ ID NO: 1975106 - RNA, 19 nt, Human
accucucucacuccuugaa

SEQ ID NO: 1975107 - RNA, 14 nt, Human
accucucucacucc

SEQ ID NO: 1975108 - RNA, 23 nt, Human
accucucccuuggauuguccccg

SEQ ID NO: 1975109 - RNA, 21 nt, Human
accugaagggguuuucuugau

SEQ ID NO: 1975110 - RNA, 23 nt, Human
accugaagggguuuucuugauaa

SEQ ID NO: 1975111 - RNA, 12 nt, Human
accucugcacaa

SEQ ID NO: 1975112 - RNA, 21 nt, Human
accucuaaauucuuucauuuu

SEQ ID NO: 1975113 - RNA, 16 nt, Human
accucuagcccugccc

SEQ ID NO: 1975114 - RNA, 18 nt, Human
accucuagcccugcccgg

SEQ ID NO: 1975115 - RNA, 12 nt, Human
accucuagaauu

SEQ ID NO: 1975116 - RNA, 13 nt, Human
accucuagaauuu

SEQ ID NO: 1975117 - RNA, 19 nt, Human
accucuagaauuuuaagcc

SEQ ID NO: 1975118 - RNA, 15 nt, Human
accucuagcccugcc

SEQ ID NO: 1975119 - RNA, 15 nt, Human
accucucccuuggau

SEQ ID NO: 1975120 - RNA, 14 nt, Human
accucucccuugga

SEQ ID NO: 1975121 - RNA, 13 nt, Human
accucucccuugg

SEQ ID NO: 1975122 - RNA, 16 nt, Human
accgccuccuacagcc

SEQ ID NO: 1975123 - RNA, 13 nt, Human
accgccucuuccc

SEQ ID NO: 1975124 - RNA, 14 nt, Human
accgccucuucccg

SEQ ID NO: 1975125 - RNA, 20 nt, Human
accgcagacaggaccaggga

SEQ ID NO: 1975126 - RNA, 20 nt, Human
accgaugcaaacauuggaag

SEQ ID NO: 1975127 - RNA, 20 nt, Human
accgagucucuucuccacug

SEQ ID NO: 1975128 - RNA, 21 nt, Human
accgagucucuucuccacugg

SEQ ID NO: 1975129 - RNA, 24 nt, Human
accgagucucuucuccacuggaug

SEQ ID NO: 1975130 - RNA, 17 nt, Human
accgccaaggcuggggg

SEQ ID NO: 1975131 - RNA, 21 nt, Human
accgaacugggcauauuucua

SEQ ID NO: 1975132 - RNA, 16 nt, Human
ucauauuuacuucuua

SEQ ID NO: 1975133 - RNA, 22 nt, Human
ucauauuuacuucuuauacauu

SEQ ID NO: 1975134 - RNA, 21 nt, Human
ucauauuuacuucuuauacau

SEQ ID NO: 1975135 - RNA, 20 nt, Human
ucauauuuacuucuuauaca

SEQ ID NO: 1975136 - RNA, 18 nt, Human
accgagucucuucuccac

SEQ ID NO: 1975137 - RNA, 15 nt, Human
accgacuagacacac

SEQ ID NO: 1975138 - RNA, 22 nt, Human
accgacuagacacacaaagcag

SEQ ID NO: 1975139 - RNA, 11 nt, Human
accgacaagca

SEQ ID NO: 1975140 - RNA, 10 nt, Human
acccuuuucu

SEQ ID NO: 1975141 - RNA, 15 nt, Human
acccuuuuccauuuu

SEQ ID NO: 1975142 - RNA, 13 nt, Human
ucauauuacaaua

SEQ ID NO: 1975143 - RNA, 14 nt, Human
ucauauuacaauau

SEQ ID NO: 1975144 - RNA, 15 nt, Human
ucauauuacaauauu

SEQ ID NO: 1975145 - RNA, 13 nt, Human
ucauauuagacuu

SEQ ID NO: 1975146 - RNA, 18 nt, Human
ucauauuagacuucuguu

SEQ ID NO: 1975147 - RNA, 20 nt, Human
ucauauuagacuucuguuuu

SEQ ID NO: 1975148 - RNA, 12 nt, Human
ucauauuauaca

SEQ ID NO: 1975149 - RNA, 22 nt, Human
ucauauuagacuucuguuuuca

SEQ ID NO: 1975150 - RNA, 15 nt, Human
ucauauucagcuugc

SEQ ID NO: 1975151 - RNA, 14 nt, Human
ucauauucaugcaa

SEQ ID NO: 1975152 - RNA, 21 nt, Human
ucauauucaugcaaguauucu

SEQ ID NO: 1975153 - RNA, 20 nt, Human
accuccgccucuuggguuca

SEQ ID NO: 1975154 - RNA, 11 nt, Human
accucccccac

SEQ ID NO: 1975155 - RNA, 16 nt, Human
accucccccacuccca

SEQ ID NO: 1975156 - RNA, 13 nt, Human
accuccucacauu

SEQ ID NO: 1975157 - RNA, 22 nt, Human
accuccuaaaaggcccagagag

SEQ ID NO: 1975158 - RNA, 19 nt, Human
accuccuaaaaggcccaga

SEQ ID NO: 1975159 - RNA, 21 nt, Human
accuccuaaaaggcccagaga

SEQ ID NO: 1975160 - RNA, 17 nt, Human
accuccuaaaaggccca

SEQ ID NO: 1975161 - RNA, 18 nt, Human
accuccuaaaaggcccag

SEQ ID NO: 1975162 - RNA, 14 nt, Human
accuccucccacug

SEQ ID NO: 1975163 - RNA, 15 nt, Human
accuccucccacugc

SEQ ID NO: 1975164 - RNA, 16 nt, Human
accuccucccacugcc

SEQ ID NO: 1975165 - RNA, 18 nt, Human
accuccucccacugccca

SEQ ID NO: 1975166 - RNA, 19 nt, Human
accuccucccacugcccac

SEQ ID NO: 1975167 - RNA, 18 nt, Human
accguguuugucucuucu

SEQ ID NO: 1975168 - RNA, 19 nt, Human
accguguuugucucuucug

SEQ ID NO: 1975169 - RNA, 15 nt, Human
accguguuugucucu

SEQ ID NO: 1975170 - RNA, 17 nt, Human
accuaugagugagaaua

SEQ ID NO: 1975171 - RNA, 13 nt, Human
accuagccuuaga

SEQ ID NO: 1975172 - RNA, 22 nt, Human
uccacucucucuuguucuuacu

SEQ ID NO: 1975173 - RNA, 19 nt, Human
uccacucuggauucagccu

SEQ ID NO: 1975174 - RNA, 20 nt, Human
uccacucuggauucagccuu

SEQ ID NO: 1975175 - RNA, 21 nt, Human
uccacucuggauucagccuuc

SEQ ID NO: 1975176 - RNA, 22 nt, Human
uccacucuggauucagccuucu

SEQ ID NO: 1975177 - RNA, 12 nt, Human
uccagaaugaag

SEQ ID NO: 1975178 - RNA, 19 nt, Human
uccagaaugaagaauucag

SEQ ID NO: 1975179 - RNA, 22 nt, Human
uccagaaguuugagaucagccu

SEQ ID NO: 1975180 - RNA, 23 nt, Human
accuuuguauucucuccuguacc

SEQ ID NO: 1975181 - RNA, 15 nt, Human
accuuuggcuuaauu

SEQ ID NO: 1975182 - RNA, 18 nt, Human
accuuuggcuuaauucca

SEQ ID NO: 1975183 - RNA, 15 nt, Human
accuuuguauucucu

SEQ ID NO: 1975184 - RNA, 19 nt, Human
accuuuguauucucuccug

SEQ ID NO: 1975185 - RNA, 11 nt, Human
uccagccugcc

SEQ ID NO: 1975186 - RNA, 21 nt, Human
uccagccugagcgacagugag

SEQ ID NO: 1975187 - RNA, 20 nt, Human
uccagccugagcgacaguga

SEQ ID NO: 1975188 - RNA, 22 nt, Human
uccagccccuggaugcagccuc

SEQ ID NO: 1975189 - RNA, 23 nt, Human
uccagaccccuggcuuuucacug

SEQ ID NO: 1975190 - RNA, 21 nt, Human
uccagccccuggaugcagccu

SEQ ID NO: 1975191 - RNA, 19 nt, Human
uccagccccuggaugcagc

SEQ ID NO: 1975192 - RNA, 17 nt, Human
uccagccccuggaugca

SEQ ID NO: 1975193 - RNA, 16 nt, Human
uccagccccuggaugc

SEQ ID NO: 1975194 - RNA, 15 nt, Human
uccagccccuggaug

SEQ ID NO: 1975195 - RNA, 15 nt, Human
uccagaccccuggcu

SEQ ID NO: 1975196 - RNA, 16 nt, Human
uccagaccccuggcuu

SEQ ID NO: 1975197 - RNA, 17 nt, Human
uccagaccccuggcuuu

SEQ ID NO: 1975198 - RNA, 18 nt, Human
uccagaccccuggcuuuu

SEQ ID NO: 1975199 - RNA, 13 nt, Human
accuucuccuuca

SEQ ID NO: 1975200 - RNA, 12 nt, Human
accuucuguggc

SEQ ID NO: 1975201 - RNA, 13 nt, Human
accuucuguggcu

SEQ ID NO: 1975202 - RNA, 15 nt, Human
accuucuguggcuca

SEQ ID NO: 1975203 - RNA, 16 nt, Human
accuucuguggcucac

SEQ ID NO: 1975204 - RNA, 15 nt, Human
accuugacagggcac

SEQ ID NO: 1975205 - RNA, 15 nt, Human
accuugaaugaugcc

SEQ ID NO: 1975206 - RNA, 14 nt, Human
accuugacagggca

SEQ ID NO: 1975207 - RNA, 17 nt, Human
accuuccaagagccuga

SEQ ID NO: 1975208 - RNA, 20 nt, Human
accuucuauagcaucacuua

SEQ ID NO: 1975209 - RNA, 17 nt, Human
accuucuauagcaucac

SEQ ID NO: 1975210 - RNA, 18 nt, Human
accuucuauagcaucacu

SEQ ID NO: 1975211 - RNA, 12 nt, Human
accuucuccuuc

SEQ ID NO: 1975212 - RNA, 17 nt, Human
accuuagacagucccug

SEQ ID NO: 1975213 - RNA, 14 nt, Human
accuuagccugccc

SEQ ID NO: 1975214 - RNA, 21 nt, Human
accuuagaagguauuaagauu

SEQ ID NO: 1975215 - RNA, 15 nt, Human
uccaccaucaagcca

SEQ ID NO: 1975216 - RNA, 22 nt, Human
accuggucacaggacucugccu

SEQ ID NO: 1975217 - RNA, 23 nt, Human
accuggucacaggacucugccuc

SEQ ID NO: 1975218 - RNA, 13 nt, Human
uccaagcucccag

SEQ ID NO: 1975219 - RNA, 12 nt, Human
uccaagcuccca

SEQ ID NO: 1975220 - RNA, 15 nt, Human
uccaagcucccaggc

SEQ ID NO: 1975221 - RNA, 14 nt, Human
uccaagcucccagg

SEQ ID NO: 1975222 - RNA, 16 nt, Human
uccaagcucccaggca

SEQ ID NO: 1975223 - RNA, 18 nt, Human
uccaagcuccaucuccac

SEQ ID NO: 1975224 - RNA, 15 nt, Human
uccaacauccacucu

SEQ ID NO: 1975225 - RNA, 22 nt, Human
uccaacgaggcuaaguuaaugc

SEQ ID NO: 1975226 - RNA, 14 nt, Human
uccaaaugcagcuu

SEQ ID NO: 1975227 - RNA, 15 nt, Human
uccaaaugcagcuuu

SEQ ID NO: 1975228 - RNA, 20 nt, Human
uccaaauaauauguuuccuu

SEQ ID NO: 1975229 - RNA, 17 nt, Human
uccaauaugugauuuuu

SEQ ID NO: 1975230 - RNA, 14 nt, Human
uccaauaugugauu

SEQ ID NO: 1975231 - RNA, 16 nt, Human
uccaauaugugauuuu

SEQ ID NO: 1975232 - RNA, 22 nt, Human
uccaaguggccuccgucacuac

SEQ ID NO: 1975233 - RNA, 11 nt, Human
uccaagcuggu

SEQ ID NO: 1975234 - RNA, 22 nt, Human
uccaccaagccuggucagccca

SEQ ID NO: 1975235 - RNA, 23 nt, Human
uccaccaagccuggucagcccaa

SEQ ID NO: 1975236 - RNA, 18 nt, Human
uccaccaagccuggucag

SEQ ID NO: 1975237 - RNA, 18 nt, Human
accugcggugcuaucucc

SEQ ID NO: 1975238 - RNA, 22 nt, Human
accugaagucuuuguacagaca

SEQ ID NO: 1975239 - RNA, 15 nt, Human
accugaagucuuugu

SEQ ID NO: 1975240 - RNA, 22 nt, Human
accugcggugcuaucuccccca

SEQ ID NO: 1975241 - RNA, 19 nt, Human
accugcggugcuaucuccc

SEQ ID NO: 1975242 - RNA, 23 nt, Human
accugcggugcuaucucccccag

SEQ ID NO: 1975243 - RNA, 18 nt, Human
accugcucuccucuugcc

SEQ ID NO: 1975244 - RNA, 17 nt, Human
accugcucuccucuugc

SEQ ID NO: 1975245 - RNA, 19 nt, Human
accugcucuccucuugcca

SEQ ID NO: 1975246 - RNA, 12 nt, Human
accugcucugcu

SEQ ID NO: 1975247 - RNA, 13 nt, Human
accugcucugcug

SEQ ID NO: 1975248 - RNA, 14 nt, Human
accugcucugcuga

SEQ ID NO: 1975249 - RNA, 14 nt, Human
accuggaauauaua

SEQ ID NO: 1975250 - RNA, 17 nt, Human
accuggaauauauaacc

SEQ ID NO: 1975251 - RNA, 19 nt, Human
ucauuugagcagggcucag

SEQ ID NO: 1975252 - RNA, 18 nt, Human
accuggaaggcccagcac

SEQ ID NO: 1975253 - RNA, 19 nt, Human
accuggaaggcccagcacc

SEQ ID NO: 1975254 - RNA, 13 nt, Human
ucauuuuuuuuaa

SEQ ID NO: 1975255 - RNA, 23 nt, Human
uccaaagucucuggaauuugaaa

SEQ ID NO: 1975256 - RNA, 22 nt, Human
ucauuuucaagacugaauucca

SEQ ID NO: 1975257 - RNA, 11 nt, Human
ucauuuucauu

SEQ ID NO: 1975258 - RNA, 12 nt, Human
ucauuuucauua

SEQ ID NO: 1975259 - RNA, 17 nt, Human
ucauuuucauuagcaaa

SEQ ID NO: 1975260 - RNA, 21 nt, Human
ucauuuuuuauauauaugcau

SEQ ID NO: 1975261 - RNA, 22 nt, Human
ucauuuuuuauauauaugcaua

SEQ ID NO: 1975262 - RNA, 23 nt, Human
ucauuuuuuauggcugcauagua

SEQ ID NO: 1975263 - RNA, 12 nt, Human
ucauuuuuuccu

SEQ ID NO: 1975264 - RNA, 13 nt, Human
ucauuuuuuccug

SEQ ID NO: 1975265 - RNA, 17 nt, Human
ucauuuuuuccuguuug

SEQ ID NO: 1975266 - RNA, 23 nt, Human
ucauuuuuuccuguuugggaaga

SEQ ID NO: 1975267 - RNA, 21 nt, Human
ucauuugagcagggcucagcg

SEQ ID NO: 1975268 - RNA, 18 nt, Human
ucauuugugccagaaugc

SEQ ID NO: 1975269 - RNA, 14 nt, Human
ucauuugcuuugga

SEQ ID NO: 1975270 - RNA, 20 nt, Human
ucauuuuagggguagcauuu

SEQ ID NO: 1975271 - RNA, 22 nt, Human
ucauuuuacaguuacuuuuccu

SEQ ID NO: 1975272 - RNA, 22 nt, Human
ucauuuuauauaugaaaacuaa

SEQ ID NO: 1975273 - RNA, 14 nt, Human
ucauuuuacaguua

SEQ ID NO: 1975274 - RNA, 19 nt, Human
ucauuuuacaguuacuuuu

SEQ ID NO: 1975275 - RNA, 16 nt, Human
acugcaaccuccgccu

SEQ ID NO: 1975276 - RNA, 22 nt, Human
acugcaaccuccgccucuuggg

SEQ ID NO: 1975277 - RNA, 20 nt, Human
acugcaaccuucgccaccug

SEQ ID NO: 1975278 - RNA, 23 nt, Human
acugcaaccuucgccaccugggu

SEQ ID NO: 1975279 - RNA, 13 nt, Human
acugcaaccuccg

SEQ ID NO: 1975280 - RNA, 14 nt, Human
acugcaaccuccgc

SEQ ID NO: 1975281 - RNA, 19 nt, Human
acugaguuagaauguugaa

SEQ ID NO: 1975282 - RNA, 22 nt, Human
acugaguacguugugcauuugg

SEQ ID NO: 1975283 - RNA, 23 nt, Human
acugaguacguugugcauuuggu

SEQ ID NO: 1975284 - RNA, 16 nt, Human
acugagugccuuuugg

SEQ ID NO: 1975285 - RNA, 19 nt, Human
acugaguacguugugcauu

SEQ ID NO: 1975286 - RNA, 21 nt, Human
acugaguacguugugcauuug

SEQ ID NO: 1975287 - RNA, 18 nt, Human
acugaguacguugugcau

SEQ ID NO: 1975288 - RNA, 12 nt, Human
acugagcuugga

SEQ ID NO: 1975289 - RNA, 13 nt, Human
acugagcuuggaa

SEQ ID NO: 1975290 - RNA, 16 nt, Human
acugagcuuggaagcu

SEQ ID NO: 1975291 - RNA, 17 nt, Human
acugagcuuggaagcuu

SEQ ID NO: 1975292 - RNA, 15 nt, Human
uccucuccccagcaa

SEQ ID NO: 1975293 - RNA, 14 nt, Human
acugaggaucagag

SEQ ID NO: 1975294 - RNA, 15 nt, Human
acugaggaccagcca

SEQ ID NO: 1975295 - RNA, 18 nt, Human
acugaggcaguuugagga

SEQ ID NO: 1975296 - RNA, 20 nt, Human
acugaggcaguuugaggauu

SEQ ID NO: 1975297 - RNA, 17 nt, Human
acugaggggaggggagc

SEQ ID NO: 1975298 - RNA, 22 nt, Human
acugaggggaggggagcauggg

SEQ ID NO: 1975299 - RNA, 20 nt, Human
uccugaguagcugggauuac

SEQ ID NO: 1975300 - RNA, 23 nt, Human
uccugaggugaugaagacagccc

SEQ ID NO: 1975301 - RNA, 23 nt, Human
uccugauagcauaugacaaaugu

SEQ ID NO: 1975302 - RNA, 16 nt, Human
acugcacagugcaucu

SEQ ID NO: 1975303 - RNA, 18 nt, Human
acugcacagugcaucuca

SEQ ID NO: 1975304 - RNA, 15 nt, Human
uccugcaggcagcca

SEQ ID NO: 1975305 - RNA, 16 nt, Human
uccugcacugacucug

SEQ ID NO: 1975306 - RNA, 17 nt, Human
uccugcacugacucugg

SEQ ID NO: 1975307 - RNA, 21 nt, Human
uccugcacugacucuggaaaa

SEQ ID NO: 1975308 - RNA, 20 nt, Human
uccugcaaccaaacucccau

SEQ ID NO: 1975309 - RNA, 23 nt, Human
uccugcaaccaaacucccaucag

SEQ ID NO: 1975310 - RNA, 21 nt, Human
uccugauugguuucucuucuc

SEQ ID NO: 1975311 - RNA, 23 nt, Human
uccugauugguuucucuucuccc

SEQ ID NO: 1975312 - RNA, 20 nt, Human
uccugauugguuucucuucu

SEQ ID NO: 1975313 - RNA, 20 nt, Human
uccugcaggcagccaggcca

SEQ ID NO: 1975314 - RNA, 19 nt, Human
uccugcaggcagccaggcc

SEQ ID NO: 1975315 - RNA, 17 nt, Human
uccugcaggcagccagg

SEQ ID NO: 1975316 - RNA, 16 nt, Human
uccugcaggcagccag

SEQ ID NO: 1975317 - RNA, 20 nt, Human
uccugcaggccaggccagcu

SEQ ID NO: 1975318 - RNA, 19 nt, Human
uccugcaggccaggccagc

SEQ ID NO: 1975319 - RNA, 14 nt, Human
uccugcaggccagg

SEQ ID NO: 1975320 - RNA, 22 nt, Human
uccugcaggcagccaggccaca

SEQ ID NO: 1975321 - RNA, 19 nt, Human
uccugccucagccucccaa

SEQ ID NO: 1975322 - RNA, 23 nt, Human
uccugcauugggugaucauucac

SEQ ID NO: 1975323 - RNA, 21 nt, Human
uccugccucgaacuggcugca

SEQ ID NO: 1975324 - RNA, 21 nt, Human
uccugccuccuugauauuugu

SEQ ID NO: 1975325 - RNA, 15 nt, Human
uccugcguguucuca

SEQ ID NO: 1975326 - RNA, 20 nt, Human
uccugccucgaacuggcugc

SEQ ID NO: 1975327 - RNA, 13 nt, Human
uccugcucagcag

SEQ ID NO: 1975328 - RNA, 11 nt, Human
uccugcucugc

SEQ ID NO: 1975329 - RNA, 12 nt, Human
uccugcucugcu

SEQ ID NO: 1975330 - RNA, 13 nt, Human
uccugcucugcuc

SEQ ID NO: 1975331 - RNA, 18 nt, Human
uccuggggaaccugaccc

SEQ ID NO: 1975332 - RNA, 19 nt, Human
uccuggggaaccugacccc

SEQ ID NO: 1975333 - RNA, 20 nt, Human
uccugggcuuuuguuuugcu

SEQ ID NO: 1975334 - RNA, 23 nt, Human
uccugggcuuuuguuuugcuuuu

SEQ ID NO: 1975335 - RNA, 19 nt, Human
uccuggggcauccaugggg

SEQ ID NO: 1975336 - RNA, 21 nt, Human
uccuggggguucuuucuuccu

SEQ ID NO: 1975337 - RNA, 22 nt, Human
uccuggggguucuuucuuccuc

SEQ ID NO: 1975338 - RNA, 23 nt, Human
uccuggggguucuuucuuccucu

SEQ ID NO: 1975339 - RNA, 13 nt, Human
uccugcugcaguu

SEQ ID NO: 1975340 - RNA, 13 nt, Human
uccugugccaggu

SEQ ID NO: 1975341 - RNA, 18 nt, Human
uccugugacuucagcucu

SEQ ID NO: 1975342 - RNA, 17 nt, Human
uccuguggccugccagu

SEQ ID NO: 1975343 - RNA, 19 nt, Human
uccuguggccugccaguca

SEQ ID NO: 1975344 - RNA, 16 nt, Human
uccugucuucugcuuu

SEQ ID NO: 1975345 - RNA, 17 nt, Human
uccugucuucugcuuug

SEQ ID NO: 1975346 - RNA, 19 nt, Human
uccugucuucugcuuuguu

SEQ ID NO: 1975347 - RNA, 12 nt, Human
uccugucuucug

SEQ ID NO: 1975348 - RNA, 13 nt, Human
uccugucuucugc

SEQ ID NO: 1975349 - RNA, 14 nt, Human
uccugucuucugcu

SEQ ID NO: 1975350 - RNA, 15 nt, Human
uccugucuucugcuu

SEQ ID NO: 1975351 - RNA, 23 nt, Human
uccuggguuuucuuaaccaucuu

SEQ ID NO: 1975352 - RNA, 19 nt, Human
uccuguucccaugagauga

SEQ ID NO: 1975353 - RNA, 17 nt, Human
uccuguugucaagaaua

SEQ ID NO: 1975354 - RNA, 16 nt, Human
uccuguuucaaguuca

SEQ ID NO: 1975355 - RNA, 20 nt, Human
uccuguuucucagucucaca

SEQ ID NO: 1975356 - RNA, 23 nt, Human
uccuguuugggaagagcuuagaa

SEQ ID NO: 1975357 - RNA, 18 nt, Human
uccugugugugcgccuac

SEQ ID NO: 1975358 - RNA, 13 nt, Human
uccugugugugcg

SEQ ID NO: 1975359 - RNA, 14 nt, Human
uccugugugugcgc

SEQ ID NO: 1975360 - RNA, 22 nt, Human
uccuguguguccaaaacugccu

SEQ ID NO: 1975361 - RNA, 14 nt, Human
uccugugucaguuu

SEQ ID NO: 1975362 - RNA, 16 nt, Human
uccugugucaguuuau

SEQ ID NO: 1975363 - RNA, 23 nt, Human
uccugugucuugcaauggcagcc

SEQ ID NO: 1975364 - RNA, 24 nt, Human
uccugugucuugcaauggcagccu

SEQ ID NO: 1975365 - RNA, 13 nt, Human
acugcacuguuuu

SEQ ID NO: 1975366 - RNA, 19 nt, Human
acugcagccucaaccuccu

SEQ ID NO: 1975367 - RNA, 12 nt, Human
acugcagaacag

SEQ ID NO: 1975368 - RNA, 16 nt, Human
uccuuaagagacaauu

SEQ ID NO: 1975369 - RNA, 21 nt, Human
acugcagccucaaccuccugg

SEQ ID NO: 1975370 - RNA, 22 nt, Human
acugcagccucaaccuccuggg

SEQ ID NO: 1975371 - RNA, 23 nt, Human
acugcagccucaaccuccugggc

SEQ ID NO: 1975372 - RNA, 22 nt, Human
acugcagccuccgcuucccugg

SEQ ID NO: 1975373 - RNA, 17 nt, Human
acugcagggacugccag

SEQ ID NO: 1975374 - RNA, 18 nt, Human
acugcagggacugccagu

SEQ ID NO: 1975375 - RNA, 16 nt, Human
acugcagggacugcca

SEQ ID NO: 1975376 - RNA, 16 nt, Human
acuguaaggcaaucau

SEQ ID NO: 1975377 - RNA, 20 nt, Human
acuggguacuuguggacaca

SEQ ID NO: 1975378 - RNA, 23 nt, Human
acuggguacuuguggacacagcu

SEQ ID NO: 1975379 - RNA, 19 nt, Human
acuggguacuuguggacac

SEQ ID NO: 1975380 - RNA, 15 nt, Human
acuggggagucuuug

SEQ ID NO: 1975381 - RNA, 12 nt, Human
acugggagccua

SEQ ID NO: 1975382 - RNA, 23 nt, Human
acugggagccuacccacccccag

SEQ ID NO: 1975383 - RNA, 22 nt, Human
acugggaugggaggagaggaca

SEQ ID NO: 1975384 - RNA, 15 nt, Human
acugggccaggggag

SEQ ID NO: 1975385 - RNA, 22 nt, Human
acugggcuuggggaccagagcu

SEQ ID NO: 1975386 - RNA, 12 nt, Human
ucgcuccugugu

SEQ ID NO: 1975387 - RNA, 17 nt, Human
acugggagaaaugaaaa

SEQ ID NO: 1975388 - RNA, 13 nt, Human
ucgcuccuguguc

SEQ ID NO: 1975389 - RNA, 23 nt, Human
acuguacaugaaaacacauuuuu

SEQ ID NO: 1975390 - RNA, 13 nt, Human
acuguacaugaaa

SEQ ID NO: 1975391 - RNA, 14 nt, Human
acuguacaugaaaa

SEQ ID NO: 1975392 - RNA, 15 nt, Human
acuguacuccuccca

SEQ ID NO: 1975393 - RNA, 21 nt, Human
acuguacaugggacuaugcuu

SEQ ID NO: 1975394 - RNA, 13 nt, Human
acuguacuccucc

SEQ ID NO: 1975395 - RNA, 14 nt, Human
acuguacuccuccc

SEQ ID NO: 1975396 - RNA, 16 nt, Human
acuguaauuauuugaa

SEQ ID NO: 1975397 - RNA, 17 nt, Human
acuguaauuauuugaau

SEQ ID NO: 1975398 - RNA, 18 nt, Human
acuguaauuauuugaaug

SEQ ID NO: 1975399 - RNA, 20 nt, Human
acuguaauuauuugaaugac

SEQ ID NO: 1975400 - RNA, 13 nt, Human
acuguacaaagua

SEQ ID NO: 1975401 - RNA, 19 nt, Human
acuguaauuugugauacaa

SEQ ID NO: 1975402 - RNA, 15 nt, Human
acuguacaaaguaga

SEQ ID NO: 1975403 - RNA, 14 nt, Human
acuguacaaaguag

SEQ ID NO: 1975404 - RNA, 20 nt, Human
acuguacagacagaaaaaac

SEQ ID NO: 1975405 - RNA, 15 nt, Human
ucgagcaugccugga

SEQ ID NO: 1975406 - RNA, 14 nt, Human
ucgagcaugccugg

SEQ ID NO: 1975407 - RNA, 12 nt, Human
ucgacacagagu

SEQ ID NO: 1975408 - RNA, 21 nt, Human
ucgacacgugggcuccccucu

SEQ ID NO: 1975409 - RNA, 13 nt, Human
ucgaccugccucg

SEQ ID NO: 1975410 - RNA, 22 nt, Human
ucgacgcccgaguuagccucac

SEQ ID NO: 1975411 - RNA, 14 nt, Human
ucgaggacagggag

SEQ ID NO: 1975412 - RNA, 17 nt, Human
ucgaggacagggaggug

SEQ ID NO: 1975413 - RNA, 13 nt, Human
ucgcgacaaugca

SEQ ID NO: 1975414 - RNA, 14 nt, Human
ucgcgacaaugcaa

SEQ ID NO: 1975415 - RNA, 22 nt, Human
ucgccuuucagcaggcagccuu

SEQ ID NO: 1975416 - RNA, 19 nt, Human
ucgccuuucagcaggcagc

SEQ ID NO: 1975417 - RNA, 20 nt, Human
ucgccuuucagcaggcagcc

SEQ ID NO: 1975418 - RNA, 14 nt, Human
ucgccuuucagcag

SEQ ID NO: 1975419 - RNA, 16 nt, Human
ucgccuuucagcaggc

SEQ ID NO: 1975420 - RNA, 15 nt, Human
ucgccuuccaccucu

SEQ ID NO: 1975421 - RNA, 19 nt, Human
ucgccuuccaccucuggga

SEQ ID NO: 1975422 - RNA, 16 nt, Human
uccuuucacaaccuuc

SEQ ID NO: 1975423 - RNA, 18 nt, Human
uccuuucacaaccuucug

SEQ ID NO: 1975424 - RNA, 19 nt, Human
uccuuucacaaccuucugu

SEQ ID NO: 1975425 - RNA, 20 nt, Human
uccuuucacaaccuucugug

SEQ ID NO: 1975426 - RNA, 15 nt, Human
uccuuucaccacaug

SEQ ID NO: 1975427 - RNA, 13 nt, Human
uccuuucacuucu

SEQ ID NO: 1975428 - RNA, 16 nt, Human
uccuuucacuucuuuc

SEQ ID NO: 1975429 - RNA, 18 nt, Human
uccuuucacuucuuuccc

SEQ ID NO: 1975430 - RNA, 20 nt, Human
uccuuucaguggcuuggacu

SEQ ID NO: 1975431 - RNA, 14 nt, Human
ucgaacuggcugca

SEQ ID NO: 1975432 - RNA, 13 nt, Human
ucgaacuggcugc

SEQ ID NO: 1975433 - RNA, 15 nt, Human
ucgaacuggcugcaa

SEQ ID NO: 1975434 - RNA, 13 nt, Human
acugcagucacug

SEQ ID NO: 1975435 - RNA, 19 nt, Human
acugcuauuuuccuguucu

SEQ ID NO: 1975436 - RNA, 19 nt, Human
acugcuagucuuaagaacu

SEQ ID NO: 1975437 - RNA, 12 nt, Human
acugcucugaug

SEQ ID NO: 1975438 - RNA, 22 nt, Human
acugcucuugggcaauauucuc

SEQ ID NO: 1975439 - RNA, 19 nt, Human
acugcucuugggcaauauu

SEQ ID NO: 1975440 - RNA, 23 nt, Human
acugcuuccagugaggcucugcc

SEQ ID NO: 1975441 - RNA, 22 nt, Human
acugcuuccagugaggcucugc

SEQ ID NO: 1975442 - RNA, 21 nt, Human
acugcuuccagugaggcucug

SEQ ID NO: 1975443 - RNA, 18 nt, Human
acugcuuccagugaggcu

SEQ ID NO: 1975444 - RNA, 21 nt, Human
acugcugcccagccuccaagc

SEQ ID NO: 1975445 - RNA, 16 nt, Human
acugcugcccagccuc

SEQ ID NO: 1975446 - RNA, 18 nt, Human
acugcugcccagccucca

SEQ ID NO: 1975447 - RNA, 12 nt, Human
acugcuggcugc

SEQ ID NO: 1975448 - RNA, 20 nt, Human
acugcugcuucauguuugcc

SEQ ID NO: 1975449 - RNA, 15 nt, Human
acuggauuauucagg

SEQ ID NO: 1975450 - RNA, 22 nt, Human
acuggauuaaacuuaaucuaaa

SEQ ID NO: 1975451 - RNA, 13 nt, Human
acugcuggcugcc

SEQ ID NO: 1975452 - RNA, 17 nt, Human
acugcuuccuauaauuu

SEQ ID NO: 1975453 - RNA, 18 nt, Human
acugcuuccuauaauuuu

SEQ ID NO: 1975454 - RNA, 21 nt, Human
acugcuuccuauaauuuugau

SEQ ID NO: 1975455 - RNA, 22 nt, Human
acugcuuccuauaauuuugaua

SEQ ID NO: 1975456 - RNA, 13 nt, Human
acugcuugaauaa

SEQ ID NO: 1975457 - RNA, 17 nt, Human
acugcuuccuuucuuga

SEQ ID NO: 1975458 - RNA, 18 nt, Human
acugcuuccuuucuugau

SEQ ID NO: 1975459 - RNA, 16 nt, Human
uccuuccucugagccu

SEQ ID NO: 1975460 - RNA, 22 nt, Human
uccuuccuaguucaucccuucu

SEQ ID NO: 1975461 - RNA, 17 nt, Human
uccuuccucugagccuu

SEQ ID NO: 1975462 - RNA, 16 nt, Human
uccuuccucugaggcu

SEQ ID NO: 1975463 - RNA, 17 nt, Human
uccuucccuugcuacca

SEQ ID NO: 1975464 - RNA, 13 nt, Human
uccuucagccuga

SEQ ID NO: 1975465 - RNA, 11 nt, Human
uccuucagugc

SEQ ID NO: 1975466 - RNA, 12 nt, Human
uccuucagugcc

SEQ ID NO: 1975467 - RNA, 20 nt, Human
uccuucagugccuuauggaa

SEQ ID NO: 1975468 - RNA, 13 nt, Human
uccuucagugccu

SEQ ID NO: 1975469 - RNA, 22 nt, Human
uccuucagugccuuauggaaca

SEQ ID NO: 1975470 - RNA, 15 nt, Human
uccuucagauauuuu

SEQ ID NO: 1975471 - RNA, 17 nt, Human
uccuucagauauuuuua

SEQ ID NO: 1975472 - RNA, 14 nt, Human
uccuucagauauuu

SEQ ID NO: 1975473 - RNA, 22 nt, Human
acuggcugcaaaggguaucagg

SEQ ID NO: 1975474 - RNA, 23 nt, Human
acuggccucugcugauccuccca

SEQ ID NO: 1975475 - RNA, 16 nt, Human
acuggccucugcugau

SEQ ID NO: 1975476 - RNA, 18 nt, Human
acuggcagggauaacaaa

SEQ ID NO: 1975477 - RNA, 14 nt, Human
acuggcaagaaaag

SEQ ID NO: 1975478 - RNA, 16 nt, Human
acuggcaaugguaguu

SEQ ID NO: 1975479 - RNA, 14 nt, Human
uccccuccaggagu

SEQ ID NO: 1975480 - RNA, 18 nt, Human
uccccucagaaggucugu

SEQ ID NO: 1975481 - RNA, 15 nt, Human
ucccgaauagcuggg

SEQ ID NO: 1975482 - RNA, 16 nt, Human
ucccgaauagcuggga

SEQ ID NO: 1975483 - RNA, 14 nt, Human
uccccuugcagccg

SEQ ID NO: 1975484 - RNA, 14 nt, Human
uccccuugccagcu

SEQ ID NO: 1975485 - RNA, 15 nt, Human
uccccuugccagcug

SEQ ID NO: 1975486 - RNA, 16 nt, Human
uccccuugccagcugc

SEQ ID NO: 1975487 - RNA, 17 nt, Human
uccccuugccagcugcu

SEQ ID NO: 1975488 - RNA, 22 nt, Human
uccccuugccagcugcugagcc

SEQ ID NO: 1975489 - RNA, 18 nt, Human
ucccgcccaaaccuuucc

SEQ ID NO: 1975490 - RNA, 20 nt, Human
ucccgaguagcugggacuac

SEQ ID NO: 1975491 - RNA, 18 nt, Human
ucccgaauagcugggacu

SEQ ID NO: 1975492 - RNA, 13 nt, Human
ucccgcucagccc

SEQ ID NO: 1975493 - RNA, 19 nt, Human
ucccgcccaaaccuuuccc

SEQ ID NO: 1975494 - RNA, 20 nt, Human
ucccgcccaaaccuuucccc

SEQ ID NO: 1975495 - RNA, 15 nt, Human
ucccgccuccaaccc

SEQ ID NO: 1975496 - RNA, 21 nt, Human
ucccgccuccaaccccucgcc

SEQ ID NO: 1975497 - RNA, 14 nt, Human
ucccgcucagcccu

SEQ ID NO: 1975498 - RNA, 15 nt, Human
ucccgcucagcccuc

SEQ ID NO: 1975499 - RNA, 16 nt, Human
ucccgcucagcccucc

SEQ ID NO: 1975500 - RNA, 20 nt, Human
ucccgcucagcccucccugc

SEQ ID NO: 1975501 - RNA, 18 nt, Human
ucccuauuagagaagaga

SEQ ID NO: 1975502 - RNA, 19 nt, Human
acuauguugcccaggcagg

SEQ ID NO: 1975503 - RNA, 20 nt, Human
acuauguugcccaggcaggu

SEQ ID NO: 1975504 - RNA, 23 nt, Human
acuauguugcccaggcaggucuu

SEQ ID NO: 1975505 - RNA, 22 nt, Human
acuauguuuuaucguccaguga

SEQ ID NO: 1975506 - RNA, 15 nt, Human
acucaaccaaauggu

SEQ ID NO: 1975507 - RNA, 16 nt, Human
acucaaccaaauggua

SEQ ID NO: 1975508 - RNA, 21 nt, Human
acucaaccaaaugguacaaaa

SEQ ID NO: 1975509 - RNA, 22 nt, Human
acuaugaaguuuuuuuuauaca

SEQ ID NO: 1975510 - RNA, 13 nt, Human
acuaucuucaucu

SEQ ID NO: 1975511 - RNA, 18 nt, Human
acuauguugcccaggcag

SEQ ID NO: 1975512 - RNA, 22 nt, Human
acuaucaugucaaacgugaaaa

SEQ ID NO: 1975513 - RNA, 16 nt, Human
acuaucccggcugccc

SEQ ID NO: 1975514 - RNA, 17 nt, Human
acuaucccggcugcccu

SEQ ID NO: 1975515 - RNA, 18 nt, Human
acuaucccggcugcccuu

SEQ ID NO: 1975516 - RNA, 22 nt, Human
acuaucuuaucucagauauuug

SEQ ID NO: 1975517 - RNA, 24 nt, Human
uccccaccgcagacaggaccaggg

SEQ ID NO: 1975518 - RNA, 23 nt, Human
uccccaauaucuugcuugaacuu

SEQ ID NO: 1975519 - RNA, 16 nt, Human
uccccaggcaccucac

SEQ ID NO: 1975520 - RNA, 23 nt, Human
uccccaggaggccagccuugacc

SEQ ID NO: 1975521 - RNA, 23 nt, Human
acuauaauuuaccugaagucuuu

SEQ ID NO: 1975522 - RNA, 17 nt, Human
acuauagccuaggugac

SEQ ID NO: 1975523 - RNA, 14 nt, Human
acguuucuaaaggc

SEQ ID NO: 1975524 - RNA, 19 nt, Human
acguuuuaaggacugacug

SEQ ID NO: 1975525 - RNA, 13 nt, Human
acuaaaaauacaa

SEQ ID NO: 1975526 - RNA, 24 nt, Human
uccagccugggugacagagcaagu

SEQ ID NO: 1975527 - RNA, 13 nt, Human
uccagccugggug

SEQ ID NO: 1975528 - RNA, 12 nt, Human
acguuucuaaag

SEQ ID NO: 1975529 - RNA, 15 nt, Human
uccagcucaccagcc

SEQ ID NO: 1975530 - RNA, 14 nt, Human
uccagcucaccagc

SEQ ID NO: 1975531 - RNA, 22 nt, Human
acuaaacucugaauaagcacuu

SEQ ID NO: 1975532 - RNA, 21 nt, Human
acuaaacucugaauaagcacu

SEQ ID NO: 1975533 - RNA, 15 nt, Human
acuaaaguuguacuu

SEQ ID NO: 1975534 - RNA, 20 nt, Human
acuaaaguuguacuuuaaaa

SEQ ID NO: 1975535 - RNA, 20 nt, Human
acuaaaauaauuuuguaaug

SEQ ID NO: 1975536 - RNA, 14 nt, Human
acuaaaauguucua

SEQ ID NO: 1975537 - RNA, 15 nt, Human
acuaaaauaauuuug

SEQ ID NO: 1975538 - RNA, 16 nt, Human
acuaaaauaauuuugu

SEQ ID NO: 1975539 - RNA, 17 nt, Human
acuaaaauaauuuugua

SEQ ID NO: 1975540 - RNA, 19 nt, Human
acuaaaauaauuuuguaau

SEQ ID NO: 1975541 - RNA, 14 nt, Human
acuaaaauaauuuu

SEQ ID NO: 1975542 - RNA, 16 nt, Human
acuaaccagcagaaau

SEQ ID NO: 1975543 - RNA, 13 nt, Human
acuaaccacgcug

SEQ ID NO: 1975544 - RNA, 22 nt, Human
acuaaaguuguacuuuaaaaau

SEQ ID NO: 1975545 - RNA, 15 nt, Human
acuacaguccuccca

SEQ ID NO: 1975546 - RNA, 17 nt, Human
acuaaccagcagaaaug

SEQ ID NO: 1975547 - RNA, 23 nt, Human
acuacaggugugagucaccaagc

SEQ ID NO: 1975548 - RNA, 16 nt, Human
acuacauauugaauag

SEQ ID NO: 1975549 - RNA, 16 nt, Human
acuacaguccucccau

SEQ ID NO: 1975550 - RNA, 17 nt, Human
acuacaguccucccauc

SEQ ID NO: 1975551 - RNA, 22 nt, Human
ucccagugccgagaaggaagcc

SEQ ID NO: 1975552 - RNA, 19 nt, Human
ucccagugccgagaaggaa

SEQ ID NO: 1975553 - RNA, 19 nt, Human
ucccaucucacacaugagc

SEQ ID NO: 1975554 - RNA, 14 nt, Human
ucccaucucacaca

SEQ ID NO: 1975555 - RNA, 13 nt, Human
ucccaucucacac

SEQ ID NO: 1975556 - RNA, 15 nt, Human
ucccauaugccuggg

SEQ ID NO: 1975557 - RNA, 16 nt, Human
ucccauaugccugggc

SEQ ID NO: 1975558 - RNA, 20 nt, Human
ucccauaucaaaagacacag

SEQ ID NO: 1975559 - RNA, 21 nt, Human
uccccaaggcccccugccugc

SEQ ID NO: 1975560 - RNA, 23 nt, Human
uccccaaggcccccugccugccc

SEQ ID NO: 1975561 - RNA, 19 nt, Human
uccccaaggcccccugccu

SEQ ID NO: 1975562 - RNA, 20 nt, Human
uccccaaggcccccugccug

SEQ ID NO: 1975563 - RNA, 15 nt, Human
uccccaagccuggca

SEQ ID NO: 1975564 - RNA, 22 nt, Human
ucccuuacgugaguccuggcau

SEQ ID NO: 1975565 - RNA, 18 nt, Human
ucccuuacgugaguccug

SEQ ID NO: 1975566 - RNA, 11 nt, Human
ucccuucaacc

SEQ ID NO: 1975567 - RNA, 15 nt, Human
ucccuuaucccugcu

SEQ ID NO: 1975568 - RNA, 21 nt, Human
ucccuucaaccauuccccaug

SEQ ID NO: 1975569 - RNA, 22 nt, Human
ucccuuuccaaaugcccagcuu

SEQ ID NO: 1975570 - RNA, 20 nt, Human
ucccuuuagcuguguuauua

SEQ ID NO: 1975571 - RNA, 17 nt, Human
ucccuuucauuugcuau

SEQ ID NO: 1975572 - RNA, 17 nt, Human
ucccuuuagcuguguua

SEQ ID NO: 1975573 - RNA, 18 nt, Human
ucccuuuagcuguguuau

SEQ ID NO: 1975574 - RNA, 20 nt, Human
ucccuguaauuguuguuugu

SEQ ID NO: 1975575 - RNA, 21 nt, Human
ucccuguaauuguuguuugua

SEQ ID NO: 1975576 - RNA, 23 nt, Human
acuccugcacacgcuccuuccuc

SEQ ID NO: 1975577 - RNA, 14 nt, Human
ucccugguucaagc

SEQ ID NO: 1975578 - RNA, 18 nt, Human
ucccugguucaagcgauu

SEQ ID NO: 1975579 - RNA, 14 nt, Human
uccgucacuaccug

SEQ ID NO: 1975580 - RNA, 15 nt, Human
uccgucacuaccugg

SEQ ID NO: 1975581 - RNA, 16 nt, Human
uccgucacuaccuggc

SEQ ID NO: 1975582 - RNA, 17 nt, Human
uccgucacuaccuggcu

SEQ ID NO: 1975583 - RNA, 18 nt, Human
uccgucacuaccuggcug

SEQ ID NO: 1975584 - RNA, 23 nt, Human
ucccuuugacgccaucccagccc

SEQ ID NO: 1975585 - RNA, 22 nt, Human
ucccuuugacgccaucccagcc

SEQ ID NO: 1975586 - RNA, 13 nt, Human
uccuaaaaggccc

SEQ ID NO: 1975587 - RNA, 15 nt, Human
uccuaaaaggcccag

SEQ ID NO: 1975588 - RNA, 16 nt, Human
uccuaaaaggcccaga

SEQ ID NO: 1975589 - RNA, 18 nt, Human
uccuaaaaggcccagaga

SEQ ID NO: 1975590 - RNA, 21 nt, Human
uccuaaaaggcccagagagaa

SEQ ID NO: 1975591 - RNA, 20 nt, Human
uccguuugauuugucacugc

SEQ ID NO: 1975592 - RNA, 21 nt, Human
uccguuugauuugucacugcu

SEQ ID NO: 1975593 - RNA, 14 nt, Human
uccuaggcauuugc

SEQ ID NO: 1975594 - RNA, 20 nt, Human
uccuagcacuuugggaggcc

SEQ ID NO: 1975595 - RNA, 15 nt, Human
acuccaacauccacu

SEQ ID NO: 1975596 - RNA, 16 nt, Human
acuccaacauccacuc

SEQ ID NO: 1975597 - RNA, 17 nt, Human
acuccaacauccacucu

SEQ ID NO: 1975598 - RNA, 18 nt, Human
acuccaacauccacucuc

SEQ ID NO: 1975599 - RNA, 19 nt, Human
acuccaacauccacucucu

SEQ ID NO: 1975600 - RNA, 20 nt, Human
acuccagcuggguuggaaaa

SEQ ID NO: 1975601 - RNA, 14 nt, Human
acuccuaccuggua

SEQ ID NO: 1975602 - RNA, 23 nt, Human
acuccaguagcgagagacggcac

SEQ ID NO: 1975603 - RNA, 20 nt, Human
acucauugcaucauuuacaa

SEQ ID NO: 1975604 - RNA, 17 nt, Human
acucaugcaugcaaauu

SEQ ID NO: 1975605 - RNA, 18 nt, Human
acucaucuagguaaauua

SEQ ID NO: 1975606 - RNA, 16 nt, Human
acucaucuagguaaau

SEQ ID NO: 1975607 - RNA, 23 nt, Human
ucccucauuccaccuucccaugc

SEQ ID NO: 1975608 - RNA, 21 nt, Human
ucccucagucuggcccuuccu

SEQ ID NO: 1975609 - RNA, 22 nt, Human
ucccucauccucauacccaccc

SEQ ID NO: 1975610 - RNA, 18 nt, Human
acucgcgacaaugcaaac

SEQ ID NO: 1975611 - RNA, 23 nt, Human
uccuagggcauuguaucugucuu

SEQ ID NO: 1975612 - RNA, 19 nt, Human
uccuaggcauuugcugaau

SEQ ID NO: 1975613 - RNA, 23 nt, Human
acucgcgacaaugcaaaccauca

SEQ ID NO: 1975614 - RNA, 20 nt, Human
acucgcgacaaugcaaacca

SEQ ID NO: 1975615 - RNA, 17 nt, Human
acucuccucugcugcug

SEQ ID NO: 1975616 - RNA, 14 nt, Human
acucggugucccca

SEQ ID NO: 1975617 - RNA, 18 nt, Human
acucgguguccccaccau

SEQ ID NO: 1975618 - RNA, 22 nt, Human
acucgguguccccaccaucugc

SEQ ID NO: 1975619 - RNA, 23 nt, Human
acucgguguccccaccaucugcu

SEQ ID NO: 1975620 - RNA, 19 nt, Human
acucuccucugcugcuggc

SEQ ID NO: 1975621 - RNA, 18 nt, Human
acucuccucugcugcugg

SEQ ID NO: 1975622 - RNA, 21 nt, Human
acucuccucugcugcuggcug

SEQ ID NO: 1975623 - RNA, 19 nt, Human
acucugaauuuaucuuuga

SEQ ID NO: 1975624 - RNA, 17 nt, Human
acucugaauuuaucuuu

SEQ ID NO: 1975625 - RNA, 18 nt, Human
acucugaauuuaucuuug

SEQ ID NO: 1975626 - RNA, 20 nt, Human
acucugaauaagcacuuuuu

SEQ ID NO: 1975627 - RNA, 22 nt, Human
acucugaauaagcacuuuuuaa

SEQ ID NO: 1975628 - RNA, 23 nt, Human
acucugaauaagcacuuuuuaaa

SEQ ID NO: 1975629 - RNA, 15 nt, Human
acucugaauuuaucu

SEQ ID NO: 1975630 - RNA, 21 nt, Human
acucuggagguuuguuuagaa

SEQ ID NO: 1975631 - RNA, 14 nt, Human
acucuggacuuucu

SEQ ID NO: 1975632 - RNA, 16 nt, Human
acucuggacuuucucu

SEQ ID NO: 1975633 - RNA, 17 nt, Human
acucuggacuuucucua

SEQ ID NO: 1975634 - RNA, 21 nt, Human
acucuggacuuucucuaauaa

SEQ ID NO: 1975635 - RNA, 22 nt, Human
acucuggacuuucucuaauaau

SEQ ID NO: 1975636 - RNA, 23 nt, Human
acucuggacuuucucuaauaaua

SEQ ID NO: 1975637 - RNA, 22 nt, Human
acucuuauaucuauauuuuaca

SEQ ID NO: 1975638 - RNA, 23 nt, Human
acucuuauaucuauauuuuacau

SEQ ID NO: 1975639 - RNA, 17 nt, Human
acucuggaaaaggcaua

SEQ ID NO: 1975640 - RNA, 12 nt, Human
acucuggaaaag

SEQ ID NO: 1975641 - RNA, 13 nt, Human
acucugcagacug

SEQ ID NO: 1975642 - RNA, 18 nt, Human
uccucauacccaccccca

SEQ ID NO: 1975643 - RNA, 14 nt, Human
uccucauacccacc

SEQ ID NO: 1975644 - RNA, 22 nt, Human
uccucauacccacccccaccca

SEQ ID NO: 1975645 - RNA, 16 nt, Human
uccuccccuccuccug

SEQ ID NO: 1975646 - RNA, 18 nt, Human
uccuccccuccuccugga

SEQ ID NO: 1975647 - RNA, 20 nt, Human
uccuccccuccuccuggacu

SEQ ID NO: 1975648 - RNA, 22 nt, Human
uccuccccuccuccuggacucc

SEQ ID NO: 1975649 - RNA, 14 nt, Human
uccuccccuggacu

SEQ ID NO: 1975650 - RNA, 15 nt, Human
uccuccccuggacuc

SEQ ID NO: 1975651 - RNA, 12 nt, Human
uccucuccacug

SEQ ID NO: 1975652 - RNA, 13 nt, Human
uccucuccacugc

SEQ ID NO: 1975653 - RNA, 14 nt, Human
uccucuccacugcc

SEQ ID NO: 1975654 - RNA, 12 nt, Human
uccucuccccag

SEQ ID NO: 1975655 - RNA, 15 nt, Human
uccucuccacugccu

SEQ ID NO: 1975656 - RNA, 16 nt, Human
uccucuccacugccuu

SEQ ID NO: 1975657 - RNA, 15 nt, Human
uccucccucccucuu

SEQ ID NO: 1975658 - RNA, 17 nt, Human
uccucccucccucuuuc

SEQ ID NO: 1975659 - RNA, 19 nt, Human
uccucccucccucuuuccc

SEQ ID NO: 1975660 - RNA, 20 nt, Human
uccucacaggugucuccaua

SEQ ID NO: 1975661 - RNA, 16 nt, Human
acucuuauugcccacg

SEQ ID NO: 1975662 - RNA, 19 nt, Human
acucuuauugcccacgcug

SEQ ID NO: 1975663 - RNA, 17 nt, Human
uccucaaaaugggagau

SEQ ID NO: 1975664 - RNA, 20 nt, Human
uccucagaucuucugugggu

SEQ ID NO: 1975665 - RNA, 16 nt, Human
uauggcuuuugugcau

SEQ ID NO: 1975666 - RNA, 21 nt, Human
uauggcuuuauuuuuuugaac

SEQ ID NO: 1975667 - RNA, 21 nt, Human
uauggcugcauaguauuccau

SEQ ID NO: 1975668 - RNA, 17 nt, Human
uauggggauagaugugu

SEQ ID NO: 1975669 - RNA, 18 nt, Human
uauggggauagaugugug

SEQ ID NO: 1975670 - RNA, 19 nt, Human
uauggggauagaugugugg

SEQ ID NO: 1975671 - RNA, 14 nt, Human
acagccuggcacag

SEQ ID NO: 1975672 - RNA, 15 nt, Human
acagccuggcacagg

SEQ ID NO: 1975673 - RNA, 15 nt, Human
acagcuaacauggaa

SEQ ID NO: 1975674 - RNA, 14 nt, Human
acagcuaacaugga

SEQ ID NO: 1975675 - RNA, 20 nt, Human
acagccuggucgccuuccac

SEQ ID NO: 1975676 - RNA, 21 nt, Human
acagccuggucgccuuccacc

SEQ ID NO: 1975677 - RNA, 15 nt, Human
acagcuccaagaauu

SEQ ID NO: 1975678 - RNA, 17 nt, Human
acagcuaacauggaagu

SEQ ID NO: 1975679 - RNA, 20 nt, Human
acagcuaaucagcauucuca

SEQ ID NO: 1975680 - RNA, 19 nt, Human
uaugauguuaguuuuccuu

SEQ ID NO: 1975681 - RNA, 18 nt, Human
uaugcucugcauguuaca

SEQ ID NO: 1975682 - RNA, 14 nt, Human
uaugcucugcaugu

SEQ ID NO: 1975683 - RNA, 20 nt, Human
uaugauguuaguuuuccuua

SEQ ID NO: 1975684 - RNA, 12 nt, Human
uaugauuaaaaa

SEQ ID NO: 1975685 - RNA, 14 nt, Human
uaugauuaaaaaua

SEQ ID NO: 1975686 - RNA, 21 nt, Human
uaugaugacguacaaguaguu

SEQ ID NO: 1975687 - RNA, 14 nt, Human
uauggccuguggau

SEQ ID NO: 1975688 - RNA, 22 nt, Human
uauggccugugagcuaggaauu

SEQ ID NO: 1975689 - RNA, 23 nt, Human
uaugauuaaaaauaucaaauuaa

SEQ ID NO: 1975690 - RNA, 17 nt, Human
uaugauuaaaaauauca

SEQ ID NO: 1975691 - RNA, 21 nt, Human
uaugauuaaaaauaucaaauu

SEQ ID NO: 1975692 - RNA, 19 nt, Human
uaugcucugcauguuacau

SEQ ID NO: 1975693 - RNA, 15 nt, Human
uaucuugaagacuuu

SEQ ID NO: 1975694 - RNA, 15 nt, Human
uaucuugaauaaugu

SEQ ID NO: 1975695 - RNA, 14 nt, Human
uaucuugaaggaaa

SEQ ID NO: 1975696 - RNA, 17 nt, Human
uaucuugaaggaaaaau

SEQ ID NO: 1975697 - RNA, 13 nt, Human
uaucuugcuugaa

SEQ ID NO: 1975698 - RNA, 20 nt, Human
uaucuugcuugaacuuacag

SEQ ID NO: 1975699 - RNA, 13 nt, Human
uaugaggcauuug

SEQ ID NO: 1975700 - RNA, 21 nt, Human
uaugaucacggcucacugcag

SEQ ID NO: 1975701 - RNA, 23 nt, Human
uaugaucacggcucacugcagcc

SEQ ID NO: 1975702 - RNA, 13 nt, Human
uaugauaaauuug

SEQ ID NO: 1975703 - RNA, 14 nt, Human
uaugaucacggcuc

SEQ ID NO: 1975704 - RNA, 18 nt, Human
acagcagccccugcacaa

SEQ ID NO: 1975705 - RNA, 20 nt, Human
acagaguuuucacucuuauu

SEQ ID NO: 1975706 - RNA, 17 nt, Human
acagauaaagauugugu

SEQ ID NO: 1975707 - RNA, 14 nt, Human
acagauaaaugauu

SEQ ID NO: 1975708 - RNA, 13 nt, Human
acagauaaagauu

SEQ ID NO: 1975709 - RNA, 18 nt, Human
acagaguuuucacucuua

SEQ ID NO: 1975710 - RNA, 13 nt, Human
acagcccaccugg

SEQ ID NO: 1975711 - RNA, 13 nt, Human
acagacuucugaa

SEQ ID NO: 1975712 - RNA, 14 nt, Human
acagacuucugaaa

SEQ ID NO: 1975713 - RNA, 12 nt, Human
acagacuuguau

SEQ ID NO: 1975714 - RNA, 20 nt, Human
acagacuggauguaccacca

SEQ ID NO: 1975715 - RNA, 20 nt, Human
acagacuuuagcuuucugag

SEQ ID NO: 1975716 - RNA, 14 nt, Human
acagacuuguauau

SEQ ID NO: 1975717 - RNA, 16 nt, Human
acagacuuuagcuuuc

SEQ ID NO: 1975718 - RNA, 17 nt, Human
acagacuuuagcuuucu

SEQ ID NO: 1975719 - RNA, 19 nt, Human
acagacuuuagcuuucuga

SEQ ID NO: 1975720 - RNA, 19 nt, Human
acagagagagauacucugg

SEQ ID NO: 1975721 - RNA, 20 nt, Human
acagagagagauacucuggg

SEQ ID NO: 1975722 - RNA, 20 nt, Human
acagagcccacgcccccacu

SEQ ID NO: 1975723 - RNA, 17 nt, Human
acagagccguaaaaacu

SEQ ID NO: 1975724 - RNA, 16 nt, Human
acagagcuacacaggg

SEQ ID NO: 1975725 - RNA, 12 nt, Human
acagagccugcc

SEQ ID NO: 1975726 - RNA, 15 nt, Human
acagagccugcccca

SEQ ID NO: 1975727 - RNA, 19 nt, Human
acagagccugccccagcgc

SEQ ID NO: 1975728 - RNA, 16 nt, Human
acagagcgacagagca

SEQ ID NO: 1975729 - RNA, 17 nt, Human
acagagcgacagagcag

SEQ ID NO: 1975730 - RNA, 22 nt, Human
acagaguggacuguucccugag

SEQ ID NO: 1975731 - RNA, 22 nt, Human
acagagugccaacuucuuucau

SEQ ID NO: 1975732 - RNA, 16 nt, Human
acagagugcuuuucug

SEQ ID NO: 1975733 - RNA, 18 nt, Human
acagagcuacacagggga

SEQ ID NO: 1975734 - RNA, 21 nt, Human
acagagugagacucugucuca

SEQ ID NO: 1975735 - RNA, 10 nt, Human
uaucagaauu

SEQ ID NO: 1975736 - RNA, 13 nt, Human
uaucuacuugugu

SEQ ID NO: 1975737 - RNA, 15 nt, Human
uaucuagauacugua

SEQ ID NO: 1975738 - RNA, 16 nt, Human
uaucuagauacuguau

SEQ ID NO: 1975739 - RNA, 19 nt, Human
uaucuagauacuguaucau

SEQ ID NO: 1975740 - RNA, 13 nt, Human
uaucuagauguaa

SEQ ID NO: 1975741 - RNA, 15 nt, Human
uaucuagauguaaau

SEQ ID NO: 1975742 - RNA, 17 nt, Human
uaucuagauguaaauuu

SEQ ID NO: 1975743 - RNA, 13 nt, Human
uaucuagcugcau

SEQ ID NO: 1975744 - RNA, 18 nt, Human
uaucuagcugcauaucuu

SEQ ID NO: 1975745 - RNA, 14 nt, Human
uaucuaguaauaua

SEQ ID NO: 1975746 - RNA, 17 nt, Human
uaucucccccagcccca

SEQ ID NO: 1975747 - RNA, 23 nt, Human
uaucuaguaauauauuuaaaggg

SEQ ID NO: 1975748 - RNA, 15 nt, Human
uaucuaguguuugau

SEQ ID NO: 1975749 - RNA, 16 nt, Human
uaucuaguguuugauu

SEQ ID NO: 1975750 - RNA, 18 nt, Human
uaucucccccagccccau

SEQ ID NO: 1975751 - RNA, 16 nt, Human
uauauugauccagaaa

SEQ ID NO: 1975752 - RNA, 14 nt, Human
acagacuggaagca

SEQ ID NO: 1975753 - RNA, 20 nt, Human
acagacucaaaugcucagac

SEQ ID NO: 1975754 - RNA, 20 nt, Human
acagacccugcccugugggc

SEQ ID NO: 1975755 - RNA, 18 nt, Human
acagacccugcccugugg

SEQ ID NO: 1975756 - RNA, 16 nt, Human
acagacccugcccugu

SEQ ID NO: 1975757 - RNA, 17 nt, Human
acagacccugcccugug

SEQ ID NO: 1975758 - RNA, 21 nt, Human
acagacacucccacuuggcau

SEQ ID NO: 1975759 - RNA, 13 nt, Human
acagacagcccuc

SEQ ID NO: 1975760 - RNA, 15 nt, Human
acagacagcccucca

SEQ ID NO: 1975761 - RNA, 11 nt, Human
acacuccuuca

SEQ ID NO: 1975762 - RNA, 23 nt, Human
acagacacaggcccggcuccagg

SEQ ID NO: 1975763 - RNA, 18 nt, Human
uaucacccagaagaaaau

SEQ ID NO: 1975764 - RNA, 18 nt, Human
uaucaaguauuauaccuu

SEQ ID NO: 1975765 - RNA, 18 nt, Human
uauauuuacaacacuuua

SEQ ID NO: 1975766 - RNA, 21 nt, Human
uaucaaguauuauaccuuuuu

SEQ ID NO: 1975767 - RNA, 15 nt, Human
uauauuuacaaaugg

SEQ ID NO: 1975768 - RNA, 14 nt, Human
uauauuuacaaaug

SEQ ID NO: 1975769 - RNA, 19 nt, Human
uauauugcacaauuauaaa

SEQ ID NO: 1975770 - RNA, 15 nt, Human
uauauugguuuuaug

SEQ ID NO: 1975771 - RNA, 16 nt, Human
uauauugguuuuauga

SEQ ID NO: 1975772 - RNA, 17 nt, Human
uauauugguuuuaugau

SEQ ID NO: 1975773 - RNA, 19 nt, Human
uauauugguuuuaugauga

SEQ ID NO: 1975774 - RNA, 20 nt, Human
uauaaccaguguuguggauu

SEQ ID NO: 1975775 - RNA, 22 nt, Human
uauaagagcuuccaauuuuccu

SEQ ID NO: 1975776 - RNA, 18 nt, Human
uauaagccaaaauuaagg

SEQ ID NO: 1975777 - RNA, 19 nt, Human
uauaagccaaaauuaaggu

SEQ ID NO: 1975778 - RNA, 21 nt, Human
uauaagccaaaauuaaggugu

SEQ ID NO: 1975779 - RNA, 22 nt, Human
uauaagccaaaauuaagguguu

SEQ ID NO: 1975780 - RNA, 23 nt, Human
uauaagccaaaauuaagguguuu

SEQ ID NO: 1975781 - RNA, 21 nt, Human
uauaagcccuugauuggaagg

SEQ ID NO: 1975782 - RNA, 21 nt, Human
uauaauuuaccugaagucuuu

SEQ ID NO: 1975783 - RNA, 20 nt, Human
acaccucaacuaaauccaaa

SEQ ID NO: 1975784 - RNA, 14 nt, Human
uauaauuuugauag

SEQ ID NO: 1975785 - RNA, 15 nt, Human
uauaauuuugauagu

SEQ ID NO: 1975786 - RNA, 21 nt, Human
uauacacuuacacuuuaugca

SEQ ID NO: 1975787 - RNA, 13 nt, Human
uauacauaaacaa

SEQ ID NO: 1975788 - RNA, 14 nt, Human
uauacauaaacaag

SEQ ID NO: 1975789 - RNA, 14 nt, Human
uauacauuugauaa

SEQ ID NO: 1975790 - RNA, 20 nt, Human
uauacauguuuauguaaaca

SEQ ID NO: 1975791 - RNA, 13 nt, Human
uauaccauuuccg

SEQ ID NO: 1975792 - RNA, 17 nt, Human
uauaccauuuccguaau

SEQ ID NO: 1975793 - RNA, 21 nt, Human
uauauauuuuuuucugaaauu

SEQ ID NO: 1975794 - RNA, 22 nt, Human
uauauauuuuuuucugaaauuu

SEQ ID NO: 1975795 - RNA, 20 nt, Human
uauauauuuuuuucugaaau

SEQ ID NO: 1975796 - RNA, 13 nt, Human
uauauauaugugu

SEQ ID NO: 1975797 - RNA, 23 nt, Human
uauauauuuuuuucugaaauuuc

SEQ ID NO: 1975798 - RNA, 15 nt, Human
uauaucagacugcuu

SEQ ID NO: 1975799 - RNA, 21 nt, Human
uauaucagacugcuuugagaa

SEQ ID NO: 1975800 - RNA, 13 nt, Human
uauauaucaaaua

SEQ ID NO: 1975801 - RNA, 13 nt, Human
uauauauauaucu

SEQ ID NO: 1975802 - RNA, 13 nt, Human
uauauauaucugu

SEQ ID NO: 1975803 - RNA, 13 nt, Human
uauauauaugcau

SEQ ID NO: 1975804 - RNA, 14 nt, Human
uauauauaugcaua

SEQ ID NO: 1975805 - RNA, 15 nt, Human
uauauauaugcauau

SEQ ID NO: 1975806 - RNA, 23 nt, Human
acacucauugaccugaggcccuu

SEQ ID NO: 1975807 - RNA, 21 nt, Human
acacucauugaccugaggccc

SEQ ID NO: 1975808 - RNA, 11 nt, Human
acacuccaacg

SEQ ID NO: 1975809 - RNA, 19 nt, Human
acacucauugaccugaggc

SEQ ID NO: 1975810 - RNA, 16 nt, Human
uauaucccugauaaau

SEQ ID NO: 1975811 - RNA, 19 nt, Human
uauaucccugauaaauauu

SEQ ID NO: 1975812 - RNA, 16 nt, Human
uauaucauucuaaaga

SEQ ID NO: 1975813 - RNA, 17 nt, Human
uauaucauucuaaagau

SEQ ID NO: 1975814 - RNA, 13 nt, Human
uauaggaauugac

SEQ ID NO: 1975815 - RNA, 14 nt, Human
uauaggaauugacc

SEQ ID NO: 1975816 - RNA, 19 nt, Human
uauaggaauugacccacaa

SEQ ID NO: 1975817 - RNA, 20 nt, Human
uauagccuaggugacagagu

SEQ ID NO: 1975818 - RNA, 20 nt, Human
uaguuccucauuagcauuuu

SEQ ID NO: 1975819 - RNA, 14 nt, Human
uaguuacuguaaaa

SEQ ID NO: 1975820 - RNA, 20 nt, Human
uaguuacuguaaaaugcaaa

SEQ ID NO: 1975821 - RNA, 11 nt, Human
uagugacuuuu

SEQ ID NO: 1975822 - RNA, 19 nt, Human
uagugacuuuucaaguauu

SEQ ID NO: 1975823 - RNA, 12 nt, Human
uaguucuguauu

SEQ ID NO: 1975824 - RNA, 14 nt, Human
uaguucuguauuug

SEQ ID NO: 1975825 - RNA, 15 nt, Human
uaguucuguauuuga

SEQ ID NO: 1975826 - RNA, 9 nt, Human
uaguucugu

SEQ ID NO: 1975827 - RNA, 16 nt, Human
uaguucuguauuugaa

SEQ ID NO: 1975828 - RNA, 23 nt, Human
uaguucuagugcagcugaaauug

SEQ ID NO: 1975829 - RNA, 22 nt, Human
uaguucuagugcagcugaaauu

SEQ ID NO: 1975830 - RNA, 21 nt, Human
uagucagcgcaggaaugcaca

SEQ ID NO: 1975831 - RNA, 17 nt, Human
uagucauuuucaagacu

SEQ ID NO: 1975832 - RNA, 23 nt, Human
acaagcugcacccucaggcaggu

SEQ ID NO: 1975833 - RNA, 22 nt, Human
acaagcugcacccucaggcagg

SEQ ID NO: 1975834 - RNA, 21 nt, Human
acaagcugcacccucaggcag

SEQ ID NO: 1975835 - RNA, 19 nt, Human
acaagcugcacccucaggc

SEQ ID NO: 1975836 - RNA, 21 nt, Human
uagucaggugccucaagagaa

SEQ ID NO: 1975837 - RNA, 14 nt, Human
acaaggaagaaauu

SEQ ID NO: 1975838 - RNA, 19 nt, Human
acaaggaagaaauuaacuu

SEQ ID NO: 1975839 - RNA, 23 nt, Human
acaagcuauucccucaaaucuga

SEQ ID NO: 1975840 - RNA, 13 nt, Human
acaagcuggcuua

SEQ ID NO: 1975841 - RNA, 19 nt, Human
acaagcuggcuuacacugg

SEQ ID NO: 1975842 - RNA, 20 nt, Human
acaagcuguugaccaggcac

SEQ ID NO: 1975843 - RNA, 22 nt, Human
acaagcuguugaccaggcaccu

SEQ ID NO: 1975844 - RNA, 19 nt, Human
acacaugcaaggucauuuu

SEQ ID NO: 1975845 - RNA, 20 nt, Human
acacaugcaaggucauuuuu

SEQ ID NO: 1975846 - RNA, 18 nt, Human
acacaugcaaggucauuu

SEQ ID NO: 1975847 - RNA, 14 nt, Human
acacaucaucugua

SEQ ID NO: 1975848 - RNA, 15 nt, Human
acacaucaucuguaa

SEQ ID NO: 1975849 - RNA, 16 nt, Human
acacaucaucuguaag

SEQ ID NO: 1975850 - RNA, 17 nt, Human
uauaaaagccuguuuaa

SEQ ID NO: 1975851 - RNA, 14 nt, Human
uauaaaagccuguu

SEQ ID NO: 1975852 - RNA, 12 nt, Human
uauaaaagccug

SEQ ID NO: 1975853 - RNA, 13 nt, Human
uaguuuucucagc

SEQ ID NO: 1975854 - RNA, 23 nt, Human
uaguuuuauuuucuaaaguacug

SEQ ID NO: 1975855 - RNA, 14 nt, Human
uaguuuuauuuaua

SEQ ID NO: 1975856 - RNA, 15 nt, Human
uaguuuuauuuauau

SEQ ID NO: 1975857 - RNA, 21 nt, Human
uaguuuuauuuauauuuauug

SEQ ID NO: 1975858 - RNA, 22 nt, Human
uaguuuuauuuauauuuauuga

SEQ ID NO: 1975859 - RNA, 15 nt, Human
uaguuuuauuuucua

SEQ ID NO: 1975860 - RNA, 17 nt, Human
uaguuuuauuuucuaaa

SEQ ID NO: 1975861 - RNA, 19 nt, Human
uaguuuuauuuucuaaagu

SEQ ID NO: 1975862 - RNA, 21 nt, Human
acacaugcaaggucauuuuuu

SEQ ID NO: 1975863 - RNA, 19 nt, Human
acacccagcccacuucugc

SEQ ID NO: 1975864 - RNA, 20 nt, Human
acacccagcccacuucugcc

SEQ ID NO: 1975865 - RNA, 21 nt, Human
acacccagcccacuucugcca

SEQ ID NO: 1975866 - RNA, 18 nt, Human
acacccugugauggggcc

SEQ ID NO: 1975867 - RNA, 12 nt, Human
acacccugugau

SEQ ID NO: 1975868 - RNA, 11 nt, Human
acacccuguga

SEQ ID NO: 1975869 - RNA, 16 nt, Human
acaccgggccuggaga

SEQ ID NO: 1975870 - RNA, 12 nt, Human
uauugacaguug

SEQ ID NO: 1975871 - RNA, 12 nt, Human
uauucuuucucc

SEQ ID NO: 1975872 - RNA, 16 nt, Human
uauucuuucuccuuuu

SEQ ID NO: 1975873 - RNA, 14 nt, Human
uauucuuugcacuu

SEQ ID NO: 1975874 - RNA, 16 nt, Human
uauucuuugcacuuuu

SEQ ID NO: 1975875 - RNA, 22 nt, Human
uauucuuugcacuuuuucuuaa

SEQ ID NO: 1975876 - RNA, 12 nt, Human
uauucuuuguua

SEQ ID NO: 1975877 - RNA, 15 nt, Human
uauucuugaugaaaa

SEQ ID NO: 1975878 - RNA, 19 nt, Human
uauucuugaugaaaagcuu

SEQ ID NO: 1975879 - RNA, 19 nt, Human
uauucuugaucaguaguuu

SEQ ID NO: 1975880 - RNA, 22 nt, Human
uauucuugaucaguaguuugca

SEQ ID NO: 1975881 - RNA, 23 nt, Human
uauucuugaucaguaguuugcau

SEQ ID NO: 1975882 - RNA, 14 nt, Human
uauucuugaugaaa

SEQ ID NO: 1975883 - RNA, 16 nt, Human
uauugaaaugauuuca

SEQ ID NO: 1975884 - RNA, 13 nt, Human
uauucuuuguuaa

SEQ ID NO: 1975885 - RNA, 15 nt, Human
uauucuuuguuaauu

SEQ ID NO: 1975886 - RNA, 17 nt, Human
uauucuuuguuaauuug

SEQ ID NO: 1975887 - RNA, 19 nt, Human
uauucuuuguuaauuugga

SEQ ID NO: 1975888 - RNA, 17 nt, Human
uauucuuuuuuucucua

SEQ ID NO: 1975889 - RNA, 19 nt, Human
uauugaggaaaaauaugug

SEQ ID NO: 1975890 - RNA, 21 nt, Human
uauugaggaaaaauaugugaa

SEQ ID NO: 1975891 - RNA, 22 nt, Human
uauugaggaaaaauaugugaag

SEQ ID NO: 1975892 - RNA, 20 nt, Human
uauugagggaaauguuuuca

SEQ ID NO: 1975893 - RNA, 17 nt, Human
uauugacaguugugcag

SEQ ID NO: 1975894 - RNA, 16 nt, Human
uauugagagagaugug

SEQ ID NO: 1975895 - RNA, 19 nt, Human
uauugagagagauguguaa

SEQ ID NO: 1975896 - RNA, 22 nt, Human
uauugagagagauguguaauuu

SEQ ID NO: 1975897 - RNA, 15 nt, Human
uauugaggaaaaaua

SEQ ID NO: 1975898 - RNA, 17 nt, Human
uauugaggaaaaauaug

SEQ ID NO: 1975899 - RNA, 15 nt, Human
uauugguauacuguu

SEQ ID NO: 1975900 - RNA, 14 nt, Human
uauugguauauccu

SEQ ID NO: 1975901 - RNA, 17 nt, Human
uauugguauauccuuuu

SEQ ID NO: 1975902 - RNA, 19 nt, Human
uauugguauauccuuuucu

SEQ ID NO: 1975903 - RNA, 17 nt, Human
uauugguguaagguacu

SEQ ID NO: 1975904 - RNA, 13 nt, Human
uauugguuuuaug

SEQ ID NO: 1975905 - RNA, 14 nt, Human
uauugguuuuauga

SEQ ID NO: 1975906 - RNA, 15 nt, Human
uauugguuuuaugau

SEQ ID NO: 1975907 - RNA, 16 nt, Human
uauuguaacuauguuu

SEQ ID NO: 1975908 - RNA, 11 nt, Human
uauuguaagaa

SEQ ID NO: 1975909 - RNA, 17 nt, Human
uauuguaagaaauacug

SEQ ID NO: 1975910 - RNA, 19 nt, Human
uauuguaagaaauacugua

SEQ ID NO: 1975911 - RNA, 16 nt, Human
acaguucucuccuucu

SEQ ID NO: 1975912 - RNA, 19 nt, Human
acaguuccaaucaguagcu

SEQ ID NO: 1975913 - RNA, 23 nt, Human
acaguucggugagcuacaaaugc

SEQ ID NO: 1975914 - RNA, 19 nt, Human
acaguucggugagcuacaa

SEQ ID NO: 1975915 - RNA, 22 nt, Human
acaguucggugagcuacaaaug

SEQ ID NO: 1975916 - RNA, 13 nt, Human
acaguuacucaga

SEQ ID NO: 1975917 - RNA, 20 nt, Human
acaguuacucagaauucucu

SEQ ID NO: 1975918 - RNA, 13 nt, Human
acaguuauuacau

SEQ ID NO: 1975919 - RNA, 16 nt, Human
acaguuauagaaagca

SEQ ID NO: 1975920 - RNA, 12 nt, Human
acaguuacuuuu

SEQ ID NO: 1975921 - RNA, 13 nt, Human
acaguuacuuuuc

SEQ ID NO: 1975922 - RNA, 14 nt, Human
acaguuacuuuucc

SEQ ID NO: 1975923 - RNA, 15 nt, Human
acaguuacuuuuccu

SEQ ID NO: 1975924 - RNA, 16 nt, Human
acaguuacuuuuccuu

SEQ ID NO: 1975925 - RNA, 20 nt, Human
acaguuacuuuuccuugcau

SEQ ID NO: 1975926 - RNA, 23 nt, Human
acaguuacuuuuccuugcauaca

SEQ ID NO: 1975927 - RNA, 20 nt, Human
acaguucaauucucauuugu

SEQ ID NO: 1975928 - RNA, 19 nt, Human
acaguucauucagggccga

SEQ ID NO: 1975929 - RNA, 17 nt, Human
acaguucucuccuucuu

SEQ ID NO: 1975930 - RNA, 13 nt, Human
uauucucuguaca

SEQ ID NO: 1975931 - RNA, 14 nt, Human
uauucucuguacau

SEQ ID NO: 1975932 - RNA, 15 nt, Human
uauucucuguacaua

SEQ ID NO: 1975933 - RNA, 16 nt, Human
uauucucuguacauau

SEQ ID NO: 1975934 - RNA, 20 nt, Human
uauucucuccuguaccucuu

SEQ ID NO: 1975935 - RNA, 24 nt, Human
uauucucuccuguaccucuugagc

SEQ ID NO: 1975936 - RNA, 22 nt, Human
uauucugugcuguuacaguuuu

SEQ ID NO: 1975937 - RNA, 16 nt, Human
uauucuguuggccagu

SEQ ID NO: 1975938 - RNA, 15 nt, Human
uauucuuauuuaaug

SEQ ID NO: 1975939 - RNA, 13 nt, Human
uauucucuuuuca

SEQ ID NO: 1975940 - RNA, 18 nt, Human
uauucucuguacauauua

SEQ ID NO: 1975941 - RNA, 21 nt, Human
uauucugggaauguauaguau

SEQ ID NO: 1975942 - RNA, 23 nt, Human
uauucugggaauguauaguauuu

SEQ ID NO: 1975943 - RNA, 16 nt, Human
uauucugggaauguau

SEQ ID NO: 1975944 - RNA, 17 nt, Human
uauucugggaauguaua

SEQ ID NO: 1975945 - RNA, 19 nt, Human
uauucugggaauguauagu

SEQ ID NO: 1975946 - RNA, 15 nt, Human
uauucugucuucauc

SEQ ID NO: 1975947 - RNA, 19 nt, Human
uauuucaaguacacugaau

SEQ ID NO: 1975948 - RNA, 20 nt, Human
uauuuauuuuuuuuaauugu

SEQ ID NO: 1975949 - RNA, 22 nt, Human
uauuuauuuuuuuuaauuguau

SEQ ID NO: 1975950 - RNA, 14 nt, Human
uauuuauuuauuua

SEQ ID NO: 1975951 - RNA, 14 nt, Human
uauuuauuuaaauu

SEQ ID NO: 1975952 - RNA, 14 nt, Human
uauuuauuuaguau

SEQ ID NO: 1975953 - RNA, 13 nt, Human
uauuuauuuaaau

SEQ ID NO: 1975954 - RNA, 19 nt, Human
uauuuaguguucauaaaua

SEQ ID NO: 1975955 - RNA, 12 nt, Human
uauuuaauguug

SEQ ID NO: 1975956 - RNA, 13 nt, Human
uauuuaauguuga

SEQ ID NO: 1975957 - RNA, 14 nt, Human
uauuuaauguugaa

SEQ ID NO: 1975958 - RNA, 15 nt, Human
uauuuaauguugaac

SEQ ID NO: 1975959 - RNA, 17 nt, Human
uauuuaauguugaacaa

SEQ ID NO: 1975960 - RNA, 18 nt, Human
uauuuaauguugaacaaa

SEQ ID NO: 1975961 - RNA, 20 nt, Human
uauuuaauguugaacaaaau

SEQ ID NO: 1975962 - RNA, 23 nt, Human
uauuuaauguugaacaaaauaaa

SEQ ID NO: 1975963 - RNA, 14 nt, Human
uauuuaauucaugu

SEQ ID NO: 1975964 - RNA, 13 nt, Human
uauuuaauuugaa

SEQ ID NO: 1975965 - RNA, 16 nt, Human
uauuuaauuugaaggu

SEQ ID NO: 1975966 - RNA, 23 nt, Human
uauuuaauuugaagguagaaugu

SEQ ID NO: 1975967 - RNA, 23 nt, Human
uauuuaauuuuuuugagacagag

SEQ ID NO: 1975968 - RNA, 16 nt, Human
uauuuacaaccuagaa

SEQ ID NO: 1975969 - RNA, 20 nt, Human
uauuuacaacacuuuaaugg

SEQ ID NO: 1975970 - RNA, 15 nt, Human
uauuuacacaauuua

SEQ ID NO: 1975971 - RNA, 18 nt, Human
uauuuacuucuuauacau

SEQ ID NO: 1975972 - RNA, 20 nt, Human
uauuuagcaccagggaaggg

SEQ ID NO: 1975973 - RNA, 20 nt, Human
uauuuagaugcauauuacug

SEQ ID NO: 1975974 - RNA, 17 nt, Human
uauuguagcauccugga

SEQ ID NO: 1975975 - RNA, 18 nt, Human
uauuguagcauccuggaa

SEQ ID NO: 1975976 - RNA, 20 nt, Human
uauuguagcauccuggaaua

SEQ ID NO: 1975977 - RNA, 21 nt, Human
uauuguagcauccuggaauau

SEQ ID NO: 1975978 - RNA, 22 nt, Human
uauuguaucaaucuuuagaaaa

SEQ ID NO: 1975979 - RNA, 17 nt, Human
uauugucaaagugguga

SEQ ID NO: 1975980 - RNA, 13 nt, Human
uauugucaaagug

SEQ ID NO: 1975981 - RNA, 17 nt, Human
uauuuaaccucuaaauu

SEQ ID NO: 1975982 - RNA, 18 nt, Human
uauuuaaccucuaaauuc

SEQ ID NO: 1975983 - RNA, 22 nt, Human
uauuguccuauuaguguuauau

SEQ ID NO: 1975984 - RNA, 21 nt, Human
uauugucccuggcuuccuuac

SEQ ID NO: 1975985 - RNA, 22 nt, Human
uauugucccuggcuuccuuacu

SEQ ID NO: 1975986 - RNA, 17 nt, Human
uauuguccuauuagugu

SEQ ID NO: 1975987 - RNA, 18 nt, Human
uauuguccuauuaguguu

SEQ ID NO: 1975988 - RNA, 20 nt, Human
uauugucccuggcuuccuua

SEQ ID NO: 1975989 - RNA, 14 nt, Human
uauuuaauagguuu

SEQ ID NO: 1975990 - RNA, 21 nt, Human
uauuuaaugaaagacuguaca

SEQ ID NO: 1975991 - RNA, 15 nt, Human
uauuuaaugaaagac

SEQ ID NO: 1975992 - RNA, 24 nt, Human
uauuuaagccuaaagauuuugauc

SEQ ID NO: 1975993 - RNA, 17 nt, Human
uauuuaagccuaaagau

SEQ ID NO: 1975994 - RNA, 18 nt, Human
uauuuaagccuaaagauu

SEQ ID NO: 1975995 - RNA, 22 nt, Human
uauuuaagccuaaagauuuuga

SEQ ID NO: 1975996 - RNA, 14 nt, Human
acagugugauuuug

SEQ ID NO: 1975997 - RNA, 22 nt, Human
acaguguguggucaacauuucu

SEQ ID NO: 1975998 - RNA, 14 nt, Human
acagugagacucug

SEQ ID NO: 1975999 - RNA, 18 nt, Human
acagugagacucugucuc

SEQ ID NO: 1976000 - RNA, 11 nt, Human
acaguguuccg

SEQ ID NO: 1976001 - RNA, 16 nt, Human
acaguguugagaacua

SEQ ID NO: 1976002 - RNA, 15 nt, Human
acaguuaagagaaau

SEQ ID NO: 1976003 - RNA, 18 nt, Human
acaguuaaggagaaucau

SEQ ID NO: 1976004 - RNA, 22 nt, Human
acaguccuuaccagcagagcac

SEQ ID NO: 1976005 - RNA, 21 nt, Human
acaguccuuaccagcagagca

SEQ ID NO: 1976006 - RNA, 12 nt, Human
acagucucacca

SEQ ID NO: 1976007 - RNA, 18 nt, Human
acagucucaccauuuccc

SEQ ID NO: 1976008 - RNA, 22 nt, Human
acagucucaccauuuccccagg

SEQ ID NO: 1976009 - RNA, 13 nt, Human
acagucuccccca

SEQ ID NO: 1976010 - RNA, 18 nt, Human
acagucucugagaacugg

SEQ ID NO: 1976011 - RNA, 20 nt, Human
acagugaaagaaaauaacaa

SEQ ID NO: 1976012 - RNA, 15 nt, Human
acaguccucccaucu

SEQ ID NO: 1976013 - RNA, 14 nt, Human
acaguccucccauc

SEQ ID NO: 1976014 - RNA, 13 nt, Human
acaguccucccau

SEQ ID NO: 1976015 - RNA, 15 nt, Human
acagucccugccaau

SEQ ID NO: 1976016 - RNA, 20 nt, Human
acaguccuuaccagcagagc

SEQ ID NO: 1976017 - RNA, 18 nt, Human
acaguccuuaccagcaga

SEQ ID NO: 1976018 - RNA, 17 nt, Human
acaguccucccaucuca

SEQ ID NO: 1976019 - RNA, 22 nt, Human
acaguccuauuuagacauguaa

SEQ ID NO: 1976020 - RNA, 13 nt, Human
acagucccugcca

SEQ ID NO: 1976021 - RNA, 15 nt, Human
acaguauuacuucug

SEQ ID NO: 1976022 - RNA, 16 nt, Human
acaguauuacuucugc

SEQ ID NO: 1976023 - RNA, 17 nt, Human
acaguauuacuucugcu

SEQ ID NO: 1976024 - RNA, 19 nt, Human
acaguauuacuucugcuac

SEQ ID NO: 1976025 - RNA, 21 nt, Human
acaguauggcagcuuuccuca

SEQ ID NO: 1976026 - RNA, 16 nt, Human
acagggcaugaaauga

SEQ ID NO: 1976027 - RNA, 21 nt, Human
acaggcugggcuucaguggca

SEQ ID NO: 1976028 - RNA, 15 nt, Human
acaggcugggcuggg

SEQ ID NO: 1976029 - RNA, 17 nt, Human
acaggcugggcugggca

SEQ ID NO: 1976030 - RNA, 14 nt, Human
acaggcugggcuuc

SEQ ID NO: 1976031 - RNA, 17 nt, Human
acaggcugggcuucagu

SEQ ID NO: 1976032 - RNA, 22 nt, Human
acagguuuuccugaagaauuga

SEQ ID NO: 1976033 - RNA, 22 nt, Human
acagggcacaccgggcacucag

SEQ ID NO: 1976034 - RNA, 21 nt, Human
acaggcugggcugggcacugc

SEQ ID NO: 1976035 - RNA, 23 nt, Human
uauuaguguuauaugaacauaca

SEQ ID NO: 1976036 - RNA, 13 nt, Human
uauuauaaacaag

SEQ ID NO: 1976037 - RNA, 19 nt, Human
uauuauaaacaagaaugaa

SEQ ID NO: 1976038 - RNA, 23 nt, Human
uauuauaaacaagaaugaagguu

SEQ ID NO: 1976039 - RNA, 21 nt, Human
uauuagcgacaacagauugga

SEQ ID NO: 1976040 - RNA, 23 nt, Human
uauuagcgacaacagauuggauu

SEQ ID NO: 1976041 - RNA, 13 nt, Human
uauuaguguuaua

SEQ ID NO: 1976042 - RNA, 14 nt, Human
uauuaguguuauau

SEQ ID NO: 1976043 - RNA, 16 nt, Human
uauuaguguuauauga

SEQ ID NO: 1976044 - RNA, 17 nt, Human
uauuaguguuauaugaa

SEQ ID NO: 1976045 - RNA, 18 nt, Human
uauuaguguuauaugaac

SEQ ID NO: 1976046 - RNA, 21 nt, Human
uauuaguguuauaugaacaua

SEQ ID NO: 1976047 - RNA, 23 nt, Human
uauuagcagcugacuuucaaagu

SEQ ID NO: 1976048 - RNA, 18 nt, Human
uauuagcgacaacagauu

SEQ ID NO: 1976049 - RNA, 20 nt, Human
uauuagcgacaacagauugg

SEQ ID NO: 1976050 - RNA, 20 nt, Human
uauuaccaccaucccgugcu

SEQ ID NO: 1976051 - RNA, 16 nt, Human
uauuaccacagacaua

SEQ ID NO: 1976052 - RNA, 20 nt, Human
uauuacgaaguucaagauca

SEQ ID NO: 1976053 - RNA, 21 nt, Human
uauuacgaaguucaagaucaa

SEQ ID NO: 1976054 - RNA, 12 nt, Human
uauuagagaaga

SEQ ID NO: 1976055 - RNA, 17 nt, Human
uauuagacuucuguuuu

SEQ ID NO: 1976056 - RNA, 20 nt, Human
uauuagacuucuguuuucaa

SEQ ID NO: 1976057 - RNA, 21 nt, Human
uauuagacuucuguuuucaau

SEQ ID NO: 1976058 - RNA, 23 nt, Human
uauuagacuucuguuuucaaucu

SEQ ID NO: 1976059 - RNA, 14 nt, Human
uauucauaauuauu

SEQ ID NO: 1976060 - RNA, 17 nt, Human
uauucauaguagaacuu

SEQ ID NO: 1976061 - RNA, 23 nt, Human
uauucauagcagcuuauucacaa

SEQ ID NO: 1976062 - RNA, 13 nt, Human
uauucauauuugu

SEQ ID NO: 1976063 - RNA, 15 nt, Human
uauucauauuuguac

SEQ ID NO: 1976064 - RNA, 16 nt, Human
uauucauauuuguacu

SEQ ID NO: 1976065 - RNA, 17 nt, Human
uauucauauuuguacuu

SEQ ID NO: 1976066 - RNA, 22 nt, Human
uauucauauuuguacuuucugu

SEQ ID NO: 1976067 - RNA, 23 nt, Human
uauucauauuuguacuuucuguu

SEQ ID NO: 1976068 - RNA, 22 nt, Human
uauucaggaagcucagggccug

SEQ ID NO: 1976069 - RNA, 18 nt, Human
uauucaggaagcucaggg

SEQ ID NO: 1976070 - RNA, 15 nt, Human
uauucaggcuuuagg

SEQ ID NO: 1976071 - RNA, 19 nt, Human
uauucaggggaaacuugau

SEQ ID NO: 1976072 - RNA, 22 nt, Human
uauucagcaaggcgcuaacuug

SEQ ID NO: 1976073 - RNA, 23 nt, Human
uauucagcaaggcgcuaacuugc

SEQ ID NO: 1976074 - RNA, 15 nt, Human
uauucagcucaugga

SEQ ID NO: 1976075 - RNA, 12 nt, Human
acagcuccccca

SEQ ID NO: 1976076 - RNA, 16 nt, Human
acagcucccccagcuc

SEQ ID NO: 1976077 - RNA, 11 nt, Human
uaugugugugu

SEQ ID NO: 1976078 - RNA, 14 nt, Human
uauguguguguguu

SEQ ID NO: 1976079 - RNA, 22 nt, Human
uauguguguguguugugugugg

SEQ ID NO: 1976080 - RNA, 16 nt, Human
uauuaaaaaucucaaa

SEQ ID NO: 1976081 - RNA, 18 nt, Human
uauuaaaaaucucaaauu

SEQ ID NO: 1976082 - RNA, 20 nt, Human
uauuaaaaaucucaaauuuc

SEQ ID NO: 1976083 - RNA, 22 nt, Human
uauuaaaaaucucaaauuucua

SEQ ID NO: 1976084 - RNA, 23 nt, Human
uauguguguguguuguguguggg

SEQ ID NO: 1976085 - RNA, 17 nt, Human
uauguuuuaagaggcag

SEQ ID NO: 1976086 - RNA, 19 nt, Human
uauguuuuaagaggcaggg

SEQ ID NO: 1976087 - RNA, 23 nt, Human
uauuacaguggggaaugaagaua

SEQ ID NO: 1976088 - RNA, 21 nt, Human
uauuaaaguuucaaaaaucug

SEQ ID NO: 1976089 - RNA, 22 nt, Human
uauuaaaguuucaaaaaucuga

SEQ ID NO: 1976090 - RNA, 13 nt, Human
uauuaaaguuuca

SEQ ID NO: 1976091 - RNA, 14 nt, Human
uauuaaaguuucaa

SEQ ID NO: 1976092 - RNA, 15 nt, Human
uauuaaaguuucaaa

SEQ ID NO: 1976093 - RNA, 16 nt, Human
uauuaaaguuucaaaa

SEQ ID NO: 1976094 - RNA, 18 nt, Human
uauuaaaguuucaaaaau

SEQ ID NO: 1976095 - RNA, 23 nt, Human
uauuaaaaaucucaaauuucuaa

SEQ ID NO: 1976096 - RNA, 13 nt, Human
aauuuaucuuuga

SEQ ID NO: 1976097 - RNA, 15 nt, Human
aauuuaccugaaguc

SEQ ID NO: 1976098 - RNA, 17 nt, Human
aauuuagaaauauaauu

SEQ ID NO: 1976099 - RNA, 14 nt, Human
aauuuaugugaugg

SEQ ID NO: 1976100 - RNA, 15 nt, Human
aauuuaucuuugaua

SEQ ID NO: 1976101 - RNA, 16 nt, Human
aauuuaucuuugauaa

SEQ ID NO: 1976102 - RNA, 13 nt, Human
aauuucuaaaucu

SEQ ID NO: 1976103 - RNA, 21 nt, Human
aauuucuaaaucuccaaaaua

SEQ ID NO: 1976104 - RNA, 19 nt, Human
aauuugauaugugaacagu

SEQ ID NO: 1976105 - RNA, 15 nt, Human
aauuugauaugugaa

SEQ ID NO: 1976106 - RNA, 16 nt, Human
aauuugauaugugaac

SEQ ID NO: 1976107 - RNA, 18 nt, Human
aauuugauaugugaacag

SEQ ID NO: 1976108 - RNA, 20 nt, Human
aauuugaaacacuuugcaua

SEQ ID NO: 1976109 - RNA, 12 nt, Human
aauuugaaacau

SEQ ID NO: 1976110 - RNA, 13 nt, Human
aauuugaaacauu

SEQ ID NO: 1976111 - RNA, 14 nt, Human
aauuugaaacauug

SEQ ID NO: 1976112 - RNA, 15 nt, Human
aauuugaaacauugc

SEQ ID NO: 1976113 - RNA, 21 nt, Human
aauuugaaacauugcuuuuaa

SEQ ID NO: 1976114 - RNA, 23 nt, Human
aauuucucuuaaguacugaaaua

SEQ ID NO: 1976115 - RNA, 15 nt, Human
aauuugaaacacuuu

SEQ ID NO: 1976116 - RNA, 15 nt, Human
aauuuaaauagcuuu

SEQ ID NO: 1976117 - RNA, 16 nt, Human
aauuuaaauagcuuuu

SEQ ID NO: 1976118 - RNA, 12 nt, Human
aauuuaaguuuu

SEQ ID NO: 1976119 - RNA, 15 nt, Human
aauuuaaguuuugac

SEQ ID NO: 1976120 - RNA, 17 nt, Human
aauuuaaguuuugacaa

SEQ ID NO: 1976121 - RNA, 20 nt, Human
aauuuaaguuuugacaagcu

SEQ ID NO: 1976122 - RNA, 23 nt, Human
aauuuaaguuuugacaagcuggc

SEQ ID NO: 1976123 - RNA, 24 nt, Human
aauuuaaguuuugacaagcuggcu

SEQ ID NO: 1976124 - RNA, 19 nt, Human
aauuuacauacucugcuua

SEQ ID NO: 1976125 - RNA, 20 nt, Human
aauuuaaagaaaaaaauguc

SEQ ID NO: 1976126 - RNA, 13 nt, Human
aauuuaaaauaua

SEQ ID NO: 1976127 - RNA, 13 nt, Human
aauuuaaaagucu

SEQ ID NO: 1976128 - RNA, 17 nt, Human
aauuuaaaaagcccaac

SEQ ID NO: 1976129 - RNA, 20 nt, Human
aauuguuguccgguuuacuu

SEQ ID NO: 1976130 - RNA, 22 nt, Human
aauuguuguccgguuuacuuua

SEQ ID NO: 1976131 - RNA, 23 nt, Human
aauuguuguccgguuuacuuuaa

SEQ ID NO: 1976132 - RNA, 22 nt, Human
aauuguuuagauuuuguguuua

SEQ ID NO: 1976133 - RNA, 14 nt, Human
aauuguuuagauuu

SEQ ID NO: 1976134 - RNA, 22 nt, Human
aauuguuuggggaugagaaagg

SEQ ID NO: 1976135 - RNA, 13 nt, Human
aauuguuguuugu

SEQ ID NO: 1976136 - RNA, 14 nt, Human
aauuguuguuugua

SEQ ID NO: 1976137 - RNA, 17 nt, Human
aauuguuguuuguaugu

SEQ ID NO: 1976138 - RNA, 19 nt, Human
aauuguuguuuguauguau

SEQ ID NO: 1976139 - RNA, 21 nt, Human
aauuguuguuuguauguauaa

SEQ ID NO: 1976140 - RNA, 22 nt, Human
aauuguuguuuguauguauaau

SEQ ID NO: 1976141 - RNA, 23 nt, Human
aauuguuguuuguauguauaauu

SEQ ID NO: 1976142 - RNA, 12 nt, Human
aauugcuccuug

SEQ ID NO: 1976143 - RNA, 17 nt, Human
aauugcucacaguuauu

SEQ ID NO: 1976144 - RNA, 21 nt, Human
aauugcucacaguuauuacau

SEQ ID NO: 1976145 - RNA, 13 nt, Human
aauugcucacagu

SEQ ID NO: 1976146 - RNA, 23 nt, Human
uacuguaaaaugcaaaaaaucuu

SEQ ID NO: 1976147 - RNA, 15 nt, Human
aauugugugaacuug

SEQ ID NO: 1976148 - RNA, 18 nt, Human
aauugugugaacuuggaa

SEQ ID NO: 1976149 - RNA, 15 nt, Human
aauugugugauauuu

SEQ ID NO: 1976150 - RNA, 19 nt, Human
aauugugugauauuucaga

SEQ ID NO: 1976151 - RNA, 21 nt, Human
aauugugugauauuucagaaa

SEQ ID NO: 1976152 - RNA, 22 nt, Human
aauugugugauauuucagaaau

SEQ ID NO: 1976153 - RNA, 23 nt, Human
aauugugugauauuucagaaaua

SEQ ID NO: 1976154 - RNA, 22 nt, Human
aauugcucacaguuauuacaua

SEQ ID NO: 1976155 - RNA, 13 nt, Human
aauugcugaggca

SEQ ID NO: 1976156 - RNA, 18 nt, Human
aauucuuugaccuguugg

SEQ ID NO: 1976157 - RNA, 22 nt, Human
aauucuuugaccuguugggagu

SEQ ID NO: 1976158 - RNA, 14 nt, Human
aauucuuucauuuu

SEQ ID NO: 1976159 - RNA, 17 nt, Human
aauucuuugcaaaaauc

SEQ ID NO: 1976160 - RNA, 18 nt, Human
aauucuuugcaaaaaucc

SEQ ID NO: 1976161 - RNA, 13 nt, Human
aauucuuuuuuau

SEQ ID NO: 1976162 - RNA, 14 nt, Human
aauucuuuuuuauu

SEQ ID NO: 1976163 - RNA, 16 nt, Human
aauucuuuuuuauuaa

SEQ ID NO: 1976164 - RNA, 17 nt, Human
aauucuuuuuuauuaau

SEQ ID NO: 1976165 - RNA, 18 nt, Human
aauucuuuuuuauuaauc

SEQ ID NO: 1976166 - RNA, 21 nt, Human
aauucuuuuuuauuaaucacu

SEQ ID NO: 1976167 - RNA, 22 nt, Human
aauucuuuuuuauuaaucacug

SEQ ID NO: 1976168 - RNA, 23 nt, Human
aauucuuuuuuauuaaucacugu

SEQ ID NO: 1976169 - RNA, 14 nt, Human
aauugaaaaguuau

SEQ ID NO: 1976170 - RNA, 13 nt, Human
aauucuuuaauga

SEQ ID NO: 1976171 - RNA, 19 nt, Human
aauucuuuaaugauuccua

SEQ ID NO: 1976172 - RNA, 13 nt, Human
aauugacccacaa

SEQ ID NO: 1976173 - RNA, 16 nt, Human
aauugaagguuuuuga

SEQ ID NO: 1976174 - RNA, 18 nt, Human
aauugaagguuuuugaua

SEQ ID NO: 1976175 - RNA, 19 nt, Human
aauugaagguuuuugauag

SEQ ID NO: 1976176 - RNA, 16 nt, Human
aauugacccacaagaa

SEQ ID NO: 1976177 - RNA, 19 nt, Human
aauugacccacaagaaaug

SEQ ID NO: 1976178 - RNA, 15 nt, Human
uacguacacauuuua

SEQ ID NO: 1976179 - RNA, 21 nt, Human
aauugaagguuuuugauagca

SEQ ID NO: 1976180 - RNA, 23 nt, Human
aauucuuauuccauauuagaaaa

SEQ ID NO: 1976181 - RNA, 21 nt, Human
aauucuuauuacuagacugcc

SEQ ID NO: 1976182 - RNA, 18 nt, Human
aauucuuauuccauauua

SEQ ID NO: 1976183 - RNA, 19 nt, Human
aauucuuauuccauauuag

SEQ ID NO: 1976184 - RNA, 22 nt, Human
aauucuuauuccauauuagaaa

SEQ ID NO: 1976185 - RNA, 16 nt, Human
uacccuuuuucuugaa

SEQ ID NO: 1976186 - RNA, 22 nt, Human
aauucuucuccacuuucuagcc

SEQ ID NO: 1976187 - RNA, 14 nt, Human
aauucuugcaaagu

SEQ ID NO: 1976188 - RNA, 20 nt, Human
aauucuugcaaaguaucccu

SEQ ID NO: 1976189 - RNA, 21 nt, Human
aauucuugccaaauauaaaua

SEQ ID NO: 1976190 - RNA, 16 nt, Human
uacuauguaucaauga

SEQ ID NO: 1976191 - RNA, 21 nt, Human
uacuauaacauagaauugcaa

SEQ ID NO: 1976192 - RNA, 16 nt, Human
uacuauaauuuaccug

SEQ ID NO: 1976193 - RNA, 14 nt, Human
uacgugugcaugug

SEQ ID NO: 1976194 - RNA, 13 nt, Human
uacguugugcauu

SEQ ID NO: 1976195 - RNA, 14 nt, Human
uacguugugcauuu

SEQ ID NO: 1976196 - RNA, 12 nt, Human
uacguaguucua

SEQ ID NO: 1976197 - RNA, 14 nt, Human
uacgucugacaggc

SEQ ID NO: 1976198 - RNA, 14 nt, Human
uacguuaccaggca

SEQ ID NO: 1976199 - RNA, 13 nt, Human
uacucuucucucu

SEQ ID NO: 1976200 - RNA, 16 nt, Human
uacucuucucucugcu

SEQ ID NO: 1976201 - RNA, 17 nt, Human
uacucuucucucugcuc

SEQ ID NO: 1976202 - RNA, 18 nt, Human
uacucuucucucugcucu

SEQ ID NO: 1976203 - RNA, 22 nt, Human
uacucuuauaucuauauuuuac

SEQ ID NO: 1976204 - RNA, 22 nt, Human
uacucuucaguuaagccuuugg

SEQ ID NO: 1976205 - RNA, 20 nt, Human
uacucuuauaucuauauuuu

SEQ ID NO: 1976206 - RNA, 18 nt, Human
uacucuuauagacaacau

SEQ ID NO: 1976207 - RNA, 14 nt, Human
uacucacagccagc

SEQ ID NO: 1976208 - RNA, 21 nt, Human
uacucugugucagguggggca

SEQ ID NO: 1976209 - RNA, 19 nt, Human
uacucuucucucugcucug

SEQ ID NO: 1976210 - RNA, 14 nt, Human
uacucuugggacau

SEQ ID NO: 1976211 - RNA, 16 nt, Human
uacugaaccacuugua

SEQ ID NO: 1976212 - RNA, 17 nt, Human
uacugaaccacuuguag

SEQ ID NO: 1976213 - RNA, 19 nt, Human
uacugaaccacuuguagau

SEQ ID NO: 1976214 - RNA, 22 nt, Human
uacugaaccacuuguagauuug

SEQ ID NO: 1976215 - RNA, 23 nt, Human
uacugaaccacuuguagauuuga

SEQ ID NO: 1976216 - RNA, 20 nt, Human
uacuguaaaaugcaaaaaau

SEQ ID NO: 1976217 - RNA, 17 nt, Human
uagaagucuuagaugua

SEQ ID NO: 1976218 - RNA, 16 nt, Human
uagaagucuuagaugu

SEQ ID NO: 1976219 - RNA, 23 nt, Human
uagaagucacauuccugaacagg

SEQ ID NO: 1976220 - RNA, 16 nt, Human
uagaagucacacagua

SEQ ID NO: 1976221 - RNA, 19 nt, Human
uagaagucuuagauguaua

SEQ ID NO: 1976222 - RNA, 18 nt, Human
uagaagucuuagauguau

SEQ ID NO: 1976223 - RNA, 20 nt, Human
uagaagucuuagauguauau

SEQ ID NO: 1976224 - RNA, 19 nt, Human
uagaauugaagguuuuuga

SEQ ID NO: 1976225 - RNA, 17 nt, Human
uagaauugcaaucuaua

SEQ ID NO: 1976226 - RNA, 20 nt, Human
uagaauugaagguuuuugau

SEQ ID NO: 1976227 - RNA, 21 nt, Human
uagaauugaagguuuuugaua

SEQ ID NO: 1976228 - RNA, 23 nt, Human
uagaauugaagguuuuugauagc

SEQ ID NO: 1976229 - RNA, 18 nt, Human
uagaauugcaaucuauaa

SEQ ID NO: 1976230 - RNA, 20 nt, Human
uagaauugcaaucuauaaua

SEQ ID NO: 1976231 - RNA, 18 nt, Human
uagacaauauaagagcuu

SEQ ID NO: 1976232 - RNA, 16 nt, Human
uagacaauuuauuaug

SEQ ID NO: 1976233 - RNA, 14 nt, Human
uagacagcaugaga

SEQ ID NO: 1976234 - RNA, 22 nt, Human
uagacaggaaaagcaugucuua

SEQ ID NO: 1976235 - RNA, 15 nt, Human
uagaacucccuuuca

SEQ ID NO: 1976236 - RNA, 23 nt, Human
uagaacgccagggaccccagaau

SEQ ID NO: 1976237 - RNA, 17 nt, Human
uacuucaaaaguuuguu

SEQ ID NO: 1976238 - RNA, 22 nt, Human
uacuucaaaaguuuguuugcuu

SEQ ID NO: 1976239 - RNA, 15 nt, Human
uagaagucacacagu

SEQ ID NO: 1976240 - RNA, 18 nt, Human
aauuuuuauuaaauuaug

SEQ ID NO: 1976241 - RNA, 17 nt, Human
aauuuuuauuaaauuau

SEQ ID NO: 1976242 - RNA, 13 nt, Human
aauuuuuaugugu

SEQ ID NO: 1976243 - RNA, 14 nt, Human
aauuuuuaugugug

SEQ ID NO: 1976244 - RNA, 20 nt, Human
aauuuuaagccuuuguugaa

SEQ ID NO: 1976245 - RNA, 23 nt, Human
aauuuuaagccuuuguugaacug

SEQ ID NO: 1976246 - RNA, 18 nt, Human
aauuuuaagcuaggaaaa

SEQ ID NO: 1976247 - RNA, 23 nt, Human
aauuuuaagcuaggaaaagaaau

SEQ ID NO: 1976248 - RNA, 14 nt, Human
uagacagucccugc

SEQ ID NO: 1976249 - RNA, 12 nt, Human
uagacagucccu

SEQ ID NO: 1976250 - RNA, 15 nt, Human
uagacaggagaagaa

SEQ ID NO: 1976251 - RNA, 18 nt, Human
uagacaggagaagaaaga

SEQ ID NO: 1976252 - RNA, 19 nt, Human
uagacaggagaagaaagaa

SEQ ID NO: 1976253 - RNA, 17 nt, Human
aauuuguaccauuucag

SEQ ID NO: 1976254 - RNA, 21 nt, Human
aauuuuuuaagugaaaauaua

SEQ ID NO: 1976255 - RNA, 14 nt, Human
aauuuuuguauuuu

SEQ ID NO: 1976256 - RNA, 14 nt, Human
aauuuuucuguaua

SEQ ID NO: 1976257 - RNA, 18 nt, Human
aauuuuucuguauagaca

SEQ ID NO: 1976258 - RNA, 12 nt, Human
aauuuuucugua

SEQ ID NO: 1976259 - RNA, 13 nt, Human
aauuuuucuguau

SEQ ID NO: 1976260 - RNA, 13 nt, Human
aauuuuucauauu

SEQ ID NO: 1976261 - RNA, 14 nt, Human
aauuuuucauauuu

SEQ ID NO: 1976262 - RNA, 13 nt, Human
acaaaaacauggc

SEQ ID NO: 1976263 - RNA, 17 nt, Human
aauuuuuuugagacaga

SEQ ID NO: 1976264 - RNA, 14 nt, Human
aauuuuuuuguaug

SEQ ID NO: 1976265 - RNA, 15 nt, Human
aauuuuuuuguauga

SEQ ID NO: 1976266 - RNA, 15 nt, Human
acaagacaacauugu

SEQ ID NO: 1976267 - RNA, 18 nt, Human
acaagagcccaggccucc

SEQ ID NO: 1976268 - RNA, 17 nt, Human
acaagagcccaggccuc

SEQ ID NO: 1976269 - RNA, 18 nt, Human
acaagcacuaaacaaaga

SEQ ID NO: 1976270 - RNA, 17 nt, Human
acaagacaacauuguaa

SEQ ID NO: 1976271 - RNA, 17 nt, Human
acaagcauauaaaaugg

SEQ ID NO: 1976272 - RNA, 19 nt, Human
acaagcauauaaaauggca

SEQ ID NO: 1976273 - RNA, 15 nt, Human
acaagcauauaaaau

SEQ ID NO: 1976274 - RNA, 20 nt, Human
acaagcgugagccacugcac

SEQ ID NO: 1976275 - RNA, 21 nt, Human
acaagcgugagccacugcacc

SEQ ID NO: 1976276 - RNA, 13 nt, Human
acaagcugcaccc

SEQ ID NO: 1976277 - RNA, 12 nt, Human
acaagccacccc

SEQ ID NO: 1976278 - RNA, 18 nt, Human
acaagccacgaaugaaug

SEQ ID NO: 1976279 - RNA, 15 nt, Human
acaaauuauaaugua

SEQ ID NO: 1976280 - RNA, 16 nt, Human
acaaauuauaauguau

SEQ ID NO: 1976281 - RNA, 17 nt, Human
acaaauuauaauguauu

SEQ ID NO: 1976282 - RNA, 20 nt, Human
acaaauuauaauguauucau

SEQ ID NO: 1976283 - RNA, 18 nt, Human
acaaauuaugcuaagaau

SEQ ID NO: 1976284 - RNA, 21 nt, Human
acaaauuaugcuaagaauuuu

SEQ ID NO: 1976285 - RNA, 15 nt, Human
uagcauuuggugcuu

SEQ ID NO: 1976286 - RNA, 13 nt, Human
acaaauguuucua

SEQ ID NO: 1976287 - RNA, 19 nt, Human
uagcauuuguguugaagag

SEQ ID NO: 1976288 - RNA, 22 nt, Human
uagcauugucuauuuuucucuu

SEQ ID NO: 1976289 - RNA, 15 nt, Human
uagcauuuaugguaa

SEQ ID NO: 1976290 - RNA, 22 nt, Human
uagcauuuaugguaaucauauu

SEQ ID NO: 1976291 - RNA, 18 nt, Human
uagcauuguaaaagcauu

SEQ ID NO: 1976292 - RNA, 19 nt, Human
uagcauuguaaaagcauuu

SEQ ID NO: 1976293 - RNA, 22 nt, Human
uagcauuguaagcguauggcuu

SEQ ID NO: 1976294 - RNA, 15 nt, Human
acaacaacaaaauga

SEQ ID NO: 1976295 - RNA, 18 nt, Human
acaaauucugucucugga

SEQ ID NO: 1976296 - RNA, 15 nt, Human
acaacaaccugguca

SEQ ID NO: 1976297 - RNA, 12 nt, Human
acaacacucaca

SEQ ID NO: 1976298 - RNA, 22 nt, Human
acaagaaaugaaagcagggacu

SEQ ID NO: 1976299 - RNA, 19 nt, Human
acaacaccaaaaaauaucu

SEQ ID NO: 1976300 - RNA, 23 nt, Human
acaagaaugaagguuuuuguaaa

SEQ ID NO: 1976301 - RNA, 15 nt, Human
acaagaaugaagguu

SEQ ID NO: 1976302 - RNA, 17 nt, Human
acaagaauaaaggcagc

SEQ ID NO: 1976303 - RNA, 18 nt, Human
acaagaauaaaggcagcu

SEQ ID NO: 1976304 - RNA, 16 nt, Human
acaaaaagcauaaaaa

SEQ ID NO: 1976305 - RNA, 12 nt, Human
uagagcagaaau

SEQ ID NO: 1976306 - RNA, 20 nt, Human
acaaaaagauaccuuaaaau

SEQ ID NO: 1976307 - RNA, 13 nt, Human
uagagcagaaauu

SEQ ID NO: 1976308 - RNA, 14 nt, Human
uagagcagaaauuc

SEQ ID NO: 1976309 - RNA, 15 nt, Human
uagagcagaaauucu

SEQ ID NO: 1976310 - RNA, 15 nt, Human
uagagcuucuggcac

SEQ ID NO: 1976311 - RNA, 22 nt, Human
uagaucaacucauguuaauuga

SEQ ID NO: 1976312 - RNA, 13 nt, Human
uagaucauaguuu

SEQ ID NO: 1976313 - RNA, 19 nt, Human
uagcacagacccugcccug

SEQ ID NO: 1976314 - RNA, 18 nt, Human
uagcacagacccugcccu

SEQ ID NO: 1976315 - RNA, 17 nt, Human
uagcacagacccugccc

SEQ ID NO: 1976316 - RNA, 16 nt, Human
uagcacagacccugcc

SEQ ID NO: 1976317 - RNA, 22 nt, Human
uagauuuuagacccuauugcug

SEQ ID NO: 1976318 - RNA, 17 nt, Human
uagaucauaguuuuauu

SEQ ID NO: 1976319 - RNA, 19 nt, Human
uagaucauaguuuuauuua

SEQ ID NO: 1976320 - RNA, 21 nt, Human
uagcaugucgucaaagcugaa

SEQ ID NO: 1976321 - RNA, 18 nt, Human
uagcaugucgucaaagcu

SEQ ID NO: 1976322 - RNA, 16 nt, Human
uagcaccagggaaggg

SEQ ID NO: 1976323 - RNA, 13 nt, Human
uagcaccagggaa

SEQ ID NO: 1976324 - RNA, 14 nt, Human
uagcaccagggaag

SEQ ID NO: 1976325 - RNA, 13 nt, Human
uagcacagcuccc

SEQ ID NO: 1976326 - RNA, 14 nt, Human
uagcacagcucccu

SEQ ID NO: 1976327 - RNA, 12 nt, Human
uagcacaggcug

SEQ ID NO: 1976328 - RNA, 13 nt, Human
uagcacaggcuga

SEQ ID NO: 1976329 - RNA, 15 nt, Human
uagcacaggcugagu

SEQ ID NO: 1976330 - RNA, 19 nt, Human
uagcacaggcugagugcag

SEQ ID NO: 1976331 - RNA, 20 nt, Human
uagcacaggcugagugcagg

SEQ ID NO: 1976332 - RNA, 21 nt, Human
uagcacaggcugagugcaggc

SEQ ID NO: 1976333 - RNA, 20 nt, Human
uagcacagcguuaugugucu

SEQ ID NO: 1976334 - RNA, 12 nt, Human
uagcacagcucc

SEQ ID NO: 1976335 - RNA, 15 nt, Human
uagauuuuguguuua

SEQ ID NO: 1976336 - RNA, 21 nt, Human
uagauuuuguguuuauucuug

SEQ ID NO: 1976337 - RNA, 22 nt, Human
uagauuuuguguuuauucuuga

SEQ ID NO: 1976338 - RNA, 23 nt, Human
uagauuuuguguuuauucuugau

SEQ ID NO: 1976339 - RNA, 22 nt, Human
uaauacaccacuacauucuguu

SEQ ID NO: 1976340 - RNA, 21 nt, Human
uaauacaccacuacauucugu

SEQ ID NO: 1976341 - RNA, 23 nt, Human
uaauacaccacuacauucuguua

SEQ ID NO: 1976342 - RNA, 21 nt, Human
aauacauaugauaaauuugac

SEQ ID NO: 1976343 - RNA, 20 nt, Human
aauacaguaucucagggccu

SEQ ID NO: 1976344 - RNA, 18 nt, Human
uaauacuugcuuuggaaa

SEQ ID NO: 1976345 - RNA, 13 nt, Human
uaauacuguuauu

SEQ ID NO: 1976346 - RNA, 15 nt, Human
uaauacuguuauucu

SEQ ID NO: 1976347 - RNA, 16 nt, Human
uaauacuguuauucuu

SEQ ID NO: 1976348 - RNA, 17 nt, Human
uaauacuguuauucuuu

SEQ ID NO: 1976349 - RNA, 20 nt, Human
uaauacuguuauucuuugca

SEQ ID NO: 1976350 - RNA, 22 nt, Human
uaauacuguuauucuuugcacu

SEQ ID NO: 1976351 - RNA, 13 nt, Human
uaauaccucccuu

SEQ ID NO: 1976352 - RNA, 22 nt, Human
uaauacaggauuauuuugauua

SEQ ID NO: 1976353 - RNA, 22 nt, Human
uaauccaagcaaaugugaauca

SEQ ID NO: 1976354 - RNA, 12 nt, Human
uaaucauuuuuu

SEQ ID NO: 1976355 - RNA, 17 nt, Human
uaaucuuuaauuuuaca

SEQ ID NO: 1976356 - RNA, 21 nt, Human
uaauauugauaugcuuauaca

SEQ ID NO: 1976357 - RNA, 20 nt, Human
uaaucagggaccaccagagg

SEQ ID NO: 1976358 - RNA, 17 nt, Human
uaauguaagcucuacug

SEQ ID NO: 1976359 - RNA, 16 nt, Human
uaauguaagcucuacu

SEQ ID NO: 1976360 - RNA, 15 nt, Human
uaauguaagacaaau

SEQ ID NO: 1976361 - RNA, 19 nt, Human
uaaucuugugaaaauaauu

SEQ ID NO: 1976362 - RNA, 16 nt, Human
uaaucuugugaaaaua

SEQ ID NO: 1976363 - RNA, 12 nt, Human
uaaugugaaacu

SEQ ID NO: 1976364 - RNA, 20 nt, Human
uaaugugaaacuggauuaaa

SEQ ID NO: 1976365 - RNA, 22 nt, Human
uaaugugaaacuggauuaaacu

SEQ ID NO: 1976366 - RNA, 23 nt, Human
uaaugugaaacuggauuaaacuu

SEQ ID NO: 1976367 - RNA, 16 nt, Human
uaaugucacaggcagg

SEQ ID NO: 1976368 - RNA, 17 nt, Human
uaaugucacaggcaggu

SEQ ID NO: 1976369 - RNA, 15 nt, Human
uaaugucacaggcag

SEQ ID NO: 1976370 - RNA, 13 nt, Human
uaauguggcuucu

SEQ ID NO: 1976371 - RNA, 13 nt, Human
aaucuugaaaaug

SEQ ID NO: 1976372 - RNA, 23 nt, Human
aaucuucugaacuuggcgcugcc

SEQ ID NO: 1976373 - RNA, 15 nt, Human
aaugaaugaaugaau

SEQ ID NO: 1976374 - RNA, 14 nt, Human
aaugaaugaaacau

SEQ ID NO: 1976375 - RNA, 14 nt, Human
aaugaaugucagug

SEQ ID NO: 1976376 - RNA, 15 nt, Human
aaugaaugucagugu

SEQ ID NO: 1976377 - RNA, 23 nt, Human
aaucuuuuccaggaaaaagaacu

SEQ ID NO: 1976378 - RNA, 14 nt, Human
aaucuuuucugaau

SEQ ID NO: 1976379 - RNA, 22 nt, Human
aaucuuuucugaaucuucugaa

SEQ ID NO: 1976380 - RNA, 20 nt, Human
uaauuugaagguagaauguu

SEQ ID NO: 1976381 - RNA, 21 nt, Human
uaauuuuuguauuuuuaguag

SEQ ID NO: 1976382 - RNA, 18 nt, Human
uaauuuaccugaagucuu

SEQ ID NO: 1976383 - RNA, 17 nt, Human
uaauuuaccugaagucu

SEQ ID NO: 1976384 - RNA, 20 nt, Human
uaauuuaaguuuugacaagc

SEQ ID NO: 1976385 - RNA, 17 nt, Human
uaauuuccuuaaagcaa

SEQ ID NO: 1976386 - RNA, 14 nt, Human
uaauuuaaguuuug

SEQ ID NO: 1976387 - RNA, 15 nt, Human
uaauuuaaguuuuga

SEQ ID NO: 1976388 - RNA, 13 nt, Human
uaauucauguugc

SEQ ID NO: 1976389 - RNA, 16 nt, Human
uacaaaaacauggccu

SEQ ID NO: 1976390 - RNA, 16 nt, Human
uacaagcgugagccac

SEQ ID NO: 1976391 - RNA, 18 nt, Human
uacaagcgugagccacug

SEQ ID NO: 1976392 - RNA, 19 nt, Human
uacaagcgugagccacugc

SEQ ID NO: 1976393 - RNA, 20 nt, Human
uacaagcgugagccacugca

SEQ ID NO: 1976394 - RNA, 21 nt, Human
uacaagcgugagccacugcac

SEQ ID NO: 1976395 - RNA, 20 nt, Human
uacaauaaaaucuugaaaau

SEQ ID NO: 1976396 - RNA, 16 nt, Human
aaugcaaaccaucauu

SEQ ID NO: 1976397 - RNA, 15 nt, Human
aaugaccuuucaaua

SEQ ID NO: 1976398 - RNA, 14 nt, Human
aaugaccuuucaau

SEQ ID NO: 1976399 - RNA, 13 nt, Human
aaugaccuuucaa

SEQ ID NO: 1976400 - RNA, 13 nt, Human
aaugaccuuguaa

SEQ ID NO: 1976401 - RNA, 14 nt, Human
aaugaccuuguaau

SEQ ID NO: 1976402 - RNA, 16 nt, Human
aaugaccuuguaaugu

SEQ ID NO: 1976403 - RNA, 18 nt, Human
aaugaccuuguaauguaa

SEQ ID NO: 1976404 - RNA, 21 nt, Human
aaugaaugucagugugacuga

SEQ ID NO: 1976405 - RNA, 20 nt, Human
aaugaaugucagugugacug

SEQ ID NO: 1976406 - RNA, 23 nt, Human
aaugcaaaccaucauugaaaucu

SEQ ID NO: 1976407 - RNA, 22 nt, Human
aaugcaaaccaucauugaaauc

SEQ ID NO: 1976408 - RNA, 19 nt, Human
aaugaccuuguaauguaac

SEQ ID NO: 1976409 - RNA, 20 nt, Human
aaugaccuuguaauguaacu

SEQ ID NO: 1976410 - RNA, 21 nt, Human
aaugaccuuguaauguaacug

SEQ ID NO: 1976411 - RNA, 22 nt, Human
aaugaccuuguaauguaacugc

SEQ ID NO: 1976412 - RNA, 13 nt, Human
aaugcaaccauuu

SEQ ID NO: 1976413 - RNA, 17 nt, Human
aaugcaaccauuugaaa

SEQ ID NO: 1976414 - RNA, 18 nt, Human
aaugcaaccauuugaaac

SEQ ID NO: 1976415 - RNA, 18 nt, Human
aaugcacaaacagaggcc

SEQ ID NO: 1976416 - RNA, 16 nt, Human
aaugcacuuuguucug

SEQ ID NO: 1976417 - RNA, 13 nt, Human
aaugcacuuuguu

SEQ ID NO: 1976418 - RNA, 20 nt, Human
aaugcacaaacagaggccgc

SEQ ID NO: 1976419 - RNA, 19 nt, Human
aaugcacaaacagaggccg

SEQ ID NO: 1976420 - RNA, 20 nt, Human
aaugcacuuuguucuggcuc

SEQ ID NO: 1976421 - RNA, 19 nt, Human
aaugcacuuuguucuggcu

SEQ ID NO: 1976422 - RNA, 23 nt, Human
uaauuaguuccucauuagcauuu

SEQ ID NO: 1976423 - RNA, 20 nt, Human
uaauuauacccccugcaaag

SEQ ID NO: 1976424 - RNA, 15 nt, Human
aaugcaauaugugaa

SEQ ID NO: 1976425 - RNA, 20 nt, Human
aauguaggggaaaguuucau

SEQ ID NO: 1976426 - RNA, 12 nt, Human
aauguagagggg

SEQ ID NO: 1976427 - RNA, 15 nt, Human
aauguaugcuucaua

SEQ ID NO: 1976428 - RNA, 16 nt, Human
aauguaugcuucauac

SEQ ID NO: 1976429 - RNA, 17 nt, Human
aauguaugcuucauaca

SEQ ID NO: 1976430 - RNA, 15 nt, Human
aauguaguuugagga

SEQ ID NO: 1976431 - RNA, 22 nt, Human
aaugugaaacuggauuaaacuu

SEQ ID NO: 1976432 - RNA, 14 nt, Human
aaugucacaggcag

SEQ ID NO: 1976433 - RNA, 13 nt, Human
aaugucacaggca

SEQ ID NO: 1976434 - RNA, 18 nt, Human
aaugucaaaaauauuuag

SEQ ID NO: 1976435 - RNA, 14 nt, Human
aaugucaaaaguag

SEQ ID NO: 1976436 - RNA, 15 nt, Human
aaugucaaaaguaga

SEQ ID NO: 1976437 - RNA, 19 nt, Human
aaugucaaaaguagaacuu

SEQ ID NO: 1976438 - RNA, 23 nt, Human
aaugucaaaaguagaacuuugua

SEQ ID NO: 1976439 - RNA, 18 nt, Human
uacaguccucccaucuca

SEQ ID NO: 1976440 - RNA, 17 nt, Human
uacaguccucccaucuc

SEQ ID NO: 1976441 - RNA, 15 nt, Human
uacaguccucccauc

SEQ ID NO: 1976442 - RNA, 12 nt, Human
uacaguccuccc

SEQ ID NO: 1976443 - RNA, 18 nt, Human
uacaguaucucagggccu

SEQ ID NO: 1976444 - RNA, 20 nt, Human
uacaguggggaaugaagaua

SEQ ID NO: 1976445 - RNA, 15 nt, Human
uacauaaugcgugca

SEQ ID NO: 1976446 - RNA, 23 nt, Human
uacauaauacugaaccacuugua

SEQ ID NO: 1976447 - RNA, 20 nt, Human
uacauaauacugaaccacuu

SEQ ID NO: 1976448 - RNA, 16 nt, Human
uacagugccuaaaaua

SEQ ID NO: 1976449 - RNA, 22 nt, Human
aaugguuuucuuguguguuuau

SEQ ID NO: 1976450 - RNA, 18 nt, Human
aaugguuuucuugugugu

SEQ ID NO: 1976451 - RNA, 17 nt, Human
aaugguuuucuugugug

SEQ ID NO: 1976452 - RNA, 15 nt, Human
aauguaagcucuacu

SEQ ID NO: 1976453 - RNA, 13 nt, Human
aauguaagcucua

SEQ ID NO: 1976454 - RNA, 13 nt, Human
aauguaagacaaa

SEQ ID NO: 1976455 - RNA, 23 nt, Human
aauguaaaaaggaauaugaaagu

SEQ ID NO: 1976456 - RNA, 17 nt, Human
uacaauauuugugugcu

SEQ ID NO: 1976457 - RNA, 16 nt, Human
aaugguuuaaaugguc

SEQ ID NO: 1976458 - RNA, 15 nt, Human
uacaauauguacauu

SEQ ID NO: 1976459 - RNA, 16 nt, Human
uacaauauguacauuu

SEQ ID NO: 1976460 - RNA, 21 nt, Human
uacaauauguacauuucuaag

SEQ ID NO: 1976461 - RNA, 22 nt, Human
uacagcaaggagauuuacaacu

SEQ ID NO: 1976462 - RNA, 19 nt, Human
uacagacuggauguaccac

SEQ ID NO: 1976463 - RNA, 15 nt, Human
uacagagaaagaaau

SEQ ID NO: 1976464 - RNA, 16 nt, Human
uacagagaaagaaauu

SEQ ID NO: 1976465 - RNA, 22 nt, Human
uacacgguucaaaccugugaag

SEQ ID NO: 1976466 - RNA, 21 nt, Human
aauguacagcaaggagauuua

SEQ ID NO: 1976467 - RNA, 23 nt, Human
aauguacagcaaggagauuuaca

SEQ ID NO: 1976468 - RNA, 14 nt, Human
aauguacauguauu

SEQ ID NO: 1976469 - RNA, 16 nt, Human
aauguacauguauuaa

SEQ ID NO: 1976470 - RNA, 20 nt, Human
aauguacauguauuaaauua

SEQ ID NO: 1976471 - RNA, 12 nt, Human
aauguugauuuc

SEQ ID NO: 1976472 - RNA, 13 nt, Human
aauguugauuucu

SEQ ID NO: 1976473 - RNA, 14 nt, Human
aauguugauuucua

SEQ ID NO: 1976474 - RNA, 15 nt, Human
aauguugauuucuag

SEQ ID NO: 1976475 - RNA, 16 nt, Human
aauguugauuucuagu

SEQ ID NO: 1976476 - RNA, 22 nt, Human
aauguugauuucuaguuauuua

SEQ ID NO: 1976477 - RNA, 23 nt, Human
aauguugauuucuaguuauuuau

SEQ ID NO: 1976478 - RNA, 17 nt, Human
aauguugauuucuaguu

SEQ ID NO: 1976479 - RNA, 18 nt, Human
aauguugauuucuaguua

SEQ ID NO: 1976480 - RNA, 20 nt, Human
aauguugauuucuaguuauu

SEQ ID NO: 1976481 - RNA, 21 nt, Human
aauguugauuucuaguuauuu

SEQ ID NO: 1976482 - RNA, 16 nt, Human
aauguugaagaacuca

SEQ ID NO: 1976483 - RNA, 23 nt, Human
aauguugaagaacucaugugauu

SEQ ID NO: 1976484 - RNA, 16 nt, Human
aauguugaacaaaaua

SEQ ID NO: 1976485 - RNA, 17 nt, Human
aauguugaacaaaauaa

SEQ ID NO: 1976486 - RNA, 21 nt, Human
aauguugaacaaaauaaauug

SEQ ID NO: 1976487 - RNA, 22 nt, Human
aauguugaacaaaauaaauugg

SEQ ID NO: 1976488 - RNA, 12 nt, Human
aaugugaauuac

SEQ ID NO: 1976489 - RNA, 17 nt, Human
aaugugaauuacuaacu

SEQ ID NO: 1976490 - RNA, 19 nt, Human
aaugugaacagcggcugga

SEQ ID NO: 1976491 - RNA, 15 nt, Human
aaugucaaaugugaa

SEQ ID NO: 1976492 - RNA, 18 nt, Human
aauuaacuuuuauaaacu

SEQ ID NO: 1976493 - RNA, 20 nt, Human
aauuaacuuuuauaaacuuu

SEQ ID NO: 1976494 - RNA, 22 nt, Human
aauuaacuuuuauaaacuuuac

SEQ ID NO: 1976495 - RNA, 15 nt, Human
aauuaagagagucua

SEQ ID NO: 1976496 - RNA, 17 nt, Human
aauuaacacuuaagguu

SEQ ID NO: 1976497 - RNA, 19 nt, Human
aauuaacaugaauauuuag

SEQ ID NO: 1976498 - RNA, 19 nt, Human
uacauuagcaguuugcuuu

SEQ ID NO: 1976499 - RNA, 20 nt, Human
uacauuagcaguuugcuuug

SEQ ID NO: 1976500 - RNA, 19 nt, Human
uacauguuuauguaaacaa

SEQ ID NO: 1976501 - RNA, 21 nt, Human
uacauguuuauguaaacaaau

SEQ ID NO: 1976502 - RNA, 14 nt, Human
uacauguuuaugua

SEQ ID NO: 1976503 - RNA, 15 nt, Human
uacauguuuauguaa

SEQ ID NO: 1976504 - RNA, 18 nt, Human
uacauguuuauguaaaca

SEQ ID NO: 1976505 - RNA, 23 nt, Human
uacauggcuggagcuagaauuug

SEQ ID NO: 1976506 - RNA, 20 nt, Human
aauuaagguguuugaaaaua

SEQ ID NO: 1976507 - RNA, 13 nt, Human
uacaugggacuau

SEQ ID NO: 1976508 - RNA, 18 nt, Human
uacaugggacuaugcuuu

SEQ ID NO: 1976509 - RNA, 19 nt, Human
uacaugggacuaugcuuuu

SEQ ID NO: 1976510 - RNA, 17 nt, Human
uacauguacugauuacu

SEQ ID NO: 1976511 - RNA, 19 nt, Human
uacauguaucaagccuaga

SEQ ID NO: 1976512 - RNA, 17 nt, Human
uacauguauuaaauuac

SEQ ID NO: 1976513 - RNA, 18 nt, Human
uacauguauuaaauuaca

SEQ ID NO: 1976514 - RNA, 19 nt, Human
uacauguauuaaauuacau

SEQ ID NO: 1976515 - RNA, 20 nt, Human
uacauguauuaaauuacauu

SEQ ID NO: 1976516 - RNA, 23 nt, Human
uacauguauuaaauuacauuugu

SEQ ID NO: 1976517 - RNA, 13 nt, Human
aauuaaguacuau

SEQ ID NO: 1976518 - RNA, 13 nt, Human
aauuaagguguuu

SEQ ID NO: 1976519 - RNA, 15 nt, Human
aauuaagguguuuga

SEQ ID NO: 1976520 - RNA, 16 nt, Human
aauuaagguguuugaa

SEQ ID NO: 1976521 - RNA, 17 nt, Human
aauuaagguguuugaaa

SEQ ID NO: 1976522 - RNA, 18 nt, Human
aauuaagguguuugaaaa

SEQ ID NO: 1976523 - RNA, 15 nt, Human
uacauuuaaaacauu

SEQ ID NO: 1976524 - RNA, 16 nt, Human
uacauuuaaaacauua

SEQ ID NO: 1976525 - RNA, 19 nt, Human
uacauuuaaaacauuaaaa

SEQ ID NO: 1976526 - RNA, 20 nt, Human
uacauuuaaaacauuaaaau

SEQ ID NO: 1976527 - RNA, 17 nt, Human
uaccacuuuuguucuug

SEQ ID NO: 1976528 - RNA, 19 nt, Human
uaccacugaaucuguacag

SEQ ID NO: 1976529 - RNA, 20 nt, Human
uaccacugaaucuguacaga

SEQ ID NO: 1976530 - RNA, 11 nt, Human
uaccacugaau

SEQ ID NO: 1976531 - RNA, 15 nt, Human
uaccacugaaucugu

SEQ ID NO: 1976532 - RNA, 16 nt, Human
uaccacugaaucugua

SEQ ID NO: 1976533 - RNA, 18 nt, Human
uaccacugaaucuguaca

SEQ ID NO: 1976534 - RNA, 15 nt, Human
uaccacuuuagauga

SEQ ID NO: 1976535 - RNA, 19 nt, Human
uaccccaagcgcccuggcc

SEQ ID NO: 1976536 - RNA, 17 nt, Human
uaccauccccuguagag

SEQ ID NO: 1976537 - RNA, 16 nt, Human
uaccccauggaccaug

SEQ ID NO: 1976538 - RNA, 22 nt, Human
uacccuggcacuauaauguaag

SEQ ID NO: 1976539 - RNA, 20 nt, Human
uacccuggcacuauaaugua

SEQ ID NO: 1976540 - RNA, 16 nt, Human
uacccucauguucuua

SEQ ID NO: 1976541 - RNA, 15 nt, Human
uacccucauguucuu

SEQ ID NO: 1976542 - RNA, 23 nt, Human
uaccccucccggcccugccugcu

SEQ ID NO: 1976543 - RNA, 20 nt, Human
uacccgggaagggggcuggg

SEQ ID NO: 1976544 - RNA, 21 nt, Human
uaccccucccggcccugccug

SEQ ID NO: 1976545 - RNA, 22 nt, Human
uaccccucccggcccugccugc

SEQ ID NO: 1976546 - RNA, 16 nt, Human
guucugugacuaggaa

SEQ ID NO: 1976547 - RNA, 12 nt, Human
guucucugcccu

SEQ ID NO: 1976548 - RNA, 15 nt, Human
guucuguauuugaaa

SEQ ID NO: 1976549 - RNA, 20 nt, Human
guucuguauuugaaagugcc

SEQ ID NO: 1976550 - RNA, 20 nt, Human
guucuccagucauuauguua

SEQ ID NO: 1976551 - RNA, 18 nt, Human
guucuccagucauuaugu

SEQ ID NO: 1976552 - RNA, 11 nt, Human
guucucugccc

SEQ ID NO: 1976553 - RNA, 16 nt, Human
guucucugaggacacu

SEQ ID NO: 1976554 - RNA, 18 nt, Human
guuccccuguucacucua

SEQ ID NO: 1976555 - RNA, 24 nt, Human
guuccccuggaagcagugcccagg

SEQ ID NO: 1976556 - RNA, 13 nt, Human
guucuguuacaaa

SEQ ID NO: 1976557 - RNA, 14 nt, Human
guucuguuacaaaa

SEQ ID NO: 1976558 - RNA, 18 nt, Human
guucuguuacaaaaugua

SEQ ID NO: 1976559 - RNA, 19 nt, Human
guucuguuacaaaauguaa

SEQ ID NO: 1976560 - RNA, 20 nt, Human
guucuguuacaaaauguaac

SEQ ID NO: 1976561 - RNA, 13 nt, Human
guugaauuuuaca

SEQ ID NO: 1976562 - RNA, 21 nt, Human
guucuguuacaaaauguaacu

SEQ ID NO: 1976563 - RNA, 22 nt, Human
guucuguuacaaaauguaacug

SEQ ID NO: 1976564 - RNA, 22 nt, Human
guugauagcacagacccugccc

SEQ ID NO: 1976565 - RNA, 12 nt, Human
guugagcuauga

SEQ ID NO: 1976566 - RNA, 15 nt, Human
guugagcuaugacuu

SEQ ID NO: 1976567 - RNA, 16 nt, Human
guugagcuaugacuua

SEQ ID NO: 1976568 - RNA, 23 nt, Human
guugauagcacagacccugcccu

SEQ ID NO: 1976569 - RNA, 14 nt, Human
guugagaggacacu

SEQ ID NO: 1976570 - RNA, 19 nt, Human
guugacaucacuggcaugg

SEQ ID NO: 1976571 - RNA, 18 nt, Human
guugagaggacacucccg

SEQ ID NO: 1976572 - RNA, 22 nt, Human
aagcucccaggcauuccccagg

SEQ ID NO: 1976573 - RNA, 12 nt, Human
aagcucccaggc

SEQ ID NO: 1976574 - RNA, 23 nt, Human
aagcucccaggcauuccccagga

SEQ ID NO: 1976575 - RNA, 13 nt, Human
guguuuauuguca

SEQ ID NO: 1976576 - RNA, 15 nt, Human
guguuuauucuugau

SEQ ID NO: 1976577 - RNA, 11 nt, Human
aagcucccagg

SEQ ID NO: 1976578 - RNA, 16 nt, Human
aagcuccaucuuauuu

SEQ ID NO: 1976579 - RNA, 12 nt, Human
guguuuaugugu

SEQ ID NO: 1976580 - RNA, 18 nt, Human
guguuuauaucuccuuug

SEQ ID NO: 1976581 - RNA, 17 nt, Human
guguuuaucagaaaggg

SEQ ID NO: 1976582 - RNA, 16 nt, Human
guguuuaugugugugu

SEQ ID NO: 1976583 - RNA, 14 nt, Human
guguuuauucuuga

SEQ ID NO: 1976584 - RNA, 22 nt, Human
guguuuaagacauuuuuggaag

SEQ ID NO: 1976585 - RNA, 12 nt, Human
guguuuaacuga

SEQ ID NO: 1976586 - RNA, 15 nt, Human
guguuuagaauugaa

SEQ ID NO: 1976587 - RNA, 14 nt, Human
guguuuacagagau

SEQ ID NO: 1976588 - RNA, 18 nt, Human
guguuuagaauugaaggu

SEQ ID NO: 1976589 - RNA, 20 nt, Human
aagcuuuguugaaagaaagu

SEQ ID NO: 1976590 - RNA, 16 nt, Human
aagcuuuguuuguucu

SEQ ID NO: 1976591 - RNA, 17 nt, Human
aagcuguuugguuuuaa

SEQ ID NO: 1976592 - RNA, 18 nt, Human
aagcuguuacugucuuca

SEQ ID NO: 1976593 - RNA, 13 nt, Human
aagcucugcuccu

SEQ ID NO: 1976594 - RNA, 14 nt, Human
aagcuguucuuccu

SEQ ID NO: 1976595 - RNA, 15 nt, Human
aagcuguucuuccug

SEQ ID NO: 1976596 - RNA, 16 nt, Human
aagcuguucuuccugg

SEQ ID NO: 1976597 - RNA, 18 nt, Human
aagcuguugaccaggcac

SEQ ID NO: 1976598 - RNA, 19 nt, Human
aagcuguuggccucugcaa

SEQ ID NO: 1976599 - RNA, 16 nt, Human
aagcuuuuaugugaaa

SEQ ID NO: 1976600 - RNA, 12 nt, Human
guuccccuggaa

SEQ ID NO: 1976601 - RNA, 21 nt, Human
guuccccuggaagcagugccc

SEQ ID NO: 1976602 - RNA, 15 nt, Human
guuccccuguucacu

SEQ ID NO: 1976603 - RNA, 17 nt, Human
guuccccuguucacucu

SEQ ID NO: 1976604 - RNA, 16 nt, Human
aaggaaaaaauaacaa

SEQ ID NO: 1976605 - RNA, 19 nt, Human
aaggaaaaaauaacaauga

SEQ ID NO: 1976606 - RNA, 22 nt, Human
aaggauccugagccagauuuca

SEQ ID NO: 1976607 - RNA, 20 nt, Human
aaggauccugagccagauuu

SEQ ID NO: 1976608 - RNA, 12 nt, Human
aaggauccugag

SEQ ID NO: 1976609 - RNA, 11 nt, Human
aaggauccuga

SEQ ID NO: 1976610 - RNA, 11 nt, Human
aaggauaaagu

SEQ ID NO: 1976611 - RNA, 20 nt, Human
aaggaggaagagaaaaaaua

SEQ ID NO: 1976612 - RNA, 21 nt, Human
aaggauaaaguugguaaaccu

SEQ ID NO: 1976613 - RNA, 23 nt, Human
aaggauaaaguugguaaaccuuu

SEQ ID NO: 1976614 - RNA, 13 nt, Human
aaggauaaugaau

SEQ ID NO: 1976615 - RNA, 15 nt, Human
aaggaaacccagcuc

SEQ ID NO: 1976616 - RNA, 16 nt, Human
aaggaaacccagcucu

SEQ ID NO: 1976617 - RNA, 16 nt, Human
aaggaagguaaaaagu

SEQ ID NO: 1976618 - RNA, 18 nt, Human
aaggaagguaaaaaguua

SEQ ID NO: 1976619 - RNA, 17 nt, Human
aaggaagguaguucaag

SEQ ID NO: 1976620 - RNA, 18 nt, Human
aaggagauuuacaacugg

SEQ ID NO: 1976621 - RNA, 22 nt, Human
aaggagcaagucagaauagaaa

SEQ ID NO: 1976622 - RNA, 17 nt, Human
aaggagauuuacaacug

SEQ ID NO: 1976623 - RNA, 14 nt, Human
aaggagacuguguu

SEQ ID NO: 1976624 - RNA, 18 nt, Human
aaggagaaucauguuucu

SEQ ID NO: 1976625 - RNA, 19 nt, Human
aaggagaaucauguuucuu

SEQ ID NO: 1976626 - RNA, 20 nt, Human
aaggagaaucauguuucuuu

SEQ ID NO: 1976627 - RNA, 22 nt, Human
aaggagaaucauguuucuuuga

SEQ ID NO: 1976628 - RNA, 19 nt, Human
aaggaugcccaaagaugca

SEQ ID NO: 1976629 - RNA, 22 nt, Human
aaggaugccaagaaguuuaagg

SEQ ID NO: 1976630 - RNA, 14 nt, Human
aaggaugcccaaag

SEQ ID NO: 1976631 - RNA, 24 nt, Human
aaggaugcacagaguuguuacauu

SEQ ID NO: 1976632 - RNA, 20 nt, Human
aaggaugccaagaaguuuaa

SEQ ID NO: 1976633 - RNA, 22 nt, Human
aaggaugcacagaguuguuaca

SEQ ID NO: 1976634 - RNA, 16 nt, Human
aaggccccgcccaggc

SEQ ID NO: 1976635 - RNA, 14 nt, Human
aaggccccgcccag

SEQ ID NO: 1976636 - RNA, 19 nt, Human
aaggcccccugccugcccu

SEQ ID NO: 1976637 - RNA, 14 nt, Human
aaggcccccugccu

SEQ ID NO: 1976638 - RNA, 15 nt, Human
aaggcccccugccug

SEQ ID NO: 1976639 - RNA, 19 nt, Human
aaggccccgcccaggcuua

SEQ ID NO: 1976640 - RNA, 13 nt, Human
aaggcuaccuuug

SEQ ID NO: 1976641 - RNA, 18 nt, Human
aaggcgcuaacuugcuua

SEQ ID NO: 1976642 - RNA, 22 nt, Human
aaggcgcuaacuugcuuaaaug

SEQ ID NO: 1976643 - RNA, 23 nt, Human
aaggcgcuaacuugcuuaaaugu

SEQ ID NO: 1976644 - RNA, 15 nt, Human
aaggcuaccuuugua

SEQ ID NO: 1976645 - RNA, 14 nt, Human
guugcccaggcugg

SEQ ID NO: 1976646 - RNA, 21 nt, Human
guugggggaggggagacuuug

SEQ ID NO: 1976647 - RNA, 22 nt, Human
guugguuccaagucuuugcuau

SEQ ID NO: 1976648 - RNA, 14 nt, Human
guugggagaauguc

SEQ ID NO: 1976649 - RNA, 21 nt, Human
guugggagaaugucaguaugu

SEQ ID NO: 1976650 - RNA, 17 nt, Human
guugggcuggugucacc

SEQ ID NO: 1976651 - RNA, 23 nt, Human
guugggacccaguggcagggcac

SEQ ID NO: 1976652 - RNA, 21 nt, Human
guugggacccaguggcagggc

SEQ ID NO: 1976653 - RNA, 22 nt, Human
guugggacccaguggcagggca

SEQ ID NO: 1976654 - RNA, 16 nt, Human
guugggacccaguggc

SEQ ID NO: 1976655 - RNA, 20 nt, Human
guugggacccaguggcaggg

SEQ ID NO: 1976656 - RNA, 15 nt, Human
guugcccaggcuggc

SEQ ID NO: 1976657 - RNA, 20 nt, Human
guugcccaggcuggagugca

SEQ ID NO: 1976658 - RNA, 16 nt, Human
guugcccaggcuggcg

SEQ ID NO: 1976659 - RNA, 17 nt, Human
guugcccaggcuggcgu

SEQ ID NO: 1976660 - RNA, 23 nt, Human
guuggcugggggccucagugcca

SEQ ID NO: 1976661 - RNA, 15 nt, Human
guugcugacuuagaa

SEQ ID NO: 1976662 - RNA, 13 nt, Human
guugcugauuuua

SEQ ID NO: 1976663 - RNA, 14 nt, Human
guugcugauuuuau

SEQ ID NO: 1976664 - RNA, 18 nt, Human
guugcugauuuuauucuu

SEQ ID NO: 1976665 - RNA, 20 nt, Human
guugcugauuuuauucuuga

SEQ ID NO: 1976666 - RNA, 15 nt, Human
aaguacuauguauca

SEQ ID NO: 1976667 - RNA, 16 nt, Human
aaguacuauguaucaa

SEQ ID NO: 1976668 - RNA, 15 nt, Human
guuuuauauccauuu

SEQ ID NO: 1976669 - RNA, 16 nt, Human
aaguacugagcaguga

SEQ ID NO: 1976670 - RNA, 23 nt, Human
aaguacugagcagugauauucuu

SEQ ID NO: 1976671 - RNA, 15 nt, Human
aaguacuggagaaaa

SEQ ID NO: 1976672 - RNA, 21 nt, Human
aaguacuucuccacccugcuc

SEQ ID NO: 1976673 - RNA, 22 nt, Human
aaguacuucuccacccugcucu

SEQ ID NO: 1976674 - RNA, 23 nt, Human
aaguacuucuccacccugcucuc

SEQ ID NO: 1976675 - RNA, 15 nt, Human
aaguauguuuuacuu

SEQ ID NO: 1976676 - RNA, 13 nt, Human
aaguauucucuuu

SEQ ID NO: 1976677 - RNA, 20 nt, Human
aagucacauuccugaacagg

SEQ ID NO: 1976678 - RNA, 16 nt, Human
aagucacaguuaagga

SEQ ID NO: 1976679 - RNA, 13 nt, Human
aagucacacagug

SEQ ID NO: 1976680 - RNA, 13 nt, Human
aagucacaguuaa

SEQ ID NO: 1976681 - RNA, 14 nt, Human
aagucacugcacag

SEQ ID NO: 1976682 - RNA, 12 nt, Human
aagucacugcac

SEQ ID NO: 1976683 - RNA, 19 nt, Human
aagucacugcaaaaccagg

SEQ ID NO: 1976684 - RNA, 22 nt, Human
aagucacugcaaaaccagguuu

SEQ ID NO: 1976685 - RNA, 19 nt, Human
aagucacaguuaaggagaa

SEQ ID NO: 1976686 - RNA, 21 nt, Human
aagucaagugaaaaaggagga

SEQ ID NO: 1976687 - RNA, 24 nt, Human
aagucacacaguauuacuucugcu

SEQ ID NO: 1976688 - RNA, 19 nt, Human
aagucaaggguaggguggg

SEQ ID NO: 1976689 - RNA, 18 nt, Human
aaguauucucuuuucaag

SEQ ID NO: 1976690 - RNA, 19 nt, Human
aaguauucuuauuuaauga

SEQ ID NO: 1976691 - RNA, 18 nt, Human
aaguauucuuauuuaaug

SEQ ID NO: 1976692 - RNA, 18 nt, Human
guuuuucuaggccugggg

SEQ ID NO: 1976693 - RNA, 14 nt, Human
aagugacgguuccu

SEQ ID NO: 1976694 - RNA, 15 nt, Human
aagugacgguuccua

SEQ ID NO: 1976695 - RNA, 17 nt, Human
aagugacgguuccuaca

SEQ ID NO: 1976696 - RNA, 18 nt, Human
aagugaccaucauuucac

SEQ ID NO: 1976697 - RNA, 17 nt, Human
aagucuuagauguauau

SEQ ID NO: 1976698 - RNA, 13 nt, Human
aagucaugauguu

SEQ ID NO: 1976699 - RNA, 17 nt, Human
aagucaugauguuuuua

SEQ ID NO: 1976700 - RNA, 18 nt, Human
aagucaugauguuuuuaa

SEQ ID NO: 1976701 - RNA, 19 nt, Human
aagucaugauguuuuuaaa

SEQ ID NO: 1976702 - RNA, 21 nt, Human
aagucaugauguuuuuaaaau

SEQ ID NO: 1976703 - RNA, 22 nt, Human
aagucaugauguuuuuaaaauc

SEQ ID NO: 1976704 - RNA, 23 nt, Human
aagucaugauguuuuuaaaaucu

SEQ ID NO: 1976705 - RNA, 19 nt, Human
aagucuuagauguauauau

SEQ ID NO: 1976706 - RNA, 18 nt, Human
aagucuuagauguauaua

SEQ ID NO: 1976707 - RNA, 16 nt, Human
guuuuugucuuaaaaa

SEQ ID NO: 1976708 - RNA, 12 nt, Human
guuuuuguaaag

SEQ ID NO: 1976709 - RNA, 13 nt, Human
guuuuuguaaaga

SEQ ID NO: 1976710 - RNA, 15 nt, Human
guuuuuguaaagaaa

SEQ ID NO: 1976711 - RNA, 19 nt, Human
guuuuuguaaagaaaaaua

SEQ ID NO: 1976712 - RNA, 20 nt, Human
guuuuuguaaagaaaaauau

SEQ ID NO: 1976713 - RNA, 21 nt, Human
guuuuuguaaagaaaaauauu

SEQ ID NO: 1976714 - RNA, 15 nt, Human
guuuuuguaaagauu

SEQ ID NO: 1976715 - RNA, 14 nt, Human
guuuuuguuuuguu

SEQ ID NO: 1976716 - RNA, 17 nt, Human
guuuuuguuuuguugca

SEQ ID NO: 1976717 - RNA, 19 nt, Human
guuuuuguuuuuguuuugu

SEQ ID NO: 1976718 - RNA, 18 nt, Human
guuuuuuaaaaaucugug

SEQ ID NO: 1976719 - RNA, 22 nt, Human
guuuuuguaaagauuucuguuc

SEQ ID NO: 1976720 - RNA, 14 nt, Human
guuuuuguauauug

SEQ ID NO: 1976721 - RNA, 16 nt, Human
guuuuucugcuuuaga

SEQ ID NO: 1976722 - RNA, 18 nt, Human
guuuuucugcuuuagacu

SEQ ID NO: 1976723 - RNA, 19 nt, Human
guuuuucugcuuuagacuu

SEQ ID NO: 1976724 - RNA, 22 nt, Human
guuuuucugcuuuagacuugaa

SEQ ID NO: 1976725 - RNA, 15 nt, Human
guuuuucugauaugu

SEQ ID NO: 1976726 - RNA, 14 nt, Human
guuuuucugcuuua

SEQ ID NO: 1976727 - RNA, 18 nt, Human
guuuuuuguuuuucugcu

SEQ ID NO: 1976728 - RNA, 15 nt, Human
guuuuuuuuuaaaga

SEQ ID NO: 1976729 - RNA, 18 nt, Human
guuuuuuguucuugcgau

SEQ ID NO: 1976730 - RNA, 9 nt, Human
guuuuuugu

SEQ ID NO: 1976731 - RNA, 17 nt, Human
guuuuuugaaguguugg

SEQ ID NO: 1976732 - RNA, 9 nt, Human
guuuuuuga

SEQ ID NO: 1976733 - RNA, 16 nt, Human
guuuuuugaaguguug

SEQ ID NO: 1976734 - RNA, 19 nt, Human
aagggugauguacacaugu

SEQ ID NO: 1976735 - RNA, 21 nt, Human
guuucuaagguaacaagauga

SEQ ID NO: 1976736 - RNA, 17 nt, Human
aaguaaaucucuucugu

SEQ ID NO: 1976737 - RNA, 15 nt, Human
aaguaaaucucuucu

SEQ ID NO: 1976738 - RNA, 16 nt, Human
aaguaaaucucuucug

SEQ ID NO: 1976739 - RNA, 14 nt, Human
aaggggcaguggug

SEQ ID NO: 1976740 - RNA, 17 nt, Human
aaggguaucaggugcug

SEQ ID NO: 1976741 - RNA, 17 nt, Human
aaggggcaguggugguu

SEQ ID NO: 1976742 - RNA, 16 nt, Human
aaggguaucuggugac

SEQ ID NO: 1976743 - RNA, 19 nt, Human
aaggguaucaggugcugcc

SEQ ID NO: 1976744 - RNA, 15 nt, Human
aagggcccagagagg

SEQ ID NO: 1976745 - RNA, 13 nt, Human
aagggcccagaga

SEQ ID NO: 1976746 - RNA, 19 nt, Human
aaggcugagaggagagaga

SEQ ID NO: 1976747 - RNA, 18 nt, Human
guuuuacugcagcuuugu

SEQ ID NO: 1976748 - RNA, 16 nt, Human
guuuuacugcagcuuu

SEQ ID NO: 1976749 - RNA, 18 nt, Human
guuuuaaggacugacuga

SEQ ID NO: 1976750 - RNA, 19 nt, Human
guuuuaaggacugacugag

SEQ ID NO: 1976751 - RNA, 14 nt, Human
guuuuaagaggcag

SEQ ID NO: 1976752 - RNA, 18 nt, Human
guuuuaaggaugcuugua

SEQ ID NO: 1976753 - RNA, 16 nt, Human
guuuuaagaggcaggg

SEQ ID NO: 1976754 - RNA, 22 nt, Human
guuugcuccccuuccccuuccu

SEQ ID NO: 1976755 - RNA, 14 nt, Human
guuugcuccccuuc

SEQ ID NO: 1976756 - RNA, 18 nt, Human
guuucugccgcagcccug

SEQ ID NO: 1976757 - RNA, 22 nt, Human
guuucugccgcagcccugcaga

SEQ ID NO: 1976758 - RNA, 15 nt, Human
guuucucccgugcuu

SEQ ID NO: 1976759 - RNA, 14 nt, Human
guuucucagcuccc

SEQ ID NO: 1976760 - RNA, 19 nt, Human
guuugcaucugaaaauuga

SEQ ID NO: 1976761 - RNA, 17 nt, Human
guuugccucugccucug

SEQ ID NO: 1976762 - RNA, 13 nt, Human
guuugcuaaguga

SEQ ID NO: 1976763 - RNA, 17 nt, Human
guuugcacucaaaucuu

SEQ ID NO: 1976764 - RNA, 19 nt, Human
guuugcacucaaaucuuaa

SEQ ID NO: 1976765 - RNA, 21 nt, Human
guuugcacucaaaucuuaaga

SEQ ID NO: 1976766 - RNA, 22 nt, Human
guuugcacucaaaucuuaagaa

SEQ ID NO: 1976767 - RNA, 23 nt, Human
guuugcacucaaaucuuaagaaa

SEQ ID NO: 1976768 - RNA, 17 nt, Human
aaguucugcagauaaac

SEQ ID NO: 1976769 - RNA, 14 nt, Human
aaguuaaauaaauc

SEQ ID NO: 1976770 - RNA, 12 nt, Human
aaguuaaauaaa

SEQ ID NO: 1976771 - RNA, 11 nt, Human
aaguuaaaggg

SEQ ID NO: 1976772 - RNA, 14 nt, Human
aaguuaaagggaag

SEQ ID NO: 1976773 - RNA, 21 nt, Human
aaguguucuguuacaaaaugu

SEQ ID NO: 1976774 - RNA, 22 nt, Human
aaguguucuguuacaaaaugua

SEQ ID NO: 1976775 - RNA, 23 nt, Human
aaguguucuguuacaaaauguaa

SEQ ID NO: 1976776 - RNA, 23 nt, Human
aaguguugggguuugguuuuguu

SEQ ID NO: 1976777 - RNA, 17 nt, Human
guuuuuuuuuaaagacu

SEQ ID NO: 1976778 - RNA, 16 nt, Human
aaguguucuguuacaa

SEQ ID NO: 1976779 - RNA, 17 nt, Human
aaguguucuguuacaaa

SEQ ID NO: 1976780 - RNA, 19 nt, Human
aaguguucuguuacaaaau

SEQ ID NO: 1976781 - RNA, 20 nt, Human
aaguguucuguuacaaaaug

SEQ ID NO: 1976782 - RNA, 20 nt, Human
aaguuugcacucaaaucuua

SEQ ID NO: 1976783 - RNA, 11 nt, Human
aaguuugcacu

SEQ ID NO: 1976784 - RNA, 15 nt, Human
aaguuucaaaaaucu

SEQ ID NO: 1976785 - RNA, 16 nt, Human
aaguuucaaaaaucug

SEQ ID NO: 1976786 - RNA, 17 nt, Human
aaguuucaaaaaucuga

SEQ ID NO: 1976787 - RNA, 21 nt, Human
aaguuucaaaaaucugaagau

SEQ ID NO: 1976788 - RNA, 14 nt, Human
aaguuuaugucuca

SEQ ID NO: 1976789 - RNA, 14 nt, Human
aaguuucaaaaauc

SEQ ID NO: 1976790 - RNA, 22 nt, Human
aaguuuucccuugaggaaacaa

SEQ ID NO: 1976791 - RNA, 21 nt, Human
aaguuuucccuugaggaaaca

SEQ ID NO: 1976792 - RNA, 16 nt, Human
aaguuuucccugaagu

SEQ ID NO: 1976793 - RNA, 23 nt, Human
aaguuuucccugaaguuaugugu

SEQ ID NO: 1976794 - RNA, 19 nt, Human
aaguuuuaggguacaugug

SEQ ID NO: 1976795 - RNA, 15 nt, Human
aaguuuugacaagcu

SEQ ID NO: 1976796 - RNA, 19 nt, Human
aaguuuugacaagcuggcu

SEQ ID NO: 1976797 - RNA, 20 nt, Human
aaguuuugacaagcuggcuu

SEQ ID NO: 1976798 - RNA, 12 nt, Human
uaaaauguuuuc

SEQ ID NO: 1976799 - RNA, 13 nt, Human
uaaaauguuuuca

SEQ ID NO: 1976800 - RNA, 14 nt, Human
uaaaauguuuucag

SEQ ID NO: 1976801 - RNA, 16 nt, Human
uaaaauguuuucagcu

SEQ ID NO: 1976802 - RNA, 21 nt, Human
uaaaauguuuucagcuaggaa

SEQ ID NO: 1976803 - RNA, 17 nt, Human
uaaaauuuuuaaucuuu

SEQ ID NO: 1976804 - RNA, 19 nt, Human
uaaaauuuuaagcuaggaa

SEQ ID NO: 1976805 - RNA, 17 nt, Human
uaaaauuuuaggcaagu

SEQ ID NO: 1976806 - RNA, 21 nt, Human
uaaaauuuuaggcaaguuuuc

SEQ ID NO: 1976807 - RNA, 21 nt, Human
uaaaauuaucaccuuugucag

SEQ ID NO: 1976808 - RNA, 18 nt, Human
uaaaauuuuaagcuagga

SEQ ID NO: 1976809 - RNA, 16 nt, Human
uaaaauuaaagcugaa

SEQ ID NO: 1976810 - RNA, 18 nt, Human
uaaaauuaaagcugaaaa

SEQ ID NO: 1976811 - RNA, 19 nt, Human
uaaaauuaaagcugaaaac

SEQ ID NO: 1976812 - RNA, 23 nt, Human
uaaaauguuuucagcuaggaaca

SEQ ID NO: 1976813 - RNA, 15 nt, Human
uaaaauuauaccugu

SEQ ID NO: 1976814 - RNA, 19 nt, Human
uaaaccaaggcuagaacca

SEQ ID NO: 1976815 - RNA, 19 nt, Human
uaaaauuuuuaaucuuuaa

SEQ ID NO: 1976816 - RNA, 21 nt, Human
uaaaggcuaccuuuguauucu

SEQ ID NO: 1976817 - RNA, 19 nt, Human
uaaaggcuaccuuuguauu

SEQ ID NO: 1976818 - RNA, 21 nt, Human
uaaagcaaccaaaaagaaaaa

SEQ ID NO: 1976819 - RNA, 19 nt, Human
uaaagcaaccaaaaagaaa

SEQ ID NO: 1976820 - RNA, 19 nt, Human
uaaagauuuugaucucaca

SEQ ID NO: 1976821 - RNA, 21 nt, Human
uaaagauuuugaucucacauu

SEQ ID NO: 1976822 - RNA, 14 nt, Human
uaaagauuuugauc

SEQ ID NO: 1976823 - RNA, 15 nt, Human
uaaagauuuugaucu

SEQ ID NO: 1976824 - RNA, 14 nt, Human
uaaagauuucuguu

SEQ ID NO: 1976825 - RNA, 15 nt, Human
uaaagauuucuguuc

SEQ ID NO: 1976826 - RNA, 16 nt, Human
uaaagauguagcaaac

SEQ ID NO: 1976827 - RNA, 20 nt, Human
uaaagauguagcaaacccug

SEQ ID NO: 1976828 - RNA, 13 nt, Human
uaaagauugugug

SEQ ID NO: 1976829 - RNA, 17 nt, Human
uaaagauuuaggccaau

SEQ ID NO: 1976830 - RNA, 12 nt, Human
uaaagauuucug

SEQ ID NO: 1976831 - RNA, 13 nt, Human
uaaagauuucugu

SEQ ID NO: 1976832 - RNA, 19 nt, Human
uaaagaugagcuuugucua

SEQ ID NO: 1976833 - RNA, 18 nt, Human
uaaagaguuaguuugagu

SEQ ID NO: 1976834 - RNA, 12 nt, Human
uaaagaaauaau

SEQ ID NO: 1976835 - RNA, 14 nt, Human
uaaagaaauaauuu

SEQ ID NO: 1976836 - RNA, 14 nt, Human
uaaagaagguuuca

SEQ ID NO: 1976837 - RNA, 14 nt, Human
uaaagaauaggacu

SEQ ID NO: 1976838 - RNA, 15 nt, Human
uaaagaauaggacuu

SEQ ID NO: 1976839 - RNA, 14 nt, Human
uaaagaauuucuuu

SEQ ID NO: 1976840 - RNA, 16 nt, Human
uaaagaauuucuuuau

SEQ ID NO: 1976841 - RNA, 14 nt, Human
uaaagaauuuguca

SEQ ID NO: 1976842 - RNA, 20 nt, Human
uaaagaauuugucacaggaa

SEQ ID NO: 1976843 - RNA, 16 nt, Human
uaaagacuuuuaugau

SEQ ID NO: 1976844 - RNA, 11 nt, Human
uaaagacucua

SEQ ID NO: 1976845 - RNA, 15 nt, Human
uaaagacaccuacug

SEQ ID NO: 1976846 - RNA, 19 nt, Human
uaaagacccagggggagaa

SEQ ID NO: 1976847 - RNA, 21 nt, Human
uaaagacccagggggagaaug

SEQ ID NO: 1976848 - RNA, 21 nt, Human
uaaacucugaauuuaucuuug

SEQ ID NO: 1976849 - RNA, 13 nt, Human
uaaacucugaaua

SEQ ID NO: 1976850 - RNA, 14 nt, Human
uaaacucugaauaa

SEQ ID NO: 1976851 - RNA, 19 nt, Human
uaaacucugaauaagcacu

SEQ ID NO: 1976852 - RNA, 22 nt, Human
uaaacucugaauaagcacuuuu

SEQ ID NO: 1976853 - RNA, 17 nt, Human
uaaacucugaauuuauc

SEQ ID NO: 1976854 - RNA, 18 nt, Human
uaaacucugaauuuaucu

SEQ ID NO: 1976855 - RNA, 12 nt, Human
uaaacugccccc

SEQ ID NO: 1976856 - RNA, 18 nt, Human
uaaaccgccaaggcuggg

SEQ ID NO: 1976857 - RNA, 16 nt, Human
uaaaccgccaaggcug

SEQ ID NO: 1976858 - RNA, 13 nt, Human
uaaacgucuuaaa

SEQ ID NO: 1976859 - RNA, 17 nt, Human
uaaacgucuuaaauauu

SEQ ID NO: 1976860 - RNA, 13 nt, Human
uaaacguggagaa

SEQ ID NO: 1976861 - RNA, 23 nt, Human
uaaacguggagaaucacaggcug

SEQ ID NO: 1976862 - RNA, 22 nt, Human
uaaacguguauguuuuucaguu

SEQ ID NO: 1976863 - RNA, 23 nt, Human
uaaacguguauguuuuucaguuc

SEQ ID NO: 1976864 - RNA, 20 nt, Human
uaaacguguauguuuuucag

SEQ ID NO: 1976865 - RNA, 18 nt, Human
uaaacguguauguuuuuc

SEQ ID NO: 1976866 - RNA, 15 nt, Human
aauacaccacuacau

SEQ ID NO: 1976867 - RNA, 16 nt, Human
aauacacaaaaucaaa

SEQ ID NO: 1976868 - RNA, 16 nt, Human
aauacaccacuacauu

SEQ ID NO: 1976869 - RNA, 18 nt, Human
aauacaccacuacauucu

SEQ ID NO: 1976870 - RNA, 20 nt, Human
aauacaccacuacauucugu

SEQ ID NO: 1976871 - RNA, 21 nt, Human
aauacaccacuacauucuguu

SEQ ID NO: 1976872 - RNA, 17 nt, Human
uaaauaauucuuuuuua

SEQ ID NO: 1976873 - RNA, 23 nt, Human
uaaauaauucuuuuuuauuaauc

SEQ ID NO: 1976874 - RNA, 12 nt, Human
uaaauagcuuuu

SEQ ID NO: 1976875 - RNA, 19 nt, Human
uaaauaguaaaaauaaaau

SEQ ID NO: 1976876 - RNA, 20 nt, Human
uaaauaguaaaaauaaaauu

SEQ ID NO: 1976877 - RNA, 19 nt, Human
uaaaucuccaaaauaaaac

SEQ ID NO: 1976878 - RNA, 12 nt, Human
uaaauaguguua

SEQ ID NO: 1976879 - RNA, 15 nt, Human
uaaauaguguuauug

SEQ ID NO: 1976880 - RNA, 16 nt, Human
uaaauaguguuauuga

SEQ ID NO: 1976881 - RNA, 19 nt, Human
uaaauaguguuauugagag

SEQ ID NO: 1976882 - RNA, 18 nt, Human
uaacaaauaacaacuuuu

SEQ ID NO: 1976883 - RNA, 21 nt, Human
uaaauuuuuuuguaugaaaac

SEQ ID NO: 1976884 - RNA, 22 nt, Human
uaaauuuuuuuguaugaaaaca

SEQ ID NO: 1976885 - RNA, 15 nt, Human
uaaauuuuuuuguau

SEQ ID NO: 1976886 - RNA, 16 nt, Human
uaaauuuuuuuguaug

SEQ ID NO: 1976887 - RNA, 17 nt, Human
uaaauuuuuuuguauga

SEQ ID NO: 1976888 - RNA, 18 nt, Human
uaaauuuuuuuguaugaa

SEQ ID NO: 1976889 - RNA, 15 nt, Human
uaaauuuugaaaagu

SEQ ID NO: 1976890 - RNA, 22 nt, Human
uaaauuuugaaaaguaauauuu

SEQ ID NO: 1976891 - RNA, 14 nt, Human
uaaauuuugaaaag

SEQ ID NO: 1976892 - RNA, 13 nt, Human
uaacaagccaccc

SEQ ID NO: 1976893 - RNA, 16 nt, Human
uaacaacuaugauuug

SEQ ID NO: 1976894 - RNA, 21 nt, Human
uaacaacuaugauuuggaaaa

SEQ ID NO: 1976895 - RNA, 22 nt, Human
uaacaacuaugauuuggaaaau

SEQ ID NO: 1976896 - RNA, 15 nt, Human
uaacaacugcccagu

SEQ ID NO: 1976897 - RNA, 20 nt, Human
uaacaacuuuuuuuucuuuu

SEQ ID NO: 1976898 - RNA, 14 nt, Human
uaacaagaaaauga

SEQ ID NO: 1976899 - RNA, 13 nt, Human
uaacaagaagcaa

SEQ ID NO: 1976900 - RNA, 22 nt, Human
uaaauuaacuuuuauaaacuuu

SEQ ID NO: 1976901 - RNA, 23 nt, Human
uaaauguuuuguaaacuuugaaa

SEQ ID NO: 1976902 - RNA, 20 nt, Human
uaaauguuuuuuuuuaaaga

SEQ ID NO: 1976903 - RNA, 12 nt, Human
uaaauguuuugu

SEQ ID NO: 1976904 - RNA, 14 nt, Human
uaaauguuuuguaa

SEQ ID NO: 1976905 - RNA, 15 nt, Human
uaaauguuuuguaaa

SEQ ID NO: 1976906 - RNA, 16 nt, Human
uaaauguuuuguaaac

SEQ ID NO: 1976907 - RNA, 18 nt, Human
uaaauguuuuguaaacuu

SEQ ID NO: 1976908 - RNA, 19 nt, Human
uaaauguuuuguaaacuuu

SEQ ID NO: 1976909 - RNA, 21 nt, Human
uaaauguuuuguaaacuuuga

SEQ ID NO: 1976910 - RNA, 22 nt, Human
uaaauguuuuguaaacuuugaa

SEQ ID NO: 1976911 - RNA, 21 nt, Human
uaaauuacauuuguaauuuaa

SEQ ID NO: 1976912 - RNA, 18 nt, Human
uaaauuaguacagcacuu

SEQ ID NO: 1976913 - RNA, 15 nt, Human
uaaauuacauuugua

SEQ ID NO: 1976914 - RNA, 16 nt, Human
uaaauuacauuuguaa

SEQ ID NO: 1976915 - RNA, 17 nt, Human
uaaauuacauuuguaau

SEQ ID NO: 1976916 - RNA, 17 nt, Human
uaaaugauuucauucaa

SEQ ID NO: 1976917 - RNA, 20 nt, Human
uaaaugauucaaaaagucac

SEQ ID NO: 1976918 - RNA, 14 nt, Human
uaaaugauucaaaa

SEQ ID NO: 1976919 - RNA, 11 nt, Human
uaaauguuuug

SEQ ID NO: 1976920 - RNA, 20 nt, Human
uaaaucuccaaaauaaaacu

SEQ ID NO: 1976921 - RNA, 21 nt, Human
uaaaucuccaaaauaaaacuu

SEQ ID NO: 1976922 - RNA, 22 nt, Human
uaaaucuccaaaauaaaacuuu

SEQ ID NO: 1976923 - RNA, 19 nt, Human
aauaauuacagugccuaaa

SEQ ID NO: 1976924 - RNA, 22 nt, Human
aauaauuacagugccuaaaaua

SEQ ID NO: 1976925 - RNA, 21 nt, Human
aauaagggaaaaaucaaguau

SEQ ID NO: 1976926 - RNA, 15 nt, Human
aauaacuaaaaggua

SEQ ID NO: 1976927 - RNA, 20 nt, Human
aauaacagccgcuccagagu

SEQ ID NO: 1976928 - RNA, 15 nt, Human
aauaacuagaacaaa

SEQ ID NO: 1976929 - RNA, 23 nt, Human
aauaagcuaguugaauacuugaa

SEQ ID NO: 1976930 - RNA, 20 nt, Human
aauaagcuaguugaauacuu

SEQ ID NO: 1976931 - RNA, 22 nt, Human
aauaagcuaguugaauacuuga

SEQ ID NO: 1976932 - RNA, 17 nt, Human
aauaagcacuuuuuaaa

SEQ ID NO: 1976933 - RNA, 16 nt, Human
aauaagcuaguugaau

SEQ ID NO: 1976934 - RNA, 17 nt, Human
aauaagcuaguugaaua

SEQ ID NO: 1976935 - RNA, 18 nt, Human
aauaagcuaguugaauac

SEQ ID NO: 1976936 - RNA, 18 nt, Human
aauaaaguuugaucuucc

SEQ ID NO: 1976937 - RNA, 19 nt, Human
aauaaaguuugaucuuccu

SEQ ID NO: 1976938 - RNA, 10 nt, Human
aauaaauagu

SEQ ID NO: 1976939 - RNA, 15 nt, Human
aauaaauaguucuuc

SEQ ID NO: 1976940 - RNA, 12 nt, Human
aauaaauuauuu

SEQ ID NO: 1976941 - RNA, 22 nt, Human
aauaacauguaauuaaguacua

SEQ ID NO: 1976942 - RNA, 19 nt, Human
aauaacauguaauuaagua

SEQ ID NO: 1976943 - RNA, 12 nt, Human
aauaacauguaa

SEQ ID NO: 1976944 - RNA, 13 nt, Human
aauaacagccgcu

SEQ ID NO: 1976945 - RNA, 12 nt, Human
aauaaauuuuga

SEQ ID NO: 1976946 - RNA, 13 nt, Human
aauaaauuuugaa

SEQ ID NO: 1976947 - RNA, 14 nt, Human
aauaaauuuugaaa

SEQ ID NO: 1976948 - RNA, 22 nt, Human
aauaaauuuugaaaaguaauau

SEQ ID NO: 1976949 - RNA, 15 nt, Human
aauaaauuuugaaaa

SEQ ID NO: 1976950 - RNA, 16 nt, Human
aauaaauuuugaaaag

SEQ ID NO: 1976951 - RNA, 18 nt, Human
aauaaauuuugaaaagua

SEQ ID NO: 1976952 - RNA, 20 nt, Human
aauaaauuuugaaaaguaau

SEQ ID NO: 1976953 - RNA, 15 nt, Human
aauaacaauaaaaga

SEQ ID NO: 1976954 - RNA, 21 nt, Human
uaaagucuguugauuaaagau

SEQ ID NO: 1976955 - RNA, 23 nt, Human
uaaagggaagaaaacacuguuau

SEQ ID NO: 1976956 - RNA, 13 nt, Human
uaaagucaggggu

SEQ ID NO: 1976957 - RNA, 13 nt, Human
uaaagggaagaaa

SEQ ID NO: 1976958 - RNA, 14 nt, Human
uaaagggaagaaaa

SEQ ID NO: 1976959 - RNA, 17 nt, Human
uaaagggaagaaaacac

SEQ ID NO: 1976960 - RNA, 22 nt, Human
uaaagggaagaaaacacuguua

SEQ ID NO: 1976961 - RNA, 22 nt, Human
uaaagucuguugauuaaagaug

SEQ ID NO: 1976962 - RNA, 14 nt, Human
uaaaguguauuuuu

SEQ ID NO: 1976963 - RNA, 15 nt, Human
uaaaguguauuuuuu

SEQ ID NO: 1976964 - RNA, 19 nt, Human
uaaaguguauuuuuuuacu

SEQ ID NO: 1976965 - RNA, 17 nt, Human
aauaaaaaaagaaaaaa

SEQ ID NO: 1976966 - RNA, 17 nt, Human
aauaaaaaaaagaaaaa

SEQ ID NO: 1976967 - RNA, 18 nt, Human
aauaaaaaaaagaaaaaa

SEQ ID NO: 1976968 - RNA, 15 nt, Human
aauaaaagcccagga

SEQ ID NO: 1976969 - RNA, 17 nt, Human
aauaaaagcccaggagc

SEQ ID NO: 1976970 - RNA, 19 nt, Human
aauaaaagcccaggagccc

SEQ ID NO: 1976971 - RNA, 13 nt, Human
aauaaaagcccag

SEQ ID NO: 1976972 - RNA, 14 nt, Human
aauaaaagcccagg

SEQ ID NO: 1976973 - RNA, 12 nt, Human
aauaaaaauaau

SEQ ID NO: 1976974 - RNA, 23 nt, Human
aauaaaggcagcuguugucucuu

SEQ ID NO: 1976975 - RNA, 14 nt, Human
aauaaaguaauuau

SEQ ID NO: 1976976 - RNA, 16 nt, Human
aauaaaguacaagagc

SEQ ID NO: 1976977 - RNA, 16 nt, Human
aauaaaaucuugaaaa

SEQ ID NO: 1976978 - RNA, 14 nt, Human
guggaagagggcug

SEQ ID NO: 1976979 - RNA, 17 nt, Human
guggaagagggcugcaa

SEQ ID NO: 1976980 - RNA, 20 nt, Human
guggaauuauuuuaaaagau

SEQ ID NO: 1976981 - RNA, 12 nt, Human
gugcugugaaaa

SEQ ID NO: 1976982 - RNA, 14 nt, Human
guggacacagcucu

SEQ ID NO: 1976983 - RNA, 15 nt, Human
guggacacagcucuu

SEQ ID NO: 1976984 - RNA, 17 nt, Human
guggacacagcucuucu

SEQ ID NO: 1976985 - RNA, 24 nt, Human
guggacacagcucuucuccaggcu

SEQ ID NO: 1976986 - RNA, 20 nt, Human
gugcugcccugcccaccugg

SEQ ID NO: 1976987 - RNA, 19 nt, Human
gugcugcccugcccaccug

SEQ ID NO: 1976988 - RNA, 21 nt, Human
gugcugcccugcccaccuggc

SEQ ID NO: 1976989 - RNA, 12 nt, Human
gugcugcuuuga

SEQ ID NO: 1976990 - RNA, 18 nt, Human
gugcugcccugcccaccu

SEQ ID NO: 1976991 - RNA, 23 nt, Human
aagaagguuucagaaagaagugg

SEQ ID NO: 1976992 - RNA, 16 nt, Human
gugcugggccccugcc

SEQ ID NO: 1976993 - RNA, 13 nt, Human
gugcugcuuugau

SEQ ID NO: 1976994 - RNA, 19 nt, Human
gugcugggccccugccucu

SEQ ID NO: 1976995 - RNA, 15 nt, Human
aagaauauuugaaug

SEQ ID NO: 1976996 - RNA, 21 nt, Human
aagaaucaccuaauuaauuuc

SEQ ID NO: 1976997 - RNA, 11 nt, Human
aagaauauuug

SEQ ID NO: 1976998 - RNA, 17 nt, Human
guggcagcugcggucca

SEQ ID NO: 1976999 - RNA, 24 nt, Human
aagaauuucuaggacugaauuaug

SEQ ID NO: 1977000 - RNA, 14 nt, Human
aagaauucagauug

SEQ ID NO: 1977001 - RNA, 13 nt, Human
aagacccaaaagg

SEQ ID NO: 1977002 - RNA, 23 nt, Human
aagaccagagauaguggggagac

SEQ ID NO: 1977003 - RNA, 16 nt, Human
aagaauuuuuuauuuu

SEQ ID NO: 1977004 - RNA, 20 nt, Human
aagaauuuuuuauuuuuugg

SEQ ID NO: 1977005 - RNA, 14 nt, Human
aagaauuuuuuauu

SEQ ID NO: 1977006 - RNA, 19 nt, Human
aagaauuucuuuauaaaau

SEQ ID NO: 1977007 - RNA, 14 nt, Human
guggcaccagcagc

SEQ ID NO: 1977008 - RNA, 13 nt, Human
guggcaccagcag

SEQ ID NO: 1977009 - RNA, 22 nt, Human
guggcagcucaccucucccuug

SEQ ID NO: 1977010 - RNA, 14 nt, Human
guggcagcugcggu

SEQ ID NO: 1977011 - RNA, 22 nt, Human
guggcaaagcuguucuuccugg

SEQ ID NO: 1977012 - RNA, 23 nt, Human
guggauuuaacagaaauguacag

SEQ ID NO: 1977013 - RNA, 21 nt, Human
guggauuuaacagaaauguac

SEQ ID NO: 1977014 - RNA, 15 nt, Human
aagaagcucucuccu

SEQ ID NO: 1977015 - RNA, 14 nt, Human
aagaagcucucucc

SEQ ID NO: 1977016 - RNA, 17 nt, Human
aagaagcccaggaaagg

SEQ ID NO: 1977017 - RNA, 16 nt, Human
aagaagcccaggaaag

SEQ ID NO: 1977018 - RNA, 12 nt, Human
aagaagcauuuc

SEQ ID NO: 1977019 - RNA, 13 nt, Human
aagaaaaccaaac

SEQ ID NO: 1977020 - RNA, 22 nt, Human
aagaaaauaaaaaaaagaaaaa

SEQ ID NO: 1977021 - RNA, 23 nt, Human
aagaaaauaaaaaaaagaaaaaa

SEQ ID NO: 1977022 - RNA, 13 nt, Human
aagaaaauaaaaa

SEQ ID NO: 1977023 - RNA, 18 nt, Human
aagaaaauaaaaaaaaga

SEQ ID NO: 1977024 - RNA, 21 nt, Human
aagaaaauaaaaaaaagaaaa

SEQ ID NO: 1977025 - RNA, 22 nt, Human
aagaaaaaggaugcacagaguu

SEQ ID NO: 1977026 - RNA, 11 nt, Human
aagaaaaauau

SEQ ID NO: 1977027 - RNA, 12 nt, Human
aagaaaaauauu

SEQ ID NO: 1977028 - RNA, 13 nt, Human
aagaaaaauauuu

SEQ ID NO: 1977029 - RNA, 19 nt, Human
aagaaaaaggaugcacaga

SEQ ID NO: 1977030 - RNA, 20 nt, Human
aagaaaaaggaugcacagag

SEQ ID NO: 1977031 - RNA, 18 nt, Human
aacuuguaauaaacccuu

SEQ ID NO: 1977032 - RNA, 13 nt, Human
aacuuguuuucug

SEQ ID NO: 1977033 - RNA, 19 nt, Human
aacuuguucuuccaaagca

SEQ ID NO: 1977034 - RNA, 20 nt, Human
aacuuguucuuccaaagcag

SEQ ID NO: 1977035 - RNA, 16 nt, Human
aacuuguugaauuuau

SEQ ID NO: 1977036 - RNA, 16 nt, Human
aacuuguuuaauaaag

SEQ ID NO: 1977037 - RNA, 14 nt, Human
gugccaagcagagg

SEQ ID NO: 1977038 - RNA, 15 nt, Human
gugcauuuggugguu

SEQ ID NO: 1977039 - RNA, 21 nt, Human
gugcauuugaggucuguucuu

SEQ ID NO: 1977040 - RNA, 22 nt, Human
gugcauuugaggucuguucuuu

SEQ ID NO: 1977041 - RNA, 20 nt, Human
gugcacuaauguguaagaca

SEQ ID NO: 1977042 - RNA, 20 nt, Human
gugcauuugaggucuguucu

SEQ ID NO: 1977043 - RNA, 16 nt, Human
aacugcagucacugca

SEQ ID NO: 1977044 - RNA, 12 nt, Human
gugcacacacca

SEQ ID NO: 1977045 - RNA, 14 nt, Human
gugcacacaccaga

SEQ ID NO: 1977046 - RNA, 18 nt, Human
gugcacguacacacacau

SEQ ID NO: 1977047 - RNA, 17 nt, Human
gugcacacaccagagcc

SEQ ID NO: 1977048 - RNA, 23 nt, Human
aacuugguucccauuugcuccuu

SEQ ID NO: 1977049 - RNA, 17 nt, Human
aacuuggcgcugccccu

SEQ ID NO: 1977050 - RNA, 15 nt, Human
aacuuguaaaugugg

SEQ ID NO: 1977051 - RNA, 18 nt, Human
aacuugcuuaaaugugaa

SEQ ID NO: 1977052 - RNA, 19 nt, Human
aacuugcuuaaaugugaau

SEQ ID NO: 1977053 - RNA, 20 nt, Human
aacuugcuuaaaugugaauu

SEQ ID NO: 1977054 - RNA, 21 nt, Human
aacuugcuuaaaugugaauua

SEQ ID NO: 1977055 - RNA, 17 nt, Human
aacuuggaugaguuuug

SEQ ID NO: 1977056 - RNA, 16 nt, Human
aacuuggaugaguuuu

SEQ ID NO: 1977057 - RNA, 14 nt, Human
aacuuggcgcugcc

SEQ ID NO: 1977058 - RNA, 15 nt, Human
gugccucugggacug

SEQ ID NO: 1977059 - RNA, 14 nt, Human
gugccucugggacu

SEQ ID NO: 1977060 - RNA, 16 nt, Human
gugccuggccacgccc

SEQ ID NO: 1977061 - RNA, 23 nt, Human
gugccugcuucagccucccacag

SEQ ID NO: 1977062 - RNA, 12 nt, Human
gugccugcuuca

SEQ ID NO: 1977063 - RNA, 13 nt, Human
gugccugcuucag

SEQ ID NO: 1977064 - RNA, 21 nt, Human
gugccugcuucagccucccac

SEQ ID NO: 1977065 - RNA, 15 nt, Human
gugugguguuuccug

SEQ ID NO: 1977066 - RNA, 13 nt, Human
gugugagucacca

SEQ ID NO: 1977067 - RNA, 18 nt, Human
gugugagucaccaagccc

SEQ ID NO: 1977068 - RNA, 21 nt, Human
gugucuugcaauggcagccuu

SEQ ID NO: 1977069 - RNA, 19 nt, Human
gugucuugcaauggcagcc

SEQ ID NO: 1977070 - RNA, 20 nt, Human
gugucccaaaaagaaaggag

SEQ ID NO: 1977071 - RNA, 13 nt, Human
guguucugugaua

SEQ ID NO: 1977072 - RNA, 13 nt, Human
guguguguguugc

SEQ ID NO: 1977073 - RNA, 13 nt, Human
guguguuacaaug

SEQ ID NO: 1977074 - RNA, 15 nt, Human
guguguuacaaugua

SEQ ID NO: 1977075 - RNA, 19 nt, Human
guguguuacaauguaacuu

SEQ ID NO: 1977076 - RNA, 13 nt, Human
guguucuguuaca

SEQ ID NO: 1977077 - RNA, 14 nt, Human
guguucuguuacaa

SEQ ID NO: 1977078 - RNA, 15 nt, Human
guguucuguuacaaa

SEQ ID NO: 1977079 - RNA, 17 nt, Human
guguucuguuacaaaau

SEQ ID NO: 1977080 - RNA, 18 nt, Human
guguucuguuacaaaaug

SEQ ID NO: 1977081 - RNA, 19 nt, Human
guguucuguuacaaaaugu

SEQ ID NO: 1977082 - RNA, 13 nt, Human
guguuuaagacau

SEQ ID NO: 1977083 - RNA, 14 nt, Human
guguuuaagacauu

SEQ ID NO: 1977084 - RNA, 21 nt, Human
guguugaagagcagcuccuuc

SEQ ID NO: 1977085 - RNA, 13 nt, Human
guguguguaugug

SEQ ID NO: 1977086 - RNA, 21 nt, Human
guguguaagaugucuuccuau

SEQ ID NO: 1977087 - RNA, 23 nt, Human
guguguggucaacauuucucaug

SEQ ID NO: 1977088 - RNA, 15 nt, Human
gugugguuaugaacu

SEQ ID NO: 1977089 - RNA, 19 nt, Human
gugugguguuuccuggcac

SEQ ID NO: 1977090 - RNA, 17 nt, Human
guguguguugugugugg

SEQ ID NO: 1977091 - RNA, 14 nt, Human
guguguguaugugg

SEQ ID NO: 1977092 - RNA, 19 nt, Human
guguguguaugcgugugug

SEQ ID NO: 1977093 - RNA, 17 nt, Human
aagauauuuugcuuugu

SEQ ID NO: 1977094 - RNA, 20 nt, Human
aagauauuuugcuuugugau

SEQ ID NO: 1977095 - RNA, 20 nt, Human
aagaguaggaagacuuugga

SEQ ID NO: 1977096 - RNA, 22 nt, Human
aagauauuuugcuuugugauuu

SEQ ID NO: 1977097 - RNA, 12 nt, Human
aagaucacuguu

SEQ ID NO: 1977098 - RNA, 14 nt, Human
aagaucacuguuua

SEQ ID NO: 1977099 - RNA, 20 nt, Human
aagaucacuguuuagauuug

SEQ ID NO: 1977100 - RNA, 20 nt, Human
gugguucacucuuggagccu

SEQ ID NO: 1977101 - RNA, 21 nt, Human
gugguucacucuuggagccug

SEQ ID NO: 1977102 - RNA, 18 nt, Human
gugguuauggagagggug

SEQ ID NO: 1977103 - RNA, 19 nt, Human
gugguguuuccuggcacug

SEQ ID NO: 1977104 - RNA, 15 nt, Human
aagauauuuugcuuu

SEQ ID NO: 1977105 - RNA, 19 nt, Human
aagaguaggaagacuuugg

SEQ ID NO: 1977106 - RNA, 18 nt, Human
aagaguaggaagacuuug

SEQ ID NO: 1977107 - RNA, 16 nt, Human
aagaguaggaagacuu

SEQ ID NO: 1977108 - RNA, 19 nt, Human
aagauguagaggagaaacu

SEQ ID NO: 1977109 - RNA, 20 nt, Human
aagaugagaacagauaaaga

SEQ ID NO: 1977110 - RNA, 22 nt, Human
aagaugagaacagauaaagauu

SEQ ID NO: 1977111 - RNA, 19 nt, Human
aagaugagaacagauaaag

SEQ ID NO: 1977112 - RNA, 13 nt, Human
aagcaaaauguga

SEQ ID NO: 1977113 - RNA, 19 nt, Human
aagauguagauuuauuuca

SEQ ID NO: 1977114 - RNA, 22 nt, Human
aagauguagauuuauuucauca

SEQ ID NO: 1977115 - RNA, 13 nt, Human
aagauguagcaaa

SEQ ID NO: 1977116 - RNA, 14 nt, Human
aagauguagcaaac

SEQ ID NO: 1977117 - RNA, 18 nt, Human
aagauguagcaaacccug

SEQ ID NO: 1977118 - RNA, 23 nt, Human
aagauguagcaaacccugucaaa

SEQ ID NO: 1977119 - RNA, 15 nt, Human
aagaugcaauguaga

SEQ ID NO: 1977120 - RNA, 16 nt, Human
aagauguagauuuauu

SEQ ID NO: 1977121 - RNA, 22 nt, Human
aagauguagaggagaaacugga

SEQ ID NO: 1977122 - RNA, 14 nt, Human
aagcaaaugugaau

SEQ ID NO: 1977123 - RNA, 13 nt, Human
aagcaaaugugaa

SEQ ID NO: 1977124 - RNA, 12 nt, Human
aagcaaaugucu

SEQ ID NO: 1977125 - RNA, 22 nt, Human
aagcaaacugguuauuuaaaau

SEQ ID NO: 1977126 - RNA, 14 nt, Human
aagacuccagaaau

SEQ ID NO: 1977127 - RNA, 12 nt, Human
aagacuccagaa

SEQ ID NO: 1977128 - RNA, 13 nt, Human
aagacuccagaaa

SEQ ID NO: 1977129 - RNA, 17 nt, Human
aagacucauucuucugu

SEQ ID NO: 1977130 - RNA, 23 nt, Human
aagacgcugugcugcccugccca

SEQ ID NO: 1977131 - RNA, 20 nt, Human
aagacgcugugcugcccugc

SEQ ID NO: 1977132 - RNA, 22 nt, Human
aagacgcugugcugcccugccc

SEQ ID NO: 1977133 - RNA, 21 nt, Human
aagacgcugugcugcccugcc

SEQ ID NO: 1977134 - RNA, 12 nt, Human
aagaccagucca

SEQ ID NO: 1977135 - RNA, 23 nt, Human
aagaccccuuaccacugcucuga

SEQ ID NO: 1977136 - RNA, 19 nt, Human
aagagauugugguuucauu

SEQ ID NO: 1977137 - RNA, 16 nt, Human
aagagauugugguuuc

SEQ ID NO: 1977138 - RNA, 20 nt, Human
aagagaugaugaaaauauuu

SEQ ID NO: 1977139 - RNA, 23 nt, Human
aagagauggcuuacaaaaagaaa

SEQ ID NO: 1977140 - RNA, 16 nt, Human
aagacuguacaaagua

SEQ ID NO: 1977141 - RNA, 14 nt, Human
aagagcccaggccu

SEQ ID NO: 1977142 - RNA, 12 nt, Human
aagagcccaggc

SEQ ID NO: 1977143 - RNA, 12 nt, Human
aagagccccacu

SEQ ID NO: 1977144 - RNA, 16 nt, Human
aagagcccaggccucc

SEQ ID NO: 1977145 - RNA, 22 nt, Human
aagagcuaggcagggugucugc

SEQ ID NO: 1977146 - RNA, 18 nt, Human
aagagccccacucucaga

SEQ ID NO: 1977147 - RNA, 19 nt, Human
aagagccccacucucagag

SEQ ID NO: 1977148 - RNA, 13 nt, Human
aagagccccacuc

SEQ ID NO: 1977149 - RNA, 16 nt, Human
aagagccccacucuca

SEQ ID NO: 1977150 - RNA, 17 nt, Human
aagagccccacucucag

SEQ ID NO: 1977151 - RNA, 13 nt, Human
aagagcuaggcag

SEQ ID NO: 1977152 - RNA, 16 nt, Human
aagagcuaggcagggu

SEQ ID NO: 1977153 - RNA, 13 nt, Human
guggccccaccug

SEQ ID NO: 1977154 - RNA, 22 nt, Human
guggccccaccuggcccucucu

SEQ ID NO: 1977155 - RNA, 16 nt, Human
guggcccgacagccug

SEQ ID NO: 1977156 - RNA, 12 nt, Human
gugggagcugag

SEQ ID NO: 1977157 - RNA, 18 nt, Human
gugggauccuccaggugc

SEQ ID NO: 1977158 - RNA, 15 nt, Human
gugggauccuccagg

SEQ ID NO: 1977159 - RNA, 14 nt, Human
guggccucccaacu

SEQ ID NO: 1977160 - RNA, 13 nt, Human
guggccucccaac

SEQ ID NO: 1977161 - RNA, 17 nt, Human
guggcccgacagccugg

SEQ ID NO: 1977162 - RNA, 15 nt, Human
guggccucccaacuc

SEQ ID NO: 1977163 - RNA, 21 nt, Human
guggcuucccgcucagcccuc

SEQ ID NO: 1977164 - RNA, 20 nt, Human
gugguguuuccugcaggcca

SEQ ID NO: 1977165 - RNA, 16 nt, Human
gugguguuuccuggca

SEQ ID NO: 1977166 - RNA, 15 nt, Human
gugguguuuccuggc

SEQ ID NO: 1977167 - RNA, 14 nt, Human
gugggucuggagga

SEQ ID NO: 1977168 - RNA, 21 nt, Human
gugggucaugaugcucuuucc

SEQ ID NO: 1977169 - RNA, 15 nt, Human
gugggggucugugug

SEQ ID NO: 1977170 - RNA, 16 nt, Human
gugggggucugugugu

SEQ ID NO: 1977171 - RNA, 14 nt, Human
gugggggucugugu

SEQ ID NO: 1977172 - RNA, 16 nt, Human
gugggcaaaagagugu

SEQ ID NO: 1977173 - RNA, 18 nt, Human
guggggggggugcugggc

SEQ ID NO: 1977174 - RNA, 13 nt, Human
gugggggguccuu

SEQ ID NO: 1977175 - RNA, 20 nt, Human
aacauacucccaucugugaa

SEQ ID NO: 1977176 - RNA, 15 nt, Human
aacauaauucuuauu

SEQ ID NO: 1977177 - RNA, 16 nt, Human
aacauacucccaucug

SEQ ID NO: 1977178 - RNA, 18 nt, Human
aacauacucccaucugug

SEQ ID NO: 1977179 - RNA, 22 nt, Human
aacauguuuuucuucucccuca

SEQ ID NO: 1977180 - RNA, 14 nt, Human
aacaucaacaucuu

SEQ ID NO: 1977181 - RNA, 21 nt, Human
aacauagaauugcaaucuaua

SEQ ID NO: 1977182 - RNA, 22 nt, Human
aacauagaauugcaaucuauaa

SEQ ID NO: 1977183 - RNA, 13 nt, Human
guccuacccaccc

SEQ ID NO: 1977184 - RNA, 20 nt, Human
aacagacuggaagcacagcu

SEQ ID NO: 1977185 - RNA, 21 nt, Human
guccuaauggugaugcagucu

SEQ ID NO: 1977186 - RNA, 12 nt, Human
aacagaggacca

SEQ ID NO: 1977187 - RNA, 13 nt, Human
aacagaggaccag

SEQ ID NO: 1977188 - RNA, 12 nt, Human
aacagaggauau

SEQ ID NO: 1977189 - RNA, 18 nt, Human
aacagaggaccagcacac

SEQ ID NO: 1977190 - RNA, 20 nt, Human
aacagaggaccagcacacuc

SEQ ID NO: 1977191 - RNA, 14 nt, Human
aacagauaaagauu

SEQ ID NO: 1977192 - RNA, 18 nt, Human
aacagaugaccccugccc

SEQ ID NO: 1977193 - RNA, 21 nt, Human
aacagaggaccagcacacucc

SEQ ID NO: 1977194 - RNA, 16 nt, Human
aacagaguaaucuugu

SEQ ID NO: 1977195 - RNA, 19 nt, Human
aacagaugaccccugccca

SEQ ID NO: 1977196 - RNA, 14 nt, Human
aacagaugcucuga

SEQ ID NO: 1977197 - RNA, 17 nt, Human
aacagaugcucugagag

SEQ ID NO: 1977198 - RNA, 19 nt, Human
aacagguuuuccugaagaa

SEQ ID NO: 1977199 - RNA, 24 nt, Human
aacagauuggauuuuauguugaca

SEQ ID NO: 1977200 - RNA, 23 nt, Human
aacagauuggauuuuauguugac

SEQ ID NO: 1977201 - RNA, 17 nt, Human
aacagauuggauuuuau

SEQ ID NO: 1977202 - RNA, 18 nt, Human
aacagauuggauuuuaug

SEQ ID NO: 1977203 - RNA, 14 nt, Human
aacagauucuuuua

SEQ ID NO: 1977204 - RNA, 17 nt, Human
aacagauucuuuuaugu

SEQ ID NO: 1977205 - RNA, 16 nt, Human
aacagauuggauuuua

SEQ ID NO: 1977206 - RNA, 20 nt, Human
guccgaccuggccugucugu

SEQ ID NO: 1977207 - RNA, 13 nt, Human
guccuaaugguga

SEQ ID NO: 1977208 - RNA, 18 nt, Human
guccuaaggaaccuuccu

SEQ ID NO: 1977209 - RNA, 15 nt, Human
guccuaaggaaccuu

SEQ ID NO: 1977210 - RNA, 22 nt, Human
guccgaaagggacuuggaagcu

SEQ ID NO: 1977211 - RNA, 13 nt, Human
gucccuuuuccuu

SEQ ID NO: 1977212 - RNA, 21 nt, Human
guccgaaagggacuuggaagc

SEQ ID NO: 1977213 - RNA, 16 nt, Human
guccccgcacugggcu

SEQ ID NO: 1977214 - RNA, 15 nt, Human
guccccgcacugggc

SEQ ID NO: 1977215 - RNA, 13 nt, Human
gucccccugacaa

SEQ ID NO: 1977216 - RNA, 12 nt, Human
guccccuucccg

SEQ ID NO: 1977217 - RNA, 23 nt, Human
guccccuguuuguuucugaaagg

SEQ ID NO: 1977218 - RNA, 12 nt, Human
guccccucccag

SEQ ID NO: 1977219 - RNA, 19 nt, Human
gucccaccuuggcugcagg

SEQ ID NO: 1977220 - RNA, 12 nt, Human
gucccccucugg

SEQ ID NO: 1977221 - RNA, 14 nt, Human
gucccccucuggcu

SEQ ID NO: 1977222 - RNA, 17 nt, Human
guccccccacucccagc

SEQ ID NO: 1977223 - RNA, 17 nt, Human
gucccaccuuggcugca

SEQ ID NO: 1977224 - RNA, 18 nt, Human
gucccaccuuggcugcag

SEQ ID NO: 1977225 - RNA, 13 nt, Human
guccauucucaag

SEQ ID NO: 1977226 - RNA, 22 nt, Human
guagcucuaggagggcuggcaa

SEQ ID NO: 1977227 - RNA, 22 nt, Human
guagccucaaucgagugagaca

SEQ ID NO: 1977228 - RNA, 16 nt, Human
guagcuaacuuuuauu

SEQ ID NO: 1977229 - RNA, 22 nt, Human
aaccacaguguaccauuaaaau

SEQ ID NO: 1977230 - RNA, 23 nt, Human
aaccacaguguaccauuaaaaua

SEQ ID NO: 1977231 - RNA, 13 nt, Human
aaccacaucuugc

SEQ ID NO: 1977232 - RNA, 13 nt, Human
aaccacagcuccu

SEQ ID NO: 1977233 - RNA, 18 nt, Human
aaccacagcuccuuuucc

SEQ ID NO: 1977234 - RNA, 19 nt, Human
aaccacagcuccuuuucca

SEQ ID NO: 1977235 - RNA, 17 nt, Human
aaccacaguguaccauu

SEQ ID NO: 1977236 - RNA, 18 nt, Human
aaccacaguguaccauua

SEQ ID NO: 1977237 - RNA, 21 nt, Human
aaccacaguguaccauuaaaa

SEQ ID NO: 1977238 - RNA, 13 nt, Human
gucuccauguuug

SEQ ID NO: 1977239 - RNA, 14 nt, Human
aacauuuucucuua

SEQ ID NO: 1977240 - RNA, 17 nt, Human
aacauuuucucuuagaa

SEQ ID NO: 1977241 - RNA, 17 nt, Human
aacauuuuacccacaca

SEQ ID NO: 1977242 - RNA, 15 nt, Human
aacauuuuacccaca

SEQ ID NO: 1977243 - RNA, 16 nt, Human
aacauuuugucauaua

SEQ ID NO: 1977244 - RNA, 18 nt, Human
aacauuuucucuuagaaa

SEQ ID NO: 1977245 - RNA, 19 nt, Human
aacauuuucucuuagaaaa

SEQ ID NO: 1977246 - RNA, 22 nt, Human
aacauuuguucuauagcuuuuc

SEQ ID NO: 1977247 - RNA, 22 nt, Human
gucucaaacucuugaccucagg

SEQ ID NO: 1977248 - RNA, 14 nt, Human
gucuaugggacuca

SEQ ID NO: 1977249 - RNA, 15 nt, Human
gucuaugggacucaa

SEQ ID NO: 1977250 - RNA, 20 nt, Human
gucucaagagggcacuggug

SEQ ID NO: 1977251 - RNA, 22 nt, Human
gucucaagagggcacugguggc

SEQ ID NO: 1977252 - RNA, 15 nt, Human
gucucaagagggcac

SEQ ID NO: 1977253 - RNA, 17 nt, Human
gucucaagagggcacug

SEQ ID NO: 1977254 - RNA, 14 nt, Human
gucucaaaggccag

SEQ ID NO: 1977255 - RNA, 23 nt, Human
gucucaguccaugaagauguaga

SEQ ID NO: 1977256 - RNA, 16 nt, Human
gucucaggucccugca

SEQ ID NO: 1977257 - RNA, 15 nt, Human
gucucaggucccugc

SEQ ID NO: 1977258 - RNA, 16 nt, Human
guccugcugcaguugc

SEQ ID NO: 1977259 - RNA, 13 nt, Human
guccugcugcagu

SEQ ID NO: 1977260 - RNA, 15 nt, Human
guccugcucagcagu

SEQ ID NO: 1977261 - RNA, 17 nt, Human
guccugcugcaguugcc

SEQ ID NO: 1977262 - RNA, 12 nt, Human
guccuuuagaaa

SEQ ID NO: 1977263 - RNA, 13 nt, Human
guccuuuagaaac

SEQ ID NO: 1977264 - RNA, 13 nt, Human
aacauuaaaauau

SEQ ID NO: 1977265 - RNA, 12 nt, Human
aacauuaauguu

SEQ ID NO: 1977266 - RNA, 14 nt, Human
aacauuaauguuga

SEQ ID NO: 1977267 - RNA, 15 nt, Human
aacauuaauguugau

SEQ ID NO: 1977268 - RNA, 17 nt, Human
aacauuaauguugauuu

SEQ ID NO: 1977269 - RNA, 19 nt, Human
aacauuaauguugauuucu

SEQ ID NO: 1977270 - RNA, 20 nt, Human
aacauuaauguugauuucua

SEQ ID NO: 1977271 - RNA, 24 nt, Human
aacauuaguacuuuauagaagaau

SEQ ID NO: 1977272 - RNA, 21 nt, Human
aacauuaggcagguugcuuaa

SEQ ID NO: 1977273 - RNA, 15 nt, Human
aacauuaguacuuua

SEQ ID NO: 1977274 - RNA, 16 nt, Human
aacauuaguacuuuau

SEQ ID NO: 1977275 - RNA, 17 nt, Human
aacauuaguacuuuaua

SEQ ID NO: 1977276 - RNA, 20 nt, Human
gucgcccaggcuggagugca

SEQ ID NO: 1977277 - RNA, 15 nt, Human
gucgcccaggcugga

SEQ ID NO: 1977278 - RNA, 14 nt, Human
gucgcccaggcugg

SEQ ID NO: 1977279 - RNA, 13 nt, Human
gucgcccagucug

SEQ ID NO: 1977280 - RNA, 14 nt, Human
gucgcccagucugg

SEQ ID NO: 1977281 - RNA, 13 nt, Human
gucgaaaguuagu

SEQ ID NO: 1977282 - RNA, 14 nt, Human
gucgaggacaggga

SEQ ID NO: 1977283 - RNA, 21 nt, Human
gucgagccugggggcuggagc

SEQ ID NO: 1977284 - RNA, 13 nt, Human
gucgagcuccccc

SEQ ID NO: 1977285 - RNA, 20 nt, Human
gucuaccugaggggccucuu

SEQ ID NO: 1977286 - RNA, 15 nt, Human
gucgcccucccaggc

SEQ ID NO: 1977287 - RNA, 18 nt, Human
gucgcccuggacugugug

SEQ ID NO: 1977288 - RNA, 14 nt, Human
gucgcccuggacug

SEQ ID NO: 1977289 - RNA, 23 nt, Human
gucgcccagucuggaaugcagug

SEQ ID NO: 1977290 - RNA, 16 nt, Human
gucuauaccuuaagaa

SEQ ID NO: 1977291 - RNA, 14 nt, Human
gucuaucauuguug

SEQ ID NO: 1977292 - RNA, 22 nt, Human
gucuauaccuuaagaaugccaa

SEQ ID NO: 1977293 - RNA, 18 nt, Human
aaccugauugugucucuu

SEQ ID NO: 1977294 - RNA, 19 nt, Human
gucuuuuaaaaaguauugc

SEQ ID NO: 1977295 - RNA, 23 nt, Human
gucuuuuaaaaaguauugccaaa

SEQ ID NO: 1977296 - RNA, 19 nt, Human
aaccugauugugucucuug

SEQ ID NO: 1977297 - RNA, 13 nt, Human
aaccuguucugcu

SEQ ID NO: 1977298 - RNA, 17 nt, Human
aaccuguucugcuuucc

SEQ ID NO: 1977299 - RNA, 10 nt, Human
gucuuuuaaa

SEQ ID NO: 1977300 - RNA, 14 nt, Human
gucuuuuaaaaagu

SEQ ID NO: 1977301 - RNA, 15 nt, Human
gucuuuuaaaaagua

SEQ ID NO: 1977302 - RNA, 17 nt, Human
gucuuuuaaaaaguauu

SEQ ID NO: 1977303 - RNA, 16 nt, Human
gucuuuguacagacaa

SEQ ID NO: 1977304 - RNA, 15 nt, Human
gucuuuguacagaca

SEQ ID NO: 1977305 - RNA, 16 nt, Human
gucuucaguaagccgu

SEQ ID NO: 1977306 - RNA, 18 nt, Human
gucuucauccccucagaa

SEQ ID NO: 1977307 - RNA, 13 nt, Human
gucuucaugaaau

SEQ ID NO: 1977308 - RNA, 15 nt, Human
gucuucaugaaaugc

SEQ ID NO: 1977309 - RNA, 16 nt, Human
gucuucaugaaaugcu

SEQ ID NO: 1977310 - RNA, 23 nt, Human
gucuucaugaaaugcuaugucau

SEQ ID NO: 1977311 - RNA, 17 nt, Human
gucuucauguucccacu

SEQ ID NO: 1977312 - RNA, 23 nt, Human
aacguggcugcuucaaggauccu

SEQ ID NO: 1977313 - RNA, 16 nt, Human
aaccuuucuauaauuu

SEQ ID NO: 1977314 - RNA, 20 nt, Human
aacguguauguuuuucaguu

SEQ ID NO: 1977315 - RNA, 22 nt, Human
aacguguauguuuuucaguuca

SEQ ID NO: 1977316 - RNA, 16 nt, Human
aacgugugcuguguuu

SEQ ID NO: 1977317 - RNA, 19 nt, Human
aacgugugcuguguuugcu

SEQ ID NO: 1977318 - RNA, 14 nt, Human
aacguguauguuuu

SEQ ID NO: 1977319 - RNA, 11 nt, Human
aaccuuucccc

SEQ ID NO: 1977320 - RNA, 13 nt, Human
aaccuuuccccca

SEQ ID NO: 1977321 - RNA, 13 nt, Human
aacuagaacaaau

SEQ ID NO: 1977322 - RNA, 18 nt, Human
gucuggaggaccugcccg

SEQ ID NO: 1977323 - RNA, 21 nt, Human
gucugacaggcaaugcuggcu

SEQ ID NO: 1977324 - RNA, 17 nt, Human
gucugaagucacugcac

SEQ ID NO: 1977325 - RNA, 19 nt, Human
gucugaagucacugcacag

SEQ ID NO: 1977326 - RNA, 22 nt, Human
gucugacaggcaaugcuggcug

SEQ ID NO: 1977327 - RNA, 23 nt, Human
gucugacaggcaaugcuggcugu

SEQ ID NO: 1977328 - RNA, 23 nt, Human
gucuggaugcgggcauggcagcc

SEQ ID NO: 1977329 - RNA, 15 nt, Human
gucuggggaccagcu

SEQ ID NO: 1977330 - RNA, 18 nt, Human
gucucuuuaaugucacag

SEQ ID NO: 1977331 - RNA, 19 nt, Human
gucucuuuaaugucacagg

SEQ ID NO: 1977332 - RNA, 20 nt, Human
gucucuuuaaugucacaggc

SEQ ID NO: 1977333 - RNA, 19 nt, Human
gucugaaggcuggguucug

SEQ ID NO: 1977334 - RNA, 14 nt, Human
gucugaaggcuggg

SEQ ID NO: 1977335 - RNA, 16 nt, Human
gucugaagucacugca

SEQ ID NO: 1977336 - RNA, 22 nt, Human
gucucuuuaaugucacaggcag

SEQ ID NO: 1977337 - RNA, 23 nt, Human
gucucuuuaaugucacaggcagg

SEQ ID NO: 1977338 - RNA, 19 nt, Human
gucucuugguccugcugca

SEQ ID NO: 1977339 - RNA, 18 nt, Human
gucucuugguccugcugc

SEQ ID NO: 1977340 - RNA, 20 nt, Human
gucucuugguccugcugcag

SEQ ID NO: 1977341 - RNA, 13 nt, Human
gucucuugguccu

SEQ ID NO: 1977342 - RNA, 17 nt, Human
gucucuugguccugcug

SEQ ID NO: 1977343 - RNA, 12 nt, Human
gugagagcuggg

SEQ ID NO: 1977344 - RNA, 13 nt, Human
gugacuuuugcuu

SEQ ID NO: 1977345 - RNA, 15 nt, Human
gugacuuuugcuuua

SEQ ID NO: 1977346 - RNA, 18 nt, Human
gugacuuuucaaguauuu

SEQ ID NO: 1977347 - RNA, 12 nt, Human
gugaccccaggu

SEQ ID NO: 1977348 - RNA, 17 nt, Human
gugaguacuacaguccu

SEQ ID NO: 1977349 - RNA, 15 nt, Human
gugagcaggcuguga

SEQ ID NO: 1977350 - RNA, 21 nt, Human
gugagcacuaaggugugcucu

SEQ ID NO: 1977351 - RNA, 15 nt, Human
gugagcaauccugca

SEQ ID NO: 1977352 - RNA, 12 nt, Human
gugagacagacu

SEQ ID NO: 1977353 - RNA, 17 nt, Human
gugagaggggaggccaa

SEQ ID NO: 1977354 - RNA, 13 nt, Human
gugagagcugggu

SEQ ID NO: 1977355 - RNA, 16 nt, Human
gugagaggggaacaga

SEQ ID NO: 1977356 - RNA, 14 nt, Human
aacugaacucugac

SEQ ID NO: 1977357 - RNA, 21 nt, Human
gugaguacuacaguccuccca

SEQ ID NO: 1977358 - RNA, 19 nt, Human
gugaguacuacaguccucc

SEQ ID NO: 1977359 - RNA, 17 nt, Human
gugaguccuggcauggg

SEQ ID NO: 1977360 - RNA, 14 nt, Human
gugaguccuccaga

SEQ ID NO: 1977361 - RNA, 20 nt, Human
gugaguccuggcaugggaau

SEQ ID NO: 1977362 - RNA, 15 nt, Human
gugagucgaggacag

SEQ ID NO: 1977363 - RNA, 16 nt, Human
gugaguccuccagaac

SEQ ID NO: 1977364 - RNA, 17 nt, Human
gugaguccuccagaacu

SEQ ID NO: 1977365 - RNA, 12 nt, Human
aacucugccugc

SEQ ID NO: 1977366 - RNA, 18 nt, Human
gugaguccuccagaacuc

SEQ ID NO: 1977367 - RNA, 23 nt, Human
gugaagacaaugacuuacuguac

SEQ ID NO: 1977368 - RNA, 14 nt, Human
gugaagacuccaga

SEQ ID NO: 1977369 - RNA, 16 nt, Human
gugaagacuccagaaa

SEQ ID NO: 1977370 - RNA, 16 nt, Human
gugaagagcaagagag

SEQ ID NO: 1977371 - RNA, 21 nt, Human
gugaaggaggcuccaggcagc

SEQ ID NO: 1977372 - RNA, 21 nt, Human
gugaaggaccuucacucuaag

SEQ ID NO: 1977373 - RNA, 23 nt, Human
gugaaggaccuucacucuaagau

SEQ ID NO: 1977374 - RNA, 16 nt, Human
gugaaggaggcuccag

SEQ ID NO: 1977375 - RNA, 17 nt, Human
gugaaggaggcuccagg

SEQ ID NO: 1977376 - RNA, 16 nt, Human
gugaagccagggcccg

SEQ ID NO: 1977377 - RNA, 13 nt, Human
gugaagauacuuu

SEQ ID NO: 1977378 - RNA, 15 nt, Human
gugaagauacuuugu

SEQ ID NO: 1977379 - RNA, 18 nt, Human
gugaagauacuuuguauu

SEQ ID NO: 1977380 - RNA, 20 nt, Human
gugaagauacuuuguauugu

SEQ ID NO: 1977381 - RNA, 14 nt, Human
gugaagugaagaca

SEQ ID NO: 1977382 - RNA, 14 nt, Human
gugacaugucuuuu

SEQ ID NO: 1977383 - RNA, 22 nt, Human
gugacauccacaaaugcaguuu

SEQ ID NO: 1977384 - RNA, 20 nt, Human
gugacaucucuauuccccac

SEQ ID NO: 1977385 - RNA, 16 nt, Human
gugacagaggcagccc

SEQ ID NO: 1977386 - RNA, 18 nt, Human
gugacagaggcagcccca

SEQ ID NO: 1977387 - RNA, 19 nt, Human
gugacagaggcagccccau

SEQ ID NO: 1977388 - RNA, 17 nt, Human
gugaccaaugaugguca

SEQ ID NO: 1977389 - RNA, 23 nt, Human
gugacauuugucauuuucauuag

SEQ ID NO: 1977390 - RNA, 21 nt, Human
gugaccagcaccaucucuccu

SEQ ID NO: 1977391 - RNA, 18 nt, Human
gugaccagcaccaucucu

SEQ ID NO: 1977392 - RNA, 18 nt, Human
gugaccauguuuuguuua

SEQ ID NO: 1977393 - RNA, 16 nt, Human
caaccugauugugucu

SEQ ID NO: 1977394 - RNA, 17 nt, Human
caacgagccuuuucacc

SEQ ID NO: 1977395 - RNA, 19 nt, Human
caacucuccuccagaguca

SEQ ID NO: 1977396 - RNA, 18 nt, Human
caacgcagcccugcuuug

SEQ ID NO: 1977397 - RNA, 20 nt, Human
caacgaucacaaaugacuuu

SEQ ID NO: 1977398 - RNA, 12 nt, Human
caacgcagcccu

SEQ ID NO: 1977399 - RNA, 16 nt, Human
caacgaucacaaauga

SEQ ID NO: 1977400 - RNA, 18 nt, Human
caacgaucacaaaugacu

SEQ ID NO: 1977401 - RNA, 19 nt, Human
caacgaucacaaaugacuu

SEQ ID NO: 1977402 - RNA, 13 nt, Human
caacgcagcccug

SEQ ID NO: 1977403 - RNA, 15 nt, Human
caacgcagcccugcu

SEQ ID NO: 1977404 - RNA, 16 nt, Human
caaccucuuccuccug

SEQ ID NO: 1977405 - RNA, 20 nt, Human
caaccucuuccuccugacac

SEQ ID NO: 1977406 - RNA, 15 nt, Human
caacccucaucacca

SEQ ID NO: 1977407 - RNA, 12 nt, Human
caacccucauca

SEQ ID NO: 1977408 - RNA, 21 nt, Human
caacucugaaggguaauuaua

SEQ ID NO: 1977409 - RNA, 20 nt, Human
caacucuccuccagagucag

SEQ ID NO: 1977410 - RNA, 16 nt, Human
caacugcauuggcuuu

SEQ ID NO: 1977411 - RNA, 18 nt, Human
caacucuucccugaacuu

SEQ ID NO: 1977412 - RNA, 17 nt, Human
caacuuucaagaacuug

SEQ ID NO: 1977413 - RNA, 17 nt, Human
caacuuacauaugucuu

SEQ ID NO: 1977414 - RNA, 12 nt, Human
caacuuuguaua

SEQ ID NO: 1977415 - RNA, 11 nt, Human
caacuuuguau

SEQ ID NO: 1977416 - RNA, 23 nt, Human
caacaugccagccacugugauag

SEQ ID NO: 1977417 - RNA, 21 nt, Human
caacauggcuacuugcuuuga

SEQ ID NO: 1977418 - RNA, 21 nt, Human
caaccacacuugucggcucca

SEQ ID NO: 1977419 - RNA, 20 nt, Human
caaccacacuugucggcucc

SEQ ID NO: 1977420 - RNA, 13 nt, Human
caaccacaaaacu

SEQ ID NO: 1977421 - RNA, 12 nt, Human
caaccaaauggu

SEQ ID NO: 1977422 - RNA, 22 nt, Human
caaccaaguaugaaucuauuug

SEQ ID NO: 1977423 - RNA, 16 nt, Human
caacauuguagccuca

SEQ ID NO: 1977424 - RNA, 22 nt, Human
caacauuucucauguugaaacu

SEQ ID NO: 1977425 - RNA, 21 nt, Human
caaccccuucgcuccuguguc

SEQ ID NO: 1977426 - RNA, 21 nt, Human
caacccucagagccaccccua

SEQ ID NO: 1977427 - RNA, 18 nt, Human
caacccucagagccaccc

SEQ ID NO: 1977428 - RNA, 18 nt, Human
caaccccuucgcuccugu

SEQ ID NO: 1977429 - RNA, 19 nt, Human
caaccccuucgcuccugug

SEQ ID NO: 1977430 - RNA, 15 nt, Human
caacagguuuuccug

SEQ ID NO: 1977431 - RNA, 18 nt, Human
caacaggguuuuuuucca

SEQ ID NO: 1977432 - RNA, 19 nt, Human
caacagguuuuccugaaga

SEQ ID NO: 1977433 - RNA, 21 nt, Human
caacagguagcauagcucugu

SEQ ID NO: 1977434 - RNA, 22 nt, Human
caacaucuuggucagauuugaa

SEQ ID NO: 1977435 - RNA, 13 nt, Human
caacauccacucu

SEQ ID NO: 1977436 - RNA, 14 nt, Human
caacauccacucuc

SEQ ID NO: 1977437 - RNA, 15 nt, Human
caaauuuacagagac

SEQ ID NO: 1977438 - RNA, 23 nt, Human
caacaggcugggcuucaguggca

SEQ ID NO: 1977439 - RNA, 24 nt, Human
caacaggcugggcuucaguggcag

SEQ ID NO: 1977440 - RNA, 13 nt, Human
caaauuuaacagg

SEQ ID NO: 1977441 - RNA, 15 nt, Human
caaauucugucucug

SEQ ID NO: 1977442 - RNA, 14 nt, Human
caaauuuacagaga

SEQ ID NO: 1977443 - RNA, 23 nt, Human
caaggugggaggauugcuugagc

SEQ ID NO: 1977444 - RNA, 12 nt, Human
caaggugggagg

SEQ ID NO: 1977445 - RNA, 19 nt, Human
caaggugcaggcaggcugg

SEQ ID NO: 1977446 - RNA, 19 nt, Human
caagggccuggccugagcu

SEQ ID NO: 1977447 - RNA, 16 nt, Human
caagggcggccuuucc

SEQ ID NO: 1977448 - RNA, 18 nt, Human
caagggcggccuuuccca

SEQ ID NO: 1977449 - RNA, 19 nt, Human
caagggcggccuuucccac

SEQ ID NO: 1977450 - RNA, 15 nt, Human
caaggauugcuacug

SEQ ID NO: 1977451 - RNA, 16 nt, Human
caagggccuggccuga

SEQ ID NO: 1977452 - RNA, 13 nt, Human
caagggcuuuccu

SEQ ID NO: 1977453 - RNA, 18 nt, Human
caagggcuuuccugugcc

SEQ ID NO: 1977454 - RNA, 21 nt, Human
caagggcuuuccugugccagg

SEQ ID NO: 1977455 - RNA, 14 nt, Human
caaggugcaggcag

SEQ ID NO: 1977456 - RNA, 15 nt, Human
caaggugcaggcagg

SEQ ID NO: 1977457 - RNA, 17 nt, Human
caaggugcaggcaggcu

SEQ ID NO: 1977458 - RNA, 13 nt, Human
caaggucuugcuc

SEQ ID NO: 1977459 - RNA, 15 nt, Human
caaggucuugcucuc

SEQ ID NO: 1977460 - RNA, 22 nt, Human
caagugugguagagugugccug

SEQ ID NO: 1977461 - RNA, 21 nt, Human
caagucuuugcuauugugaau

SEQ ID NO: 1977462 - RNA, 21 nt, Human
caagugauucuccugccucag

SEQ ID NO: 1977463 - RNA, 22 nt, Human
caagugauucuccugccucagc

SEQ ID NO: 1977464 - RNA, 19 nt, Human
caagugaaaaaggaggaag

SEQ ID NO: 1977465 - RNA, 22 nt, Human
caagugauucucaugccucagc

SEQ ID NO: 1977466 - RNA, 16 nt, Human
caagugauucuccugc

SEQ ID NO: 1977467 - RNA, 17 nt, Human
caagugauucuccugcc

SEQ ID NO: 1977468 - RNA, 21 nt, Human
caaggaugaucuaggaagacu

SEQ ID NO: 1977469 - RNA, 19 nt, Human
caaggaugccccguccccc

SEQ ID NO: 1977470 - RNA, 13 nt, Human
caaggauccugag

SEQ ID NO: 1977471 - RNA, 15 nt, Human
caaggacgcuucaca

SEQ ID NO: 1977472 - RNA, 20 nt, Human
caaggacgcuucacaggaca

SEQ ID NO: 1977473 - RNA, 21 nt, Human
caaggacgcuucacaggacag

SEQ ID NO: 1977474 - RNA, 17 nt, Human
caagcgugagccacugc

SEQ ID NO: 1977475 - RNA, 18 nt, Human
caagcgugagccacugca

SEQ ID NO: 1977476 - RNA, 18 nt, Human
caaggacagccccuccuc

SEQ ID NO: 1977477 - RNA, 13 nt, Human
caaggaagaaauu

SEQ ID NO: 1977478 - RNA, 18 nt, Human
caaggaagaaauuaacuu

SEQ ID NO: 1977479 - RNA, 21 nt, Human
caagccccugcuccagaagau

SEQ ID NO: 1977480 - RNA, 21 nt, Human
caagccaccaacauacuccca

SEQ ID NO: 1977481 - RNA, 16 nt, Human
caagcgugagccacug

SEQ ID NO: 1977482 - RNA, 17 nt, Human
caagcgcccuggccccc

SEQ ID NO: 1977483 - RNA, 18 nt, Human
caagcgcccuggccccca

SEQ ID NO: 1977484 - RNA, 19 nt, Human
caagcgcccuggcccccac

SEQ ID NO: 1977485 - RNA, 23 nt, Human
caagcgcccuggcccccacaugg

SEQ ID NO: 1977486 - RNA, 14 nt, Human
caagccguggcuuc

SEQ ID NO: 1977487 - RNA, 15 nt, Human
caagccguggcuucc

SEQ ID NO: 1977488 - RNA, 16 nt, Human
caagccguggcuuccc

SEQ ID NO: 1977489 - RNA, 18 nt, Human
caagcaccuccugccucg

SEQ ID NO: 1977490 - RNA, 20 nt, Human
caagaaacaaacaaaagcug

SEQ ID NO: 1977491 - RNA, 12 nt, Human
caagaaaagagu

SEQ ID NO: 1977492 - RNA, 17 nt, Human
caagcacuaaacaaaga

SEQ ID NO: 1977493 - RNA, 22 nt, Human
caagcacuucaggccuauguuu

SEQ ID NO: 1977494 - RNA, 17 nt, Human
caaagcuuucuuuguuu

SEQ ID NO: 1977495 - RNA, 17 nt, Human
caaaggagcucgaagga

SEQ ID NO: 1977496 - RNA, 19 nt, Human
caaaggagcucgaaggaua

SEQ ID NO: 1977497 - RNA, 16 nt, Human
caaagcuuguuaagau

SEQ ID NO: 1977498 - RNA, 18 nt, Human
caaagcuguucuuccugg

SEQ ID NO: 1977499 - RNA, 20 nt, Human
caaagcuucccgauuaacug

SEQ ID NO: 1977500 - RNA, 20 nt, Human
caaagccaaagcuaggccug

SEQ ID NO: 1977501 - RNA, 20 nt, Human
caaagcauuugacuuucugu

SEQ ID NO: 1977502 - RNA, 21 nt, Human
caaagccaaagcuaggccugg

SEQ ID NO: 1977503 - RNA, 15 nt, Human
caaagcuaggccugg

SEQ ID NO: 1977504 - RNA, 16 nt, Human
caaagcuaggccuggc

SEQ ID NO: 1977505 - RNA, 17 nt, Human
caaagcuaggccuggcc

SEQ ID NO: 1977506 - RNA, 18 nt, Human
caaagcuaggccuggcca

SEQ ID NO: 1977507 - RNA, 16 nt, Human
caaagcuguucuuccu

SEQ ID NO: 1977508 - RNA, 17 nt, Human
caaagcuguucuuccug

SEQ ID NO: 1977509 - RNA, 23 nt, Human
caaagaggcaguugcccagccuc

SEQ ID NO: 1977510 - RNA, 17 nt, Human
caaagcauguuuugcau

SEQ ID NO: 1977511 - RNA, 13 nt, Human
caaacuucuuuca

SEQ ID NO: 1977512 - RNA, 19 nt, Human
caaaaaauaucuaguaaua

SEQ ID NO: 1977513 - RNA, 23 nt, Human
caaaaaauaucuaguaauauauu

SEQ ID NO: 1977514 - RNA, 13 nt, Human
caaaaaaucuuaa

SEQ ID NO: 1977515 - RNA, 19 nt, Human
caaaaaaucuuaauacugu

SEQ ID NO: 1977516 - RNA, 16 nt, Human
caaaaaaauccagaaa

SEQ ID NO: 1977517 - RNA, 18 nt, Human
auuuuuuuacuaauagac

SEQ ID NO: 1977518 - RNA, 16 nt, Human
caaaucagcugcuacu

SEQ ID NO: 1977519 - RNA, 15 nt, Human
caaaugucuuccugg

SEQ ID NO: 1977520 - RNA, 18 nt, Human
caaaugucuuccuggauu

SEQ ID NO: 1977521 - RNA, 13 nt, Human
caaaucagcugcu

SEQ ID NO: 1977522 - RNA, 21 nt, Human
caaauguucaucaaugaauga

SEQ ID NO: 1977523 - RNA, 20 nt, Human
caaauguucaucaaugaaug

SEQ ID NO: 1977524 - RNA, 14 nt, Human
caaauguggcuccu

SEQ ID NO: 1977525 - RNA, 22 nt, Human
caaauucugcuugcuugcuuuu

SEQ ID NO: 1977526 - RNA, 17 nt, Human
caaauguguuuuggucc

SEQ ID NO: 1977527 - RNA, 15 nt, Human
caaaugugugcccag

SEQ ID NO: 1977528 - RNA, 16 nt, Human
caaaugugugcccagc

SEQ ID NO: 1977529 - RNA, 17 nt, Human
caaaugugugcccagcu

SEQ ID NO: 1977530 - RNA, 18 nt, Human
caaaugugugcccagcuu

SEQ ID NO: 1977531 - RNA, 21 nt, Human
caaaggaugcccaaagaugca

SEQ ID NO: 1977532 - RNA, 20 nt, Human
caaaguuuucaugugcucag

SEQ ID NO: 1977533 - RNA, 18 nt, Human
caaauaauaccuuagaag

SEQ ID NO: 1977534 - RNA, 19 nt, Human
caaauaauaccuuagaagg

SEQ ID NO: 1977535 - RNA, 22 nt, Human
caaauaauauguuuccuucccu

SEQ ID NO: 1977536 - RNA, 19 nt, Human
caaauacauuuaaaacauu

SEQ ID NO: 1977537 - RNA, 12 nt, Human
caaauauauuca

SEQ ID NO: 1977538 - RNA, 23 nt, Human
caaauaguaggcaagauggcaca

SEQ ID NO: 1977539 - RNA, 14 nt, Human
cacacucauccccu

SEQ ID NO: 1977540 - RNA, 18 nt, Human
cacacuucaggcucuucu

SEQ ID NO: 1977541 - RNA, 20 nt, Human
cacacuucaggcucuucucc

SEQ ID NO: 1977542 - RNA, 21 nt, Human
cacacuucaggcucuucuccu

SEQ ID NO: 1977543 - RNA, 22 nt, Human
cacacuucaggcucuucuccuu

SEQ ID NO: 1977544 - RNA, 14 nt, Human
cacacuucaggcuc

SEQ ID NO: 1977545 - RNA, 17 nt, Human
cacacuucaggcucuuc

SEQ ID NO: 1977546 - RNA, 16 nt, Human
cacacuuagcuggaga

SEQ ID NO: 1977547 - RNA, 12 nt, Human
cacacuuagcug

SEQ ID NO: 1977548 - RNA, 21 nt, Human
cacacuugacaucaacugcau

SEQ ID NO: 1977549 - RNA, 17 nt, Human
cacacuugucggcucca

SEQ ID NO: 1977550 - RNA, 18 nt, Human
cacacuugucggcuccag

SEQ ID NO: 1977551 - RNA, 22 nt, Human
cacacuugucggcuccaguccc

SEQ ID NO: 1977552 - RNA, 23 nt, Human
cacacuugucggcuccagucccc

SEQ ID NO: 1977553 - RNA, 16 nt, Human
cacagaguuguuacau

SEQ ID NO: 1977554 - RNA, 17 nt, Human
cacagaguuguuacauu

SEQ ID NO: 1977555 - RNA, 20 nt, Human
cacagacuuuagcuuucuga

SEQ ID NO: 1977556 - RNA, 18 nt, Human
cacagacucaaaugcuca

SEQ ID NO: 1977557 - RNA, 12 nt, Human
cacacagaaggg

SEQ ID NO: 1977558 - RNA, 22 nt, Human
cacacagaaggggacugccacc

SEQ ID NO: 1977559 - RNA, 19 nt, Human
cacacagaggcugccucuc

SEQ ID NO: 1977560 - RNA, 12 nt, Human
cacacagcucug

SEQ ID NO: 1977561 - RNA, 14 nt, Human
cacacaccagagcc

SEQ ID NO: 1977562 - RNA, 13 nt, Human
cacacccagccca

SEQ ID NO: 1977563 - RNA, 23 nt, Human
cacaccaaucuuacuuuguaaau

SEQ ID NO: 1977564 - RNA, 15 nt, Human
cacaccagagcccac

SEQ ID NO: 1977565 - RNA, 12 nt, Human
cacaccagagcc

SEQ ID NO: 1977566 - RNA, 13 nt, Human
cacaccagagccc

SEQ ID NO: 1977567 - RNA, 16 nt, Human
cacaccuguaauucca

SEQ ID NO: 1977568 - RNA, 23 nt, Human
cacaccuccucccacugcccacu

SEQ ID NO: 1977569 - RNA, 17 nt, Human
cacaccgggcacucaga

SEQ ID NO: 1977570 - RNA, 14 nt, Human
cacacccuguuuua

SEQ ID NO: 1977571 - RNA, 19 nt, Human
cacaccccaccugcgcuuc

SEQ ID NO: 1977572 - RNA, 16 nt, Human
cacaccccaccugcgc

SEQ ID NO: 1977573 - RNA, 17 nt, Human
cacaccccaccugcgcu

SEQ ID NO: 1977574 - RNA, 12 nt, Human
cacaccccaccu

SEQ ID NO: 1977575 - RNA, 13 nt, Human
cacaccccaccug

SEQ ID NO: 1977576 - RNA, 14 nt, Human
cacaccccaccugc

SEQ ID NO: 1977577 - RNA, 15 nt, Human
cacaccccaccugcg

SEQ ID NO: 1977578 - RNA, 19 nt, Human
caaugugaaaagaaaaaug

SEQ ID NO: 1977579 - RNA, 22 nt, Human
caaugaaugaaugaauggcuaa

SEQ ID NO: 1977580 - RNA, 18 nt, Human
caaugcaaaccaucauug

SEQ ID NO: 1977581 - RNA, 17 nt, Human
caaugcaaaccaucauu

SEQ ID NO: 1977582 - RNA, 20 nt, Human
caaugcaaaccaucauugaa

SEQ ID NO: 1977583 - RNA, 19 nt, Human
caaugcaaaccaucauuga

SEQ ID NO: 1977584 - RNA, 23 nt, Human
caaugcacuuuguucuggcucuu

SEQ ID NO: 1977585 - RNA, 13 nt, Human
caaugcagaacuc

SEQ ID NO: 1977586 - RNA, 20 nt, Human
caauaggaaaaacugauuuu

SEQ ID NO: 1977587 - RNA, 21 nt, Human
caauaggaaaaacugauuuuu

SEQ ID NO: 1977588 - RNA, 21 nt, Human
caauaggaugggcuucugugc

SEQ ID NO: 1977589 - RNA, 14 nt, Human
caauuuucagauuu

SEQ ID NO: 1977590 - RNA, 16 nt, Human
caauuuucagauuugc

SEQ ID NO: 1977591 - RNA, 19 nt, Human
caauuuucagauuugcaca

SEQ ID NO: 1977592 - RNA, 12 nt, Human
caauuuucagau

SEQ ID NO: 1977593 - RNA, 22 nt, Human
caauuuuauaaggacuuccuga

SEQ ID NO: 1977594 - RNA, 11 nt, Human
caauuuuccuu

SEQ ID NO: 1977595 - RNA, 21 nt, Human
caauuuuccuucagauauuuu

SEQ ID NO: 1977596 - RNA, 22 nt, Human
caauuuuaacuuagagcuuuuu

SEQ ID NO: 1977597 - RNA, 22 nt, Human
caaugccaaaaaaagacagggc

SEQ ID NO: 1977598 - RNA, 17 nt, Human
caauuaaagaaauaauu

SEQ ID NO: 1977599 - RNA, 18 nt, Human
caauuaaagaaauaauuu

SEQ ID NO: 1977600 - RNA, 13 nt, Human
caauuaaagaaau

SEQ ID NO: 1977601 - RNA, 15 nt, Human
caauuaaagaaauaa

SEQ ID NO: 1977602 - RNA, 21 nt, Human
cacaaauucugucucuggauu

SEQ ID NO: 1977603 - RNA, 20 nt, Human
cacaaauuaugcuaagaauu

SEQ ID NO: 1977604 - RNA, 15 nt, Human
cacaaauuucucugu

SEQ ID NO: 1977605 - RNA, 17 nt, Human
cacaaccuucuguggcu

SEQ ID NO: 1977606 - RNA, 18 nt, Human
cacaaccuucuguggcuc

SEQ ID NO: 1977607 - RNA, 19 nt, Human
cacaaccuucuguggcuca

SEQ ID NO: 1977608 - RNA, 23 nt, Human
cacaaccuucuguggcucacaga

SEQ ID NO: 1977609 - RNA, 22 nt, Human
cacaacacacagauuugagcuc

SEQ ID NO: 1977610 - RNA, 14 nt, Human
cacaacccccagcu

SEQ ID NO: 1977611 - RNA, 15 nt, Human
cacaacccccagcuc

SEQ ID NO: 1977612 - RNA, 16 nt, Human
cacaacccccagcucc

SEQ ID NO: 1977613 - RNA, 17 nt, Human
cacaacccccagcuccc

SEQ ID NO: 1977614 - RNA, 18 nt, Human
cacaacccccagcucccg

SEQ ID NO: 1977615 - RNA, 22 nt, Human
cacaaaaagauaccuuaaaauu

SEQ ID NO: 1977616 - RNA, 16 nt, Human
cacaaaaguuucucuu

SEQ ID NO: 1977617 - RNA, 18 nt, Human
cacaaaaguuucucuuuu

SEQ ID NO: 1977618 - RNA, 19 nt, Human
cacaggcagggcaggacca

SEQ ID NO: 1977619 - RNA, 19 nt, Human
cacagugagucgaggacag

SEQ ID NO: 1977620 - RNA, 20 nt, Human
cacagugagucgaggacagg

SEQ ID NO: 1977621 - RNA, 18 nt, Human
cacagugagucgaggaca

SEQ ID NO: 1977622 - RNA, 15 nt, Human
cacaggcccuuccuc

SEQ ID NO: 1977623 - RNA, 12 nt, Human
cacaggcagggc

SEQ ID NO: 1977624 - RNA, 13 nt, Human
cacaggcagggca

SEQ ID NO: 1977625 - RNA, 14 nt, Human
cacaggcagggcag

SEQ ID NO: 1977626 - RNA, 18 nt, Human
cacaggcagggcaggacc

SEQ ID NO: 1977627 - RNA, 20 nt, Human
cacaggcccggcuccaggcu

SEQ ID NO: 1977628 - RNA, 23 nt, Human
cacaggcccggcuccaggcuccu

SEQ ID NO: 1977629 - RNA, 15 nt, Human
cacauaauuaacacu

SEQ ID NO: 1977630 - RNA, 17 nt, Human
cacauacacacacacgc

SEQ ID NO: 1977631 - RNA, 23 nt, Human
cacauauaaauugucuuaaugga

SEQ ID NO: 1977632 - RNA, 22 nt, Human
cacauaauucaggaagcagcuu

SEQ ID NO: 1977633 - RNA, 10 nt, Human
cacaggcagg

SEQ ID NO: 1977634 - RNA, 16 nt, Human
cacaggcccggcucca

SEQ ID NO: 1977635 - RNA, 17 nt, Human
cacaggcccggcuccag

SEQ ID NO: 1977636 - RNA, 18 nt, Human
cacaggcccggcuccagg

SEQ ID NO: 1977637 - RNA, 19 nt, Human
cacaggcccggcuccaggc

SEQ ID NO: 1977638 - RNA, 12 nt, Human
cacaggaucagu

SEQ ID NO: 1977639 - RNA, 15 nt, Human
cacaggaucagucug

SEQ ID NO: 1977640 - RNA, 16 nt, Human
cacaggaucagucuga

SEQ ID NO: 1977641 - RNA, 15 nt, Human
cacaggaaguagagg

SEQ ID NO: 1977642 - RNA, 14 nt, Human
cacagcauuucaag

SEQ ID NO: 1977643 - RNA, 18 nt, Human
cacagaugggugcuugga

SEQ ID NO: 1977644 - RNA, 14 nt, Human
cacagaugggugcu

SEQ ID NO: 1977645 - RNA, 20 nt, Human
cacagaguuguuacauuuuu

SEQ ID NO: 1977646 - RNA, 20 nt, Human
cacagaugggugcuuggagg

SEQ ID NO: 1977647 - RNA, 16 nt, Human
cacagcagccccugca

SEQ ID NO: 1977648 - RNA, 20 nt, Human
cacagcacgggggccaagga

SEQ ID NO: 1977649 - RNA, 21 nt, Human
cacagcacuugaguaaaauac

SEQ ID NO: 1977650 - RNA, 15 nt, Human
cacagcacccuauau

SEQ ID NO: 1977651 - RNA, 22 nt, Human
caccaagccuggucagcccaaa

SEQ ID NO: 1977652 - RNA, 12 nt, Human
cacauugugcag

SEQ ID NO: 1977653 - RNA, 21 nt, Human
cacauuggucuaucuacuggc

SEQ ID NO: 1977654 - RNA, 13 nt, Human
caccacacccagc

SEQ ID NO: 1977655 - RNA, 15 nt, Human
caccacacccagccc

SEQ ID NO: 1977656 - RNA, 17 nt, Human
caccacacccagcccac

SEQ ID NO: 1977657 - RNA, 17 nt, Human
cacauuggaaacaaguc

SEQ ID NO: 1977658 - RNA, 18 nt, Human
cacauuggagauguuuag

SEQ ID NO: 1977659 - RNA, 19 nt, Human
caccaagccuggucagccc

SEQ ID NO: 1977660 - RNA, 20 nt, Human
caccaagccuggucagccca

SEQ ID NO: 1977661 - RNA, 21 nt, Human
caccaagccuggucagcccaa

SEQ ID NO: 1977662 - RNA, 15 nt, Human
caccaagcccaguua

SEQ ID NO: 1977663 - RNA, 23 nt, Human
caccacauaaggucagcucagag

SEQ ID NO: 1977664 - RNA, 19 nt, Human
caccacaugugcacaugca

SEQ ID NO: 1977665 - RNA, 15 nt, Human
caccacaugugcaca

SEQ ID NO: 1977666 - RNA, 18 nt, Human
caccacaugugcacaugc

SEQ ID NO: 1977667 - RNA, 17 nt, Human
caccacccuccuuccca

SEQ ID NO: 1977668 - RNA, 14 nt, Human
caccaccucuuugg

SEQ ID NO: 1977669 - RNA, 16 nt, Human
caccacuacauucugu

SEQ ID NO: 1977670 - RNA, 17 nt, Human
caccacuacauucuguu

SEQ ID NO: 1977671 - RNA, 18 nt, Human
caccacuacauucuguua

SEQ ID NO: 1977672 - RNA, 19 nt, Human
caccacuacauucuguuaa

SEQ ID NO: 1977673 - RNA, 20 nt, Human
caccacuacauucuguuaau

SEQ ID NO: 1977674 - RNA, 18 nt, Human
cacaugccucucucaggc

SEQ ID NO: 1977675 - RNA, 17 nt, Human
cacaugccucucucagg

SEQ ID NO: 1977676 - RNA, 13 nt, Human
cacaugccucucu

SEQ ID NO: 1977677 - RNA, 19 nt, Human
cacaucagcacgauuucug

SEQ ID NO: 1977678 - RNA, 18 nt, Human
cacaucagcacgauuucu

SEQ ID NO: 1977679 - RNA, 17 nt, Human
cacauauuucagugagg

SEQ ID NO: 1977680 - RNA, 12 nt, Human
cacauaucuguc

SEQ ID NO: 1977681 - RNA, 14 nt, Human
cacauaucugucau

SEQ ID NO: 1977682 - RNA, 22 nt, Human
cacauggugacuuuugaaaaga

SEQ ID NO: 1977683 - RNA, 12 nt, Human
cacauggugaug

SEQ ID NO: 1977684 - RNA, 15 nt, Human
cacauggugauguug

SEQ ID NO: 1977685 - RNA, 14 nt, Human
cacaugguuuuccu

SEQ ID NO: 1977686 - RNA, 23 nt, Human
cacauguccaagaagcccaggaa

SEQ ID NO: 1977687 - RNA, 14 nt, Human
cacauauuuuucca

SEQ ID NO: 1977688 - RNA, 19 nt, Human
cacaugccucucucaggcc

SEQ ID NO: 1977689 - RNA, 20 nt, Human
cacauuacuagaguuggcau

SEQ ID NO: 1977690 - RNA, 16 nt, Human
cacauguuuucaaaug

SEQ ID NO: 1977691 - RNA, 18 nt, Human
cacauguuuucaaaugga

SEQ ID NO: 1977692 - RNA, 16 nt, Human
cacauuccugaacagg

SEQ ID NO: 1977693 - RNA, 16 nt, Human
cacauuccugaugcuu

SEQ ID NO: 1977694 - RNA, 14 nt, Human
cacaugugcacaug

SEQ ID NO: 1977695 - RNA, 15 nt, Human
cacaugugcacaugc

SEQ ID NO: 1977696 - RNA, 17 nt, Human
cacaugugcacaugcac

SEQ ID NO: 1977697 - RNA, 13 nt, Human
cacauguggacuu

SEQ ID NO: 1977698 - RNA, 12 nt, Human
cacauguuuuca

SEQ ID NO: 1977699 - RNA, 13 nt, Human
cacauguuuucaa

SEQ ID NO: 1977700 - RNA, 14 nt, Human
cacauguuuucaaa

SEQ ID NO: 1977701 - RNA, 15 nt, Human
cacauguuuucaaau

SEQ ID NO: 1977702 - RNA, 17 nt, Human
caccccggccaccugcg

SEQ ID NO: 1977703 - RNA, 16 nt, Human
caccccggccaccugc

SEQ ID NO: 1977704 - RNA, 15 nt, Human
caccccggccaccug

SEQ ID NO: 1977705 - RNA, 14 nt, Human
caccccggccaccu

SEQ ID NO: 1977706 - RNA, 14 nt, Human
caccccuaaagaga

SEQ ID NO: 1977707 - RNA, 22 nt, Human
cacccccacccaagggccuggc

SEQ ID NO: 1977708 - RNA, 13 nt, Human
caccccagcccca

SEQ ID NO: 1977709 - RNA, 12 nt, Human
caccccagcccc

SEQ ID NO: 1977710 - RNA, 15 nt, Human
caccccauggccggc

SEQ ID NO: 1977711 - RNA, 12 nt, Human
caccccauccuc

SEQ ID NO: 1977712 - RNA, 12 nt, Human
cacccaccucag

SEQ ID NO: 1977713 - RNA, 13 nt, Human
cacccaccucagc

SEQ ID NO: 1977714 - RNA, 14 nt, Human
cacccaccucagcc

SEQ ID NO: 1977715 - RNA, 16 nt, Human
cacccaccucagccuc

SEQ ID NO: 1977716 - RNA, 20 nt, Human
cacccaccaucaugucuggc

SEQ ID NO: 1977717 - RNA, 22 nt, Human
cacccaccaucaugucuggcua

SEQ ID NO: 1977718 - RNA, 13 nt, Human
caccagaagccca

SEQ ID NO: 1977719 - RNA, 14 nt, Human
caccagaagcccag

SEQ ID NO: 1977720 - RNA, 15 nt, Human
caccagaagcccaga

SEQ ID NO: 1977721 - RNA, 16 nt, Human
caccacucaagaccaa

SEQ ID NO: 1977722 - RNA, 18 nt, Human
cacccaagggccuggccu

SEQ ID NO: 1977723 - RNA, 17 nt, Human
cacccaagggccuggcc

SEQ ID NO: 1977724 - RNA, 16 nt, Human
caccagaagcccagaa

SEQ ID NO: 1977725 - RNA, 17 nt, Human
caccagaagcccagaau

SEQ ID NO: 1977726 - RNA, 16 nt, Human
cacccaagggccuggc

SEQ ID NO: 1977727 - RNA, 23 nt, Human
cacccaagggccuggccugagcu

SEQ ID NO: 1977728 - RNA, 21 nt, Human
cacccaagggccuggccugag

SEQ ID NO: 1977729 - RNA, 20 nt, Human
cacccaagggccuggccuga

SEQ ID NO: 1977730 - RNA, 19 nt, Human
cacccaagggccuggccug

SEQ ID NO: 1977731 - RNA, 15 nt, Human
cacccacaggcaugu

SEQ ID NO: 1977732 - RNA, 15 nt, Human
caccccuaaagagau

SEQ ID NO: 1977733 - RNA, 11 nt, Human
uuuguggggag

SEQ ID NO: 1977734 - RNA, 13 nt, Human
uuuguggugauuu

SEQ ID NO: 1977735 - RNA, 12 nt, Human
uuuguguaaauu

SEQ ID NO: 1977736 - RNA, 21 nt, Human
uuuguguaaauuauugaugaa

SEQ ID NO: 1977737 - RNA, 21 nt, Human
uugaagagguuuuaaagcuuc

SEQ ID NO: 1977738 - RNA, 19 nt, Human
uugaagaggggagcucagu

SEQ ID NO: 1977739 - RNA, 14 nt, Human
uugaagagugaaau

SEQ ID NO: 1977740 - RNA, 13 nt, Human
uugaagauucuau

SEQ ID NO: 1977741 - RNA, 22 nt, Human
uugaagauucuauguuaauauu

SEQ ID NO: 1977742 - RNA, 23 nt, Human
uugaagauucuauguuaauauuu

SEQ ID NO: 1977743 - RNA, 20 nt, Human
uugaagcacagugaucaagu

SEQ ID NO: 1977744 - RNA, 16 nt, Human
uugaagcaaacaguug

SEQ ID NO: 1977745 - RNA, 16 nt, Human
uugaagagguuuuaaa

SEQ ID NO: 1977746 - RNA, 18 nt, Human
uugaagagcagcuccuuc

SEQ ID NO: 1977747 - RNA, 20 nt, Human
uugaacuuugaccucugcag

SEQ ID NO: 1977748 - RNA, 17 nt, Human
uugaacuuugaccucug

SEQ ID NO: 1977749 - RNA, 18 nt, Human
uugaacuuugaccucugc

SEQ ID NO: 1977750 - RNA, 22 nt, Human
uugaaugacuaagaggaaagua

SEQ ID NO: 1977751 - RNA, 16 nt, Human
uugaaugaugccauga

SEQ ID NO: 1977752 - RNA, 12 nt, Human
uugaaugaugcc

SEQ ID NO: 1977753 - RNA, 15 nt, Human
uugaacuuugaccuc

SEQ ID NO: 1977754 - RNA, 11 nt, Human
uugaaacauug

SEQ ID NO: 1977755 - RNA, 12 nt, Human
uugaaacauugc

SEQ ID NO: 1977756 - RNA, 14 nt, Human
uugaaacauugcuu

SEQ ID NO: 1977757 - RNA, 18 nt, Human
uugaaacauugcuuuuaa

SEQ ID NO: 1977758 - RNA, 19 nt, Human
uugaaacauugcuuuuaaa

SEQ ID NO: 1977759 - RNA, 14 nt, Human
uugaaaauaguuua

SEQ ID NO: 1977760 - RNA, 23 nt, Human
uugaaaauaguuuauuuuaaaac

SEQ ID NO: 1977761 - RNA, 14 nt, Human
uucuuucccuuccu

SEQ ID NO: 1977762 - RNA, 18 nt, Human
uugaaaauuaacaugaau

SEQ ID NO: 1977763 - RNA, 11 nt, Human
uucuuuacaaa

SEQ ID NO: 1977764 - RNA, 21 nt, Human
uucuuuccugaggcugggcuc

SEQ ID NO: 1977765 - RNA, 21 nt, Human
uugaaaaucuuauaauuuaaa

SEQ ID NO: 1977766 - RNA, 14 nt, Human
uucuggccucccac

SEQ ID NO: 1977767 - RNA, 15 nt, Human
uucuggccucccaca

SEQ ID NO: 1977768 - RNA, 16 nt, Human
uucuggcuaugcauuu

SEQ ID NO: 1977769 - RNA, 20 nt, Human
uucuggcagaguugaagaca

SEQ ID NO: 1977770 - RNA, 15 nt, Human
uucuggcagaggagg

SEQ ID NO: 1977771 - RNA, 20 nt, Human
uucuaaguugaguauauuau

SEQ ID NO: 1977772 - RNA, 23 nt, Human
uucuaagucaaacacuugugacu

SEQ ID NO: 1977773 - RNA, 11 nt, Human
uucuguauuug

SEQ ID NO: 1977774 - RNA, 13 nt, Human
uucuguauuugaa

SEQ ID NO: 1977775 - RNA, 18 nt, Human
uucuguauagacaggaga

SEQ ID NO: 1977776 - RNA, 23 nt, Human
uucuguauagacaggagaagaaa

SEQ ID NO: 1977777 - RNA, 24 nt, Human
uucugugcccagaauacugaugga

SEQ ID NO: 1977778 - RNA, 19 nt, Human
uucugugcccagaauacug

SEQ ID NO: 1977779 - RNA, 20 nt, Human
uucugugcccagaauacuga

SEQ ID NO: 1977780 - RNA, 23 nt, Human
uucugugcccagaauacugaugg

SEQ ID NO: 1977781 - RNA, 23 nt, Human
uucugugcuguuacaguuuucuu

SEQ ID NO: 1977782 - RNA, 17 nt, Human
uucuuagggaaggauac

SEQ ID NO: 1977783 - RNA, 13 nt, Human
uucuucagagacu

SEQ ID NO: 1977784 - RNA, 17 nt, Human
uucuuauguugcccagu

SEQ ID NO: 1977785 - RNA, 17 nt, Human
uucuuauuacuagacug

SEQ ID NO: 1977786 - RNA, 14 nt, Human
uucuuguguguuua

SEQ ID NO: 1977787 - RNA, 17 nt, Human
uucuuauuccauauuag

SEQ ID NO: 1977788 - RNA, 13 nt, Human
uugcacugaaguu

SEQ ID NO: 1977789 - RNA, 16 nt, Human
uugcacugaaguuuga

SEQ ID NO: 1977790 - RNA, 11 nt, Human
uugcacugaag

SEQ ID NO: 1977791 - RNA, 12 nt, Human
uugcacugaagu

SEQ ID NO: 1977792 - RNA, 15 nt, Human
uugcacuuucagacu

SEQ ID NO: 1977793 - RNA, 21 nt, Human
uugcacuuucagacucucucu

SEQ ID NO: 1977794 - RNA, 17 nt, Human
uugcacuuuuucuuaau

SEQ ID NO: 1977795 - RNA, 22 nt, Human
uugcacuuuuucuuaaucauuu

SEQ ID NO: 1977796 - RNA, 17 nt, Human
uugauucauaaugacuu

SEQ ID NO: 1977797 - RNA, 13 nt, Human
uugauucauaaug

SEQ ID NO: 1977798 - RNA, 18 nt, Human
uugcagcucagaaccaca

SEQ ID NO: 1977799 - RNA, 23 nt, Human
uugcagacaggcaagcaccuccu

SEQ ID NO: 1977800 - RNA, 17 nt, Human
uugcagcacagcugaga

SEQ ID NO: 1977801 - RNA, 16 nt, Human
uugcauaacguauaaa

SEQ ID NO: 1977802 - RNA, 19 nt, Human
uugccaguaacacaggcca

SEQ ID NO: 1977803 - RNA, 12 nt, Human
uugccagcccau

SEQ ID NO: 1977804 - RNA, 15 nt, Human
uugccagcccauuug

SEQ ID NO: 1977805 - RNA, 20 nt, Human
uugccagcccauuugggcag

SEQ ID NO: 1977806 - RNA, 17 nt, Human
uugccagcugcugagcc

SEQ ID NO: 1977807 - RNA, 20 nt, Human
uugccagcugcugagccgca

SEQ ID NO: 1977808 - RNA, 22 nt, Human
uugccagcugcugagccgcaga

SEQ ID NO: 1977809 - RNA, 16 nt, Human
uugccauguuggccag

SEQ ID NO: 1977810 - RNA, 17 nt, Human
uugccauguuggccagg

SEQ ID NO: 1977811 - RNA, 18 nt, Human
uugccauguuggccaggc

SEQ ID NO: 1977812 - RNA, 19 nt, Human
uugccauguuggccaggcu

SEQ ID NO: 1977813 - RNA, 15 nt, Human
uugccaucucugcuc

SEQ ID NO: 1977814 - RNA, 17 nt, Human
uugccaucucugcucca

SEQ ID NO: 1977815 - RNA, 16 nt, Human
uugauaugugaacagu

SEQ ID NO: 1977816 - RNA, 16 nt, Human
uugauaugcuuauaca

SEQ ID NO: 1977817 - RNA, 20 nt, Human
uugaggcuuauauuugugua

SEQ ID NO: 1977818 - RNA, 17 nt, Human
uugaucaguaguuugca

SEQ ID NO: 1977819 - RNA, 18 nt, Human
uugaucaguaguuugcau

SEQ ID NO: 1977820 - RNA, 22 nt, Human
uugauauuuguauuuauucuuu

SEQ ID NO: 1977821 - RNA, 22 nt, Human
uugauauuuucaacgcagcccu

SEQ ID NO: 1977822 - RNA, 13 nt, Human
uugauauuuguau

SEQ ID NO: 1977823 - RNA, 15 nt, Human
uugauauuuguauuu

SEQ ID NO: 1977824 - RNA, 16 nt, Human
uugauucagcucugca

SEQ ID NO: 1977825 - RNA, 23 nt, Human
uugauucagacagcugccuggga

SEQ ID NO: 1977826 - RNA, 21 nt, Human
uugauucagacagcugccugg

SEQ ID NO: 1977827 - RNA, 17 nt, Human
uugauucagacagcugc

SEQ ID NO: 1977828 - RNA, 17 nt, Human
uugauccagaaagaaaa

SEQ ID NO: 1977829 - RNA, 14 nt, Human
uugaucucacauuu

SEQ ID NO: 1977830 - RNA, 12 nt, Human
uugaucucccca

SEQ ID NO: 1977831 - RNA, 18 nt, Human
uugaucucccuuuccuau

SEQ ID NO: 1977832 - RNA, 14 nt, Human
uugagccugggagg

SEQ ID NO: 1977833 - RNA, 14 nt, Human
uugagccuugaacu

SEQ ID NO: 1977834 - RNA, 15 nt, Human
uugagccuugaacuu

SEQ ID NO: 1977835 - RNA, 16 nt, Human
uugagccuugaacuuu

SEQ ID NO: 1977836 - RNA, 15 nt, Human
uugagcuaugacuua

SEQ ID NO: 1977837 - RNA, 16 nt, Human
uugagcuaugacuuaa

SEQ ID NO: 1977838 - RNA, 13 nt, Human
uugagcucagccc

SEQ ID NO: 1977839 - RNA, 12 nt, Human
uugagcucccac

SEQ ID NO: 1977840 - RNA, 22 nt, Human
uugagcucccacuucugccaga

SEQ ID NO: 1977841 - RNA, 13 nt, Human
uugagcuccuggg

SEQ ID NO: 1977842 - RNA, 19 nt, Human
uugagccuugaacuuugac

SEQ ID NO: 1977843 - RNA, 15 nt, Human
uugagccugucaaga

SEQ ID NO: 1977844 - RNA, 11 nt, Human
uugagcuauga

SEQ ID NO: 1977845 - RNA, 14 nt, Human
uugagcuaugacuu

SEQ ID NO: 1977846 - RNA, 16 nt, Human
uugaggagcacugaaa

SEQ ID NO: 1977847 - RNA, 14 nt, Human
uugaggauuaguuu

SEQ ID NO: 1977848 - RNA, 17 nt, Human
uugaggauuaguuuaga

SEQ ID NO: 1977849 - RNA, 18 nt, Human
uugaggauuaguuuagaa

SEQ ID NO: 1977850 - RNA, 19 nt, Human
uugaggauuaguuuagaac

SEQ ID NO: 1977851 - RNA, 15 nt, Human
uugucucuucuccuu

SEQ ID NO: 1977852 - RNA, 17 nt, Human
uugucugaagucacugc

SEQ ID NO: 1977853 - RNA, 18 nt, Human
uugucugaagucacugca

SEQ ID NO: 1977854 - RNA, 13 nt, Human
uugucuuaaugga

SEQ ID NO: 1977855 - RNA, 22 nt, Human
uugucuuaaaaaguggaaaaau

SEQ ID NO: 1977856 - RNA, 20 nt, Human
uugucuaugggacucaaugc

SEQ ID NO: 1977857 - RNA, 22 nt, Human
uugucaagaauagcauuguaaa

SEQ ID NO: 1977858 - RNA, 23 nt, Human
uugucuauuuuucucuucauauu

SEQ ID NO: 1977859 - RNA, 22 nt, Human
uugucaaaguggugagaggcau

SEQ ID NO: 1977860 - RNA, 14 nt, Human
uugucuaugggacu

SEQ ID NO: 1977861 - RNA, 15 nt, Human
uuguauuuuuccaga

SEQ ID NO: 1977862 - RNA, 16 nt, Human
uuguauuuuuguuguu

SEQ ID NO: 1977863 - RNA, 19 nt, Human
uuguauuuuuguuguuggg

SEQ ID NO: 1977864 - RNA, 22 nt, Human
uuguaugaaagauggcugugcc

SEQ ID NO: 1977865 - RNA, 20 nt, Human
uuguaugauccuaaugaaug

SEQ ID NO: 1977866 - RNA, 12 nt, Human
uuguaugaaaac

SEQ ID NO: 1977867 - RNA, 13 nt, Human
uuguaugaucugu

SEQ ID NO: 1977868 - RNA, 19 nt, Human
uuguaugaucugugccuuu

SEQ ID NO: 1977869 - RNA, 19 nt, Human
uuguaugcaagcaguuuca

SEQ ID NO: 1977870 - RNA, 20 nt, Human
uuguaugcaagcaguuucaa

SEQ ID NO: 1977871 - RNA, 22 nt, Human
uuguaugcaagcaguuucaaua

SEQ ID NO: 1977872 - RNA, 24 nt, Human
uuguaugcaagcaguuucaauaaa

SEQ ID NO: 1977873 - RNA, 15 nt, Human
uuguagauuugauuu

SEQ ID NO: 1977874 - RNA, 15 nt, Human
uuguagcauccugga

SEQ ID NO: 1977875 - RNA, 14 nt, Human
uuguaucugucuuu

SEQ ID NO: 1977876 - RNA, 15 nt, Human
uuguaucugucuuuc

SEQ ID NO: 1977877 - RNA, 16 nt, Human
uuguaucugucuuucc

SEQ ID NO: 1977878 - RNA, 18 nt, Human
uuguaucugucuuuccac

SEQ ID NO: 1977879 - RNA, 17 nt, Human
uuguagaagucacauuc

SEQ ID NO: 1977880 - RNA, 20 nt, Human
uuguacuuucuguuaaaaug

SEQ ID NO: 1977881 - RNA, 22 nt, Human
uuguacuuucuguuaaaaugca

SEQ ID NO: 1977882 - RNA, 22 nt, Human
uuguagaagucacauuccugaa

SEQ ID NO: 1977883 - RNA, 18 nt, Human
uuguacuuuagggaagua

SEQ ID NO: 1977884 - RNA, 15 nt, Human
uuguacuuuaaaaau

SEQ ID NO: 1977885 - RNA, 13 nt, Human
uuguacuuucugu

SEQ ID NO: 1977886 - RNA, 15 nt, Human
uuguacuuucuguua

SEQ ID NO: 1977887 - RNA, 17 nt, Human
uuguacuuucuguuaaa

SEQ ID NO: 1977888 - RNA, 20 nt, Human
uuguaaaauggugugaccac

SEQ ID NO: 1977889 - RNA, 12 nt, Human
uuguaaacuuug

SEQ ID NO: 1977890 - RNA, 13 nt, Human
uuguaaacuuuga

SEQ ID NO: 1977891 - RNA, 14 nt, Human
uuguaaacuuugaa

SEQ ID NO: 1977892 - RNA, 15 nt, Human
uuguaaacuuugaaa

SEQ ID NO: 1977893 - RNA, 17 nt, Human
uuguaaacuuugaaaua

SEQ ID NO: 1977894 - RNA, 16 nt, Human
uuguaccgcaauguga

SEQ ID NO: 1977895 - RNA, 18 nt, Human
uuguaaacuuugaaauau

SEQ ID NO: 1977896 - RNA, 19 nt, Human
uuguaaacuuugaaauaua

SEQ ID NO: 1977897 - RNA, 21 nt, Human
uuguaaacuuugaaauauaug

SEQ ID NO: 1977898 - RNA, 17 nt, Human
uuguaaagaaaaauauu

SEQ ID NO: 1977899 - RNA, 14 nt, Human
uugggaccccuggu

SEQ ID NO: 1977900 - RNA, 15 nt, Human
uugggaccccuggug

SEQ ID NO: 1977901 - RNA, 16 nt, Human
uugggaccccuggugg

SEQ ID NO: 1977902 - RNA, 20 nt, Human
uugggaccccuggugguuca

SEQ ID NO: 1977903 - RNA, 17 nt, Human
uugggaagagcuuagaa

SEQ ID NO: 1977904 - RNA, 18 nt, Human
uugggaagagcuuagaaa

SEQ ID NO: 1977905 - RNA, 22 nt, Human
uugggaaguuaaagggaagaaa

SEQ ID NO: 1977906 - RNA, 14 nt, Human
uugggaauuuuauu

SEQ ID NO: 1977907 - RNA, 15 nt, Human
uugggacccaguggc

SEQ ID NO: 1977908 - RNA, 20 nt, Human
uugggacccaguggcagggc

SEQ ID NO: 1977909 - RNA, 22 nt, Human
uugggacccaguggcagggcac

SEQ ID NO: 1977910 - RNA, 23 nt, Human
uuggcuucacggaagagccuugc

SEQ ID NO: 1977911 - RNA, 13 nt, Human
uuggcuuggcccu

SEQ ID NO: 1977912 - RNA, 16 nt, Human
uuggcuugccauuuuu

SEQ ID NO: 1977913 - RNA, 19 nt, Human
uuggcagguaggaauauua

SEQ ID NO: 1977914 - RNA, 20 nt, Human
uuggcagguaggaauauuau

SEQ ID NO: 1977915 - RNA, 19 nt, Human
uugggauccaggccccucc

SEQ ID NO: 1977916 - RNA, 21 nt, Human
uugggauccaggccccucccu

SEQ ID NO: 1977917 - RNA, 19 nt, Human
uugggcaauauucucugua

SEQ ID NO: 1977918 - RNA, 21 nt, Human
uugggcaauauucucuguaca

SEQ ID NO: 1977919 - RNA, 22 nt, Human
uugggcaauauucucuguacau

SEQ ID NO: 1977920 - RNA, 15 nt, Human
uuggucugugagaug

SEQ ID NO: 1977921 - RNA, 12 nt, Human
uuguaaaauggu

SEQ ID NO: 1977922 - RNA, 13 nt, Human
uuguaaaauggug

SEQ ID NO: 1977923 - RNA, 20 nt, Human
uuggucugacccacugcuuu

SEQ ID NO: 1977924 - RNA, 21 nt, Human
uugguccuggaggcucaaauu

SEQ ID NO: 1977925 - RNA, 16 nt, Human
uuggcagcucuacucu

SEQ ID NO: 1977926 - RNA, 16 nt, Human
uuggcaccuucccccu

SEQ ID NO: 1977927 - RNA, 23 nt, Human
uuggcaccuucccccucccccag

SEQ ID NO: 1977928 - RNA, 22 nt, Human
uuggcagaugcagcucuuccug

SEQ ID NO: 1977929 - RNA, 13 nt, Human
uuggcagaugcag

SEQ ID NO: 1977930 - RNA, 16 nt, Human
uuggcagaugcagcuc

SEQ ID NO: 1977931 - RNA, 21 nt, Human
uuggcagaugcagcucuuccu

SEQ ID NO: 1977932 - RNA, 22 nt, Human
uuggauuuuauguugacauuug

SEQ ID NO: 1977933 - RNA, 24 nt, Human
uuggauuuuauguugacauuuguu

SEQ ID NO: 1977934 - RNA, 20 nt, Human
uuggcaauaaauuuugaaaa

SEQ ID NO: 1977935 - RNA, 22 nt, Human
uuggcaauaaauuuugaaaagu

SEQ ID NO: 1977936 - RNA, 21 nt, Human
uuggacccugaggcccagagg

SEQ ID NO: 1977937 - RNA, 19 nt, Human
uuggacccugaggcccaga

SEQ ID NO: 1977938 - RNA, 18 nt, Human
uuggacccugaggcccag

SEQ ID NO: 1977939 - RNA, 15 nt, Human
uuggacccugaggcc

SEQ ID NO: 1977940 - RNA, 14 nt, Human
uuggauuuggagag

SEQ ID NO: 1977941 - RNA, 19 nt, Human
uuggauuuggagagaaaua

SEQ ID NO: 1977942 - RNA, 13 nt, Human
uuggauuuuaugu

SEQ ID NO: 1977943 - RNA, 17 nt, Human
uuggauuuuauguugac

SEQ ID NO: 1977944 - RNA, 18 nt, Human
uuggauuuuauguugaca

SEQ ID NO: 1977945 - RNA, 20 nt, Human
uuggauuuuauguugacauu

SEQ ID NO: 1977946 - RNA, 15 nt, Human
uuggauuguccccga

SEQ ID NO: 1977947 - RNA, 15 nt, Human
uuggacauuuuaugu

SEQ ID NO: 1977948 - RNA, 19 nt, Human
uuggaagcuccgcuuucua

SEQ ID NO: 1977949 - RNA, 19 nt, Human
uuggaagcagguuaaaugu

SEQ ID NO: 1977950 - RNA, 20 nt, Human
uuggaagcagguuaaauguu

SEQ ID NO: 1977951 - RNA, 21 nt, Human
uuggaagcagguuaaauguuu

SEQ ID NO: 1977952 - RNA, 22 nt, Human
uuggaagcacaccaaucuuacu

SEQ ID NO: 1977953 - RNA, 18 nt, Human
uuggaagcagguuaaaug

SEQ ID NO: 1977954 - RNA, 19 nt, Human
uugcugugacagugauggc

SEQ ID NO: 1977955 - RNA, 18 nt, Human
uuggacaaaauggaauac

SEQ ID NO: 1977956 - RNA, 23 nt, Human
uuggaauuagaacccuugcacag

SEQ ID NO: 1977957 - RNA, 21 nt, Human
uuggaaugcacucagacugua

SEQ ID NO: 1977958 - RNA, 23 nt, Human
uuggaaugcacucagacuguaua

SEQ ID NO: 1977959 - RNA, 18 nt, Human
uugcugucccuuuuccuu

SEQ ID NO: 1977960 - RNA, 16 nt, Human
uugcugucccuuuucc

SEQ ID NO: 1977961 - RNA, 14 nt, Human
uugcuggaaagagc

SEQ ID NO: 1977962 - RNA, 16 nt, Human
uugcugcuugaggcaa

SEQ ID NO: 1977963 - RNA, 14 nt, Human
uugcugcuugaggc

SEQ ID NO: 1977964 - RNA, 20 nt, Human
uugccauguuggccaggcug

SEQ ID NO: 1977965 - RNA, 21 nt, Human
uugccauguuggccaggcugg

SEQ ID NO: 1977966 - RNA, 13 nt, Human
uugccaugugcuu

SEQ ID NO: 1977967 - RNA, 20 nt, Human
uugccaugugcuucugccac

SEQ ID NO: 1977968 - RNA, 16 nt, Human
uugccuugacaaacuu

SEQ ID NO: 1977969 - RNA, 12 nt, Human
uugccuuucugu

SEQ ID NO: 1977970 - RNA, 14 nt, Human
uugccuuucugugu

SEQ ID NO: 1977971 - RNA, 17 nt, Human
uugccuuucuguguuua

SEQ ID NO: 1977972 - RNA, 19 nt, Human
uugccuuucuguguuuauu

SEQ ID NO: 1977973 - RNA, 14 nt, Human
uugccuuugaagag

SEQ ID NO: 1977974 - RNA, 17 nt, Human
uugccuuugaagaguga

SEQ ID NO: 1977975 - RNA, 21 nt, Human
uugcgaauauuuuguaaauua

SEQ ID NO: 1977976 - RNA, 21 nt, Human
uuuaucgcccuggcaggcagg

SEQ ID NO: 1977977 - RNA, 17 nt, Human
uuuaucuugaaggaaaa

SEQ ID NO: 1977978 - RNA, 21 nt, Human
uuuaucuugaaggaaaaauuc

SEQ ID NO: 1977979 - RNA, 15 nt, Human
uuuaucccuuaagaa

SEQ ID NO: 1977980 - RNA, 16 nt, Human
uuuaucccuuaagaau

SEQ ID NO: 1977981 - RNA, 18 nt, Human
uuuaucccuuaagaauga

SEQ ID NO: 1977982 - RNA, 17 nt, Human
uuuauaccuguuuaaau

SEQ ID NO: 1977983 - RNA, 18 nt, Human
uuuauaccuguuuaaauu

SEQ ID NO: 1977984 - RNA, 15 nt, Human
uuuauacgagaacag

SEQ ID NO: 1977985 - RNA, 16 nt, Human
uuuauaccuguuuaaa

SEQ ID NO: 1977986 - RNA, 12 nt, Human
uuuauacauaaa

SEQ ID NO: 1977987 - RNA, 20 nt, Human
uuuauacauaaacaagacca

SEQ ID NO: 1977988 - RNA, 18 nt, Human
uuuauaaacuuuaccuuu

SEQ ID NO: 1977989 - RNA, 23 nt, Human
uuuauacagaugccauauagugu

SEQ ID NO: 1977990 - RNA, 22 nt, Human
uuuagacccuauugcugcuuga

SEQ ID NO: 1977991 - RNA, 21 nt, Human
uuuagacauguaauuugugua

SEQ ID NO: 1977992 - RNA, 18 nt, Human
uuuaguugcaacuuugua

SEQ ID NO: 1977993 - RNA, 17 nt, Human
uuuaguugcaacuuugu

SEQ ID NO: 1977994 - RNA, 19 nt, Human
uuuagacccuauugcugcu

SEQ ID NO: 1977995 - RNA, 16 nt, Human
uuuacccuauaucuau

SEQ ID NO: 1977996 - RNA, 18 nt, Human
uuuacccuauaucuauaa

SEQ ID NO: 1977997 - RNA, 15 nt, Human
uuuacccuauaucua

SEQ ID NO: 1977998 - RNA, 14 nt, Human
uuuaacagaaaugu

SEQ ID NO: 1977999 - RNA, 15 nt, Human
uuuaacagaaaugua

SEQ ID NO: 1978000 - RNA, 14 nt, Human
uuuaaccucuaaau

SEQ ID NO: 1978001 - RNA, 15 nt, Human
uuuaauaaacacucu

SEQ ID NO: 1978002 - RNA, 14 nt, Human
uuuaauaaacacuc

SEQ ID NO: 1978003 - RNA, 15 nt, Human
uuuaauaauuagaaa

SEQ ID NO: 1978004 - RNA, 13 nt, Human
uuuaauaaaccau

SEQ ID NO: 1978005 - RNA, 22 nt, Human
uuuaauaaacacucuugaaaaa

SEQ ID NO: 1978006 - RNA, 20 nt, Human
uuuacagaggacaguauuug

SEQ ID NO: 1978007 - RNA, 21 nt, Human
uuuacagagaugucucuuaua

SEQ ID NO: 1978008 - RNA, 13 nt, Human
uuuacagagacag

SEQ ID NO: 1978009 - RNA, 16 nt, Human
uuuaauaugaaauuuu

SEQ ID NO: 1978010 - RNA, 15 nt, Human
uuuaauaugaaauuu

SEQ ID NO: 1978011 - RNA, 19 nt, Human
uuuacccacacacagauaa

SEQ ID NO: 1978012 - RNA, 16 nt, Human
uuuacauggcuggagc

SEQ ID NO: 1978013 - RNA, 13 nt, Human
uuuacagcugccu

SEQ ID NO: 1978014 - RNA, 19 nt, Human
uuuacaguguuucuggcuu

SEQ ID NO: 1978015 - RNA, 15 nt, Human
uuuacaguuacuuuu

SEQ ID NO: 1978016 - RNA, 19 nt, Human
uuuacaguuacuuuuccuu

SEQ ID NO: 1978017 - RNA, 21 nt, Human
uuuacaguuacuuuuccuugc

SEQ ID NO: 1978018 - RNA, 15 nt, Human
uuuacaguuauagaa

SEQ ID NO: 1978019 - RNA, 20 nt, Human
uuuaaaagcccuuuccaaag

SEQ ID NO: 1978020 - RNA, 13 nt, Human
uuuaaaauaaacu

SEQ ID NO: 1978021 - RNA, 12 nt, Human
uuuaaaauacug

SEQ ID NO: 1978022 - RNA, 15 nt, Human
uuuaaaauacuguag

SEQ ID NO: 1978023 - RNA, 16 nt, Human
uuuaaaauacuguaga

SEQ ID NO: 1978024 - RNA, 17 nt, Human
uuuaaaauacuguagau

SEQ ID NO: 1978025 - RNA, 18 nt, Human
uuuaaaauacuguagaua

SEQ ID NO: 1978026 - RNA, 16 nt, Human
uuuaaaaucuuauuaa

SEQ ID NO: 1978027 - RNA, 20 nt, Human
uuuaaaaucuuauuaaaguu

SEQ ID NO: 1978028 - RNA, 21 nt, Human
uuuaaaaucuuauuaaaguuu

SEQ ID NO: 1978029 - RNA, 22 nt, Human
uuuaaaaucuuauuaaaguuuc

SEQ ID NO: 1978030 - RNA, 18 nt, Human
uuuaaaagaugcaaugua

SEQ ID NO: 1978031 - RNA, 19 nt, Human
uuuaaaagcccuuuccaaa

SEQ ID NO: 1978032 - RNA, 20 nt, Human
uuuaaaagauaaauauuaua

SEQ ID NO: 1978033 - RNA, 13 nt, Human
uuuaaaagauaca

SEQ ID NO: 1978034 - RNA, 13 nt, Human
uuuaaaacuacuu

SEQ ID NO: 1978035 - RNA, 16 nt, Human
uuuaaaacuacuuagc

SEQ ID NO: 1978036 - RNA, 13 nt, Human
uuuaacagaaaug

SEQ ID NO: 1978037 - RNA, 21 nt, Human
uuuaaacucugaauuuaucuu

SEQ ID NO: 1978038 - RNA, 15 nt, Human
uuuaaacugucgugu

SEQ ID NO: 1978039 - RNA, 16 nt, Human
uuuaaaauugugaugu

SEQ ID NO: 1978040 - RNA, 19 nt, Human
uuuaaaauucucuuccaac

SEQ ID NO: 1978041 - RNA, 13 nt, Human
uuuaaaauguaca

SEQ ID NO: 1978042 - RNA, 20 nt, Human
uuuaaaauguacauguauua

SEQ ID NO: 1978043 - RNA, 21 nt, Human
uuuaaaauguacauguauuaa

SEQ ID NO: 1978044 - RNA, 13 nt, Human
uuuaaaauuucuu

SEQ ID NO: 1978045 - RNA, 19 nt, Human
uuuaaaauuucuuagaaaa

SEQ ID NO: 1978046 - RNA, 14 nt, Human
uuuaaaauuuuaag

SEQ ID NO: 1978047 - RNA, 16 nt, Human
uuuaaaaugagaaauc

SEQ ID NO: 1978048 - RNA, 12 nt, Human
uuuaaaaugucu

SEQ ID NO: 1978049 - RNA, 15 nt, Human
uuguuuagaagaagu

SEQ ID NO: 1978050 - RNA, 18 nt, Human
uuguuuagaagaagugug

SEQ ID NO: 1978051 - RNA, 12 nt, Human
uuguuuaauggu

SEQ ID NO: 1978052 - RNA, 23 nt, Human
uuguuuaaugguaguuuuacagu

SEQ ID NO: 1978053 - RNA, 15 nt, Human
uuguuauuuauugaa

SEQ ID NO: 1978054 - RNA, 20 nt, Human
uuguuauuuauugaaaugau

SEQ ID NO: 1978055 - RNA, 12 nt, Human
uugucuuucugg

SEQ ID NO: 1978056 - RNA, 18 nt, Human
uugucuuguguauuucag

SEQ ID NO: 1978057 - RNA, 15 nt, Human
uugucuuuggacccu

SEQ ID NO: 1978058 - RNA, 15 nt, Human
uugucuuauugacag

SEQ ID NO: 1978059 - RNA, 19 nt, Human
uugucuuccuauuucagaa

SEQ ID NO: 1978060 - RNA, 17 nt, Human
uugucuuaauggaugaa

SEQ ID NO: 1978061 - RNA, 19 nt, Human
uugucuuaauggaugaaau

SEQ ID NO: 1978062 - RNA, 23 nt, Human
uugucuuccuauuucagaaguuu

SEQ ID NO: 1978063 - RNA, 24 nt, Human
uugucuuuggacccugaggcccag

SEQ ID NO: 1978064 - RNA, 20 nt, Human
uugucuuuggacccugaggc

SEQ ID NO: 1978065 - RNA, 14 nt, Human
uugucuuucugggg

SEQ ID NO: 1978066 - RNA, 17 nt, Human
uuguuuaucuagaugua

SEQ ID NO: 1978067 - RNA, 19 nt, Human
uuguuuaucuagauguaaa

SEQ ID NO: 1978068 - RNA, 19 nt, Human
uuguuuagauuuuguguuu

SEQ ID NO: 1978069 - RNA, 20 nt, Human
uuguuuagauuuuguguuua

SEQ ID NO: 1978070 - RNA, 23 nt, Human
uuguuuagucuuuauacugcaaa

SEQ ID NO: 1978071 - RNA, 16 nt, Human
uuguuucuuucucuga

SEQ ID NO: 1978072 - RNA, 19 nt, Human
uuguuucuuucucugagga

SEQ ID NO: 1978073 - RNA, 20 nt, Human
uuguuuggggaugagaaagg

SEQ ID NO: 1978074 - RNA, 22 nt, Human
uuguuuguauguauaauucaaa

SEQ ID NO: 1978075 - RNA, 21 nt, Human
uuguuugguuauagugcaaua

SEQ ID NO: 1978076 - RNA, 13 nt, Human
uuguuuguaugua

SEQ ID NO: 1978077 - RNA, 19 nt, Human
uuguuuguauguauaauuc

SEQ ID NO: 1978078 - RNA, 18 nt, Human
uuguuugguuauagugca

SEQ ID NO: 1978079 - RNA, 12 nt, Human
uuguuuguuuca

SEQ ID NO: 1978080 - RNA, 13 nt, Human
uuguuuguuucaa

SEQ ID NO: 1978081 - RNA, 19 nt, Human
uuguuuguuaauaaagugc

SEQ ID NO: 1978082 - RNA, 18 nt, Human
uuuaaaacaccuucuaua

SEQ ID NO: 1978083 - RNA, 23 nt, Human
uuucauuuugcuuuaauuuuagc

SEQ ID NO: 1978084 - RNA, 15 nt, Human
uuucauuuugcuuua

SEQ ID NO: 1978085 - RNA, 16 nt, Human
uuucauuuugcuuuaa

SEQ ID NO: 1978086 - RNA, 20 nt, Human
uuucauuuugcuuuaauuuu

SEQ ID NO: 1978087 - RNA, 21 nt, Human
uuuccacuaagaacaccugca

SEQ ID NO: 1978088 - RNA, 19 nt, Human
uuuccacuccuccuagcca

SEQ ID NO: 1978089 - RNA, 14 nt, Human
uuuccacucuggau

SEQ ID NO: 1978090 - RNA, 18 nt, Human
uuuccacuccuccuagcc

SEQ ID NO: 1978091 - RNA, 20 nt, Human
uuuccuaaauauauuuuaag

SEQ ID NO: 1978092 - RNA, 19 nt, Human
uuucaguaaaccugucuga

SEQ ID NO: 1978093 - RNA, 16 nt, Human
uuucaguaagaucaag

SEQ ID NO: 1978094 - RNA, 21 nt, Human
uuucauuuuacaguuacuuuu

SEQ ID NO: 1978095 - RNA, 22 nt, Human
uuucagcuaggaacaaaucuuc

SEQ ID NO: 1978096 - RNA, 15 nt, Human
uuucagcuaggaaca

SEQ ID NO: 1978097 - RNA, 19 nt, Human
uuucagcuaggaacaaauc

SEQ ID NO: 1978098 - RNA, 21 nt, Human
uuucagcuaggaacaaaucuu

SEQ ID NO: 1978099 - RNA, 16 nt, Human
uuucaggugcucaaaa

SEQ ID NO: 1978100 - RNA, 19 nt, Human
uuucaggugcucaaaaugc

SEQ ID NO: 1978101 - RNA, 20 nt, Human
uuucaggugcucaaaaugca

SEQ ID NO: 1978102 - RNA, 22 nt, Human
uuucaggugcucaaaaugcaaa

SEQ ID NO: 1978103 - RNA, 23 nt, Human
uuucaaugugauauaaacagcuu

SEQ ID NO: 1978104 - RNA, 22 nt, Human
uuuaugauacuugaaaauuaac

SEQ ID NO: 1978105 - RNA, 17 nt, Human
uuucagccaagaauucu

SEQ ID NO: 1978106 - RNA, 14 nt, Human
uuucagccuaagag

SEQ ID NO: 1978107 - RNA, 16 nt, Human
uuucacagugugauuu

SEQ ID NO: 1978108 - RNA, 22 nt, Human
uuucacaguguguggucaacau

SEQ ID NO: 1978109 - RNA, 20 nt, Human
uuucacagugugauuuugau

SEQ ID NO: 1978110 - RNA, 23 nt, Human
uuuccuggcacugcuuccaguga

SEQ ID NO: 1978111 - RNA, 22 nt, Human
uuuccucuuagucgagccaagu

SEQ ID NO: 1978112 - RNA, 19 nt, Human
uuuccugggacaucuucug

SEQ ID NO: 1978113 - RNA, 19 nt, Human
uuuccuggcacugcuucca

SEQ ID NO: 1978114 - RNA, 19 nt, Human
uuucuaauuggcuuuacua

SEQ ID NO: 1978115 - RNA, 14 nt, Human
uuucuaaaguacug

SEQ ID NO: 1978116 - RNA, 19 nt, Human
uuucuaaaucuccaaaaua

SEQ ID NO: 1978117 - RNA, 22 nt, Human
uuucuaaaguaaaaacaaagaa

SEQ ID NO: 1978118 - RNA, 17 nt, Human
uuucuaaaguaaaaaca

SEQ ID NO: 1978119 - RNA, 12 nt, Human
uuucugaaauuu

SEQ ID NO: 1978120 - RNA, 20 nt, Human
uuucucuuugaaacaugcuu

SEQ ID NO: 1978121 - RNA, 19 nt, Human
uuucucucuauuucccccu

SEQ ID NO: 1978122 - RNA, 15 nt, Human
uuucucuuugaaaca

SEQ ID NO: 1978123 - RNA, 14 nt, Human
uuucugaaauaaca

SEQ ID NO: 1978124 - RNA, 22 nt, Human
uuucuacccagcgagcccuggu

SEQ ID NO: 1978125 - RNA, 15 nt, Human
uuucuacccagcgag

SEQ ID NO: 1978126 - RNA, 18 nt, Human
uuucuacccagcgagccc

SEQ ID NO: 1978127 - RNA, 17 nt, Human
uuucuacucauuuuaau

SEQ ID NO: 1978128 - RNA, 16 nt, Human
uuucuccuuuuguguu

SEQ ID NO: 1978129 - RNA, 19 nt, Human
uuucuccuuuuguguucca

SEQ ID NO: 1978130 - RNA, 13 nt, Human
uuucuacucauuu

SEQ ID NO: 1978131 - RNA, 15 nt, Human
uuucucuaauaauaa

SEQ ID NO: 1978132 - RNA, 17 nt, Human
uuucucuaauaauaaau

SEQ ID NO: 1978133 - RNA, 21 nt, Human
uuucucuaauaauaaauaguu

SEQ ID NO: 1978134 - RNA, 19 nt, Human
uuugaucaugaauaacuga

SEQ ID NO: 1978135 - RNA, 21 nt, Human
uuugcauuucagaaagccuuu

SEQ ID NO: 1978136 - RNA, 10 nt, Human
uuugccagcc

SEQ ID NO: 1978137 - RNA, 17 nt, Human
uuugccagcccauuugg

SEQ ID NO: 1978138 - RNA, 14 nt, Human
uuugauaugugaac

SEQ ID NO: 1978139 - RNA, 15 nt, Human
uuugauaugugaaca

SEQ ID NO: 1978140 - RNA, 17 nt, Human
uuugauaugugaacagu

SEQ ID NO: 1978141 - RNA, 14 nt, Human
uuugauccaagcug

SEQ ID NO: 1978142 - RNA, 15 nt, Human
uuugcauuucagaaa

SEQ ID NO: 1978143 - RNA, 12 nt, Human
uuugaucaugaa

SEQ ID NO: 1978144 - RNA, 13 nt, Human
uuugaucaugaau

SEQ ID NO: 1978145 - RNA, 17 nt, Human
uuugcuuuaauuuuagc

SEQ ID NO: 1978146 - RNA, 19 nt, Human
uuuggacccugaggcccag

SEQ ID NO: 1978147 - RNA, 15 nt, Human
uuuggacccugaggc

SEQ ID NO: 1978148 - RNA, 23 nt, Human
uuugcuuguggcuccacacacac

SEQ ID NO: 1978149 - RNA, 12 nt, Human
uuugcuuuaauu

SEQ ID NO: 1978150 - RNA, 14 nt, Human
uuugcuugaaagaa

SEQ ID NO: 1978151 - RNA, 16 nt, Human
uuugcuugaaagaaaa

SEQ ID NO: 1978152 - RNA, 18 nt, Human
uuuguaaagauuucuguu

SEQ ID NO: 1978153 - RNA, 15 nt, Human
uuuguaaacuuugaa

SEQ ID NO: 1978154 - RNA, 16 nt, Human
uuuguaaacuuugaaa

SEQ ID NO: 1978155 - RNA, 19 nt, Human
uuuguaaacuuugaaauau

SEQ ID NO: 1978156 - RNA, 21 nt, Human
uuuguaaacuuugaaauauau

SEQ ID NO: 1978157 - RNA, 15 nt, Human
uuuguaaagaaaaau

SEQ ID NO: 1978158 - RNA, 16 nt, Human
uuuguaaagaaaaaua

SEQ ID NO: 1978159 - RNA, 17 nt, Human
uuuguaaagaaaaauau

SEQ ID NO: 1978160 - RNA, 18 nt, Human
uuuguaaagaaaaauauu

SEQ ID NO: 1978161 - RNA, 15 nt, Human
uuuguauucucuccu

SEQ ID NO: 1978162 - RNA, 22 nt, Human
uuuguauucaauuaaagaaaua

SEQ ID NO: 1978163 - RNA, 16 nt, Human
uuuguaugcacuuugu

SEQ ID NO: 1978164 - RNA, 14 nt, Human
uuuguauguauaau

SEQ ID NO: 1978165 - RNA, 15 nt, Human
uuuguauguauaauu

SEQ ID NO: 1978166 - RNA, 14 nt, Human
uuugguugaauaaa

SEQ ID NO: 1978167 - RNA, 15 nt, Human
uuugguugaauaaac

SEQ ID NO: 1978168 - RNA, 17 nt, Human
uuugguugaauaaacua

SEQ ID NO: 1978169 - RNA, 15 nt, Human
uuuggagagaaauau

SEQ ID NO: 1978170 - RNA, 14 nt, Human
uuuggagagaaaua

SEQ ID NO: 1978171 - RNA, 19 nt, Human
uuuggagagaaauauuuua

SEQ ID NO: 1978172 - RNA, 23 nt, Human
uuugauaacagggauugauuuua

SEQ ID NO: 1978173 - RNA, 15 nt, Human
uuugauaagaaaacc

SEQ ID NO: 1978174 - RNA, 13 nt, Human
uuugauaaauagu

SEQ ID NO: 1978175 - RNA, 14 nt, Human
uuugauaaauagug

SEQ ID NO: 1978176 - RNA, 14 nt, Human
uuugagaucuaaaa

SEQ ID NO: 1978177 - RNA, 16 nt, Human
uuugagaucuaaaaau

SEQ ID NO: 1978178 - RNA, 17 nt, Human
uuugagaucuaaaaaua

SEQ ID NO: 1978179 - RNA, 18 nt, Human
uuugagaucuaaaaauaa

SEQ ID NO: 1978180 - RNA, 21 nt, Human
uuugagaucuaaaaauaacug

SEQ ID NO: 1978181 - RNA, 16 nt, Human
uuugaggauuaguuua

SEQ ID NO: 1978182 - RNA, 23 nt, Human
uuugaggauuaguuuagaacagg

SEQ ID NO: 1978183 - RNA, 20 nt, Human
uuugaggcucaccagaauua

SEQ ID NO: 1978184 - RNA, 17 nt, Human
uuugaggauuaguuuag

SEQ ID NO: 1978185 - RNA, 18 nt, Human
uuugaggauuaguuuaga

SEQ ID NO: 1978186 - RNA, 19 nt, Human
uuugaggauuaguuuagaa

SEQ ID NO: 1978187 - RNA, 22 nt, Human
uuugaggauuaguuuagaacag

SEQ ID NO: 1978188 - RNA, 17 nt, Human
uuugagaucagccuggg

SEQ ID NO: 1978189 - RNA, 16 nt, Human
uuugagaucagccugg

SEQ ID NO: 1978190 - RNA, 21 nt, Human
uuugaagguagaauguuuuca

SEQ ID NO: 1978191 - RNA, 18 nt, Human
uuucuuaaccagaucauu

SEQ ID NO: 1978192 - RNA, 23 nt, Human
uuucugaucugaugcaagcaaga

SEQ ID NO: 1978193 - RNA, 13 nt, Human
uuucuugcucccu

SEQ ID NO: 1978194 - RNA, 18 nt, Human
uuucuugcucccugacug

SEQ ID NO: 1978195 - RNA, 14 nt, Human
uuucuuaaccaucu

SEQ ID NO: 1978196 - RNA, 15 nt, Human
uuucuuaaccaucuu

SEQ ID NO: 1978197 - RNA, 19 nt, Human
uuucuuguguguuuauugu

SEQ ID NO: 1978198 - RNA, 18 nt, Human
uuugaagcacagugauca

SEQ ID NO: 1978199 - RNA, 21 nt, Human
uuugaaauuguauuacaaauc

SEQ ID NO: 1978200 - RNA, 19 nt, Human
uucaaaggagcaagaacuu

SEQ ID NO: 1978201 - RNA, 17 nt, Human
uucaaagucaugauguu

SEQ ID NO: 1978202 - RNA, 18 nt, Human
uucaaagucaugauguuu

SEQ ID NO: 1978203 - RNA, 19 nt, Human
uucaaagucaugauguuuu

SEQ ID NO: 1978204 - RNA, 21 nt, Human
uucaaagucaugauguuuuua

SEQ ID NO: 1978205 - RNA, 20 nt, Human
uuauuuuauguugcauagaa

SEQ ID NO: 1978206 - RNA, 17 nt, Human
uucaacugaccagccuc

SEQ ID NO: 1978207 - RNA, 20 nt, Human
uucaacgcagcccugcuuug

SEQ ID NO: 1978208 - RNA, 16 nt, Human
uucaacgcagcccugc

SEQ ID NO: 1978209 - RNA, 19 nt, Human
uucaacgcagcccugcuuu

SEQ ID NO: 1978210 - RNA, 19 nt, Human
uuauuggugaguuaggaac

SEQ ID NO: 1978211 - RNA, 20 nt, Human
uuauugccaaaacccagcug

SEQ ID NO: 1978212 - RNA, 21 nt, Human
uuauugccaaaacccagcugc

SEQ ID NO: 1978213 - RNA, 22 nt, Human
uuauugccaaaacccagcugca

SEQ ID NO: 1978214 - RNA, 18 nt, Human
uuauugucaaagugguga

SEQ ID NO: 1978215 - RNA, 17 nt, Human
uuauugucaaaguggug

SEQ ID NO: 1978216 - RNA, 16 nt, Human
uucacucuaagauguu

SEQ ID NO: 1978217 - RNA, 17 nt, Human
uucacucuaagauguua

SEQ ID NO: 1978218 - RNA, 18 nt, Human
uucacucuaagauguuau

SEQ ID NO: 1978219 - RNA, 13 nt, Human
uucacucuccuug

SEQ ID NO: 1978220 - RNA, 16 nt, Human
uucagacauagaauua

SEQ ID NO: 1978221 - RNA, 21 nt, Human
uucagacagcugccugggauc

SEQ ID NO: 1978222 - RNA, 20 nt, Human
uucagacauagaauuaacac

SEQ ID NO: 1978223 - RNA, 19 nt, Human
uucagagacuccugcaggc

SEQ ID NO: 1978224 - RNA, 22 nt, Human
uucagaguugaugguuguacau

SEQ ID NO: 1978225 - RNA, 21 nt, Human
uucagaguugaugguuguaca

SEQ ID NO: 1978226 - RNA, 22 nt, Human
uucacucuaagauguuauauuu

SEQ ID NO: 1978227 - RNA, 20 nt, Human
uucaauaggaaaaacugauu

SEQ ID NO: 1978228 - RNA, 18 nt, Human
uucaauaggaaaaacuga

SEQ ID NO: 1978229 - RNA, 15 nt, Human
uucaauaggaaaaac

SEQ ID NO: 1978230 - RNA, 13 nt, Human
uucaauaggaaaa

SEQ ID NO: 1978231 - RNA, 19 nt, Human
uucacgucauaggaaguua

SEQ ID NO: 1978232 - RNA, 18 nt, Human
uucacggaagagccuugc

SEQ ID NO: 1978233 - RNA, 15 nt, Human
uucacgugguccuaa

SEQ ID NO: 1978234 - RNA, 13 nt, Human
uuaguugcaacuu

SEQ ID NO: 1978235 - RNA, 14 nt, Human
uuaguuccuugagu

SEQ ID NO: 1978236 - RNA, 16 nt, Human
uuaguuccucauuagc

SEQ ID NO: 1978237 - RNA, 16 nt, Human
uuaucuagauacugua

SEQ ID NO: 1978238 - RNA, 11 nt, Human
uuaguuuagaa

SEQ ID NO: 1978239 - RNA, 16 nt, Human
uuaguuuagaacaggu

SEQ ID NO: 1978240 - RNA, 20 nt, Human
uuaguugcaacuuuguauaa

SEQ ID NO: 1978241 - RNA, 20 nt, Human
uuaucuugaauaauguaaga

SEQ ID NO: 1978242 - RNA, 14 nt, Human
uuaucuagcugcau

SEQ ID NO: 1978243 - RNA, 17 nt, Human
uuaucuagauacuguau

SEQ ID NO: 1978244 - RNA, 18 nt, Human
uuaucuagauguaaauuu

SEQ ID NO: 1978245 - RNA, 19 nt, Human
uuaucuagauguaaauuuu

SEQ ID NO: 1978246 - RNA, 14 nt, Human
uuaucuagauguaa

SEQ ID NO: 1978247 - RNA, 15 nt, Human
uuaucuagauguaaa

SEQ ID NO: 1978248 - RNA, 16 nt, Human
uuaucuagauguaaau

SEQ ID NO: 1978249 - RNA, 17 nt, Human
uuaucuagauguaaauu

SEQ ID NO: 1978250 - RNA, 19 nt, Human
uuaucuuggccuuacugua

SEQ ID NO: 1978251 - RNA, 11 nt, Human
uuaucuuugau

SEQ ID NO: 1978252 - RNA, 16 nt, Human
uuaugcaugaaguaau

SEQ ID NO: 1978253 - RNA, 22 nt, Human
uuaugcaugaaguaauaugcac

SEQ ID NO: 1978254 - RNA, 10 nt, Human
uuaugcuaag

SEQ ID NO: 1978255 - RNA, 15 nt, Human
uuaugcuaagaauuu

SEQ ID NO: 1978256 - RNA, 16 nt, Human
uuaugcuaagaauuuu

SEQ ID NO: 1978257 - RNA, 20 nt, Human
uuaugcuaagaauuuuuuau

SEQ ID NO: 1978258 - RNA, 22 nt, Human
uuaugcaaggucuugcauuuaa

SEQ ID NO: 1978259 - RNA, 16 nt, Human
uuauggaacacucuga

SEQ ID NO: 1978260 - RNA, 18 nt, Human
uuaugcuguaaaagcaag

SEQ ID NO: 1978261 - RNA, 14 nt, Human
uuaugcuuccagaa

SEQ ID NO: 1978262 - RNA, 15 nt, Human
uuaugcuuccagaaa

SEQ ID NO: 1978263 - RNA, 16 nt, Human
uuaugcuuccagaaac

SEQ ID NO: 1978264 - RNA, 14 nt, Human
uuauugacucuuga

SEQ ID NO: 1978265 - RNA, 18 nt, Human
uuauugacaguugugcag

SEQ ID NO: 1978266 - RNA, 11 nt, Human
uuauucugcuc

SEQ ID NO: 1978267 - RNA, 19 nt, Human
uuauucugggaauguauag

SEQ ID NO: 1978268 - RNA, 20 nt, Human
uuauucugggaauguauagu

SEQ ID NO: 1978269 - RNA, 17 nt, Human
uuauucuuugcacuuuu

SEQ ID NO: 1978270 - RNA, 22 nt, Human
uuauucuuuuuuucucuagagu

SEQ ID NO: 1978271 - RNA, 15 nt, Human
uuauucuuucuccuu

SEQ ID NO: 1978272 - RNA, 14 nt, Human
uuauucuuugcacu

SEQ ID NO: 1978273 - RNA, 15 nt, Human
uuauucuuugcacuu

SEQ ID NO: 1978274 - RNA, 11 nt, Human
uuauucuugau

SEQ ID NO: 1978275 - RNA, 13 nt, Human
uuauucuugauca

SEQ ID NO: 1978276 - RNA, 14 nt, Human
uuauucuugaugaa

SEQ ID NO: 1978277 - RNA, 15 nt, Human
uuauucuugaugaaa

SEQ ID NO: 1978278 - RNA, 23 nt, Human
uuauugaggaaaaauaugugaag

SEQ ID NO: 1978279 - RNA, 13 nt, Human
uuauugaugaaaa

SEQ ID NO: 1978280 - RNA, 15 nt, Human
uuauugauguuuuca

SEQ ID NO: 1978281 - RNA, 14 nt, Human
uuauugaugaaaau

SEQ ID NO: 1978282 - RNA, 15 nt, Human
uuauugcccacgcug

SEQ ID NO: 1978283 - RNA, 21 nt, Human
uuauugaggaaaaauauguga

SEQ ID NO: 1978284 - RNA, 22 nt, Human
uuauugaggaaaaauaugugaa

SEQ ID NO: 1978285 - RNA, 16 nt, Human
uuauugacucuugagu

SEQ ID NO: 1978286 - RNA, 17 nt, Human
uuauugacucuugaguu

SEQ ID NO: 1978287 - RNA, 20 nt, Human
uuauugacucuugaguuguu

SEQ ID NO: 1978288 - RNA, 21 nt, Human
uuauugacucuugaguuguuu

SEQ ID NO: 1978289 - RNA, 18 nt, Human
uuauugagagagaugugu

SEQ ID NO: 1978290 - RNA, 19 nt, Human
uuauugagagagaugugua

SEQ ID NO: 1978291 - RNA, 20 nt, Human
uuauugagagagauguguaa

SEQ ID NO: 1978292 - RNA, 22 nt, Human
uuauugagagagauguguaauu

SEQ ID NO: 1978293 - RNA, 19 nt, Human
uuauugaggaaaaauaugu

SEQ ID NO: 1978294 - RNA, 14 nt, Human
uuauuaaucacugu

SEQ ID NO: 1978295 - RNA, 16 nt, Human
uuauuaaucacugugu

SEQ ID NO: 1978296 - RNA, 18 nt, Human
uuauuaaucacuguguau

SEQ ID NO: 1978297 - RNA, 14 nt, Human
uuauuaaaguuuca

SEQ ID NO: 1978298 - RNA, 15 nt, Human
uuauuaaaguuucaa

SEQ ID NO: 1978299 - RNA, 17 nt, Human
uuauuaaaguuucaaaa

SEQ ID NO: 1978300 - RNA, 19 nt, Human
uuauuaaaguuucaaaaau

SEQ ID NO: 1978301 - RNA, 12 nt, Human
uuauuaaaauug

SEQ ID NO: 1978302 - RNA, 13 nt, Human
uuauuaaaauugu

SEQ ID NO: 1978303 - RNA, 13 nt, Human
uuauuaaugcuuu

SEQ ID NO: 1978304 - RNA, 14 nt, Human
uuauuaaugcuuug

SEQ ID NO: 1978305 - RNA, 18 nt, Human
uuauuaauuuuuaaggau

SEQ ID NO: 1978306 - RNA, 12 nt, Human
uuauucuaauua

SEQ ID NO: 1978307 - RNA, 20 nt, Human
uuauuccugcccugcuguuu

SEQ ID NO: 1978308 - RNA, 13 nt, Human
uucaggaagcuca

SEQ ID NO: 1978309 - RNA, 11 nt, Human
uucaggaagcu

SEQ ID NO: 1978310 - RNA, 19 nt, Human
uucaggaaagcagcaguuu

SEQ ID NO: 1978311 - RNA, 15 nt, Human
uucaugaaagauuca

SEQ ID NO: 1978312 - RNA, 17 nt, Human
uucaugaaagauucaau

SEQ ID NO: 1978313 - RNA, 21 nt, Human
uucaucuugaauuguaaggaa

SEQ ID NO: 1978314 - RNA, 17 nt, Human
uucaugcaaacuuuauu

SEQ ID NO: 1978315 - RNA, 14 nt, Human
uucaugcaaguauu

SEQ ID NO: 1978316 - RNA, 15 nt, Human
uucauuuccuguguc

SEQ ID NO: 1978317 - RNA, 16 nt, Human
uucauuuccugugucu

SEQ ID NO: 1978318 - RNA, 12 nt, Human
uucauuugcuuu

SEQ ID NO: 1978319 - RNA, 13 nt, Human
uucauuugcuauc

SEQ ID NO: 1978320 - RNA, 21 nt, Human
uuccacuccuccuagccaccc

SEQ ID NO: 1978321 - RNA, 20 nt, Human
uuccagagacaaauauuucu

SEQ ID NO: 1978322 - RNA, 19 nt, Human
uuccacucuggauucagcc

SEQ ID NO: 1978323 - RNA, 21 nt, Human
uuccacucuggauucagccuu

SEQ ID NO: 1978324 - RNA, 23 nt, Human
uuccacucuggauucagccuucu

SEQ ID NO: 1978325 - RNA, 16 nt, Human
uuccacuccuccuagc

SEQ ID NO: 1978326 - RNA, 18 nt, Human
uuccacuccuccuagcca

SEQ ID NO: 1978327 - RNA, 17 nt, Human
uuccagagaguggcucc

SEQ ID NO: 1978328 - RNA, 18 nt, Human
uuccagagaguggcuccu

SEQ ID NO: 1978329 - RNA, 19 nt, Human
uuccagagaguggcuccuc

SEQ ID NO: 1978330 - RNA, 20 nt, Human
uuccagagaguggcuccucc

SEQ ID NO: 1978331 - RNA, 21 nt, Human
uuccagagaguggcuccuccc

SEQ ID NO: 1978332 - RNA, 10 nt, Human
uuccagagca

SEQ ID NO: 1978333 - RNA, 20 nt, Human
uuccaaauaauauguuuccu

SEQ ID NO: 1978334 - RNA, 14 nt, Human
uuccaaacaugguu

SEQ ID NO: 1978335 - RNA, 16 nt, Human
uucauuugcuuuggaa

SEQ ID NO: 1978336 - RNA, 22 nt, Human
uuccaaacaugagguucucucu

SEQ ID NO: 1978337 - RNA, 15 nt, Human
uuccaaauucugcuu

SEQ ID NO: 1978338 - RNA, 23 nt, Human
uuccaaauaauauguuuccuucc

SEQ ID NO: 1978339 - RNA, 23 nt, Human
uuccacuaagaacaccugcauuc

SEQ ID NO: 1978340 - RNA, 20 nt, Human
uuccccaggaggccagccuu

SEQ ID NO: 1978341 - RNA, 19 nt, Human
uuccccaggaggccagccu

SEQ ID NO: 1978342 - RNA, 18 nt, Human
uuccccaggaggccagcc

SEQ ID NO: 1978343 - RNA, 17 nt, Human
uuccccaggaggccagc

SEQ ID NO: 1978344 - RNA, 21 nt, Human
uuccccaggaggccagccuug

SEQ ID NO: 1978345 - RNA, 14 nt, Human
uuccccauacaaau

SEQ ID NO: 1978346 - RNA, 18 nt, Human
uuccccauacaaauaagc

SEQ ID NO: 1978347 - RNA, 11 nt, Human
uuccccauggg

SEQ ID NO: 1978348 - RNA, 19 nt, Human
uuccccaugucucgacuca

SEQ ID NO: 1978349 - RNA, 22 nt, Human
uuccccauuauaucacacuuau

SEQ ID NO: 1978350 - RNA, 20 nt, Human
uucccucccuuccucuuucc

SEQ ID NO: 1978351 - RNA, 17 nt, Human
uucccucccuuccucuu

SEQ ID NO: 1978352 - RNA, 11 nt, Human
uucccucccuu

SEQ ID NO: 1978353 - RNA, 13 nt, Human
uucccaucuccuu

SEQ ID NO: 1978354 - RNA, 21 nt, Human
uucccaucuccuuucucuggu

SEQ ID NO: 1978355 - RNA, 14 nt, Human
uucccauucuugca

SEQ ID NO: 1978356 - RNA, 11 nt, Human
uucccauucca

SEQ ID NO: 1978357 - RNA, 16 nt, Human
uuccccaggaggccag

SEQ ID NO: 1978358 - RNA, 15 nt, Human
uuccccaggaggcca

SEQ ID NO: 1978359 - RNA, 16 nt, Human
uucccauuugcuccuu

SEQ ID NO: 1978360 - RNA, 13 nt, Human
uucccauuuagaa

SEQ ID NO: 1978361 - RNA, 14 nt, Human
uucccauuuagaau

SEQ ID NO: 1978362 - RNA, 15 nt, Human
uucccauuuagaaug

SEQ ID NO: 1978363 - RNA, 22 nt, Human
uucccauuuagaauggugauuu

SEQ ID NO: 1978364 - RNA, 20 nt, Human
uuccagcaauucuccugccu

SEQ ID NO: 1978365 - RNA, 21 nt, Human
uuccagcaauucuccugccuc

SEQ ID NO: 1978366 - RNA, 22 nt, Human
uuccagcaauucuccugccuca

SEQ ID NO: 1978367 - RNA, 23 nt, Human
uuccagcaauucuccugccucag

SEQ ID NO: 1978368 - RNA, 21 nt, Human
uuccagaugcugguuuuuccc

SEQ ID NO: 1978369 - RNA, 15 nt, Human
uuccugaugcuucuu

SEQ ID NO: 1978370 - RNA, 19 nt, Human
uuccugaugcuucuucaga

SEQ ID NO: 1978371 - RNA, 18 nt, Human
uuccugaugcuucuucag

SEQ ID NO: 1978372 - RNA, 15 nt, Human
uuccugcauuuguga

SEQ ID NO: 1978373 - RNA, 16 nt, Human
uuccugcauuugugaa

SEQ ID NO: 1978374 - RNA, 18 nt, Human
uuccugcauuugugaaau

SEQ ID NO: 1978375 - RNA, 17 nt, Human
uuccugccaggcauggu

SEQ ID NO: 1978376 - RNA, 14 nt, Human
uuccuggcacugcu

SEQ ID NO: 1978377 - RNA, 18 nt, Human
uuccuggacaggccaggu

SEQ ID NO: 1978378 - RNA, 20 nt, Human
uuccuugaguugauucagcu

SEQ ID NO: 1978379 - RNA, 15 nt, Human
uuccuucuuugcccu

SEQ ID NO: 1978380 - RNA, 20 nt, Human
uuccuucuuugcccuuuacu

SEQ ID NO: 1978381 - RNA, 17 nt, Human
uucuaaagcugccagcc

SEQ ID NO: 1978382 - RNA, 13 nt, Human
uucuaaagcugcc

SEQ ID NO: 1978383 - RNA, 18 nt, Human
uucuaaaacuguacuuug

SEQ ID NO: 1978384 - RNA, 19 nt, Human
uucuaaaacuguacuuuga

SEQ ID NO: 1978385 - RNA, 20 nt, Human
uucuaaaacuguacuuugau

SEQ ID NO: 1978386 - RNA, 14 nt, Human
uucgggcugugccc

SEQ ID NO: 1978387 - RNA, 14 nt, Human
uucguucucugcca

SEQ ID NO: 1978388 - RNA, 17 nt, Human
uucguuuguuuguuuca

SEQ ID NO: 1978389 - RNA, 12 nt, Human
uucuaaaacugu

SEQ ID NO: 1978390 - RNA, 13 nt, Human
uucuaaaacugua

SEQ ID NO: 1978391 - RNA, 15 nt, Human
uucuaaaacuguacu

SEQ ID NO: 1978392 - RNA, 16 nt, Human
uucuaaaacuguacuu

SEQ ID NO: 1978393 - RNA, 20 nt, Human
uuccuugaggggagccagga

SEQ ID NO: 1978394 - RNA, 22 nt, Human
uuccuugaggggagccaggagg

SEQ ID NO: 1978395 - RNA, 23 nt, Human
uuccuugaggggagccaggaggg

SEQ ID NO: 1978396 - RNA, 20 nt, Human
uucgggaggucgaggcagga

SEQ ID NO: 1978397 - RNA, 12 nt, Human
uucgggcugugc

SEQ ID NO: 1978398 - RNA, 13 nt, Human
uucgggcugugcc

SEQ ID NO: 1978399 - RNA, 13 nt, Human
uucccuuccucca

SEQ ID NO: 1978400 - RNA, 14 nt, Human
uucccuuccuccau

SEQ ID NO: 1978401 - RNA, 17 nt, Human
uucccuuccuccauccu

SEQ ID NO: 1978402 - RNA, 16 nt, Human
uucccugaaggaacca

SEQ ID NO: 1978403 - RNA, 12 nt, Human
uucccugaggug

SEQ ID NO: 1978404 - RNA, 19 nt, Human
uucccccuccaaucccacc

SEQ ID NO: 1978405 - RNA, 17 nt, Human
uucccucgucuuuccca

SEQ ID NO: 1978406 - RNA, 18 nt, Human
uucccucggaguucuucu

SEQ ID NO: 1978407 - RNA, 19 nt, Human
uucccucggaguucuucuu

SEQ ID NO: 1978408 - RNA, 13 nt, Human
uuccucauuagca

SEQ ID NO: 1978409 - RNA, 14 nt, Human
uuccuccauccucc

SEQ ID NO: 1978410 - RNA, 18 nt, Human
uuccuccauccuccuccu

SEQ ID NO: 1978411 - RNA, 22 nt, Human
uuccuccauccuccuccuuccu

SEQ ID NO: 1978412 - RNA, 24 nt, Human
uuccuccauccuccuccuuccuag

SEQ ID NO: 1978413 - RNA, 16 nt, Human
uuccuauuucagaagu

SEQ ID NO: 1978414 - RNA, 23 nt, Human
uuccuauuucagaaguuuaaaua

SEQ ID NO: 1978415 - RNA, 13 nt, Human
uuccuauuucaga

SEQ ID NO: 1978416 - RNA, 15 nt, Human
uuccuauuucagaag

SEQ ID NO: 1978417 - RNA, 20 nt, Human
uucccuuugacgccauccca

SEQ ID NO: 1978418 - RNA, 22 nt, Human
uucccuuugacgccaucccagc

SEQ ID NO: 1978419 - RNA, 21 nt, Human
uucccuuugacgccaucccag

SEQ ID NO: 1978420 - RNA, 18 nt, Human
uucccuuugccacacugu

SEQ ID NO: 1978421 - RNA, 18 nt, Human
uuccuauaccauuuccgu

SEQ ID NO: 1978422 - RNA, 17 nt, Human
uuccuaucaaaaagaua

SEQ ID NO: 1978423 - RNA, 18 nt, Human
uuccuaucaaaaagauau

SEQ ID NO: 1978424 - RNA, 13 nt, Human
uuacuaaguuuuu

SEQ ID NO: 1978425 - RNA, 14 nt, Human
uuacuaaguuuuua

SEQ ID NO: 1978426 - RNA, 16 nt, Human
uuacuaauagacaauu

SEQ ID NO: 1978427 - RNA, 11 nt, Human
uuacuaacuuc

SEQ ID NO: 1978428 - RNA, 15 nt, Human
uuacuaacuucuaaa

SEQ ID NO: 1978429 - RNA, 17 nt, Human
uuacuaacuucuaaaac

SEQ ID NO: 1978430 - RNA, 19 nt, Human
uuacuaacuucuaaaacug

SEQ ID NO: 1978431 - RNA, 20 nt, Human
uuacuaacuucuaaaacugu

SEQ ID NO: 1978432 - RNA, 21 nt, Human
uuacuaacuucuaaaacugua

SEQ ID NO: 1978433 - RNA, 21 nt, Human
uuacuaggugcccagaaugag

SEQ ID NO: 1978434 - RNA, 17 nt, Human
uuacuaguuucccuugc

SEQ ID NO: 1978435 - RNA, 21 nt, Human
uuacuaucaugucaaacguga

SEQ ID NO: 1978436 - RNA, 19 nt, Human
uuacuaucaugucaaacgu

SEQ ID NO: 1978437 - RNA, 17 nt, Human
uuacuaccuccucuccu

SEQ ID NO: 1978438 - RNA, 17 nt, Human
uuacuacaauauguaca

SEQ ID NO: 1978439 - RNA, 19 nt, Human
uuacuacaauauguacauu

SEQ ID NO: 1978440 - RNA, 14 nt, Human
uuaaugauuccuau

SEQ ID NO: 1978441 - RNA, 11 nt, Human
uuacuucugcu

SEQ ID NO: 1978442 - RNA, 23 nt, Human
uuacuucuuauacauuugauaaa

SEQ ID NO: 1978443 - RNA, 12 nt, Human
uuacuucugcua

SEQ ID NO: 1978444 - RNA, 18 nt, Human
uuacuuagguguggggga

SEQ ID NO: 1978445 - RNA, 19 nt, Human
uuacugucuuuuuucuaaa

SEQ ID NO: 1978446 - RNA, 19 nt, Human
uuacuauggcccuggccua

SEQ ID NO: 1978447 - RNA, 17 nt, Human
uuacugucuuuuuucua

SEQ ID NO: 1978448 - RNA, 21 nt, Human
uuacuuaaaccgccaaggcug

SEQ ID NO: 1978449 - RNA, 23 nt, Human
uuacuguucauuugauuuguaca

SEQ ID NO: 1978450 - RNA, 24 nt, Human
uuagagacagagcgacagagcagu

SEQ ID NO: 1978451 - RNA, 21 nt, Human
uuagacuuuuccaauauguga

SEQ ID NO: 1978452 - RNA, 22 nt, Human
uuagacuuuuccaauaugugau

SEQ ID NO: 1978453 - RNA, 12 nt, Human
uuagacuugaaa

SEQ ID NO: 1978454 - RNA, 13 nt, Human
uuagacuugaaaa

SEQ ID NO: 1978455 - RNA, 19 nt, Human
uuagacuugaaaagagaca

SEQ ID NO: 1978456 - RNA, 20 nt, Human
uuagacuugaaaagagacag

SEQ ID NO: 1978457 - RNA, 14 nt, Human
uuagacuucuguuu

SEQ ID NO: 1978458 - RNA, 15 nt, Human
uuagacuucuguuuu

SEQ ID NO: 1978459 - RNA, 17 nt, Human
uuagacuucuguuuuca

SEQ ID NO: 1978460 - RNA, 18 nt, Human
uuagacuucuguuuucaa

SEQ ID NO: 1978461 - RNA, 19 nt, Human
uuagacuucuguuuucaau

SEQ ID NO: 1978462 - RNA, 14 nt, Human
uuagacugccagcu

SEQ ID NO: 1978463 - RNA, 16 nt, Human
uuagacugccagcucu

SEQ ID NO: 1978464 - RNA, 17 nt, Human
uuagacugccagcucuu

SEQ ID NO: 1978465 - RNA, 13 nt, Human
uuagacugccagc

SEQ ID NO: 1978466 - RNA, 22 nt, Human
uuagaaaaggugauaaaaucau

SEQ ID NO: 1978467 - RNA, 14 nt, Human
uuagacagucccug

SEQ ID NO: 1978468 - RNA, 18 nt, Human
uuagacagucccugccaa

SEQ ID NO: 1978469 - RNA, 17 nt, Human
uuagacagucccugcca

SEQ ID NO: 1978470 - RNA, 16 nt, Human
uuagacagucccugcc

SEQ ID NO: 1978471 - RNA, 17 nt, Human
uuagacauguaauuugu

SEQ ID NO: 1978472 - RNA, 19 nt, Human
uuacuuuuccuugcauaca

SEQ ID NO: 1978473 - RNA, 23 nt, Human
uuacuuuguaaauucugauuucu

SEQ ID NO: 1978474 - RNA, 14 nt, Human
uuacuuuguguuca

SEQ ID NO: 1978475 - RNA, 15 nt, Human
uuagacagucccugc

SEQ ID NO: 1978476 - RNA, 13 nt, Human
uuagaaaacuuug

SEQ ID NO: 1978477 - RNA, 20 nt, Human
uuacuuuuccuugcauacaa

SEQ ID NO: 1978478 - RNA, 14 nt, Human
uuagaaaacuuugu

SEQ ID NO: 1978479 - RNA, 15 nt, Human
uuagaaaacuuuguu

SEQ ID NO: 1978480 - RNA, 16 nt, Human
uuagaaaacuuuguua

SEQ ID NO: 1978481 - RNA, 12 nt, Human
uuagaaaaggca

SEQ ID NO: 1978482 - RNA, 20 nt, Human
uuagaaaaggugauaaaauc

SEQ ID NO: 1978483 - RNA, 21 nt, Human
uuagaaaaggugauaaaauca

SEQ ID NO: 1978484 - RNA, 17 nt, Human
uuacuuuaaaaggagcc

SEQ ID NO: 1978485 - RNA, 18 nt, Human
uuacuuuaaaaggagcca

SEQ ID NO: 1978486 - RNA, 15 nt, Human
uuacuugauaaggga

SEQ ID NO: 1978487 - RNA, 17 nt, Human
uuacuugauaagggacu

SEQ ID NO: 1978488 - RNA, 21 nt, Human
uuacuugucuuucugggguuu

SEQ ID NO: 1978489 - RNA, 13 nt, Human
uuacuuuagaaaa

SEQ ID NO: 1978490 - RNA, 17 nt, Human
uuacuuguugccuauaa

SEQ ID NO: 1978491 - RNA, 23 nt, Human
uuacuuguugccuauaagccaaa

SEQ ID NO: 1978492 - RNA, 22 nt, Human
uuacuuuaacuuaguuuugcau

SEQ ID NO: 1978493 - RNA, 11 nt, Human
uuacuuuguaa

SEQ ID NO: 1978494 - RNA, 13 nt, Human
uuacuuuguaaau

SEQ ID NO: 1978495 - RNA, 19 nt, Human
uuacuuuccaauucuccuu

SEQ ID NO: 1978496 - RNA, 14 nt, Human
uuacuuuguaaauu

SEQ ID NO: 1978497 - RNA, 17 nt, Human
uuacuuuguaaauucug

SEQ ID NO: 1978498 - RNA, 18 nt, Human
uuacuuuguaaauucuga

SEQ ID NO: 1978499 - RNA, 19 nt, Human
uuacuuuguaaauucugau

SEQ ID NO: 1978500 - RNA, 20 nt, Human
uuacuuuguaaauucugauu

SEQ ID NO: 1978501 - RNA, 22 nt, Human
uuacuuuguaaauucugauuuc

SEQ ID NO: 1978502 - RNA, 14 nt, Human
uuagaguugauacu

SEQ ID NO: 1978503 - RNA, 22 nt, Human
uuagagcuuuuuuuuuuuaauu

SEQ ID NO: 1978504 - RNA, 16 nt, Human
uuagaucauaguuuua

SEQ ID NO: 1978505 - RNA, 22 nt, Human
uuagauaauacaccacuacauu

SEQ ID NO: 1978506 - RNA, 15 nt, Human
uuagauaaauauuga

SEQ ID NO: 1978507 - RNA, 15 nt, Human
uuagaucauaguuuu

SEQ ID NO: 1978508 - RNA, 17 nt, Human
uuagaucauaguuuuau

SEQ ID NO: 1978509 - RNA, 18 nt, Human
uuagcuacguuuacucac

SEQ ID NO: 1978510 - RNA, 13 nt, Human
uuagcuguaacag

SEQ ID NO: 1978511 - RNA, 18 nt, Human
uuagcugccugaaaauca

SEQ ID NO: 1978512 - RNA, 12 nt, Human
uuagcugggaga

SEQ ID NO: 1978513 - RNA, 20 nt, Human
uuagcuuucugagcaagagg

SEQ ID NO: 1978514 - RNA, 17 nt, Human
uuagcuguaacaguucu

SEQ ID NO: 1978515 - RNA, 14 nt, Human
uuagcuguguuauu

SEQ ID NO: 1978516 - RNA, 18 nt, Human
uuagcuguguuauuauag

SEQ ID NO: 1978517 - RNA, 14 nt, Human
uuaguguucauaaa

SEQ ID NO: 1978518 - RNA, 20 nt, Human
uuagucucaguucucuuaau

SEQ ID NO: 1978519 - RNA, 12 nt, Human
uuagugugauug

SEQ ID NO: 1978520 - RNA, 14 nt, Human
uuaguguuauauga

SEQ ID NO: 1978521 - RNA, 15 nt, Human
uuaguguuauaugaa

SEQ ID NO: 1978522 - RNA, 15 nt, Human
uuaguuccacugaga

SEQ ID NO: 1978523 - RNA, 16 nt, Human
uuaguuccacugagac

SEQ ID NO: 1978524 - RNA, 22 nt, Human
uuaguuacuaccuccucuccug

SEQ ID NO: 1978525 - RNA, 18 nt, Human
uuaguaugaggcauuugu

SEQ ID NO: 1978526 - RNA, 16 nt, Human
uuaguaugaggcauuu

SEQ ID NO: 1978527 - RNA, 22 nt, Human
uuaguaggauaugccugcucuu

SEQ ID NO: 1978528 - RNA, 17 nt, Human
uuaguagagacaggguu

SEQ ID NO: 1978529 - RNA, 16 nt, Human
uuaguaggauaugccu

SEQ ID NO: 1978530 - RNA, 19 nt, Human
uuaguaggauaugccugcu

SEQ ID NO: 1978531 - RNA, 18 nt, Human
uuaggcaguauaaagaau

SEQ ID NO: 1978532 - RNA, 19 nt, Human
uuaggccaaagacaaauag

SEQ ID NO: 1978533 - RNA, 20 nt, Human
uuaggcaguauaaagaauag

SEQ ID NO: 1978534 - RNA, 18 nt, Human
uuaggcaugguuuugggc

SEQ ID NO: 1978535 - RNA, 15 nt, Human
uuaggccaaagacaa

SEQ ID NO: 1978536 - RNA, 18 nt, Human
uuaggccaaagacaaaua

SEQ ID NO: 1978537 - RNA, 20 nt, Human
uuaggagaagucuucuauuu

SEQ ID NO: 1978538 - RNA, 12 nt, Human
uuaggacaaauc

SEQ ID NO: 1978539 - RNA, 18 nt, Human
uuaggauguugaaaaagu

SEQ ID NO: 1978540 - RNA, 15 nt, Human
uuaggaguuuugaga

SEQ ID NO: 1978541 - RNA, 11 nt, Human
uuaaaauacug

SEQ ID NO: 1978542 - RNA, 12 nt, Human
uuaaaauacugu

SEQ ID NO: 1978543 - RNA, 13 nt, Human
uuaaaauacugua

SEQ ID NO: 1978544 - RNA, 16 nt, Human
uuaaaauacuguagau

SEQ ID NO: 1978545 - RNA, 17 nt, Human
uuaaaauacuguagaua

SEQ ID NO: 1978546 - RNA, 18 nt, Human
uuaaaauacuguagauaa

SEQ ID NO: 1978547 - RNA, 20 nt, Human
uuaaaauacuguagauaauu

SEQ ID NO: 1978548 - RNA, 22 nt, Human
uuaaacucugaauuuaucuuug

SEQ ID NO: 1978549 - RNA, 13 nt, Human
uuaaacucugaau

SEQ ID NO: 1978550 - RNA, 20 nt, Human
uuaaacucugaauuuaucuu

SEQ ID NO: 1978551 - RNA, 20 nt, Human
uuaaagaaauauguauucug

SEQ ID NO: 1978552 - RNA, 13 nt, Human
uuaaagaagacau

SEQ ID NO: 1978553 - RNA, 20 nt, Human
uuaaacugucgugucauacu

SEQ ID NO: 1978554 - RNA, 21 nt, Human
uuaaaagaugcaauguagagg

SEQ ID NO: 1978555 - RNA, 21 nt, Human
uuaaaauaccagccaguaaau

SEQ ID NO: 1978556 - RNA, 21 nt, Human
uuaaaagccuuggccucagag

SEQ ID NO: 1978557 - RNA, 22 nt, Human
uguuuuguugcacugaaguuug

SEQ ID NO: 1978558 - RNA, 18 nt, Human
uguuuuuuguuuuucugc

SEQ ID NO: 1978559 - RNA, 17 nt, Human
uguuuuguuuggagaca

SEQ ID NO: 1978560 - RNA, 14 nt, Human
uguuuuguugcacu

SEQ ID NO: 1978561 - RNA, 18 nt, Human
uguuuuguugcacugaag

SEQ ID NO: 1978562 - RNA, 20 nt, Human
uguuuuguugcacugaaguu

SEQ ID NO: 1978563 - RNA, 18 nt, Human
uguuuuaaggaugcuugu

SEQ ID NO: 1978564 - RNA, 22 nt, Human
uguuuuaagaggcagggucuca

SEQ ID NO: 1978565 - RNA, 23 nt, Human
uguuugugcaguaacuugggagu

SEQ ID NO: 1978566 - RNA, 15 nt, Human
uguuuuguacagaug

SEQ ID NO: 1978567 - RNA, 16 nt, Human
uguuuuguacagaugu

SEQ ID NO: 1978568 - RNA, 14 nt, Human
uuaaaagauacagu

SEQ ID NO: 1978569 - RNA, 17 nt, Human
uuaaaagauacaguuac

SEQ ID NO: 1978570 - RNA, 18 nt, Human
uguuuuuuuuuaaagacu

SEQ ID NO: 1978571 - RNA, 18 nt, Human
uguuuuuuuuuuccacuu

SEQ ID NO: 1978572 - RNA, 19 nt, Human
uguuuuuuuuuuccacuua

SEQ ID NO: 1978573 - RNA, 22 nt, Human
uuaaaagaaaauaaaaaaaaga

SEQ ID NO: 1978574 - RNA, 23 nt, Human
uuaaaagaaaauaaaaaaaagaa

SEQ ID NO: 1978575 - RNA, 15 nt, Human
uguuucauccuuccc

SEQ ID NO: 1978576 - RNA, 18 nt, Human
uguuucauccuucccacu

SEQ ID NO: 1978577 - RNA, 16 nt, Human
uguuucauuaacugug

SEQ ID NO: 1978578 - RNA, 23 nt, Human
uguuuccuggcacugcuuccagu

SEQ ID NO: 1978579 - RNA, 13 nt, Human
uguuuccuucccu

SEQ ID NO: 1978580 - RNA, 23 nt, Human
uguuuccuugaggggagccagga

SEQ ID NO: 1978581 - RNA, 22 nt, Human
uguuucuaagguaacaagauga

SEQ ID NO: 1978582 - RNA, 16 nt, Human
uguuucuagaguuccu

SEQ ID NO: 1978583 - RNA, 17 nt, Human
uguuuguacaagauugu

SEQ ID NO: 1978584 - RNA, 18 nt, Human
uguuuguacaagauuguc

SEQ ID NO: 1978585 - RNA, 20 nt, Human
uguuuguacaagauugucau

SEQ ID NO: 1978586 - RNA, 16 nt, Human
uguuuguaaaaaugua

SEQ ID NO: 1978587 - RNA, 16 nt, Human
uguuuguaacaagaaa

SEQ ID NO: 1978588 - RNA, 15 nt, Human
uguuuguauguauaa

SEQ ID NO: 1978589 - RNA, 14 nt, Human
uguuugguuauagu

SEQ ID NO: 1978590 - RNA, 18 nt, Human
uguuugguuauagugcaa

SEQ ID NO: 1978591 - RNA, 16 nt, Human
uguuugguuuuaaaau

SEQ ID NO: 1978592 - RNA, 21 nt, Human
uguuugguuuuaaaauacugu

SEQ ID NO: 1978593 - RNA, 22 nt, Human
uguuugguuuuaaaauacugua

SEQ ID NO: 1978594 - RNA, 24 nt, Human
uguuugguuuuuuguucuugcgau

SEQ ID NO: 1978595 - RNA, 14 nt, Human
uguuugucucuucu

SEQ ID NO: 1978596 - RNA, 13 nt, Human
uguuugugauuga

SEQ ID NO: 1978597 - RNA, 20 nt, Human
uguuuuaagaggcagggucu

SEQ ID NO: 1978598 - RNA, 15 nt, Human
uguuugucucuucug

SEQ ID NO: 1978599 - RNA, 17 nt, Human
uguuugugcaguaacuu

SEQ ID NO: 1978600 - RNA, 16 nt, Human
uguuuagaagaagugu

SEQ ID NO: 1978601 - RNA, 19 nt, Human
uguuuagaagaaguguguc

SEQ ID NO: 1978602 - RNA, 12 nt, Human
uguuuagaauug

SEQ ID NO: 1978603 - RNA, 14 nt, Human
uguuuagaauugaa

SEQ ID NO: 1978604 - RNA, 15 nt, Human
uguuuagaauugaag

SEQ ID NO: 1978605 - RNA, 17 nt, Human
uguuuagaauugaaggu

SEQ ID NO: 1978606 - RNA, 23 nt, Human
uguuuagaauugaagguuuuuga

SEQ ID NO: 1978607 - RNA, 16 nt, Human
uguuuagauaauacac

SEQ ID NO: 1978608 - RNA, 15 nt, Human
uguuucaaacuuuac

SEQ ID NO: 1978609 - RNA, 12 nt, Human
uguuucauccuu

SEQ ID NO: 1978610 - RNA, 21 nt, Human
uguuucagaggcucagauugu

SEQ ID NO: 1978611 - RNA, 22 nt, Human
uguuucaaguucacaccugcag

SEQ ID NO: 1978612 - RNA, 22 nt, Human
uuaauauugauaugcuuauaca

SEQ ID NO: 1978613 - RNA, 18 nt, Human
uuaauauugauaugcuua

SEQ ID NO: 1978614 - RNA, 21 nt, Human
uuaaugauaugcuuguaacua

SEQ ID NO: 1978615 - RNA, 11 nt, Human
uuaagcugcag

SEQ ID NO: 1978616 - RNA, 17 nt, Human
uuaagcuguuacugucu

SEQ ID NO: 1978617 - RNA, 22 nt, Human
uuaagcuaggaaaagaaaucua

SEQ ID NO: 1978618 - RNA, 18 nt, Human
uuaagccuuuguugaacu

SEQ ID NO: 1978619 - RNA, 19 nt, Human
uuaagcuaggaaaagaaau

SEQ ID NO: 1978620 - RNA, 17 nt, Human
uuaagccuuuguugaac

SEQ ID NO: 1978621 - RNA, 15 nt, Human
uuaagccuuuggaaa

SEQ ID NO: 1978622 - RNA, 16 nt, Human
uuaagccuuuggaaac

SEQ ID NO: 1978623 - RNA, 19 nt, Human
uuaaugguaguuuuacagu

SEQ ID NO: 1978624 - RNA, 21 nt, Human
uuacaagcgugagccacugca

SEQ ID NO: 1978625 - RNA, 20 nt, Human
uuacaagcgugagccacugc

SEQ ID NO: 1978626 - RNA, 17 nt, Human
uuaauguugauuucuag

SEQ ID NO: 1978627 - RNA, 21 nt, Human
uuaauguugauuucuaguuau

SEQ ID NO: 1978628 - RNA, 17 nt, Human
uuaauguugaacaaaau

SEQ ID NO: 1978629 - RNA, 23 nt, Human
uuaauguugaacaaaauaaauug

SEQ ID NO: 1978630 - RNA, 14 nt, Human
uuaauguugauuuc

SEQ ID NO: 1978631 - RNA, 15 nt, Human
uuaauguugauuucu

SEQ ID NO: 1978632 - RNA, 12 nt, Human
uuaacucagucu

SEQ ID NO: 1978633 - RNA, 17 nt, Human
uuaacugcucaguguuu

SEQ ID NO: 1978634 - RNA, 15 nt, Human
uuaacugcuuccuau

SEQ ID NO: 1978635 - RNA, 24 nt, Human
uuaacugcuuccuauaauuuugau

SEQ ID NO: 1978636 - RNA, 18 nt, Human
uuaacuuuuauaaacuuu

SEQ ID NO: 1978637 - RNA, 18 nt, Human
uuaagcagaauuggaaaa

SEQ ID NO: 1978638 - RNA, 22 nt, Human
uuaagcagaauuggaaaagacu

SEQ ID NO: 1978639 - RNA, 16 nt, Human
uuaacuuuuauaaacu

SEQ ID NO: 1978640 - RNA, 17 nt, Human
uuaacuuuuauaaacuu

SEQ ID NO: 1978641 - RNA, 15 nt, Human
uuaacuuuuauaaac

SEQ ID NO: 1978642 - RNA, 18 nt, Human
uuaacuuaguuuugcaua

SEQ ID NO: 1978643 - RNA, 16 nt, Human
uuaacuucacauauug

SEQ ID NO: 1978644 - RNA, 14 nt, Human
uuaacuuaauaauc

SEQ ID NO: 1978645 - RNA, 16 nt, Human
uuaacuuaauaaucaa

SEQ ID NO: 1978646 - RNA, 17 nt, Human
uuaacuuaauaaucaag

SEQ ID NO: 1978647 - RNA, 14 nt, Human
uuaacuuaguuuug

SEQ ID NO: 1978648 - RNA, 17 nt, Human
uuaacuuaguuuugcau

SEQ ID NO: 1978649 - RNA, 17 nt, Human
uuaaccacuucagcuga

SEQ ID NO: 1978650 - RNA, 23 nt, Human
uuaaauguuuuuuuuuaaagacu

SEQ ID NO: 1978651 - RNA, 21 nt, Human
uuaaauguuuuuuuuuaaaga

SEQ ID NO: 1978652 - RNA, 17 nt, Human
uuaaauuacauuuguaa

SEQ ID NO: 1978653 - RNA, 18 nt, Human
uuaaauuacauuuguaau

SEQ ID NO: 1978654 - RNA, 16 nt, Human
uuaaauuacauuugua

SEQ ID NO: 1978655 - RNA, 21 nt, Human
uuaaauguuuuguaaacuuug

SEQ ID NO: 1978656 - RNA, 23 nt, Human
uuaaauguuuuguaaacuuugaa

SEQ ID NO: 1978657 - RNA, 17 nt, Human
uuaaagaauuucuuuau

SEQ ID NO: 1978658 - RNA, 11 nt, Human
uuaaauguuuu

SEQ ID NO: 1978659 - RNA, 12 nt, Human
uuaaauguuuug

SEQ ID NO: 1978660 - RNA, 14 nt, Human
uuaaauguuuugua

SEQ ID NO: 1978661 - RNA, 15 nt, Human
uuaaauguuuuguaa

SEQ ID NO: 1978662 - RNA, 18 nt, Human
uuaaauguuuuguaaacu

SEQ ID NO: 1978663 - RNA, 19 nt, Human
uuaaauguuuuguaaacuu

SEQ ID NO: 1978664 - RNA, 20 nt, Human
uuaaauguuuuguaaacuuu

SEQ ID NO: 1978665 - RNA, 16 nt, Human
uggggauagaugugug

SEQ ID NO: 1978666 - RNA, 17 nt, Human
uggggauagaugugugg

SEQ ID NO: 1978667 - RNA, 18 nt, Human
uggggauagaugugugga

SEQ ID NO: 1978668 - RNA, 20 nt, Human
uggggauagauguguggaca

SEQ ID NO: 1978669 - RNA, 16 nt, Human
ugggcuucugugccca

SEQ ID NO: 1978670 - RNA, 14 nt, Human
ugggcuugcugugg

SEQ ID NO: 1978671 - RNA, 12 nt, Human
ugggccuucagg

SEQ ID NO: 1978672 - RNA, 12 nt, Human
ugggcuucugug

SEQ ID NO: 1978673 - RNA, 20 nt, Human
uggggccaguuggucccccu

SEQ ID NO: 1978674 - RNA, 22 nt, Human
uggggccaggcugggucgcccu

SEQ ID NO: 1978675 - RNA, 21 nt, Human
uggggccaggcugggucgccc

SEQ ID NO: 1978676 - RNA, 15 nt, Human
uggggaugagaaagg

SEQ ID NO: 1978677 - RNA, 20 nt, Human
uggggccaggcugggucgcc

SEQ ID NO: 1978678 - RNA, 23 nt, Human
uggggaugagaaagguugaagca

SEQ ID NO: 1978679 - RNA, 14 nt, Human
ugggggucugugug

SEQ ID NO: 1978680 - RNA, 16 nt, Human
ugggggaguggccaca

SEQ ID NO: 1978681 - RNA, 13 nt, Human
uggggggggugcu

SEQ ID NO: 1978682 - RNA, 20 nt, Human
ugggggaggggagacuuuga

SEQ ID NO: 1978683 - RNA, 22 nt, Human
uggggguguucagccacugagg

SEQ ID NO: 1978684 - RNA, 15 nt, Human
uggggguucuuucuu

SEQ ID NO: 1978685 - RNA, 19 nt, Human
uggggguucuuucuuccuc

SEQ ID NO: 1978686 - RNA, 20 nt, Human
uggggguucuuucuuccucu

SEQ ID NO: 1978687 - RNA, 22 nt, Human
uggggguucuuucuuccucugc

SEQ ID NO: 1978688 - RNA, 17 nt, Human
uggguacuuguggacac

SEQ ID NO: 1978689 - RNA, 18 nt, Human
uggguacuuguggacaca

SEQ ID NO: 1978690 - RNA, 13 nt, Human
ugggauccuccag

SEQ ID NO: 1978691 - RNA, 12 nt, Human
ugggauccucca

SEQ ID NO: 1978692 - RNA, 14 nt, Human
ugggauccuccagg

SEQ ID NO: 1978693 - RNA, 15 nt, Human
ugggauccaggcccc

SEQ ID NO: 1978694 - RNA, 18 nt, Human
ugggauccaggccccucc

SEQ ID NO: 1978695 - RNA, 20 nt, Human
ugggauccaggccccucccu

SEQ ID NO: 1978696 - RNA, 22 nt, Human
ugggcagagcagagaccauccc

SEQ ID NO: 1978697 - RNA, 17 nt, Human
ugggauuacaggcguga

SEQ ID NO: 1978698 - RNA, 18 nt, Human
ugggcagagcagagacca

SEQ ID NO: 1978699 - RNA, 22 nt, Human
ugggauuacaagcgugagccac

SEQ ID NO: 1978700 - RNA, 16 nt, Human
ugggagugggcccaau

SEQ ID NO: 1978701 - RNA, 14 nt, Human
ugggagugggccca

SEQ ID NO: 1978702 - RNA, 11 nt, Human
ugggagugugu

SEQ ID NO: 1978703 - RNA, 13 nt, Human
ugggaguguguaa

SEQ ID NO: 1978704 - RNA, 19 nt, Human
ugggaucacauguggacuu

SEQ ID NO: 1978705 - RNA, 18 nt, Human
ugggagugugguuucuuu

SEQ ID NO: 1978706 - RNA, 16 nt, Human
uggcugggggccucag

SEQ ID NO: 1978707 - RNA, 17 nt, Human
uggcugggggccucagu

SEQ ID NO: 1978708 - RNA, 22 nt, Human
ugggagugaggaugucugggcc

SEQ ID NO: 1978709 - RNA, 20 nt, Human
uggcugggggccucagugcc

SEQ ID NO: 1978710 - RNA, 19 nt, Human
ugggccuggcucccucacu

SEQ ID NO: 1978711 - RNA, 14 nt, Human
ugggccuggcuccc

SEQ ID NO: 1978712 - RNA, 11 nt, Human
ugggccuucag

SEQ ID NO: 1978713 - RNA, 21 nt, Human
ugggccuggcucccucacucu

SEQ ID NO: 1978714 - RNA, 23 nt, Human
ugggccccugccucucugcaggu

SEQ ID NO: 1978715 - RNA, 21 nt, Human
ugggccccugccucucugcag

SEQ ID NO: 1978716 - RNA, 14 nt, Human
ugggcaggagacug

SEQ ID NO: 1978717 - RNA, 23 nt, Human
ugggcagagcagagaccaucccu

SEQ ID NO: 1978718 - RNA, 14 nt, Human
uggucggaaaacau

SEQ ID NO: 1978719 - RNA, 18 nt, Human
uggucgccuuccaccucu

SEQ ID NO: 1978720 - RNA, 17 nt, Human
uggucggaaaacaugcu

SEQ ID NO: 1978721 - RNA, 14 nt, Human
uggucuaauguuua

SEQ ID NO: 1978722 - RNA, 19 nt, Human
uggucguaaacaucucaga

SEQ ID NO: 1978723 - RNA, 20 nt, Human
uggucgaaaguuaguaggau

SEQ ID NO: 1978724 - RNA, 20 nt, Human
ugguccuggaggcucaaauu

SEQ ID NO: 1978725 - RNA, 13 nt, Human
ugguccuguagga

SEQ ID NO: 1978726 - RNA, 20 nt, Human
ugguccuguaggaguucuau

SEQ ID NO: 1978727 - RNA, 18 nt, Human
uggucuacacugugcuga

SEQ ID NO: 1978728 - RNA, 17 nt, Human
uggucuacacugugcug

SEQ ID NO: 1978729 - RNA, 16 nt, Human
uggucuacacugugcu

SEQ ID NO: 1978730 - RNA, 15 nt, Human
uggucuacacugugc

SEQ ID NO: 1978731 - RNA, 19 nt, Human
uggucuacacugugcugag

SEQ ID NO: 1978732 - RNA, 21 nt, Human
uggucuaauguuuaagcagaa

SEQ ID NO: 1978733 - RNA, 15 nt, Human
uggucuaauguuuaa

SEQ ID NO: 1978734 - RNA, 19 nt, Human
uggucuaauguuuaagcag

SEQ ID NO: 1978735 - RNA, 16 nt, Human
uggugaauuucacaag

SEQ ID NO: 1978736 - RNA, 13 nt, Human
uggugaccucugc

SEQ ID NO: 1978737 - RNA, 14 nt, Human
uggugaccucugcc

SEQ ID NO: 1978738 - RNA, 23 nt, Human
uggugcacgcuggggaagaauuu

SEQ ID NO: 1978739 - RNA, 21 nt, Human
uggugcaaugaccuuucaaua

SEQ ID NO: 1978740 - RNA, 14 nt, Human
uggugaugcagucu

SEQ ID NO: 1978741 - RNA, 15 nt, Human
uggugaguuaggaac

SEQ ID NO: 1978742 - RNA, 16 nt, Human
uggugacuuugcuuca

SEQ ID NO: 1978743 - RNA, 12 nt, Human
uggugagcauua

SEQ ID NO: 1978744 - RNA, 18 nt, Human
uggugagcauuacaggca

SEQ ID NO: 1978745 - RNA, 21 nt, Human
uggugaccuuccaagagccug

SEQ ID NO: 1978746 - RNA, 22 nt, Human
uggugaccuuccaagagccuga

SEQ ID NO: 1978747 - RNA, 19 nt, Human
uggugacuuuccucuuugg

SEQ ID NO: 1978748 - RNA, 15 nt, Human
uggugaccucugccu

SEQ ID NO: 1978749 - RNA, 16 nt, Human
uggugaccucugccug

SEQ ID NO: 1978750 - RNA, 17 nt, Human
uggugaccucugccuga

SEQ ID NO: 1978751 - RNA, 22 nt, Human
uggugaccucugccugaaguca

SEQ ID NO: 1978752 - RNA, 21 nt, Human
uggucaaacaaacucucugaa

SEQ ID NO: 1978753 - RNA, 16 nt, Human
uggucaaacaaacucu

SEQ ID NO: 1978754 - RNA, 22 nt, Human
ugguaugcuugcauauauuuca

SEQ ID NO: 1978755 - RNA, 22 nt, Human
uggucaaacaaacucucugaac

SEQ ID NO: 1978756 - RNA, 17 nt, Human
uggucacaggaaguaga

SEQ ID NO: 1978757 - RNA, 22 nt, Human
uggucacaggaaguagaggagg

SEQ ID NO: 1978758 - RNA, 18 nt, Human
uggucacaggacucugcc

SEQ ID NO: 1978759 - RNA, 14 nt, Human
uggucaacauuucu

SEQ ID NO: 1978760 - RNA, 14 nt, Human
uggucccccuucca

SEQ ID NO: 1978761 - RNA, 19 nt, Human
uggucacaggacucugccu

SEQ ID NO: 1978762 - RNA, 23 nt, Human
ugguccugcugcaguugccaguc

SEQ ID NO: 1978763 - RNA, 15 nt, Human
ugguccugcugcagu

SEQ ID NO: 1978764 - RNA, 13 nt, Human
ugguccugcugca

SEQ ID NO: 1978765 - RNA, 14 nt, Human
ugguccucacacuc

SEQ ID NO: 1978766 - RNA, 19 nt, Human
ugguccuaaucuucugaac

SEQ ID NO: 1978767 - RNA, 17 nt, Human
ugguccuaaucuucuga

SEQ ID NO: 1978768 - RNA, 23 nt, Human
uggucccccuuccauggacuuug

SEQ ID NO: 1978769 - RNA, 18 nt, Human
uggucccccuuccaugga

SEQ ID NO: 1978770 - RNA, 16 nt, Human
uggucccccuuccaug

SEQ ID NO: 1978771 - RNA, 15 nt, Human
uggucccccuuccau

SEQ ID NO: 1978772 - RNA, 17 nt, Human
uggcaauaaauuuugaa

SEQ ID NO: 1978773 - RNA, 18 nt, Human
uggcaauaaauuuugaaa

SEQ ID NO: 1978774 - RNA, 20 nt, Human
uggcaauaaauuuugaaaag

SEQ ID NO: 1978775 - RNA, 21 nt, Human
uggcaauaaauuuugaaaagu

SEQ ID NO: 1978776 - RNA, 16 nt, Human
uggcacuauaauguaa

SEQ ID NO: 1978777 - RNA, 15 nt, Human
uggcacuauaaugua

SEQ ID NO: 1978778 - RNA, 19 nt, Human
uggcaaacucuccaccaca

SEQ ID NO: 1978779 - RNA, 20 nt, Human
uggcaaagcuguucuuccug

SEQ ID NO: 1978780 - RNA, 17 nt, Human
uggcaaagcuguucuuc

SEQ ID NO: 1978781 - RNA, 19 nt, Human
uggcaaagcuguucuuccu

SEQ ID NO: 1978782 - RNA, 23 nt, Human
uggcaaagcagcaacacacaugc

SEQ ID NO: 1978783 - RNA, 12 nt, Human
uggcaaaaaggc

SEQ ID NO: 1978784 - RNA, 19 nt, Human
uggaucugugaggggcucu

SEQ ID NO: 1978785 - RNA, 16 nt, Human
uggcaaaaaggcagga

SEQ ID NO: 1978786 - RNA, 15 nt, Human
uggaucugugagggg

SEQ ID NO: 1978787 - RNA, 16 nt, Human
uggaguuggaguucau

SEQ ID NO: 1978788 - RNA, 19 nt, Human
uggaguuggggcagaggag

SEQ ID NO: 1978789 - RNA, 23 nt, Human
uggaggaaggaaacccagcucug

SEQ ID NO: 1978790 - RNA, 21 nt, Human
uggaggaaggaaacccagcuc

SEQ ID NO: 1978791 - RNA, 14 nt, Human
uggagacugucuca

SEQ ID NO: 1978792 - RNA, 13 nt, Human
uggacuccucugu

SEQ ID NO: 1978793 - RNA, 21 nt, Human
uggagaagcucccugaaguaa

SEQ ID NO: 1978794 - RNA, 15 nt, Human
uggagaaucacaggc

SEQ ID NO: 1978795 - RNA, 16 nt, Human
uggagaaucacaggcu

SEQ ID NO: 1978796 - RNA, 17 nt, Human
uggagaaucacaggcug

SEQ ID NO: 1978797 - RNA, 18 nt, Human
uggagaaucacaggcugg

SEQ ID NO: 1978798 - RNA, 19 nt, Human
uggagaaucacaggcuggg

SEQ ID NO: 1978799 - RNA, 20 nt, Human
uggagaaucacaggcugggc

SEQ ID NO: 1978800 - RNA, 22 nt, Human
uggagaaucacaggcugggcug

SEQ ID NO: 1978801 - RNA, 23 nt, Human
uggagaaucacaggcugggcugg

SEQ ID NO: 1978802 - RNA, 20 nt, Human
uggagaaucucaacaugucu

SEQ ID NO: 1978803 - RNA, 21 nt, Human
uggagaaugcaccauacucau

SEQ ID NO: 1978804 - RNA, 22 nt, Human
uggagaaugcaccauacucaug

SEQ ID NO: 1978805 - RNA, 20 nt, Human
uggagacugcuccugagccc

SEQ ID NO: 1978806 - RNA, 22 nt, Human
uggagacugcuccugagccccc

SEQ ID NO: 1978807 - RNA, 23 nt, Human
uggagacugcuccugagccccca

SEQ ID NO: 1978808 - RNA, 17 nt, Human
ugcuguugcugauuuua

SEQ ID NO: 1978809 - RNA, 22 nt, Human
ugcuguuuaucccuuaagaaug

SEQ ID NO: 1978810 - RNA, 23 nt, Human
ugcuguuucccggggaggaaaca

SEQ ID NO: 1978811 - RNA, 19 nt, Human
uggccagaugcaccagccc

SEQ ID NO: 1978812 - RNA, 16 nt, Human
uggccaggcugcucuu

SEQ ID NO: 1978813 - RNA, 17 nt, Human
uggccaggcugcucuug

SEQ ID NO: 1978814 - RNA, 13 nt, Human
uggccaggcugcu

SEQ ID NO: 1978815 - RNA, 17 nt, Human
uggccaggcugcucuca

SEQ ID NO: 1978816 - RNA, 19 nt, Human
uggccaggcugcucucaaa

SEQ ID NO: 1978817 - RNA, 21 nt, Human
uggccaggaaguagcacaggc

SEQ ID NO: 1978818 - RNA, 22 nt, Human
uggccaggaaguagcacaggcu

SEQ ID NO: 1978819 - RNA, 20 nt, Human
uggccaggaaguagcacagg

SEQ ID NO: 1978820 - RNA, 19 nt, Human
uggccaggaaguagcacag

SEQ ID NO: 1978821 - RNA, 15 nt, Human
uggcagaguugaaga

SEQ ID NO: 1978822 - RNA, 12 nt, Human
uggcagaggagg

SEQ ID NO: 1978823 - RNA, 21 nt, Human
uggcagaguggauucuugaac

SEQ ID NO: 1978824 - RNA, 19 nt, Human
uggcagaguugaagacaga

SEQ ID NO: 1978825 - RNA, 17 nt, Human
uggcagaguugaagaca

SEQ ID NO: 1978826 - RNA, 17 nt, Human
uggccagaugcaccagc

SEQ ID NO: 1978827 - RNA, 18 nt, Human
uggccagaugcaccagcc

SEQ ID NO: 1978828 - RNA, 19 nt, Human
uggcccagggggcuuccug

SEQ ID NO: 1978829 - RNA, 21 nt, Human
uggcccagggggcuuccugag

SEQ ID NO: 1978830 - RNA, 23 nt, Human
uggcccagggugagguggcaugg

SEQ ID NO: 1978831 - RNA, 20 nt, Human
uggccaggcugcucuugaac

SEQ ID NO: 1978832 - RNA, 13 nt, Human
uggccaggcuggu

SEQ ID NO: 1978833 - RNA, 14 nt, Human
uggccccugcccgg

SEQ ID NO: 1978834 - RNA, 15 nt, Human
uggccccugcccggc

SEQ ID NO: 1978835 - RNA, 16 nt, Human
uggccccugcccggcu

SEQ ID NO: 1978836 - RNA, 20 nt, Human
uggccccugcccggcugcgg

SEQ ID NO: 1978837 - RNA, 23 nt, Human
uggcgcugccccuggcagccccu

SEQ ID NO: 1978838 - RNA, 16 nt, Human
uggcgcugccccuggc

SEQ ID NO: 1978839 - RNA, 23 nt, Human
uggcgcagcauauucaggaagcu

SEQ ID NO: 1978840 - RNA, 22 nt, Human
uggcgcagcauauucaggaagc

SEQ ID NO: 1978841 - RNA, 18 nt, Human
uggccucccacagacuca

SEQ ID NO: 1978842 - RNA, 23 nt, Human
uggccucccaacucaccccagcc

SEQ ID NO: 1978843 - RNA, 22 nt, Human
uggccucagaggacccuuucca

SEQ ID NO: 1978844 - RNA, 15 nt, Human
uggcgggguggggug

SEQ ID NO: 1978845 - RNA, 14 nt, Human
uggcucccacaggc

SEQ ID NO: 1978846 - RNA, 17 nt, Human
uggcucccacaggcccu

SEQ ID NO: 1978847 - RNA, 20 nt, Human
uggcucccacaggcccuucc

SEQ ID NO: 1978848 - RNA, 15 nt, Human
uggcugcuucaagga

SEQ ID NO: 1978849 - RNA, 11 nt, Human
uggcugcuuca

SEQ ID NO: 1978850 - RNA, 18 nt, Human
uggcuccucccggugccc

SEQ ID NO: 1978851 - RNA, 19 nt, Human
uggcuccucccggugccca

SEQ ID NO: 1978852 - RNA, 14 nt, Human
uggcuccucccggu

SEQ ID NO: 1978853 - RNA, 16 nt, Human
uggcuccucccggugc

SEQ ID NO: 1978854 - RNA, 18 nt, Human
ugcccaggcuggcgugca

SEQ ID NO: 1978855 - RNA, 19 nt, Human
ugcccaggcuggcgugcag

SEQ ID NO: 1978856 - RNA, 20 nt, Human
ugcccaggcuggcgugcagu

SEQ ID NO: 1978857 - RNA, 23 nt, Human
ugccccaaauggauuccuguuuc

SEQ ID NO: 1978858 - RNA, 19 nt, Human
ugcccauuguuuuucugau

SEQ ID NO: 1978859 - RNA, 22 nt, Human
ugccccaaguuuugugaaauuu

SEQ ID NO: 1978860 - RNA, 12 nt, Human
ugcccggcugcg

SEQ ID NO: 1978861 - RNA, 14 nt, Human
ugcccggcugcgga

SEQ ID NO: 1978862 - RNA, 13 nt, Human
ugcccgccaccac

SEQ ID NO: 1978863 - RNA, 16 nt, Human
ugccccuggcagcccc

SEQ ID NO: 1978864 - RNA, 19 nt, Human
ugccccuccucucugcccu

SEQ ID NO: 1978865 - RNA, 20 nt, Human
ugccccuccucucugcccua

SEQ ID NO: 1978866 - RNA, 15 nt, Human
ugccccucccuucaa

SEQ ID NO: 1978867 - RNA, 16 nt, Human
ugccccucccuucaac

SEQ ID NO: 1978868 - RNA, 17 nt, Human
ugccccuccucucugcc

SEQ ID NO: 1978869 - RNA, 18 nt, Human
ugccccuccucucugccc

SEQ ID NO: 1978870 - RNA, 19 nt, Human
ugcccugucaggaggcaga

SEQ ID NO: 1978871 - RNA, 16 nt, Human
ugcccugucaggaggc

SEQ ID NO: 1978872 - RNA, 23 nt, Human
ugcccugguuuccugcccuggga

SEQ ID NO: 1978873 - RNA, 19 nt, Human
ugcccugguuuccugcccu

SEQ ID NO: 1978874 - RNA, 20 nt, Human
ugcccugguuuccugcccug

SEQ ID NO: 1978875 - RNA, 12 nt, Human
ugcccuggugcu

SEQ ID NO: 1978876 - RNA, 14 nt, Human
ugcccuggugcugc

SEQ ID NO: 1978877 - RNA, 16 nt, Human
ugcccuggugcugcca

SEQ ID NO: 1978878 - RNA, 17 nt, Human
ugcccuggugcugccac

SEQ ID NO: 1978879 - RNA, 17 nt, Human
ugcccugguuuccugcc

SEQ ID NO: 1978880 - RNA, 18 nt, Human
ugcccugguuuccugccc

SEQ ID NO: 1978881 - RNA, 20 nt, Human
ugcccugcccaccuggccuc

SEQ ID NO: 1978882 - RNA, 16 nt, Human
ugcccugcccaccugg

SEQ ID NO: 1978883 - RNA, 14 nt, Human
ugcccugcccaccu

SEQ ID NO: 1978884 - RNA, 15 nt, Human
ugcccugcccaccug

SEQ ID NO: 1978885 - RNA, 13 nt, Human
ugcccugggaggc

SEQ ID NO: 1978886 - RNA, 15 nt, Human
ugcccugggaggcag

SEQ ID NO: 1978887 - RNA, 17 nt, Human
ugcccugggaggcagug

SEQ ID NO: 1978888 - RNA, 18 nt, Human
ugcccugggaggcaguga

SEQ ID NO: 1978889 - RNA, 16 nt, Human
ugccucggauccccuu

SEQ ID NO: 1978890 - RNA, 23 nt, Human
ugccucgacacgugggcuccccu

SEQ ID NO: 1978891 - RNA, 24 nt, Human
ugccucgacacgugggcuccccuc

SEQ ID NO: 1978892 - RNA, 18 nt, Human
ugccucggauccccuucc

SEQ ID NO: 1978893 - RNA, 14 nt, Human
ugccuccucuucaa

SEQ ID NO: 1978894 - RNA, 16 nt, Human
ugccuccucuucaacu

SEQ ID NO: 1978895 - RNA, 14 nt, Human
ugccucaagagaag

SEQ ID NO: 1978896 - RNA, 15 nt, Human
ugccucaagagaagg

SEQ ID NO: 1978897 - RNA, 16 nt, Human
ugccuauaagccaaaa

SEQ ID NO: 1978898 - RNA, 17 nt, Human
ugccuauaagccaaaau

SEQ ID NO: 1978899 - RNA, 20 nt, Human
ugccuauaagccaaaauuaa

SEQ ID NO: 1978900 - RNA, 21 nt, Human
ugccuauaagccaaaauuaag

SEQ ID NO: 1978901 - RNA, 15 nt, Human
ugccuauauuuuccu

SEQ ID NO: 1978902 - RNA, 16 nt, Human
ugccuaacaaaauauu

SEQ ID NO: 1978903 - RNA, 12 nt, Human
ugccuaaaauaa

SEQ ID NO: 1978904 - RNA, 20 nt, Human
ugccuaaauaaguuauaaag

SEQ ID NO: 1978905 - RNA, 21 nt, Human
ugcauuuggugguuucagaaa

SEQ ID NO: 1978906 - RNA, 14 nt, Human
ugcauuugcuuuug

SEQ ID NO: 1978907 - RNA, 13 nt, Human
ugcauuuggaaca

SEQ ID NO: 1978908 - RNA, 12 nt, Human
ugccaaacauua

SEQ ID NO: 1978909 - RNA, 19 nt, Human
ugccaaacauuaauguuga

SEQ ID NO: 1978910 - RNA, 20 nt, Human
ugccaaacauuaauguugau

SEQ ID NO: 1978911 - RNA, 23 nt, Human
ugcauuuggugguuucagaaaug

SEQ ID NO: 1978912 - RNA, 14 nt, Human
ugccaggcauggug

SEQ ID NO: 1978913 - RNA, 22 nt, Human
ugccaggaagccagcaggcucu

SEQ ID NO: 1978914 - RNA, 20 nt, Human
ugccaggaagccagcaggcu

SEQ ID NO: 1978915 - RNA, 16 nt, Human
ugccacuaaauugaca

SEQ ID NO: 1978916 - RNA, 10 nt, Human
ugccaccucc

SEQ ID NO: 1978917 - RNA, 13 nt, Human
ugccaccuccccu

SEQ ID NO: 1978918 - RNA, 17 nt, Human
ugccaccuccccuugcc

SEQ ID NO: 1978919 - RNA, 18 nt, Human
ugccaccuccccuugcca

SEQ ID NO: 1978920 - RNA, 21 nt, Human
ugccaccuccccuugccagcu

SEQ ID NO: 1978921 - RNA, 22 nt, Human
ugccaccuccccuugccagcug

SEQ ID NO: 1978922 - RNA, 13 nt, Human
ugcagggaguccg

SEQ ID NO: 1978923 - RNA, 15 nt, Human
ugauuuaauuugaaa

SEQ ID NO: 1978924 - RNA, 13 nt, Human
ugcaguuacaaau

SEQ ID NO: 1978925 - RNA, 18 nt, Human
ugcaguuacaaauuauaa

SEQ ID NO: 1978926 - RNA, 21 nt, Human
ugcaguuacacuaaaagguga

SEQ ID NO: 1978927 - RNA, 19 nt, Human
ugcaguuacaaauuauaau

SEQ ID NO: 1978928 - RNA, 21 nt, Human
ugcaguuacaaauuauaaugu

SEQ ID NO: 1978929 - RNA, 13 nt, Human
ugcaguucccauc

SEQ ID NO: 1978930 - RNA, 23 nt, Human
ugcaguuacaaauuauaauguau

SEQ ID NO: 1978931 - RNA, 23 nt, Human
ugcaguuccccuggaagcagugc

SEQ ID NO: 1978932 - RNA, 20 nt, Human
ugcaguggugcgaucugggu

SEQ ID NO: 1978933 - RNA, 21 nt, Human
ugcaguggugcgaucuggguu

SEQ ID NO: 1978934 - RNA, 16 nt, Human
ugcaguugccagucac

SEQ ID NO: 1978935 - RNA, 20 nt, Human
ugcauagguuagauauagag

SEQ ID NO: 1978936 - RNA, 18 nt, Human
ugcauauaacuuauauug

SEQ ID NO: 1978937 - RNA, 13 nt, Human
ugcauauuacugu

SEQ ID NO: 1978938 - RNA, 22 nt, Human
ugcauauuacuguacaugggac

SEQ ID NO: 1978939 - RNA, 18 nt, Human
ugcauauuauuuuauguu

SEQ ID NO: 1978940 - RNA, 22 nt, Human
ugcauaguaaauguaguucaua

SEQ ID NO: 1978941 - RNA, 14 nt, Human
ugcauaguauucca

SEQ ID NO: 1978942 - RNA, 14 nt, Human
ugcauauaacuuau

SEQ ID NO: 1978943 - RNA, 15 nt, Human
ugcauauaacuuaua

SEQ ID NO: 1978944 - RNA, 16 nt, Human
ugcauauaacuuauau

SEQ ID NO: 1978945 - RNA, 22 nt, Human
ugcauauucuaguaauaaagac

SEQ ID NO: 1978946 - RNA, 17 nt, Human
ugcgccaccgcccagag

SEQ ID NO: 1978947 - RNA, 15 nt, Human
ugcgcauaggccugc

SEQ ID NO: 1978948 - RNA, 20 nt, Human
ugcgcauaggccugcuuugu

SEQ ID NO: 1978949 - RNA, 13 nt, Human
ugcgcaguugcug

SEQ ID NO: 1978950 - RNA, 11 nt, Human
ugcgcuucacu

SEQ ID NO: 1978951 - RNA, 14 nt, Human
ugcgcuucacuugg

SEQ ID NO: 1978952 - RNA, 15 nt, Human
ugcgcuucacuuggg

SEQ ID NO: 1978953 - RNA, 16 nt, Human
ugcgcuucacuugggu

SEQ ID NO: 1978954 - RNA, 23 nt, Human
ugccuugcccacuccugcucugc

SEQ ID NO: 1978955 - RNA, 21 nt, Human
ugcgcaggcuggcccugcccu

SEQ ID NO: 1978956 - RNA, 22 nt, Human
ugcgcaggcuggcccugcccug

SEQ ID NO: 1978957 - RNA, 23 nt, Human
ugcgcaggcuggcccugcccugg

SEQ ID NO: 1978958 - RNA, 20 nt, Human
ugccuugcauaauggucaga

SEQ ID NO: 1978959 - RNA, 19 nt, Human
ugccuugcccacuccugcu

SEQ ID NO: 1978960 - RNA, 16 nt, Human
ugcuaagaauuuuuua

SEQ ID NO: 1978961 - RNA, 19 nt, Human
ugcuaagaauuuuuuauuu

SEQ ID NO: 1978962 - RNA, 20 nt, Human
ugcuaagaauuuuuuauuuu

SEQ ID NO: 1978963 - RNA, 17 nt, Human
ugcuaagaauauuugaa

SEQ ID NO: 1978964 - RNA, 21 nt, Human
ugcuaagaauauuugaaugua

SEQ ID NO: 1978965 - RNA, 22 nt, Human
ugcuaagaauauuugaauguau

SEQ ID NO: 1978966 - RNA, 21 nt, Human
ugcuacuguccuacccacccu

SEQ ID NO: 1978967 - RNA, 22 nt, Human
ugcuacuguccuacccacccuc

SEQ ID NO: 1978968 - RNA, 13 nt, Human
ugcuagaaaaauu

SEQ ID NO: 1978969 - RNA, 14 nt, Human
ugcuaagaaaccag

SEQ ID NO: 1978970 - RNA, 15 nt, Human
ugcuaaacguguaug

SEQ ID NO: 1978971 - RNA, 16 nt, Human
ugcuaaacguguaugu

SEQ ID NO: 1978972 - RNA, 17 nt, Human
ugcggacagccacggcc

SEQ ID NO: 1978973 - RNA, 22 nt, Human
ugcgcuucacuuggguccaggc

SEQ ID NO: 1978974 - RNA, 19 nt, Human
ugcgcuuguuuuaaagugg

SEQ ID NO: 1978975 - RNA, 15 nt, Human
ugcguguucucagag

SEQ ID NO: 1978976 - RNA, 20 nt, Human
ugcuaggaacacuccuucac

SEQ ID NO: 1978977 - RNA, 21 nt, Human
ugcuaggaacacuccuucaca

SEQ ID NO: 1978978 - RNA, 22 nt, Human
ugcuaggaacacuccuucacag

SEQ ID NO: 1978979 - RNA, 13 nt, Human
ugcuagaacuccc

SEQ ID NO: 1978980 - RNA, 14 nt, Human
ugcuagaacucccu

SEQ ID NO: 1978981 - RNA, 15 nt, Human
ugcuagaacucccuu

SEQ ID NO: 1978982 - RNA, 17 nt, Human
ugcuagaacucccuuuc

SEQ ID NO: 1978983 - RNA, 19 nt, Human
ugcucagggaaaagcagcu

SEQ ID NO: 1978984 - RNA, 14 nt, Human
ugcucagaccagcu

SEQ ID NO: 1978985 - RNA, 20 nt, Human
ugcucaggagcccugggagg

SEQ ID NO: 1978986 - RNA, 19 nt, Human
ugcucaggagcccugggag

SEQ ID NO: 1978987 - RNA, 18 nt, Human
ugcucaggagcccuggga

SEQ ID NO: 1978988 - RNA, 17 nt, Human
ugcucacauaucuguca

SEQ ID NO: 1978989 - RNA, 15 nt, Human
ugcucaggagcccug

SEQ ID NO: 1978990 - RNA, 23 nt, Human
ugcucuaaaauauuuaugaagaa

SEQ ID NO: 1978991 - RNA, 13 nt, Human
ugcucuaaaauau

SEQ ID NO: 1978992 - RNA, 14 nt, Human
ugcucuaaaauauu

SEQ ID NO: 1978993 - RNA, 15 nt, Human
ugcucuaaaauauuu

SEQ ID NO: 1978994 - RNA, 19 nt, Human
ugcucuaaaauauuuauga

SEQ ID NO: 1978995 - RNA, 20 nt, Human
ugcucuaaaauauuuaugaa

SEQ ID NO: 1978996 - RNA, 12 nt, Human
ugcucuaaaaua

SEQ ID NO: 1978997 - RNA, 15 nt, Human
ugcucaguguuucau

SEQ ID NO: 1978998 - RNA, 16 nt, Human
ugcucaguguuucaua

SEQ ID NO: 1978999 - RNA, 17 nt, Human
ugcucuugaugccuggc

SEQ ID NO: 1979000 - RNA, 15 nt, Human
ugcucuugggcaaua

SEQ ID NO: 1979001 - RNA, 17 nt, Human
ugcucuugggcaauauu

SEQ ID NO: 1979002 - RNA, 18 nt, Human
ugcucuugggcaauauuc

SEQ ID NO: 1979003 - RNA, 19 nt, Human
ugcucuugggcaauauucu

SEQ ID NO: 1979004 - RNA, 21 nt, Human
ugcucuugggcaauauucucu

SEQ ID NO: 1979005 - RNA, 24 nt, Human
ugcucuugggcaauauucucugua

SEQ ID NO: 1979006 - RNA, 16 nt, Human
ugcucuuucccaccca

SEQ ID NO: 1979007 - RNA, 19 nt, Human
ugcucuuucccacccagcc

SEQ ID NO: 1979008 - RNA, 20 nt, Human
ugcucuuucccacccagccu

SEQ ID NO: 1979009 - RNA, 21 nt, Human
ugcucuuucccacccagccug

SEQ ID NO: 1979010 - RNA, 23 nt, Human
ugcucuccgaccagacaccuuga

SEQ ID NO: 1979011 - RNA, 12 nt, Human
ugcucuccucuu

SEQ ID NO: 1979012 - RNA, 13 nt, Human
ugcuggguguggc

SEQ ID NO: 1979013 - RNA, 22 nt, Human
ugcuggugggcuugucauagcc

SEQ ID NO: 1979014 - RNA, 14 nt, Human
ugcugguaaaauga

SEQ ID NO: 1979015 - RNA, 16 nt, Human
ugcugguaaaaugaag

SEQ ID NO: 1979016 - RNA, 17 nt, Human
ugcugguaaaaugaaga

SEQ ID NO: 1979017 - RNA, 18 nt, Human
ugcugguaaaaugaagaa

SEQ ID NO: 1979018 - RNA, 19 nt, Human
ugcugguaaaaugaagaau

SEQ ID NO: 1979019 - RNA, 20 nt, Human
ugcugggggggauuguaaaa

SEQ ID NO: 1979020 - RNA, 17 nt, Human
ugcugggcuugucugua

SEQ ID NO: 1979021 - RNA, 16 nt, Human
ugcuguuaucccugcc

SEQ ID NO: 1979022 - RNA, 18 nt, Human
ugcuguuacaguuuucuu

SEQ ID NO: 1979023 - RNA, 13 nt, Human
ugcuguuacaugc

SEQ ID NO: 1979024 - RNA, 18 nt, Human
ugcuguguguggcuucug

SEQ ID NO: 1979025 - RNA, 21 nt, Human
ugcuguguguugccugggaca

SEQ ID NO: 1979026 - RNA, 13 nt, Human
ugcuguguuugcu

SEQ ID NO: 1979027 - RNA, 17 nt, Human
ugcuguuacaguuuucu

SEQ ID NO: 1979028 - RNA, 16 nt, Human
ugcuguucaugaaaga

SEQ ID NO: 1979029 - RNA, 17 nt, Human
ugcuguucaugaaagau

SEQ ID NO: 1979030 - RNA, 13 nt, Human
ugcugguuuuagu

SEQ ID NO: 1979031 - RNA, 15 nt, Human
ugcuguaaaagcaag

SEQ ID NO: 1979032 - RNA, 18 nt, Human
ugcuguaacuuucugaaa

SEQ ID NO: 1979033 - RNA, 17 nt, Human
ugcugcauuuaaaagau

SEQ ID NO: 1979034 - RNA, 18 nt, Human
ugcugcauuuaaaagaua

SEQ ID NO: 1979035 - RNA, 19 nt, Human
ugcugcauuuaaaagauac

SEQ ID NO: 1979036 - RNA, 23 nt, Human
ugcugcauuuaaaagauacaguu

SEQ ID NO: 1979037 - RNA, 14 nt, Human
ugcugcauuuaaaa

SEQ ID NO: 1979038 - RNA, 17 nt, Human
ugcugccugcuuuuuau

SEQ ID NO: 1979039 - RNA, 15 nt, Human
ugcugccugcuuuuu

SEQ ID NO: 1979040 - RNA, 19 nt, Human
ugcugccucggauccccuu

SEQ ID NO: 1979041 - RNA, 20 nt, Human
ugcugccucggauccccuuc

SEQ ID NO: 1979042 - RNA, 22 nt, Human
ugcugccucggauccccuuccu

SEQ ID NO: 1979043 - RNA, 24 nt, Human
ugcugggccccugccucucugcag

SEQ ID NO: 1979044 - RNA, 23 nt, Human
ugcugggccccugccucucugca

SEQ ID NO: 1979045 - RNA, 22 nt, Human
ugcugggccccugccucucugc

SEQ ID NO: 1979046 - RNA, 21 nt, Human
ugcugggccccugccucucug

SEQ ID NO: 1979047 - RNA, 19 nt, Human
ugcugggccccugccucuc

SEQ ID NO: 1979048 - RNA, 18 nt, Human
ugcugggccccugccucu

SEQ ID NO: 1979049 - RNA, 17 nt, Human
ugcugggccccugccuc

SEQ ID NO: 1979050 - RNA, 16 nt, Human
ugcugggccccugccu

SEQ ID NO: 1979051 - RNA, 14 nt, Human
ugcugggccccugc

SEQ ID NO: 1979052 - RNA, 19 nt, Human
ugcugcuugaggcaacuca

SEQ ID NO: 1979053 - RNA, 20 nt, Human
ugcugggauuacagguguga

SEQ ID NO: 1979054 - RNA, 12 nt, Human
ugcugcuugagg

SEQ ID NO: 1979055 - RNA, 15 nt, Human
ugcugcuucauguuu

SEQ ID NO: 1979056 - RNA, 21 nt, Human
ugauuggaggggggagguggg

SEQ ID NO: 1979057 - RNA, 22 nt, Human
ugauuggaagggcuuuucaaaa

SEQ ID NO: 1979058 - RNA, 23 nt, Human
ugauuggaagggcuuuucaaaau

SEQ ID NO: 1979059 - RNA, 13 nt, Human
ugauuggaggggg

SEQ ID NO: 1979060 - RNA, 14 nt, Human
ugauugcuuuuaaa

SEQ ID NO: 1979061 - RNA, 16 nt, Human
ugauugcuuuuaaaau

SEQ ID NO: 1979062 - RNA, 17 nt, Human
ugauugcuuuuaaaauu

SEQ ID NO: 1979063 - RNA, 19 nt, Human
ugauugcuuuuaaaauuuu

SEQ ID NO: 1979064 - RNA, 20 nt, Human
ugauugcuuuuaaaauuuua

SEQ ID NO: 1979065 - RNA, 22 nt, Human
ugauugcuuuuaaaauuuuaag

SEQ ID NO: 1979066 - RNA, 19 nt, Human
ugauuggaagggcuuuuca

SEQ ID NO: 1979067 - RNA, 20 nt, Human
ugauuggaagggcuuuucaa

SEQ ID NO: 1979068 - RNA, 20 nt, Human
ugauuggcaggaguuggaag

SEQ ID NO: 1979069 - RNA, 17 nt, Human
ugauugguuucucuucu

SEQ ID NO: 1979070 - RNA, 16 nt, Human
ugauugugucucuugg

SEQ ID NO: 1979071 - RNA, 13 nt, Human
ugauuuaaacuuc

SEQ ID NO: 1979072 - RNA, 21 nt, Human
ugauuuaaacuucuuaacugg

SEQ ID NO: 1979073 - RNA, 11 nt, Human
ugauucucucc

SEQ ID NO: 1979074 - RNA, 12 nt, Human
ugauugaagaaa

SEQ ID NO: 1979075 - RNA, 14 nt, Human
ugauugaagaaaca

SEQ ID NO: 1979076 - RNA, 20 nt, Human
ugauugcagaauuguuuaga

SEQ ID NO: 1979077 - RNA, 18 nt, Human
ugauugaagaaacagcua

SEQ ID NO: 1979078 - RNA, 21 nt, Human
ugauugcagaauuguuuagau

SEQ ID NO: 1979079 - RNA, 21 nt, Human
ugauucagacagcugccuggg

SEQ ID NO: 1979080 - RNA, 20 nt, Human
ugauucagacagcugccugg

SEQ ID NO: 1979081 - RNA, 19 nt, Human
ugauucagacagcugccug

SEQ ID NO: 1979082 - RNA, 18 nt, Human
ugauucagacagcugccu

SEQ ID NO: 1979083 - RNA, 23 nt, Human
ugauucagacagcugccugggau

SEQ ID NO: 1979084 - RNA, 21 nt, Human
ugauucuccugccucagccuc

SEQ ID NO: 1979085 - RNA, 20 nt, Human
ugauucacauguuuucaaau

SEQ ID NO: 1979086 - RNA, 21 nt, Human
ugauucacauguuuucaaaug

SEQ ID NO: 1979087 - RNA, 12 nt, Human
ugauucacagug

SEQ ID NO: 1979088 - RNA, 13 nt, Human
ugauucacauguu

SEQ ID NO: 1979089 - RNA, 14 nt, Human
ugauucacauguuu

SEQ ID NO: 1979090 - RNA, 15 nt, Human
ugauucacauguuuu

SEQ ID NO: 1979091 - RNA, 16 nt, Human
ugauucacauguuuuc

SEQ ID NO: 1979092 - RNA, 17 nt, Human
ugauucacauguuuuca

SEQ ID NO: 1979093 - RNA, 18 nt, Human
ugauucacauguuuucaa

SEQ ID NO: 1979094 - RNA, 19 nt, Human
ugauucacauguuuucaaa

SEQ ID NO: 1979095 - RNA, 16 nt, Human
ugauucagacagcugc

SEQ ID NO: 1979096 - RNA, 15 nt, Human
ugauucagacagcug

SEQ ID NO: 1979097 - RNA, 14 nt, Human
ugauucagacagcu

SEQ ID NO: 1979098 - RNA, 13 nt, Human
ugauucagacagc

SEQ ID NO: 1979099 - RNA, 20 nt, Human
ugauucaacagguuuuccug

SEQ ID NO: 1979100 - RNA, 16 nt, Human
ugauuaccagggacug

SEQ ID NO: 1979101 - RNA, 15 nt, Human
ugauguugaugcaau

SEQ ID NO: 1979102 - RNA, 19 nt, Human
ugauguugaugcaauccuu

SEQ ID NO: 1979103 - RNA, 20 nt, Human
ugauguugacaucacuggca

SEQ ID NO: 1979104 - RNA, 14 nt, Human
ugauguugaugcaa

SEQ ID NO: 1979105 - RNA, 20 nt, Human
ugauguucuuucacccuuuu

SEQ ID NO: 1979106 - RNA, 14 nt, Human
ugauuaguaagucu

SEQ ID NO: 1979107 - RNA, 21 nt, Human
ugauuaguaagucuugccuau

SEQ ID NO: 1979108 - RNA, 13 nt, Human
ugauuauauguca

SEQ ID NO: 1979109 - RNA, 16 nt, Human
ugauguguuaucucuu

SEQ ID NO: 1979110 - RNA, 18 nt, Human
ugauguguugccacuuuc

SEQ ID NO: 1979111 - RNA, 20 nt, Human
ugauguguugccacuuucca

SEQ ID NO: 1979112 - RNA, 22 nt, Human
ugauguguuguucuuggcaaua

SEQ ID NO: 1979113 - RNA, 14 nt, Human
ugauguguuguucu

SEQ ID NO: 1979114 - RNA, 19 nt, Human
ugaugucccaacuuguaaa

SEQ ID NO: 1979115 - RNA, 18 nt, Human
ugaugucagcaguugcug

SEQ ID NO: 1979116 - RNA, 22 nt, Human
ugaugucagcaguugcugguaa

SEQ ID NO: 1979117 - RNA, 23 nt, Human
ugaugucagcaguugcugguaaa

SEQ ID NO: 1979118 - RNA, 18 nt, Human
ugaugcuucuucagagac

SEQ ID NO: 1979119 - RNA, 13 nt, Human
ugaugcuguauuc

SEQ ID NO: 1979120 - RNA, 17 nt, Human
ugaugcuucuucagaga

SEQ ID NO: 1979121 - RNA, 16 nt, Human
ugaugcuucuucagag

SEQ ID NO: 1979122 - RNA, 14 nt, Human
ugaugguuguacau

SEQ ID NO: 1979123 - RNA, 18 nt, Human
ugaugucaauaacaguau

SEQ ID NO: 1979124 - RNA, 13 nt, Human
ugaugguuguaca

SEQ ID NO: 1979125 - RNA, 14 nt, Human
ugaugguuccccug

SEQ ID NO: 1979126 - RNA, 18 nt, Human
ugaucuuugcagacaggc

SEQ ID NO: 1979127 - RNA, 15 nt, Human
ugaugauuucagaaa

SEQ ID NO: 1979128 - RNA, 16 nt, Human
ugaugauuucagaaac

SEQ ID NO: 1979129 - RNA, 18 nt, Human
ugaugcaauccuuacaaa

SEQ ID NO: 1979130 - RNA, 19 nt, Human
ugaugcaauccuuacaaau

SEQ ID NO: 1979131 - RNA, 23 nt, Human
ugaugcaauccuuacaaaugauu

SEQ ID NO: 1979132 - RNA, 16 nt, Human
ugaucuuugcagacag

SEQ ID NO: 1979133 - RNA, 17 nt, Human
ugaugcauuaaaagaaa

SEQ ID NO: 1979134 - RNA, 18 nt, Human
ugaugcauuaaaagaaaa

SEQ ID NO: 1979135 - RNA, 19 nt, Human
ugaugcauuaaaagaaaau

SEQ ID NO: 1979136 - RNA, 21 nt, Human
ugaugcauuaaaagaaaauaa

SEQ ID NO: 1979137 - RNA, 16 nt, Human
ugaugcgcaguugcug

SEQ ID NO: 1979138 - RNA, 21 nt, Human
ugaugccugugaacugaacuc

SEQ ID NO: 1979139 - RNA, 23 nt, Human
ugaugcuacaggauuugaaauug

SEQ ID NO: 1979140 - RNA, 11 nt, Human
ugaugccuggc

SEQ ID NO: 1979141 - RNA, 15 nt, Human
ugaugccugugaacu

SEQ ID NO: 1979142 - RNA, 20 nt, Human
ugaugccugugaacugaacu

SEQ ID NO: 1979143 - RNA, 20 nt, Human
ugaugcuacaggauuugaaa

SEQ ID NO: 1979144 - RNA, 12 nt, Human
ugaucuucacua

SEQ ID NO: 1979145 - RNA, 16 nt, Human
ugaucuuccucugcua

SEQ ID NO: 1979146 - RNA, 17 nt, Human
ugaucuuccucugcuaa

SEQ ID NO: 1979147 - RNA, 15 nt, Human
ugaucuguuauaggu

SEQ ID NO: 1979148 - RNA, 20 nt, Human
ugaucuucuuuauaauucua

SEQ ID NO: 1979149 - RNA, 18 nt, Human
ugaucuuccucugcuaaa

SEQ ID NO: 1979150 - RNA, 20 nt, Human
ugaucuuccucugcuaaauu

SEQ ID NO: 1979151 - RNA, 21 nt, Human
ugaucuuccucugcuaaauug

SEQ ID NO: 1979152 - RNA, 15 nt, Human
ugaucugugggcaca

SEQ ID NO: 1979153 - RNA, 14 nt, Human
ugaucugugccuuu

SEQ ID NO: 1979154 - RNA, 23 nt, Human
ugaucugugccuuuuuuauaucu

SEQ ID NO: 1979155 - RNA, 17 nt, Human
ugaucucucgugauuga

SEQ ID NO: 1979156 - RNA, 17 nt, Human
ugauccacccaccucag

SEQ ID NO: 1979157 - RNA, 18 nt, Human
ugauccacccaccucagc

SEQ ID NO: 1979158 - RNA, 19 nt, Human
ugauccacccaccucagcc

SEQ ID NO: 1979159 - RNA, 19 nt, Human
ugaucauucaccaguacau

SEQ ID NO: 1979160 - RNA, 14 nt, Human
ugaucucauuguuc

SEQ ID NO: 1979161 - RNA, 16 nt, Human
ugauagcaaaaucaag

SEQ ID NO: 1979162 - RNA, 12 nt, Human
ugauaagaaaac

SEQ ID NO: 1979163 - RNA, 14 nt, Human
ugauagcacagacc

SEQ ID NO: 1979164 - RNA, 13 nt, Human
ugauagcacagac

SEQ ID NO: 1979165 - RNA, 17 nt, Human
ugaucaguaguuugcau

SEQ ID NO: 1979166 - RNA, 19 nt, Human
ugaucaguaguuugcauuu

SEQ ID NO: 1979167 - RNA, 18 nt, Human
ugauagcaaauggccuca

SEQ ID NO: 1979168 - RNA, 17 nt, Human
ugauagcaaaaucaaga

SEQ ID NO: 1979169 - RNA, 13 nt, Human
ugauccaagcugg

SEQ ID NO: 1979170 - RNA, 14 nt, Human
ugauccaagcuggu

SEQ ID NO: 1979171 - RNA, 15 nt, Human
ugauccaagcugguc

SEQ ID NO: 1979172 - RNA, 19 nt, Human
ugaguccagaaguuugaga

SEQ ID NO: 1979173 - RNA, 13 nt, Human
ugaguccagaagu

SEQ ID NO: 1979174 - RNA, 21 nt, Human
ugaggugggaggaucucuuga

SEQ ID NO: 1979175 - RNA, 18 nt, Human
ugagguggcaugguccau

SEQ ID NO: 1979176 - RNA, 15 nt, Human
ugagucccaggcuga

SEQ ID NO: 1979177 - RNA, 19 nt, Human
ugagucgaggacagggagg

SEQ ID NO: 1979178 - RNA, 19 nt, Human
ugagucccaggcugagccu

SEQ ID NO: 1979179 - RNA, 18 nt, Human
ugagucuucauguuccca

SEQ ID NO: 1979180 - RNA, 19 nt, Human
ugagucuucauguucccac

SEQ ID NO: 1979181 - RNA, 17 nt, Human
ugagucuguucugguaa

SEQ ID NO: 1979182 - RNA, 14 nt, Human
ugagucuguucugg

SEQ ID NO: 1979183 - RNA, 16 nt, Human
ugagucuguucuggua

SEQ ID NO: 1979184 - RNA, 22 nt, Human
ugagucuuuuuuuuuuaaguga

SEQ ID NO: 1979185 - RNA, 13 nt, Human
ugagugagaauau

SEQ ID NO: 1979186 - RNA, 15 nt, Human
ugagugagaggggag

SEQ ID NO: 1979187 - RNA, 12 nt, Human
ugagucuuuuuu

SEQ ID NO: 1979188 - RNA, 20 nt, Human
ugagucuuuuuuuuuuaagu

SEQ ID NO: 1979189 - RNA, 18 nt, Human
ugagucugaaggcugggu

SEQ ID NO: 1979190 - RNA, 17 nt, Human
ugagucugaaggcuggg

SEQ ID NO: 1979191 - RNA, 15 nt, Human
ugagucugaaggcug

SEQ ID NO: 1979192 - RNA, 13 nt, Human
ugagucugaaggc

SEQ ID NO: 1979193 - RNA, 13 nt, Human
ugaguuuguuucu

SEQ ID NO: 1979194 - RNA, 14 nt, Human
ugaguuuguuucuu

SEQ ID NO: 1979195 - RNA, 19 nt, Human
ugaguuuguuucuuugaau

SEQ ID NO: 1979196 - RNA, 20 nt, Human
ugaguuuguuucuuugaauu

SEQ ID NO: 1979197 - RNA, 22 nt, Human
ugaguuuugggaaguuaaaggg

SEQ ID NO: 1979198 - RNA, 19 nt, Human
ugaguuuugggaaguuaaa

SEQ ID NO: 1979199 - RNA, 17 nt, Human
ugauaacaauguuuuaa

SEQ ID NO: 1979200 - RNA, 20 nt, Human
ugauaacaauguuuuaacaa

SEQ ID NO: 1979201 - RNA, 21 nt, Human
ugauaacaauguuuuaacaag

SEQ ID NO: 1979202 - RNA, 20 nt, Human
ugauaacagggauugauuuu

SEQ ID NO: 1979203 - RNA, 21 nt, Human
ugauaacagggauugauuuua

SEQ ID NO: 1979204 - RNA, 22 nt, Human
ugauaacagggauugauuuuaa

SEQ ID NO: 1979205 - RNA, 23 nt, Human
ugauaacagggauugauuuuaaa

SEQ ID NO: 1979206 - RNA, 20 nt, Human
ugauaaccauagcauuaaua

SEQ ID NO: 1979207 - RNA, 20 nt, Human
ugaguugauagcacagaccc

SEQ ID NO: 1979208 - RNA, 16 nt, Human
ugaguugauagcacag

SEQ ID NO: 1979209 - RNA, 14 nt, Human
ugagugagcaugcc

SEQ ID NO: 1979210 - RNA, 13 nt, Human
ugaguuucuuaga

SEQ ID NO: 1979211 - RNA, 14 nt, Human
ugaguuucuuagac

SEQ ID NO: 1979212 - RNA, 22 nt, Human
ugaguuugggccccagaggcug

SEQ ID NO: 1979213 - RNA, 23 nt, Human
ugaguuugggccccagaggcugg

SEQ ID NO: 1979214 - RNA, 12 nt, Human
ugaggcauuugu

SEQ ID NO: 1979215 - RNA, 23 nt, Human
ugaggcaucgcaauguaagacuc

SEQ ID NO: 1979216 - RNA, 14 nt, Human
ugaggcaguuugag

SEQ ID NO: 1979217 - RNA, 19 nt, Human
ugaggcauuuguuugaacu

SEQ ID NO: 1979218 - RNA, 20 nt, Human
ugaggcauuuguuugaacug

SEQ ID NO: 1979219 - RNA, 17 nt, Human
ugaggcuaguguggugu

SEQ ID NO: 1979220 - RNA, 21 nt, Human
ugaggcauuuguuugaacuga

SEQ ID NO: 1979221 - RNA, 23 nt, Human
ugaggcuagugugguguuuccug

SEQ ID NO: 1979222 - RNA, 23 nt, Human
ugaggcauuuguuugaacugaua

SEQ ID NO: 1979223 - RNA, 20 nt, Human
ugagcuggggaugucucuca

SEQ ID NO: 1979224 - RNA, 13 nt, Human
ugagcugggauga

SEQ ID NO: 1979225 - RNA, 14 nt, Human
ugaggcaggucccc

SEQ ID NO: 1979226 - RNA, 16 nt, Human
ugaggcagguccccag

SEQ ID NO: 1979227 - RNA, 17 nt, Human
ugaggcagguccccaga

SEQ ID NO: 1979228 - RNA, 16 nt, Human
ugaggagcuugaaacc

SEQ ID NO: 1979229 - RNA, 14 nt, Human
ugaggugggagaug

SEQ ID NO: 1979230 - RNA, 13 nt, Human
ugaggugggagga

SEQ ID NO: 1979231 - RNA, 12 nt, Human
ugaggugggagg

SEQ ID NO: 1979232 - RNA, 18 nt, Human
ugaggcuccacuuggucu

SEQ ID NO: 1979233 - RNA, 20 nt, Human
ugaggcuccacuuggucugu

SEQ ID NO: 1979234 - RNA, 14 nt, Human
ugaggcucugcccu

SEQ ID NO: 1979235 - RNA, 13 nt, Human
ugaggcucugccc

SEQ ID NO: 1979236 - RNA, 21 nt, Human
ugagggaagaauaaagagcug

SEQ ID NO: 1979237 - RNA, 17 nt, Human
ugagggaacagagaggu

SEQ ID NO: 1979238 - RNA, 23 nt, Human
ugaggcuccuuaggguuuucucu

SEQ ID NO: 1979239 - RNA, 17 nt, Human
ugagcugcuuuuuuuga

SEQ ID NO: 1979240 - RNA, 18 nt, Human
ugagcugcuuuuuuugaa

SEQ ID NO: 1979241 - RNA, 19 nt, Human
ugagcugcuuuuuuugaaa

SEQ ID NO: 1979242 - RNA, 12 nt, Human
ugagcuccuggg

SEQ ID NO: 1979243 - RNA, 19 nt, Human
ugagccgagaucacgccac

SEQ ID NO: 1979244 - RNA, 18 nt, Human
ugagcccuguccugccua

SEQ ID NO: 1979245 - RNA, 21 nt, Human
ugagccgagaucacgccacug

SEQ ID NO: 1979246 - RNA, 17 nt, Human
ugagccucagcauccug

SEQ ID NO: 1979247 - RNA, 22 nt, Human
ugagccucagcauccuggcacc

SEQ ID NO: 1979248 - RNA, 14 nt, Human
ugagccucagucuc

SEQ ID NO: 1979249 - RNA, 16 nt, Human
ugagcccugaggaggc

SEQ ID NO: 1979250 - RNA, 24 nt, Human
ugagcccuucggaggaccagggcu

SEQ ID NO: 1979251 - RNA, 15 nt, Human
ugagcccuuguuuca

SEQ ID NO: 1979252 - RNA, 18 nt, Human
ugagccucagcauccugg

SEQ ID NO: 1979253 - RNA, 21 nt, Human
ugagccucagcauccuggcac

SEQ ID NO: 1979254 - RNA, 20 nt, Human
ugagcaucaggccaggcccu

SEQ ID NO: 1979255 - RNA, 19 nt, Human
ugagcaucaggccaggccc

SEQ ID NO: 1979256 - RNA, 18 nt, Human
ugagcaucaggccaggcc

SEQ ID NO: 1979257 - RNA, 13 nt, Human
ugagcccccagcu

SEQ ID NO: 1979258 - RNA, 15 nt, Human
ugagcccccagcuuc

SEQ ID NO: 1979259 - RNA, 16 nt, Human
ugagcccccagcuucc

SEQ ID NO: 1979260 - RNA, 17 nt, Human
ugagcccccagcuucca

SEQ ID NO: 1979261 - RNA, 22 nt, Human
ugagcccccagcuuccagcagg

SEQ ID NO: 1979262 - RNA, 19 nt, Human
ugagcagggcucagcgggg

SEQ ID NO: 1979263 - RNA, 14 nt, Human
ugagcagugauauu

SEQ ID NO: 1979264 - RNA, 17 nt, Human
ugagcagugauauucuu

SEQ ID NO: 1979265 - RNA, 20 nt, Human
ugagcagugauauucuuugu

SEQ ID NO: 1979266 - RNA, 22 nt, Human
ugagcagugauauucuuuguua

SEQ ID NO: 1979267 - RNA, 16 nt, Human
ugagcagggcucagcg

SEQ ID NO: 1979268 - RNA, 17 nt, Human
ugagcagggcucagcgg

SEQ ID NO: 1979269 - RNA, 16 nt, Human
ugagcaucaggccagg

SEQ ID NO: 1979270 - RNA, 23 nt, Human
ugagcagugauauucuuuguuaa

SEQ ID NO: 1979271 - RNA, 15 nt, Human
ugagaucagccuggg

SEQ ID NO: 1979272 - RNA, 14 nt, Human
ugagaucagccugg

SEQ ID NO: 1979273 - RNA, 15 nt, Human
ugagaucaaaacggu

SEQ ID NO: 1979274 - RNA, 12 nt, Human
ugagcagggcuc

SEQ ID NO: 1979275 - RNA, 13 nt, Human
ugagcagggcuca

SEQ ID NO: 1979276 - RNA, 14 nt, Human
ugagcagggcucag

SEQ ID NO: 1979277 - RNA, 15 nt, Human
ugagcagggcucagc

SEQ ID NO: 1979278 - RNA, 23 nt, Human
ugagacucgcgacaaugcaaacc

SEQ ID NO: 1979279 - RNA, 22 nt, Human
ugagacucgcgacaaugcaaac

SEQ ID NO: 1979280 - RNA, 21 nt, Human
ugagacucgcgacaaugcaaa

SEQ ID NO: 1979281 - RNA, 20 nt, Human
ugagacucgcgacaaugcaa

SEQ ID NO: 1979282 - RNA, 16 nt, Human
ugagagugaacaaauu

SEQ ID NO: 1979283 - RNA, 17 nt, Human
ugagaaauuuauaaacu

SEQ ID NO: 1979284 - RNA, 17 nt, Human
ugagaacagauaaagau

SEQ ID NO: 1979285 - RNA, 18 nt, Human
ugagaacagauaaagauu

SEQ ID NO: 1979286 - RNA, 23 nt, Human
ugagaacagauaaagauugugug

SEQ ID NO: 1979287 - RNA, 20 nt, Human
ugaccgacagcuuuccagua

SEQ ID NO: 1979288 - RNA, 22 nt, Human
ugaccucagcuuugauauuuca

SEQ ID NO: 1979289 - RNA, 16 nt, Human
ugaccucagcuuugau

SEQ ID NO: 1979290 - RNA, 20 nt, Human
ugaccucaggugauccaccc

SEQ ID NO: 1979291 - RNA, 21 nt, Human
ugaccucaggugauccaccca

SEQ ID NO: 1979292 - RNA, 19 nt, Human
ugagacucgcgacaaugca

SEQ ID NO: 1979293 - RNA, 17 nt, Human
ugaaagccuuagggaag

SEQ ID NO: 1979294 - RNA, 18 nt, Human
ugaaagcccugagcuuuc

SEQ ID NO: 1979295 - RNA, 19 nt, Human
ugaaagauggcugugccuc

SEQ ID NO: 1979296 - RNA, 18 nt, Human
ugaaagauggcugugccu

SEQ ID NO: 1979297 - RNA, 20 nt, Human
ugaaaccccuguaggccuca

SEQ ID NO: 1979298 - RNA, 23 nt, Human
ugaaagaggccaaacaggcccuc

SEQ ID NO: 1979299 - RNA, 15 nt, Human
ugaaagagucuuucu

SEQ ID NO: 1979300 - RNA, 23 nt, Human
ugaaagggaguauuacaaaaaca

SEQ ID NO: 1979301 - RNA, 13 nt, Human
ugaaagggcccag

SEQ ID NO: 1979302 - RNA, 22 nt, Human
ugaaagccuuagggaagcuggc

SEQ ID NO: 1979303 - RNA, 20 nt, Human
ugaaaggcaguagucauuuu

SEQ ID NO: 1979304 - RNA, 11 nt, Human
ugaaaggcuuu

SEQ ID NO: 1979305 - RNA, 15 nt, Human
ugaaaggcuuuucaa

SEQ ID NO: 1979306 - RNA, 21 nt, Human
ugaaaggcuuuucaaccacaa

SEQ ID NO: 1979307 - RNA, 19 nt, Human
ugaaaauuuugauguuuua

SEQ ID NO: 1979308 - RNA, 21 nt, Human
ugaaaauuuugauguuuuaag

SEQ ID NO: 1979309 - RNA, 13 nt, Human
ugaaaauuuugau

SEQ ID NO: 1979310 - RNA, 20 nt, Human
ugaaaagcuccauuuuuagu

SEQ ID NO: 1979311 - RNA, 14 nt, Human
ugaaacauuuuguc

SEQ ID NO: 1979312 - RNA, 19 nt, Human
ugaaacauugcuuuuaaaa

SEQ ID NO: 1979313 - RNA, 21 nt, Human
ugaaacauugcuuuuaaaacu

SEQ ID NO: 1979314 - RNA, 18 nt, Human
ugaaaccaaauguaacua

SEQ ID NO: 1979315 - RNA, 17 nt, Human
ugaaaucaguaaacacu

SEQ ID NO: 1979316 - RNA, 16 nt, Human
ugaaaucaguuacucu

SEQ ID NO: 1979317 - RNA, 17 nt, Human
ugaaaucaguuacucuu

SEQ ID NO: 1979318 - RNA, 19 nt, Human
ugaaaucaguaaacacugu

SEQ ID NO: 1979319 - RNA, 20 nt, Human
ugaaaucaguaaacacugug

SEQ ID NO: 1979320 - RNA, 22 nt, Human
ugaaaucaguaaacacugugua

SEQ ID NO: 1979321 - RNA, 17 nt, Human
ugaaaucauauuuggaa

SEQ ID NO: 1979322 - RNA, 13 nt, Human
ugaaaugucaacc

SEQ ID NO: 1979323 - RNA, 12 nt, Human
ugaaaugugugu

SEQ ID NO: 1979324 - RNA, 14 nt, Human
ugaaauguguguga

SEQ ID NO: 1979325 - RNA, 16 nt, Human
ugaaaugugugugaug

SEQ ID NO: 1979326 - RNA, 17 nt, Human
ugaaaugugugugaugu

SEQ ID NO: 1979327 - RNA, 19 nt, Human
ugaaaugugugugauguga

SEQ ID NO: 1979328 - RNA, 20 nt, Human
ugaaaugugugugaugugac

SEQ ID NO: 1979329 - RNA, 21 nt, Human
ugaaaugugugugaugugaca

SEQ ID NO: 1979330 - RNA, 22 nt, Human
ugaaaugugugugaugugacau

SEQ ID NO: 1979331 - RNA, 24 nt, Human
ugaaaugugugugaugugacauuu

SEQ ID NO: 1979332 - RNA, 12 nt, Human
ugaaauuacccu

SEQ ID NO: 1979333 - RNA, 12 nt, Human
ugaaauuauuca

SEQ ID NO: 1979334 - RNA, 14 nt, Human
ugaaauucacaaag

SEQ ID NO: 1979335 - RNA, 18 nt, Human
ugaaauucacaaaguuaa

SEQ ID NO: 1979336 - RNA, 20 nt, Human
ugaacauugguucuuucauu

SEQ ID NO: 1979337 - RNA, 12 nt, Human
ugaacauugcau

SEQ ID NO: 1979338 - RNA, 22 nt, Human
ugaacauugcauauaacuuaua

SEQ ID NO: 1979339 - RNA, 22 nt, Human
ugaaccaagaacuuuccaggaa

SEQ ID NO: 1979340 - RNA, 19 nt, Human
ugaaccacaucuugcucug

SEQ ID NO: 1979341 - RNA, 23 nt, Human
ugaaccacaucuugcucugcuga

SEQ ID NO: 1979342 - RNA, 17 nt, Human
ugaaccaccacacccag

SEQ ID NO: 1979343 - RNA, 20 nt, Human
ugaaccaccacacccagccc

SEQ ID NO: 1979344 - RNA, 16 nt, Human
ugaacuccuggccuca

SEQ ID NO: 1979345 - RNA, 15 nt, Human
ugaacagcggcugga

SEQ ID NO: 1979346 - RNA, 19 nt, Human
ugaacagaggccacauuac

SEQ ID NO: 1979347 - RNA, 21 nt, Human
ugaacagaugaccccugccca

SEQ ID NO: 1979348 - RNA, 21 nt, Human
ugaacagcggcuggacuugga

SEQ ID NO: 1979349 - RNA, 22 nt, Human
ugaacagcggcuggacuuggag

SEQ ID NO: 1979350 - RNA, 19 nt, Human
ugaacaguuguguuugaag

SEQ ID NO: 1979351 - RNA, 12 nt, Human
ugaacagugcac

SEQ ID NO: 1979352 - RNA, 19 nt, Human
ugaacaggugggugucugc

SEQ ID NO: 1979353 - RNA, 15 nt, Human
ugaacaagcauucuc

SEQ ID NO: 1979354 - RNA, 15 nt, Human
ugaacaagucccugu

SEQ ID NO: 1979355 - RNA, 21 nt, Human
ucuuucagccaagaauucuua

SEQ ID NO: 1979356 - RNA, 20 nt, Human
ucuuucagccaagaauucuu

SEQ ID NO: 1979357 - RNA, 19 nt, Human
ucuuucagccaagaauucu

SEQ ID NO: 1979358 - RNA, 16 nt, Human
ucuuucagccaagaau

SEQ ID NO: 1979359 - RNA, 13 nt, Human
ucuuuccaaagua

SEQ ID NO: 1979360 - RNA, 14 nt, Human
ucuuuccaaaguac

SEQ ID NO: 1979361 - RNA, 18 nt, Human
ucuuucacucacaucuuu

SEQ ID NO: 1979362 - RNA, 21 nt, Human
ucuuuccacuccuccuagcca

SEQ ID NO: 1979363 - RNA, 22 nt, Human
ucuuuccacuccuccuagccac

SEQ ID NO: 1979364 - RNA, 21 nt, Human
ucuuucauuugcuuuggaagu

SEQ ID NO: 1979365 - RNA, 17 nt, Human
ucuuuccaaaguacacu

SEQ ID NO: 1979366 - RNA, 22 nt, Human
ucuuucuucuucaaaccuuugu

SEQ ID NO: 1979367 - RNA, 14 nt, Human
ucuuucuugcuccc

SEQ ID NO: 1979368 - RNA, 18 nt, Human
ucuuucuugcucccugac

SEQ ID NO: 1979369 - RNA, 19 nt, Human
ucuuucuugcucccugacu

SEQ ID NO: 1979370 - RNA, 16 nt, Human
ucuuuccauaauaaaa

SEQ ID NO: 1979371 - RNA, 15 nt, Human
ucuuuccauauccau

SEQ ID NO: 1979372 - RNA, 16 nt, Human
ucuuuccauauccaua

SEQ ID NO: 1979373 - RNA, 13 nt, Human
ucuuuccacucug

SEQ ID NO: 1979374 - RNA, 14 nt, Human
ucuuuccacucugg

SEQ ID NO: 1979375 - RNA, 15 nt, Human
ucuuuccacucugga

SEQ ID NO: 1979376 - RNA, 16 nt, Human
ucuuuccacucuggau

SEQ ID NO: 1979377 - RNA, 17 nt, Human
ucuuuccacucuggauu

SEQ ID NO: 1979378 - RNA, 23 nt, Human
ucuuuccacucuggauucagccu

SEQ ID NO: 1979379 - RNA, 20 nt, Human
ucuuucuugcucccugacug

SEQ ID NO: 1979380 - RNA, 18 nt, Human
ucuuugcaguucccaucu

SEQ ID NO: 1979381 - RNA, 21 nt, Human
ucuuuggaaaaggaagguagu

SEQ ID NO: 1979382 - RNA, 17 nt, Human
ucuuuggacacucacac

SEQ ID NO: 1979383 - RNA, 13 nt, Human
ucuuugauguguu

SEQ ID NO: 1979384 - RNA, 14 nt, Human
ucuuugaucaugaa

SEQ ID NO: 1979385 - RNA, 20 nt, Human
ucuuugaucaugaauaacug

SEQ ID NO: 1979386 - RNA, 14 nt, Human
ucuuugauguguug

SEQ ID NO: 1979387 - RNA, 16 nt, Human
ucuuugauguguuguu

SEQ ID NO: 1979388 - RNA, 16 nt, Human
ucuuugauaacaggga

SEQ ID NO: 1979389 - RNA, 11 nt, Human
ucuuucuuuuu

SEQ ID NO: 1979390 - RNA, 20 nt, Human
ucuuugaaaauaguuauuca

SEQ ID NO: 1979391 - RNA, 19 nt, Human
ucuuugaaacaugcuugug

SEQ ID NO: 1979392 - RNA, 13 nt, Human
ucuuugauucugu

SEQ ID NO: 1979393 - RNA, 22 nt, Human
ucuuugcaaaaauccaaauauu

SEQ ID NO: 1979394 - RNA, 14 nt, Human
ucuuugcaguuccc

SEQ ID NO: 1979395 - RNA, 12 nt, Human
ucuuugccaagu

SEQ ID NO: 1979396 - RNA, 23 nt, Human
ucuugcaauggcagccuuggcaa

SEQ ID NO: 1979397 - RNA, 17 nt, Human
ucuccucuugccacugc

SEQ ID NO: 1979398 - RNA, 20 nt, Human
ucuccucugcugcuggcugg

SEQ ID NO: 1979399 - RNA, 16 nt, Human
ucucccuucauccuuc

SEQ ID NO: 1979400 - RNA, 13 nt, Human
ucuccucuugcca

SEQ ID NO: 1979401 - RNA, 16 nt, Human
ucuccucuugccacug

SEQ ID NO: 1979402 - RNA, 15 nt, Human
ucuugcaugaggcua

SEQ ID NO: 1979403 - RNA, 23 nt, Human
ucuuucacccuuuucuguuugcu

SEQ ID NO: 1979404 - RNA, 18 nt, Human
ucuuucaagggcuuuccu

SEQ ID NO: 1979405 - RNA, 20 nt, Human
ucuuucaagggcuuuccugu

SEQ ID NO: 1979406 - RNA, 21 nt, Human
ucuuucaagggcuuuccugug

SEQ ID NO: 1979407 - RNA, 17 nt, Human
ucuuucacauuuaaaua

SEQ ID NO: 1979408 - RNA, 20 nt, Human
ucuuucaacaguuucaaaau

SEQ ID NO: 1979409 - RNA, 17 nt, Human
ucuuucaacucauugca

SEQ ID NO: 1979410 - RNA, 16 nt, Human
ucuuguuuugcuuccc

SEQ ID NO: 1979411 - RNA, 16 nt, Human
ucuuguuuuuaaguuu

SEQ ID NO: 1979412 - RNA, 17 nt, Human
ucuuguuuuuaaguuug

SEQ ID NO: 1979413 - RNA, 21 nt, Human
ucuuguuuuuaaguuugcacu

SEQ ID NO: 1979414 - RNA, 23 nt, Human
ucuuguuuuuaaguuugcacuca

SEQ ID NO: 1979415 - RNA, 21 nt, Human
ucuuguguguuuauugucaaa

SEQ ID NO: 1979416 - RNA, 16 nt, Human
ucuuguguguuuauug

SEQ ID NO: 1979417 - RNA, 14 nt, Human
ucuugcuugaacuu

SEQ ID NO: 1979418 - RNA, 11 nt, Human
ucuuguugguu

SEQ ID NO: 1979419 - RNA, 14 nt, Human
ucuuguuucucccg

SEQ ID NO: 1979420 - RNA, 13 nt, Human
ucuuguuuugcuu

SEQ ID NO: 1979421 - RNA, 13 nt, Human
ugacagaggcagc

SEQ ID NO: 1979422 - RNA, 16 nt, Human
ugacagacagcccucc

SEQ ID NO: 1979423 - RNA, 20 nt, Human
ugacagacacaggcccggcu

SEQ ID NO: 1979424 - RNA, 23 nt, Human
ugacagacacaggcccggcucca

SEQ ID NO: 1979425 - RNA, 14 nt, Human
ugacagaggcagcc

SEQ ID NO: 1979426 - RNA, 15 nt, Human
ugacagaggcagccc

SEQ ID NO: 1979427 - RNA, 16 nt, Human
ugacagaggcagcccc

SEQ ID NO: 1979428 - RNA, 17 nt, Human
ugacagaggcagcccca

SEQ ID NO: 1979429 - RNA, 18 nt, Human
ugacagaggcagccccau

SEQ ID NO: 1979430 - RNA, 23 nt, Human
ugacagaggcagccccauucugc

SEQ ID NO: 1979431 - RNA, 14 nt, Human
ugacagagugagac

SEQ ID NO: 1979432 - RNA, 17 nt, Human
ugacagagugagacucu

SEQ ID NO: 1979433 - RNA, 17 nt, Human
ugacauacauccaacau

SEQ ID NO: 1979434 - RNA, 23 nt, Human
ugacauaaguauuuaauucaugu

SEQ ID NO: 1979435 - RNA, 19 nt, Human
ugacagagugagacucugu

SEQ ID NO: 1979436 - RNA, 22 nt, Human
ugacagagggauggaggaagaa

SEQ ID NO: 1979437 - RNA, 20 nt, Human
ugacagaaaauauguauuaa

SEQ ID NO: 1979438 - RNA, 23 nt, Human
ugacagaaaauauguauuaacac

SEQ ID NO: 1979439 - RNA, 14 nt, Human
ugacagaaaauaug

SEQ ID NO: 1979440 - RNA, 19 nt, Human
ugacagaaaauauguauua

SEQ ID NO: 1979441 - RNA, 14 nt, Human
ugacaauguuuaca

SEQ ID NO: 1979442 - RNA, 18 nt, Human
ugacaaggauugcuacug

SEQ ID NO: 1979443 - RNA, 14 nt, Human
ugacaagcuggcuu

SEQ ID NO: 1979444 - RNA, 21 nt, Human
ugacaagcuggcuuacacugg

SEQ ID NO: 1979445 - RNA, 23 nt, Human
ugacaagcuggcuuacacuggca

SEQ ID NO: 1979446 - RNA, 14 nt, Human
ugaauuggaaugca

SEQ ID NO: 1979447 - RNA, 15 nt, Human
ugaauuggaaugcac

SEQ ID NO: 1979448 - RNA, 20 nt, Human
ugaccacugcagaagacagu

SEQ ID NO: 1979449 - RNA, 19 nt, Human
ugaccagcaccaucucucc

SEQ ID NO: 1979450 - RNA, 15 nt, Human
ugacaugucuuuucu

SEQ ID NO: 1979451 - RNA, 13 nt, Human
ugacaugucuuuu

SEQ ID NO: 1979452 - RNA, 18 nt, Human
ugacauguauuuuuuccu

SEQ ID NO: 1979453 - RNA, 15 nt, Human
ugacauauuggcucu

SEQ ID NO: 1979454 - RNA, 20 nt, Human
ugaccgugaggccagagaca

SEQ ID NO: 1979455 - RNA, 16 nt, Human
ugaccgugaggccaga

SEQ ID NO: 1979456 - RNA, 14 nt, Human
ugaccgugaggcca

SEQ ID NO: 1979457 - RNA, 13 nt, Human
ugaccgugaggcc

SEQ ID NO: 1979458 - RNA, 18 nt, Human
ugaccgacagcuuuccag

SEQ ID NO: 1979459 - RNA, 19 nt, Human
ugaccauucuccaccugcc

SEQ ID NO: 1979460 - RNA, 13 nt, Human
ugaccauaaaauu

SEQ ID NO: 1979461 - RNA, 14 nt, Human
ugaccaucauuuca

SEQ ID NO: 1979462 - RNA, 18 nt, Human
ugaccauucuccaccugc

SEQ ID NO: 1979463 - RNA, 17 nt, Human
ugaccauucuccaccug

SEQ ID NO: 1979464 - RNA, 16 nt, Human
ugaccauucuccaccu

SEQ ID NO: 1979465 - RNA, 20 nt, Human
ugaccagcaccaucucuccu

SEQ ID NO: 1979466 - RNA, 22 nt, Human
ugaccaggcaccuccccucccg

SEQ ID NO: 1979467 - RNA, 19 nt, Human
ugaccaguggcuauggccu

SEQ ID NO: 1979468 - RNA, 21 nt, Human
ugaaguucugccucugaugua

SEQ ID NO: 1979469 - RNA, 22 nt, Human
ugaaguucugccucugauguau

SEQ ID NO: 1979470 - RNA, 20 nt, Human
ugaauaaacuagauuacauu

SEQ ID NO: 1979471 - RNA, 12 nt, Human
ugaaguuauauu

SEQ ID NO: 1979472 - RNA, 13 nt, Human
ugaaguuauauuu

SEQ ID NO: 1979473 - RNA, 16 nt, Human
ugaaguuauauuuccu

SEQ ID NO: 1979474 - RNA, 19 nt, Human
ugaaguuauguguauguga

SEQ ID NO: 1979475 - RNA, 16 nt, Human
ugaagugccuuaaaua

SEQ ID NO: 1979476 - RNA, 10 nt, Human
ugaaguguug

SEQ ID NO: 1979477 - RNA, 17 nt, Human
ugaaggccccgcccagg

SEQ ID NO: 1979478 - RNA, 18 nt, Human
ugaaggcagaaagcaaaa

SEQ ID NO: 1979479 - RNA, 16 nt, Human
ugaaggccacuugagu

SEQ ID NO: 1979480 - RNA, 16 nt, Human
ugaagucaugcucccc

SEQ ID NO: 1979481 - RNA, 22 nt, Human
ugaagucaugcuccccugugcc

SEQ ID NO: 1979482 - RNA, 13 nt, Human
ugaagugccuuaa

SEQ ID NO: 1979483 - RNA, 16 nt, Human
ugaaggccccgcccag

SEQ ID NO: 1979484 - RNA, 15 nt, Human
ugaaggccccgccca

SEQ ID NO: 1979485 - RNA, 15 nt, Human
ugaaggcagaaagca

SEQ ID NO: 1979486 - RNA, 16 nt, Human
ugaaggagagcccuuc

SEQ ID NO: 1979487 - RNA, 21 nt, Human
ugaaggaccuucacucuaaga

SEQ ID NO: 1979488 - RNA, 22 nt, Human
ugaaggacauugcggacagcca

SEQ ID NO: 1979489 - RNA, 19 nt, Human
ugaaggacauugcggacag

SEQ ID NO: 1979490 - RNA, 20 nt, Human
ugaaggacauugcggacagc

SEQ ID NO: 1979491 - RNA, 15 nt, Human
ugaagauacugaaau

SEQ ID NO: 1979492 - RNA, 16 nt, Human
ugaagauacugaaaua

SEQ ID NO: 1979493 - RNA, 18 nt, Human
ugaagauacugaaauaaa

SEQ ID NO: 1979494 - RNA, 12 nt, Human
ugaagauacuuu

SEQ ID NO: 1979495 - RNA, 14 nt, Human
ugaagauacuuugu

SEQ ID NO: 1979496 - RNA, 15 nt, Human
ugaagauacuuugua

SEQ ID NO: 1979497 - RNA, 20 nt, Human
ugaaggaauaaauugcuccu

SEQ ID NO: 1979498 - RNA, 16 nt, Human
ugaagauacuuuguau

SEQ ID NO: 1979499 - RNA, 17 nt, Human
ugaagauacuuuguauu

SEQ ID NO: 1979500 - RNA, 19 nt, Human
ugaagauacuuuguauugu

SEQ ID NO: 1979501 - RNA, 17 nt, Human
ugaacuccuggccucaa

SEQ ID NO: 1979502 - RNA, 16 nt, Human
ugaacucugacaacag

SEQ ID NO: 1979503 - RNA, 14 nt, Human
ugaacucugagaga

SEQ ID NO: 1979504 - RNA, 16 nt, Human
ugaacauaauucuuau

SEQ ID NO: 1979505 - RNA, 12 nt, Human
ugaacucugaga

SEQ ID NO: 1979506 - RNA, 14 nt, Human
ugaagauacugaaa

SEQ ID NO: 1979507 - RNA, 17 nt, Human
ugaauugacuuauuuca

SEQ ID NO: 1979508 - RNA, 17 nt, Human
ugaauugagccuaaaaa

SEQ ID NO: 1979509 - RNA, 18 nt, Human
ugaauugagccuaaaaau

SEQ ID NO: 1979510 - RNA, 20 nt, Human
ugaauugagccuaaaaauaa

SEQ ID NO: 1979511 - RNA, 19 nt, Human
ugaauucaccacagacuuu

SEQ ID NO: 1979512 - RNA, 13 nt, Human
ugaauuaugaaac

SEQ ID NO: 1979513 - RNA, 15 nt, Human
ugaauuaugaaacuu

SEQ ID NO: 1979514 - RNA, 17 nt, Human
ugaauuaugaaacuuuu

SEQ ID NO: 1979515 - RNA, 16 nt, Human
ugaauuauuuucucuc

SEQ ID NO: 1979516 - RNA, 13 nt, Human
ugaauuacuaacu

SEQ ID NO: 1979517 - RNA, 15 nt, Human
ugaauuacuaacuuc

SEQ ID NO: 1979518 - RNA, 16 nt, Human
ugaauuacuaacuucu

SEQ ID NO: 1979519 - RNA, 18 nt, Human
ugaauuacuaacuucuaa

SEQ ID NO: 1979520 - RNA, 19 nt, Human
ugaauuacuaacuucuaaa

SEQ ID NO: 1979521 - RNA, 20 nt, Human
ugaauuacuaacuucuaaaa

SEQ ID NO: 1979522 - RNA, 21 nt, Human
ugaauuacuaacuucuaaaac

SEQ ID NO: 1979523 - RNA, 21 nt, Human
ugaaugacuuccccaauaucu

SEQ ID NO: 1979524 - RNA, 22 nt, Human
ugaaugacuuccccaauaucuu

SEQ ID NO: 1979525 - RNA, 17 nt, Human
ugaaugacuaagaggaa

SEQ ID NO: 1979526 - RNA, 23 nt, Human
ugaaucauuuuaccuuugacaaa

SEQ ID NO: 1979527 - RNA, 22 nt, Human
ugaaucauuuuaccuuugacaa

SEQ ID NO: 1979528 - RNA, 14 nt, Human
ugaauaaagacacc

SEQ ID NO: 1979529 - RNA, 15 nt, Human
ugaauaaagacaccu

SEQ ID NO: 1979530 - RNA, 13 nt, Human
ugaaucuuuaauu

SEQ ID NO: 1979531 - RNA, 17 nt, Human
ugaauccaaaagaaaaa

SEQ ID NO: 1979532 - RNA, 18 nt, Human
ugaauccaaaagaaaaac

SEQ ID NO: 1979533 - RNA, 21 nt, Human
ugaauccaaaagaaaaacagc

SEQ ID NO: 1979534 - RNA, 15 nt, Human
ucuccagccccugga

SEQ ID NO: 1979535 - RNA, 14 nt, Human
ucuccagccccugg

SEQ ID NO: 1979536 - RNA, 13 nt, Human
ucuccagccccug

SEQ ID NO: 1979537 - RNA, 12 nt, Human
ucuccagccccu

SEQ ID NO: 1979538 - RNA, 11 nt, Human
ucuccagcagg

SEQ ID NO: 1979539 - RNA, 14 nt, Human
ucuccagcaggccc

SEQ ID NO: 1979540 - RNA, 14 nt, Human
ucuccacugccuuc

SEQ ID NO: 1979541 - RNA, 18 nt, Human
ucuccagccccuggaugc

SEQ ID NO: 1979542 - RNA, 16 nt, Human
ucuccagccccuggau

SEQ ID NO: 1979543 - RNA, 22 nt, Human
ucuccagccccuggaugcagcc

SEQ ID NO: 1979544 - RNA, 14 nt, Human
ucucccucccuugg

SEQ ID NO: 1979545 - RNA, 23 nt, Human
ucucccucagucuggcccuuccu

SEQ ID NO: 1979546 - RNA, 18 nt, Human
ucucccucagucuggccc

SEQ ID NO: 1979547 - RNA, 11 nt, Human
ucuccaggcug

SEQ ID NO: 1979548 - RNA, 13 nt, Human
ucucccccacccu

SEQ ID NO: 1979549 - RNA, 20 nt, Human
ucucccccacccuuguucca

SEQ ID NO: 1979550 - RNA, 21 nt, Human
ucucccccacccuuguuccag

SEQ ID NO: 1979551 - RNA, 23 nt, Human
ucucccccacccuuguuccaguu

SEQ ID NO: 1979552 - RNA, 12 nt, Human
ucucccccagcc

SEQ ID NO: 1979553 - RNA, 13 nt, Human
ucuccccucagag

SEQ ID NO: 1979554 - RNA, 18 nt, Human
ucuccccucagagugcaa

SEQ ID NO: 1979555 - RNA, 13 nt, Human
ucucccccagccc

SEQ ID NO: 1979556 - RNA, 16 nt, Human
ucuccccgcaguguuu

SEQ ID NO: 1979557 - RNA, 16 nt, Human
ucuccaccugccaggg

SEQ ID NO: 1979558 - RNA, 15 nt, Human
ucuccaccugccagg

SEQ ID NO: 1979559 - RNA, 14 nt, Human
ucuccaccugccag

SEQ ID NO: 1979560 - RNA, 19 nt, Human
ucuccaccugccagggaca

SEQ ID NO: 1979561 - RNA, 17 nt, Human
ucuccaccugccaggga

SEQ ID NO: 1979562 - RNA, 22 nt, Human
ucuccaccugccagggacagag

SEQ ID NO: 1979563 - RNA, 13 nt, Human
ucuccacuccaga

SEQ ID NO: 1979564 - RNA, 13 nt, Human
ucucaugccucag

SEQ ID NO: 1979565 - RNA, 13 nt, Human
ucuccacccugcu

SEQ ID NO: 1979566 - RNA, 16 nt, Human
ucucaugccucagccu

SEQ ID NO: 1979567 - RNA, 19 nt, Human
ucucaugccucagccuccu

SEQ ID NO: 1979568 - RNA, 17 nt, Human
ucuccacccugcucucc

SEQ ID NO: 1979569 - RNA, 14 nt, Human
ucuccacccugcuc

SEQ ID NO: 1979570 - RNA, 16 nt, Human
ucuccacccugcucuc

SEQ ID NO: 1979571 - RNA, 22 nt, Human
ucucaucuugacagagccugcc

SEQ ID NO: 1979572 - RNA, 17 nt, Human
ucucaucuugacagagc

SEQ ID NO: 1979573 - RNA, 13 nt, Human
ucucagucucaca

SEQ ID NO: 1979574 - RNA, 18 nt, Human
ucucauacucaccucacc

SEQ ID NO: 1979575 - RNA, 16 nt, Human
ucucauacucaccuca

SEQ ID NO: 1979576 - RNA, 19 nt, Human
ucuaugggacucaaugcac

SEQ ID NO: 1979577 - RNA, 12 nt, Human
ucuaugggacuc

SEQ ID NO: 1979578 - RNA, 13 nt, Human
ucuaugggacuca

SEQ ID NO: 1979579 - RNA, 23 nt, Human
ucucaguccaugaagauguagag

SEQ ID NO: 1979580 - RNA, 12 nt, Human
ucucagucucac

SEQ ID NO: 1979581 - RNA, 16 nt, Human
ucuacugggagccuac

SEQ ID NO: 1979582 - RNA, 19 nt, Human
ucuacugggagccuaccca

SEQ ID NO: 1979583 - RNA, 15 nt, Human
ucuacuuccaagacu

SEQ ID NO: 1979584 - RNA, 20 nt, Human
ucuacuucauguaauccaaa

SEQ ID NO: 1979585 - RNA, 14 nt, Human
ucuaccuuccugca

SEQ ID NO: 1979586 - RNA, 14 nt, Human
ucuaccuucauaag

SEQ ID NO: 1979587 - RNA, 17 nt, Human
ucuacaaauuuuucugu

SEQ ID NO: 1979588 - RNA, 21 nt, Human
ucuacacauauaaauugucuu

SEQ ID NO: 1979589 - RNA, 15 nt, Human
ucuacagaggccaug

SEQ ID NO: 1979590 - RNA, 16 nt, Human
ucuacagaggccaugg

SEQ ID NO: 1979591 - RNA, 13 nt, Human
ucuagugcuguga

SEQ ID NO: 1979592 - RNA, 14 nt, Human
ucuagugcugugaa

SEQ ID NO: 1979593 - RNA, 15 nt, Human
ucuagugcugugaaa

SEQ ID NO: 1979594 - RNA, 16 nt, Human
ucuagugcugugaaaa

SEQ ID NO: 1979595 - RNA, 19 nt, Human
ucuagugcugugaaaaaaa

SEQ ID NO: 1979596 - RNA, 23 nt, Human
ucuagugcugugaaaaaaaaaau

SEQ ID NO: 1979597 - RNA, 21 nt, Human
ucuaggaagacuuuggaaaga

SEQ ID NO: 1979598 - RNA, 19 nt, Human
ucuaggaagacuuuggaaa

SEQ ID NO: 1979599 - RNA, 16 nt, Human
ucuaggaagacuuugg

SEQ ID NO: 1979600 - RNA, 15 nt, Human
ucuaggaagacuuug

SEQ ID NO: 1979601 - RNA, 14 nt, Human
ucuaugacacaugc

SEQ ID NO: 1979602 - RNA, 17 nt, Human
ucuaugacacaugcaag

SEQ ID NO: 1979603 - RNA, 14 nt, Human
ucuaucaccaagga

SEQ ID NO: 1979604 - RNA, 13 nt, Human
ucuaucauuguug

SEQ ID NO: 1979605 - RNA, 18 nt, Human
ucuaaaggcuaccuuugu

SEQ ID NO: 1979606 - RNA, 17 nt, Human
ucuaaaggcuaccuuug

SEQ ID NO: 1979607 - RNA, 19 nt, Human
ucuaaaggcuaccuuugua

SEQ ID NO: 1979608 - RNA, 20 nt, Human
ucuaaaggcuaccuuuguau

SEQ ID NO: 1979609 - RNA, 16 nt, Human
ucguguccccuauccu

SEQ ID NO: 1979610 - RNA, 22 nt, Human
ucgugucauacucgagucugag

SEQ ID NO: 1979611 - RNA, 17 nt, Human
ucuaaaguaauugguua

SEQ ID NO: 1979612 - RNA, 16 nt, Human
ucuaaaguacugagca

SEQ ID NO: 1979613 - RNA, 16 nt, Human
uccuuagaaaagccau

SEQ ID NO: 1979614 - RNA, 18 nt, Human
ucggacuuagcugggaga

SEQ ID NO: 1979615 - RNA, 15 nt, Human
ucggauccccuuccu

SEQ ID NO: 1979616 - RNA, 13 nt, Human
ucggcacagccug

SEQ ID NO: 1979617 - RNA, 14 nt, Human
ucggcacagccugg

SEQ ID NO: 1979618 - RNA, 13 nt, Human
ucggauccccuuc

SEQ ID NO: 1979619 - RNA, 19 nt, Human
ucggaucagcugagccuuc

SEQ ID NO: 1979620 - RNA, 16 nt, Human
ucggaucaggcuccca

SEQ ID NO: 1979621 - RNA, 12 nt, Human
ucggaguucuuc

SEQ ID NO: 1979622 - RNA, 13 nt, Human
ucggaguucuucu

SEQ ID NO: 1979623 - RNA, 14 nt, Human
ucggaucagcugag

SEQ ID NO: 1979624 - RNA, 13 nt, Human
ucgugacaacacu

SEQ ID NO: 1979625 - RNA, 18 nt, Human
ucgugacaauguuuacaa

SEQ ID NO: 1979626 - RNA, 15 nt, Human
ucgucuuucccaaag

SEQ ID NO: 1979627 - RNA, 15 nt, Human
ucccccuuccaugga

SEQ ID NO: 1979628 - RNA, 21 nt, Human
ucccccuguuucagaggcuca

SEQ ID NO: 1979629 - RNA, 22 nt, Human
ucccuucaaccauuccccaugg

SEQ ID NO: 1979630 - RNA, 16 nt, Human
ucccuuccucuuucca

SEQ ID NO: 1979631 - RNA, 15 nt, Human
ucccuuccucuuucc

SEQ ID NO: 1979632 - RNA, 13 nt, Human
ucccuuccuccau

SEQ ID NO: 1979633 - RNA, 14 nt, Human
uccgccucuugggu

SEQ ID NO: 1979634 - RNA, 15 nt, Human
uccgcagaagcccug

SEQ ID NO: 1979635 - RNA, 13 nt, Human
uccgaguguguuu

SEQ ID NO: 1979636 - RNA, 19 nt, Human
uccgaguguguuucauccu

SEQ ID NO: 1979637 - RNA, 23 nt, Human
uccgaguguguuucauccuuccc

SEQ ID NO: 1979638 - RNA, 15 nt, Human
ucccuuggacauuuu

SEQ ID NO: 1979639 - RNA, 16 nt, Human
ucccuuggacauuuua

SEQ ID NO: 1979640 - RNA, 18 nt, Human
ucccuuggacauuuuaug

SEQ ID NO: 1979641 - RNA, 19 nt, Human
ucccuuggacauuuuaugu

SEQ ID NO: 1979642 - RNA, 21 nt, Human
ucccuuggacauuuuaugucu

SEQ ID NO: 1979643 - RNA, 21 nt, Human
uccuaagcuauucaguaauaa

SEQ ID NO: 1979644 - RNA, 20 nt, Human
uccuaagcuauucaguaaua

SEQ ID NO: 1979645 - RNA, 18 nt, Human
uccgcuuucuacccagcg

SEQ ID NO: 1979646 - RNA, 20 nt, Human
uccgcuuucuacccagcgag

SEQ ID NO: 1979647 - RNA, 16 nt, Human
uccgcuuucuacccag

SEQ ID NO: 1979648 - RNA, 16 nt, Human
uccgcuucccugguuc

SEQ ID NO: 1979649 - RNA, 12 nt, Human
uccgcuucccug

SEQ ID NO: 1979650 - RNA, 13 nt, Human
uccgcuucccugg

SEQ ID NO: 1979651 - RNA, 20 nt, Human
uccgcuccccugcuccuguc

SEQ ID NO: 1979652 - RNA, 15 nt, Human
uccuccauccuccuc

SEQ ID NO: 1979653 - RNA, 12 nt, Human
uccucccaccuc

SEQ ID NO: 1979654 - RNA, 10 nt, Human
uccuccaggu

SEQ ID NO: 1979655 - RNA, 19 nt, Human
uccuccagggcucaacacu

SEQ ID NO: 1979656 - RNA, 14 nt, Human
uccuccaagccagc

SEQ ID NO: 1979657 - RNA, 12 nt, Human
uccuccaagcca

SEQ ID NO: 1979658 - RNA, 14 nt, Human
uccuccaaggacag

SEQ ID NO: 1979659 - RNA, 18 nt, Human
uccucauuagcauuuugc

SEQ ID NO: 1979660 - RNA, 17 nt, Human
uccuaucagaaguuucu

SEQ ID NO: 1979661 - RNA, 22 nt, Human
uccucauucccucgucuuuccc

SEQ ID NO: 1979662 - RNA, 23 nt, Human
uccucauucccucgucuuuccca

SEQ ID NO: 1979663 - RNA, 19 nt, Human
uccuaguucaucccuucuc

SEQ ID NO: 1979664 - RNA, 20 nt, Human
uccuaguucaucccuucucu

SEQ ID NO: 1979665 - RNA, 23 nt, Human
uccuauauuguuuucaguguaca

SEQ ID NO: 1979666 - RNA, 12 nt, Human
uccuaguuccac

SEQ ID NO: 1979667 - RNA, 13 nt, Human
uccuaaggaaccu

SEQ ID NO: 1979668 - RNA, 12 nt, Human
uccuacacagga

SEQ ID NO: 1979669 - RNA, 14 nt, Human
uccuacacaggaca

SEQ ID NO: 1979670 - RNA, 15 nt, Human
uccuacacaggacag

SEQ ID NO: 1979671 - RNA, 16 nt, Human
uccuacacaggacagg

SEQ ID NO: 1979672 - RNA, 17 nt, Human
uccugcccuuaccugcc

SEQ ID NO: 1979673 - RNA, 21 nt, Human
uccugcccugggaggcaguga

SEQ ID NO: 1979674 - RNA, 16 nt, Human
uccugcccugcuguuu

SEQ ID NO: 1979675 - RNA, 11 nt, Human
uccugcccugg

SEQ ID NO: 1979676 - RNA, 12 nt, Human
uccugcccuggg

SEQ ID NO: 1979677 - RNA, 14 nt, Human
uccugcccugggag

SEQ ID NO: 1979678 - RNA, 15 nt, Human
uccugcccugggagg

SEQ ID NO: 1979679 - RNA, 20 nt, Human
uccugcccuuaccugccagg

SEQ ID NO: 1979680 - RNA, 23 nt, Human
uccuggaggcucaaauuuugagu

SEQ ID NO: 1979681 - RNA, 14 nt, Human
uccuggaguucugg

SEQ ID NO: 1979682 - RNA, 16 nt, Human
uccugccuaaggcuga

SEQ ID NO: 1979683 - RNA, 19 nt, Human
uccugccuaaggcugaacu

SEQ ID NO: 1979684 - RNA, 17 nt, Human
uccuggacaggccaggu

SEQ ID NO: 1979685 - RNA, 15 nt, Human
uccuggacaggccag

SEQ ID NO: 1979686 - RNA, 13 nt, Human
uccuguagcccua

SEQ ID NO: 1979687 - RNA, 11 nt, Human
uccuguagccc

SEQ ID NO: 1979688 - RNA, 12 nt, Human
uccuggccucaa

SEQ ID NO: 1979689 - RNA, 19 nt, Human
uccuggccggugugggggc

SEQ ID NO: 1979690 - RNA, 22 nt, Human
uccuggcacuaccaaaggacac

SEQ ID NO: 1979691 - RNA, 16 nt, Human
uccuggcacugcuucc

SEQ ID NO: 1979692 - RNA, 13 nt, Human
uccuggcacugcu

SEQ ID NO: 1979693 - RNA, 23 nt, Human
uccuggcacccggccccugcugg

SEQ ID NO: 1979694 - RNA, 17 nt, Human
uccugccccugagccca

SEQ ID NO: 1979695 - RNA, 18 nt, Human
uccugccccugagcccau

SEQ ID NO: 1979696 - RNA, 10 nt, Human
uccugcccug

SEQ ID NO: 1979697 - RNA, 15 nt, Human
uccugcccacugaua

SEQ ID NO: 1979698 - RNA, 14 nt, Human
uccugccaggcaug

SEQ ID NO: 1979699 - RNA, 13 nt, Human
uccugccaggcau

SEQ ID NO: 1979700 - RNA, 11 nt, Human
uccugccacca

SEQ ID NO: 1979701 - RNA, 16 nt, Human
uccugccaccacgccc

SEQ ID NO: 1979702 - RNA, 19 nt, Human
uccugaggcuccacuuggu

SEQ ID NO: 1979703 - RNA, 20 nt, Human
uccugaggcuccacuugguc

SEQ ID NO: 1979704 - RNA, 21 nt, Human
uccugaggcuccacuuggucu

SEQ ID NO: 1979705 - RNA, 16 nt, Human
uccugcauuugugaaa

SEQ ID NO: 1979706 - RNA, 16 nt, Human
uccuccuccuuccuag

SEQ ID NO: 1979707 - RNA, 18 nt, Human
uccuccuccuuccuaguu

SEQ ID NO: 1979708 - RNA, 16 nt, Human
uccucuuaacuguggu

SEQ ID NO: 1979709 - RNA, 16 nt, Human
uccuccugacacccca

SEQ ID NO: 1979710 - RNA, 13 nt, Human
uccuccugacacc

SEQ ID NO: 1979711 - RNA, 11 nt, Human
uccugagcccc

SEQ ID NO: 1979712 - RNA, 13 nt, Human
uccugagccccca

SEQ ID NO: 1979713 - RNA, 16 nt, Human
uccugagcccccagcu

SEQ ID NO: 1979714 - RNA, 17 nt, Human
uccugagcccccagcuu

SEQ ID NO: 1979715 - RNA, 18 nt, Human
uccugagcccccagcuuc

SEQ ID NO: 1979716 - RNA, 19 nt, Human
uccugagcccccagcuucc

SEQ ID NO: 1979717 - RNA, 21 nt, Human
uccacuuggucugugagaugc

SEQ ID NO: 1979718 - RNA, 17 nt, Human
uccacuuggucugugag

SEQ ID NO: 1979719 - RNA, 14 nt, Human
uccaaaguacacug

SEQ ID NO: 1979720 - RNA, 16 nt, Human
uccaaaguacacuguu

SEQ ID NO: 1979721 - RNA, 19 nt, Human
uccacuuucuagccagagg

SEQ ID NO: 1979722 - RNA, 16 nt, Human
uccaaagguuucaacu

SEQ ID NO: 1979723 - RNA, 23 nt, Human
uccacuuggucugugagaugcua

SEQ ID NO: 1979724 - RNA, 21 nt, Human
uccacuuucuagccagaggag

SEQ ID NO: 1979725 - RNA, 20 nt, Human
uccacuuucuagccagagga

SEQ ID NO: 1979726 - RNA, 18 nt, Human
uccacuuuuccaguauuu

SEQ ID NO: 1979727 - RNA, 23 nt, Human
uccagaaagaaaacuuguauuau

SEQ ID NO: 1979728 - RNA, 24 nt, Human
uccacuuuuuaacucguuugcuga

SEQ ID NO: 1979729 - RNA, 17 nt, Human
uccagaaacacccacag

SEQ ID NO: 1979730 - RNA, 15 nt, Human
uccagaaacuuguuc

SEQ ID NO: 1979731 - RNA, 16 nt, Human
uccagaaacuuguucu

SEQ ID NO: 1979732 - RNA, 17 nt, Human
uccagaaacuuguucuu

SEQ ID NO: 1979733 - RNA, 20 nt, Human
uccagaaacuuguucuucca

SEQ ID NO: 1979734 - RNA, 15 nt, Human
uccaggagcagccac

SEQ ID NO: 1979735 - RNA, 14 nt, Human
uccaggagcagcca

SEQ ID NO: 1979736 - RNA, 13 nt, Human
uccaggagcagcc

SEQ ID NO: 1979737 - RNA, 12 nt, Human
uccaggagcagc

SEQ ID NO: 1979738 - RNA, 20 nt, Human
uccaggggugggacacccug

SEQ ID NO: 1979739 - RNA, 19 nt, Human
uccaggggugggacacccu

SEQ ID NO: 1979740 - RNA, 15 nt, Human
uccagcucuggcaug

SEQ ID NO: 1979741 - RNA, 21 nt, Human
uccagcacaaccuucaagcug

SEQ ID NO: 1979742 - RNA, 14 nt, Human
uccagcaccacacu

SEQ ID NO: 1979743 - RNA, 21 nt, Human
uccagcaauucuccugccuca

SEQ ID NO: 1979744 - RNA, 22 nt, Human
uccagcaauucuccugccucag

SEQ ID NO: 1979745 - RNA, 15 nt, Human
uccauagagagcaag

SEQ ID NO: 1979746 - RNA, 14 nt, Human
uccauagagagcaa

SEQ ID NO: 1979747 - RNA, 21 nt, Human
uccauaaucuggacuccucug

SEQ ID NO: 1979748 - RNA, 14 nt, Human
uccaucaggccacu

SEQ ID NO: 1979749 - RNA, 22 nt, Human
uccaucaagccaagccuccugu

SEQ ID NO: 1979750 - RNA, 17 nt, Human
uccauauuuuuuuccuu

SEQ ID NO: 1979751 - RNA, 18 nt, Human
uccauauuuuuuuccuua

SEQ ID NO: 1979752 - RNA, 22 nt, Human
uccauauuuuuuuccuuacaua

SEQ ID NO: 1979753 - RNA, 23 nt, Human
uccauauuuuuuuccuuacauaa

SEQ ID NO: 1979754 - RNA, 16 nt, Human
uccauauuuuuacaac

SEQ ID NO: 1979755 - RNA, 16 nt, Human
uccauauuuuuuuccu

SEQ ID NO: 1979756 - RNA, 20 nt, Human
uccaugggccauaugaaaag

SEQ ID NO: 1979757 - RNA, 14 nt, Human
uccaugcugccucc

SEQ ID NO: 1979758 - RNA, 15 nt, Human
uccaugcugccucca

SEQ ID NO: 1979759 - RNA, 21 nt, Human
uccaggguucucuuguuuuga

SEQ ID NO: 1979760 - RNA, 22 nt, Human
uccaggggugggacacccugug

SEQ ID NO: 1979761 - RNA, 20 nt, Human
uccagguuuaagcuguuacu

SEQ ID NO: 1979762 - RNA, 15 nt, Human
uccaguaagaucacu

SEQ ID NO: 1979763 - RNA, 17 nt, Human
uccaguaagaucacugu

SEQ ID NO: 1979764 - RNA, 18 nt, Human
uccaguaagaucacuguu

SEQ ID NO: 1979765 - RNA, 19 nt, Human
uccaguaagaucacuguuu

SEQ ID NO: 1979766 - RNA, 20 nt, Human
uccaguaagaucacuguuua

SEQ ID NO: 1979767 - RNA, 19 nt, Human
uccaguuucagaguucuca

SEQ ID NO: 1979768 - RNA, 14 nt, Human
uccaguuuuucaua

SEQ ID NO: 1979769 - RNA, 22 nt, Human
uccauaaucuggacuccucugu

SEQ ID NO: 1979770 - RNA, 21 nt, Human
uccaguaagaucacuguuuag

SEQ ID NO: 1979771 - RNA, 16 nt, Human
uccaguuacuuuccaa

SEQ ID NO: 1979772 - RNA, 15 nt, Human
uccaguuuauuccag

SEQ ID NO: 1979773 - RNA, 13 nt, Human
uccaguuuauucc

SEQ ID NO: 1979774 - RNA, 19 nt, Human
uccccagccagccuggcug

SEQ ID NO: 1979775 - RNA, 20 nt, Human
uccccagccagccuggcugg

SEQ ID NO: 1979776 - RNA, 21 nt, Human
uccccagccagccuggcuggg

SEQ ID NO: 1979777 - RNA, 13 nt, Human
uccccagccagcc

SEQ ID NO: 1979778 - RNA, 14 nt, Human
uccccagccagccu

SEQ ID NO: 1979779 - RNA, 16 nt, Human
uccccagccagccugg

SEQ ID NO: 1979780 - RNA, 14 nt, Human
uccccaggaggcca

SEQ ID NO: 1979781 - RNA, 18 nt, Human
uccccagcccuuccucug

SEQ ID NO: 1979782 - RNA, 20 nt, Human
uccccagcccuuccucugcu

SEQ ID NO: 1979783 - RNA, 21 nt, Human
uccccagcccuuccucugcuc

SEQ ID NO: 1979784 - RNA, 22 nt, Human
uccccagcccuuccucugcucc

SEQ ID NO: 1979785 - RNA, 17 nt, Human
uccccaggaggccagcc

SEQ ID NO: 1979786 - RNA, 17 nt, Human
ucccccagccccauccu

SEQ ID NO: 1979787 - RNA, 16 nt, Human
uccccaggaggccagc

SEQ ID NO: 1979788 - RNA, 15 nt, Human
uccccaggaggccag

SEQ ID NO: 1979789 - RNA, 21 nt, Human
ucccccagccccauccucugu

SEQ ID NO: 1979790 - RNA, 20 nt, Human
ucccccagccccauccucug

SEQ ID NO: 1979791 - RNA, 22 nt, Human
ucccccagccccauccucugua

SEQ ID NO: 1979792 - RNA, 19 nt, Human
uccccagauugcaacaggc

SEQ ID NO: 1979793 - RNA, 20 nt, Human
uccccagauugcaacaggcu

SEQ ID NO: 1979794 - RNA, 22 nt, Human
uccccagauugcaacaggcugg

SEQ ID NO: 1979795 - RNA, 23 nt, Human
uccccagauugcaacaggcuggg

SEQ ID NO: 1979796 - RNA, 20 nt, Human
uccccagcaagugagagcug

SEQ ID NO: 1979797 - RNA, 21 nt, Human
uccccagcaagugagagcugg

SEQ ID NO: 1979798 - RNA, 22 nt, Human
uccccagcaagugagagcuggg

SEQ ID NO: 1979799 - RNA, 20 nt, Human
ucccaugagccucagcaucc

SEQ ID NO: 1979800 - RNA, 13 nt, Human
uccccagauugca

SEQ ID NO: 1979801 - RNA, 18 nt, Human
uccccagauugcaacagg

SEQ ID NO: 1979802 - RNA, 22 nt, Human
ucccaccucucucacuccuuga

SEQ ID NO: 1979803 - RNA, 20 nt, Human
uccaugugggcuaguugggc

SEQ ID NO: 1979804 - RNA, 16 nt, Human
uccauguggacuuagg

SEQ ID NO: 1979805 - RNA, 18 nt, Human
uccauguggacuuaggaa

SEQ ID NO: 1979806 - RNA, 19 nt, Human
uccauguggacuuaggaag

SEQ ID NO: 1979807 - RNA, 20 nt, Human
uccauguggacuuaggaagg

SEQ ID NO: 1979808 - RNA, 13 nt, Human
ucccaccuuggcu

SEQ ID NO: 1979809 - RNA, 16 nt, Human
ucccaccuuggcugca

SEQ ID NO: 1979810 - RNA, 17 nt, Human
ucccaccuuggcugcag

SEQ ID NO: 1979811 - RNA, 20 nt, Human
ucccagcugugcucuggaca

SEQ ID NO: 1979812 - RNA, 18 nt, Human
ucccaccuuggcugcagg

SEQ ID NO: 1979813 - RNA, 15 nt, Human
ucccaucuuccaagg

SEQ ID NO: 1979814 - RNA, 16 nt, Human
ucccaggcgccccuuc

SEQ ID NO: 1979815 - RNA, 21 nt, Human
ucccaucuuuuuaaccucugu

SEQ ID NO: 1979816 - RNA, 21 nt, Human
ucccaucugugaaaggaaaga

SEQ ID NO: 1979817 - RNA, 18 nt, Human
ucccaugagccucagcau

SEQ ID NO: 1979818 - RNA, 19 nt, Human
ucccaugagccucagcauc

SEQ ID NO: 1979819 - RNA, 23 nt, Human
ucccaucuuuuuaaccucuguuc

SEQ ID NO: 1979820 - RNA, 23 nt, Human
ucccagcugugcucuggacaggc

SEQ ID NO: 1979821 - RNA, 19 nt, Human
ucccagcuucggcauuuga

SEQ ID NO: 1979822 - RNA, 20 nt, Human
ucccaggaaagaagcauuuc

SEQ ID NO: 1979823 - RNA, 21 nt, Human
ucccagcugugcucuggacag

SEQ ID NO: 1979824 - RNA, 22 nt, Human
ucccagcugugcucuggacagg

SEQ ID NO: 1979825 - RNA, 24 nt, Human
ucccaggcauuccccaggaggcca

SEQ ID NO: 1979826 - RNA, 23 nt, Human
ucccaggcauuccccaggaggcc

SEQ ID NO: 1979827 - RNA, 17 nt, Human
ucagggaccaccagagg

SEQ ID NO: 1979828 - RNA, 16 nt, Human
ucaggcucuucuccuu

SEQ ID NO: 1979829 - RNA, 21 nt, Human
ucaggcucuucuccuuucaca

SEQ ID NO: 1979830 - RNA, 14 nt, Human
ucaggcugagcuga

SEQ ID NO: 1979831 - RNA, 16 nt, Human
ucagggaagauaaguu

SEQ ID NO: 1979832 - RNA, 20 nt, Human
ucagggaagauaaguuggaa

SEQ ID NO: 1979833 - RNA, 23 nt, Human
ucaggugagaagcagaggaagga

SEQ ID NO: 1979834 - RNA, 16 nt, Human
ucaggugauccaccca

SEQ ID NO: 1979835 - RNA, 12 nt, Human
ucaggucccugc

SEQ ID NO: 1979836 - RNA, 21 nt, Human
ucaggugaaacuccagaugcc

SEQ ID NO: 1979837 - RNA, 14 nt, Human
ucagguccugcuca

SEQ ID NO: 1979838 - RNA, 16 nt, Human
ucagguccugcucagc

SEQ ID NO: 1979839 - RNA, 18 nt, Human
ucagguccugcucagcag

SEQ ID NO: 1979840 - RNA, 23 nt, Human
ucaggugauccacccaccucagc

SEQ ID NO: 1979841 - RNA, 18 nt, Human
ucagguggggcagcuuga

SEQ ID NO: 1979842 - RNA, 19 nt, Human
ucagguggggcagcuugag

SEQ ID NO: 1979843 - RNA, 21 nt, Human
ucagucugauucccaagcucu

SEQ ID NO: 1979844 - RNA, 22 nt, Human
ucagucugauucccaagcucug

SEQ ID NO: 1979845 - RNA, 23 nt, Human
ucagucugauucccaagcucugc

SEQ ID NO: 1979846 - RNA, 15 nt, Human
ucagugaugugccua

SEQ ID NO: 1979847 - RNA, 16 nt, Human
ucagugaugugccuaa

SEQ ID NO: 1979848 - RNA, 22 nt, Human
ucagugaccuacuacgcagagg

SEQ ID NO: 1979849 - RNA, 22 nt, Human
ucagucuuuaaucugagaggcc

SEQ ID NO: 1979850 - RNA, 23 nt, Human
ucagucgccuuucagcaggcagc

SEQ ID NO: 1979851 - RNA, 16 nt, Human
ucagucucccucccuu

SEQ ID NO: 1979852 - RNA, 20 nt, Human
ucagguggggcagcuugagg

SEQ ID NO: 1979853 - RNA, 23 nt, Human
ucaggaagcucagggccuggcuc

SEQ ID NO: 1979854 - RNA, 13 nt, Human
ucagcuuccccag

SEQ ID NO: 1979855 - RNA, 17 nt, Human
ucagcuuccccaguagc

SEQ ID NO: 1979856 - RNA, 19 nt, Human
ucagcucuuggcuccacug

SEQ ID NO: 1979857 - RNA, 23 nt, Human
ucagcucugcaagaauugaagca

SEQ ID NO: 1979858 - RNA, 23 nt, Human
ucagcuccagcucaccagcccca

SEQ ID NO: 1979859 - RNA, 24 nt, Human
ucagcuccagcucaccagccccag

SEQ ID NO: 1979860 - RNA, 17 nt, Human
ucaccuaauuaauuuca

SEQ ID NO: 1979861 - RNA, 16 nt, Human
ucaccuaauuaauuuc

SEQ ID NO: 1979862 - RNA, 20 nt, Human
ucaggaauugcccauuguuu

SEQ ID NO: 1979863 - RNA, 18 nt, Human
ucagcuuccccaguagcu

SEQ ID NO: 1979864 - RNA, 19 nt, Human
ucagcuuccccaguagcug

SEQ ID NO: 1979865 - RNA, 15 nt, Human
ucaggagcccuggga

SEQ ID NO: 1979866 - RNA, 14 nt, Human
ucaggagcccuggg

SEQ ID NO: 1979867 - RNA, 12 nt, Human
ucaggagcccug

SEQ ID NO: 1979868 - RNA, 11 nt, Human
ucaggagcccu

SEQ ID NO: 1979869 - RNA, 20 nt, Human
ucaggaucaaaccccgacca

SEQ ID NO: 1979870 - RNA, 15 nt, Human
ucaggcucuucuccu

SEQ ID NO: 1979871 - RNA, 21 nt, Human
ucaggccugggggcugggcag

SEQ ID NO: 1979872 - RNA, 18 nt, Human
ucaggccgggcagagcac

SEQ ID NO: 1979873 - RNA, 20 nt, Human
ucaggccgggcagagcacag

SEQ ID NO: 1979874 - RNA, 17 nt, Human
ucaugcuguucaugaaa

SEQ ID NO: 1979875 - RNA, 19 nt, Human
ucaucuugacagagccugc

SEQ ID NO: 1979876 - RNA, 21 nt, Human
ucaucuugacagagccugccc

SEQ ID NO: 1979877 - RNA, 16 nt, Human
ucaucuccccaucauu

SEQ ID NO: 1979878 - RNA, 18 nt, Human
ucauccacugugccaugu

SEQ ID NO: 1979879 - RNA, 14 nt, Human
ucauccacugugcc

SEQ ID NO: 1979880 - RNA, 17 nt, Human
ucauccacugugccaug

SEQ ID NO: 1979881 - RNA, 20 nt, Human
ucaguguacauggaauaaca

SEQ ID NO: 1979882 - RNA, 11 nt, Human
ucauagcagcu

SEQ ID NO: 1979883 - RNA, 12 nt, Human
ucauagcagcuu

SEQ ID NO: 1979884 - RNA, 17 nt, Human
ucaucaaugaaugaaug

SEQ ID NO: 1979885 - RNA, 14 nt, Human
ucaucauccuaagc

SEQ ID NO: 1979886 - RNA, 15 nt, Human
ucaucauguuuugau

SEQ ID NO: 1979887 - RNA, 14 nt, Human
uccaaaagaaaaac

SEQ ID NO: 1979888 - RNA, 22 nt, Human
uccaaacaugagguucucucua

SEQ ID NO: 1979889 - RNA, 13 nt, Human
uccaaaagaaaaa

SEQ ID NO: 1979890 - RNA, 12 nt, Human
uccaaaacugcc

SEQ ID NO: 1979891 - RNA, 13 nt, Human
uccaaaacugccu

SEQ ID NO: 1979892 - RNA, 14 nt, Human
uccaaacacaggca

SEQ ID NO: 1979893 - RNA, 22 nt, Human
uccaaacaugguuuauugguga

SEQ ID NO: 1979894 - RNA, 13 nt, Human
uccaaaguacacu

SEQ ID NO: 1979895 - RNA, 14 nt, Human
ucauggugcucaga

SEQ ID NO: 1979896 - RNA, 12 nt, Human
ucauuagcaaaa

SEQ ID NO: 1979897 - RNA, 16 nt, Human
ucauuagcaaaaaaag

SEQ ID NO: 1979898 - RNA, 16 nt, Human
ucauuaggauggcuag

SEQ ID NO: 1979899 - RNA, 17 nt, Human
ucauuagcaaaaaaagu

SEQ ID NO: 1979900 - RNA, 18 nt, Human
ucauuagcaaaaaaaguu

SEQ ID NO: 1979901 - RNA, 20 nt, Human
ucauuagcaaaaaaaguugu

SEQ ID NO: 1979902 - RNA, 22 nt, Human
ucauuagcaaaaaaaguuguau

SEQ ID NO: 1979903 - RNA, 19 nt, Human
ucauuguaauguugugaau

SEQ ID NO: 1979904 - RNA, 21 nt, Human
ucauuuacaagacaacauugu

SEQ ID NO: 1979905 - RNA, 18 nt, Human
ucauuguuggacauuugg

SEQ ID NO: 1979906 - RNA, 15 nt, Human
ucauuguccagagcu

SEQ ID NO: 1979907 - RNA, 22 nt, Human
ucauuguccagagcugcuuccc

SEQ ID NO: 1979908 - RNA, 12 nt, Human
uauuuauaugua

SEQ ID NO: 1979909 - RNA, 14 nt, Human
uauuuauauguaug

SEQ ID NO: 1979910 - RNA, 15 nt, Human
uauuuauauguaugu

SEQ ID NO: 1979911 - RNA, 16 nt, Human
uauuuauauguaugug

SEQ ID NO: 1979912 - RNA, 17 nt, Human
uauuuauauguaugugu

SEQ ID NO: 1979913 - RNA, 18 nt, Human
uauuuauauguauguguu

SEQ ID NO: 1979914 - RNA, 19 nt, Human
uauuuauauguauguguuu

SEQ ID NO: 1979915 - RNA, 21 nt, Human
uauuuauauguauguguuuag

SEQ ID NO: 1979916 - RNA, 22 nt, Human
uauuuauauguauguguuuaga

SEQ ID NO: 1979917 - RNA, 15 nt, Human
uauuuauauuuauug

SEQ ID NO: 1979918 - RNA, 16 nt, Human
uauuuauauuuauuga

SEQ ID NO: 1979919 - RNA, 17 nt, Human
uauuuauauuuauugac

SEQ ID NO: 1979920 - RNA, 18 nt, Human
uauuuauauuuauugacu

SEQ ID NO: 1979921 - RNA, 16 nt, Human
uauuuaucuguucaaa

SEQ ID NO: 1979922 - RNA, 14 nt, Human
uauuuaugaagaaa

SEQ ID NO: 1979923 - RNA, 15 nt, Human
uauuuaugaagaaaa

SEQ ID NO: 1979924 - RNA, 20 nt, Human
uauuuaugaagaaaauacuu

SEQ ID NO: 1979925 - RNA, 17 nt, Human
uauuuaugggauccugg

SEQ ID NO: 1979926 - RNA, 12 nt, Human
uauuuaaaggga

SEQ ID NO: 1979927 - RNA, 18 nt, Human
uauuuaaagggaaauuga

SEQ ID NO: 1979928 - RNA, 21 nt, Human
uauuugaauguaugcuucaua

SEQ ID NO: 1979929 - RNA, 15 nt, Human
uauuugaaagugccu

SEQ ID NO: 1979930 - RNA, 20 nt, Human
uauuugaaagugccuuugca

SEQ ID NO: 1979931 - RNA, 14 nt, Human
uauuugaaagugcc

SEQ ID NO: 1979932 - RNA, 14 nt, Human
uauuugaaaacaga

SEQ ID NO: 1979933 - RNA, 18 nt, Human
uauuugaaaacagaaauu

SEQ ID NO: 1979934 - RNA, 19 nt, Human
uauuugaaaacagaaauug

SEQ ID NO: 1979935 - RNA, 20 nt, Human
uauuugaaaacagaaauugg

SEQ ID NO: 1979936 - RNA, 22 nt, Human
uauuugaaaacagaaauuggua

SEQ ID NO: 1979937 - RNA, 11 nt, Human
uauuuauuaaa

SEQ ID NO: 1979938 - RNA, 21 nt, Human
uauuuaugaagaaaauacuua

SEQ ID NO: 1979939 - RNA, 22 nt, Human
uauuuauuaaaugcccagcccc

SEQ ID NO: 1979940 - RNA, 15 nt, Human
uauugugcuguucua

SEQ ID NO: 1979941 - RNA, 22 nt, Human
uauugcugauggugcaaugacc

SEQ ID NO: 1979942 - RNA, 23 nt, Human
uauugcugauggugcaaugaccu

SEQ ID NO: 1979943 - RNA, 13 nt, Human
uauugcccacgcu

SEQ ID NO: 1979944 - RNA, 14 nt, Human
uauugcccacgcug

SEQ ID NO: 1979945 - RNA, 15 nt, Human
uauugcccacgcugg

SEQ ID NO: 1979946 - RNA, 18 nt, Human
uauugccaaacauuaaug

SEQ ID NO: 1979947 - RNA, 19 nt, Human
uauugccaaacauuaaugu

SEQ ID NO: 1979948 - RNA, 21 nt, Human
uauugccaaacauuaauguug

SEQ ID NO: 1979949 - RNA, 22 nt, Human
uauugccaaacauuaauguuga

SEQ ID NO: 1979950 - RNA, 18 nt, Human
uauucauuguggucauag

SEQ ID NO: 1979951 - RNA, 18 nt, Human
uauucauucuuuuugaaa

SEQ ID NO: 1979952 - RNA, 23 nt, Human
uauucauucuuuuugaaauguca

SEQ ID NO: 1979953 - RNA, 20 nt, Human
uauugauaugcuuauacacu

SEQ ID NO: 1979954 - RNA, 18 nt, Human
uauugccaaaacccagcu

SEQ ID NO: 1979955 - RNA, 19 nt, Human
uauugccaaaacccagcug

SEQ ID NO: 1979956 - RNA, 20 nt, Human
uauugccaaaacccagcugc

SEQ ID NO: 1979957 - RNA, 21 nt, Human
uauugccaaaacccagcugca

SEQ ID NO: 1979958 - RNA, 22 nt, Human
uauugccaaaacccagcugcac

SEQ ID NO: 1979959 - RNA, 14 nt, Human
uauugccaaacauu

SEQ ID NO: 1979960 - RNA, 15 nt, Human
uauugccaaacauua

SEQ ID NO: 1979961 - RNA, 17 nt, Human
uauugccaaacauuaau

SEQ ID NO: 1979962 - RNA, 22 nt, Human
uauugcaucuggguagcuguaa

SEQ ID NO: 1979963 - RNA, 14 nt, Human
uauuaaggaagaca

SEQ ID NO: 1979964 - RNA, 22 nt, Human
uauuaagauuauaauuguugca

SEQ ID NO: 1979965 - RNA, 16 nt, Human
uauuaagcaugacaga

SEQ ID NO: 1979966 - RNA, 20 nt, Human
uauuaagcaugacagaaaau

SEQ ID NO: 1979967 - RNA, 12 nt, Human
uauuauaccuuu

SEQ ID NO: 1979968 - RNA, 13 nt, Human
uauuauaccuuuu

SEQ ID NO: 1979969 - RNA, 20 nt, Human
uauuaaguaagucucaaggu

SEQ ID NO: 1979970 - RNA, 14 nt, Human
uauuauaccuuuuu

SEQ ID NO: 1979971 - RNA, 18 nt, Human
uauuauagagcagaaauu

SEQ ID NO: 1979972 - RNA, 19 nt, Human
uauuauagagcagaaauuc

SEQ ID NO: 1979973 - RNA, 20 nt, Human
uauuauagagcagaaauucu

SEQ ID NO: 1979974 - RNA, 22 nt, Human
uauuauagagcagaaauucugu

SEQ ID NO: 1979975 - RNA, 16 nt, Human
uauuauagagcagaaa

SEQ ID NO: 1979976 - RNA, 17 nt, Human
uauuauagagcagaaau

SEQ ID NO: 1979977 - RNA, 17 nt, Human
uauuauauuuacaaaug

SEQ ID NO: 1979978 - RNA, 13 nt, Human
uauuauauucauu

SEQ ID NO: 1979979 - RNA, 11 nt, Human
uauuauauuug

SEQ ID NO: 1979980 - RNA, 12 nt, Human
uauuauauuugg

SEQ ID NO: 1979981 - RNA, 13 nt, Human
uauuauauuugga

SEQ ID NO: 1979982 - RNA, 17 nt, Human
uauuauauucauucuuu

SEQ ID NO: 1979983 - RNA, 23 nt, Human
uauuauauucauucuuuuugaaa

SEQ ID NO: 1979984 - RNA, 20 nt, Human
uauuauggaggcaggaguuu

SEQ ID NO: 1979985 - RNA, 22 nt, Human
uauuauuuauuuuuuuuaauug

SEQ ID NO: 1979986 - RNA, 14 nt, Human
uauuaucaaguaga

SEQ ID NO: 1979987 - RNA, 14 nt, Human
uauuauauuuggau

SEQ ID NO: 1979988 - RNA, 15 nt, Human
uauuauauuuggaug

SEQ ID NO: 1979989 - RNA, 16 nt, Human
uauuauauuuggaugc

SEQ ID NO: 1979990 - RNA, 17 nt, Human
uauuauauuuggaugca

SEQ ID NO: 1979991 - RNA, 16 nt, Human
uauuaucaaguagacu

SEQ ID NO: 1979992 - RNA, 22 nt, Human
uauuaucaaguagacuacuguu

SEQ ID NO: 1979993 - RNA, 19 nt, Human
uauuaaaugcccagccccu

SEQ ID NO: 1979994 - RNA, 17 nt, Human
uauuaaaugcccagccc

SEQ ID NO: 1979995 - RNA, 15 nt, Human
uauuaaaugcccagc

SEQ ID NO: 1979996 - RNA, 17 nt, Human
uauuaacacuacucaaa

SEQ ID NO: 1979997 - RNA, 16 nt, Human
uauuaagaaagacuau

SEQ ID NO: 1979998 - RNA, 19 nt, Human
uauuaacugcucaguguuu

SEQ ID NO: 1979999 - RNA, 22 nt, Human
uauuaacugcucaguguuucau

SEQ ID NO: 1980000 - RNA, 15 nt, Human
uauuaacuuaauaau

SEQ ID NO: 1980001 - RNA, 20 nt, Human
uauuaacuuaauaaucaaga

SEQ ID NO: 1980002 - RNA, 16 nt, Human
uauuaacuuaauaauc

SEQ ID NO: 1980003 - RNA, 18 nt, Human
uauuaacuuaauaaucaa

SEQ ID NO: 1980004 - RNA, 17 nt, Human
uauguucuaagaaguga

SEQ ID NO: 1980005 - RNA, 22 nt, Human
uauguucuuaguggauguucug

SEQ ID NO: 1980006 - RNA, 21 nt, Human
uauguugcuauaauaaagaag

SEQ ID NO: 1980007 - RNA, 17 nt, Human
uauguugaagccuuugu

SEQ ID NO: 1980008 - RNA, 21 nt, Human
uauguugcccaggcaggucuu

SEQ ID NO: 1980009 - RNA, 13 nt, Human
uauguguguuuua

SEQ ID NO: 1980010 - RNA, 18 nt, Human
uauggauaugaaaaauga

SEQ ID NO: 1980011 - RNA, 23 nt, Human
uauggaggagaguguuuaacuga

SEQ ID NO: 1980012 - RNA, 14 nt, Human
uauggaggcaggag

SEQ ID NO: 1980013 - RNA, 18 nt, Human
uauggacagcauugccag

SEQ ID NO: 1980014 - RNA, 16 nt, Human
uauguuaauauuucug

SEQ ID NO: 1980015 - RNA, 14 nt, Human
uauguuaauauuuu

SEQ ID NO: 1980016 - RNA, 13 nt, Human
uauguuaauauuu

SEQ ID NO: 1980017 - RNA, 13 nt, Human
uauguguuuagaa

SEQ ID NO: 1980018 - RNA, 16 nt, Human
uauguguuuagaauug

SEQ ID NO: 1980019 - RNA, 14 nt, Human
ucaccgaaaacgug

SEQ ID NO: 1980020 - RNA, 12 nt, Human
ucacccuuuucu

SEQ ID NO: 1980021 - RNA, 20 nt, Human
ucacccuggggcuaggaaau

SEQ ID NO: 1980022 - RNA, 19 nt, Human
ucacccgcuaagagggagg

SEQ ID NO: 1980023 - RNA, 16 nt, Human
ucacccggugaccucu

SEQ ID NO: 1980024 - RNA, 21 nt, Human
ucaccgaaaacguggcugcuu

SEQ ID NO: 1980025 - RNA, 20 nt, Human
ucaccgaaaacguggcugcu

SEQ ID NO: 1980026 - RNA, 19 nt, Human
ucaccgaaaacguggcugc

SEQ ID NO: 1980027 - RNA, 15 nt, Human
ucaccgaaaacgugg

SEQ ID NO: 1980028 - RNA, 23 nt, Human
ucaccgaaaacguggcugcuuca

SEQ ID NO: 1980029 - RNA, 22 nt, Human
ucaccgaaaacguggcugcuuc

SEQ ID NO: 1980030 - RNA, 18 nt, Human
ucacccgcuaagagggag

SEQ ID NO: 1980031 - RNA, 21 nt, Human
ucacccgaucgccagcaaaac

SEQ ID NO: 1980032 - RNA, 13 nt, Human
ucaccaagcccag

SEQ ID NO: 1980033 - RNA, 16 nt, Human
ucaccacaugugcaca

SEQ ID NO: 1980034 - RNA, 18 nt, Human
ucaccaacgucugugcca

SEQ ID NO: 1980035 - RNA, 17 nt, Human
ucaccaacgucugugcc

SEQ ID NO: 1980036 - RNA, 21 nt, Human
ucaccaaaucagcugcuacua

SEQ ID NO: 1980037 - RNA, 14 nt, Human
ucacauuuauucug

SEQ ID NO: 1980038 - RNA, 17 nt, Human
ucacauuggaaacaagu

SEQ ID NO: 1980039 - RNA, 22 nt, Human
ucacauuguauucagaguugau

SEQ ID NO: 1980040 - RNA, 12 nt, Human
ucacauuuaaau

SEQ ID NO: 1980041 - RNA, 20 nt, Human
ucacauuccugaacaggaua

SEQ ID NO: 1980042 - RNA, 14 nt, Human
ucacauuggaaaca

SEQ ID NO: 1980043 - RNA, 19 nt, Human
ucacaggacucugccuccu

SEQ ID NO: 1980044 - RNA, 23 nt, Human
ucacaggacucugccuccucuuc

SEQ ID NO: 1980045 - RNA, 19 nt, Human
ucacaggagggagggggaa

SEQ ID NO: 1980046 - RNA, 14 nt, Human
ucacacauuugccu

SEQ ID NO: 1980047 - RNA, 16 nt, Human
ucacaggacucugccu

SEQ ID NO: 1980048 - RNA, 17 nt, Human
ucacaggacucugccuc

SEQ ID NO: 1980049 - RNA, 18 nt, Human
ucacaggacucugccucc

SEQ ID NO: 1980050 - RNA, 23 nt, Human
ucacacaugagcaucaggccagg

SEQ ID NO: 1980051 - RNA, 22 nt, Human
ucacacaugagcaucaggccag

SEQ ID NO: 1980052 - RNA, 15 nt, Human
ucacacacuuuggcu

SEQ ID NO: 1980053 - RNA, 18 nt, Human
ucaauucccaccuaugag

SEQ ID NO: 1980054 - RNA, 22 nt, Human
ucacaagacccaaaaggcagaa

SEQ ID NO: 1980055 - RNA, 17 nt, Human
ucaauuaaagaaauaau

SEQ ID NO: 1980056 - RNA, 19 nt, Human
ucaauuaaagaaauaauuu

SEQ ID NO: 1980057 - RNA, 22 nt, Human
ucaauuauacuacuucuaaggu

SEQ ID NO: 1980058 - RNA, 15 nt, Human
ucaaauguaaaguuu

SEQ ID NO: 1980059 - RNA, 18 nt, Human
ucaaaucuuaagaaauaa

SEQ ID NO: 1980060 - RNA, 22 nt, Human
ucaaauguaauguggcuucugg

SEQ ID NO: 1980061 - RNA, 14 nt, Human
ucaaauguguuuug

SEQ ID NO: 1980062 - RNA, 16 nt, Human
ucaaauguguuuuggu

SEQ ID NO: 1980063 - RNA, 22 nt, Human
ucaaaucucuacaaauuuuucu

SEQ ID NO: 1980064 - RNA, 14 nt, Human
ucaaaucuuaagaa

SEQ ID NO: 1980065 - RNA, 17 nt, Human
ucaaaucuuaagaaaua

SEQ ID NO: 1980066 - RNA, 23 nt, Human
ucaaagagguuuuaaaaaaaucc

SEQ ID NO: 1980067 - RNA, 12 nt, Human
ucaaagagguuu

SEQ ID NO: 1980068 - RNA, 22 nt, Human
uauuugaauguaugcuucauac

SEQ ID NO: 1980069 - RNA, 23 nt, Human
uauuugaauguaugcuucauaca

SEQ ID NO: 1980070 - RNA, 15 nt, Human
uauuugaaugacuaa

SEQ ID NO: 1980071 - RNA, 23 nt, Human
uauuugauuuauuaacuuaauaa

SEQ ID NO: 1980072 - RNA, 13 nt, Human
uauuugauuuauu

SEQ ID NO: 1980073 - RNA, 15 nt, Human
uauuugauuuauuaa

SEQ ID NO: 1980074 - RNA, 16 nt, Human
uauuugauuuauuaac

SEQ ID NO: 1980075 - RNA, 19 nt, Human
uauuugauuuauuaacuua

SEQ ID NO: 1980076 - RNA, 13 nt, Human
ucaaaccugugaa

SEQ ID NO: 1980077 - RNA, 23 nt, Human
ucaaaccccgaccaccugcccaa

SEQ ID NO: 1980078 - RNA, 14 nt, Human
ucaaaccccugacc

SEQ ID NO: 1980079 - RNA, 15 nt, Human
ucaaaccccugaccu

SEQ ID NO: 1980080 - RNA, 19 nt, Human
ucaaaccccgaccaccugc

SEQ ID NO: 1980081 - RNA, 20 nt, Human
ucaaaccccgaccaccugcc

SEQ ID NO: 1980082 - RNA, 20 nt, Human
ucaaacauuaguacuuuaua

SEQ ID NO: 1980083 - RNA, 16 nt, Human
ucaaacauuaguacuu

SEQ ID NO: 1980084 - RNA, 17 nt, Human
ucaaacauuaguacuuu

SEQ ID NO: 1980085 - RNA, 18 nt, Human
ucaaacauuaguacuuua

SEQ ID NO: 1980086 - RNA, 19 nt, Human
ucaaacauuaguacuuuau

SEQ ID NO: 1980087 - RNA, 15 nt, Human
ucaaacauuaguacu

SEQ ID NO: 1980088 - RNA, 14 nt, Human
ucaacucccugccc

SEQ ID NO: 1980089 - RNA, 15 nt, Human
ucaacucccugcccc

SEQ ID NO: 1980090 - RNA, 21 nt, Human
ucaacucccugccccccagcc

SEQ ID NO: 1980091 - RNA, 22 nt, Human
ucaacucccugccccccagccc

SEQ ID NO: 1980092 - RNA, 20 nt, Human
ucaacucuccuccagaguca

SEQ ID NO: 1980093 - RNA, 24 nt, Human
ucaacugaccagccuccaugcugc

SEQ ID NO: 1980094 - RNA, 18 nt, Human
ucaacugaccagccucca

SEQ ID NO: 1980095 - RNA, 16 nt, Human
ucaaccuccugggcua

SEQ ID NO: 1980096 - RNA, 20 nt, Human
ucaaccccuucgcuccugug

SEQ ID NO: 1980097 - RNA, 15 nt, Human
ucaaccuccugggcu

SEQ ID NO: 1980098 - RNA, 18 nt, Human
ucaaccccuucgcuccug

SEQ ID NO: 1980099 - RNA, 19 nt, Human
ucaaccccuucgcuccugu

SEQ ID NO: 1980100 - RNA, 18 nt, Human
ucaaauguguuuuggucc

SEQ ID NO: 1980101 - RNA, 20 nt, Human
ucaagccaccaacauacucc

SEQ ID NO: 1980102 - RNA, 12 nt, Human
ucaagccaccaa

SEQ ID NO: 1980103 - RNA, 16 nt, Human
ucaagccagacucugc

SEQ ID NO: 1980104 - RNA, 13 nt, Human
ucaagcccaggag

SEQ ID NO: 1980105 - RNA, 14 nt, Human
ucaagcccaggagg

SEQ ID NO: 1980106 - RNA, 21 nt, Human
ucaagcgauucuucugcuuca

SEQ ID NO: 1980107 - RNA, 14 nt, Human
ucaagcuuauuuug

SEQ ID NO: 1980108 - RNA, 18 nt, Human
ucaagcgauucuucugcu

SEQ ID NO: 1980109 - RNA, 19 nt, Human
ucaagcgauucuucugcuu

SEQ ID NO: 1980110 - RNA, 17 nt, Human
ucaaggauccugagcca

SEQ ID NO: 1980111 - RNA, 16 nt, Human
ucaaggauccugagcc

SEQ ID NO: 1980112 - RNA, 15 nt, Human
ucaaggauccugagc

SEQ ID NO: 1980113 - RNA, 14 nt, Human
ucaaggauccugag

SEQ ID NO: 1980114 - RNA, 13 nt, Human
ucaaggauccuga

SEQ ID NO: 1980115 - RNA, 13 nt, Human
uaguaucaaaaga

SEQ ID NO: 1980116 - RNA, 23 nt, Human
uaggugacagagugagacucugu

SEQ ID NO: 1980117 - RNA, 21 nt, Human
uaggugauccacucgccuuca

SEQ ID NO: 1980118 - RNA, 12 nt, Human
uaguauuugaaa

SEQ ID NO: 1980119 - RNA, 14 nt, Human
uaguauuugaaaac

SEQ ID NO: 1980120 - RNA, 17 nt, Human
uaguauuugaaaacaga

SEQ ID NO: 1980121 - RNA, 22 nt, Human
uaguauuugaaaacagaaauug

SEQ ID NO: 1980122 - RNA, 18 nt, Human
uaguguggaaauuaagaa

SEQ ID NO: 1980123 - RNA, 22 nt, Human
uaguguggaaauuaagaagaaa

SEQ ID NO: 1980124 - RNA, 20 nt, Human
uaguugcaacuuuguauaaa

SEQ ID NO: 1980125 - RNA, 13 nt, Human
uaguguucauaaa

SEQ ID NO: 1980126 - RNA, 13 nt, Human
uaguguuauauga

SEQ ID NO: 1980127 - RNA, 15 nt, Human
uaguguuauaugaac

SEQ ID NO: 1980128 - RNA, 16 nt, Human
uaguguuauaugaaca

SEQ ID NO: 1980129 - RNA, 17 nt, Human
uaguguuauaugaacau

SEQ ID NO: 1980130 - RNA, 18 nt, Human
uaguguuauaugaacaua

SEQ ID NO: 1980131 - RNA, 22 nt, Human
uaguguuauaugaacauacaaa

SEQ ID NO: 1980132 - RNA, 22 nt, Human
uaguguuauugagagagaugug

SEQ ID NO: 1980133 - RNA, 16 nt, Human
uaguguucagaaaaaa

SEQ ID NO: 1980134 - RNA, 23 nt, Human
uagucaaauguaauguggcuucu

SEQ ID NO: 1980135 - RNA, 14 nt, Human
uagugcaauauauu

SEQ ID NO: 1980136 - RNA, 15 nt, Human
uagugcaauauauuu

SEQ ID NO: 1980137 - RNA, 16 nt, Human
uagugcaauauauuuu

SEQ ID NO: 1980138 - RNA, 17 nt, Human
uagugcaauauauuuug

SEQ ID NO: 1980139 - RNA, 18 nt, Human
uagugcaauauauuuugu

SEQ ID NO: 1980140 - RNA, 19 nt, Human
uagugcaauauauuuugua

SEQ ID NO: 1980141 - RNA, 22 nt, Human
uagugcaauauauuuuguaugc

SEQ ID NO: 1980142 - RNA, 23 nt, Human
uagugcaauauauuuuguaugca

SEQ ID NO: 1980143 - RNA, 15 nt, Human
uagugcagcagggca

SEQ ID NO: 1980144 - RNA, 15 nt, Human
uagugcagcugaaau

SEQ ID NO: 1980145 - RNA, 16 nt, Human
uagugcagcugaaauu

SEQ ID NO: 1980146 - RNA, 17 nt, Human
uagugcagcugaaauug

SEQ ID NO: 1980147 - RNA, 18 nt, Human
uagugcagcugaaauuga

SEQ ID NO: 1980148 - RNA, 20 nt, Human
uagugcagcugaaauugaaa

SEQ ID NO: 1980149 - RNA, 21 nt, Human
uagugcagcugaaauugaaaa

SEQ ID NO: 1980150 - RNA, 22 nt, Human
uagugcagcugaaauugaaaag

SEQ ID NO: 1980151 - RNA, 20 nt, Human
uaggcuccuucaacaaggcu

SEQ ID NO: 1980152 - RNA, 21 nt, Human
uagggaaaaaccagcguguga

SEQ ID NO: 1980153 - RNA, 20 nt, Human
uagggaaaaaccagcgugug

SEQ ID NO: 1980154 - RNA, 19 nt, Human
uagggaaaaaccagcgugu

SEQ ID NO: 1980155 - RNA, 17 nt, Human
uaggcucugccugacag

SEQ ID NO: 1980156 - RNA, 20 nt, Human
uagguauaaguggugugugu

SEQ ID NO: 1980157 - RNA, 20 nt, Human
uagguauaucucccagugcu

SEQ ID NO: 1980158 - RNA, 16 nt, Human
uagguaaauuacaguu

SEQ ID NO: 1980159 - RNA, 15 nt, Human
uagguagagucugag

SEQ ID NO: 1980160 - RNA, 19 nt, Human
uaggucguuuuaaaaacaa

SEQ ID NO: 1980161 - RNA, 15 nt, Human
uagguccuuuagaaa

SEQ ID NO: 1980162 - RNA, 16 nt, Human
uagguccuuuagaaac

SEQ ID NO: 1980163 - RNA, 15 nt, Human
uaggucucaauaccu

SEQ ID NO: 1980164 - RNA, 16 nt, Human
uaggucagugcaaaua

SEQ ID NO: 1980165 - RNA, 13 nt, Human
uaggaauauuaua

SEQ ID NO: 1980166 - RNA, 14 nt, Human
uaggaauauuauau

SEQ ID NO: 1980167 - RNA, 15 nt, Human
uaggaauauuauauu

SEQ ID NO: 1980168 - RNA, 16 nt, Human
uaggaauauuauauuu

SEQ ID NO: 1980169 - RNA, 17 nt, Human
uaggaauauuauauuug

SEQ ID NO: 1980170 - RNA, 18 nt, Human
uaggaauauuauauuugg

SEQ ID NO: 1980171 - RNA, 20 nt, Human
uaggaauauuauauuuggau

SEQ ID NO: 1980172 - RNA, 23 nt, Human
uaggaauauuauauuuggaugca

SEQ ID NO: 1980173 - RNA, 20 nt, Human
uaggacaaggugcaggcagg

SEQ ID NO: 1980174 - RNA, 16 nt, Human
uaggaauuguguuuau

SEQ ID NO: 1980175 - RNA, 19 nt, Human
uaggacaagggaaaauaaa

SEQ ID NO: 1980176 - RNA, 15 nt, Human
uaggacaaggugcag

SEQ ID NO: 1980177 - RNA, 19 nt, Human
uaggacaaggugcaggcag

SEQ ID NO: 1980178 - RNA, 12 nt, Human
uaggaauugacc

SEQ ID NO: 1980179 - RNA, 15 nt, Human
uaggccuggccagau

SEQ ID NO: 1980180 - RNA, 14 nt, Human
uaggcccuuucagu

SEQ ID NO: 1980181 - RNA, 15 nt, Human
uaggcccuuucagug

SEQ ID NO: 1980182 - RNA, 18 nt, Human
uaggccuggccagaugca

SEQ ID NO: 1980183 - RNA, 16 nt, Human
uaggccaugggacagg

SEQ ID NO: 1980184 - RNA, 18 nt, Human
uaggccaugggacaggga

SEQ ID NO: 1980185 - RNA, 16 nt, Human
uauagugcaauauauu

SEQ ID NO: 1980186 - RNA, 19 nt, Human
uauagugcaauauauuuug

SEQ ID NO: 1980187 - RNA, 19 nt, Human
uauaguuaaucuauaacua

SEQ ID NO: 1980188 - RNA, 18 nt, Human
uauaguuguuuuauaugu

SEQ ID NO: 1980189 - RNA, 22 nt, Human
uauaguuauguaaauaauucuu

SEQ ID NO: 1980190 - RNA, 16 nt, Human
uauaguuauguaaaua

SEQ ID NO: 1980191 - RNA, 20 nt, Human
uauaguuauguaaauaauuc

SEQ ID NO: 1980192 - RNA, 22 nt, Human
uauacugcaaacuauuuaaaga

SEQ ID NO: 1980193 - RNA, 16 nt, Human
uauacgagaacaggca

SEQ ID NO: 1980194 - RNA, 23 nt, Human
uauaccuguugcuuaauuacaau

SEQ ID NO: 1980195 - RNA, 17 nt, Human
uauaccuguuuaaauug

SEQ ID NO: 1980196 - RNA, 18 nt, Human
uauaccuguuuaaauugc

SEQ ID NO: 1980197 - RNA, 19 nt, Human
uauaccuguuuaaauugcu

SEQ ID NO: 1980198 - RNA, 21 nt, Human
uauaccuguuuaaauugcuca

SEQ ID NO: 1980199 - RNA, 13 nt, Human
uauacguuucaaa

SEQ ID NO: 1980200 - RNA, 21 nt, Human
uauaucuauauuuuacauaaa

SEQ ID NO: 1980201 - RNA, 17 nt, Human
uauaucucaaauuguaa

SEQ ID NO: 1980202 - RNA, 19 nt, Human
uauaucucaaauuguaauu

SEQ ID NO: 1980203 - RNA, 12 nt, Human
uauaucuccuuu

SEQ ID NO: 1980204 - RNA, 16 nt, Human
uauaucuccuuuguau

SEQ ID NO: 1980205 - RNA, 15 nt, Human
uauauguauguguuu

SEQ ID NO: 1980206 - RNA, 16 nt, Human
uauauguauguguuua

SEQ ID NO: 1980207 - RNA, 18 nt, Human
uauauguauguguuuaga

SEQ ID NO: 1980208 - RNA, 19 nt, Human
uauauguauguguuuagaa

SEQ ID NO: 1980209 - RNA, 22 nt, Human
uauauguauguguuuagaauug

SEQ ID NO: 1980210 - RNA, 13 nt, Human
uauauguguccau

SEQ ID NO: 1980211 - RNA, 17 nt, Human
uauaugugccacauuuu

SEQ ID NO: 1980212 - RNA, 21 nt, Human
uauaugcucugcauguuacau

SEQ ID NO: 1980213 - RNA, 14 nt, Human
uauauguauguguu

SEQ ID NO: 1980214 - RNA, 15 nt, Human
uauaauucacauugu

SEQ ID NO: 1980215 - RNA, 23 nt, Human
uauaauugugugauauuucagaa

SEQ ID NO: 1980216 - RNA, 13 nt, Human
uauaccuguugcu

SEQ ID NO: 1980217 - RNA, 12 nt, Human
uauaauugugug

SEQ ID NO: 1980218 - RNA, 20 nt, Human
uauaauugugugauauuuca

SEQ ID NO: 1980219 - RNA, 22 nt, Human
uauaauugugugauauuucaga

SEQ ID NO: 1980220 - RNA, 16 nt, Human
uauaaucaccagggcc

SEQ ID NO: 1980221 - RNA, 16 nt, Human
uauaauguugcccagu

SEQ ID NO: 1980222 - RNA, 15 nt, Human
uauaaauuauauucc

SEQ ID NO: 1980223 - RNA, 15 nt, Human
uauaauacacaaaau

SEQ ID NO: 1980224 - RNA, 16 nt, Human
uauaauacacaaaauc

SEQ ID NO: 1980225 - RNA, 18 nt, Human
uauaauacacaaaaucaa

SEQ ID NO: 1980226 - RNA, 23 nt, Human
uauaauacacaaaaucaaauaau

SEQ ID NO: 1980227 - RNA, 18 nt, Human
uauaaacuuuaccuuuuu

SEQ ID NO: 1980228 - RNA, 18 nt, Human
uaguugaggaaagcacag

SEQ ID NO: 1980229 - RNA, 23 nt, Human
uauaaagaagguuggugaauuuc

SEQ ID NO: 1980230 - RNA, 12 nt, Human
uauaaagaauag

SEQ ID NO: 1980231 - RNA, 17 nt, Human
uauaaagaauaggacuu

SEQ ID NO: 1980232 - RNA, 21 nt, Human
uauaaagaauaggacuuguuu

SEQ ID NO: 1980233 - RNA, 16 nt, Human
uaugauucaaaugucu

SEQ ID NO: 1980234 - RNA, 21 nt, Human
uaugauucaaaugucuauaaa

SEQ ID NO: 1980235 - RNA, 23 nt, Human
uaugagcuggggaugucucucau

SEQ ID NO: 1980236 - RNA, 23 nt, Human
uaugacuccagaauuucccaaag

SEQ ID NO: 1980237 - RNA, 17 nt, Human
uaugacuccagaauuuc

SEQ ID NO: 1980238 - RNA, 16 nt, Human
uaugacuccagaauuu

SEQ ID NO: 1980239 - RNA, 18 nt, Human
uaugauuuggaaaauaaa

SEQ ID NO: 1980240 - RNA, 15 nt, Human
uaugauuuggaaaau

SEQ ID NO: 1980241 - RNA, 17 nt, Human
uaugauuuggaaaauaa

SEQ ID NO: 1980242 - RNA, 17 nt, Human
uaugauuuaauuugaaa

SEQ ID NO: 1980243 - RNA, 18 nt, Human
uaugauuuaauuugaaau

SEQ ID NO: 1980244 - RNA, 18 nt, Human
uaugcaaucaaaucugcu

SEQ ID NO: 1980245 - RNA, 13 nt, Human
uaugcaagcaguu

SEQ ID NO: 1980246 - RNA, 16 nt, Human
uaugcaagcaguuuca

SEQ ID NO: 1980247 - RNA, 17 nt, Human
uaugcaagcaguuucaa

SEQ ID NO: 1980248 - RNA, 18 nt, Human
uaugcaagcaguuucaau

SEQ ID NO: 1980249 - RNA, 23 nt, Human
uaugcaagcaguuucaauaaagu

SEQ ID NO: 1980250 - RNA, 13 nt, Human
uaugcacacauuu

SEQ ID NO: 1980251 - RNA, 14 nt, Human
uaugcacacauuuu

SEQ ID NO: 1980252 - RNA, 15 nt, Human
uaugcacaauuccau

SEQ ID NO: 1980253 - RNA, 20 nt, Human
uaugcacaauuccaugacaa

SEQ ID NO: 1980254 - RNA, 19 nt, Human
uauggaacacucugagacu

SEQ ID NO: 1980255 - RNA, 16 nt, Human
uauggaaaugcaaacu

SEQ ID NO: 1980256 - RNA, 16 nt, Human
uauggaagguggagcg

SEQ ID NO: 1980257 - RNA, 19 nt, Human
uauggaagguggagcguuc

SEQ ID NO: 1980258 - RNA, 22 nt, Human
uauggacacuggugccauguca

SEQ ID NO: 1980259 - RNA, 17 nt, Human
uauggacaaugacccag

SEQ ID NO: 1980260 - RNA, 17 nt, Human
uaugcuucauacaggga

SEQ ID NO: 1980261 - RNA, 14 nt, Human
uaugcuuccagaaa

SEQ ID NO: 1980262 - RNA, 17 nt, Human
uaugcuuccagaaacac

SEQ ID NO: 1980263 - RNA, 23 nt, Human
uaugcuuccagaaacacccacag

SEQ ID NO: 1980264 - RNA, 19 nt, Human
uaugcuugcauauauuuca

SEQ ID NO: 1980265 - RNA, 18 nt, Human
uaugcuuguaacuaaaau

SEQ ID NO: 1980266 - RNA, 20 nt, Human
uaugcuuguaacuaaaauaa

SEQ ID NO: 1980267 - RNA, 14 nt, Human
uaugcuuuucucaa

SEQ ID NO: 1980268 - RNA, 18 nt, Human
uauggaacacucugagac

SEQ ID NO: 1980269 - RNA, 17 nt, Human
uauggaacacucugaga

SEQ ID NO: 1980270 - RNA, 16 nt, Human
uauggaacacucugag

SEQ ID NO: 1980271 - RNA, 13 nt, Human
uauggaacacucu

SEQ ID NO: 1980272 - RNA, 12 nt, Human
uaugcuucauac

SEQ ID NO: 1980273 - RNA, 13 nt, Human
uaugcuucauaca

SEQ ID NO: 1980274 - RNA, 14 nt, Human
uaugcuucauacag

SEQ ID NO: 1980275 - RNA, 16 nt, Human
uaugcuucauacaggg

SEQ ID NO: 1980276 - RNA, 22 nt, Human
uaugcuuauacacuuacacuuu

SEQ ID NO: 1980277 - RNA, 13 nt, Human
uaugcaugaagua

SEQ ID NO: 1980278 - RNA, 18 nt, Human
uaugcaugaaguaauaug

SEQ ID NO: 1980279 - RNA, 20 nt, Human
uaugcauauuauuuuauguu

SEQ ID NO: 1980280 - RNA, 19 nt, Human
uaugcauauauauaugugu

SEQ ID NO: 1980281 - RNA, 20 nt, Human
uaugcauauauauaugugug

SEQ ID NO: 1980282 - RNA, 24 nt, Human
uaugcauaauaauccugcaaagua

SEQ ID NO: 1980283 - RNA, 17 nt, Human
uaugcauauauauaugu

SEQ ID NO: 1980284 - RNA, 18 nt, Human
uaugcagagguccacaac

SEQ ID NO: 1980285 - RNA, 18 nt, Human
uaugcacuaagucucuuu

SEQ ID NO: 1980286 - RNA, 16 nt, Human
uaugcagaauggcauu

SEQ ID NO: 1980287 - RNA, 19 nt, Human
uaugcagaauggcauuugc

SEQ ID NO: 1980288 - RNA, 16 nt, Human
uaugcacuaagucucu

SEQ ID NO: 1980289 - RNA, 17 nt, Human
uaugcacuaagucucuu

SEQ ID NO: 1980290 - RNA, 22 nt, Human
uaugacacaugcaaggucauuu

SEQ ID NO: 1980291 - RNA, 17 nt, Human
uaugacaaauguuucua

SEQ ID NO: 1980292 - RNA, 12 nt, Human
uaugacacaugc

SEQ ID NO: 1980293 - RNA, 13 nt, Human
uaugacaaauguu

SEQ ID NO: 1980294 - RNA, 14 nt, Human
uaugacaaauguuu

SEQ ID NO: 1980295 - RNA, 16 nt, Human
uaugacaaauguuucu

SEQ ID NO: 1980296 - RNA, 14 nt, Human
uaugaccacacucc

SEQ ID NO: 1980297 - RNA, 19 nt, Human
uaugaccacacuccagcug

SEQ ID NO: 1980298 - RNA, 13 nt, Human
uaugaauacuuug

SEQ ID NO: 1980299 - RNA, 15 nt, Human
uaugaauacuuugca

SEQ ID NO: 1980300 - RNA, 20 nt, Human
uaugaaucuauuugugggug

SEQ ID NO: 1980301 - RNA, 16 nt, Human
uaucuguuuacagugu

SEQ ID NO: 1980302 - RNA, 17 nt, Human
uaucuguuuacaguguu

SEQ ID NO: 1980303 - RNA, 14 nt, Human
uaucuugaagacuu

SEQ ID NO: 1980304 - RNA, 18 nt, Human
uaugaauaaagacaccua

SEQ ID NO: 1980305 - RNA, 20 nt, Human
uaugaaguuuuuuuuauaca

SEQ ID NO: 1980306 - RNA, 10 nt, Human
uaucuucauc

SEQ ID NO: 1980307 - RNA, 18 nt, Human
uaucuuaucucagauauu

SEQ ID NO: 1980308 - RNA, 23 nt, Human
uaucuuaucucagauauuugcac

SEQ ID NO: 1980309 - RNA, 20 nt, Human
uaucugucauuugagcaggg

SEQ ID NO: 1980310 - RNA, 15 nt, Human
uaucuguaagagugu

SEQ ID NO: 1980311 - RNA, 21 nt, Human
uaucugucauuugagcagggc

SEQ ID NO: 1980312 - RNA, 23 nt, Human
uaucugucauuugagcagggcuc

SEQ ID NO: 1980313 - RNA, 12 nt, Human
uaucugucuuuc

SEQ ID NO: 1980314 - RNA, 14 nt, Human
uaucugucuuucca

SEQ ID NO: 1980315 - RNA, 15 nt, Human
uaucugucuuuccac

SEQ ID NO: 1980316 - RNA, 19 nt, Human
uauauguuuuaagaggcag

SEQ ID NO: 1980317 - RNA, 19 nt, Human
uauauguuuuugaaggcag

SEQ ID NO: 1980318 - RNA, 16 nt, Human
uauauuaaaagcaggc

SEQ ID NO: 1980319 - RNA, 16 nt, Human
uaucuaaauguugaaa

SEQ ID NO: 1980320 - RNA, 16 nt, Human
uaucgguauaaaggca

SEQ ID NO: 1980321 - RNA, 18 nt, Human
uaucguaaaauuaagaaa

SEQ ID NO: 1980322 - RNA, 15 nt, Human
uaucguaaaauuaag

SEQ ID NO: 1980323 - RNA, 15 nt, Human
uauccuucagccuga

SEQ ID NO: 1980324 - RNA, 14 nt, Human
uauccuucagccug

SEQ ID NO: 1980325 - RNA, 12 nt, Human
uauccuuucaca

SEQ ID NO: 1980326 - RNA, 18 nt, Human
uauccugagagcccagaa

SEQ ID NO: 1980327 - RNA, 12 nt, Human
uauccugaauaa

SEQ ID NO: 1980328 - RNA, 16 nt, Human
uaucgucacugcuuaa

SEQ ID NO: 1980329 - RNA, 16 nt, Human
uaucguauucaccuuc

SEQ ID NO: 1980330 - RNA, 18 nt, Human
uaucguauucaccuucag

SEQ ID NO: 1980331 - RNA, 21 nt, Human
uaucuaauauguaacaagcca

SEQ ID NO: 1980332 - RNA, 20 nt, Human
uaucuaccaacuuucaagaa

SEQ ID NO: 1980333 - RNA, 16 nt, Human
uaucuaccaacuuuca

SEQ ID NO: 1980334 - RNA, 17 nt, Human
uaucuaccaacuuucaa

SEQ ID NO: 1980335 - RNA, 18 nt, Human
uaucuaccaacuuucaag

SEQ ID NO: 1980336 - RNA, 19 nt, Human
uaucuaccaacuuucaaga

SEQ ID NO: 1980337 - RNA, 14 nt, Human
uaucuaauucuuua

SEQ ID NO: 1980338 - RNA, 15 nt, Human
uaucuaauucuuuaa

SEQ ID NO: 1980339 - RNA, 16 nt, Human
uaucuaauucuuuaau

SEQ ID NO: 1980340 - RNA, 15 nt, Human
uaucuaauuuggauu

SEQ ID NO: 1980341 - RNA, 15 nt, Human
uaucuaccaacuuuc

SEQ ID NO: 1980342 - RNA, 19 nt, Human
uaucugcccaccucggccu

SEQ ID NO: 1980343 - RNA, 11 nt, Human
guggccccacc

SEQ ID NO: 1980344 - RNA, 21 nt, Human
guggccacuccagaccccugg

SEQ ID NO: 1980345 - RNA, 16 nt, Human
guggccaucauuucug

SEQ ID NO: 1980346 - RNA, 15 nt, Human
guggcaguuuggcaa

SEQ ID NO: 1980347 - RNA, 19 nt, Human
guggcagugggagcugccu

SEQ ID NO: 1980348 - RNA, 21 nt, Human
guggcagugggagcugccugu

SEQ ID NO: 1980349 - RNA, 11 nt, Human
guggcagucug

SEQ ID NO: 1980350 - RNA, 15 nt, Human
guggcagugggagcu

SEQ ID NO: 1980351 - RNA, 16 nt, Human
guggcagugggagcug

SEQ ID NO: 1980352 - RNA, 17 nt, Human
guggcagugggagcugc

SEQ ID NO: 1980353 - RNA, 17 nt, Human
guggcaggacacugcag

SEQ ID NO: 1980354 - RNA, 14 nt, Human
guggcagggcacag

SEQ ID NO: 1980355 - RNA, 15 nt, Human
guggcagggcacagg

SEQ ID NO: 1980356 - RNA, 18 nt, Human
guggcagggcacagggcc

SEQ ID NO: 1980357 - RNA, 19 nt, Human
guggcagggcacagggccu

SEQ ID NO: 1980358 - RNA, 20 nt, Human
guggcagggcacagggccug

SEQ ID NO: 1980359 - RNA, 19 nt, Human
guggcagcugcgguccacc

SEQ ID NO: 1980360 - RNA, 20 nt, Human
guggaugccugguggcagcu

SEQ ID NO: 1980361 - RNA, 21 nt, Human
guggcagcugcgguccaccca

SEQ ID NO: 1980362 - RNA, 22 nt, Human
guggcagcugcgguccacccag

SEQ ID NO: 1980363 - RNA, 23 nt, Human
guggcagcugcgguccacccagg

SEQ ID NO: 1980364 - RNA, 12 nt, Human
guggcagcugcu

SEQ ID NO: 1980365 - RNA, 13 nt, Human
guggcagcugcuu

SEQ ID NO: 1980366 - RNA, 19 nt, Human
guggcagcugcuuuugucu

SEQ ID NO: 1980367 - RNA, 20 nt, Human
guggagaagcggcuggcagc

SEQ ID NO: 1980368 - RNA, 13 nt, Human
guggacuuuuauu

SEQ ID NO: 1980369 - RNA, 23 nt, Human
guggacuuaggaagguggccuuc

SEQ ID NO: 1980370 - RNA, 21 nt, Human
guggaaauuaagaagaaacua

SEQ ID NO: 1980371 - RNA, 18 nt, Human
guggagaggcccggccuc

SEQ ID NO: 1980372 - RNA, 15 nt, Human
guggagacugcuccu

SEQ ID NO: 1980373 - RNA, 22 nt, Human
guggagacugcuccugagcccc

SEQ ID NO: 1980374 - RNA, 17 nt, Human
guggagaaucacaggcu

SEQ ID NO: 1980375 - RNA, 18 nt, Human
guggagaaucacaggcug

SEQ ID NO: 1980376 - RNA, 19 nt, Human
guggagaaucacaggcugg

SEQ ID NO: 1980377 - RNA, 20 nt, Human
guggagaaucacaggcuggg

SEQ ID NO: 1980378 - RNA, 21 nt, Human
guggagaaucacaggcugggc

SEQ ID NO: 1980379 - RNA, 14 nt, Human
guggagacugcucc

SEQ ID NO: 1980380 - RNA, 14 nt, Human
guggagcccaggag

SEQ ID NO: 1980381 - RNA, 15 nt, Human
guggagcccaggagu

SEQ ID NO: 1980382 - RNA, 19 nt, Human
guggagccugacagccaga

SEQ ID NO: 1980383 - RNA, 21 nt, Human
guggagccugacagccagaac

SEQ ID NO: 1980384 - RNA, 22 nt, Human
guggagccugacagccagaacu

SEQ ID NO: 1980385 - RNA, 23 nt, Human
guggagccugacagccagaacuc

SEQ ID NO: 1980386 - RNA, 16 nt, Human
guggagcguucaccag

SEQ ID NO: 1980387 - RNA, 14 nt, Human
guggagucauuucu

SEQ ID NO: 1980388 - RNA, 20 nt, Human
guggagguugcugguacaca

SEQ ID NO: 1980389 - RNA, 22 nt, Human
guggagucagccucgcaggccu

SEQ ID NO: 1980390 - RNA, 17 nt, Human
guggaguucaucuugaa

SEQ ID NO: 1980391 - RNA, 16 nt, Human
guggaugccugguggc

SEQ ID NO: 1980392 - RNA, 18 nt, Human
guggaugccugguggcag

SEQ ID NO: 1980393 - RNA, 21 nt, Human
guggaugccacagcccagcuu

SEQ ID NO: 1980394 - RNA, 16 nt, Human
guggaugcaauuuuuc

SEQ ID NO: 1980395 - RNA, 18 nt, Human
gugcuugugaaagagguc

SEQ ID NO: 1980396 - RNA, 17 nt, Human
guggaaauuaagaagaa

SEQ ID NO: 1980397 - RNA, 18 nt, Human
guggaaauuaagaagaaa

SEQ ID NO: 1980398 - RNA, 19 nt, Human
guggaaauuaagaagaaac

SEQ ID NO: 1980399 - RNA, 20 nt, Human
guggaaauuaagaagaaacu

SEQ ID NO: 1980400 - RNA, 23 nt, Human
guggaaaagccaagaggcugcag

SEQ ID NO: 1980401 - RNA, 18 nt, Human
guggaaaaauagccugcc

SEQ ID NO: 1980402 - RNA, 18 nt, Human
gugcuuauguaugaggua

SEQ ID NO: 1980403 - RNA, 15 nt, Human
gugcuuggaggaagg

SEQ ID NO: 1980404 - RNA, 13 nt, Human
gugcuuggaggaa

SEQ ID NO: 1980405 - RNA, 12 nt, Human
gugcuuggagga

SEQ ID NO: 1980406 - RNA, 21 nt, Human
gugcuucugccacccugcuga

SEQ ID NO: 1980407 - RNA, 22 nt, Human
gugcuucugccacccugcugag

SEQ ID NO: 1980408 - RNA, 11 nt, Human
gugcugcccug

SEQ ID NO: 1980409 - RNA, 22 nt, Human
gugcugccauccagguucagcu

SEQ ID NO: 1980410 - RNA, 21 nt, Human
gugcugccacacuucaggcuc

SEQ ID NO: 1980411 - RNA, 19 nt, Human
gugcuguguuugcuccccu

SEQ ID NO: 1980412 - RNA, 19 nt, Human
gugcugagucugaaggcug

SEQ ID NO: 1980413 - RNA, 18 nt, Human
gugcugagucugaaggcu

SEQ ID NO: 1980414 - RNA, 17 nt, Human
gugcugagucugaaggc

SEQ ID NO: 1980415 - RNA, 16 nt, Human
gugcugagucugaagg

SEQ ID NO: 1980416 - RNA, 12 nt, Human
gugcugagucug

SEQ ID NO: 1980417 - RNA, 12 nt, Human
gugcugcauuua

SEQ ID NO: 1980418 - RNA, 19 nt, Human
gugcugcauuuaaaagaua

SEQ ID NO: 1980419 - RNA, 20 nt, Human
gugcugcauuuaaaagauac

SEQ ID NO: 1980420 - RNA, 15 nt, Human
gugcugccauccagg

SEQ ID NO: 1980421 - RNA, 12 nt, Human
gugcugccacac

SEQ ID NO: 1980422 - RNA, 22 nt, Human
gugcugcagggcuuuaaaauuc

SEQ ID NO: 1980423 - RNA, 13 nt, Human
gugcugcaguaug

SEQ ID NO: 1980424 - RNA, 18 nt, Human
gugcugccauccagguuc

SEQ ID NO: 1980425 - RNA, 19 nt, Human
gugcugccauccagguuca

SEQ ID NO: 1980426 - RNA, 21 nt, Human
gugccuuggggacaagagcag

SEQ ID NO: 1980427 - RNA, 22 nt, Human
gugccgagaaggaagccuccca

SEQ ID NO: 1980428 - RNA, 15 nt, Human
gugcucuggacaggc

SEQ ID NO: 1980429 - RNA, 16 nt, Human
gugcucuggacaggca

SEQ ID NO: 1980430 - RNA, 17 nt, Human
gugccuuugcagcucag

SEQ ID NO: 1980431 - RNA, 17 nt, Human
gugcucuggacaggcau

SEQ ID NO: 1980432 - RNA, 18 nt, Human
gugcucuggacaggcaug

SEQ ID NO: 1980433 - RNA, 20 nt, Human
gugcugaaugguuuucaaaa

SEQ ID NO: 1980434 - RNA, 19 nt, Human
gugcugaaugguuuucaaa

SEQ ID NO: 1980435 - RNA, 23 nt, Human
gugcugaaugguuuucaaaauaa

SEQ ID NO: 1980436 - RNA, 19 nt, Human
gugaccuuccaagagccug

SEQ ID NO: 1980437 - RNA, 20 nt, Human
gugaccuuccaagagccuga

SEQ ID NO: 1980438 - RNA, 16 nt, Human
gugacugaauuucuuu

SEQ ID NO: 1980439 - RNA, 18 nt, Human
gugacugaauuucuuuug

SEQ ID NO: 1980440 - RNA, 15 nt, Human
gugacugaauuucuu

SEQ ID NO: 1980441 - RNA, 16 nt, Human
gugacaacacuugugu

SEQ ID NO: 1980442 - RNA, 16 nt, Human
gugaccucagcuuuga

SEQ ID NO: 1980443 - RNA, 20 nt, Human
gugaccuaucaguuauuaau

SEQ ID NO: 1980444 - RNA, 19 nt, Human
gugaccucuagcccugccc

SEQ ID NO: 1980445 - RNA, 20 nt, Human
gugaccucuagcccugcccg

SEQ ID NO: 1980446 - RNA, 17 nt, Human
gugacugaucucucgug

SEQ ID NO: 1980447 - RNA, 17 nt, Human
gugagcaggcugugagu

SEQ ID NO: 1980448 - RNA, 13 nt, Human
gugagccacugca

SEQ ID NO: 1980449 - RNA, 17 nt, Human
gugagccaccgugccug

SEQ ID NO: 1980450 - RNA, 21 nt, Human
gugagccaccgugccuggcca

SEQ ID NO: 1980451 - RNA, 16 nt, Human
gugagccaccacgccc

SEQ ID NO: 1980452 - RNA, 15 nt, Human
gugagccaccgugcc

SEQ ID NO: 1980453 - RNA, 15 nt, Human
gugagccaccacgcc

SEQ ID NO: 1980454 - RNA, 19 nt, Human
gugaggaagccgcuggggc

SEQ ID NO: 1980455 - RNA, 16 nt, Human
gugaggaagccgcugg

SEQ ID NO: 1980456 - RNA, 11 nt, Human
gugaggaagcc

SEQ ID NO: 1980457 - RNA, 11 nt, Human
gugagcuggag

SEQ ID NO: 1980458 - RNA, 14 nt, Human
gugaggaaaucaaa

SEQ ID NO: 1980459 - RNA, 18 nt, Human
gugaggaaaucaaagugc

SEQ ID NO: 1980460 - RNA, 22 nt, Human
gugaggaaaucaaagugcuauu

SEQ ID NO: 1980461 - RNA, 14 nt, Human
gugagccacugcac

SEQ ID NO: 1980462 - RNA, 22 nt, Human
gugagccaccgugccuggccac

SEQ ID NO: 1980463 - RNA, 14 nt, Human
gugagcuacaaaug

SEQ ID NO: 1980464 - RNA, 13 nt, Human
gugagcugcacca

SEQ ID NO: 1980465 - RNA, 17 nt, Human
gugagcugcugccauga

SEQ ID NO: 1980466 - RNA, 19 nt, Human
gugagcugcugccaugaac

SEQ ID NO: 1980467 - RNA, 14 nt, Human
gugaaucagagcac

SEQ ID NO: 1980468 - RNA, 22 nt, Human
gugaauacugcuugaauaaaca

SEQ ID NO: 1980469 - RNA, 16 nt, Human
gugaauuacuaacuuc

SEQ ID NO: 1980470 - RNA, 18 nt, Human
gugaauuacuaacuucua

SEQ ID NO: 1980471 - RNA, 19 nt, Human
gugaauuacuaacuucuaa

SEQ ID NO: 1980472 - RNA, 19 nt, Human
gugaaaggaaagagggagg

SEQ ID NO: 1980473 - RNA, 13 nt, Human
gugaaaucauuca

SEQ ID NO: 1980474 - RNA, 12 nt, Human
gugaaauuuuuc

SEQ ID NO: 1980475 - RNA, 20 nt, Human
gugaaauuauucauaauuau

SEQ ID NO: 1980476 - RNA, 18 nt, Human
gugaaauuauucauaauu

SEQ ID NO: 1980477 - RNA, 12 nt, Human
gugaaacuggau

SEQ ID NO: 1980478 - RNA, 19 nt, Human
gugaaagaaaauaacaaua

SEQ ID NO: 1980479 - RNA, 22 nt, Human
gugaaaauaagccaugagaaug

SEQ ID NO: 1980480 - RNA, 13 nt, Human
gugaaaauaauug

SEQ ID NO: 1980481 - RNA, 12 nt, Human
gugaaaagaaua

SEQ ID NO: 1980482 - RNA, 23 nt, Human
gugaaaagaaaaaugagccuggc

SEQ ID NO: 1980483 - RNA, 14 nt, Human
gugaaaagaaaaau

SEQ ID NO: 1980484 - RNA, 16 nt, Human
gugaaaaugugugugu

SEQ ID NO: 1980485 - RNA, 14 nt, Human
gugauucuccugcc

SEQ ID NO: 1980486 - RNA, 20 nt, Human
gugauucucaugccucagcc

SEQ ID NO: 1980487 - RNA, 16 nt, Human
gugauucuccugccuc

SEQ ID NO: 1980488 - RNA, 17 nt, Human
gugauucuccugccuca

SEQ ID NO: 1980489 - RNA, 18 nt, Human
gugauucuccugccucag

SEQ ID NO: 1980490 - RNA, 19 nt, Human
gugauucuccugccucagc

SEQ ID NO: 1980491 - RNA, 20 nt, Human
gugauucuccugccucagcc

SEQ ID NO: 1980492 - RNA, 22 nt, Human
gugauucuccugccucagccuc

SEQ ID NO: 1980493 - RNA, 23 nt, Human
gugauucuccugccucagccucc

SEQ ID NO: 1980494 - RNA, 23 nt, Human
gugauccucccaccucagccucc

SEQ ID NO: 1980495 - RNA, 20 nt, Human
gugauucacagugugaaucu

SEQ ID NO: 1980496 - RNA, 20 nt, Human
gugauccucccaccucagcc

SEQ ID NO: 1980497 - RNA, 22 nt, Human
gugauccucccaccucagccuc

SEQ ID NO: 1980498 - RNA, 14 nt, Human
gugauccucccacc

SEQ ID NO: 1980499 - RNA, 14 nt, Human
gugauccacucgcc

SEQ ID NO: 1980500 - RNA, 15 nt, Human
gugauccucccaccu

SEQ ID NO: 1980501 - RNA, 18 nt, Human
gugauccucccaccucag

SEQ ID NO: 1980502 - RNA, 11 nt, Human
gugaggccaga

SEQ ID NO: 1980503 - RNA, 23 nt, Human
gugaggauuaaauaauguaaaua

SEQ ID NO: 1980504 - RNA, 22 nt, Human
gugaggagaaugaaauguaugu

SEQ ID NO: 1980505 - RNA, 13 nt, Human
gugaggccagaga

SEQ ID NO: 1980506 - RNA, 15 nt, Human
gugauccacccaccu

SEQ ID NO: 1980507 - RNA, 18 nt, Human
gugauccacccaccucag

SEQ ID NO: 1980508 - RNA, 20 nt, Human
gugauccacccaccucagcc

SEQ ID NO: 1980509 - RNA, 13 nt, Human
gugcauaccacuu

SEQ ID NO: 1980510 - RNA, 14 nt, Human
gugcauaccacuuu

SEQ ID NO: 1980511 - RNA, 21 nt, Human
gugcauaccacuuuuguucuu

SEQ ID NO: 1980512 - RNA, 15 nt, Human
gugcaucucagccca

SEQ ID NO: 1980513 - RNA, 14 nt, Human
gugcaucucagccc

SEQ ID NO: 1980514 - RNA, 18 nt, Human
gugcaucucagcccacau

SEQ ID NO: 1980515 - RNA, 18 nt, Human
gugcaugcagcaucuaag

SEQ ID NO: 1980516 - RNA, 20 nt, Human
gugccagguuuuuggucuga

SEQ ID NO: 1980517 - RNA, 22 nt, Human
gugccagguuuuuggucugacc

SEQ ID NO: 1980518 - RNA, 22 nt, Human
gugcaaaguucccuacuuccug

SEQ ID NO: 1980519 - RNA, 18 nt, Human
gugcaguaacuugggagu

SEQ ID NO: 1980520 - RNA, 13 nt, Human
gugcaguagugca

SEQ ID NO: 1980521 - RNA, 19 nt, Human
gugcauaaguuaacuucca

SEQ ID NO: 1980522 - RNA, 11 nt, Human
gugcccagcuu

SEQ ID NO: 1980523 - RNA, 20 nt, Human
gugcccacaggaucagucug

SEQ ID NO: 1980524 - RNA, 23 nt, Human
gugcccaagaauagaugcugacu

SEQ ID NO: 1980525 - RNA, 12 nt, Human
gucucugugagg

SEQ ID NO: 1980526 - RNA, 23 nt, Human
gucucucacagacaggaccccug

SEQ ID NO: 1980527 - RNA, 12 nt, Human
gucucucacaga

SEQ ID NO: 1980528 - RNA, 14 nt, Human
gucucucacagaca

SEQ ID NO: 1980529 - RNA, 16 nt, Human
gucucucacagacagg

SEQ ID NO: 1980530 - RNA, 19 nt, Human
gucucucacagacaggacc

SEQ ID NO: 1980531 - RNA, 19 nt, Human
gucucggaaccugugagcu

SEQ ID NO: 1980532 - RNA, 23 nt, Human
gucucggaaccugugagcugcac

SEQ ID NO: 1980533 - RNA, 20 nt, Human
gucucggaucaggcucccag

SEQ ID NO: 1980534 - RNA, 13 nt, Human
gucugacccacug

SEQ ID NO: 1980535 - RNA, 14 nt, Human
gucugacccacugc

SEQ ID NO: 1980536 - RNA, 15 nt, Human
gucucuucuccacug

SEQ ID NO: 1980537 - RNA, 16 nt, Human
gucucuucuccacugg

SEQ ID NO: 1980538 - RNA, 14 nt, Human
gucucuucuccacu

SEQ ID NO: 1980539 - RNA, 15 nt, Human
gucugacccacugcu

SEQ ID NO: 1980540 - RNA, 17 nt, Human
gucucuucuccacugga

SEQ ID NO: 1980541 - RNA, 11 nt, Human
gucucuucucc

SEQ ID NO: 1980542 - RNA, 18 nt, Human
gucugaggaauccagacc

SEQ ID NO: 1980543 - RNA, 19 nt, Human
gucugaggaauccagaccc

SEQ ID NO: 1980544 - RNA, 20 nt, Human
gucugauucccaagcucugc

SEQ ID NO: 1980545 - RNA, 21 nt, Human
gucugauucccaagcucugcu

SEQ ID NO: 1980546 - RNA, 17 nt, Human
gucugauucccaagcuc

SEQ ID NO: 1980547 - RNA, 14 nt, Human
gucugauauucaaa

SEQ ID NO: 1980548 - RNA, 18 nt, Human
gucugauucccaagcucu

SEQ ID NO: 1980549 - RNA, 19 nt, Human
gucugauucccaagcucug

SEQ ID NO: 1980550 - RNA, 21 nt, Human
gucugaguuguuaccccaagc

SEQ ID NO: 1980551 - RNA, 17 nt, Human
gucugagguugggagag

SEQ ID NO: 1980552 - RNA, 21 nt, Human
gucugagggcuuguaguucuu

SEQ ID NO: 1980553 - RNA, 21 nt, Human
gucugaggaauccagacccgg

SEQ ID NO: 1980554 - RNA, 18 nt, Human
gucugaggccguugcuga

SEQ ID NO: 1980555 - RNA, 22 nt, Human
gucugaggccguugcugacuua

SEQ ID NO: 1980556 - RNA, 20 nt, Human
gucugagggcuuguaguucu

SEQ ID NO: 1980557 - RNA, 15 nt, Human
gucuaauguuuaagc

SEQ ID NO: 1980558 - RNA, 17 nt, Human
gucuaauguuuaagcag

SEQ ID NO: 1980559 - RNA, 15 nt, Human
gucuacacugugcug

SEQ ID NO: 1980560 - RNA, 17 nt, Human
gucuacagcucccccag

SEQ ID NO: 1980561 - RNA, 21 nt, Human
gucuacagcucccccagcucc

SEQ ID NO: 1980562 - RNA, 13 nt, Human
gucuacagcuccc

SEQ ID NO: 1980563 - RNA, 15 nt, Human
gucuacagcuccccc

SEQ ID NO: 1980564 - RNA, 23 nt, Human
gucuaccccucccggcccugccu

SEQ ID NO: 1980565 - RNA, 15 nt, Human
gucguuuuaaaaaca

SEQ ID NO: 1980566 - RNA, 23 nt, Human
gucguuaaaaacagauuuggaaa

SEQ ID NO: 1980567 - RNA, 17 nt, Human
guccugugucaguuuau

SEQ ID NO: 1980568 - RNA, 22 nt, Human
guccugugucaguuuauguuuu

SEQ ID NO: 1980569 - RNA, 17 nt, Human
guccuuaccagcagagc

SEQ ID NO: 1980570 - RNA, 16 nt, Human
guccuuaccagcagag

SEQ ID NO: 1980571 - RNA, 15 nt, Human
guccuuaccagcaga

SEQ ID NO: 1980572 - RNA, 16 nt, Human
guccugugucaguuua

SEQ ID NO: 1980573 - RNA, 20 nt, Human
gucucacuauguugcccagg

SEQ ID NO: 1980574 - RNA, 21 nt, Human
gucucacuauguugcccaggc

SEQ ID NO: 1980575 - RNA, 13 nt, Human
gucucacuguugc

SEQ ID NO: 1980576 - RNA, 23 nt, Human
gucucacuauguugcccaggcag

SEQ ID NO: 1980577 - RNA, 16 nt, Human
gucucacuguugccca

SEQ ID NO: 1980578 - RNA, 17 nt, Human
gucucacuguugcccag

SEQ ID NO: 1980579 - RNA, 18 nt, Human
gucucacuguugcccagg

SEQ ID NO: 1980580 - RNA, 19 nt, Human
gucucacuguugcccaggc

SEQ ID NO: 1980581 - RNA, 20 nt, Human
gucucacuguugcccaggcu

SEQ ID NO: 1980582 - RNA, 21 nt, Human
gucucacuguugcccaggcug

SEQ ID NO: 1980583 - RNA, 22 nt, Human
gucucacuguugcccaggcugg

SEQ ID NO: 1980584 - RNA, 23 nt, Human
gucucacuguugcccaggcuggc

SEQ ID NO: 1980585 - RNA, 22 nt, Human
gucucgcucuguugcccaggcu

SEQ ID NO: 1980586 - RNA, 14 nt, Human
guccuccaagccag

SEQ ID NO: 1980587 - RNA, 22 nt, Human
guccucagggagcagggaaggc

SEQ ID NO: 1980588 - RNA, 12 nt, Human
guccuccagaac

SEQ ID NO: 1980589 - RNA, 13 nt, Human
guccuccagaacu

SEQ ID NO: 1980590 - RNA, 13 nt, Human
guccucagggagc

SEQ ID NO: 1980591 - RNA, 16 nt, Human
guccucagggagcagg

SEQ ID NO: 1980592 - RNA, 13 nt, Human
guccucacacuca

SEQ ID NO: 1980593 - RNA, 21 nt, Human
guccuauuauauucauucuuu

SEQ ID NO: 1980594 - RNA, 17 nt, Human
guccuauuaguguuaua

SEQ ID NO: 1980595 - RNA, 20 nt, Human
guccuauuaguguuauauga

SEQ ID NO: 1980596 - RNA, 21 nt, Human
guccuauuaguguuauaugaa

SEQ ID NO: 1980597 - RNA, 22 nt, Human
guccuauuaguguuauaugaac

SEQ ID NO: 1980598 - RNA, 19 nt, Human
guccuauuauauucauucu

SEQ ID NO: 1980599 - RNA, 23 nt, Human
guccuagaaauuccccacccuga

SEQ ID NO: 1980600 - RNA, 17 nt, Human
guccuagacuucaggga

SEQ ID NO: 1980601 - RNA, 15 nt, Human
guccuacucuguguc

SEQ ID NO: 1980602 - RNA, 23 nt, Human
guccuacucugugucaggugggg

SEQ ID NO: 1980603 - RNA, 16 nt, Human
gucccuggcuuccuua

SEQ ID NO: 1980604 - RNA, 16 nt, Human
gucccugguggcagcu

SEQ ID NO: 1980605 - RNA, 17 nt, Human
gucccugguggcagcuc

SEQ ID NO: 1980606 - RNA, 13 nt, Human
guccuacucugug

SEQ ID NO: 1980607 - RNA, 15 nt, Human
gucccuggcuuccuu

SEQ ID NO: 1980608 - RNA, 12 nt, Human
gucccagugccg

SEQ ID NO: 1980609 - RNA, 19 nt, Human
guccugggagugagcuggu

SEQ ID NO: 1980610 - RNA, 17 nt, Human
guccugggagugagcug

SEQ ID NO: 1980611 - RNA, 18 nt, Human
guccugggagugagcugg

SEQ ID NO: 1980612 - RNA, 19 nt, Human
guccuggggaaccugaccc

SEQ ID NO: 1980613 - RNA, 20 nt, Human
guccuggggaaccugacccc

SEQ ID NO: 1980614 - RNA, 18 nt, Human
guccuguaggaguucuau

SEQ ID NO: 1980615 - RNA, 15 nt, Human
guccugggagugagc

SEQ ID NO: 1980616 - RNA, 16 nt, Human
guccugggagugagcu

SEQ ID NO: 1980617 - RNA, 17 nt, Human
guccuggcaugggaaug

SEQ ID NO: 1980618 - RNA, 23 nt, Human
guccucccaucucacacaugagc

SEQ ID NO: 1980619 - RNA, 14 nt, Human
guccucccaucuca

SEQ ID NO: 1980620 - RNA, 13 nt, Human
guccucccaucuc

SEQ ID NO: 1980621 - RNA, 12 nt, Human
guccucccaucu

SEQ ID NO: 1980622 - RNA, 20 nt, Human
guccuccagaacucuuccuc

SEQ ID NO: 1980623 - RNA, 13 nt, Human
guagagugggagc

SEQ ID NO: 1980624 - RNA, 15 nt, Human
guagagguauaauug

SEQ ID NO: 1980625 - RNA, 16 nt, Human
guagagguauaauugu

SEQ ID NO: 1980626 - RNA, 19 nt, Human
guagagguauaauugugug

SEQ ID NO: 1980627 - RNA, 20 nt, Human
guauuacaguggggaaugaa

SEQ ID NO: 1980628 - RNA, 12 nt, Human
guagagucugag

SEQ ID NO: 1980629 - RNA, 14 nt, Human
guagagucugaggg

SEQ ID NO: 1980630 - RNA, 21 nt, Human
guagagucugagggcuuguag

SEQ ID NO: 1980631 - RNA, 15 nt, Human
guagagugggagcug

SEQ ID NO: 1980632 - RNA, 22 nt, Human
guauuacaguggggaaugaaga

SEQ ID NO: 1980633 - RNA, 13 nt, Human
guauuacuucugc

SEQ ID NO: 1980634 - RNA, 14 nt, Human
guauuacuucugcu

SEQ ID NO: 1980635 - RNA, 15 nt, Human
guauuacuucugcua

SEQ ID NO: 1980636 - RNA, 15 nt, Human
guauuauguguguuu

SEQ ID NO: 1980637 - RNA, 23 nt, Human
guauuauaaacaagaaugaaggu

SEQ ID NO: 1980638 - RNA, 14 nt, Human
guauuauaccuuuu

SEQ ID NO: 1980639 - RNA, 22 nt, Human
guauucaauuaaagaaauaauu

SEQ ID NO: 1980640 - RNA, 23 nt, Human
guauucagcaaggcgcuaacuug

SEQ ID NO: 1980641 - RNA, 14 nt, Human
guauucauauuugu

SEQ ID NO: 1980642 - RNA, 17 nt, Human
guauucauauuuguacu

SEQ ID NO: 1980643 - RNA, 19 nt, Human
guauucauauuuguacuuu

SEQ ID NO: 1980644 - RNA, 23 nt, Human
guauucauauuuguacuuucugu

SEQ ID NO: 1980645 - RNA, 19 nt, Human
guauuuauuuaguauuuau

SEQ ID NO: 1980646 - RNA, 12 nt, Human
guauuuauucuu

SEQ ID NO: 1980647 - RNA, 15 nt, Human
guauuugaaaacaga

SEQ ID NO: 1980648 - RNA, 16 nt, Human
guauuugaaaacagaa

SEQ ID NO: 1980649 - RNA, 19 nt, Human
guauuugaaaacagaaauu

SEQ ID NO: 1980650 - RNA, 20 nt, Human
guauuugaaaacagaaauug

SEQ ID NO: 1980651 - RNA, 17 nt, Human
guauuugaaagugccuu

SEQ ID NO: 1980652 - RNA, 17 nt, Human
guauuuggaauuagaac

SEQ ID NO: 1980653 - RNA, 15 nt, Human
gucaauuacaggaag

SEQ ID NO: 1980654 - RNA, 13 nt, Human
gucaauuacagga

SEQ ID NO: 1980655 - RNA, 16 nt, Human
gucaauuacaggaagu

SEQ ID NO: 1980656 - RNA, 14 nt, Human
gucaaguggcaaag

SEQ ID NO: 1980657 - RNA, 20 nt, Human
gucaaguggcaaagcuguuc

SEQ ID NO: 1980658 - RNA, 22 nt, Human
gucaaguggcaaagcuguucuu

SEQ ID NO: 1980659 - RNA, 15 nt, Human
gucaccccggccacc

SEQ ID NO: 1980660 - RNA, 13 nt, Human
gucaccccggcca

SEQ ID NO: 1980661 - RNA, 14 nt, Human
gucacccaugacag

SEQ ID NO: 1980662 - RNA, 20 nt, Human
gucaccugaagacucauucu

SEQ ID NO: 1980663 - RNA, 19 nt, Human
gucaccucacucagcacca

SEQ ID NO: 1980664 - RNA, 21 nt, Human
gucaccucacucagcaccacu

SEQ ID NO: 1980665 - RNA, 13 nt, Human
gucaccucacuca

SEQ ID NO: 1980666 - RNA, 15 nt, Human
gucaccucacucagc

SEQ ID NO: 1980667 - RNA, 16 nt, Human
gucaccucacucagca

SEQ ID NO: 1980668 - RNA, 12 nt, Human
guauuuggguuu

SEQ ID NO: 1980669 - RNA, 18 nt, Human
gucaagagggucugagga

SEQ ID NO: 1980670 - RNA, 19 nt, Human
gucaagagggucugaggaa

SEQ ID NO: 1980671 - RNA, 21 nt, Human
gucaagaauagcauuguaaaa

SEQ ID NO: 1980672 - RNA, 18 nt, Human
gucaagugaaaaaggagg

SEQ ID NO: 1980673 - RNA, 16 nt, Human
gucaagugaaaaagga

SEQ ID NO: 1980674 - RNA, 19 nt, Human
gucaagugaaaaaggagga

SEQ ID NO: 1980675 - RNA, 23 nt, Human
gucagcaguugcugguaaaauga

SEQ ID NO: 1980676 - RNA, 14 nt, Human
gucagcaguugcug

SEQ ID NO: 1980677 - RNA, 22 nt, Human
gucagcccaaaccaccagaagc

SEQ ID NO: 1980678 - RNA, 23 nt, Human
gucagcccaaaccaccagaagcc

SEQ ID NO: 1980679 - RNA, 17 nt, Human
gucaccugcuucucugc

SEQ ID NO: 1980680 - RNA, 22 nt, Human
gucaccugggcgucaucugguc

SEQ ID NO: 1980681 - RNA, 23 nt, Human
gucaccucacucagcaccacuca

SEQ ID NO: 1980682 - RNA, 13 nt, Human
gucaccugcuucu

SEQ ID NO: 1980683 - RNA, 14 nt, Human
gucaccugcuucuc

SEQ ID NO: 1980684 - RNA, 16 nt, Human
gucaccugcuucucug

SEQ ID NO: 1980685 - RNA, 16 nt, Human
gucagccucgcaggcc

SEQ ID NO: 1980686 - RNA, 23 nt, Human
gucagccucgcaggccucccugc

SEQ ID NO: 1980687 - RNA, 18 nt, Human
gucauacucgagucugag

SEQ ID NO: 1980688 - RNA, 19 nt, Human
gucauacucgagucugagg

SEQ ID NO: 1980689 - RNA, 20 nt, Human
gucauacucgagucugaggc

SEQ ID NO: 1980690 - RNA, 13 nt, Human
gucauacauagga

SEQ ID NO: 1980691 - RNA, 15 nt, Human
gucauaggaaguuag

SEQ ID NO: 1980692 - RNA, 16 nt, Human
gucauaggaaguuagc

SEQ ID NO: 1980693 - RNA, 21 nt, Human
gucauauaagauucauauuua

SEQ ID NO: 1980694 - RNA, 14 nt, Human
gucauauguuugcu

SEQ ID NO: 1980695 - RNA, 17 nt, Human
gucauauuuaaacagaa

SEQ ID NO: 1980696 - RNA, 16 nt, Human
gucaucucagcuggau

SEQ ID NO: 1980697 - RNA, 13 nt, Human
gucaucuagcauu

SEQ ID NO: 1980698 - RNA, 21 nt, Human
gucaucuagcauuagguauau

SEQ ID NO: 1980699 - RNA, 18 nt, Human
gucaucauguuuugauuu

SEQ ID NO: 1980700 - RNA, 13 nt, Human
gucaucugagaau

SEQ ID NO: 1980701 - RNA, 15 nt, Human
gucaucugagaauga

SEQ ID NO: 1980702 - RNA, 19 nt, Human
gucaucugagaaugaacaa

SEQ ID NO: 1980703 - RNA, 22 nt, Human
gucaugcagaguauuucuaaag

SEQ ID NO: 1980704 - RNA, 22 nt, Human
gucaugauguuuuuaaaaucuu

SEQ ID NO: 1980705 - RNA, 23 nt, Human
gucaugauguuuuuaaaaucuua

SEQ ID NO: 1980706 - RNA, 16 nt, Human
gucaugaugcucuuuc

SEQ ID NO: 1980707 - RNA, 19 nt, Human
gucaugaugcucuuuccca

SEQ ID NO: 1980708 - RNA, 13 nt, Human
gucaugauguuuu

SEQ ID NO: 1980709 - RNA, 14 nt, Human
gucaugauguuuuu

SEQ ID NO: 1980710 - RNA, 15 nt, Human
gucaugauguuuuua

SEQ ID NO: 1980711 - RNA, 16 nt, Human
gucaugauguuuuuaa

SEQ ID NO: 1980712 - RNA, 20 nt, Human
gucaugauguuuuuaaaauc

SEQ ID NO: 1980713 - RNA, 20 nt, Human
gucccagaaugccuccugca

SEQ ID NO: 1980714 - RNA, 17 nt, Human
gucccagauacuugggg

SEQ ID NO: 1980715 - RNA, 11 nt, Human
gucccagcagc

SEQ ID NO: 1980716 - RNA, 14 nt, Human
gucccagcagccag

SEQ ID NO: 1980717 - RNA, 17 nt, Human
gucccagcagccagcca

SEQ ID NO: 1980718 - RNA, 15 nt, Human
gucccagcagccagc

SEQ ID NO: 1980719 - RNA, 16 nt, Human
gucccagcagccagcc

SEQ ID NO: 1980720 - RNA, 22 nt, Human
guccaggacaggagaugcugug

SEQ ID NO: 1980721 - RNA, 23 nt, Human
guccaggccuacuccugucuucu

SEQ ID NO: 1980722 - RNA, 24 nt, Human
guccaggccuacuccugucuucug

SEQ ID NO: 1980723 - RNA, 15 nt, Human
guccaggccuacucc

SEQ ID NO: 1980724 - RNA, 19 nt, Human
guccaggccuacuccuguc

SEQ ID NO: 1980725 - RNA, 20 nt, Human
guccaggccuacuccugucu

SEQ ID NO: 1980726 - RNA, 21 nt, Human
guccaggccuacuccugucuu

SEQ ID NO: 1980727 - RNA, 14 nt, Human
gucccacucagucc

SEQ ID NO: 1980728 - RNA, 15 nt, Human
gucccacucagucca

SEQ ID NO: 1980729 - RNA, 13 nt, Human
gucccacuccaag

SEQ ID NO: 1980730 - RNA, 19 nt, Human
gucccacuccaagccagca

SEQ ID NO: 1980731 - RNA, 15 nt, Human
gucaugcuccccugu

SEQ ID NO: 1980732 - RNA, 17 nt, Human
gucaugcuccccugugc

SEQ ID NO: 1980733 - RNA, 19 nt, Human
gucaugcuccccugugcca

SEQ ID NO: 1980734 - RNA, 20 nt, Human
gucaugcuccccugugccag

SEQ ID NO: 1980735 - RNA, 23 nt, Human
gucaugcuccccugugccagccc

SEQ ID NO: 1980736 - RNA, 14 nt, Human
guccacccaggagc

SEQ ID NO: 1980737 - RNA, 15 nt, Human
guccacccaggagcc

SEQ ID NO: 1980738 - RNA, 16 nt, Human
guccacccaggagccc

SEQ ID NO: 1980739 - RNA, 12 nt, Human
guccacuuuucc

SEQ ID NO: 1980740 - RNA, 14 nt, Human
guccacuuuuccag

SEQ ID NO: 1980741 - RNA, 15 nt, Human
guccacuuuuccagu

SEQ ID NO: 1980742 - RNA, 18 nt, Human
guccacuuuuccaguauu

SEQ ID NO: 1980743 - RNA, 19 nt, Human
guccacuuuuccaguauuu

SEQ ID NO: 1980744 - RNA, 20 nt, Human
guccacuuuuccaguauuuu

SEQ ID NO: 1980745 - RNA, 21 nt, Human
guccacuuuuccaguauuuua

SEQ ID NO: 1980746 - RNA, 22 nt, Human
guccacuuuuccaguauuuuag

SEQ ID NO: 1980747 - RNA, 20 nt, Human
gggcuuggggaccagagcug

SEQ ID NO: 1980748 - RNA, 16 nt, Human
gggcuucugugcccag

SEQ ID NO: 1980749 - RNA, 19 nt, Human
gggcuucauacacaugaga

SEQ ID NO: 1980750 - RNA, 20 nt, Human
gggcuucauccuccucagau

SEQ ID NO: 1980751 - RNA, 18 nt, Human
gggcuuccugaggggaga

SEQ ID NO: 1980752 - RNA, 13 nt, Human
gggcuucauacac

SEQ ID NO: 1980753 - RNA, 19 nt, Human
gggcuucauccuccucaga

SEQ ID NO: 1980754 - RNA, 19 nt, Human
gggcuucaguggcagcugc

SEQ ID NO: 1980755 - RNA, 20 nt, Human
gggcuucaguggcagcugcu

SEQ ID NO: 1980756 - RNA, 15 nt, Human
gggcuucaguggcag

SEQ ID NO: 1980757 - RNA, 16 nt, Human
gggcuucaguggcagc

SEQ ID NO: 1980758 - RNA, 17 nt, Human
gggcuucaguggcagcu

SEQ ID NO: 1980759 - RNA, 18 nt, Human
gggcuucaguggcagcug

SEQ ID NO: 1980760 - RNA, 12 nt, Human
ggggagcuggac

SEQ ID NO: 1980761 - RNA, 20 nt, Human
ggggagggugacaguggccg

SEQ ID NO: 1980762 - RNA, 19 nt, Human
ggggagguuuucuccccca

SEQ ID NO: 1980763 - RNA, 13 nt, Human
ggggaguggccac

SEQ ID NO: 1980764 - RNA, 18 nt, Human
ggggagacuuugauguca

SEQ ID NO: 1980765 - RNA, 21 nt, Human
gggcuuggggaccagagcugc

SEQ ID NO: 1980766 - RNA, 13 nt, Human
ggggauagaugug

SEQ ID NO: 1980767 - RNA, 17 nt, Human
ggggaucacagccucug

SEQ ID NO: 1980768 - RNA, 12 nt, Human
ggggcagccucu

SEQ ID NO: 1980769 - RNA, 14 nt, Human
ggggcagccugccu

SEQ ID NO: 1980770 - RNA, 19 nt, Human
ggggcagccugccuugccc

SEQ ID NO: 1980771 - RNA, 17 nt, Human
ggggcagagcccugcuc

SEQ ID NO: 1980772 - RNA, 14 nt, Human
ggggucuuaccuug

SEQ ID NO: 1980773 - RNA, 23 nt, Human
gggguucccuuuuuuggcugcug

SEQ ID NO: 1980774 - RNA, 20 nt, Human
gggguucuuucuuccucugc

SEQ ID NO: 1980775 - RNA, 22 nt, Human
gggguucuuucuuccucugcug

SEQ ID NO: 1980776 - RNA, 18 nt, Human
gggguuccuucugggcau

SEQ ID NO: 1980777 - RNA, 18 nt, Human
ggguacccacugcucugg

SEQ ID NO: 1980778 - RNA, 11 nt, Human
ggguacaugug

SEQ ID NO: 1980779 - RNA, 13 nt, Human
ggguacccacugc

SEQ ID NO: 1980780 - RNA, 15 nt, Human
ggguacccacugcuc

SEQ ID NO: 1980781 - RNA, 19 nt, Human
ggguacuuguggacacagc

SEQ ID NO: 1980782 - RNA, 22 nt, Human
ggguacuuguggacacagcucu

SEQ ID NO: 1980783 - RNA, 23 nt, Human
ggguagagcggagaaaggaaggg

SEQ ID NO: 1980784 - RNA, 23 nt, Human
ggguacuuguggacacagcucuu

SEQ ID NO: 1980785 - RNA, 20 nt, Human
gggggaacgcccacuucccu

SEQ ID NO: 1980786 - RNA, 17 nt, Human
ggggcugggcagaggaa

SEQ ID NO: 1980787 - RNA, 16 nt, Human
ggggcugggcagagga

SEQ ID NO: 1980788 - RNA, 13 nt, Human
ggggcugggacau

SEQ ID NO: 1980789 - RNA, 20 nt, Human
gggcucugccucccaucacc

SEQ ID NO: 1980790 - RNA, 17 nt, Human
gggcucugccucccauc

SEQ ID NO: 1980791 - RNA, 16 nt, Human
gggcucugccucccau

SEQ ID NO: 1980792 - RNA, 15 nt, Human
gggcucugccuccca

SEQ ID NO: 1980793 - RNA, 13 nt, Human
gggcucugccucc

SEQ ID NO: 1980794 - RNA, 16 nt, Human
gggcugacugggccag

SEQ ID NO: 1980795 - RNA, 20 nt, Human
gggcugacugggccagggga

SEQ ID NO: 1980796 - RNA, 14 nt, Human
gggcuucaguggca

SEQ ID NO: 1980797 - RNA, 14 nt, Human
gggcugcaccggcu

SEQ ID NO: 1980798 - RNA, 16 nt, Human
gggcugaggugggagg

SEQ ID NO: 1980799 - RNA, 23 nt, Human
gggcucccuucccaccucucuca

SEQ ID NO: 1980800 - RNA, 18 nt, Human
gggcucccuucccaccuc

SEQ ID NO: 1980801 - RNA, 17 nt, Human
gggcucccuucccaccu

SEQ ID NO: 1980802 - RNA, 14 nt, Human
gggcucccuuccca

SEQ ID NO: 1980803 - RNA, 16 nt, Human
gggcgcgguggcucac

SEQ ID NO: 1980804 - RNA, 13 nt, Human
gggcucccuuccc

SEQ ID NO: 1980805 - RNA, 20 nt, Human
ggcucccacaggcccuuccu

SEQ ID NO: 1980806 - RNA, 21 nt, Human
ggcucccacaggcccuuccuc

SEQ ID NO: 1980807 - RNA, 22 nt, Human
ggcucccaaaacaccugacagc

SEQ ID NO: 1980808 - RNA, 21 nt, Human
gggcccuccgaccacuuccag

SEQ ID NO: 1980809 - RNA, 16 nt, Human
gggccuggcucaggug

SEQ ID NO: 1980810 - RNA, 14 nt, Human
gggccuggcucagg

SEQ ID NO: 1980811 - RNA, 18 nt, Human
gggccuggucguuuucaa

SEQ ID NO: 1980812 - RNA, 12 nt, Human
gggccuggccug

SEQ ID NO: 1980813 - RNA, 22 nt, Human
gggccuggcagccgugccuuca

SEQ ID NO: 1980814 - RNA, 10 nt, Human
gggccuggca

SEQ ID NO: 1980815 - RNA, 12 nt, Human
gggccuggcuca

SEQ ID NO: 1980816 - RNA, 14 nt, Human
gggccuggcccaug

SEQ ID NO: 1980817 - RNA, 19 nt, Human
gggccuggccugagcuggg

SEQ ID NO: 1980818 - RNA, 23 nt, Human
ggucagcccaaaccaccagaagc

SEQ ID NO: 1980819 - RNA, 22 nt, Human
ggucccaccccacacacgccag

SEQ ID NO: 1980820 - RNA, 22 nt, Human
ggucccacucaguccauagcag

SEQ ID NO: 1980821 - RNA, 14 nt, Human
ggucagcucagagc

SEQ ID NO: 1980822 - RNA, 12 nt, Human
ggucccacucag

SEQ ID NO: 1980823 - RNA, 14 nt, Human
ggucccacucaguc

SEQ ID NO: 1980824 - RNA, 23 nt, Human
ggucccccuuccauggacuuugu

SEQ ID NO: 1980825 - RNA, 18 nt, Human
ggucccccuuccauggac

SEQ ID NO: 1980826 - RNA, 13 nt, Human
ggucccccuucca

SEQ ID NO: 1980827 - RNA, 22 nt, Human
gguccccagcccuuccucugcu

SEQ ID NO: 1980828 - RNA, 23 nt, Human
gguccccagcccuuccucugcuc

SEQ ID NO: 1980829 - RNA, 19 nt, Human
gguccccagcccuuccucu

SEQ ID NO: 1980830 - RNA, 23 nt, Human
gguagaauguuuucaaauguucu

SEQ ID NO: 1980831 - RNA, 13 nt, Human
ggucacagccagg

SEQ ID NO: 1980832 - RNA, 14 nt, Human
ggucacagccaggc

SEQ ID NO: 1980833 - RNA, 17 nt, Human
ggucacagccaggcgcu

SEQ ID NO: 1980834 - RNA, 20 nt, Human
ggucacucuggcagcucaga

SEQ ID NO: 1980835 - RNA, 16 nt, Human
ggucacucuggcagcu

SEQ ID NO: 1980836 - RNA, 22 nt, Human
ggucacucuggcagcucagaga

SEQ ID NO: 1980837 - RNA, 12 nt, Human
ggucagagccug

SEQ ID NO: 1980838 - RNA, 13 nt, Human
ggucagagccugc

SEQ ID NO: 1980839 - RNA, 14 nt, Human
ggucagagccugca

SEQ ID NO: 1980840 - RNA, 15 nt, Human
ggucagagccugcag

SEQ ID NO: 1980841 - RNA, 16 nt, Human
ggucagagccugcagu

SEQ ID NO: 1980842 - RNA, 18 nt, Human
gggugcugggccccugcc

SEQ ID NO: 1980843 - RNA, 19 nt, Human
gggugcugggccccugccu

SEQ ID NO: 1980844 - RNA, 22 nt, Human
ggguaccacugaaucuguacag

SEQ ID NO: 1980845 - RNA, 19 nt, Human
ggguuccagcaccacacuc

SEQ ID NO: 1980846 - RNA, 22 nt, Human
ggguuccagcaauucuccugcc

SEQ ID NO: 1980847 - RNA, 16 nt, Human
gggugcuguuuugcca

SEQ ID NO: 1980848 - RNA, 17 nt, Human
ggguucuacccaggugc

SEQ ID NO: 1980849 - RNA, 22 nt, Human
ggguucuacccaggugcuagga

SEQ ID NO: 1980850 - RNA, 23 nt, Human
ggguucccuuuuuuggcugcuga

SEQ ID NO: 1980851 - RNA, 16 nt, Human
ggguuggccccugccc

SEQ ID NO: 1980852 - RNA, 19 nt, Human
ggguuggccccugcccggc

SEQ ID NO: 1980853 - RNA, 14 nt, Human
ggguucuuucuucc

SEQ ID NO: 1980854 - RNA, 22 nt, Human
gguacuuguggacacagcucuu

SEQ ID NO: 1980855 - RNA, 21 nt, Human
gguacuuguggacacagcucu

SEQ ID NO: 1980856 - RNA, 17 nt, Human
gguacuguaauguuaau

SEQ ID NO: 1980857 - RNA, 11 nt, Human
gguaccuugca

SEQ ID NO: 1980858 - RNA, 12 nt, Human
gguaccuugcac

SEQ ID NO: 1980859 - RNA, 23 nt, Human
gguaccuugcacacaucaucugu

SEQ ID NO: 1980860 - RNA, 24 nt, Human
gguaccuugcacacaucaucugua

SEQ ID NO: 1980861 - RNA, 15 nt, Human
ggguugggcuggugu

SEQ ID NO: 1980862 - RNA, 12 nt, Human
ggguuggcuuuu

SEQ ID NO: 1980863 - RNA, 20 nt, Human
ggguuucaccauguuggcca

SEQ ID NO: 1980864 - RNA, 17 nt, Human
gguacccacugcucugg

SEQ ID NO: 1980865 - RNA, 22 nt, Human
ggugcuaucucccccagcccca

SEQ ID NO: 1980866 - RNA, 23 nt, Human
ggugcuaucucccccagccccau

SEQ ID NO: 1980867 - RNA, 15 nt, Human
ggugcgaucuggguu

SEQ ID NO: 1980868 - RNA, 16 nt, Human
gguggcagugggagcu

SEQ ID NO: 1980869 - RNA, 15 nt, Human
gguggcagcugcggu

SEQ ID NO: 1980870 - RNA, 23 nt, Human
gguggcagcugcgguccacccag

SEQ ID NO: 1980871 - RNA, 13 nt, Human
gguggcagcucac

SEQ ID NO: 1980872 - RNA, 11 nt, Human
gguggcagcug

SEQ ID NO: 1980873 - RNA, 12 nt, Human
gguggcagcugc

SEQ ID NO: 1980874 - RNA, 13 nt, Human
gguggcagcugcg

SEQ ID NO: 1980875 - RNA, 22 nt, Human
ggugauagguauaaguggugug

SEQ ID NO: 1980876 - RNA, 22 nt, Human
ggugauaauagaagaguggcag

SEQ ID NO: 1980877 - RNA, 14 nt, Human
ggugaccucugccu

SEQ ID NO: 1980878 - RNA, 16 nt, Human
ggugaccucugccuga

SEQ ID NO: 1980879 - RNA, 21 nt, Human
ggugaccucugccugaaguca

SEQ ID NO: 1980880 - RNA, 21 nt, Human
ggugaccucuagcccugcccg

SEQ ID NO: 1980881 - RNA, 15 nt, Human
ggugaguccuccaga

SEQ ID NO: 1980882 - RNA, 17 nt, Human
ggugaguccuccagaac

SEQ ID NO: 1980883 - RNA, 17 nt, Human
ggucccuaauaaagcug

SEQ ID NO: 1980884 - RNA, 16 nt, Human
ggucccuaauaaagcu

SEQ ID NO: 1980885 - RNA, 13 nt, Human
ggucccuaauaaa

SEQ ID NO: 1980886 - RNA, 12 nt, Human
ggucccuaauaa

SEQ ID NO: 1980887 - RNA, 14 nt, Human
ggucccugguggca

SEQ ID NO: 1980888 - RNA, 18 nt, Human
ggucccuaauaaagcugu

SEQ ID NO: 1980889 - RNA, 16 nt, Human
gguccccuccaggagu

SEQ ID NO: 1980890 - RNA, 22 nt, Human
ggucccugguggcagcucaccu

SEQ ID NO: 1980891 - RNA, 21 nt, Human
gguccgaguguguuucauccu

SEQ ID NO: 1980892 - RNA, 23 nt, Human
gguccuagaaauuccccacccug

SEQ ID NO: 1980893 - RNA, 22 nt, Human
ggucucacuauguugcccaggc

SEQ ID NO: 1980894 - RNA, 21 nt, Human
ggucucacuauguugcccagg

SEQ ID NO: 1980895 - RNA, 17 nt, Human
ggucuccgaaaugcugu

SEQ ID NO: 1980896 - RNA, 19 nt, Human
ggucuccgaaaugcugucu

SEQ ID NO: 1980897 - RNA, 12 nt, Human
ggucucacucug

SEQ ID NO: 1980898 - RNA, 16 nt, Human
ggucucacucugucgc

SEQ ID NO: 1980899 - RNA, 15 nt, Human
ggucugacccacugc

SEQ ID NO: 1980900 - RNA, 16 nt, Human
ggucugacccacugcu

SEQ ID NO: 1980901 - RNA, 19 nt, Human
ggucucgaacuccugaccu

SEQ ID NO: 1980902 - RNA, 12 nt, Human
ggucuccucagg

SEQ ID NO: 1980903 - RNA, 15 nt, Human
ggucuccucaggacc

SEQ ID NO: 1980904 - RNA, 19 nt, Human
ggucuccucaggaccaggg

SEQ ID NO: 1980905 - RNA, 20 nt, Human
ggucucgaacuccugaccuu

SEQ ID NO: 1980906 - RNA, 16 nt, Human
ggugaacuugguuccc

SEQ ID NO: 1980907 - RNA, 19 nt, Human
ggucugaggaauccagacc

SEQ ID NO: 1980908 - RNA, 18 nt, Human
ggugaagugaagacaaug

SEQ ID NO: 1980909 - RNA, 14 nt, Human
ggugaaggaggcuc

SEQ ID NO: 1980910 - RNA, 18 nt, Human
ggugaaggaggcuccagg

SEQ ID NO: 1980911 - RNA, 22 nt, Human
ggugaaggaggcuccaggcagc

SEQ ID NO: 1980912 - RNA, 23 nt, Human
ggugaaggaggcuccaggcagca

SEQ ID NO: 1980913 - RNA, 14 nt, Human
guaagaguguuuau

SEQ ID NO: 1980914 - RNA, 13 nt, Human
guaagaucacugu

SEQ ID NO: 1980915 - RNA, 18 nt, Human
guaagaucacuguuuaga

SEQ ID NO: 1980916 - RNA, 20 nt, Human
guaagaucacuguuuagauu

SEQ ID NO: 1980917 - RNA, 13 nt, Human
guaagaaauacag

SEQ ID NO: 1980918 - RNA, 16 nt, Human
guaagaaauacagacu

SEQ ID NO: 1980919 - RNA, 12 nt, Human
guaagaaauacu

SEQ ID NO: 1980920 - RNA, 13 nt, Human
guaagaaauacug

SEQ ID NO: 1980921 - RNA, 17 nt, Human
guaagaaauacuguaca

SEQ ID NO: 1980922 - RNA, 22 nt, Human
guaacuguuuagaugaauguca

SEQ ID NO: 1980923 - RNA, 20 nt, Human
guaacuguuaccauuggaaa

SEQ ID NO: 1980924 - RNA, 21 nt, Human
guaacuguuaccauuggaaau

SEQ ID NO: 1980925 - RNA, 23 nt, Human
guaaauuaacuuuuauaaacuuu

SEQ ID NO: 1980926 - RNA, 12 nt, Human
guaacuguuacc

SEQ ID NO: 1980927 - RNA, 13 nt, Human
guaacuguuacca

SEQ ID NO: 1980928 - RNA, 17 nt, Human
guaacuguuaccauugg

SEQ ID NO: 1980929 - RNA, 22 nt, Human
guaaguauucuuauuuaaugaa

SEQ ID NO: 1980930 - RNA, 18 nt, Human
guaaguauaucucaguuu

SEQ ID NO: 1980931 - RNA, 19 nt, Human
guaagguauaucauucuaa

SEQ ID NO: 1980932 - RNA, 14 nt, Human
guaaggcaugaagg

SEQ ID NO: 1980933 - RNA, 13 nt, Human
guaaggaaugauu

SEQ ID NO: 1980934 - RNA, 23 nt, Human
guaaggaauaccugucccccuga

SEQ ID NO: 1980935 - RNA, 21 nt, Human
guaaggaauaccugucccccu

SEQ ID NO: 1980936 - RNA, 20 nt, Human
guaaggaauaccuguccccc

SEQ ID NO: 1980937 - RNA, 18 nt, Human
guaaggaauaccuguccc

SEQ ID NO: 1980938 - RNA, 18 nt, Human
guaagcuguuugguuuua

SEQ ID NO: 1980939 - RNA, 21 nt, Human
guaagcuguuugguuuuaaaa

SEQ ID NO: 1980940 - RNA, 22 nt, Human
guaagcuguuugguuuuaaaau

SEQ ID NO: 1980941 - RNA, 16 nt, Human
guaagcggcucaagcc

SEQ ID NO: 1980942 - RNA, 21 nt, Human
guaagcggcucaagcccagga

SEQ ID NO: 1980943 - RNA, 22 nt, Human
guaagcggcucaagcccaggag

SEQ ID NO: 1980944 - RNA, 14 nt, Human
guaagcguauggcu

SEQ ID NO: 1980945 - RNA, 20 nt, Human
guaagcguauggcuuuauuu

SEQ ID NO: 1980946 - RNA, 16 nt, Human
guaaauaaaggaacca

SEQ ID NO: 1980947 - RNA, 14 nt, Human
guaaauaauucuuu

SEQ ID NO: 1980948 - RNA, 15 nt, Human
guaaauaauucuuuu

SEQ ID NO: 1980949 - RNA, 13 nt, Human
guaaauaauucuu

SEQ ID NO: 1980950 - RNA, 16 nt, Human
guaaaagcauuuugua

SEQ ID NO: 1980951 - RNA, 19 nt, Human
guaaaagcagcauaaagaa

SEQ ID NO: 1980952 - RNA, 15 nt, Human
guaaauuaacuuuua

SEQ ID NO: 1980953 - RNA, 15 nt, Human
guaaauguaguucau

SEQ ID NO: 1980954 - RNA, 16 nt, Human
guaaaugguaugucau

SEQ ID NO: 1980955 - RNA, 16 nt, Human
guaaauuaacuuuuau

SEQ ID NO: 1980956 - RNA, 17 nt, Human
guaaauuaacuuuuaua

SEQ ID NO: 1980957 - RNA, 21 nt, Human
guaaauuaacuuuuauaaacu

SEQ ID NO: 1980958 - RNA, 22 nt, Human
guaaauuaacuuuuauaaacuu

SEQ ID NO: 1980959 - RNA, 18 nt, Human
guaaaucucuucuguguu

SEQ ID NO: 1980960 - RNA, 19 nt, Human
guaaaucucuucuguguuu

SEQ ID NO: 1980961 - RNA, 18 nt, Human
guaaaugggggugcauuu

SEQ ID NO: 1980962 - RNA, 19 nt, Human
guaaaugggggugcauuug

SEQ ID NO: 1980963 - RNA, 20 nt, Human
guaaaugggggugcauuuga

SEQ ID NO: 1980964 - RNA, 14 nt, Human
gguugacaggaggu

SEQ ID NO: 1980965 - RNA, 13 nt, Human
gguucuuugugua

SEQ ID NO: 1980966 - RNA, 11 nt, Human
gguugaauaaa

SEQ ID NO: 1980967 - RNA, 14 nt, Human
gguugggcuggugu

SEQ ID NO: 1980968 - RNA, 18 nt, Human
gguuggcaaaaaggcagg

SEQ ID NO: 1980969 - RNA, 13 nt, Human
gguuuaagcuguu

SEQ ID NO: 1980970 - RNA, 13 nt, Human
gguuggugggggc

SEQ ID NO: 1980971 - RNA, 20 nt, Human
gguucacugcaaccuccgcc

SEQ ID NO: 1980972 - RNA, 22 nt, Human
gguucaagcgauucuucugcuu

SEQ ID NO: 1980973 - RNA, 23 nt, Human
gguucaagcgauucuucugcuuc

SEQ ID NO: 1980974 - RNA, 12 nt, Human
gguucagcuugu

SEQ ID NO: 1980975 - RNA, 17 nt, Human
gguucuuucuuccucug

SEQ ID NO: 1980976 - RNA, 14 nt, Human
gguugaagcaccaa

SEQ ID NO: 1980977 - RNA, 18 nt, Human
gguucuuucuuccucugc

SEQ ID NO: 1980978 - RNA, 13 nt, Human
gguggccucccaa

SEQ ID NO: 1980979 - RNA, 17 nt, Human
gguggccucccaacuca

SEQ ID NO: 1980980 - RNA, 21 nt, Human
gguucaagcgauucuucugcu

SEQ ID NO: 1980981 - RNA, 16 nt, Human
gguggcccgacagccu

SEQ ID NO: 1980982 - RNA, 17 nt, Human
gguggcccgacagccug

SEQ ID NO: 1980983 - RNA, 18 nt, Human
gguggcccgacagccugg

SEQ ID NO: 1980984 - RNA, 19 nt, Human
gguggcccgacagccuggc

SEQ ID NO: 1980985 - RNA, 20 nt, Human
gguggcccgacagccuggca

SEQ ID NO: 1980986 - RNA, 12 nt, Human
guaaaagaaaaa

SEQ ID NO: 1980987 - RNA, 20 nt, Human
guaaaaacaaagaaauuaug

SEQ ID NO: 1980988 - RNA, 23 nt, Human
guaaaaaauuuaaaaagcccaac

SEQ ID NO: 1980989 - RNA, 18 nt, Human
guaaaaacaaagaaauua

SEQ ID NO: 1980990 - RNA, 14 nt, Human
guaaaaagaaaaca

SEQ ID NO: 1980991 - RNA, 14 nt, Human
guaaaaauaaaauu

SEQ ID NO: 1980992 - RNA, 18 nt, Human
guaaaaauaaccuugcag

SEQ ID NO: 1980993 - RNA, 13 nt, Human
guaaaaauaaaau

SEQ ID NO: 1980994 - RNA, 13 nt, Human
guaaaaacugaag

SEQ ID NO: 1980995 - RNA, 14 nt, Human
guaaaaacugaagu

SEQ ID NO: 1980996 - RNA, 15 nt, Human
guaaaaacugaaguu

SEQ ID NO: 1980997 - RNA, 22 nt, Human
guaaaaacugaaguucugccuc

SEQ ID NO: 1980998 - RNA, 12 nt, Human
guaaaaagaaaa

SEQ ID NO: 1980999 - RNA, 22 nt, Human
gguuuuccgcauucuuuguaca

SEQ ID NO: 1981000 - RNA, 20 nt, Human
gguuuucacauuggaaacaa

SEQ ID NO: 1981001 - RNA, 12 nt, Human
gguuuucuguuc

SEQ ID NO: 1981002 - RNA, 13 nt, Human
gguuuucuguucu

SEQ ID NO: 1981003 - RNA, 17 nt, Human
gguuuucuuaaccaucu

SEQ ID NO: 1981004 - RNA, 18 nt, Human
gguuuucuuaaccaucuu

SEQ ID NO: 1981005 - RNA, 21 nt, Human
gguuuugcacucuuguuucuc

SEQ ID NO: 1981006 - RNA, 15 nt, Human
gguuuucuguucuuu

SEQ ID NO: 1981007 - RNA, 17 nt, Human
gguuuuuauuucuccuu

SEQ ID NO: 1981008 - RNA, 18 nt, Human
gguuuuuauuucuccuuu

SEQ ID NO: 1981009 - RNA, 19 nt, Human
gguuuuuauuucuccuuuu

SEQ ID NO: 1981010 - RNA, 23 nt, Human
gguuuugccauguuggccaggcu

SEQ ID NO: 1981011 - RNA, 22 nt, Human
guacagcacuuucuucuuccca

SEQ ID NO: 1981012 - RNA, 20 nt, Human
guacagcaaggagauuuaca

SEQ ID NO: 1981013 - RNA, 20 nt, Human
guacagagccguaaaaacug

SEQ ID NO: 1981014 - RNA, 22 nt, Human
guacagagcccacgcccccacu

SEQ ID NO: 1981015 - RNA, 18 nt, Human
guacagagcccacgcccc

SEQ ID NO: 1981016 - RNA, 12 nt, Human
guacagagccca

SEQ ID NO: 1981017 - RNA, 19 nt, Human
guacacuguuucaaacuuu

SEQ ID NO: 1981018 - RNA, 20 nt, Human
guacacuguuucaaacuuua

SEQ ID NO: 1981019 - RNA, 21 nt, Human
guacacuguuucaaacuuuac

SEQ ID NO: 1981020 - RNA, 22 nt, Human
guacacuucaguuaucuugauc

SEQ ID NO: 1981021 - RNA, 15 nt, Human
guacagacagaaaaa

SEQ ID NO: 1981022 - RNA, 16 nt, Human
guacagacaacaaacc

SEQ ID NO: 1981023 - RNA, 14 nt, Human
guacagguacuuug

SEQ ID NO: 1981024 - RNA, 15 nt, Human
guacagguacuuugu

SEQ ID NO: 1981025 - RNA, 16 nt, Human
guacagguacuuuguc

SEQ ID NO: 1981026 - RNA, 20 nt, Human
guacauaaugcgugcauacc

SEQ ID NO: 1981027 - RNA, 15 nt, Human
guacauaauacugaa

SEQ ID NO: 1981028 - RNA, 16 nt, Human
guacauaauacugaac

SEQ ID NO: 1981029 - RNA, 18 nt, Human
guacauaauacugaacca

SEQ ID NO: 1981030 - RNA, 19 nt, Human
guacauaauacugaaccac

SEQ ID NO: 1981031 - RNA, 14 nt, Human
guacauaauacuga

SEQ ID NO: 1981032 - RNA, 15 nt, Human
guacccacugcucug

SEQ ID NO: 1981033 - RNA, 22 nt, Human
guacauauuagcgacaacagau

SEQ ID NO: 1981034 - RNA, 15 nt, Human
guaaugaaacuugga

SEQ ID NO: 1981035 - RNA, 17 nt, Human
guaaucuuguugguuca

SEQ ID NO: 1981036 - RNA, 16 nt, Human
guaaugaaacuuggau

SEQ ID NO: 1981037 - RNA, 13 nt, Human
guaaugaaaacca

SEQ ID NO: 1981038 - RNA, 11 nt, Human
guaaugaaaac

SEQ ID NO: 1981039 - RNA, 15 nt, Human
guaaucguguccccu

SEQ ID NO: 1981040 - RNA, 18 nt, Human
guaaugaugucguuugaa

SEQ ID NO: 1981041 - RNA, 22 nt, Human
guaauggggcagaaaucugagg

SEQ ID NO: 1981042 - RNA, 19 nt, Human
guaauguaucaaauacauu

SEQ ID NO: 1981043 - RNA, 19 nt, Human
guaauguaacugcucuugg

SEQ ID NO: 1981044 - RNA, 12 nt, Human
guaauguaacug

SEQ ID NO: 1981045 - RNA, 14 nt, Human
guaauguaacugcu

SEQ ID NO: 1981046 - RNA, 20 nt, Human
guaauuaaguacuauguauc

SEQ ID NO: 1981047 - RNA, 17 nt, Human
guaauuaaguacuaugu

SEQ ID NO: 1981048 - RNA, 14 nt, Human
guaauuaaguacua

SEQ ID NO: 1981049 - RNA, 14 nt, Human
guaauguugugaau

SEQ ID NO: 1981050 - RNA, 15 nt, Human
guaauguugugaaua

SEQ ID NO: 1981051 - RNA, 17 nt, Human
guaauguugugaauaau

SEQ ID NO: 1981052 - RNA, 18 nt, Human
guaauguugugaauaauu

SEQ ID NO: 1981053 - RNA, 21 nt, Human
guaauuaaguacuauguauca

SEQ ID NO: 1981054 - RNA, 23 nt, Human
guaauuaauaauagauugugaau

SEQ ID NO: 1981055 - RNA, 18 nt, Human
guacacuguuucaaacuu

SEQ ID NO: 1981056 - RNA, 16 nt, Human
guaauucuuauuccau

SEQ ID NO: 1981057 - RNA, 22 nt, Human
guaauucuuauuccauauuaga

SEQ ID NO: 1981058 - RNA, 13 nt, Human
guaauuauuugaa

SEQ ID NO: 1981059 - RNA, 14 nt, Human
guaauuauuugaau

SEQ ID NO: 1981060 - RNA, 15 nt, Human
guaauuauuugaaug

SEQ ID NO: 1981061 - RNA, 23 nt, Human
guacuaaggaaucuuucugcuuu

SEQ ID NO: 1981062 - RNA, 15 nt, Human
guacuaaggaaucuu

SEQ ID NO: 1981063 - RNA, 17 nt, Human
guacguugugcauuugg

SEQ ID NO: 1981064 - RNA, 20 nt, Human
guacuaaggauacaggcugg

SEQ ID NO: 1981065 - RNA, 14 nt, Human
guacuucuccaccc

SEQ ID NO: 1981066 - RNA, 15 nt, Human
guacuucuccacccu

SEQ ID NO: 1981067 - RNA, 15 nt, Human
guacguugugcauuu

SEQ ID NO: 1981068 - RNA, 16 nt, Human
guacguugugcauuug

SEQ ID NO: 1981069 - RNA, 14 nt, Human
guacguugugcauu

SEQ ID NO: 1981070 - RNA, 17 nt, Human
guacgucugacaggcaa

SEQ ID NO: 1981071 - RNA, 14 nt, Human
guacgucugacagg

SEQ ID NO: 1981072 - RNA, 15 nt, Human
guacgucugacaggc

SEQ ID NO: 1981073 - RNA, 19 nt, Human
guacgacgucagauguuua

SEQ ID NO: 1981074 - RNA, 21 nt, Human
guacgacucuuuuccaaacac

SEQ ID NO: 1981075 - RNA, 17 nt, Human
guaccuugcacacauca

SEQ ID NO: 1981076 - RNA, 23 nt, Human
guaccuugcacacaucaucugua

SEQ ID NO: 1981077 - RNA, 16 nt, Human
guaccuggguccccag

SEQ ID NO: 1981078 - RNA, 13 nt, Human
guaccucuugagc

SEQ ID NO: 1981079 - RNA, 21 nt, Human
guaccucuugagccuugaacu

SEQ ID NO: 1981080 - RNA, 22 nt, Human
guaccucuugagccuugaacuu

SEQ ID NO: 1981081 - RNA, 16 nt, Human
guacccacugcucugg

SEQ ID NO: 1981082 - RNA, 15 nt, Human
guaccgcaaugugac

SEQ ID NO: 1981083 - RNA, 19 nt, Human
guacuugcucuugaugccu

SEQ ID NO: 1981084 - RNA, 18 nt, Human
guacuugcucuugaugcc

SEQ ID NO: 1981085 - RNA, 16 nt, Human
guacuugcucuugaug

SEQ ID NO: 1981086 - RNA, 15 nt, Human
guacuugcucuugau

SEQ ID NO: 1981087 - RNA, 22 nt, Human
guacuugcucuugaugccuggc

SEQ ID NO: 1981088 - RNA, 16 nt, Human
guacuuguggacacag

SEQ ID NO: 1981089 - RNA, 20 nt, Human
guacuuguggacacagcucu

SEQ ID NO: 1981090 - RNA, 14 nt, Human
guacuugcucuuga

SEQ ID NO: 1981091 - RNA, 20 nt, Human
guacuucuccacccugcucu

SEQ ID NO: 1981092 - RNA, 21 nt, Human
guacuucuccacccugcucuc

SEQ ID NO: 1981093 - RNA, 16 nt, Human
guacuucuccacccug

SEQ ID NO: 1981094 - RNA, 17 nt, Human
guacuucuccacccugc

SEQ ID NO: 1981095 - RNA, 18 nt, Human
guacuucuccacccugcu

SEQ ID NO: 1981096 - RNA, 19 nt, Human
guacuucuccacccugcuc

SEQ ID NO: 1981097 - RNA, 15 nt, Human
guagaggagaaacug

SEQ ID NO: 1981098 - RNA, 16 nt, Human
guagagcggagaaagg

SEQ ID NO: 1981099 - RNA, 17 nt, Human
guagaaaauauguccca

SEQ ID NO: 1981100 - RNA, 20 nt, Human
guacuuugucuaagaaacau

SEQ ID NO: 1981101 - RNA, 23 nt, Human
guacuuugucuaagaaacauugg

SEQ ID NO: 1981102 - RNA, 17 nt, Human
guacuuugauucacaug

SEQ ID NO: 1981103 - RNA, 20 nt, Human
guacuuugauucacauguuu

SEQ ID NO: 1981104 - RNA, 21 nt, Human
guacuuugauucacauguuuu

SEQ ID NO: 1981105 - RNA, 23 nt, Human
guacuuugauucacauguuuuca

SEQ ID NO: 1981106 - RNA, 22 nt, Human
guacuuucauauuuuaaacaga

SEQ ID NO: 1981107 - RNA, 14 nt, Human
guacuuuaaaaauu

SEQ ID NO: 1981108 - RNA, 11 nt, Human
guacuuucugu

SEQ ID NO: 1981109 - RNA, 12 nt, Human
guacuuucuguu

SEQ ID NO: 1981110 - RNA, 13 nt, Human
guacuuucuguua

SEQ ID NO: 1981111 - RNA, 14 nt, Human
guacuuucuguuaa

SEQ ID NO: 1981112 - RNA, 15 nt, Human
guacuuucuguuaaa

SEQ ID NO: 1981113 - RNA, 16 nt, Human
guacuuucuguuaaaa

SEQ ID NO: 1981114 - RNA, 18 nt, Human
guacuuucuguuaaaaug

SEQ ID NO: 1981115 - RNA, 19 nt, Human
guacuuucuguuaaaaugc

SEQ ID NO: 1981116 - RNA, 21 nt, Human
guacuuucuguuaaaaugcau

SEQ ID NO: 1981117 - RNA, 13 nt, Human
guacuuugauuca

SEQ ID NO: 1981118 - RNA, 15 nt, Human
guacuuugauucaca

SEQ ID NO: 1981119 - RNA, 16 nt, Human
guacuuugauucacau

SEQ ID NO: 1981120 - RNA, 21 nt, Human
guacuuguggacacagcucuu

SEQ ID NO: 1981121 - RNA, 22 nt, Human
guacuuuauagaagaaugcaug

SEQ ID NO: 1981122 - RNA, 23 nt, Human
guacuuuauuuucuauaauuuaa

SEQ ID NO: 1981123 - RNA, 18 nt, Human
gcuagagguucaaagaua

SEQ ID NO: 1981124 - RNA, 20 nt, Human
gcuacuaugauuuaauuuga

SEQ ID NO: 1981125 - RNA, 22 nt, Human
gcuacuaugauuuaauuugaaa

SEQ ID NO: 1981126 - RNA, 19 nt, Human
gcuagagguucaaagauau

SEQ ID NO: 1981127 - RNA, 21 nt, Human
gcuagagguucaaagauauuu

SEQ ID NO: 1981128 - RNA, 16 nt, Human
gcuacccgugagcccu

SEQ ID NO: 1981129 - RNA, 21 nt, Human
gcuacccgggaagggggcugg

SEQ ID NO: 1981130 - RNA, 16 nt, Human
gcuacguuuacucaca

SEQ ID NO: 1981131 - RNA, 15 nt, Human
gcuacccgggaaggg

SEQ ID NO: 1981132 - RNA, 14 nt, Human
gcuacccgggaagg

SEQ ID NO: 1981133 - RNA, 17 nt, Human
gcuaagcaaaaugugau

SEQ ID NO: 1981134 - RNA, 23 nt, Human
gcuaagagggagggagggcucca

SEQ ID NO: 1981135 - RNA, 22 nt, Human
gcuaucucccccagccccaucc

SEQ ID NO: 1981136 - RNA, 21 nt, Human
gcuaucucccccagccccauc

SEQ ID NO: 1981137 - RNA, 20 nt, Human
gcuaucucccccagccccau

SEQ ID NO: 1981138 - RNA, 19 nt, Human
gcuaucucccccagcccca

SEQ ID NO: 1981139 - RNA, 23 nt, Human
gcuaucucccccagccccauccu

SEQ ID NO: 1981140 - RNA, 18 nt, Human
gcuaucucccccagcccc

SEQ ID NO: 1981141 - RNA, 17 nt, Human
gcuaucucccccagccc

SEQ ID NO: 1981142 - RNA, 16 nt, Human
gcuaucucccccagcc

SEQ ID NO: 1981143 - RNA, 19 nt, Human
gcuagcuaagccaagaggc

SEQ ID NO: 1981144 - RNA, 18 nt, Human
gcgugagccacugcaccg

SEQ ID NO: 1981145 - RNA, 15 nt, Human
gcgugagaccugccc

SEQ ID NO: 1981146 - RNA, 22 nt, Human
gcuaaagguuaccgauuucaaa

SEQ ID NO: 1981147 - RNA, 21 nt, Human
gcuaaaguaaacaacucaagg

SEQ ID NO: 1981148 - RNA, 15 nt, Human
gcgugaucaaagcca

SEQ ID NO: 1981149 - RNA, 19 nt, Human
gcgugaucaaagccacacu

SEQ ID NO: 1981150 - RNA, 23 nt, Human
gcgugagccacugcaccgggcca

SEQ ID NO: 1981151 - RNA, 16 nt, Human
gcuaacaccagacaga

SEQ ID NO: 1981152 - RNA, 20 nt, Human
gcuaaauugauguugaugca

SEQ ID NO: 1981153 - RNA, 21 nt, Human
gcuaaauugauguugaugcaa

SEQ ID NO: 1981154 - RNA, 23 nt, Human
gcuaaauugauguugaugcaauc

SEQ ID NO: 1981155 - RNA, 22 nt, Human
gcuaagagggagggagggcucc

SEQ ID NO: 1981156 - RNA, 21 nt, Human
gcuaagagggagggagggcuc

SEQ ID NO: 1981157 - RNA, 17 nt, Human
gcuaaauugauguugau

SEQ ID NO: 1981158 - RNA, 18 nt, Human
gcuaaauugauguugaug

SEQ ID NO: 1981159 - RNA, 16 nt, Human
gcuaaaugugaaugau

SEQ ID NO: 1981160 - RNA, 13 nt, Human
gcuaaaugugaau

SEQ ID NO: 1981161 - RNA, 15 nt, Human
gcgucaucugguccu

SEQ ID NO: 1981162 - RNA, 14 nt, Human
gcgucaucuggucc

SEQ ID NO: 1981163 - RNA, 19 nt, Human
gcguagugcagcagggcag

SEQ ID NO: 1981164 - RNA, 18 nt, Human
gcguauggcuuuauuuuu

SEQ ID NO: 1981165 - RNA, 18 nt, Human
gcgguccacccaggagcc

SEQ ID NO: 1981166 - RNA, 19 nt, Human
gcgguccacccaggagccc

SEQ ID NO: 1981167 - RNA, 15 nt, Human
gcgggcuuccuccug

SEQ ID NO: 1981168 - RNA, 12 nt, Human
gcggggacagcu

SEQ ID NO: 1981169 - RNA, 13 nt, Human
gcggggacagcuc

SEQ ID NO: 1981170 - RNA, 16 nt, Human
gcgguccacccaggag

SEQ ID NO: 1981171 - RNA, 23 nt, Human
gccugugagcuaggaauuguguu

SEQ ID NO: 1981172 - RNA, 17 nt, Human
gccugugaacugaacuc

SEQ ID NO: 1981173 - RNA, 14 nt, Human
gccugucaagaggc

SEQ ID NO: 1981174 - RNA, 18 nt, Human
gcucagcagugagagcag

SEQ ID NO: 1981175 - RNA, 14 nt, Human
gcucagcaaggcca

SEQ ID NO: 1981176 - RNA, 15 nt, Human
gcucagcaaggccac

SEQ ID NO: 1981177 - RNA, 21 nt, Human
gcucagaucccacuuuugcca

SEQ ID NO: 1981178 - RNA, 16 nt, Human
gcucagcaaggccacc

SEQ ID NO: 1981179 - RNA, 17 nt, Human
gcucagcaaggccaccu

SEQ ID NO: 1981180 - RNA, 18 nt, Human
gcucagcaaggccaccuc

SEQ ID NO: 1981181 - RNA, 19 nt, Human
gcucagcaaggccaccucu

SEQ ID NO: 1981182 - RNA, 23 nt, Human
gcucagcaaaagaugcuucucac

SEQ ID NO: 1981183 - RNA, 22 nt, Human
gcucagcaaaagaugcuucuca

SEQ ID NO: 1981184 - RNA, 20 nt, Human
gcucagcaaaagaugcuucu

SEQ ID NO: 1981185 - RNA, 17 nt, Human
gcucagcaaaagaugcu

SEQ ID NO: 1981186 - RNA, 20 nt, Human
gcucaccagccccagugccc

SEQ ID NO: 1981187 - RNA, 23 nt, Human
gcucaccagccccagugcccaca

SEQ ID NO: 1981188 - RNA, 17 nt, Human
gcuaugagcuggggaug

SEQ ID NO: 1981189 - RNA, 18 nt, Human
gcucaccagccccagugc

SEQ ID NO: 1981190 - RNA, 19 nt, Human
gcucaccagccccagugcc

SEQ ID NO: 1981191 - RNA, 11 nt, Human
gcuaugacuua

SEQ ID NO: 1981192 - RNA, 22 nt, Human
gcucagugucuggcugcagagc

SEQ ID NO: 1981193 - RNA, 19 nt, Human
gcucaggugucccugcacu

SEQ ID NO: 1981194 - RNA, 15 nt, Human
gcucagcggggacag

SEQ ID NO: 1981195 - RNA, 20 nt, Human
gcucagcggggacagcuccu

SEQ ID NO: 1981196 - RNA, 21 nt, Human
gcucagcggggacagcuccuu

SEQ ID NO: 1981197 - RNA, 22 nt, Human
gcucagcggggacagcuccuuc

SEQ ID NO: 1981198 - RNA, 18 nt, Human
gcucaggugucccugcac

SEQ ID NO: 1981199 - RNA, 19 nt, Human
gcuccaagcucccaggcau

SEQ ID NO: 1981200 - RNA, 18 nt, Human
gcuccaagcucccaggca

SEQ ID NO: 1981201 - RNA, 17 nt, Human
gcuccaagcucccaggc

SEQ ID NO: 1981202 - RNA, 16 nt, Human
gcuccaagcucccagg

SEQ ID NO: 1981203 - RNA, 16 nt, Human
gcuccacacacacaaa

SEQ ID NO: 1981204 - RNA, 21 nt, Human
gcuccaagcucccaggcauuc

SEQ ID NO: 1981205 - RNA, 17 nt, Human
gcuccagcuggccggga

SEQ ID NO: 1981206 - RNA, 23 nt, Human
gcuccagcuggccgggagccuga

SEQ ID NO: 1981207 - RNA, 17 nt, Human
gcuccacacacacaaaa

SEQ ID NO: 1981208 - RNA, 15 nt, Human
gcuccaagcucccag

SEQ ID NO: 1981209 - RNA, 14 nt, Human
gcuccaagcuccca

SEQ ID NO: 1981210 - RNA, 13 nt, Human
gcuccaagcuccc

SEQ ID NO: 1981211 - RNA, 13 nt, Human
gcuccaacuccaa

SEQ ID NO: 1981212 - RNA, 21 nt, Human
gcuccaacuccaacauccacu

SEQ ID NO: 1981213 - RNA, 14 nt, Human
gcuccaagaauuuc

SEQ ID NO: 1981214 - RNA, 16 nt, Human
gcuccaaaugcagcuu

SEQ ID NO: 1981215 - RNA, 20 nt, Human
gcuccaaccgggaugggagc

SEQ ID NO: 1981216 - RNA, 11 nt, Human
gcuccagcugu

SEQ ID NO: 1981217 - RNA, 13 nt, Human
gcuccaggcuccu

SEQ ID NO: 1981218 - RNA, 16 nt, Human
gcuccaggcuccuuua

SEQ ID NO: 1981219 - RNA, 23 nt, Human
gcuccaggcuccuuuagcgccca

SEQ ID NO: 1981220 - RNA, 20 nt, Human
gcuccagcuguucagcuggu

SEQ ID NO: 1981221 - RNA, 24 nt, Human
gcuccaggcuccuuuagcgcccag

SEQ ID NO: 1981222 - RNA, 17 nt, Human
gcuccauacacacgcug

SEQ ID NO: 1981223 - RNA, 20 nt, Human
gcuccauacacacgcugccu

SEQ ID NO: 1981224 - RNA, 21 nt, Human
gcuccauacacacgcugccuu

SEQ ID NO: 1981225 - RNA, 14 nt, Human
gcuccaucuccacu

SEQ ID NO: 1981226 - RNA, 14 nt, Human
gcuccaucuuauuu

SEQ ID NO: 1981227 - RNA, 20 nt, Human
gcuccauuuuuagugaaaua

SEQ ID NO: 1981228 - RNA, 16 nt, Human
gcucccucaaagaggc

SEQ ID NO: 1981229 - RNA, 17 nt, Human
gcucccucaaagaggca

SEQ ID NO: 1981230 - RNA, 19 nt, Human
gcucccucaaagaggcagu

SEQ ID NO: 1981231 - RNA, 14 nt, Human
gcucccucacucuc

SEQ ID NO: 1981232 - RNA, 15 nt, Human
gcucccucacucuca

SEQ ID NO: 1981233 - RNA, 16 nt, Human
gcucccucacucucag

SEQ ID NO: 1981234 - RNA, 17 nt, Human
gcucccucacucucagg

SEQ ID NO: 1981235 - RNA, 18 nt, Human
gcucccucacucucagga

SEQ ID NO: 1981236 - RNA, 12 nt, Human
gcucccugacug

SEQ ID NO: 1981237 - RNA, 20 nt, Human
gcucccuccgggucuuccua

SEQ ID NO: 1981238 - RNA, 23 nt, Human
gcucugcugugggcacaggucag

SEQ ID NO: 1981239 - RNA, 22 nt, Human
gcucugcuccccuaaagccuca

SEQ ID NO: 1981240 - RNA, 13 nt, Human
gcucugcucgccu

SEQ ID NO: 1981241 - RNA, 22 nt, Human
gcucugcugaugacccccccag

SEQ ID NO: 1981242 - RNA, 14 nt, Human
gcucuggacaggca

SEQ ID NO: 1981243 - RNA, 15 nt, Human
gcucuggacaggcau

SEQ ID NO: 1981244 - RNA, 16 nt, Human
gcucuggacaggcaug

SEQ ID NO: 1981245 - RNA, 21 nt, Human
gcucuggacaggcauguucuc

SEQ ID NO: 1981246 - RNA, 22 nt, Human
gcucuggacaggcauguucucu

SEQ ID NO: 1981247 - RNA, 19 nt, Human
gcucugcuccucuccccag

SEQ ID NO: 1981248 - RNA, 21 nt, Human
gcucugcuccucuccccagca

SEQ ID NO: 1981249 - RNA, 13 nt, Human
gcucugcugacag

SEQ ID NO: 1981250 - RNA, 14 nt, Human
gcucugcugacaga

SEQ ID NO: 1981251 - RNA, 18 nt, Human
gcucugcugacagacaca

SEQ ID NO: 1981252 - RNA, 19 nt, Human
gcucugcugacagacacag

SEQ ID NO: 1981253 - RNA, 20 nt, Human
gcucugcugacagacacagg

SEQ ID NO: 1981254 - RNA, 23 nt, Human
gcucugcugacagacacaggccc

SEQ ID NO: 1981255 - RNA, 22 nt, Human
gcucugccucccaucacccgcu

SEQ ID NO: 1981256 - RNA, 15 nt, Human
gcucugccucccauc

SEQ ID NO: 1981257 - RNA, 14 nt, Human
gcucugccucccau

SEQ ID NO: 1981258 - RNA, 13 nt, Human
gcucugccuccca

SEQ ID NO: 1981259 - RNA, 13 nt, Human
gcucugcuccucu

SEQ ID NO: 1981260 - RNA, 14 nt, Human
gcucugcuccucuc

SEQ ID NO: 1981261 - RNA, 16 nt, Human
gcucugccuuugcucu

SEQ ID NO: 1981262 - RNA, 16 nt, Human
gcucugccugacagag

SEQ ID NO: 1981263 - RNA, 14 nt, Human
gcucucuggccuuc

SEQ ID NO: 1981264 - RNA, 15 nt, Human
gcucucuggccuucg

SEQ ID NO: 1981265 - RNA, 19 nt, Human
gcucucuggccuucggccu

SEQ ID NO: 1981266 - RNA, 20 nt, Human
gcucucuggccuucggccuc

SEQ ID NO: 1981267 - RNA, 11 nt, Human
gcucugccucc

SEQ ID NO: 1981268 - RNA, 23 nt, Human
gcucugcccuugguuaggcauug

SEQ ID NO: 1981269 - RNA, 14 nt, Human
gcucugcccuuggu

SEQ ID NO: 1981270 - RNA, 11 nt, Human
gcucucuggcc

SEQ ID NO: 1981271 - RNA, 12 nt, Human
gcucucuggccu

SEQ ID NO: 1981272 - RNA, 13 nt, Human
gcucucuggccuu

SEQ ID NO: 1981273 - RNA, 19 nt, Human
gcucuccgaccagacaccu

SEQ ID NO: 1981274 - RNA, 20 nt, Human
gcucuccuagguagcccccu

SEQ ID NO: 1981275 - RNA, 19 nt, Human
gcucuccucuugccacugc

SEQ ID NO: 1981276 - RNA, 22 nt, Human
gcucuccucuugccacugccuc

SEQ ID NO: 1981277 - RNA, 15 nt, Human
gcucuccucuugcca

SEQ ID NO: 1981278 - RNA, 13 nt, Human
gcucuccgaccag

SEQ ID NO: 1981279 - RNA, 17 nt, Human
gcucuccgaccagacac

SEQ ID NO: 1981280 - RNA, 18 nt, Human
gcucccuucccaccucuc

SEQ ID NO: 1981281 - RNA, 16 nt, Human
gcucccuucccaccuc

SEQ ID NO: 1981282 - RNA, 15 nt, Human
gcucccuucccaccu

SEQ ID NO: 1981283 - RNA, 15 nt, Human
gcuccuucuguccua

SEQ ID NO: 1981284 - RNA, 19 nt, Human
gcucccuucccaccucucu

SEQ ID NO: 1981285 - RNA, 13 nt, Human
gcucccugacugg

SEQ ID NO: 1981286 - RNA, 21 nt, Human
gcuccuucuguccuacucugu

SEQ ID NO: 1981287 - RNA, 16 nt, Human
gcucgagcaugccugg

SEQ ID NO: 1981288 - RNA, 18 nt, Human
gcuccuuuuccagagcau

SEQ ID NO: 1981289 - RNA, 17 nt, Human
gcucgagcaugccugga

SEQ ID NO: 1981290 - RNA, 14 nt, Human
gcugacccaugggc

SEQ ID NO: 1981291 - RNA, 16 nt, Human
gcugacccaugggcag

SEQ ID NO: 1981292 - RNA, 18 nt, Human
gcugacccaugggcagga

SEQ ID NO: 1981293 - RNA, 19 nt, Human
gcugacccaugggcaggag

SEQ ID NO: 1981294 - RNA, 20 nt, Human
gcugacccaugggcaggaga

SEQ ID NO: 1981295 - RNA, 21 nt, Human
gcugacccaugggcaggagac

SEQ ID NO: 1981296 - RNA, 17 nt, Human
gcugacuacagggccgc

SEQ ID NO: 1981297 - RNA, 18 nt, Human
gcugacuguacuccuccc

SEQ ID NO: 1981298 - RNA, 19 nt, Human
gcugacuguacuccuccca

SEQ ID NO: 1981299 - RNA, 16 nt, Human
gcugacuacagggccg

SEQ ID NO: 1981300 - RNA, 17 nt, Human
gcucuugaugccuggcg

SEQ ID NO: 1981301 - RNA, 20 nt, Human
gcucuuucccacccagccug

SEQ ID NO: 1981302 - RNA, 22 nt, Human
gcucuuucccacccagccuggg

SEQ ID NO: 1981303 - RNA, 17 nt, Human
gcugacagacagcccuc

SEQ ID NO: 1981304 - RNA, 21 nt, Human
gcugacagacacaggcccggc

SEQ ID NO: 1981305 - RNA, 16 nt, Human
gcucuugaugccuggc

SEQ ID NO: 1981306 - RNA, 15 nt, Human
gcucuugaugccugg

SEQ ID NO: 1981307 - RNA, 14 nt, Human
gcucuugaugccug

SEQ ID NO: 1981308 - RNA, 23 nt, Human
gcucuucuccuuucacaaccuuc

SEQ ID NO: 1981309 - RNA, 22 nt, Human
gcucuuccuggacaggccaggu

SEQ ID NO: 1981310 - RNA, 13 nt, Human
gcucuucuccuuu

SEQ ID NO: 1981311 - RNA, 17 nt, Human
gcucuucuccuuucaca

SEQ ID NO: 1981312 - RNA, 21 nt, Human
gcucuucuccuuucacaaccu

SEQ ID NO: 1981313 - RNA, 14 nt, Human
gcucuucuccaggc

SEQ ID NO: 1981314 - RNA, 16 nt, Human
gcucuucuccaggcug

SEQ ID NO: 1981315 - RNA, 18 nt, Human
gcucuuccaggcugggag

SEQ ID NO: 1981316 - RNA, 19 nt, Human
gcucuuccaggcugggaga

SEQ ID NO: 1981317 - RNA, 20 nt, Human
gcucuuccgaaaaccaggcc

SEQ ID NO: 1981318 - RNA, 19 nt, Human
gcucuuccuggacaggcca

SEQ ID NO: 1981319 - RNA, 22 nt, Human
gcucuuccaggcugggagagcc

SEQ ID NO: 1981320 - RNA, 12 nt, Human
gcucuucuccag

SEQ ID NO: 1981321 - RNA, 22 nt, Human
gcugagugaggaauggcaguga

SEQ ID NO: 1981322 - RNA, 14 nt, Human
gcugagugcaggcc

SEQ ID NO: 1981323 - RNA, 15 nt, Human
gcugagugcaggccc

SEQ ID NO: 1981324 - RNA, 16 nt, Human
gcugagugcaggccca

SEQ ID NO: 1981325 - RNA, 18 nt, Human
gcugagugcaggcccacc

SEQ ID NO: 1981326 - RNA, 19 nt, Human
gcugagucugaaggcuggg

SEQ ID NO: 1981327 - RNA, 18 nt, Human
gcugagucugaaggcugg

SEQ ID NO: 1981328 - RNA, 16 nt, Human
gcugagucugaaggcu

SEQ ID NO: 1981329 - RNA, 15 nt, Human
gcugagucugaaggc

SEQ ID NO: 1981330 - RNA, 15 nt, Human
gcugaguccgaccug

SEQ ID NO: 1981331 - RNA, 16 nt, Human
gcugacugggccaggg

SEQ ID NO: 1981332 - RNA, 21 nt, Human
gcugacuguacuccucccagg

SEQ ID NO: 1981333 - RNA, 17 nt, Human
gcugagucccaggcuga

SEQ ID NO: 1981334 - RNA, 21 nt, Human
gcugagucccaggcugagccu

SEQ ID NO: 1981335 - RNA, 22 nt, Human
gcugagucccaggcugagccuc

SEQ ID NO: 1981336 - RNA, 23 nt, Human
gcugagugggggaucacagccuc

SEQ ID NO: 1981337 - RNA, 22 nt, Human
gcugagugggggaucacagccu

SEQ ID NO: 1981338 - RNA, 20 nt, Human
gcugagugcaggcccacccu

SEQ ID NO: 1981339 - RNA, 21 nt, Human
gcugagugcaggcccacccug

SEQ ID NO: 1981340 - RNA, 22 nt, Human
gcugagugcaggcccacccugc

SEQ ID NO: 1981341 - RNA, 23 nt, Human
gcugagugcaggcccacccugcu

SEQ ID NO: 1981342 - RNA, 16 nt, Human
gcugauggugcaauga

SEQ ID NO: 1981343 - RNA, 15 nt, Human
gcugauggugcaaug

SEQ ID NO: 1981344 - RNA, 20 nt, Human
gcugcaguugccagucaccc

SEQ ID NO: 1981345 - RNA, 18 nt, Human
gcugcaguugccagucac

SEQ ID NO: 1981346 - RNA, 21 nt, Human
gcugcaguugccagucacccc

SEQ ID NO: 1981347 - RNA, 21 nt, Human
gcugauggugcaaugaccuuu

SEQ ID NO: 1981348 - RNA, 18 nt, Human
gcugauggugcaaugacc

SEQ ID NO: 1981349 - RNA, 19 nt, Human
gccucucugcaggucccua

SEQ ID NO: 1981350 - RNA, 19 nt, Human
gccucuccgccccugagcc

SEQ ID NO: 1981351 - RNA, 20 nt, Human
gccucuccgccccugagccc

SEQ ID NO: 1981352 - RNA, 21 nt, Human
gccucuccgccccugagccca

SEQ ID NO: 1981353 - RNA, 22 nt, Human
gccucuccgccccugagcccac

SEQ ID NO: 1981354 - RNA, 23 nt, Human
gccucuccgccccugagcccacu

SEQ ID NO: 1981355 - RNA, 24 nt, Human
gccucuccgccccugagcccacug

SEQ ID NO: 1981356 - RNA, 20 nt, Human
gccucguuggaagaggaaca

SEQ ID NO: 1981357 - RNA, 11 nt, Human
gccucuagcug

SEQ ID NO: 1981358 - RNA, 13 nt, Human
gccucuagcugaa

SEQ ID NO: 1981359 - RNA, 17 nt, Human
gccucggauccccuucc

SEQ ID NO: 1981360 - RNA, 18 nt, Human
gccucggauccccuuccu

SEQ ID NO: 1981361 - RNA, 22 nt, Human
gccucggauccccuuccuacca

SEQ ID NO: 1981362 - RNA, 17 nt, Human
gccucccgaguagcugg

SEQ ID NO: 1981363 - RNA, 20 nt, Human
gccucggacuuagcugggag

SEQ ID NO: 1981364 - RNA, 21 nt, Human
gccucggacuuagcugggaga

SEQ ID NO: 1981365 - RNA, 23 nt, Human
gccucccgaauagcugggacuac

SEQ ID NO: 1981366 - RNA, 15 nt, Human
gccucccgaguagcu

SEQ ID NO: 1981367 - RNA, 13 nt, Human
gccucccacagac

SEQ ID NO: 1981368 - RNA, 14 nt, Human
gccucccacagugc

SEQ ID NO: 1981369 - RNA, 23 nt, Human
gccucccaacucaccccagcccc

SEQ ID NO: 1981370 - RNA, 22 nt, Human
gccucccaacucaccccagccc

SEQ ID NO: 1981371 - RNA, 21 nt, Human
gccucccaacucaccccagcc

SEQ ID NO: 1981372 - RNA, 15 nt, Human
gccucagugccacua

SEQ ID NO: 1981373 - RNA, 19 nt, Human
gccuccccucuccuuccug

SEQ ID NO: 1981374 - RNA, 21 nt, Human
gccuccccucuccuuccugug

SEQ ID NO: 1981375 - RNA, 21 nt, Human
gccucccgaauagcugggacu

SEQ ID NO: 1981376 - RNA, 14 nt, Human
gccucccacgacug

SEQ ID NO: 1981377 - RNA, 16 nt, Human
gccucccacagugcug

SEQ ID NO: 1981378 - RNA, 18 nt, Human
gccuccccucuccuuccu

SEQ ID NO: 1981379 - RNA, 21 nt, Human
gccucccacgacugcccggca

SEQ ID NO: 1981380 - RNA, 14 nt, Human
gccucagccucccg

SEQ ID NO: 1981381 - RNA, 23 nt, Human
gccucagccucccaaagugcugg

SEQ ID NO: 1981382 - RNA, 17 nt, Human
gccucagcuuccccagu

SEQ ID NO: 1981383 - RNA, 16 nt, Human
gccucagcuuccccag

SEQ ID NO: 1981384 - RNA, 12 nt, Human
gccucagugcca

SEQ ID NO: 1981385 - RNA, 14 nt, Human
gccucagugccacu

SEQ ID NO: 1981386 - RNA, 15 nt, Human
gccucagucucccuc

SEQ ID NO: 1981387 - RNA, 18 nt, Human
gccucagucucccucccu

SEQ ID NO: 1981388 - RNA, 22 nt, Human
gccuauauuuuuuguuaaauga

SEQ ID NO: 1981389 - RNA, 22 nt, Human
gccuauaagccaaaauuaaggu

SEQ ID NO: 1981390 - RNA, 15 nt, Human
gccuauauuuuccug

SEQ ID NO: 1981391 - RNA, 17 nt, Human
gccuaagugcagccccg

SEQ ID NO: 1981392 - RNA, 16 nt, Human
gccuaaggcugaacuu

SEQ ID NO: 1981393 - RNA, 19 nt, Human
gccgagauagccaaggcca

SEQ ID NO: 1981394 - RNA, 21 nt, Human
gccgagcccuugcccaugcug

SEQ ID NO: 1981395 - RNA, 14 nt, Human
gccucaaccuccug

SEQ ID NO: 1981396 - RNA, 16 nt, Human
gccucaaccuccuggg

SEQ ID NO: 1981397 - RNA, 16 nt, Human
gccuauccuaagagcu

SEQ ID NO: 1981398 - RNA, 17 nt, Human
gccucaaccuccugggc

SEQ ID NO: 1981399 - RNA, 19 nt, Human
gccucaagugauucuccug

SEQ ID NO: 1981400 - RNA, 20 nt, Human
gccucaagugauucuccugc

SEQ ID NO: 1981401 - RNA, 21 nt, Human
gccucaagugauucuccugcc

SEQ ID NO: 1981402 - RNA, 22 nt, Human
gccugagugagaggggaggcca

SEQ ID NO: 1981403 - RNA, 19 nt, Human
gccugaugaccaauuuuaa

SEQ ID NO: 1981404 - RNA, 13 nt, Human
gccugagucaccu

SEQ ID NO: 1981405 - RNA, 17 nt, Human
gccugacagccagaacu

SEQ ID NO: 1981406 - RNA, 16 nt, Human
gccugacagccagaac

SEQ ID NO: 1981407 - RNA, 21 nt, Human
gccucucugcaggucccuaau

SEQ ID NO: 1981408 - RNA, 20 nt, Human
gccucucugcaggucccuaa

SEQ ID NO: 1981409 - RNA, 18 nt, Human
gccucucugcaggucccu

SEQ ID NO: 1981410 - RNA, 23 nt, Human
gccucucugcaggucccuaauaa

SEQ ID NO: 1981411 - RNA, 12 nt, Human
gccucugccugu

SEQ ID NO: 1981412 - RNA, 22 nt, Human
gccugaagucacacagugaguc

SEQ ID NO: 1981413 - RNA, 19 nt, Human
gccucugcugauccuccca

SEQ ID NO: 1981414 - RNA, 18 nt, Human
gccucugcugauccuccc

SEQ ID NO: 1981415 - RNA, 13 nt, Human
gccucugccuguc

SEQ ID NO: 1981416 - RNA, 22 nt, Human
gccugcuuuuuauggccuguga

SEQ ID NO: 1981417 - RNA, 19 nt, Human
gccugcuuuuuauggccug

SEQ ID NO: 1981418 - RNA, 18 nt, Human
gccugcuuuuuauggccu

SEQ ID NO: 1981419 - RNA, 18 nt, Human
gccugcuccagcuguuca

SEQ ID NO: 1981420 - RNA, 16 nt, Human
gccugcuccagcuguu

SEQ ID NO: 1981421 - RNA, 17 nt, Human
gccugcuuugucuccuc

SEQ ID NO: 1981422 - RNA, 16 nt, Human
gccugauuuguuccuu

SEQ ID NO: 1981423 - RNA, 19 nt, Human
gccugcacuugggggcuca

SEQ ID NO: 1981424 - RNA, 21 nt, Human
gccugcacuugggggcucagc

SEQ ID NO: 1981425 - RNA, 22 nt, Human
gccugcacuugggggcucagca

SEQ ID NO: 1981426 - RNA, 23 nt, Human
gccugcacuugggggcucagcaa

SEQ ID NO: 1981427 - RNA, 12 nt, Human
gccugcagagcu

SEQ ID NO: 1981428 - RNA, 15 nt, Human
gccugcagagcugcg

SEQ ID NO: 1981429 - RNA, 15 nt, Human
gccugcuccagcugu

SEQ ID NO: 1981430 - RNA, 17 nt, Human
gccugggcagaaggaag

SEQ ID NO: 1981431 - RNA, 16 nt, Human
gccugggcagaaggaa

SEQ ID NO: 1981432 - RNA, 18 nt, Human
gccugggcagaaggaaga

SEQ ID NO: 1981433 - RNA, 20 nt, Human
gccugggggcugggcagagg

SEQ ID NO: 1981434 - RNA, 21 nt, Human
gccugggggcugggcagagga

SEQ ID NO: 1981435 - RNA, 15 nt, Human
gccugggcagaagga

SEQ ID NO: 1981436 - RNA, 23 nt, Human
gccuggccagcagguccccagcu

SEQ ID NO: 1981437 - RNA, 14 nt, Human
gccuggccagaugc

SEQ ID NO: 1981438 - RNA, 15 nt, Human
gccuggccagaugca

SEQ ID NO: 1981439 - RNA, 14 nt, Human
gccuggauggggcu

SEQ ID NO: 1981440 - RNA, 15 nt, Human
gccuggauggggcug

SEQ ID NO: 1981441 - RNA, 13 nt, Human
gccuggccacgcc

SEQ ID NO: 1981442 - RNA, 15 nt, Human
gcagacucuacagag

SEQ ID NO: 1981443 - RNA, 12 nt, Human
gccccucccuuc

SEQ ID NO: 1981444 - RNA, 14 nt, Human
gccccucccuucaa

SEQ ID NO: 1981445 - RNA, 15 nt, Human
gccccucccuucaac

SEQ ID NO: 1981446 - RNA, 18 nt, Human
gccccuccucucugcccu

SEQ ID NO: 1981447 - RNA, 19 nt, Human
gccccuccucucugcccua

SEQ ID NO: 1981448 - RNA, 13 nt, Human
gccccugccaccc

SEQ ID NO: 1981449 - RNA, 20 nt, Human
gccccucuccccgcaguguu

SEQ ID NO: 1981450 - RNA, 21 nt, Human
gccccuguucuggcagaguug

SEQ ID NO: 1981451 - RNA, 14 nt, Human
gccccugccacccu

SEQ ID NO: 1981452 - RNA, 15 nt, Human
gccccugccacccug

SEQ ID NO: 1981453 - RNA, 16 nt, Human
gcccggcuccaggcuc

SEQ ID NO: 1981454 - RNA, 12 nt, Human
gccccuuccccc

SEQ ID NO: 1981455 - RNA, 16 nt, Human
gcccgacagccuggca

SEQ ID NO: 1981456 - RNA, 17 nt, Human
gcccgacagccuggcac

SEQ ID NO: 1981457 - RNA, 19 nt, Human
gcccgacagccuggcacag

SEQ ID NO: 1981458 - RNA, 12 nt, Human
gcccgccaccac

SEQ ID NO: 1981459 - RNA, 22 nt, Human
gcccuggacugugugcucagga

SEQ ID NO: 1981460 - RNA, 16 nt, Human
gcccuggacugugugc

SEQ ID NO: 1981461 - RNA, 12 nt, Human
gcccuggacugu

SEQ ID NO: 1981462 - RNA, 22 nt, Human
gcccugcuuugggcugcccugg

SEQ ID NO: 1981463 - RNA, 23 nt, Human
gcccugcuuugggcugcccuggu

SEQ ID NO: 1981464 - RNA, 16 nt, Human
gcccugaguuccuagc

SEQ ID NO: 1981465 - RNA, 18 nt, Human
gcccugaguuccuagcca

SEQ ID NO: 1981466 - RNA, 22 nt, Human
gcccugauguguccucagggag

SEQ ID NO: 1981467 - RNA, 20 nt, Human
gcccugcuuugggcugcccu

SEQ ID NO: 1981468 - RNA, 21 nt, Human
gcccugcuuugggcugcccug

SEQ ID NO: 1981469 - RNA, 19 nt, Human
gcccugcuuugggcugccc

SEQ ID NO: 1981470 - RNA, 17 nt, Human
gcccggcuccaggcucc

SEQ ID NO: 1981471 - RNA, 18 nt, Human
gcccggcuccaggcuccu

SEQ ID NO: 1981472 - RNA, 16 nt, Human
gcccugagcuuucugc

SEQ ID NO: 1981473 - RNA, 16 nt, Human
gcccugaggaggccuu

SEQ ID NO: 1981474 - RNA, 12 nt, Human
gcccucugccca

SEQ ID NO: 1981475 - RNA, 20 nt, Human
gcccucucugaaggaggcca

SEQ ID NO: 1981476 - RNA, 22 nt, Human
gcccucucugaaggaggccacc

SEQ ID NO: 1981477 - RNA, 23 nt, Human
gcccucucugaaggaggccaccu

SEQ ID NO: 1981478 - RNA, 21 nt, Human
gcccugggaggcucuggagcc

SEQ ID NO: 1981479 - RNA, 19 nt, Human
gcccugggaggcucuggag

SEQ ID NO: 1981480 - RNA, 18 nt, Human
gcccugggaggcucugga

SEQ ID NO: 1981481 - RNA, 17 nt, Human
gcccugggaggcucugg

SEQ ID NO: 1981482 - RNA, 23 nt, Human
gcccugggaggcucuggagccca

SEQ ID NO: 1981483 - RNA, 16 nt, Human
gcccugggaggcagug

SEQ ID NO: 1981484 - RNA, 15 nt, Human
gcccuggugcugcca

SEQ ID NO: 1981485 - RNA, 16 nt, Human
gcccuggugcugccac

SEQ ID NO: 1981486 - RNA, 17 nt, Human
gcccuggugcugccaca

SEQ ID NO: 1981487 - RNA, 21 nt, Human
gcccuggugcugccacacuuc

SEQ ID NO: 1981488 - RNA, 16 nt, Human
gcccugggaggcucug

SEQ ID NO: 1981489 - RNA, 15 nt, Human
gcccugggaggcucu

SEQ ID NO: 1981490 - RNA, 14 nt, Human
gcccugggaggcuc

SEQ ID NO: 1981491 - RNA, 13 nt, Human
gcccugggaggcu

SEQ ID NO: 1981492 - RNA, 11 nt, Human
gcccugggagg

SEQ ID NO: 1981493 - RNA, 14 nt, Human
gcccugggaggcag

SEQ ID NO: 1981494 - RNA, 15 nt, Human
gcccuggcucccaca

SEQ ID NO: 1981495 - RNA, 19 nt, Human
gcccuggcucccacaggcc

SEQ ID NO: 1981496 - RNA, 20 nt, Human
gcccuggcucccacaggccc

SEQ ID NO: 1981497 - RNA, 12 nt, Human
gcccuggcagcc

SEQ ID NO: 1981498 - RNA, 14 nt, Human
gcccuggcaggcag

SEQ ID NO: 1981499 - RNA, 15 nt, Human
gcccuggcaggcagg

SEQ ID NO: 1981500 - RNA, 16 nt, Human
gcccuggcaggcaggg

SEQ ID NO: 1981501 - RNA, 13 nt, Human
gcccuggccccca

SEQ ID NO: 1981502 - RNA, 16 nt, Human
gcccuggcccccacau

SEQ ID NO: 1981503 - RNA, 17 nt, Human
gcccuggcccccacaug

SEQ ID NO: 1981504 - RNA, 14 nt, Human
gcccugguggcagu

SEQ ID NO: 1981505 - RNA, 17 nt, Human
gcccugguggcaguggg

SEQ ID NO: 1981506 - RNA, 18 nt, Human
gcccugguggcaguggga

SEQ ID NO: 1981507 - RNA, 19 nt, Human
gcccugguggcagugggag

SEQ ID NO: 1981508 - RNA, 20 nt, Human
gcccugguggcagugggagc

SEQ ID NO: 1981509 - RNA, 21 nt, Human
gcccugguggcagugggagcu

SEQ ID NO: 1981510 - RNA, 22 nt, Human
gcccugguggcagugggagcug

SEQ ID NO: 1981511 - RNA, 23 nt, Human
gcccugguggcagugggagcugc

SEQ ID NO: 1981512 - RNA, 17 nt, Human
gcccugguuuccugccc

SEQ ID NO: 1981513 - RNA, 18 nt, Human
gcccugguuuccugcccu

SEQ ID NO: 1981514 - RNA, 19 nt, Human
gcccugguuuccugcccug

SEQ ID NO: 1981515 - RNA, 20 nt, Human
gcccugguuuccugcccugg

SEQ ID NO: 1981516 - RNA, 21 nt, Human
gcccugguuuccugcccuggg

SEQ ID NO: 1981517 - RNA, 23 nt, Human
gcccugguuuccugcccugggag

SEQ ID NO: 1981518 - RNA, 15 nt, Human
gcccugucaggaggc

SEQ ID NO: 1981519 - RNA, 17 nt, Human
gcccugucaggaggcag

SEQ ID NO: 1981520 - RNA, 18 nt, Human
gcccugucaggaggcaga

SEQ ID NO: 1981521 - RNA, 14 nt, Human
gcccugguuuccug

SEQ ID NO: 1981522 - RNA, 15 nt, Human
gcccugguuuccugc

SEQ ID NO: 1981523 - RNA, 19 nt, Human
gcccuucucuccagccccu

SEQ ID NO: 1981524 - RNA, 21 nt, Human
gcccuuccucuccacugccuu

SEQ ID NO: 1981525 - RNA, 17 nt, Human
gcccuuccucuccacug

SEQ ID NO: 1981526 - RNA, 16 nt, Human
gcccuuccucuccacu

SEQ ID NO: 1981527 - RNA, 18 nt, Human
gcccuuccucuccacugc

SEQ ID NO: 1981528 - RNA, 19 nt, Human
gcccuuccucuccacugcc

SEQ ID NO: 1981529 - RNA, 22 nt, Human
gcccuucucuccagccccugga

SEQ ID NO: 1981530 - RNA, 21 nt, Human
gcccuucucuccagccccugg

SEQ ID NO: 1981531 - RNA, 23 nt, Human
gcccuucucuccagccccuggau

SEQ ID NO: 1981532 - RNA, 20 nt, Human
gcccuuccucuccacugccu

SEQ ID NO: 1981533 - RNA, 20 nt, Human
gcccuuuacuugucuuucug

SEQ ID NO: 1981534 - RNA, 17 nt, Human
gcccuuuacuugucuuu

SEQ ID NO: 1981535 - RNA, 21 nt, Human
gcccuuuacuugucuuucugg

SEQ ID NO: 1981536 - RNA, 23 nt, Human
gcccuuuacuugucuuucugggg

SEQ ID NO: 1981537 - RNA, 17 nt, Human
gccgagauugcaccacu

SEQ ID NO: 1981538 - RNA, 18 nt, Human
gccgagauugcaccacug

SEQ ID NO: 1981539 - RNA, 18 nt, Human
gccgagaucacgccacug

SEQ ID NO: 1981540 - RNA, 19 nt, Human
gccgagaucacgccacugc

SEQ ID NO: 1981541 - RNA, 16 nt, Human
gccgagaucacgccac

SEQ ID NO: 1981542 - RNA, 18 nt, Human
gcccuuuguccuccugcu

SEQ ID NO: 1981543 - RNA, 22 nt, Human
gcccuuuguccuccugcugcca

SEQ ID NO: 1981544 - RNA, 23 nt, Human
ggaauguauaguauuugaaaaca

SEQ ID NO: 1981545 - RNA, 16 nt, Human
ggaauguauaguauuu

SEQ ID NO: 1981546 - RNA, 21 nt, Human
ggaauguauaguauuugaaaa

SEQ ID NO: 1981547 - RNA, 24 nt, Human
ggaaugauuaauuaaaacacaaca

SEQ ID NO: 1981548 - RNA, 12 nt, Human
ggaaugcagugg

SEQ ID NO: 1981549 - RNA, 16 nt, Human
ggaauuauuuuaaaag

SEQ ID NO: 1981550 - RNA, 17 nt, Human
ggaauuauuuuaaaaga

SEQ ID NO: 1981551 - RNA, 14 nt, Human
ggaauuauuuuaaa

SEQ ID NO: 1981552 - RNA, 15 nt, Human
ggaauuauuuuaaaa

SEQ ID NO: 1981553 - RNA, 19 nt, Human
ggaauguuugccucugccu

SEQ ID NO: 1981554 - RNA, 19 nt, Human
ggaauuuggaaaucucuuu

SEQ ID NO: 1981555 - RNA, 23 nt, Human
ggaauuggguggggggcuucaua

SEQ ID NO: 1981556 - RNA, 12 nt, Human
ggaauuguguuu

SEQ ID NO: 1981557 - RNA, 16 nt, Human
ggacaaaauggaauac

SEQ ID NO: 1981558 - RNA, 17 nt, Human
ggacaaaauggaauacu

SEQ ID NO: 1981559 - RNA, 13 nt, Human
ggaauuuuuuugu

SEQ ID NO: 1981560 - RNA, 19 nt, Human
ggaauuuucaucuaggauu

SEQ ID NO: 1981561 - RNA, 17 nt, Human
ggacaaccuuggcuugg

SEQ ID NO: 1981562 - RNA, 22 nt, Human
ggacaaccuuggcuuggcccug

SEQ ID NO: 1981563 - RNA, 23 nt, Human
ggaaggggagauaaggguaucug

SEQ ID NO: 1981564 - RNA, 23 nt, Human
ggaagggacaccaagccuuggcu

SEQ ID NO: 1981565 - RNA, 17 nt, Human
ggaaggcugagaggaga

SEQ ID NO: 1981566 - RNA, 14 nt, Human
ggaaggcccagcac

SEQ ID NO: 1981567 - RNA, 15 nt, Human
ggaaggcccagcacc

SEQ ID NO: 1981568 - RNA, 20 nt, Human
ggaaggccugacuucugcug

SEQ ID NO: 1981569 - RNA, 12 nt, Human
ggaaggccugac

SEQ ID NO: 1981570 - RNA, 13 nt, Human
ggaaccugacccc

SEQ ID NO: 1981571 - RNA, 11 nt, Human
ggaaccugcca

SEQ ID NO: 1981572 - RNA, 13 nt, Human
ggaaccugccaug

SEQ ID NO: 1981573 - RNA, 22 nt, Human
ggaaccuguccuaaggaaccuu

SEQ ID NO: 1981574 - RNA, 18 nt, Human
ggaaccugugagcugcac

SEQ ID NO: 1981575 - RNA, 16 nt, Human
ggaaccuuccuuccug

SEQ ID NO: 1981576 - RNA, 19 nt, Human
ggaaccuuccuuccugcuu

SEQ ID NO: 1981577 - RNA, 20 nt, Human
ggaaccuuccuuccugcuug

SEQ ID NO: 1981578 - RNA, 21 nt, Human
ggaaccuuccuuccugcuuga

SEQ ID NO: 1981579 - RNA, 13 nt, Human
ggaacgcccacuu

SEQ ID NO: 1981580 - RNA, 14 nt, Human
ggaaggcagggagg

SEQ ID NO: 1981581 - RNA, 18 nt, Human
ggaaggcacuucugccug

SEQ ID NO: 1981582 - RNA, 19 nt, Human
ggaacgcccacuucccugg

SEQ ID NO: 1981583 - RNA, 19 nt, Human
ggaaguccuuaucuagcug

SEQ ID NO: 1981584 - RNA, 17 nt, Human
ggaaguagcacaggcug

SEQ ID NO: 1981585 - RNA, 18 nt, Human
ggaaguagcacaggcuga

SEQ ID NO: 1981586 - RNA, 20 nt, Human
ggaagugacgguuuaauggg

SEQ ID NO: 1981587 - RNA, 18 nt, Human
ggaagugcuaauuuugaa

SEQ ID NO: 1981588 - RNA, 14 nt, Human
ggaaugauuaauua

SEQ ID NO: 1981589 - RNA, 21 nt, Human
ggaagguaguucaagaaauga

SEQ ID NO: 1981590 - RNA, 20 nt, Human
ggaagguaguucaagaaaug

SEQ ID NO: 1981591 - RNA, 17 nt, Human
ggaaggggggucagaag

SEQ ID NO: 1981592 - RNA, 16 nt, Human
ggaaguacuggagaaa

SEQ ID NO: 1981593 - RNA, 12 nt, Human
ggaaguacugga

SEQ ID NO: 1981594 - RNA, 18 nt, Human
ggaaguacuggagaaaau

SEQ ID NO: 1981595 - RNA, 14 nt, Human
ggaaguagcacagg

SEQ ID NO: 1981596 - RNA, 15 nt, Human
ggaaguagcacaggc

SEQ ID NO: 1981597 - RNA, 23 nt, Human
ggaccucaggugagaagcagagg

SEQ ID NO: 1981598 - RNA, 19 nt, Human
ggaccucaggugagaagca

SEQ ID NO: 1981599 - RNA, 23 nt, Human
ggaccacgucuauuucaucagaa

SEQ ID NO: 1981600 - RNA, 13 nt, Human
ggaccagagcugc

SEQ ID NO: 1981601 - RNA, 18 nt, Human
ggaccacaggugcccgcc

SEQ ID NO: 1981602 - RNA, 20 nt, Human
ggaccacaggugcccgccac

SEQ ID NO: 1981603 - RNA, 20 nt, Human
ggacgcuacccgggaagggg

SEQ ID NO: 1981604 - RNA, 19 nt, Human
ggacgcuacccgggaaggg

SEQ ID NO: 1981605 - RNA, 17 nt, Human
ggacgcuacccgggaag

SEQ ID NO: 1981606 - RNA, 17 nt, Human
ggaccuucgggcugugc

SEQ ID NO: 1981607 - RNA, 18 nt, Human
ggaccuucgggcugugcc

SEQ ID NO: 1981608 - RNA, 19 nt, Human
ggaccuucgggcugugccc

SEQ ID NO: 1981609 - RNA, 20 nt, Human
ggaccuucgggcugugcccg

SEQ ID NO: 1981610 - RNA, 15 nt, Human
ggaccuugaacuggg

SEQ ID NO: 1981611 - RNA, 17 nt, Human
ggaccuugaacugggua

SEQ ID NO: 1981612 - RNA, 22 nt, Human
ggacacucaaaagcugggcagg

SEQ ID NO: 1981613 - RNA, 17 nt, Human
ggacacucaaaagcugg

SEQ ID NO: 1981614 - RNA, 15 nt, Human
ggacagccacggcca

SEQ ID NO: 1981615 - RNA, 19 nt, Human
ggacagccacggccaggcc

SEQ ID NO: 1981616 - RNA, 20 nt, Human
ggacagccacggccaggcca

SEQ ID NO: 1981617 - RNA, 21 nt, Human
ggacagccacggccaggccag

SEQ ID NO: 1981618 - RNA, 22 nt, Human
ggacagccacggccaggccaga

SEQ ID NO: 1981619 - RNA, 17 nt, Human
ggacagcauugccagua

SEQ ID NO: 1981620 - RNA, 21 nt, Human
ggacauggcuucugaaccugu

SEQ ID NO: 1981621 - RNA, 20 nt, Human
ggacauugcggacagccacg

SEQ ID NO: 1981622 - RNA, 20 nt, Human
ggacugugauuugaauccag

SEQ ID NO: 1981623 - RNA, 17 nt, Human
ggacugugugcucagga

SEQ ID NO: 1981624 - RNA, 15 nt, Human
ggagaaucacuugaa

SEQ ID NO: 1981625 - RNA, 19 nt, Human
ggagaaucacuugaacccg

SEQ ID NO: 1981626 - RNA, 18 nt, Human
ggagaagcggcuggcagc

SEQ ID NO: 1981627 - RNA, 17 nt, Human
ggagaagcggcuggcag

SEQ ID NO: 1981628 - RNA, 13 nt, Human
ggacgcucucugg

SEQ ID NO: 1981629 - RNA, 14 nt, Human
ggacgcucucuggc

SEQ ID NO: 1981630 - RNA, 15 nt, Human
ggacgcucucuggcc

SEQ ID NO: 1981631 - RNA, 18 nt, Human
ggacuggccucugcugau

SEQ ID NO: 1981632 - RNA, 17 nt, Human
ggacugggaacagaacu

SEQ ID NO: 1981633 - RNA, 20 nt, Human
ggagaaugcaccauacucau

SEQ ID NO: 1981634 - RNA, 22 nt, Human
ggagacagagcaaccccuggac

SEQ ID NO: 1981635 - RNA, 22 nt, Human
ggagaaugucaguauguggaag

SEQ ID NO: 1981636 - RNA, 17 nt, Human
ggagaaugcaccauacu

SEQ ID NO: 1981637 - RNA, 19 nt, Human
ggagaaucauguuucuuug

SEQ ID NO: 1981638 - RNA, 20 nt, Human
ggagaaucauguuucuuuga

SEQ ID NO: 1981639 - RNA, 18 nt, Human
ggagaaucauguuucuuu

SEQ ID NO: 1981640 - RNA, 12 nt, Human
ggagaggagccc

SEQ ID NO: 1981641 - RNA, 15 nt, Human
ggagaggagcccugc

SEQ ID NO: 1981642 - RNA, 16 nt, Human
ggagaggagcccugcc

SEQ ID NO: 1981643 - RNA, 20 nt, Human
ggagauagccccacaggagg

SEQ ID NO: 1981644 - RNA, 21 nt, Human
ggagauagccccacaggaggu

SEQ ID NO: 1981645 - RNA, 22 nt, Human
ggagauacuuggucacagccag

SEQ ID NO: 1981646 - RNA, 23 nt, Human
ggagauacuuggucacagccagg

SEQ ID NO: 1981647 - RNA, 18 nt, Human
ggagauccuuguguuuau

SEQ ID NO: 1981648 - RNA, 18 nt, Human
ggaaaagcagcucucccc

SEQ ID NO: 1981649 - RNA, 14 nt, Human
ggaaaagcagcucu

SEQ ID NO: 1981650 - RNA, 21 nt, Human
ggaaaaccaagccguggcuuc

SEQ ID NO: 1981651 - RNA, 17 nt, Human
ggaaaacacccagggaa

SEQ ID NO: 1981652 - RNA, 19 nt, Human
ggaaaagcggacaucagcu

SEQ ID NO: 1981653 - RNA, 11 nt, Human
ggaaaagcuga

SEQ ID NO: 1981654 - RNA, 20 nt, Human
ggaaaagccaagaggcugca

SEQ ID NO: 1981655 - RNA, 14 nt, Human
ggaaaagcugcuga

SEQ ID NO: 1981656 - RNA, 11 nt, Human
ggaaaaggaag

SEQ ID NO: 1981657 - RNA, 23 nt, Human
ggaaaaggaagguaguucaagaa

SEQ ID NO: 1981658 - RNA, 15 nt, Human
ggaaaaggcauauau

SEQ ID NO: 1981659 - RNA, 18 nt, Human
ggaaaagcugcugacagu

SEQ ID NO: 1981660 - RNA, 20 nt, Human
ggaaaagcugcugacagugu

SEQ ID NO: 1981661 - RNA, 18 nt, Human
ggaaaacaugcuacacac

SEQ ID NO: 1981662 - RNA, 11 nt, Human
ggaaaaauuca

SEQ ID NO: 1981663 - RNA, 22 nt, Human
gcuuuucacugcuggcugccuu

SEQ ID NO: 1981664 - RNA, 23 nt, Human
gcuuuucacugcuggcugccuua

SEQ ID NO: 1981665 - RNA, 21 nt, Human
gcuuuguuuguugucagcuga

SEQ ID NO: 1981666 - RNA, 23 nt, Human
gcuuuguugugugccucuagcug

SEQ ID NO: 1981667 - RNA, 14 nt, Human
gcuuuguuuguucu

SEQ ID NO: 1981668 - RNA, 18 nt, Human
gcuuuguugugugccucu

SEQ ID NO: 1981669 - RNA, 19 nt, Human
gcuuuguugugugccucua

SEQ ID NO: 1981670 - RNA, 21 nt, Human
gcuuuguugugugccucuagc

SEQ ID NO: 1981671 - RNA, 22 nt, Human
gcuuuguugugugccucuagcu

SEQ ID NO: 1981672 - RNA, 13 nt, Human
gcuuuucacugcu

SEQ ID NO: 1981673 - RNA, 15 nt, Human
gcuuuguuuguucuu

SEQ ID NO: 1981674 - RNA, 14 nt, Human
gcuuuucacugcug

SEQ ID NO: 1981675 - RNA, 18 nt, Human
gcuuuucacugcuggcug

SEQ ID NO: 1981676 - RNA, 18 nt, Human
gcuugaggguugggcugg

SEQ ID NO: 1981677 - RNA, 20 nt, Human
gcuugaggguugggcuggug

SEQ ID NO: 1981678 - RNA, 23 nt, Human
gcuuucaaaggagcucgaaggau

SEQ ID NO: 1981679 - RNA, 16 nt, Human
gcuuuauuuuuuugaa

SEQ ID NO: 1981680 - RNA, 12 nt, Human
gcuuuagacuug

SEQ ID NO: 1981681 - RNA, 14 nt, Human
gcuuuagacuugaa

SEQ ID NO: 1981682 - RNA, 15 nt, Human
gcuuuagacuugaaa

SEQ ID NO: 1981683 - RNA, 17 nt, Human
gcuuuagacuugaaaag

SEQ ID NO: 1981684 - RNA, 18 nt, Human
gcuuuagacuugaaaaga

SEQ ID NO: 1981685 - RNA, 21 nt, Human
gcuuuagacuugaaaagagac

SEQ ID NO: 1981686 - RNA, 24 nt, Human
gcuuuagacuugaaaagagacagg

SEQ ID NO: 1981687 - RNA, 12 nt, Human
gcuuuagcuuau

SEQ ID NO: 1981688 - RNA, 20 nt, Human
gcuuuaggcauaugcuucuu

SEQ ID NO: 1981689 - RNA, 21 nt, Human
gcuuuaguggccaucauuucu

SEQ ID NO: 1981690 - RNA, 15 nt, Human
gcuuugugauuuuug

SEQ ID NO: 1981691 - RNA, 18 nt, Human
gcuuugucuacuucaaaa

SEQ ID NO: 1981692 - RNA, 15 nt, Human
gcuuucaggagcucc

SEQ ID NO: 1981693 - RNA, 13 nt, Human
gcuuugucuccuc

SEQ ID NO: 1981694 - RNA, 19 nt, Human
gcuuugucuccucuauccu

SEQ ID NO: 1981695 - RNA, 15 nt, Human
gcuuuguugugugcc

SEQ ID NO: 1981696 - RNA, 17 nt, Human
gcuuuguugugugccuc

SEQ ID NO: 1981697 - RNA, 15 nt, Human
gcuuuguaugcacuu

SEQ ID NO: 1981698 - RNA, 21 nt, Human
ggaaaggcuccaggagcagcc

SEQ ID NO: 1981699 - RNA, 20 nt, Human
ggaaaggcuccaggagcagc

SEQ ID NO: 1981700 - RNA, 19 nt, Human
ggaaaggcuccaggagcag

SEQ ID NO: 1981701 - RNA, 17 nt, Human
ggaaaggcuccaggagc

SEQ ID NO: 1981702 - RNA, 22 nt, Human
ggaaaggcuccaggagcagcca

SEQ ID NO: 1981703 - RNA, 14 nt, Human
ggaaaggcuccagg

SEQ ID NO: 1981704 - RNA, 13 nt, Human
ggaaaggcuccag

SEQ ID NO: 1981705 - RNA, 12 nt, Human
ggaaaggcucca

SEQ ID NO: 1981706 - RNA, 19 nt, Human
ggaaaaucagccugcucca

SEQ ID NO: 1981707 - RNA, 22 nt, Human
ggaaaauuaguucccauucuuu

SEQ ID NO: 1981708 - RNA, 23 nt, Human
ggaaaaucagccugcuccagcug

SEQ ID NO: 1981709 - RNA, 14 nt, Human
ggaaaucaccgaaa

SEQ ID NO: 1981710 - RNA, 21 nt, Human
ggaaaucaccgaaaacguggc

SEQ ID NO: 1981711 - RNA, 18 nt, Human
ggaaaucaaauguaaagu

SEQ ID NO: 1981712 - RNA, 17 nt, Human
ggaaaucaaauguaaag

SEQ ID NO: 1981713 - RNA, 16 nt, Human
ggaaauaccaguucug

SEQ ID NO: 1981714 - RNA, 14 nt, Human
ggaaaguuucuuug

SEQ ID NO: 1981715 - RNA, 17 nt, Human
ggaaaguuucuuugaaa

SEQ ID NO: 1981716 - RNA, 21 nt, Human
ggaaccaaagcgaauuuuaaa

SEQ ID NO: 1981717 - RNA, 16 nt, Human
ggaacaggaaacugau

SEQ ID NO: 1981718 - RNA, 22 nt, Human
ggaaccaaagcgaauuuuaaaa

SEQ ID NO: 1981719 - RNA, 21 nt, Human
gcuuagaggcaugggcuugcu

SEQ ID NO: 1981720 - RNA, 12 nt, Human
gcuuagaggcau

SEQ ID NO: 1981721 - RNA, 18 nt, Human
gcuuagaggcaugggcuu

SEQ ID NO: 1981722 - RNA, 21 nt, Human
gcuuaggagaagucuucuauu

SEQ ID NO: 1981723 - RNA, 13 nt, Human
gcuguugaccagg

SEQ ID NO: 1981724 - RNA, 15 nt, Human
gcuguugaccaggca

SEQ ID NO: 1981725 - RNA, 18 nt, Human
gcuguugaccaggcaccu

SEQ ID NO: 1981726 - RNA, 23 nt, Human
gcuguugaccaggcaccuccccu

SEQ ID NO: 1981727 - RNA, 22 nt, Human
gcuguugacucuaguacuguga

SEQ ID NO: 1981728 - RNA, 17 nt, Human
gcuuagucacugagaca

SEQ ID NO: 1981729 - RNA, 15 nt, Human
gcuuagucacugaga

SEQ ID NO: 1981730 - RNA, 20 nt, Human
gcuuagucacugagacagcc

SEQ ID NO: 1981731 - RNA, 19 nt, Human
gcuuagucacugagacagc

SEQ ID NO: 1981732 - RNA, 21 nt, Human
gcuuagucacugagacagccc

SEQ ID NO: 1981733 - RNA, 12 nt, Human
gcuguucuuccu

SEQ ID NO: 1981734 - RNA, 13 nt, Human
gcuguucuuccug

SEQ ID NO: 1981735 - RNA, 14 nt, Human
gcuguucuuccugg

SEQ ID NO: 1981736 - RNA, 23 nt, Human
gcuguucuuuaguagcaacuaaa

SEQ ID NO: 1981737 - RNA, 21 nt, Human
gcuguucaugaaagauucaau

SEQ ID NO: 1981738 - RNA, 12 nt, Human
gcuguucaugaa

SEQ ID NO: 1981739 - RNA, 13 nt, Human
gcuguucagcugg

SEQ ID NO: 1981740 - RNA, 14 nt, Human
gcuguucagcuggu

SEQ ID NO: 1981741 - RNA, 21 nt, Human
gcugugggcgugagaccugcc

SEQ ID NO: 1981742 - RNA, 22 nt, Human
gcugugggcgugagaccugccc

SEQ ID NO: 1981743 - RNA, 20 nt, Human
gcugugggcgugagaccugc

SEQ ID NO: 1981744 - RNA, 19 nt, Human
gcugccaaugggagcucau

SEQ ID NO: 1981745 - RNA, 16 nt, Human
gcugccaaugggagcu

SEQ ID NO: 1981746 - RNA, 15 nt, Human
gcugccaaugggagc

SEQ ID NO: 1981747 - RNA, 19 nt, Human
gcuuaucucaggggugugc

SEQ ID NO: 1981748 - RNA, 20 nt, Human
gcuuauacacuuacacuuua

SEQ ID NO: 1981749 - RNA, 12 nt, Human
gcuuauacacuu

SEQ ID NO: 1981750 - RNA, 12 nt, Human
gcuuauaaaaca

SEQ ID NO: 1981751 - RNA, 13 nt, Human
gcuuauaaaacag

SEQ ID NO: 1981752 - RNA, 19 nt, Human
gcuuauaaaacagaguaau

SEQ ID NO: 1981753 - RNA, 16 nt, Human
gcuucaguggcagcug

SEQ ID NO: 1981754 - RNA, 23 nt, Human
gcuuaugauagcaaauggccuca

SEQ ID NO: 1981755 - RNA, 22 nt, Human
gcuuauaaaacagaguaaucuu

SEQ ID NO: 1981756 - RNA, 11 nt, Human
gcuucauacag

SEQ ID NO: 1981757 - RNA, 22 nt, Human
gcuucauacagggaugguguuc

SEQ ID NO: 1981758 - RNA, 23 nt, Human
gcuucauacuucaugaaauccug

SEQ ID NO: 1981759 - RNA, 17 nt, Human
gcuucaguggcagcugc

SEQ ID NO: 1981760 - RNA, 18 nt, Human
gcuucaguggcagcugcu

SEQ ID NO: 1981761 - RNA, 15 nt, Human
gcuucauccuccuca

SEQ ID NO: 1981762 - RNA, 12 nt, Human
gcuucauccucc

SEQ ID NO: 1981763 - RNA, 13 nt, Human
gcuucauuuccug

SEQ ID NO: 1981764 - RNA, 16 nt, Human
gcuucauuuccugugu

SEQ ID NO: 1981765 - RNA, 18 nt, Human
gcuuccagugaggcucug

SEQ ID NO: 1981766 - RNA, 20 nt, Human
gcuuccagcaggagggacag

SEQ ID NO: 1981767 - RNA, 16 nt, Human
gcuuccagugaggcuc

SEQ ID NO: 1981768 - RNA, 17 nt, Human
gcuucauuuccuguguc

SEQ ID NO: 1981769 - RNA, 21 nt, Human
gcuucauccuccucagaucuu

SEQ ID NO: 1981770 - RNA, 15 nt, Human
gcuuccagugaggcu

SEQ ID NO: 1981771 - RNA, 12 nt, Human
gcuuccagcagg

SEQ ID NO: 1981772 - RNA, 13 nt, Human
gcuuccagcagga

SEQ ID NO: 1981773 - RNA, 14 nt, Human
gcuuccagcaggag

SEQ ID NO: 1981774 - RNA, 15 nt, Human
gcuuccagcaggagg

SEQ ID NO: 1981775 - RNA, 17 nt, Human
gcuuccagcaggaggga

SEQ ID NO: 1981776 - RNA, 16 nt, Human
gcuugaggguugggcu

SEQ ID NO: 1981777 - RNA, 12 nt, Human
ggagugcaguga

SEQ ID NO: 1981778 - RNA, 23 nt, Human
ggagugaguugauagcacagacc

SEQ ID NO: 1981779 - RNA, 14 nt, Human
ggagugcagugagc

SEQ ID NO: 1981780 - RNA, 18 nt, Human
ggauacaaaagcauguga

SEQ ID NO: 1981781 - RNA, 17 nt, Human
ggaucccucauccucau

SEQ ID NO: 1981782 - RNA, 13 nt, Human
ggaucccucaucc

SEQ ID NO: 1981783 - RNA, 22 nt, Human
ggaucccucauccucauaccca

SEQ ID NO: 1981784 - RNA, 22 nt, Human
ggaucaaaccccgaccaccugc

SEQ ID NO: 1981785 - RNA, 13 nt, Human
ggauccccuuccu

SEQ ID NO: 1981786 - RNA, 15 nt, Human
ggauaugaaaaauga

SEQ ID NO: 1981787 - RNA, 13 nt, Human
ggauaugaccagu

SEQ ID NO: 1981788 - RNA, 14 nt, Human
ggauaggggcagag

SEQ ID NO: 1981789 - RNA, 13 nt, Human
ggauccuccaggu

SEQ ID NO: 1981790 - RNA, 15 nt, Human
ggaugauugaagaaa

SEQ ID NO: 1981791 - RNA, 12 nt, Human
ggauccuccagg

SEQ ID NO: 1981792 - RNA, 14 nt, Human
ggauccccuuccua

SEQ ID NO: 1981793 - RNA, 17 nt, Human
ggaugcagccucacagu

SEQ ID NO: 1981794 - RNA, 16 nt, Human
ggaugcagccucacag

SEQ ID NO: 1981795 - RNA, 21 nt, Human
ggaugauuggaggggggaggu

SEQ ID NO: 1981796 - RNA, 23 nt, Human
ggaugcacagaguuguuacauuu

SEQ ID NO: 1981797 - RNA, 16 nt, Human
ggaugcauggagauag

SEQ ID NO: 1981798 - RNA, 19 nt, Human
ggaugccaagaaguuuaag

SEQ ID NO: 1981799 - RNA, 16 nt, Human
ggaugauugaagaaac

SEQ ID NO: 1981800 - RNA, 19 nt, Human
ggaugcagccucacagucc

SEQ ID NO: 1981801 - RNA, 15 nt, Human
ggaugcuuguacaua

SEQ ID NO: 1981802 - RNA, 17 nt, Human
ggauggaaugauggguc

SEQ ID NO: 1981803 - RNA, 19 nt, Human
ggauuacaagcgugagcca

SEQ ID NO: 1981804 - RNA, 17 nt, Human
ggauugggccccugcca

SEQ ID NO: 1981805 - RNA, 18 nt, Human
ggauugggccccugccag

SEQ ID NO: 1981806 - RNA, 17 nt, Human
ggauugcuacuguccua

SEQ ID NO: 1981807 - RNA, 15 nt, Human
ggauuguaaaauggu

SEQ ID NO: 1981808 - RNA, 16 nt, Human
ggcaacccccagccug

SEQ ID NO: 1981809 - RNA, 17 nt, Human
ggcaacccccagccugc

SEQ ID NO: 1981810 - RNA, 16 nt, Human
ggauucuuccucccuc

SEQ ID NO: 1981811 - RNA, 14 nt, Human
ggauugauuuuaaa

SEQ ID NO: 1981812 - RNA, 17 nt, Human
ggauugauuuuaaaaug

SEQ ID NO: 1981813 - RNA, 18 nt, Human
ggauugauuuuaaaaugu

SEQ ID NO: 1981814 - RNA, 16 nt, Human
ggauucuuauggacaa

SEQ ID NO: 1981815 - RNA, 23 nt, Human
ggauuacaagcgugagccacugc

SEQ ID NO: 1981816 - RNA, 19 nt, Human
ggauuacaggcuccugcca

SEQ ID NO: 1981817 - RNA, 15 nt, Human
ggcaauauucucugu

SEQ ID NO: 1981818 - RNA, 16 nt, Human
ggcaauauucucugua

SEQ ID NO: 1981819 - RNA, 19 nt, Human
ggcaauaaauuuugaaaag

SEQ ID NO: 1981820 - RNA, 19 nt, Human
ggcaaucauggugcucaga

SEQ ID NO: 1981821 - RNA, 18 nt, Human
ggcaacccccagccugcu

SEQ ID NO: 1981822 - RNA, 16 nt, Human
ggcaauaaauuuugaa

SEQ ID NO: 1981823 - RNA, 17 nt, Human
ggcaauaaauuuugaaa

SEQ ID NO: 1981824 - RNA, 14 nt, Human
ggcaaugcuggcug

SEQ ID NO: 1981825 - RNA, 18 nt, Human
ggcaauauucucuguaca

SEQ ID NO: 1981826 - RNA, 19 nt, Human
ggcaauauucucuguacau

SEQ ID NO: 1981827 - RNA, 20 nt, Human
ggcaauauucucuguacaua

SEQ ID NO: 1981828 - RNA, 15 nt, Human
ggcaaugcuggcugu

SEQ ID NO: 1981829 - RNA, 23 nt, Human
ggcaaugcuggcuguuggcuggg

SEQ ID NO: 1981830 - RNA, 16 nt, Human
ggcaaugguaguuucu

SEQ ID NO: 1981831 - RNA, 17 nt, Human
ggcaaugguaguuucug

SEQ ID NO: 1981832 - RNA, 18 nt, Human
ggcaaugguaguuucugu

SEQ ID NO: 1981833 - RNA, 23 nt, Human
ggcacccaccaucaugucuggcu

SEQ ID NO: 1981834 - RNA, 22 nt, Human
ggcacccggccccugcugguuc

SEQ ID NO: 1981835 - RNA, 18 nt, Human
ggcaccggggccucggac

SEQ ID NO: 1981836 - RNA, 18 nt, Human
ggcaugacacgaauauug

SEQ ID NO: 1981837 - RNA, 15 nt, Human
ggcaugaagacagau

SEQ ID NO: 1981838 - RNA, 17 nt, Human
ggcaugaaaugaacaca

SEQ ID NO: 1981839 - RNA, 19 nt, Human
ggcaugaaaugaacacaaa

SEQ ID NO: 1981840 - RNA, 13 nt, Human
ggcauggcagccc

SEQ ID NO: 1981841 - RNA, 17 nt, Human
ggcauggccagguggcc

SEQ ID NO: 1981842 - RNA, 18 nt, Human
ggcauggccagguggcca

SEQ ID NO: 1981843 - RNA, 19 nt, Human
ggcagggugucugcccccu

SEQ ID NO: 1981844 - RNA, 19 nt, Human
ggcagggucucacucuguc

SEQ ID NO: 1981845 - RNA, 20 nt, Human
ggcagggucucacucugucg

SEQ ID NO: 1981846 - RNA, 13 nt, Human
ggcagugggagcu

SEQ ID NO: 1981847 - RNA, 14 nt, Human
ggcagugggagcug

SEQ ID NO: 1981848 - RNA, 16 nt, Human
ggcagugggagcugcc

SEQ ID NO: 1981849 - RNA, 21 nt, Human
ggcagugggacagggcauggc

SEQ ID NO: 1981850 - RNA, 13 nt, Human
ggcaccugucugc

SEQ ID NO: 1981851 - RNA, 21 nt, Human
ggcaccugucugcuccagcuc

SEQ ID NO: 1981852 - RNA, 22 nt, Human
ggcaccugucugcuccagcucu

SEQ ID NO: 1981853 - RNA, 19 nt, Human
ggcacgugguugagugggg

SEQ ID NO: 1981854 - RNA, 15 nt, Human
ggcagcuauaggaaa

SEQ ID NO: 1981855 - RNA, 14 nt, Human
ggcagcucaccucu

SEQ ID NO: 1981856 - RNA, 12 nt, Human
ggcagcucaccu

SEQ ID NO: 1981857 - RNA, 12 nt, Human
ggcagcucagcu

SEQ ID NO: 1981858 - RNA, 21 nt, Human
ggcagcucagagaggguggga

SEQ ID NO: 1981859 - RNA, 13 nt, Human
ggcagcucagaga

SEQ ID NO: 1981860 - RNA, 16 nt, Human
ggcagcucaccucucc

SEQ ID NO: 1981861 - RNA, 22 nt, Human
ggcagcugcuuuugucuauggg

SEQ ID NO: 1981862 - RNA, 17 nt, Human
ggcagcuugaggguugg

SEQ ID NO: 1981863 - RNA, 16 nt, Human
ggcagcuguugucucu

SEQ ID NO: 1981864 - RNA, 17 nt, Human
ggccagcugcuugggcu

SEQ ID NO: 1981865 - RNA, 22 nt, Human
ggccagccuugaccauucucca

SEQ ID NO: 1981866 - RNA, 20 nt, Human
ggccagccuugaccauucuc

SEQ ID NO: 1981867 - RNA, 18 nt, Human
ggccaggcccucugccca

SEQ ID NO: 1981868 - RNA, 18 nt, Human
ggccaggaaguagcacag

SEQ ID NO: 1981869 - RNA, 23 nt, Human
ggccagcugcuugggcuucaucc

SEQ ID NO: 1981870 - RNA, 11 nt, Human
ggccagcuccg

SEQ ID NO: 1981871 - RNA, 17 nt, Human
ggccaggcugcucucaa

SEQ ID NO: 1981872 - RNA, 16 nt, Human
ggccaugggccuccug

SEQ ID NO: 1981873 - RNA, 14 nt, Human
ggccaggcugcucu

SEQ ID NO: 1981874 - RNA, 15 nt, Human
ggccaggcugcucuu

SEQ ID NO: 1981875 - RNA, 11 nt, Human
ggccaggcugc

SEQ ID NO: 1981876 - RNA, 19 nt, Human
ggccaggaaguagcacagg

SEQ ID NO: 1981877 - RNA, 18 nt, Human
ggcaugggaaugaauguc

SEQ ID NO: 1981878 - RNA, 17 nt, Human
ggcauuccccaggaggc

SEQ ID NO: 1981879 - RNA, 22 nt, Human
ggcaugggaaugaaugucagug

SEQ ID NO: 1981880 - RNA, 19 nt, Human
ggcauuccccaggaggcca

SEQ ID NO: 1981881 - RNA, 18 nt, Human
ggcauuccccaggaggcc

SEQ ID NO: 1981882 - RNA, 16 nt, Human
ggcauuccccaggagg

SEQ ID NO: 1981883 - RNA, 17 nt, Human
ggccacuccagaccccu

SEQ ID NO: 1981884 - RNA, 18 nt, Human
ggccacccugugcagaag

SEQ ID NO: 1981885 - RNA, 20 nt, Human
ggccaccacgccuagccuca

SEQ ID NO: 1981886 - RNA, 13 nt, Human
ggcccugccuccu

SEQ ID NO: 1981887 - RNA, 13 nt, Human
ggcccugcccugg

SEQ ID NO: 1981888 - RNA, 20 nt, Human
ggcccugcccugguuuccug

SEQ ID NO: 1981889 - RNA, 11 nt, Human
ggcccugcccu

SEQ ID NO: 1981890 - RNA, 12 nt, Human
ggcccugcagcu

SEQ ID NO: 1981891 - RNA, 12 nt, Human
ggcccugcccug

SEQ ID NO: 1981892 - RNA, 22 nt, Human
ggcccuggcucccacaggcccu

SEQ ID NO: 1981893 - RNA, 13 nt, Human
ggcccuggcuccc

SEQ ID NO: 1981894 - RNA, 13 nt, Human
ggcccuggcagcc

SEQ ID NO: 1981895 - RNA, 14 nt, Human
ggcccuggcagccc

SEQ ID NO: 1981896 - RNA, 15 nt, Human
ggcccugccuccuuu

SEQ ID NO: 1981897 - RNA, 14 nt, Human
ggcccugccuccuu

SEQ ID NO: 1981898 - RNA, 22 nt, Human
ggcccugcccugguuuccugcc

SEQ ID NO: 1981899 - RNA, 11 nt, Human
ggcccugccug

SEQ ID NO: 1981900 - RNA, 13 nt, Human
ggcccugccugcu

SEQ ID NO: 1981901 - RNA, 17 nt, Human
ggcccucugcccacucc

SEQ ID NO: 1981902 - RNA, 16 nt, Human
ggcccucugcccacuc

SEQ ID NO: 1981903 - RNA, 15 nt, Human
ggcccucugcccacu

SEQ ID NO: 1981904 - RNA, 13 nt, Human
ggcccucugccca

SEQ ID NO: 1981905 - RNA, 20 nt, Human
ggcccucugcccacucccug

SEQ ID NO: 1981906 - RNA, 19 nt, Human
ggcccucugcccacucccu

SEQ ID NO: 1981907 - RNA, 23 nt, Human
ggcccucucugaaggaggccacc

SEQ ID NO: 1981908 - RNA, 21 nt, Human
ggcccucugcccacucccugc

SEQ ID NO: 1981909 - RNA, 11 nt, Human
ggcccagagag

SEQ ID NO: 1981910 - RNA, 18 nt, Human
ggcccagagagaagagcc

SEQ ID NO: 1981911 - RNA, 20 nt, Human
ggcccagagagaagagcccc

SEQ ID NO: 1981912 - RNA, 12 nt, Human
ggcccagagagg

SEQ ID NO: 1981913 - RNA, 22 nt, Human
ggcccagagagaagagccccac

SEQ ID NO: 1981914 - RNA, 23 nt, Human
ggcccagagagaagagccccacu

SEQ ID NO: 1981915 - RNA, 20 nt, Human
ggcccucucugaaggaggcc

SEQ ID NO: 1981916 - RNA, 21 nt, Human
ggcccucucugaaggaggcca

SEQ ID NO: 1981917 - RNA, 19 nt, Human
ggcccaacaggggcuccau

SEQ ID NO: 1981918 - RNA, 20 nt, Human
ggcccaagagucuggggacc

SEQ ID NO: 1981919 - RNA, 22 nt, Human
ggcccaagagucuggggaccag

SEQ ID NO: 1981920 - RNA, 12 nt, Human
ggcccugugccu

SEQ ID NO: 1981921 - RNA, 17 nt, Human
ggccuacaugcuuugug

SEQ ID NO: 1981922 - RNA, 23 nt, Human
ggccuagcauacguacacauuuu

SEQ ID NO: 1981923 - RNA, 18 nt, Human
ggccuacaugcuuuguga

SEQ ID NO: 1981924 - RNA, 23 nt, Human
ggccuacaugcuuugugaacaag

SEQ ID NO: 1981925 - RNA, 16 nt, Human
ggccucugcacucccc

SEQ ID NO: 1981926 - RNA, 15 nt, Human
ggccucugcacuccc

SEQ ID NO: 1981927 - RNA, 14 nt, Human
ggccucugcacucc

SEQ ID NO: 1981928 - RNA, 13 nt, Human
ggccucugcacuc

SEQ ID NO: 1981929 - RNA, 17 nt, Human
ggccucuuaugggcugg

SEQ ID NO: 1981930 - RNA, 21 nt, Human
ggccucugcaaaggaaauacc

SEQ ID NO: 1981931 - RNA, 20 nt, Human
ggccucgguguggagaagcg

SEQ ID NO: 1981932 - RNA, 18 nt, Human
ggccucuuaugggcuggg

SEQ ID NO: 1981933 - RNA, 22 nt, Human
ggccucggacuuagcugggaga

SEQ ID NO: 1981934 - RNA, 20 nt, Human
ggccucggacuuagcuggga

SEQ ID NO: 1981935 - RNA, 17 nt, Human
ggccucggacuuagcug

SEQ ID NO: 1981936 - RNA, 19 nt, Human
ggccugucucggaaccugu

SEQ ID NO: 1981937 - RNA, 13 nt, Human
ggccugucuguga

SEQ ID NO: 1981938 - RNA, 22 nt, Human
ggccugucugugaagagcaaga

SEQ ID NO: 1981939 - RNA, 23 nt, Human
ggcgcugccccuggcagccccug

SEQ ID NO: 1981940 - RNA, 21 nt, Human
ggcgcugccccuggcagcccc

SEQ ID NO: 1981941 - RNA, 19 nt, Human
ggcgcugccccuggcagcc

SEQ ID NO: 1981942 - RNA, 18 nt, Human
ggcgcugccccuggcagc

SEQ ID NO: 1981943 - RNA, 22 nt, Human
ggccugggggcugggcagagga

SEQ ID NO: 1981944 - RNA, 20 nt, Human
ggccugggggcugggcagag

SEQ ID NO: 1981945 - RNA, 14 nt, Human
ggccugggggcugg

SEQ ID NO: 1981946 - RNA, 18 nt, Human
ggccuguccaacacaucu

SEQ ID NO: 1981947 - RNA, 11 nt, Human
ggccugugagc

SEQ ID NO: 1981948 - RNA, 19 nt, Human
ggccugaagaguccucuga

SEQ ID NO: 1981949 - RNA, 13 nt, Human
ggccugaagaguc

SEQ ID NO: 1981950 - RNA, 16 nt, Human
ggccugaauccaaaag

SEQ ID NO: 1981951 - RNA, 12 nt, Human
ggccugaaccac

SEQ ID NO: 1981952 - RNA, 18 nt, Human
ggccugaaccacaggaga

SEQ ID NO: 1981953 - RNA, 21 nt, Human
ggccucuuucagugaauuugu

SEQ ID NO: 1981954 - RNA, 23 nt, Human
ggccugaagaguccucugaauga

SEQ ID NO: 1981955 - RNA, 22 nt, Human
ggccugaauccaaaagaaaaac

SEQ ID NO: 1981956 - RNA, 14 nt, Human
ggccuggcucccuc

SEQ ID NO: 1981957 - RNA, 19 nt, Human
ggccuggccugagcuggga

SEQ ID NO: 1981958 - RNA, 14 nt, Human
ggccuggcuugucu

SEQ ID NO: 1981959 - RNA, 23 nt, Human
ggccuggcucccucacucucagg

SEQ ID NO: 1981960 - RNA, 17 nt, Human
ggcuagagguucaaaga

SEQ ID NO: 1981961 - RNA, 22 nt, Human
ggcuagagguucaaagauauuu

SEQ ID NO: 1981962 - RNA, 15 nt, Human
ggcuagcuaagccaa

SEQ ID NO: 1981963 - RNA, 22 nt, Human
ggcuaggaccccuccauguggg

SEQ ID NO: 1981964 - RNA, 16 nt, Human
ggcuaggaccccucca

SEQ ID NO: 1981965 - RNA, 17 nt, Human
ggcucaagcccaggagg

SEQ ID NO: 1981966 - RNA, 12 nt, Human
ggcucaaauuuu

SEQ ID NO: 1981967 - RNA, 15 nt, Human
ggcuaugcauuugaa

SEQ ID NO: 1981968 - RNA, 21 nt, Human
ggcuauggggauagaugugug

SEQ ID NO: 1981969 - RNA, 19 nt, Human
ggcuaugggggcacugagg

SEQ ID NO: 1981970 - RNA, 16 nt, Human
ggcuaguugggcuucc

SEQ ID NO: 1981971 - RNA, 23 nt, Human
ggcuagugugguguuuccuggca

SEQ ID NO: 1981972 - RNA, 15 nt, Human
ggcuaguugggcuuc

SEQ ID NO: 1981973 - RNA, 19 nt, Human
ggcuccaggagcagccaca

SEQ ID NO: 1981974 - RNA, 13 nt, Human
ggcuccaggagca

SEQ ID NO: 1981975 - RNA, 12 nt, Human
ggcuccaggagc

SEQ ID NO: 1981976 - RNA, 12 nt, Human
ggcuccagcugg

SEQ ID NO: 1981977 - RNA, 18 nt, Human
ggcucaagcccaggaggg

SEQ ID NO: 1981978 - RNA, 15 nt, Human
ggcucaaguccucuu

SEQ ID NO: 1981979 - RNA, 21 nt, Human
ggcucaaguccucuuuucuga

SEQ ID NO: 1981980 - RNA, 14 nt, Human
ggcuccaggccagg

SEQ ID NO: 1981981 - RNA, 16 nt, Human
ggcuccaggccagggg

SEQ ID NO: 1981982 - RNA, 13 nt, Human
ggcuccaggcagc

SEQ ID NO: 1981983 - RNA, 14 nt, Human
ggcuccaggcagca

SEQ ID NO: 1981984 - RNA, 18 nt, Human
ggcuccaggccagggggc

SEQ ID NO: 1981985 - RNA, 11 nt, Human
ggcuccaggcu

SEQ ID NO: 1981986 - RNA, 16 nt, Human
ggcuccaggcuccuuu

SEQ ID NO: 1981987 - RNA, 15 nt, Human
ggcuccaguccccag

SEQ ID NO: 1981988 - RNA, 12 nt, Human
ggcuccaugcca

SEQ ID NO: 1981989 - RNA, 13 nt, Human
ggcuccaugccag

SEQ ID NO: 1981990 - RNA, 14 nt, Human
ggcuccaugccagc

SEQ ID NO: 1981991 - RNA, 17 nt, Human
ggcucccacaggcccuu

SEQ ID NO: 1981992 - RNA, 18 nt, Human
ggcucccacaggcccuuc

SEQ ID NO: 1981993 - RNA, 19 nt, Human
ggcucccacaggcccuucc

SEQ ID NO: 1981994 - RNA, 14 nt, Human
gauaugauucaaau

SEQ ID NO: 1981995 - RNA, 22 nt, Human
gauaugauucaaaugucuauaa

SEQ ID NO: 1981996 - RNA, 24 nt, Human
gauaugauucaaaugucuauaaac

SEQ ID NO: 1981997 - RNA, 15 nt, Human
gauaugaaaaaugag

SEQ ID NO: 1981998 - RNA, 12 nt, Human
gaucacaaauga

SEQ ID NO: 1981999 - RNA, 13 nt, Human
gaucacaaaugac

SEQ ID NO: 1982000 - RNA, 16 nt, Human
gaucacaaaugacuuu

SEQ ID NO: 1982001 - RNA, 20 nt, Human
gaucacaaaugacuuuauua

SEQ ID NO: 1982002 - RNA, 15 nt, Human
gauauaagugugugu

SEQ ID NO: 1982003 - RNA, 18 nt, Human
gaucacggcucacugcag

SEQ ID NO: 1982004 - RNA, 14 nt, Human
gaucacuuucugaa

SEQ ID NO: 1982005 - RNA, 21 nt, Human
gaucacuguuuagauuugcca

SEQ ID NO: 1982006 - RNA, 14 nt, Human
gaucacuguuuaga

SEQ ID NO: 1982007 - RNA, 18 nt, Human
gaucacuguuuagauuug

SEQ ID NO: 1982008 - RNA, 15 nt, Human
gaucacggcucacug

SEQ ID NO: 1982009 - RNA, 16 nt, Human
gaucacggcucacugc

SEQ ID NO: 1982010 - RNA, 23 nt, Human
gauagcuucaccccaaucccagc

SEQ ID NO: 1982011 - RNA, 22 nt, Human
gauagccaaggccaaaggaagc

SEQ ID NO: 1982012 - RNA, 14 nt, Human
gauagccaaggcca

SEQ ID NO: 1982013 - RNA, 15 nt, Human
gauagcacagacccu

SEQ ID NO: 1982014 - RNA, 16 nt, Human
gauagcacagacccug

SEQ ID NO: 1982015 - RNA, 14 nt, Human
gauagaugugugga

SEQ ID NO: 1982016 - RNA, 22 nt, Human
gauagauguguggacacauugg

SEQ ID NO: 1982017 - RNA, 21 nt, Human
gauacaggaaaagcugcugac

SEQ ID NO: 1982018 - RNA, 23 nt, Human
gauacaggaaaagcugcugacag

SEQ ID NO: 1982019 - RNA, 22 nt, Human
gauaagaaccuuuugagugccu

SEQ ID NO: 1982020 - RNA, 20 nt, Human
gauacaggaaaagcugcuga

SEQ ID NO: 1982021 - RNA, 11 nt, Human
gauaagaaaac

SEQ ID NO: 1982022 - RNA, 12 nt, Human
gauaagaaaacc

SEQ ID NO: 1982023 - RNA, 13 nt, Human
gagugggugaaua

SEQ ID NO: 1982024 - RNA, 17 nt, Human
gagugacagaggcagcc

SEQ ID NO: 1982025 - RNA, 13 nt, Human
gaguguguaauuu

SEQ ID NO: 1982026 - RNA, 15 nt, Human
gagugugguuucuuu

SEQ ID NO: 1982027 - RNA, 19 nt, Human
gagugugguuucuuuuuga

SEQ ID NO: 1982028 - RNA, 20 nt, Human
gagugugccugaagucccag

SEQ ID NO: 1982029 - RNA, 12 nt, Human
gaguuacagaca

SEQ ID NO: 1982030 - RNA, 15 nt, Human
gaguuacagccuggg

SEQ ID NO: 1982031 - RNA, 15 nt, Human
gaguuacagacaaag

SEQ ID NO: 1982032 - RNA, 13 nt, Human
gaguuacagacaa

SEQ ID NO: 1982033 - RNA, 20 nt, Human
gaguucaucuugaauuguaa

SEQ ID NO: 1982034 - RNA, 19 nt, Human
gaguucaucuugaauugua

SEQ ID NO: 1982035 - RNA, 14 nt, Human
gaguucaucuugaa

SEQ ID NO: 1982036 - RNA, 20 nt, Human
gaguucauacccuguuacca

SEQ ID NO: 1982037 - RNA, 20 nt, Human
gauaaaugauucaaaaaguc

SEQ ID NO: 1982038 - RNA, 15 nt, Human
gauaaaugauucaaa

SEQ ID NO: 1982039 - RNA, 21 nt, Human
gaguugaagacagagcuacac

SEQ ID NO: 1982040 - RNA, 17 nt, Human
gaguugaagacagagcu

SEQ ID NO: 1982041 - RNA, 15 nt, Human
gaguugaagacagag

SEQ ID NO: 1982042 - RNA, 20 nt, Human
gaguacuacaguccucccau

SEQ ID NO: 1982043 - RNA, 17 nt, Human
gaguaaucuuguugguu

SEQ ID NO: 1982044 - RNA, 18 nt, Human
gaguaauugcauuugcuu

SEQ ID NO: 1982045 - RNA, 22 nt, Human
gaguaauccaagcaaaugugaa

SEQ ID NO: 1982046 - RNA, 23 nt, Human
gaguacuacaguccucccaucuc

SEQ ID NO: 1982047 - RNA, 21 nt, Human
gaguacuacaguccucccauc

SEQ ID NO: 1982048 - RNA, 12 nt, Human
gaguagaaugua

SEQ ID NO: 1982049 - RNA, 19 nt, Human
gaguagcugggacuacagg

SEQ ID NO: 1982050 - RNA, 17 nt, Human
gaguagagguauaauug

SEQ ID NO: 1982051 - RNA, 15 nt, Human
gaguagaauguaguu

SEQ ID NO: 1982052 - RNA, 17 nt, Human
gaguaggaagacuuugg

SEQ ID NO: 1982053 - RNA, 13 nt, Human
gaguaggaagacu

SEQ ID NO: 1982054 - RNA, 12 nt, Human
gaguaggaagac

SEQ ID NO: 1982055 - RNA, 22 nt, Human
gaguagcugggacuacaggcac

SEQ ID NO: 1982056 - RNA, 16 nt, Human
gagguuucaaaccucc

SEQ ID NO: 1982057 - RNA, 18 nt, Human
gagguuuauaguuaaucu

SEQ ID NO: 1982058 - RNA, 13 nt, Human
gagguuucaguga

SEQ ID NO: 1982059 - RNA, 17 nt, Human
gagguugggaggccauu

SEQ ID NO: 1982060 - RNA, 15 nt, Human
gagguugggaggcca

SEQ ID NO: 1982061 - RNA, 17 nt, Human
gaggucagagccugcag

SEQ ID NO: 1982062 - RNA, 20 nt, Human
gaggucagagccugcaguua

SEQ ID NO: 1982063 - RNA, 21 nt, Human
gagucuauuuacggaacucaa

SEQ ID NO: 1982064 - RNA, 13 nt, Human
gagucugaaggcu

SEQ ID NO: 1982065 - RNA, 12 nt, Human
gagucugaaggc

SEQ ID NO: 1982066 - RNA, 11 nt, Human
gagucuucaug

SEQ ID NO: 1982067 - RNA, 16 nt, Human
gagucuguucugguaa

SEQ ID NO: 1982068 - RNA, 14 nt, Human
gagucugaaggcug

SEQ ID NO: 1982069 - RNA, 15 nt, Human
gagucugaaggcugg

SEQ ID NO: 1982070 - RNA, 19 nt, Human
gagucuagcguagugcagc

SEQ ID NO: 1982071 - RNA, 17 nt, Human
gagugaagcugggagaa

SEQ ID NO: 1982072 - RNA, 14 nt, Human
gagugacagaggca

SEQ ID NO: 1982073 - RNA, 15 nt, Human
gagugacagaggcag

SEQ ID NO: 1982074 - RNA, 16 nt, Human
gagugacagaggcagc

SEQ ID NO: 1982075 - RNA, 11 nt, Human
gaguauauguc

SEQ ID NO: 1982076 - RNA, 15 nt, Human
gaguauauuauaaua

SEQ ID NO: 1982077 - RNA, 12 nt, Human
gaguauucuaau

SEQ ID NO: 1982078 - RNA, 20 nt, Human
gaguauucuaauaagcuagu

SEQ ID NO: 1982079 - RNA, 19 nt, Human
gaguaggaagacuuuggaa

SEQ ID NO: 1982080 - RNA, 18 nt, Human
gaguaggaagacuuugga

SEQ ID NO: 1982081 - RNA, 21 nt, Human
gaguagugaagacuccagaaa

SEQ ID NO: 1982082 - RNA, 15 nt, Human
gagucgaggacaggg

SEQ ID NO: 1982083 - RNA, 16 nt, Human
gagucgaggacaggga

SEQ ID NO: 1982084 - RNA, 13 nt, Human
gaguccucugaau

SEQ ID NO: 1982085 - RNA, 22 nt, Human
gaguccuccagaacucuuccuc

SEQ ID NO: 1982086 - RNA, 22 nt, Human
gaguccgaccuggccugucugu

SEQ ID NO: 1982087 - RNA, 14 nt, Human
gaguccuccagaac

SEQ ID NO: 1982088 - RNA, 15 nt, Human
gaguccuccagaacu

SEQ ID NO: 1982089 - RNA, 21 nt, Human
gaguccuccagaacucuuccu

SEQ ID NO: 1982090 - RNA, 14 nt, Human
gagucgaggacagg

SEQ ID NO: 1982091 - RNA, 19 nt, Human
gaguccgaaagggacuugg

SEQ ID NO: 1982092 - RNA, 20 nt, Human
gaggauugcuugagcucagg

SEQ ID NO: 1982093 - RNA, 20 nt, Human
gaggauuggcucccaucuuu

SEQ ID NO: 1982094 - RNA, 19 nt, Human
gaggaucucuugagccugg

SEQ ID NO: 1982095 - RNA, 16 nt, Human
gaggaucucuugagcc

SEQ ID NO: 1982096 - RNA, 22 nt, Human
gaggaucucuugagccugggag

SEQ ID NO: 1982097 - RNA, 13 nt, Human
gaggaucucuuga

SEQ ID NO: 1982098 - RNA, 24 nt, Human
gagcccuucggaggaccagggcug

SEQ ID NO: 1982099 - RNA, 22 nt, Human
gagcccuguccugccuaaggcu

SEQ ID NO: 1982100 - RNA, 21 nt, Human
gaggcagccccauucugccug

SEQ ID NO: 1982101 - RNA, 20 nt, Human
gaggcagccccauucugccu

SEQ ID NO: 1982102 - RNA, 9 nt, Human
gaggcaggg

SEQ ID NO: 1982103 - RNA, 19 nt, Human
gaggcagagguugcaguga

SEQ ID NO: 1982104 - RNA, 19 nt, Human
gaggcagccccauucugcc

SEQ ID NO: 1982105 - RNA, 18 nt, Human
gaggcagccccauucugc

SEQ ID NO: 1982106 - RNA, 18 nt, Human
gaggccaugggccuccug

SEQ ID NO: 1982107 - RNA, 20 nt, Human
gaggccaugggccuccugug

SEQ ID NO: 1982108 - RNA, 21 nt, Human
gaggccaugggccuccugugu

SEQ ID NO: 1982109 - RNA, 23 nt, Human
gaggccaugggccuccugugugu

SEQ ID NO: 1982110 - RNA, 14 nt, Human
gaggccaugggccu

SEQ ID NO: 1982111 - RNA, 17 nt, Human
gaggccaugggccuccu

SEQ ID NO: 1982112 - RNA, 16 nt, Human
gaggccauaaaauaag

SEQ ID NO: 1982113 - RNA, 12 nt, Human
gaggccaucugg

SEQ ID NO: 1982114 - RNA, 14 nt, Human
gaggccaucuggag

SEQ ID NO: 1982115 - RNA, 16 nt, Human
gaggccaucuggagag

SEQ ID NO: 1982116 - RNA, 18 nt, Human
gaggccaucuggagagcc

SEQ ID NO: 1982117 - RNA, 19 nt, Human
gaggccaucuggagagccc

SEQ ID NO: 1982118 - RNA, 22 nt, Human
gaggccaucuggagagcccaga

SEQ ID NO: 1982119 - RNA, 19 nt, Human
gaggccccaauaccccaug

SEQ ID NO: 1982120 - RNA, 20 nt, Human
gaggcccuucucuccagccc

SEQ ID NO: 1982121 - RNA, 15 nt, Human
gaggcccuucucucc

SEQ ID NO: 1982122 - RNA, 21 nt, Human
gaggcccuucucuccagcccc

SEQ ID NO: 1982123 - RNA, 22 nt, Human
gaggcccuucucuccagccccu

SEQ ID NO: 1982124 - RNA, 16 nt, Human
gaggcccagagggccu

SEQ ID NO: 1982125 - RNA, 15 nt, Human
gaggcccagagggcc

SEQ ID NO: 1982126 - RNA, 19 nt, Human
gaggcccagagggccugca

SEQ ID NO: 1982127 - RNA, 14 nt, Human
gaggcccagagggc

SEQ ID NO: 1982128 - RNA, 13 nt, Human
gaggcccagaggg

SEQ ID NO: 1982129 - RNA, 11 nt, Human
gaggcccagag

SEQ ID NO: 1982130 - RNA, 21 nt, Human
gaggcgcaugaauuugugaag

SEQ ID NO: 1982131 - RNA, 19 nt, Human
gaggcuggaguuggggcag

SEQ ID NO: 1982132 - RNA, 16 nt, Human
gaggcugggcucccuu

SEQ ID NO: 1982133 - RNA, 22 nt, Human
gaggccucucauuccagaggaa

SEQ ID NO: 1982134 - RNA, 21 nt, Human
gaggccguugcugacuuagaa

SEQ ID NO: 1982135 - RNA, 23 nt, Human
gaggccuccuguggccugccagu

SEQ ID NO: 1982136 - RNA, 16 nt, Human
gaggccuucucugaag

SEQ ID NO: 1982137 - RNA, 18 nt, Human
gaggccuucucugaagga

SEQ ID NO: 1982138 - RNA, 19 nt, Human
gaggccuucucugaaggac

SEQ ID NO: 1982139 - RNA, 19 nt, Human
gaggccuugggcucugcug

SEQ ID NO: 1982140 - RNA, 20 nt, Human
gaggccuugggcucugcuga

SEQ ID NO: 1982141 - RNA, 21 nt, Human
gagguaaggaauaccuguccc

SEQ ID NO: 1982142 - RNA, 23 nt, Human
gaggguuuuuaaaaauaaagcaa

SEQ ID NO: 1982143 - RNA, 24 nt, Human
gagguaaggaauaccugucccccu

SEQ ID NO: 1982144 - RNA, 14 nt, Human
gaggguugggcugg

SEQ ID NO: 1982145 - RNA, 15 nt, Human
gaggguugggcuggu

SEQ ID NO: 1982146 - RNA, 16 nt, Human
gaggguucagagagga

SEQ ID NO: 1982147 - RNA, 21 nt, Human
gagguagcuuugagguggaag

SEQ ID NO: 1982148 - RNA, 15 nt, Human
gagguauaauugugu

SEQ ID NO: 1982149 - RNA, 17 nt, Human
gaggucaaggcugcagu

SEQ ID NO: 1982150 - RNA, 12 nt, Human
gaggucagagcc

SEQ ID NO: 1982151 - RNA, 13 nt, Human
gaggucagagccu

SEQ ID NO: 1982152 - RNA, 15 nt, Human
gagggugagugcaag

SEQ ID NO: 1982153 - RNA, 19 nt, Human
gagggugaguccuccagaa

SEQ ID NO: 1982154 - RNA, 21 nt, Human
gagggugaagugaagacaaug

SEQ ID NO: 1982155 - RNA, 12 nt, Human
gaggguggaaua

SEQ ID NO: 1982156 - RNA, 15 nt, Human
gagggugggaguggg

SEQ ID NO: 1982157 - RNA, 14 nt, Human
gaggguggugaccu

SEQ ID NO: 1982158 - RNA, 21 nt, Human
gaggguggugaccucugccug

SEQ ID NO: 1982159 - RNA, 22 nt, Human
gagggugucccaaaaagaaagg

SEQ ID NO: 1982160 - RNA, 19 nt, Human
gaggguaauaaccagacac

SEQ ID NO: 1982161 - RNA, 23 nt, Human
gagggucuugguuccagccugcc

SEQ ID NO: 1982162 - RNA, 13 nt, Human
gagggugaagccu

SEQ ID NO: 1982163 - RNA, 13 nt, Human
gagggucugagga

SEQ ID NO: 1982164 - RNA, 14 nt, Human
gagggucugaggaa

SEQ ID NO: 1982165 - RNA, 17 nt, Human
gaggggcugugggcgug

SEQ ID NO: 1982166 - RNA, 17 nt, Human
gaggggguggccuccca

SEQ ID NO: 1982167 - RNA, 13 nt, Human
gagggggcaaagg

SEQ ID NO: 1982168 - RNA, 13 nt, Human
gaggguaaggcug

SEQ ID NO: 1982169 - RNA, 21 nt, Human
gagggagugacagaggcagcc

SEQ ID NO: 1982170 - RNA, 22 nt, Human
gagggagugacagaggcagccc

SEQ ID NO: 1982171 - RNA, 20 nt, Human
gagggagggcuccagacaca

SEQ ID NO: 1982172 - RNA, 20 nt, Human
gagggagggggaaggcaggg

SEQ ID NO: 1982173 - RNA, 18 nt, Human
gagggagugacagaggca

SEQ ID NO: 1982174 - RNA, 20 nt, Human
gaggcugggcucccuuccca

SEQ ID NO: 1982175 - RNA, 17 nt, Human
gagggagcacaaccccc

SEQ ID NO: 1982176 - RNA, 19 nt, Human
gagggagggcuccagacac

SEQ ID NO: 1982177 - RNA, 23 nt, Human
gcacugcuuccagugaggcucug

SEQ ID NO: 1982178 - RNA, 14 nt, Human
gcacugguggcccg

SEQ ID NO: 1982179 - RNA, 19 nt, Human
gcacugguggcccgacagc

SEQ ID NO: 1982180 - RNA, 16 nt, Human
gcacgauuucuguuua

SEQ ID NO: 1982181 - RNA, 19 nt, Human
gcacugagagagcgcagcc

SEQ ID NO: 1982182 - RNA, 21 nt, Human
gcacugagagagcgcagccgc

SEQ ID NO: 1982183 - RNA, 14 nt, Human
gcacugcugcccag

SEQ ID NO: 1982184 - RNA, 15 nt, Human
gcacugcugcccagc

SEQ ID NO: 1982185 - RNA, 18 nt, Human
gcacugcugcccagccuc

SEQ ID NO: 1982186 - RNA, 20 nt, Human
gcacugcugcccagccucca

SEQ ID NO: 1982187 - RNA, 22 nt, Human
gcagaagggagcuggcuccagc

SEQ ID NO: 1982188 - RNA, 18 nt, Human
gcagaagggagcuggcuc

SEQ ID NO: 1982189 - RNA, 20 nt, Human
gcagaagggagcuggcucca

SEQ ID NO: 1982190 - RNA, 20 nt, Human
gcagaaguaggggaagaaua

SEQ ID NO: 1982191 - RNA, 12 nt, Human
gcagacaggcaa

SEQ ID NO: 1982192 - RNA, 13 nt, Human
gcagacaggcaag

SEQ ID NO: 1982193 - RNA, 14 nt, Human
gcagacaggcaagc

SEQ ID NO: 1982194 - RNA, 19 nt, Human
gcagacacccuuggagcuc

SEQ ID NO: 1982195 - RNA, 16 nt, Human
gcacagaguuguuaca

SEQ ID NO: 1982196 - RNA, 18 nt, Human
gcacagaguuguuacauu

SEQ ID NO: 1982197 - RNA, 19 nt, Human
gcacagaguuguuacauuu

SEQ ID NO: 1982198 - RNA, 21 nt, Human
gcacagaguuguuacauuuuu

SEQ ID NO: 1982199 - RNA, 14 nt, Human
gcacagucagguug

SEQ ID NO: 1982200 - RNA, 22 nt, Human
gcacagaguuguuacauuuuua

SEQ ID NO: 1982201 - RNA, 12 nt, Human
gcacagaggccu

SEQ ID NO: 1982202 - RNA, 15 nt, Human
gcacagugcaucuca

SEQ ID NO: 1982203 - RNA, 18 nt, Human
gcacagugcaucucagcc

SEQ ID NO: 1982204 - RNA, 13 nt, Human
gcacagugcaucu

SEQ ID NO: 1982205 - RNA, 17 nt, Human
gcaccaaaauaagaaaa

SEQ ID NO: 1982206 - RNA, 18 nt, Human
gcaccaaaauaagaaaag

SEQ ID NO: 1982207 - RNA, 12 nt, Human
gcaccauaacuu

SEQ ID NO: 1982208 - RNA, 22 nt, Human
gcaccccagcuggggccaggcu

SEQ ID NO: 1982209 - RNA, 13 nt, Human
gcaccauacucau

SEQ ID NO: 1982210 - RNA, 13 nt, Human
gcaccauccccuc

SEQ ID NO: 1982211 - RNA, 14 nt, Human
gcaccauccccucc

SEQ ID NO: 1982212 - RNA, 17 nt, Human
gcaccauccccuccggc

SEQ ID NO: 1982213 - RNA, 21 nt, Human
gcaccuuagacagucccugcc

SEQ ID NO: 1982214 - RNA, 20 nt, Human
gcaccuuagacagucccugc

SEQ ID NO: 1982215 - RNA, 12 nt, Human
gcaccugucugc

SEQ ID NO: 1982216 - RNA, 14 nt, Human
gcaccugucugcuc

SEQ ID NO: 1982217 - RNA, 15 nt, Human
gcaccugucugcucc

SEQ ID NO: 1982218 - RNA, 16 nt, Human
gcaccugucugcucca

SEQ ID NO: 1982219 - RNA, 18 nt, Human
gcaccugucugcuccagc

SEQ ID NO: 1982220 - RNA, 21 nt, Human
gcaccugucugcuccagcucu

SEQ ID NO: 1982221 - RNA, 13 nt, Human
gcacgauuucugu

SEQ ID NO: 1982222 - RNA, 15 nt, Human
gcacgauuucuguuu

SEQ ID NO: 1982223 - RNA, 14 nt, Human
gcaccuucccccuc

SEQ ID NO: 1982224 - RNA, 19 nt, Human
gcaccuucccccuccccca

SEQ ID NO: 1982225 - RNA, 14 nt, Human
gcaacucaucuuag

SEQ ID NO: 1982226 - RNA, 23 nt, Human
gcaacgaucacaaaugacuuuau

SEQ ID NO: 1982227 - RNA, 16 nt, Human
gcaacgaucacaaaug

SEQ ID NO: 1982228 - RNA, 20 nt, Human
gcaacgaucacaaaugacuu

SEQ ID NO: 1982229 - RNA, 21 nt, Human
gcaacgaucacaaaugacuuu

SEQ ID NO: 1982230 - RNA, 22 nt, Human
gcaacgaucacaaaugacuuua

SEQ ID NO: 1982231 - RNA, 14 nt, Human
gcaacacacaugcu

SEQ ID NO: 1982232 - RNA, 17 nt, Human
gcaaugguaguuucugu

SEQ ID NO: 1982233 - RNA, 19 nt, Human
gcaaugguaguuucugugg

SEQ ID NO: 1982234 - RNA, 22 nt, Human
gcaauggugucaguauccaggc

SEQ ID NO: 1982235 - RNA, 23 nt, Human
gcaauggugucaguauccaggcu

SEQ ID NO: 1982236 - RNA, 13 nt, Human
gcaacucugaagg

SEQ ID NO: 1982237 - RNA, 15 nt, Human
gcaauggcagccuug

SEQ ID NO: 1982238 - RNA, 14 nt, Human
gcaauguuuugcuu

SEQ ID NO: 1982239 - RNA, 17 nt, Human
gcaauguuuugcuuuug

SEQ ID NO: 1982240 - RNA, 15 nt, Human
gcaauguuuugcuuu

SEQ ID NO: 1982241 - RNA, 22 nt, Human
gcaauguagaggggaaaagaga

SEQ ID NO: 1982242 - RNA, 14 nt, Human
gcaaugugauaaaa

SEQ ID NO: 1982243 - RNA, 20 nt, Human
gcaauucuccugccucagcc

SEQ ID NO: 1982244 - RNA, 18 nt, Human
gcaauucuccugccucag

SEQ ID NO: 1982245 - RNA, 19 nt, Human
gcaauucuccugccucagc

SEQ ID NO: 1982246 - RNA, 14 nt, Human
gcaauucuccugcc

SEQ ID NO: 1982247 - RNA, 15 nt, Human
gcaauucuccugccu

SEQ ID NO: 1982248 - RNA, 16 nt, Human
gcaauucuccugccuc

SEQ ID NO: 1982249 - RNA, 17 nt, Human
gcaauucuccugccuca

SEQ ID NO: 1982250 - RNA, 23 nt, Human
gcacaaaaagauaccuuaaaauu

SEQ ID NO: 1982251 - RNA, 14 nt, Human
gcacaaacagaggc

SEQ ID NO: 1982252 - RNA, 23 nt, Human
gcaauuuuauaaggacuuccuga

SEQ ID NO: 1982253 - RNA, 16 nt, Human
gcacaaacagaggccg

SEQ ID NO: 1982254 - RNA, 15 nt, Human
gcacaaacagaggcc

SEQ ID NO: 1982255 - RNA, 21 nt, Human
gcacagacccugcccuguggg

SEQ ID NO: 1982256 - RNA, 20 nt, Human
gcacagacccugcccugugg

SEQ ID NO: 1982257 - RNA, 19 nt, Human
gcacagacccugcccugug

SEQ ID NO: 1982258 - RNA, 18 nt, Human
gcacagacccugcccugu

SEQ ID NO: 1982259 - RNA, 22 nt, Human
gcacagacccugcccugugggc

SEQ ID NO: 1982260 - RNA, 15 nt, Human
gcacagaguuguuac

SEQ ID NO: 1982261 - RNA, 17 nt, Human
gcacagacccugcccug

SEQ ID NO: 1982262 - RNA, 16 nt, Human
gcacagacccugcccu

SEQ ID NO: 1982263 - RNA, 15 nt, Human
gcacagacccugccc

SEQ ID NO: 1982264 - RNA, 14 nt, Human
gcacagacccugcc

SEQ ID NO: 1982265 - RNA, 22 nt, Human
gcacagaaaauggaagacagcu

SEQ ID NO: 1982266 - RNA, 21 nt, Human
gcacagaaaauggaagacagc

SEQ ID NO: 1982267 - RNA, 23 nt, Human
gcacagaaaauggaagacagcuc

SEQ ID NO: 1982268 - RNA, 20 nt, Human
gcacagaaaauggaagacag

SEQ ID NO: 1982269 - RNA, 20 nt, Human
gcacacucauccccucacuu

SEQ ID NO: 1982270 - RNA, 13 nt, Human
gcacacgcugcuc

SEQ ID NO: 1982271 - RNA, 14 nt, Human
gcacacgcugcucu

SEQ ID NO: 1982272 - RNA, 15 nt, Human
gcacacgcugcucug

SEQ ID NO: 1982273 - RNA, 17 nt, Human
gcacacgcugcucugcc

SEQ ID NO: 1982274 - RNA, 18 nt, Human
gcacacgcugcucugccc

SEQ ID NO: 1982275 - RNA, 21 nt, Human
gcacacgcugcucugccccag

SEQ ID NO: 1982276 - RNA, 22 nt, Human
gcacaccuccucccacugccca

SEQ ID NO: 1982277 - RNA, 12 nt, Human
gcacacgcugcu

SEQ ID NO: 1982278 - RNA, 20 nt, Human
gcacaccgggcacucagaag

SEQ ID NO: 1982279 - RNA, 15 nt, Human
gcacaccuccuccca

SEQ ID NO: 1982280 - RNA, 19 nt, Human
gcacaccuccucccacugc

SEQ ID NO: 1982281 - RNA, 20 nt, Human
gcacaccuccucccacugcc

SEQ ID NO: 1982282 - RNA, 17 nt, Human
gcacaacccccagcucc

SEQ ID NO: 1982283 - RNA, 18 nt, Human
gcacaacccccagcuccc

SEQ ID NO: 1982284 - RNA, 18 nt, Human
gcacaaccuucaagcugc

SEQ ID NO: 1982285 - RNA, 23 nt, Human
gcacaaauucugucucuggauua

SEQ ID NO: 1982286 - RNA, 17 nt, Human
gcacaagcuccaagcuc

SEQ ID NO: 1982287 - RNA, 15 nt, Human
gcacaagcuccaagc

SEQ ID NO: 1982288 - RNA, 18 nt, Human
gcacaagcuccaagcucc

SEQ ID NO: 1982289 - RNA, 21 nt, Human
gcacaagcuccaagcucccag

SEQ ID NO: 1982290 - RNA, 16 nt, Human
gauguuuaguaaucau

SEQ ID NO: 1982291 - RNA, 13 nt, Human
gauguuuuuaaaa

SEQ ID NO: 1982292 - RNA, 14 nt, Human
gauguugaugcaau

SEQ ID NO: 1982293 - RNA, 21 nt, Human
gauguugaugcaauccuuaca

SEQ ID NO: 1982294 - RNA, 23 nt, Human
gauguugaugcaauccuuacaaa

SEQ ID NO: 1982295 - RNA, 14 nt, Human
gauguuuaaaacac

SEQ ID NO: 1982296 - RNA, 22 nt, Human
gauguuuaaaacaccuucuaua

SEQ ID NO: 1982297 - RNA, 23 nt, Human
gauguuuaaaacaccuucuauag

SEQ ID NO: 1982298 - RNA, 15 nt, Human
gauguucaccuccug

SEQ ID NO: 1982299 - RNA, 20 nt, Human
gauguuauauuuuucuuaaa

SEQ ID NO: 1982300 - RNA, 21 nt, Human
gauguuauauuuuucuuaaaa

SEQ ID NO: 1982301 - RNA, 16 nt, Human
gauguuaguuuuccuu

SEQ ID NO: 1982302 - RNA, 17 nt, Human
gauguuaguuuuccuua

SEQ ID NO: 1982303 - RNA, 13 nt, Human
gauguuauauuuu

SEQ ID NO: 1982304 - RNA, 16 nt, Human
gauguuauauuuuucu

SEQ ID NO: 1982305 - RNA, 19 nt, Human
gauguugacaucacuggca

SEQ ID NO: 1982306 - RNA, 20 nt, Human
gauuacaggcgugagccacc

SEQ ID NO: 1982307 - RNA, 17 nt, Human
gauuacaggcuccugcc

SEQ ID NO: 1982308 - RNA, 23 nt, Human
gauuacaagcgugagccacugca

SEQ ID NO: 1982309 - RNA, 15 nt, Human
gauuaaacuuaaucu

SEQ ID NO: 1982310 - RNA, 15 nt, Human
gauguuuuuaaaauc

SEQ ID NO: 1982311 - RNA, 16 nt, Human
gauguuuuuaaaaucu

SEQ ID NO: 1982312 - RNA, 17 nt, Human
gauguuuuuaaaaucuu

SEQ ID NO: 1982313 - RNA, 15 nt, Human
gauguuuuucuuacc

SEQ ID NO: 1982314 - RNA, 22 nt, Human
gauuacaagcgugagccacugc

SEQ ID NO: 1982315 - RNA, 20 nt, Human
gauuaaagaugagcuuuguc

SEQ ID NO: 1982316 - RNA, 22 nt, Human
gauuaaaaauaucaaauuaauu

SEQ ID NO: 1982317 - RNA, 16 nt, Human
gauggugcaaugaccu

SEQ ID NO: 1982318 - RNA, 15 nt, Human
gauggugcaaugacc

SEQ ID NO: 1982319 - RNA, 24 nt, Human
gaugguguucaaaaaacuuguaaa

SEQ ID NO: 1982320 - RNA, 17 nt, Human
gauggugcaaugaccuu

SEQ ID NO: 1982321 - RNA, 23 nt, Human
gaugguaucuauagucaagacga

SEQ ID NO: 1982322 - RNA, 19 nt, Human
gaugguaugcacaauucca

SEQ ID NO: 1982323 - RNA, 14 nt, Human
gauggugcaaugac

SEQ ID NO: 1982324 - RNA, 12 nt, Human
gauggugcaaug

SEQ ID NO: 1982325 - RNA, 19 nt, Human
gaugugggccaccauugca

SEQ ID NO: 1982326 - RNA, 13 nt, Human
gaugguuccccug

SEQ ID NO: 1982327 - RNA, 18 nt, Human
gaugguuccccuguucac

SEQ ID NO: 1982328 - RNA, 21 nt, Human
gaugguuccccuguucacucu

SEQ ID NO: 1982329 - RNA, 18 nt, Human
gaugcuagaacucccuuu

SEQ ID NO: 1982330 - RNA, 16 nt, Human
gaugccccgucccccu

SEQ ID NO: 1982331 - RNA, 20 nt, Human
gaugcuagaacucccuuuca

SEQ ID NO: 1982332 - RNA, 22 nt, Human
gaugcuagaacucccuuucaac

SEQ ID NO: 1982333 - RNA, 13 nt, Human
gaugcucuuuccc

SEQ ID NO: 1982334 - RNA, 14 nt, Human
gaugcucuuuccca

SEQ ID NO: 1982335 - RNA, 17 nt, Human
gaugcugacuguacucc

SEQ ID NO: 1982336 - RNA, 20 nt, Human
gaugcugacuguacuccucc

SEQ ID NO: 1982337 - RNA, 21 nt, Human
gaugccccgucccccucuggc

SEQ ID NO: 1982338 - RNA, 12 nt, Human
gaugcucuuucc

SEQ ID NO: 1982339 - RNA, 20 nt, Human
gaugcccaaagaugcagccg

SEQ ID NO: 1982340 - RNA, 19 nt, Human
gaugcccaaagaugcagcc

SEQ ID NO: 1982341 - RNA, 20 nt, Human
gaucagaccaaacagugcug

SEQ ID NO: 1982342 - RNA, 22 nt, Human
gauggccgggcgcgguggcuca

SEQ ID NO: 1982343 - RNA, 19 nt, Human
gaugggaugauugaagaaa

SEQ ID NO: 1982344 - RNA, 20 nt, Human
gaugggcaacccccagccug

SEQ ID NO: 1982345 - RNA, 24 nt, Human
gauggggcccugccuccuuuguga

SEQ ID NO: 1982346 - RNA, 21 nt, Human
gaugggcaacccccagccugc

SEQ ID NO: 1982347 - RNA, 15 nt, Human
gauggggcugcaccg

SEQ ID NO: 1982348 - RNA, 19 nt, Human
gauggggcugcaccggcug

SEQ ID NO: 1982349 - RNA, 13 nt, Human
gauggggcugcac

SEQ ID NO: 1982350 - RNA, 20 nt, Human
gaugggaugauugaagaaac

SEQ ID NO: 1982351 - RNA, 19 nt, Human
gaugggugcuuggaggaag

SEQ ID NO: 1982352 - RNA, 15 nt, Human
gaugggucaguugua

SEQ ID NO: 1982353 - RNA, 21 nt, Human
gaugggucaguuguaucagca

SEQ ID NO: 1982354 - RNA, 12 nt, Human
gcaaaccaucau

SEQ ID NO: 1982355 - RNA, 15 nt, Human
gcaaacauuuucucu

SEQ ID NO: 1982356 - RNA, 20 nt, Human
gcaaacauuuucucuuagaa

SEQ ID NO: 1982357 - RNA, 21 nt, Human
gcaaacauuuucucuuagaaa

SEQ ID NO: 1982358 - RNA, 13 nt, Human
gcaaaccaacaag

SEQ ID NO: 1982359 - RNA, 20 nt, Human
gcaaaccaacaagaauaaag

SEQ ID NO: 1982360 - RNA, 13 nt, Human
gauuuuguguuua

SEQ ID NO: 1982361 - RNA, 21 nt, Human
gauuuuguguuuauucuugau

SEQ ID NO: 1982362 - RNA, 12 nt, Human
gauuuugaucuc

SEQ ID NO: 1982363 - RNA, 21 nt, Human
gauuuugaaauuuuuauuaaa

SEQ ID NO: 1982364 - RNA, 19 nt, Human
gauuuugauccaagcuggu

SEQ ID NO: 1982365 - RNA, 15 nt, Human
gauuuuaguuuuauu

SEQ ID NO: 1982366 - RNA, 19 nt, Human
gauuuuaguuuuauuuucu

SEQ ID NO: 1982367 - RNA, 22 nt, Human
gauuuuaguuuuauuuucuaaa

SEQ ID NO: 1982368 - RNA, 23 nt, Human
gcaacaauucucccgggacucug

SEQ ID NO: 1982369 - RNA, 14 nt, Human
gcaacaauuuucag

SEQ ID NO: 1982370 - RNA, 15 nt, Human
gcaacaauuuucaga

SEQ ID NO: 1982371 - RNA, 16 nt, Human
gcaacaauuuucagau

SEQ ID NO: 1982372 - RNA, 22 nt, Human
gcaacaaacugcacaugauuuc

SEQ ID NO: 1982373 - RNA, 23 nt, Human
gcaacaaacugcacaugauuuca

SEQ ID NO: 1982374 - RNA, 14 nt, Human
gcaacaaaauacau

SEQ ID NO: 1982375 - RNA, 14 nt, Human
gcaacaaacugcac

SEQ ID NO: 1982376 - RNA, 15 nt, Human
gcaacaaacugcaca

SEQ ID NO: 1982377 - RNA, 21 nt, Human
gcaacaaacugcacaugauuu

SEQ ID NO: 1982378 - RNA, 23 nt, Human
gcaaaugugaaucauuuuaccuu

SEQ ID NO: 1982379 - RNA, 15 nt, Human
gcaaauguggcuccu

SEQ ID NO: 1982380 - RNA, 14 nt, Human
gcaaaggaaauacc

SEQ ID NO: 1982381 - RNA, 12 nt, Human
gcaaagcuguuc

SEQ ID NO: 1982382 - RNA, 17 nt, Human
gcaaagcuguucuuccu

SEQ ID NO: 1982383 - RNA, 18 nt, Human
gcaaagcuguucuuccug

SEQ ID NO: 1982384 - RNA, 19 nt, Human
gcaaagcuguucuuccugg

SEQ ID NO: 1982385 - RNA, 19 nt, Human
gcaaagcggguuauaauga

SEQ ID NO: 1982386 - RNA, 15 nt, Human
gcaaaccaucauuga

SEQ ID NO: 1982387 - RNA, 14 nt, Human
gauuuccucuugaa

SEQ ID NO: 1982388 - RNA, 21 nt, Human
gauuuccucuugaaccagaac

SEQ ID NO: 1982389 - RNA, 15 nt, Human
gauuuaacagaaaug

SEQ ID NO: 1982390 - RNA, 22 nt, Human
gauuuccguuaaaauaccagcc

SEQ ID NO: 1982391 - RNA, 15 nt, Human
gauuucuaguuauuu

SEQ ID NO: 1982392 - RNA, 20 nt, Human
gauuucuaguuauuuauucu

SEQ ID NO: 1982393 - RNA, 16 nt, Human
gauuugagcucagccc

SEQ ID NO: 1982394 - RNA, 13 nt, Human
gauuugaauccag

SEQ ID NO: 1982395 - RNA, 15 nt, Human
gauugguuucucuuc

SEQ ID NO: 1982396 - RNA, 16 nt, Human
gauugguuucucuucu

SEQ ID NO: 1982397 - RNA, 17 nt, Human
gauugguuucucuucuc

SEQ ID NO: 1982398 - RNA, 21 nt, Human
gauugguuucucuucuccccu

SEQ ID NO: 1982399 - RNA, 17 nt, Human
gauugggccccugccag

SEQ ID NO: 1982400 - RNA, 13 nt, Human
gauuuaacagaaa

SEQ ID NO: 1982401 - RNA, 14 nt, Human
gauuuaacagaaau

SEQ ID NO: 1982402 - RNA, 12 nt, Human
gauuuaaaucag

SEQ ID NO: 1982403 - RNA, 15 nt, Human
gauucucaccagcug

SEQ ID NO: 1982404 - RNA, 21 nt, Human
gauucaaugccccugaauuua

SEQ ID NO: 1982405 - RNA, 23 nt, Human
gauuacaggcaugggccaccacg

SEQ ID NO: 1982406 - RNA, 18 nt, Human
gauucaaugccucuggcu

SEQ ID NO: 1982407 - RNA, 16 nt, Human
gauucacaccccaccu

SEQ ID NO: 1982408 - RNA, 17 nt, Human
gauucacaccccaccug

SEQ ID NO: 1982409 - RNA, 18 nt, Human
gauucacaccccaccugc

SEQ ID NO: 1982410 - RNA, 19 nt, Human
gauucaaugccccugaauu

SEQ ID NO: 1982411 - RNA, 20 nt, Human
gauucaaugccccugaauuu

SEQ ID NO: 1982412 - RNA, 18 nt, Human
gauuacaggcuccugcca

SEQ ID NO: 1982413 - RNA, 21 nt, Human
gauuacaggcuccugccacca

SEQ ID NO: 1982414 - RNA, 23 nt, Human
gauugcaggagucccugccauca

SEQ ID NO: 1982415 - RNA, 19 nt, Human
gauugccggucuugacagc

SEQ ID NO: 1982416 - RNA, 15 nt, Human
gauugcaacaggcug

SEQ ID NO: 1982417 - RNA, 16 nt, Human
gauugauuuuaaaaug

SEQ ID NO: 1982418 - RNA, 17 nt, Human
gauugauuuuaaaaugu

SEQ ID NO: 1982419 - RNA, 18 nt, Human
gauugauuuuaaaaugua

SEQ ID NO: 1982420 - RNA, 20 nt, Human
gauugauuuuaaaauguaca

SEQ ID NO: 1982421 - RNA, 14 nt, Human
gauucuccugccuc

SEQ ID NO: 1982422 - RNA, 16 nt, Human
gauucucaugccucag

SEQ ID NO: 1982423 - RNA, 20 nt, Human
gaauuugauaugugaacagu

SEQ ID NO: 1982424 - RNA, 22 nt, Human
gaauuucuuuugccguuauuaa

SEQ ID NO: 1982425 - RNA, 21 nt, Human
gaauuucuucaacucccugcc

SEQ ID NO: 1982426 - RNA, 17 nt, Human
gaauuugugaacagcag

SEQ ID NO: 1982427 - RNA, 19 nt, Human
gaauuucuaggacugaauu

SEQ ID NO: 1982428 - RNA, 20 nt, Human
gaauuucuaggacugaauua

SEQ ID NO: 1982429 - RNA, 19 nt, Human
gaauuggaaugcacucaga

SEQ ID NO: 1982430 - RNA, 18 nt, Human
gaauuuccuuacucuuga

SEQ ID NO: 1982431 - RNA, 20 nt, Human
gaauuggguggggggcuuca

SEQ ID NO: 1982432 - RNA, 22 nt, Human
gaauuggguggggggcuucaua

SEQ ID NO: 1982433 - RNA, 23 nt, Human
gaauuggguggggggcuucauac

SEQ ID NO: 1982434 - RNA, 15 nt, Human
gaauuguaaggaaug

SEQ ID NO: 1982435 - RNA, 19 nt, Human
gacaacacugggaaacaga

SEQ ID NO: 1982436 - RNA, 23 nt, Human
gacaacacucauugaccugaggc

SEQ ID NO: 1982437 - RNA, 22 nt, Human
gacaacacucauugaccugagg

SEQ ID NO: 1982438 - RNA, 14 nt, Human
gacaaaucugucug

SEQ ID NO: 1982439 - RNA, 15 nt, Human
gacaaaucugucugc

SEQ ID NO: 1982440 - RNA, 14 nt, Human
gacaaauguuucua

SEQ ID NO: 1982441 - RNA, 20 nt, Human
gacaaccuuggcuuggcccu

SEQ ID NO: 1982442 - RNA, 22 nt, Human
gacaaccuuggcuuggcccugg

SEQ ID NO: 1982443 - RNA, 19 nt, Human
gacaacagauuggauuuua

SEQ ID NO: 1982444 - RNA, 16 nt, Human
gacaacagacuucuga

SEQ ID NO: 1982445 - RNA, 14 nt, Human
gacaacauuguaag

SEQ ID NO: 1982446 - RNA, 23 nt, Human
gacacauguccaagaagcccagg

SEQ ID NO: 1982447 - RNA, 20 nt, Human
gacacauguccaagaagccc

SEQ ID NO: 1982448 - RNA, 15 nt, Human
gacacauguccaaga

SEQ ID NO: 1982449 - RNA, 19 nt, Human
gacacaugcaaggucauuu

SEQ ID NO: 1982450 - RNA, 23 nt, Human
gacacauuuaagguguaguauua

SEQ ID NO: 1982451 - RNA, 14 nt, Human
gacacaugcaaggu

SEQ ID NO: 1982452 - RNA, 20 nt, Human
gacacaggcccggcuccagg

SEQ ID NO: 1982453 - RNA, 21 nt, Human
gacacaggcccggcuccaggc

SEQ ID NO: 1982454 - RNA, 16 nt, Human
gacacaagccuucggc

SEQ ID NO: 1982455 - RNA, 15 nt, Human
gacacaaacugccaa

SEQ ID NO: 1982456 - RNA, 19 nt, Human
gacacaggcccggcuccag

SEQ ID NO: 1982457 - RNA, 20 nt, Human
gacaaugugaaaagaaaaau

SEQ ID NO: 1982458 - RNA, 19 nt, Human
gacaaugugaaaagaaaaa

SEQ ID NO: 1982459 - RNA, 13 nt, Human
gacaauguuuaca

SEQ ID NO: 1982460 - RNA, 12 nt, Human
gacaauguuuac

SEQ ID NO: 1982461 - RNA, 18 nt, Human
gacaaugugaaaagaaaa

SEQ ID NO: 1982462 - RNA, 12 nt, Human
gacaaugugaaa

SEQ ID NO: 1982463 - RNA, 22 nt, Human
gacaaugcaaaccaucauugaa

SEQ ID NO: 1982464 - RNA, 21 nt, Human
gacaaggaugaucuaggaaga

SEQ ID NO: 1982465 - RNA, 18 nt, Human
gacaaggauugcuacugu

SEQ ID NO: 1982466 - RNA, 19 nt, Human
gacaaggauugcuacuguc

SEQ ID NO: 1982467 - RNA, 21 nt, Human
gacaaggauugcuacuguccu

SEQ ID NO: 1982468 - RNA, 21 nt, Human
gacaagcuguugaccaggcac

SEQ ID NO: 1982469 - RNA, 22 nt, Human
gacaagcuguugaccaggcacc

SEQ ID NO: 1982470 - RNA, 14 nt, Human
gacaagcuggcuua

SEQ ID NO: 1982471 - RNA, 20 nt, Human
gacaagcuggcuuacacugg

SEQ ID NO: 1982472 - RNA, 20 nt, Human
gacaagcuguugaccaggca

SEQ ID NO: 1982473 - RNA, 16 nt, Human
gacaaggaaaaaauaa

SEQ ID NO: 1982474 - RNA, 16 nt, Human
gaauggcagcugccac

SEQ ID NO: 1982475 - RNA, 13 nt, Human
gaauggcauuugc

SEQ ID NO: 1982476 - RNA, 13 nt, Human
gaauggcagcugc

SEQ ID NO: 1982477 - RNA, 21 nt, Human
gaaugcacaaacagaggccgc

SEQ ID NO: 1982478 - RNA, 21 nt, Human
gaaugcaccauacucaugcau

SEQ ID NO: 1982479 - RNA, 13 nt, Human
gaaugcacucaga

SEQ ID NO: 1982480 - RNA, 20 nt, Human
gaaugcacucagacuguaua

SEQ ID NO: 1982481 - RNA, 15 nt, Human
gaaugcuguauaugu

SEQ ID NO: 1982482 - RNA, 21 nt, Human
gaaugaaagggcccagagagg

SEQ ID NO: 1982483 - RNA, 21 nt, Human
gaaucuggaccccaucuguga

SEQ ID NO: 1982484 - RNA, 20 nt, Human
gaaugcacaaacagaggccg

SEQ ID NO: 1982485 - RNA, 16 nt, Human
gaaugaacaaagacca

SEQ ID NO: 1982486 - RNA, 14 nt, Human
gaaugaaauguaug

SEQ ID NO: 1982487 - RNA, 22 nt, Human
gaaucuggaccccaucugugaa

SEQ ID NO: 1982488 - RNA, 23 nt, Human
gaaucuggaccccaucugugaau

SEQ ID NO: 1982489 - RNA, 21 nt, Human
gaaucaugugcgucaguccaa

SEQ ID NO: 1982490 - RNA, 13 nt, Human
gaaucauguuucu

SEQ ID NO: 1982491 - RNA, 14 nt, Human
gaaucauguuucuu

SEQ ID NO: 1982492 - RNA, 15 nt, Human
gaaucauguuucuuu

SEQ ID NO: 1982493 - RNA, 17 nt, Human
gaaucauguuucuuuga

SEQ ID NO: 1982494 - RNA, 12 nt, Human
gaaaggcuccag

SEQ ID NO: 1982495 - RNA, 17 nt, Human
gaaucuagccagugaac

SEQ ID NO: 1982496 - RNA, 18 nt, Human
gaaucuagccagugaaca

SEQ ID NO: 1982497 - RNA, 18 nt, Human
gaauccagacccggcugc

SEQ ID NO: 1982498 - RNA, 20 nt, Human
gaauccagacccggcugcgu

SEQ ID NO: 1982499 - RNA, 21 nt, Human
gaauguuccugccuccuugau

SEQ ID NO: 1982500 - RNA, 22 nt, Human
gaauguuccugccuccuugaua

SEQ ID NO: 1982501 - RNA, 16 nt, Human
gaauugacccacaaga

SEQ ID NO: 1982502 - RNA, 21 nt, Human
gaauugacccacaagaaauga

SEQ ID NO: 1982503 - RNA, 11 nt, Human
gaauugaaggu

SEQ ID NO: 1982504 - RNA, 18 nt, Human
gaauugaagguuuuugau

SEQ ID NO: 1982505 - RNA, 21 nt, Human
gaauugaccgacagcuuucca

SEQ ID NO: 1982506 - RNA, 20 nt, Human
gaauugcccauuguuuuucu

SEQ ID NO: 1982507 - RNA, 21 nt, Human
gaauugcccauuguuuuucug

SEQ ID NO: 1982508 - RNA, 19 nt, Human
gaaugucaguauguggaag

SEQ ID NO: 1982509 - RNA, 22 nt, Human
gaaugucaguuguuauuuauug

SEQ ID NO: 1982510 - RNA, 13 nt, Human
gaaugucagugug

SEQ ID NO: 1982511 - RNA, 13 nt, Human
gaaugucaguaug

SEQ ID NO: 1982512 - RNA, 16 nt, Human
gaaugucaguaugugg

SEQ ID NO: 1982513 - RNA, 18 nt, Human
gaaugucaguauguggaa

SEQ ID NO: 1982514 - RNA, 14 nt, Human
gaauguaguuugag

SEQ ID NO: 1982515 - RNA, 16 nt, Human
gaauguaguuugagga

SEQ ID NO: 1982516 - RNA, 17 nt, Human
gaauguaguuugaggaa

SEQ ID NO: 1982517 - RNA, 22 nt, Human
gaauguaguuugaggaaauuug

SEQ ID NO: 1982518 - RNA, 15 nt, Human
gaauguauaguauuu

SEQ ID NO: 1982519 - RNA, 17 nt, Human
gaauguauaguauuuga

SEQ ID NO: 1982520 - RNA, 19 nt, Human
gaauguauaguauuugaaa

SEQ ID NO: 1982521 - RNA, 22 nt, Human
gaauguauaguauuugaaaaca

SEQ ID NO: 1982522 - RNA, 18 nt, Human
gaauggcauuugcaauaa

SEQ ID NO: 1982523 - RNA, 13 nt, Human
gacagccagaacu

SEQ ID NO: 1982524 - RNA, 21 nt, Human
gacagcugccugggaucccuc

SEQ ID NO: 1982525 - RNA, 18 nt, Human
gacagcugccugggaucc

SEQ ID NO: 1982526 - RNA, 17 nt, Human
gacagcugccugggauc

SEQ ID NO: 1982527 - RNA, 16 nt, Human
gacagcugccugggau

SEQ ID NO: 1982528 - RNA, 20 nt, Human
gacagccacggccaggccag

SEQ ID NO: 1982529 - RNA, 21 nt, Human
gacagccacggccaggccaga

SEQ ID NO: 1982530 - RNA, 20 nt, Human
gacagagugagacucugucu

SEQ ID NO: 1982531 - RNA, 22 nt, Human
gacagagugagacucugucuca

SEQ ID NO: 1982532 - RNA, 14 nt, Human
gacagccacggcca

SEQ ID NO: 1982533 - RNA, 17 nt, Human
gacagccacggccaggc

SEQ ID NO: 1982534 - RNA, 18 nt, Human
gacagccacggccaggcc

SEQ ID NO: 1982535 - RNA, 19 nt, Human
gacagccacggccaggcca

SEQ ID NO: 1982536 - RNA, 11 nt, Human
gacaccccacu

SEQ ID NO: 1982537 - RNA, 14 nt, Human
gacaccccacuuag

SEQ ID NO: 1982538 - RNA, 12 nt, Human
gacacccagaaa

SEQ ID NO: 1982539 - RNA, 21 nt, Human
gacagagcaagugagacccug

SEQ ID NO: 1982540 - RNA, 14 nt, Human
gacagaggcagccc

SEQ ID NO: 1982541 - RNA, 16 nt, Human
gacagaggcagcccca

SEQ ID NO: 1982542 - RNA, 20 nt, Human
gacagagcaaccccuggacc

SEQ ID NO: 1982543 - RNA, 19 nt, Human
gacagaggggguggccucc

SEQ ID NO: 1982544 - RNA, 18 nt, Human
gacagaggggguggccuc

SEQ ID NO: 1982545 - RNA, 15 nt, Human
gacagaggggguggc

SEQ ID NO: 1982546 - RNA, 17 nt, Human
gacagaggcagccccau

SEQ ID NO: 1982547 - RNA, 22 nt, Human
gacagaggggguggccucccaa

SEQ ID NO: 1982548 - RNA, 21 nt, Human
gacagaggggguggccuccca

SEQ ID NO: 1982549 - RNA, 23 nt, Human
gacagaggggguggccucccaac

SEQ ID NO: 1982550 - RNA, 14 nt, Human
gacagagucucacu

SEQ ID NO: 1982551 - RNA, 23 nt, Human
gacauccccccgccaaaagcugc

SEQ ID NO: 1982552 - RNA, 17 nt, Human
gacauccccugcuggcc

SEQ ID NO: 1982553 - RNA, 18 nt, Human
gacauccccugcuggccg

SEQ ID NO: 1982554 - RNA, 20 nt, Human
gacauccugucaucugagaa

SEQ ID NO: 1982555 - RNA, 21 nt, Human
gacauccugucaucugagaau

SEQ ID NO: 1982556 - RNA, 23 nt, Human
gacauccugucaucugagaauga

SEQ ID NO: 1982557 - RNA, 24 nt, Human
gacauccugucaucugagaaugaa

SEQ ID NO: 1982558 - RNA, 20 nt, Human
gacauagaauuaacacauga

SEQ ID NO: 1982559 - RNA, 22 nt, Human
gacaguuaagagaaaugagcuu

SEQ ID NO: 1982560 - RNA, 14 nt, Human
gacaugcacucagc

SEQ ID NO: 1982561 - RNA, 14 nt, Human
gacaugggaaaggg

SEQ ID NO: 1982562 - RNA, 14 nt, Human
gacaugaucuucuu

SEQ ID NO: 1982563 - RNA, 17 nt, Human
gacagggaggacgcucu

SEQ ID NO: 1982564 - RNA, 17 nt, Human
gacaggaccccugcagu

SEQ ID NO: 1982565 - RNA, 21 nt, Human
gacaggaccccugcaguuccc

SEQ ID NO: 1982566 - RNA, 14 nt, Human
gacaggaccccugc

SEQ ID NO: 1982567 - RNA, 23 nt, Human
gacaggaccagggauuuccauga

SEQ ID NO: 1982568 - RNA, 15 nt, Human
gacaggaccagggau

SEQ ID NO: 1982569 - RNA, 14 nt, Human
gacaggaccaggga

SEQ ID NO: 1982570 - RNA, 14 nt, Human
gacaguuaagagaa

SEQ ID NO: 1982571 - RNA, 24 nt, Human
gacagggcacaccgggcacucaga

SEQ ID NO: 1982572 - RNA, 23 nt, Human
gacagggcacaccgggcacucag

SEQ ID NO: 1982573 - RNA, 18 nt, Human
gacagggaggacgcucuc

SEQ ID NO: 1982574 - RNA, 16 nt, Human
gacagggaggugaccc

SEQ ID NO: 1982575 - RNA, 17 nt, Human
gaccgugaggccagaga

SEQ ID NO: 1982576 - RNA, 16 nt, Human
gaccgugaggccagag

SEQ ID NO: 1982577 - RNA, 18 nt, Human
gaccgugaggccagagac

SEQ ID NO: 1982578 - RNA, 19 nt, Human
gaccgugaggccagagaca

SEQ ID NO: 1982579 - RNA, 17 nt, Human
gaccuacuacgcagagg

SEQ ID NO: 1982580 - RNA, 19 nt, Human
gaccgaacuguuguauaaa

SEQ ID NO: 1982581 - RNA, 21 nt, Human
gacccuuguggucccacccca

SEQ ID NO: 1982582 - RNA, 20 nt, Human
gacccuuguggucccacccc

SEQ ID NO: 1982583 - RNA, 19 nt, Human
gacccuuguggucccaccc

SEQ ID NO: 1982584 - RNA, 12 nt, Human
gacccugucuca

SEQ ID NO: 1982585 - RNA, 16 nt, Human
gacccaaaaggcagaa

SEQ ID NO: 1982586 - RNA, 15 nt, Human
gacccacaagaaaug

SEQ ID NO: 1982587 - RNA, 22 nt, Human
gacccacaagaaaugaaagcag

SEQ ID NO: 1982588 - RNA, 21 nt, Human
gacccccaaccaaguggcucc

SEQ ID NO: 1982589 - RNA, 12 nt, Human
gacccccaacca

SEQ ID NO: 1982590 - RNA, 23 nt, Human
gacccugaggcccagagggccug

SEQ ID NO: 1982591 - RNA, 13 nt, Human
gacccugcacccu

SEQ ID NO: 1982592 - RNA, 14 nt, Human
gacccugcacccuc

SEQ ID NO: 1982593 - RNA, 16 nt, Human
gacccugcacccuccu

SEQ ID NO: 1982594 - RNA, 20 nt, Human
gacccugccaggcacaggca

SEQ ID NO: 1982595 - RNA, 21 nt, Human
gacccugccaggcacaggcag

SEQ ID NO: 1982596 - RNA, 22 nt, Human
gacccugccaggcacaggcagg

SEQ ID NO: 1982597 - RNA, 23 nt, Human
gacccugccaggcacaggcaggg

SEQ ID NO: 1982598 - RNA, 12 nt, Human
gacccugccagg

SEQ ID NO: 1982599 - RNA, 13 nt, Human
gacccugccaggc

SEQ ID NO: 1982600 - RNA, 14 nt, Human
gacccugccaggca

SEQ ID NO: 1982601 - RNA, 15 nt, Human
gacccugccaggcac

SEQ ID NO: 1982602 - RNA, 16 nt, Human
gacccugccaggcaca

SEQ ID NO: 1982603 - RNA, 17 nt, Human
gacccugccaggcacag

SEQ ID NO: 1982604 - RNA, 18 nt, Human
gacccugccaggcacagg

SEQ ID NO: 1982605 - RNA, 19 nt, Human
gacccugccaggcacaggc

SEQ ID NO: 1982606 - RNA, 14 nt, Human
gaccccuccaugug

SEQ ID NO: 1982607 - RNA, 18 nt, Human
gaccccuccaugugggcu

SEQ ID NO: 1982608 - RNA, 22 nt, Human
gacccugaggcccagagggccu

SEQ ID NO: 1982609 - RNA, 21 nt, Human
gaccccuccaugugggcuagu

SEQ ID NO: 1982610 - RNA, 17 nt, Human
gaccagagcugccaccu

SEQ ID NO: 1982611 - RNA, 15 nt, Human
gaccagagcugccac

SEQ ID NO: 1982612 - RNA, 14 nt, Human
gaccagagcugcca

SEQ ID NO: 1982613 - RNA, 13 nt, Human
gaccagagcugcc

SEQ ID NO: 1982614 - RNA, 19 nt, Human
gaccagagcugccaccugc

SEQ ID NO: 1982615 - RNA, 18 nt, Human
gaccagagcugccaccug

SEQ ID NO: 1982616 - RNA, 21 nt, Human
gaccagccuccaugcugccuc

SEQ ID NO: 1982617 - RNA, 22 nt, Human
gaccagccuccaugcugccucc

SEQ ID NO: 1982618 - RNA, 20 nt, Human
gaccagccuccaugcugccu

SEQ ID NO: 1982619 - RNA, 17 nt, Human
gaccagacaagcuguug

SEQ ID NO: 1982620 - RNA, 22 nt, Human
gaccauucuccaccugccaggg

SEQ ID NO: 1982621 - RNA, 21 nt, Human
gaccauucuccaccugccagg

SEQ ID NO: 1982622 - RNA, 11 nt, Human
gaccauuuucc

SEQ ID NO: 1982623 - RNA, 13 nt, Human
gaccauuuuccug

SEQ ID NO: 1982624 - RNA, 14 nt, Human
gaccauuuuccugc

SEQ ID NO: 1982625 - RNA, 19 nt, Human
gaccauuuuccugcauugg

SEQ ID NO: 1982626 - RNA, 17 nt, Human
gaccauucuccaccugc

SEQ ID NO: 1982627 - RNA, 20 nt, Human
gaccauucuccaccugccag

SEQ ID NO: 1982628 - RNA, 19 nt, Human
gaccauucuccaccugcca

SEQ ID NO: 1982629 - RNA, 18 nt, Human
gacaugggaaaggggaag

SEQ ID NO: 1982630 - RNA, 13 nt, Human
gaccaccugccca

SEQ ID NO: 1982631 - RNA, 14 nt, Human
gaccaccugcccaa

SEQ ID NO: 1982632 - RNA, 21 nt, Human
gaccacugcagaagacaguau

SEQ ID NO: 1982633 - RNA, 14 nt, Human
gaccacguuucuaa

SEQ ID NO: 1982634 - RNA, 11 nt, Human
gaccagagcug

SEQ ID NO: 1982635 - RNA, 19 nt, Human
gaccacgucuauuucauca

SEQ ID NO: 1982636 - RNA, 15 nt, Human
gaccacuuccagggg

SEQ ID NO: 1982637 - RNA, 22 nt, Human
gaccacuuccaggggaaccugc

SEQ ID NO: 1982638 - RNA, 23 nt, Human
gaccacuuccaggggaaccugcc

SEQ ID NO: 1982639 - RNA, 21 nt, Human
gagaagagccccacucucaga

SEQ ID NO: 1982640 - RNA, 16 nt, Human
gagaagcagaggaagg

SEQ ID NO: 1982641 - RNA, 11 nt, Human
gagaagagccc

SEQ ID NO: 1982642 - RNA, 15 nt, Human
gagaagagccccacu

SEQ ID NO: 1982643 - RNA, 16 nt, Human
gagaagagaaugcaca

SEQ ID NO: 1982644 - RNA, 18 nt, Human
gagaagaaaauguucuuc

SEQ ID NO: 1982645 - RNA, 11 nt, Human
gagaagaaaau

SEQ ID NO: 1982646 - RNA, 14 nt, Human
gagaacuugcugcc

SEQ ID NO: 1982647 - RNA, 16 nt, Human
gagaacuugcugccuc

SEQ ID NO: 1982648 - RNA, 14 nt, Human
gagaagagaaugca

SEQ ID NO: 1982649 - RNA, 12 nt, Human
gagaaaugaaaa

SEQ ID NO: 1982650 - RNA, 14 nt, Human
gagaaaugagcuug

SEQ ID NO: 1982651 - RNA, 21 nt, Human
gagaaaugaaaaaauauauau

SEQ ID NO: 1982652 - RNA, 22 nt, Human
gagaaaguacuucuccacccug

SEQ ID NO: 1982653 - RNA, 16 nt, Human
gagaaagguugaagca

SEQ ID NO: 1982654 - RNA, 10 nt, Human
gagaaaagaa

SEQ ID NO: 1982655 - RNA, 11 nt, Human
gagaaaagaaa

SEQ ID NO: 1982656 - RNA, 12 nt, Human
gagaaaagaaaa

SEQ ID NO: 1982657 - RNA, 13 nt, Human
gagaaaagaaaaa

SEQ ID NO: 1982658 - RNA, 14 nt, Human
gagaaaagaaaaaa

SEQ ID NO: 1982659 - RNA, 15 nt, Human
gagaaaagaaaaaaa

SEQ ID NO: 1982660 - RNA, 19 nt, Human
gagaaaagaaaaaaaaaga

SEQ ID NO: 1982661 - RNA, 20 nt, Human
gagaaaagaaaaaaaaagaa

SEQ ID NO: 1982662 - RNA, 19 nt, Human
gacuuaagcacacuugaca

SEQ ID NO: 1982663 - RNA, 21 nt, Human
gacuuaacauagccaaaaugu

SEQ ID NO: 1982664 - RNA, 23 nt, Human
gacuuaacauagccaaaauguga

SEQ ID NO: 1982665 - RNA, 19 nt, Human
gacuuaaaauauuccugca

SEQ ID NO: 1982666 - RNA, 17 nt, Human
gacuuaacauagccaaa

SEQ ID NO: 1982667 - RNA, 14 nt, Human
gacuucugcuggca

SEQ ID NO: 1982668 - RNA, 22 nt, Human
gacuugaaaagagacaggcagg

SEQ ID NO: 1982669 - RNA, 17 nt, Human
gacuugaaaagagacag

SEQ ID NO: 1982670 - RNA, 21 nt, Human
gacuugaaaagagacaggcag

SEQ ID NO: 1982671 - RNA, 11 nt, Human
gacuugaaaag

SEQ ID NO: 1982672 - RNA, 18 nt, Human
gacuucuguuuucaaucu

SEQ ID NO: 1982673 - RNA, 23 nt, Human
gacuucuguuuucaaucucguau

SEQ ID NO: 1982674 - RNA, 14 nt, Human
gacuucuguuuuca

SEQ ID NO: 1982675 - RNA, 16 nt, Human
gacuucuguuuucaau

SEQ ID NO: 1982676 - RNA, 17 nt, Human
gacuucuguuuucaauc

SEQ ID NO: 1982677 - RNA, 13 nt, Human
gacuuggaagcuc

SEQ ID NO: 1982678 - RNA, 13 nt, Human
gacuugcauuuuu

SEQ ID NO: 1982679 - RNA, 15 nt, Human
gacuugcauuuuugc

SEQ ID NO: 1982680 - RNA, 18 nt, Human
gacuuguauauucuauuu

SEQ ID NO: 1982681 - RNA, 9 nt, Human
gagaaaaga

SEQ ID NO: 1982682 - RNA, 21 nt, Human
gacuuguauauucuauuuuac

SEQ ID NO: 1982683 - RNA, 23 nt, Human
gacuagagggaccucucccaggg

SEQ ID NO: 1982684 - RNA, 20 nt, Human
gacuagagggaccucuccca

SEQ ID NO: 1982685 - RNA, 19 nt, Human
gacuagagggaccucuccc

SEQ ID NO: 1982686 - RNA, 17 nt, Human
gacuagagggaccucuc

SEQ ID NO: 1982687 - RNA, 14 nt, Human
gacucauucuucug

SEQ ID NO: 1982688 - RNA, 15 nt, Human
gacucauucuucugu

SEQ ID NO: 1982689 - RNA, 22 nt, Human
gaccucaaaugaugugccugcu

SEQ ID NO: 1982690 - RNA, 18 nt, Human
gacuacaggugugaguca

SEQ ID NO: 1982691 - RNA, 21 nt, Human
gacuacaggugugagucacca

SEQ ID NO: 1982692 - RNA, 13 nt, Human
gacuacaggugug

SEQ ID NO: 1982693 - RNA, 16 nt, Human
gaccucaaaugaugug

SEQ ID NO: 1982694 - RNA, 13 nt, Human
gacucgcgacaau

SEQ ID NO: 1982695 - RNA, 13 nt, Human
gacuccugcaggc

SEQ ID NO: 1982696 - RNA, 23 nt, Human
gacuccugcacacgcuccuuccu

SEQ ID NO: 1982697 - RNA, 12 nt, Human
gacuccugcagg

SEQ ID NO: 1982698 - RNA, 14 nt, Human
gacuccucugucca

SEQ ID NO: 1982699 - RNA, 11 nt, Human
gacuccucugu

SEQ ID NO: 1982700 - RNA, 14 nt, Human
gacuggaagcacag

SEQ ID NO: 1982701 - RNA, 15 nt, Human
gacuggaagcacagc

SEQ ID NO: 1982702 - RNA, 16 nt, Human
gacuggaagcacagcu

SEQ ID NO: 1982703 - RNA, 22 nt, Human
gacugcuccugagcccccagcu

SEQ ID NO: 1982704 - RNA, 18 nt, Human
gacuggaagcacagcuuc

SEQ ID NO: 1982705 - RNA, 16 nt, Human
gacugggccaggggag

SEQ ID NO: 1982706 - RNA, 16 nt, Human
gacugggggcagacau

SEQ ID NO: 1982707 - RNA, 23 nt, Human
gacugggggcagacauggugggg

SEQ ID NO: 1982708 - RNA, 17 nt, Human
gacucgcgacaaugcaa

SEQ ID NO: 1982709 - RNA, 18 nt, Human
gacucuaguacugugaau

SEQ ID NO: 1982710 - RNA, 19 nt, Human
gacucuaguacugugaauc

SEQ ID NO: 1982711 - RNA, 21 nt, Human
gacugaguacguugugcauuu

SEQ ID NO: 1982712 - RNA, 22 nt, Human
gacugaguacguugugcauuug

SEQ ID NO: 1982713 - RNA, 23 nt, Human
gacucuaguacugugaauccagu

SEQ ID NO: 1982714 - RNA, 15 nt, Human
gacugcccggcaggg

SEQ ID NO: 1982715 - RNA, 13 nt, Human
gacugcccggcag

SEQ ID NO: 1982716 - RNA, 23 nt, Human
gacugaguacguugugcauuugg

SEQ ID NO: 1982717 - RNA, 18 nt, Human
gagaugaugaaaauauuu

SEQ ID NO: 1982718 - RNA, 17 nt, Human
gagaugaggccgccaug

SEQ ID NO: 1982719 - RNA, 17 nt, Human
gagaugagaggggagag

SEQ ID NO: 1982720 - RNA, 18 nt, Human
gagaucacgccacugcac

SEQ ID NO: 1982721 - RNA, 19 nt, Human
gagaucacgccacugcacu

SEQ ID NO: 1982722 - RNA, 14 nt, Human
gagauagccaaggc

SEQ ID NO: 1982723 - RNA, 23 nt, Human
gagauacuuggucacagccaggc

SEQ ID NO: 1982724 - RNA, 16 nt, Human
gagauagccaaggcca

SEQ ID NO: 1982725 - RNA, 23 nt, Human
gagaucaaccccuucgcuccugu

SEQ ID NO: 1982726 - RNA, 13 nt, Human
gagcaacauuuua

SEQ ID NO: 1982727 - RNA, 22 nt, Human
gagcaaccccuggaccccagcc

SEQ ID NO: 1982728 - RNA, 18 nt, Human
gagcaacaagaaucuaaa

SEQ ID NO: 1982729 - RNA, 21 nt, Human
gagcaaccccuggaccccagc

SEQ ID NO: 1982730 - RNA, 14 nt, Human
gagcaagagagcag

SEQ ID NO: 1982731 - RNA, 15 nt, Human
gagcaagagagcagc

SEQ ID NO: 1982732 - RNA, 21 nt, Human
gagcaaggaagguaaaaaguu

SEQ ID NO: 1982733 - RNA, 18 nt, Human
gagcaagggcagggacag

SEQ ID NO: 1982734 - RNA, 11 nt, Human
gagcaagagga

SEQ ID NO: 1982735 - RNA, 20 nt, Human
gagcaccuuagacagucccu

SEQ ID NO: 1982736 - RNA, 21 nt, Human
gagcacuaaggugugcucuga

SEQ ID NO: 1982737 - RNA, 22 nt, Human
gagcaccuuagacagucccugc

SEQ ID NO: 1982738 - RNA, 21 nt, Human
gagcaccuuagacagucccug

SEQ ID NO: 1982739 - RNA, 15 nt, Human
gagcacuaaggugug

SEQ ID NO: 1982740 - RNA, 18 nt, Human
gagcacaacccccagcuc

SEQ ID NO: 1982741 - RNA, 19 nt, Human
gagcacaacccccagcucc

SEQ ID NO: 1982742 - RNA, 21 nt, Human
gagcauuggggauguuuuucu

SEQ ID NO: 1982743 - RNA, 15 nt, Human
gagcauuagauuucu

SEQ ID NO: 1982744 - RNA, 21 nt, Human
gagcauuagauuucucauuug

SEQ ID NO: 1982745 - RNA, 21 nt, Human
gagcauuauaaucaccagggc

SEQ ID NO: 1982746 - RNA, 22 nt, Human
gagcauuauaaucaccagggcc

SEQ ID NO: 1982747 - RNA, 23 nt, Human
gagcauuauaaucaccagggcca

SEQ ID NO: 1982748 - RNA, 13 nt, Human
gagcauuccaguc

SEQ ID NO: 1982749 - RNA, 20 nt, Human
gagccagauuucacucuccu

SEQ ID NO: 1982750 - RNA, 19 nt, Human
gagccaauuuaaagaaaac

SEQ ID NO: 1982751 - RNA, 16 nt, Human
gagcagagaauucucu

SEQ ID NO: 1982752 - RNA, 12 nt, Human
gagcagagacca

SEQ ID NO: 1982753 - RNA, 14 nt, Human
gagcauuacaggca

SEQ ID NO: 1982754 - RNA, 15 nt, Human
gagcauuacaggcaa

SEQ ID NO: 1982755 - RNA, 16 nt, Human
gagcauuacaggcaag

SEQ ID NO: 1982756 - RNA, 14 nt, Human
gagccagggucuca

SEQ ID NO: 1982757 - RNA, 23 nt, Human
gagccagauuucacucuccuugg

SEQ ID NO: 1982758 - RNA, 23 nt, Human
gagcccacuguacuugcucuuga

SEQ ID NO: 1982759 - RNA, 19 nt, Human
gagccagggucucacuaug

SEQ ID NO: 1982760 - RNA, 16 nt, Human
gagcccagaguccccc

SEQ ID NO: 1982761 - RNA, 18 nt, Human
gagcccagagucccccca

SEQ ID NO: 1982762 - RNA, 13 nt, Human
gagcccacugugc

SEQ ID NO: 1982763 - RNA, 18 nt, Human
gagcccugguggcagugg

SEQ ID NO: 1982764 - RNA, 21 nt, Human
gagcccaggagucccacucca

SEQ ID NO: 1982765 - RNA, 15 nt, Human
gagagagauguguaa

SEQ ID NO: 1982766 - RNA, 22 nt, Human
gagagagauguguaauuuuucu

SEQ ID NO: 1982767 - RNA, 19 nt, Human
gagagagcuucuguugcug

SEQ ID NO: 1982768 - RNA, 22 nt, Human
gagagagcuucuguugcugccu

SEQ ID NO: 1982769 - RNA, 11 nt, Human
gagagaaauau

SEQ ID NO: 1982770 - RNA, 13 nt, Human
gagagaaauauuu

SEQ ID NO: 1982771 - RNA, 15 nt, Human
gagagcaacauuuua

SEQ ID NO: 1982772 - RNA, 19 nt, Human
gagagauguguaauuuuuc

SEQ ID NO: 1982773 - RNA, 18 nt, Human
gagagauguguaauuuuu

SEQ ID NO: 1982774 - RNA, 18 nt, Human
gagagcccuagaaagcug

SEQ ID NO: 1982775 - RNA, 16 nt, Human
gagagcccuucauuug

SEQ ID NO: 1982776 - RNA, 13 nt, Human
gagaggggcacag

SEQ ID NO: 1982777 - RNA, 16 nt, Human
gagaggggaggccaag

SEQ ID NO: 1982778 - RNA, 18 nt, Human
gagaggggagagcugaac

SEQ ID NO: 1982779 - RNA, 14 nt, Human
gagaggggaggcca

SEQ ID NO: 1982780 - RNA, 19 nt, Human
gagaggggaacagacugga

SEQ ID NO: 1982781 - RNA, 16 nt, Human
gagagggugggagugg

SEQ ID NO: 1982782 - RNA, 20 nt, Human
gagagggugggagugggccc

SEQ ID NO: 1982783 - RNA, 23 nt, Human
gagagggugaguccuccagaacu

SEQ ID NO: 1982784 - RNA, 14 nt, Human
gagagggugggagu

SEQ ID NO: 1982785 - RNA, 16 nt, Human
gagaguggcuccuccc

SEQ ID NO: 1982786 - RNA, 21 nt, Human
gagaguggcuccucccggugc

SEQ ID NO: 1982787 - RNA, 14 nt, Human
gagaguuuagcugu

SEQ ID NO: 1982788 - RNA, 13 nt, Human
gagauacucuggg

SEQ ID NO: 1982789 - RNA, 21 nt, Human
gagauacuuggucacagccag

SEQ ID NO: 1982790 - RNA, 13 nt, Human
gagaguggcuccu

SEQ ID NO: 1982791 - RNA, 21 nt, Human
gagacuccugcaggcagccag

SEQ ID NO: 1982792 - RNA, 20 nt, Human
gagacuccugcaggcagcca

SEQ ID NO: 1982793 - RNA, 19 nt, Human
gagacuccugcaggcagcc

SEQ ID NO: 1982794 - RNA, 21 nt, Human
gagacucgcgacaaugcaaac

SEQ ID NO: 1982795 - RNA, 20 nt, Human
gagacucgcgacaaugcaaa

SEQ ID NO: 1982796 - RNA, 13 nt, Human
gagacucugucuc

SEQ ID NO: 1982797 - RNA, 16 nt, Human
gagacucuagggucca

SEQ ID NO: 1982798 - RNA, 19 nt, Human
gagacucuaggguccagug

SEQ ID NO: 1982799 - RNA, 20 nt, Human
gagacucuaggguccagugg

SEQ ID NO: 1982800 - RNA, 22 nt, Human
gagacugucccugaaaccuagu

SEQ ID NO: 1982801 - RNA, 13 nt, Human
gagacugucccug

SEQ ID NO: 1982802 - RNA, 17 nt, Human
gagaaugucaguaugug

SEQ ID NO: 1982803 - RNA, 20 nt, Human
gagacagcucugcauacuca

SEQ ID NO: 1982804 - RNA, 23 nt, Human
gagaaugcacaaacagaggccgc

SEQ ID NO: 1982805 - RNA, 22 nt, Human
gagaaugaacaaagaccaauuu

SEQ ID NO: 1982806 - RNA, 21 nt, Human
gagaccaucccugaaggcccc

SEQ ID NO: 1982807 - RNA, 18 nt, Human
gagaccaucccugaaggc

SEQ ID NO: 1982808 - RNA, 14 nt, Human
gagaccaucccuga

SEQ ID NO: 1982809 - RNA, 20 nt, Human
gagacaggguuucaccaugu

SEQ ID NO: 1982810 - RNA, 22 nt, Human
gagacaggguuuugccauguug

SEQ ID NO: 1982811 - RNA, 17 nt, Human
cugcugcuucauguuug

SEQ ID NO: 1982812 - RNA, 15 nt, Human
cugcuggcaucaaga

SEQ ID NO: 1982813 - RNA, 20 nt, Human
cugcuggccggacacccgac

SEQ ID NO: 1982814 - RNA, 15 nt, Human
cugcugcuggcuggu

SEQ ID NO: 1982815 - RNA, 23 nt, Human
cugcuuccagugaggcucugccc

SEQ ID NO: 1982816 - RNA, 21 nt, Human
cugcuuccagugaggcucugc

SEQ ID NO: 1982817 - RNA, 20 nt, Human
cugcuuccagugaggcucug

SEQ ID NO: 1982818 - RNA, 19 nt, Human
cugcuuccagugaggcucu

SEQ ID NO: 1982819 - RNA, 18 nt, Human
cugcuuccagugaggcuc

SEQ ID NO: 1982820 - RNA, 16 nt, Human
cugcuuccagugaggc

SEQ ID NO: 1982821 - RNA, 15 nt, Human
cugcuuccagugagg

SEQ ID NO: 1982822 - RNA, 11 nt, Human
cugcugggcuu

SEQ ID NO: 1982823 - RNA, 12 nt, Human
cugcuggcugcc

SEQ ID NO: 1982824 - RNA, 13 nt, Human
cugcugguucagg

SEQ ID NO: 1982825 - RNA, 15 nt, Human
cugcugguucagggu

SEQ ID NO: 1982826 - RNA, 23 nt, Human
cugcugguucaggguuggccccu

SEQ ID NO: 1982827 - RNA, 11 nt, Human
cugcugaaggc

SEQ ID NO: 1982828 - RNA, 14 nt, Human
cugcugcagagcag

SEQ ID NO: 1982829 - RNA, 15 nt, Human
cugcugcagagcagu

SEQ ID NO: 1982830 - RNA, 21 nt, Human
cugcugcagagcaguaaggga

SEQ ID NO: 1982831 - RNA, 21 nt, Human
cugcucuccucuugccacugc

SEQ ID NO: 1982832 - RNA, 17 nt, Human
cugcugaaggaauaaau

SEQ ID NO: 1982833 - RNA, 18 nt, Human
cugcugaaggaauaaauu

SEQ ID NO: 1982834 - RNA, 12 nt, Human
cugcugcccagc

SEQ ID NO: 1982835 - RNA, 15 nt, Human
cugcugcccagccuc

SEQ ID NO: 1982836 - RNA, 22 nt, Human
cugcugcccagccuccaagcuc

SEQ ID NO: 1982837 - RNA, 21 nt, Human
cugcugccaugaacugucaag

SEQ ID NO: 1982838 - RNA, 11 nt, Human
cugcugccagu

SEQ ID NO: 1982839 - RNA, 18 nt, Human
cugcugccaguaccagcc

SEQ ID NO: 1982840 - RNA, 16 nt, Human
cugcugccaugaacug

SEQ ID NO: 1982841 - RNA, 19 nt, Human
cugcucuccgaccagacac

SEQ ID NO: 1982842 - RNA, 14 nt, Human
cugcucuccucuug

SEQ ID NO: 1982843 - RNA, 20 nt, Human
cugcucuccucuugccacug

SEQ ID NO: 1982844 - RNA, 20 nt, Human
cugcuccagcuguucagcug

SEQ ID NO: 1982845 - RNA, 16 nt, Human
cugcgaggcuaugagu

SEQ ID NO: 1982846 - RNA, 19 nt, Human
cugcuccagcuguucagcu

SEQ ID NO: 1982847 - RNA, 19 nt, Human
cugcgaccacaagaaggau

SEQ ID NO: 1982848 - RNA, 19 nt, Human
cugccuuggggucagguug

SEQ ID NO: 1982849 - RNA, 20 nt, Human
cugccuuggggucagguuga

SEQ ID NO: 1982850 - RNA, 22 nt, Human
cugccuuggggucagguugaca

SEQ ID NO: 1982851 - RNA, 11 nt, Human
cugccucccau

SEQ ID NO: 1982852 - RNA, 14 nt, Human
cugccuaacaaaau

SEQ ID NO: 1982853 - RNA, 19 nt, Human
cugccucccaucacccgcu

SEQ ID NO: 1982854 - RNA, 16 nt, Human
cugccucccaucaccc

SEQ ID NO: 1982855 - RNA, 14 nt, Human
cugccucccaucac

SEQ ID NO: 1982856 - RNA, 12 nt, Human
cugccucccauc

SEQ ID NO: 1982857 - RNA, 22 nt, Human
cugccucucugcaggucccuaa

SEQ ID NO: 1982858 - RNA, 15 nt, Human
cugccucugacacac

SEQ ID NO: 1982859 - RNA, 22 nt, Human
cugccucugacacacagcucug

SEQ ID NO: 1982860 - RNA, 23 nt, Human
cugccucugacacacagcucugu

SEQ ID NO: 1982861 - RNA, 21 nt, Human
cugccucucugcaggucccua

SEQ ID NO: 1982862 - RNA, 20 nt, Human
cugccucucugcaggucccu

SEQ ID NO: 1982863 - RNA, 22 nt, Human
cugccuugcccacuccugcucu

SEQ ID NO: 1982864 - RNA, 21 nt, Human
cugccugggaucccucauccu

SEQ ID NO: 1982865 - RNA, 17 nt, Human
cugccuugcccacuccu

SEQ ID NO: 1982866 - RNA, 18 nt, Human
cugccuugcccacuccug

SEQ ID NO: 1982867 - RNA, 20 nt, Human
cugccuugcccacuccugcu

SEQ ID NO: 1982868 - RNA, 20 nt, Human
cugccugcccaggccccugc

SEQ ID NO: 1982869 - RNA, 15 nt, Human
cugccugaagucaca

SEQ ID NO: 1982870 - RNA, 16 nt, Human
cugccugcccaggccc

SEQ ID NO: 1982871 - RNA, 17 nt, Human
cugccugcccaggcccc

SEQ ID NO: 1982872 - RNA, 15 nt, Human
cugccucuucucuac

SEQ ID NO: 1982873 - RNA, 19 nt, Human
cugccucucugcagguccc

SEQ ID NO: 1982874 - RNA, 17 nt, Human
cucccuucccaccucuc

SEQ ID NO: 1982875 - RNA, 16 nt, Human
cucccuucccaccucu

SEQ ID NO: 1982876 - RNA, 15 nt, Human
cucccuucccaccuc

SEQ ID NO: 1982877 - RNA, 14 nt, Human
cucccuucccaccu

SEQ ID NO: 1982878 - RNA, 12 nt, Human
cugcccuccaag

SEQ ID NO: 1982879 - RNA, 22 nt, Human
cugcccugcugagucccaggcu

SEQ ID NO: 1982880 - RNA, 14 nt, Human
cugcccugcuguuu

SEQ ID NO: 1982881 - RNA, 20 nt, Human
cugcccugcgggucacagga

SEQ ID NO: 1982882 - RNA, 18 nt, Human
cugccgcagcccugcaga

SEQ ID NO: 1982883 - RNA, 17 nt, Human
cugccgcagcccugcag

SEQ ID NO: 1982884 - RNA, 15 nt, Human
cugccgcagcccugc

SEQ ID NO: 1982885 - RNA, 14 nt, Human
cugccgcagcccug

SEQ ID NO: 1982886 - RNA, 21 nt, Human
cugcccuuucugggcaccggg

SEQ ID NO: 1982887 - RNA, 14 nt, Human
cugcccuuuguccu

SEQ ID NO: 1982888 - RNA, 18 nt, Human
cugcccuuuguccuccug

SEQ ID NO: 1982889 - RNA, 20 nt, Human
cugcccuuuguccuccugcu

SEQ ID NO: 1982890 - RNA, 23 nt, Human
cugcccuuuguccuccugcugcc

SEQ ID NO: 1982891 - RNA, 23 nt, Human
cuggcugcagagcagugggccug

SEQ ID NO: 1982892 - RNA, 24 nt, Human
cuggcucuuccaggcugggagagc

SEQ ID NO: 1982893 - RNA, 22 nt, Human
cuggcucuuccaggcugggaga

SEQ ID NO: 1982894 - RNA, 21 nt, Human
cuggcucuuccaggcugggag

SEQ ID NO: 1982895 - RNA, 22 nt, Human
cuggccuugggauccaggcccc

SEQ ID NO: 1982896 - RNA, 23 nt, Human
cuggccuucggccuccauccuga

SEQ ID NO: 1982897 - RNA, 14 nt, Human
cuggccugugucua

SEQ ID NO: 1982898 - RNA, 19 nt, Human
cuggccuugggauccaggc

SEQ ID NO: 1982899 - RNA, 20 nt, Human
cuggccuugggauccaggcc

SEQ ID NO: 1982900 - RNA, 14 nt, Human
cuggcgugcagugg

SEQ ID NO: 1982901 - RNA, 15 nt, Human
cuggcgugcaguggu

SEQ ID NO: 1982902 - RNA, 19 nt, Human
cuggcccauguauggccag

SEQ ID NO: 1982903 - RNA, 21 nt, Human
cuggcccauguauggccagga

SEQ ID NO: 1982904 - RNA, 12 nt, Human
cuggccccacac

SEQ ID NO: 1982905 - RNA, 17 nt, Human
cuggccccacaccagcc

SEQ ID NO: 1982906 - RNA, 20 nt, Human
cuggccucugcacuccccug

SEQ ID NO: 1982907 - RNA, 18 nt, Human
cuggccucugcacucccc

SEQ ID NO: 1982908 - RNA, 21 nt, Human
cuggccucugcacuccccugc

SEQ ID NO: 1982909 - RNA, 16 nt, Human
cuggccucugcacucc

SEQ ID NO: 1982910 - RNA, 22 nt, Human
cuggccuucggccuccauccug

SEQ ID NO: 1982911 - RNA, 16 nt, Human
cuggccuggggucagg

SEQ ID NO: 1982912 - RNA, 18 nt, Human
cuggccuggggucaggcc

SEQ ID NO: 1982913 - RNA, 13 nt, Human
cuggccugucugu

SEQ ID NO: 1982914 - RNA, 18 nt, Human
cuggccugucugugaaga

SEQ ID NO: 1982915 - RNA, 24 nt, Human
cuggccuggccccucagggucccu

SEQ ID NO: 1982916 - RNA, 19 nt, Human
cuggccuggccccucaggg

SEQ ID NO: 1982917 - RNA, 13 nt, Human
cuggccuggcccc

SEQ ID NO: 1982918 - RNA, 20 nt, Human
cuggcacccggccccugcug

SEQ ID NO: 1982919 - RNA, 21 nt, Human
cuggcacccggccccugcugg

SEQ ID NO: 1982920 - RNA, 19 nt, Human
cuggcacccggccccugcu

SEQ ID NO: 1982921 - RNA, 20 nt, Human
cuggagugcagugagccgag

SEQ ID NO: 1982922 - RNA, 23 nt, Human
cuggcacugcuuccagugaggcu

SEQ ID NO: 1982923 - RNA, 20 nt, Human
cuggcacugcuuccagugag

SEQ ID NO: 1982924 - RNA, 19 nt, Human
cuggcacugcuuccaguga

SEQ ID NO: 1982925 - RNA, 22 nt, Human
cuggcacccggccccugcuggu

SEQ ID NO: 1982926 - RNA, 14 nt, Human
cuggcacuuggaga

SEQ ID NO: 1982927 - RNA, 18 nt, Human
cuggcacugcuuccagug

SEQ ID NO: 1982928 - RNA, 21 nt, Human
cuggcacuuggagacuuguau

SEQ ID NO: 1982929 - RNA, 14 nt, Human
cuggccagaugcac

SEQ ID NO: 1982930 - RNA, 22 nt, Human
cuggcaucaagaggugggaggg

SEQ ID NO: 1982931 - RNA, 23 nt, Human
cuggcaucaagaggugggagggc

SEQ ID NO: 1982932 - RNA, 21 nt, Human
cuggccaguggcuggaucugu

SEQ ID NO: 1982933 - RNA, 15 nt, Human
cuggcccacugcauc

SEQ ID NO: 1982934 - RNA, 15 nt, Human
cuggacucccucaag

SEQ ID NO: 1982935 - RNA, 16 nt, Human
cuggagcucugcccau

SEQ ID NO: 1982936 - RNA, 12 nt, Human
cuggagcucugc

SEQ ID NO: 1982937 - RNA, 13 nt, Human
cuggagcucugcc

SEQ ID NO: 1982938 - RNA, 17 nt, Human
cuggagguacgaaaaga

SEQ ID NO: 1982939 - RNA, 22 nt, Human
cuggagguacgaaaagagggga

SEQ ID NO: 1982940 - RNA, 12 nt, Human
cuggagguuugu

SEQ ID NO: 1982941 - RNA, 17 nt, Human
cuggagguuuguuuaga

SEQ ID NO: 1982942 - RNA, 14 nt, Human
cuggagugcaguga

SEQ ID NO: 1982943 - RNA, 15 nt, Human
cuggagugcagugag

SEQ ID NO: 1982944 - RNA, 16 nt, Human
cuggagugcagugagc

SEQ ID NO: 1982945 - RNA, 17 nt, Human
cuggagugcagugagcc

SEQ ID NO: 1982946 - RNA, 16 nt, Human
cuggaccuugaacugg

SEQ ID NO: 1982947 - RNA, 15 nt, Human
cuggacccuguggau

SEQ ID NO: 1982948 - RNA, 19 nt, Human
cuggaccccaucugugaau

SEQ ID NO: 1982949 - RNA, 20 nt, Human
cuggaccccaucugugaaua

SEQ ID NO: 1982950 - RNA, 22 nt, Human
cuggaccccaucugugaauaag

SEQ ID NO: 1982951 - RNA, 17 nt, Human
cuggaccccagccucaa

SEQ ID NO: 1982952 - RNA, 18 nt, Human
cuggacuccucuguccag

SEQ ID NO: 1982953 - RNA, 19 nt, Human
cuggacuccucuguccagg

SEQ ID NO: 1982954 - RNA, 14 nt, Human
cuggacuccucugu

SEQ ID NO: 1982955 - RNA, 17 nt, Human
cuggacuccucugucca

SEQ ID NO: 1982956 - RNA, 17 nt, Human
cuggaccuugaacuggg

SEQ ID NO: 1982957 - RNA, 20 nt, Human
cuggaccuugaacuggguac

SEQ ID NO: 1982958 - RNA, 21 nt, Human
cuggaccuugaacuggguacu

SEQ ID NO: 1982959 - RNA, 23 nt, Human
cuggacaggcauguucucugagg

SEQ ID NO: 1982960 - RNA, 14 nt, Human
cuggacaggccagg

SEQ ID NO: 1982961 - RNA, 14 nt, Human
cuggacaggcaugu

SEQ ID NO: 1982962 - RNA, 17 nt, Human
cuggacaggcauguucu

SEQ ID NO: 1982963 - RNA, 12 nt, Human
cuggaccccagc

SEQ ID NO: 1982964 - RNA, 13 nt, Human
cuggaccccagcc

SEQ ID NO: 1982965 - RNA, 14 nt, Human
cuggaccccagccu

SEQ ID NO: 1982966 - RNA, 15 nt, Human
cuggaccccagccuc

SEQ ID NO: 1982967 - RNA, 16 nt, Human
cuggaccccagccuca

SEQ ID NO: 1982968 - RNA, 17 nt, Human
cuggaccccaucuguga

SEQ ID NO: 1982969 - RNA, 18 nt, Human
cuggaccccaucugugaa

SEQ ID NO: 1982970 - RNA, 13 nt, Human
cuggaauuugaaa

SEQ ID NO: 1982971 - RNA, 16 nt, Human
cugcuuccuauaauuu

SEQ ID NO: 1982972 - RNA, 20 nt, Human
cugcuuccuauaauuuugau

SEQ ID NO: 1982973 - RNA, 14 nt, Human
cugcuuccucagag

SEQ ID NO: 1982974 - RNA, 14 nt, Human
cugugggcccccaa

SEQ ID NO: 1982975 - RNA, 21 nt, Human
cugugggcgugagaccugccc

SEQ ID NO: 1982976 - RNA, 22 nt, Human
cugugggcgugagaccugcccc

SEQ ID NO: 1982977 - RNA, 17 nt, Human
cuguggaugauaaaaca

SEQ ID NO: 1982978 - RNA, 18 nt, Human
cugugccucugggacugg

SEQ ID NO: 1982979 - RNA, 17 nt, Human
cugugccucugggacug

SEQ ID NO: 1982980 - RNA, 22 nt, Human
cugugcugcccugcccaccugg

SEQ ID NO: 1982981 - RNA, 16 nt, Human
cugugccucugggacu

SEQ ID NO: 1982982 - RNA, 14 nt, Human
cugugccucuggga

SEQ ID NO: 1982983 - RNA, 11 nt, Human
cugugccucug

SEQ ID NO: 1982984 - RNA, 23 nt, Human
cugucucaagagggcacuggugg

SEQ ID NO: 1982985 - RNA, 19 nt, Human
cugugaggggcucucucau

SEQ ID NO: 1982986 - RNA, 18 nt, Human
cugucuccauguuugaug

SEQ ID NO: 1982987 - RNA, 21 nt, Human
cugugaguacuacaguccucc

SEQ ID NO: 1982988 - RNA, 20 nt, Human
cugugaguacuacaguccuc

SEQ ID NO: 1982989 - RNA, 23 nt, Human
cugugaguacuacaguccuccca

SEQ ID NO: 1982990 - RNA, 17 nt, Human
cugugauggggcccugc

SEQ ID NO: 1982991 - RNA, 18 nt, Human
cugugauggggcccugcc

SEQ ID NO: 1982992 - RNA, 22 nt, Human
cugugaucccaguagaaaauau

SEQ ID NO: 1982993 - RNA, 20 nt, Human
cugugauggggcccugccuc

SEQ ID NO: 1982994 - RNA, 19 nt, Human
cugugauggggcccugccu

SEQ ID NO: 1982995 - RNA, 16 nt, Human
cugugccaugugccag

SEQ ID NO: 1982996 - RNA, 18 nt, Human
cugugccaugugccaggu

SEQ ID NO: 1982997 - RNA, 14 nt, Human
cugugccauuuugu

SEQ ID NO: 1982998 - RNA, 21 nt, Human
cuguucagcugguugagguuu

SEQ ID NO: 1982999 - RNA, 19 nt, Human
cuguucagcugguugaggu

SEQ ID NO: 1983000 - RNA, 20 nt, Human
cuguuacucaaugugugccg

SEQ ID NO: 1983001 - RNA, 13 nt, Human
cuguucagcuuuu

SEQ ID NO: 1983002 - RNA, 17 nt, Human
cuguucagcuuuuauuc

SEQ ID NO: 1983003 - RNA, 19 nt, Human
cuguucagcuuuuauuccu

SEQ ID NO: 1983004 - RNA, 20 nt, Human
cuguucagcuuuuauuccug

SEQ ID NO: 1983005 - RNA, 13 nt, Human
cuguuacugucuu

SEQ ID NO: 1983006 - RNA, 16 nt, Human
cuguuaccauuggaaa

SEQ ID NO: 1983007 - RNA, 17 nt, Human
cuguuaccauuggaaau

SEQ ID NO: 1983008 - RNA, 19 nt, Human
cuguuaccauuggaaauuu

SEQ ID NO: 1983009 - RNA, 21 nt, Human
cuguuaccauuggaaauuuca

SEQ ID NO: 1983010 - RNA, 22 nt, Human
cuguuaccauuggaaauuucac

SEQ ID NO: 1983011 - RNA, 19 nt, Human
cuguuacacuuuuuggaag

SEQ ID NO: 1983012 - RNA, 18 nt, Human
cuguuacaaaauguaacu

SEQ ID NO: 1983013 - RNA, 19 nt, Human
cuguuacaaaauguaacug

SEQ ID NO: 1983014 - RNA, 22 nt, Human
cuguuacaaaauguaacuguua

SEQ ID NO: 1983015 - RNA, 18 nt, Human
cuguuacacuuuuuggaa

SEQ ID NO: 1983016 - RNA, 17 nt, Human
cuguucaugaaagauuc

SEQ ID NO: 1983017 - RNA, 18 nt, Human
cuguucaugaaagauuca

SEQ ID NO: 1983018 - RNA, 23 nt, Human
cuguucaugaaagauucaaugcc

SEQ ID NO: 1983019 - RNA, 17 nt, Human
cuguucccaccugcugg

SEQ ID NO: 1983020 - RNA, 18 nt, Human
cuguucccauucuugcau

SEQ ID NO: 1983021 - RNA, 17 nt, Human
cuguucucugcccucca

SEQ ID NO: 1983022 - RNA, 16 nt, Human
cuguucucugcccucc

SEQ ID NO: 1983023 - RNA, 15 nt, Human
cuguucucugcccuc

SEQ ID NO: 1983024 - RNA, 14 nt, Human
cuguucucugcccu

SEQ ID NO: 1983025 - RNA, 19 nt, Human
cuguucucugcccuccaag

SEQ ID NO: 1983026 - RNA, 18 nt, Human
cuguucucugcccuccaa

SEQ ID NO: 1983027 - RNA, 20 nt, Human
cuguucucugcccuccaaga

SEQ ID NO: 1983028 - RNA, 13 nt, Human
cuguucucugccc

SEQ ID NO: 1983029 - RNA, 11 nt, Human
cuguuaaaaug

SEQ ID NO: 1983030 - RNA, 12 nt, Human
cuguuaaaaugc

SEQ ID NO: 1983031 - RNA, 13 nt, Human
cuguuaaaaugca

SEQ ID NO: 1983032 - RNA, 14 nt, Human
cuguuaaaaugcau

SEQ ID NO: 1983033 - RNA, 23 nt, Human
cuguuaaaaugcaugauugcaga

SEQ ID NO: 1983034 - RNA, 17 nt, Human
cuguuacaaaauguaac

SEQ ID NO: 1983035 - RNA, 22 nt, Human
cuguguuugcuccccuuccccu

SEQ ID NO: 1983036 - RNA, 14 nt, Human
cuguguuugcuccc

SEQ ID NO: 1983037 - RNA, 19 nt, Human
cuguguuugcuccccuucc

SEQ ID NO: 1983038 - RNA, 12 nt, Human
cuguguuuauuc

SEQ ID NO: 1983039 - RNA, 21 nt, Human
cuguguuuauucaaacugaaa

SEQ ID NO: 1983040 - RNA, 19 nt, Human
cuguguuugaacugaaguc

SEQ ID NO: 1983041 - RNA, 16 nt, Human
cuguguguugccuggg

SEQ ID NO: 1983042 - RNA, 17 nt, Human
cuguguuuacagagaug

SEQ ID NO: 1983043 - RNA, 16 nt, Human
cuguguguuuaugugu

SEQ ID NO: 1983044 - RNA, 17 nt, Human
cuguguguuuaugugug

SEQ ID NO: 1983045 - RNA, 20 nt, Human
cugugugugcgccuacagga

SEQ ID NO: 1983046 - RNA, 21 nt, Human
cugugucuugcaauggcagcc

SEQ ID NO: 1983047 - RNA, 22 nt, Human
cugugucuugcaauggcagccu

SEQ ID NO: 1983048 - RNA, 23 nt, Human
cugugucuugcaauggcagccuu

SEQ ID NO: 1983049 - RNA, 23 nt, Human
cugugggcgugagaccugccccu

SEQ ID NO: 1983050 - RNA, 21 nt, Human
cugugugcucaggagcccugg

SEQ ID NO: 1983051 - RNA, 20 nt, Human
cugugugcucaggagcccug

SEQ ID NO: 1983052 - RNA, 16 nt, Human
cugugugcucaggagc

SEQ ID NO: 1983053 - RNA, 19 nt, Human
cugugugcucaggagcccu

SEQ ID NO: 1983054 - RNA, 15 nt, Human
cuguguggcagucug

SEQ ID NO: 1983055 - RNA, 23 nt, Human
cugugugcucaggagcccuggga

SEQ ID NO: 1983056 - RNA, 21 nt, Human
cugguacaauuucuuuugguu

SEQ ID NO: 1983057 - RNA, 18 nt, Human
cuggguacugaaagccuu

SEQ ID NO: 1983058 - RNA, 19 nt, Human
cugguacaauuucuuuugg

SEQ ID NO: 1983059 - RNA, 20 nt, Human
cugguacaauuucuuuuggu

SEQ ID NO: 1983060 - RNA, 17 nt, Human
cuggguucuacccaggu

SEQ ID NO: 1983061 - RNA, 16 nt, Human
cuggguucuacccagg

SEQ ID NO: 1983062 - RNA, 15 nt, Human
cuggguucuacccag

SEQ ID NO: 1983063 - RNA, 14 nt, Human
cuggguucuaccca

SEQ ID NO: 1983064 - RNA, 21 nt, Human
cuggggucaggccgggcagag

SEQ ID NO: 1983065 - RNA, 24 nt, Human
cuggggucaggccgggcagagcac

SEQ ID NO: 1983066 - RNA, 17 nt, Human
cuggguacugaaagccu

SEQ ID NO: 1983067 - RNA, 20 nt, Human
cuggguaacuagggaagaua

SEQ ID NO: 1983068 - RNA, 22 nt, Human
cuggguaacuagggaagauaau

SEQ ID NO: 1983069 - RNA, 24 nt, Human
cugggcuucaguggcagcugcuuu

SEQ ID NO: 1983070 - RNA, 15 nt, Human
cuggggcugcuguga

SEQ ID NO: 1983071 - RNA, 13 nt, Human
cugggggaagaag

SEQ ID NO: 1983072 - RNA, 22 nt, Human
cugggggggauuguaaaauggu

SEQ ID NO: 1983073 - RNA, 19 nt, Human
cugggggcugggcagagga

SEQ ID NO: 1983074 - RNA, 15 nt, Human
cugggggaagaagcu

SEQ ID NO: 1983075 - RNA, 13 nt, Human
cugggggaugggc

SEQ ID NO: 1983076 - RNA, 16 nt, Human
cugggggaugggccug

SEQ ID NO: 1983077 - RNA, 18 nt, Human
cugggggaugggccugag

SEQ ID NO: 1983078 - RNA, 23 nt, Human
cuggucaaacaaacucucugaac

SEQ ID NO: 1983079 - RNA, 18 nt, Human
cuggucaaacaaacucuc

SEQ ID NO: 1983080 - RNA, 17 nt, Human
cuggucaaacaaacucu

SEQ ID NO: 1983081 - RNA, 18 nt, Human
cuggucacaggacucugc

SEQ ID NO: 1983082 - RNA, 23 nt, Human
cugguggcagcucaccucucccu

SEQ ID NO: 1983083 - RNA, 21 nt, Human
cugguggcagcucaccucucc

SEQ ID NO: 1983084 - RNA, 12 nt, Human
cuggugcugcca

SEQ ID NO: 1983085 - RNA, 13 nt, Human
cuggugcugccac

SEQ ID NO: 1983086 - RNA, 20 nt, Human
cuggugcugccacacuucag

SEQ ID NO: 1983087 - RNA, 22 nt, Human
cuggugcugccacacuucaggc

SEQ ID NO: 1983088 - RNA, 13 nt, Human
cugguggcagcug

SEQ ID NO: 1983089 - RNA, 14 nt, Human
cugguggcagcugc

SEQ ID NO: 1983090 - RNA, 20 nt, Human
cugguggcccgacagccugg

SEQ ID NO: 1983091 - RNA, 21 nt, Human
cugguggcccgacagccuggc

SEQ ID NO: 1983092 - RNA, 22 nt, Human
cugguggcccgacagccuggca

SEQ ID NO: 1983093 - RNA, 23 nt, Human
cugguggcccgacagccuggcac

SEQ ID NO: 1983094 - RNA, 23 nt, Human
cuguaaucacagcuacuugggag

SEQ ID NO: 1983095 - RNA, 13 nt, Human
cugguuccucccc

SEQ ID NO: 1983096 - RNA, 16 nt, Human
cugguuccauggccuc

SEQ ID NO: 1983097 - RNA, 17 nt, Human
cuggugcugcaguaugu

SEQ ID NO: 1983098 - RNA, 12 nt, Human
cugguuccuccc

SEQ ID NO: 1983099 - RNA, 15 nt, Human
cuguacaaaguagaa

SEQ ID NO: 1983100 - RNA, 13 nt, Human
cuguacaaaguag

SEQ ID NO: 1983101 - RNA, 14 nt, Human
cuguaauuauuuga

SEQ ID NO: 1983102 - RNA, 15 nt, Human
cuguaauuauuugaa

SEQ ID NO: 1983103 - RNA, 21 nt, Human
cuguaauaacuagaacaaaua

SEQ ID NO: 1983104 - RNA, 16 nt, Human
cuguaauguuaauaau

SEQ ID NO: 1983105 - RNA, 20 nt, Human
cuguaauccuagcacuuugg

SEQ ID NO: 1983106 - RNA, 12 nt, Human
cuguccuccaag

SEQ ID NO: 1983107 - RNA, 12 nt, Human
cuguccuaccuu

SEQ ID NO: 1983108 - RNA, 16 nt, Human
cugucuagcacuuccu

SEQ ID NO: 1983109 - RNA, 17 nt, Human
cugucuagcacuuccuu

SEQ ID NO: 1983110 - RNA, 18 nt, Human
cugucuagcacuuccuug

SEQ ID NO: 1983111 - RNA, 20 nt, Human
cugucuagcacuuccuugcc

SEQ ID NO: 1983112 - RNA, 21 nt, Human
cugucuagcacuuccuugcca

SEQ ID NO: 1983113 - RNA, 23 nt, Human
cugucuagcacuuccuugccagu

SEQ ID NO: 1983114 - RNA, 18 nt, Human
cugucucaaaaaaagaaa

SEQ ID NO: 1983115 - RNA, 22 nt, Human
cugucucaagagggcacuggug

SEQ ID NO: 1983116 - RNA, 16 nt, Human
cugucucaaaaaaaga

SEQ ID NO: 1983117 - RNA, 23 nt, Human
cugucucaaaaaaacacaaaagu

SEQ ID NO: 1983118 - RNA, 20 nt, Human
cuguccuaaggaaccuuccu

SEQ ID NO: 1983119 - RNA, 17 nt, Human
cuguccuaaggaaccuu

SEQ ID NO: 1983120 - RNA, 14 nt, Human
cuguccuacccacc

SEQ ID NO: 1983121 - RNA, 15 nt, Human
cuguccgagcuuuga

SEQ ID NO: 1983122 - RNA, 22 nt, Human
cugucccuuacgugaguccugg

SEQ ID NO: 1983123 - RNA, 20 nt, Human
cugucccuuacgugaguccu

SEQ ID NO: 1983124 - RNA, 14 nt, Human
cuguccgagcuuug

SEQ ID NO: 1983125 - RNA, 15 nt, Human
cugucccugaaaccu

SEQ ID NO: 1983126 - RNA, 22 nt, Human
cuguccccgcacugggcuuggg

SEQ ID NO: 1983127 - RNA, 19 nt, Human
cuguccccgcacugggcuu

SEQ ID NO: 1983128 - RNA, 18 nt, Human
cuguccccgcacugggcu

SEQ ID NO: 1983129 - RNA, 17 nt, Human
cuguccccgcacugggc

SEQ ID NO: 1983130 - RNA, 18 nt, Human
cugucaagaggcaaagga

SEQ ID NO: 1983131 - RNA, 13 nt, Human
cugucaaggcuca

SEQ ID NO: 1983132 - RNA, 14 nt, Human
cugucaaggcucag

SEQ ID NO: 1983133 - RNA, 12 nt, Human
cugucaaacauu

SEQ ID NO: 1983134 - RNA, 13 nt, Human
cugucaaacauua

SEQ ID NO: 1983135 - RNA, 15 nt, Human
cugucaaacauuagu

SEQ ID NO: 1983136 - RNA, 20 nt, Human
cugucaaacauuaguacuuu

SEQ ID NO: 1983137 - RNA, 21 nt, Human
cugucaaacauuaguacuuua

SEQ ID NO: 1983138 - RNA, 22 nt, Human
cugucaaacauuaguacuuuau

SEQ ID NO: 1983139 - RNA, 23 nt, Human
cugucaaacauuaguacuuuaua

SEQ ID NO: 1983140 - RNA, 23 nt, Human
cuguccaggcacugcugcccagc

SEQ ID NO: 1983141 - RNA, 17 nt, Human
cuguccaggcacugcug

SEQ ID NO: 1983142 - RNA, 23 nt, Human
cuguaucccaugagccucagcau

SEQ ID NO: 1983143 - RNA, 16 nt, Human
cuguauacguuucaaa

SEQ ID NO: 1983144 - RNA, 21 nt, Human
cuguauaucaggguacaaaaa

SEQ ID NO: 1983145 - RNA, 21 nt, Human
cuguauagacaggagaagaaa

SEQ ID NO: 1983146 - RNA, 13 nt, Human
cuguacagagccc

SEQ ID NO: 1983147 - RNA, 15 nt, Human
cuguacaaugacuuu

SEQ ID NO: 1983148 - RNA, 14 nt, Human
cuuauagacaacau

SEQ ID NO: 1983149 - RNA, 12 nt, Human
cuuauaaaacag

SEQ ID NO: 1983150 - RNA, 15 nt, Human
cuuauaaaacagagu

SEQ ID NO: 1983151 - RNA, 14 nt, Human
cuuauaaaacagag

SEQ ID NO: 1983152 - RNA, 20 nt, Human
cuuauccacgagagcgcagc

SEQ ID NO: 1983153 - RNA, 21 nt, Human
cuuauccacgagagcgcagca

SEQ ID NO: 1983154 - RNA, 19 nt, Human
cuuauaucuauauuuuaca

SEQ ID NO: 1983155 - RNA, 20 nt, Human
cuuauaucuaaaucugucca

SEQ ID NO: 1983156 - RNA, 13 nt, Human
cuuauauuaugga

SEQ ID NO: 1983157 - RNA, 14 nt, Human
cuuagucacugaga

SEQ ID NO: 1983158 - RNA, 19 nt, Human
cuuagucacugagacagcc

SEQ ID NO: 1983159 - RNA, 18 nt, Human
cuuagucacugagacagc

SEQ ID NO: 1983160 - RNA, 18 nt, Human
cuuagugggguuuuauau

SEQ ID NO: 1983161 - RNA, 20 nt, Human
cuuagugggguuuuauaucc

SEQ ID NO: 1983162 - RNA, 12 nt, Human
cuuaguggacag

SEQ ID NO: 1983163 - RNA, 13 nt, Human
cuuagauguauau

SEQ ID NO: 1983164 - RNA, 16 nt, Human
cuuagucacugagaca

SEQ ID NO: 1983165 - RNA, 19 nt, Human
cuuagauguauauauuucc

SEQ ID NO: 1983166 - RNA, 13 nt, Human
cuguucugguaau

SEQ ID NO: 1983167 - RNA, 16 nt, Human
cuguucuggcagaguu

SEQ ID NO: 1983168 - RNA, 16 nt, Human
cuguucugcacacagc

SEQ ID NO: 1983169 - RNA, 17 nt, Human
cuucaaagcaaaugucu

SEQ ID NO: 1983170 - RNA, 21 nt, Human
cuucaaaauauaaaaugccaa

SEQ ID NO: 1983171 - RNA, 21 nt, Human
cuucaaaaguuuguuugcuua

SEQ ID NO: 1983172 - RNA, 18 nt, Human
cuuauuuguauuuuuccu

SEQ ID NO: 1983173 - RNA, 18 nt, Human
cuuauuuaaugaaagacu

SEQ ID NO: 1983174 - RNA, 20 nt, Human
cuuaucucagauauuugcac

SEQ ID NO: 1983175 - RNA, 23 nt, Human
cuuauuucacuuuaguuuuugaa

SEQ ID NO: 1983176 - RNA, 17 nt, Human
cuuauuuaaugaaagac

SEQ ID NO: 1983177 - RNA, 20 nt, Human
cuuaucuagcugcauaucuu

SEQ ID NO: 1983178 - RNA, 15 nt, Human
cuuaucucagauauu

SEQ ID NO: 1983179 - RNA, 19 nt, Human
cuuaucucagauauuugca

SEQ ID NO: 1983180 - RNA, 15 nt, Human
cuuaucuagcugcau

SEQ ID NO: 1983181 - RNA, 16 nt, Human
cuucaaggauccugag

SEQ ID NO: 1983182 - RNA, 15 nt, Human
cuucaaggauccuga

SEQ ID NO: 1983183 - RNA, 13 nt, Human
cuucaaggauccu

SEQ ID NO: 1983184 - RNA, 10 nt, Human
cuucaaggau

SEQ ID NO: 1983185 - RNA, 18 nt, Human
cuucaagcugcuuuuugu

SEQ ID NO: 1983186 - RNA, 20 nt, Human
cuucaaccauuccccauggg

SEQ ID NO: 1983187 - RNA, 16 nt, Human
cuucaaccauucccca

SEQ ID NO: 1983188 - RNA, 23 nt, Human
cuucacagaugggugcuuggagg

SEQ ID NO: 1983189 - RNA, 23 nt, Human
cuucaaucaauaacagccgcucc

SEQ ID NO: 1983190 - RNA, 20 nt, Human
cuucaaucaauaacagccgc

SEQ ID NO: 1983191 - RNA, 15 nt, Human
cuuccaggggaaccu

SEQ ID NO: 1983192 - RNA, 16 nt, Human
cuuccaggggaaccug

SEQ ID NO: 1983193 - RNA, 19 nt, Human
cuuccaggggaaccugcca

SEQ ID NO: 1983194 - RNA, 21 nt, Human
cuuccaggggugggacacccu

SEQ ID NO: 1983195 - RNA, 17 nt, Human
cuuccaggggugggaca

SEQ ID NO: 1983196 - RNA, 15 nt, Human
cuuccagggguggga

SEQ ID NO: 1983197 - RNA, 14 nt, Human
cuuccagggguggg

SEQ ID NO: 1983198 - RNA, 12 nt, Human
cuuccaggcagc

SEQ ID NO: 1983199 - RNA, 13 nt, Human
cuuccaggcagcc

SEQ ID NO: 1983200 - RNA, 19 nt, Human
cuuccaggcugggagagcc

SEQ ID NO: 1983201 - RNA, 16 nt, Human
cuuccaggcugggaga

SEQ ID NO: 1983202 - RNA, 15 nt, Human
cuuccaggcugggag

SEQ ID NO: 1983203 - RNA, 13 nt, Human
cuucccccucccc

SEQ ID NO: 1983204 - RNA, 17 nt, Human
cuucccuacaguugaaa

SEQ ID NO: 1983205 - RNA, 23 nt, Human
cuucccgcucagcccucccugcc

SEQ ID NO: 1983206 - RNA, 18 nt, Human
cuucccgcucagcccucc

SEQ ID NO: 1983207 - RNA, 19 nt, Human
cuucccgcucagcccuccc

SEQ ID NO: 1983208 - RNA, 14 nt, Human
cuuccccuuccuuc

SEQ ID NO: 1983209 - RNA, 20 nt, Human
cuucccugguucaagcgauu

SEQ ID NO: 1983210 - RNA, 13 nt, Human
cuuccucccucau

SEQ ID NO: 1983211 - RNA, 14 nt, Human
cuuccuccauccuc

SEQ ID NO: 1983212 - RNA, 17 nt, Human
cuuccuccauccuccuc

SEQ ID NO: 1983213 - RNA, 23 nt, Human
cuuccuccauccuccuccuuccu

SEQ ID NO: 1983214 - RNA, 23 nt, Human
cuuccucauucccucgucuuucc

SEQ ID NO: 1983215 - RNA, 14 nt, Human
cuuccuccaaggac

SEQ ID NO: 1983216 - RNA, 13 nt, Human
cuuccuaauucca

SEQ ID NO: 1983217 - RNA, 17 nt, Human
cuuccuaauuccacagc

SEQ ID NO: 1983218 - RNA, 18 nt, Human
cuuccuaauuccacagcu

SEQ ID NO: 1983219 - RNA, 19 nt, Human
cuuccuaauuccacagcug

SEQ ID NO: 1983220 - RNA, 21 nt, Human
cuucccuugcuaccacggccu

SEQ ID NO: 1983221 - RNA, 14 nt, Human
cuuccaggcuggga

SEQ ID NO: 1983222 - RNA, 12 nt, Human
cuuccaggcugg

SEQ ID NO: 1983223 - RNA, 11 nt, Human
cuuccaggcag

SEQ ID NO: 1983224 - RNA, 16 nt, Human
cuuccacaagagccca

SEQ ID NO: 1983225 - RNA, 14 nt, Human
cuuccaccugcucu

SEQ ID NO: 1983226 - RNA, 15 nt, Human
cuuccaccugcucug

SEQ ID NO: 1983227 - RNA, 16 nt, Human
cuuccaccugcucugc

SEQ ID NO: 1983228 - RNA, 17 nt, Human
cuuccaccugcucugcu

SEQ ID NO: 1983229 - RNA, 18 nt, Human
cuuccaccugcucugcug

SEQ ID NO: 1983230 - RNA, 21 nt, Human
cuuccacaagagcccaggccu

SEQ ID NO: 1983231 - RNA, 19 nt, Human
cuuccacaagagcccaggc

SEQ ID NO: 1983232 - RNA, 17 nt, Human
cuuccacaagagcccag

SEQ ID NO: 1983233 - RNA, 20 nt, Human
cuucauucaacccaccugcg

SEQ ID NO: 1983234 - RNA, 17 nt, Human
cuucaguggcagcugcu

SEQ ID NO: 1983235 - RNA, 22 nt, Human
cuucagugccuuauggaacacu

SEQ ID NO: 1983236 - RNA, 18 nt, Human
cuucagugccuuauggaa

SEQ ID NO: 1983237 - RNA, 13 nt, Human
cuucaguggcagc

SEQ ID NO: 1983238 - RNA, 14 nt, Human
cuucaguggcagcu

SEQ ID NO: 1983239 - RNA, 15 nt, Human
cuucaguggcagcug

SEQ ID NO: 1983240 - RNA, 16 nt, Human
cuucaguggcagcugc

SEQ ID NO: 1983241 - RNA, 23 nt, Human
cuucaguaagccgugauuuucau

SEQ ID NO: 1983242 - RNA, 16 nt, Human
cuucaguaagccguga

SEQ ID NO: 1983243 - RNA, 15 nt, Human
cuucagggagugagg

SEQ ID NO: 1983244 - RNA, 20 nt, Human
cuucagggagucagcuguuu

SEQ ID NO: 1983245 - RNA, 15 nt, Human
cuucagggcagauuu

SEQ ID NO: 1983246 - RNA, 16 nt, Human
cuucagggcagauuuu

SEQ ID NO: 1983247 - RNA, 17 nt, Human
cuucagggcagauuuua

SEQ ID NO: 1983248 - RNA, 22 nt, Human
cuucagggcagauuuuaguuuu

SEQ ID NO: 1983249 - RNA, 18 nt, Human
cuucaccccaaucccagc

SEQ ID NO: 1983250 - RNA, 19 nt, Human
cuucaggcucuucuccuuu

SEQ ID NO: 1983251 - RNA, 22 nt, Human
cuucaggcucuucuccuuucac

SEQ ID NO: 1983252 - RNA, 17 nt, Human
cuucagggagucagcug

SEQ ID NO: 1983253 - RNA, 18 nt, Human
cuucagggagucagcugu

SEQ ID NO: 1983254 - RNA, 16 nt, Human
cuugagccugggaggu

SEQ ID NO: 1983255 - RNA, 19 nt, Human
cuugacguauuauuguccu

SEQ ID NO: 1983256 - RNA, 16 nt, Human
cuugaccugcugaagu

SEQ ID NO: 1983257 - RNA, 18 nt, Human
cuugaccucacucagaag

SEQ ID NO: 1983258 - RNA, 13 nt, Human
cuugacccugcac

SEQ ID NO: 1983259 - RNA, 14 nt, Human
cuugacccugcacc

SEQ ID NO: 1983260 - RNA, 15 nt, Human
cuugacccugcaccc

SEQ ID NO: 1983261 - RNA, 16 nt, Human
cuugacccugcacccu

SEQ ID NO: 1983262 - RNA, 18 nt, Human
cuugacccugcacccucc

SEQ ID NO: 1983263 - RNA, 22 nt, Human
cuugacccugcacccuccuagg

SEQ ID NO: 1983264 - RNA, 17 nt, Human
cuugagccuugaacuuu

SEQ ID NO: 1983265 - RNA, 18 nt, Human
cuugagccuugaacuuug

SEQ ID NO: 1983266 - RNA, 19 nt, Human
cuugagccugucaagaggc

SEQ ID NO: 1983267 - RNA, 15 nt, Human
cuugagccuugaacu

SEQ ID NO: 1983268 - RNA, 20 nt, Human
cuugaggaaacaacagcuuu

SEQ ID NO: 1983269 - RNA, 18 nt, Human
cuugaggaaacaacagcu

SEQ ID NO: 1983270 - RNA, 13 nt, Human
cuugaggaaacaa

SEQ ID NO: 1983271 - RNA, 21 nt, Human
cuugaggaaacaacagcuuua

SEQ ID NO: 1983272 - RNA, 21 nt, Human
cuugaggguugggcugguguc

SEQ ID NO: 1983273 - RNA, 19 nt, Human
cuugaggguugggcuggug

SEQ ID NO: 1983274 - RNA, 20 nt, Human
cuugaggguugggcuggugu

SEQ ID NO: 1983275 - RNA, 23 nt, Human
cuugaccauucuccaccugccag

SEQ ID NO: 1983276 - RNA, 22 nt, Human
cuugaccauucuccaccugcca

SEQ ID NO: 1983277 - RNA, 17 nt, Human
cuugaccgugaggccag

SEQ ID NO: 1983278 - RNA, 16 nt, Human
cuugaagacuuuucuu

SEQ ID NO: 1983279 - RNA, 20 nt, Human
cuugaccgugaggccagaga

SEQ ID NO: 1983280 - RNA, 18 nt, Human
cuugaccgugaggccaga

SEQ ID NO: 1983281 - RNA, 21 nt, Human
cuugaccgugaggccagagac

SEQ ID NO: 1983282 - RNA, 13 nt, Human
cuugaccucaggu

SEQ ID NO: 1983283 - RNA, 17 nt, Human
cuugaacuuugaccucu

SEQ ID NO: 1983284 - RNA, 21 nt, Human
cuugaacuuugaccucugcag

SEQ ID NO: 1983285 - RNA, 18 nt, Human
cuugaacuccugaccuca

SEQ ID NO: 1983286 - RNA, 14 nt, Human
cuugaaccauaaaa

SEQ ID NO: 1983287 - RNA, 17 nt, Human
cuugaaccauaaaaugu

SEQ ID NO: 1983288 - RNA, 13 nt, Human
cuugaacuccugg

SEQ ID NO: 1983289 - RNA, 13 nt, Human
cuugaacuccuga

SEQ ID NO: 1983290 - RNA, 16 nt, Human
cuugaacuccugaccu

SEQ ID NO: 1983291 - RNA, 18 nt, Human
cuugaaaauuaacaugaa

SEQ ID NO: 1983292 - RNA, 13 nt, Human
cuugaaaauuaac

SEQ ID NO: 1983293 - RNA, 12 nt, Human
cuugaaaauuaa

SEQ ID NO: 1983294 - RNA, 21 nt, Human
cuugaaaagagacaggcaggu

SEQ ID NO: 1983295 - RNA, 15 nt, Human
cuugaaaagagacag

SEQ ID NO: 1983296 - RNA, 18 nt, Human
cuugaaaagagacaggca

SEQ ID NO: 1983297 - RNA, 23 nt, Human
cuugaaaacacuguucucugccc

SEQ ID NO: 1983298 - RNA, 14 nt, Human
cuugaaaacacugu

SEQ ID NO: 1983299 - RNA, 18 nt, Human
cuugaaaaaugcauguug

SEQ ID NO: 1983300 - RNA, 12 nt, Human
cuugaaaaaugc

SEQ ID NO: 1983301 - RNA, 22 nt, Human
cuucuuuauaauucuacuuuga

SEQ ID NO: 1983302 - RNA, 17 nt, Human
cuucuuuuuuugugaug

SEQ ID NO: 1983303 - RNA, 21 nt, Human
cuucuguggguuucuaaagcu

SEQ ID NO: 1983304 - RNA, 14 nt, Human
cuucuguggguuuc

SEQ ID NO: 1983305 - RNA, 13 nt, Human
cuucuguggguuu

SEQ ID NO: 1983306 - RNA, 15 nt, Human
cuucuguggcucaca

SEQ ID NO: 1983307 - RNA, 22 nt, Human
cuucuguggcucacagaacccu

SEQ ID NO: 1983308 - RNA, 13 nt, Human
cuucuguggcuca

SEQ ID NO: 1983309 - RNA, 20 nt, Human
cuucugugcccagaauacug

SEQ ID NO: 1983310 - RNA, 21 nt, Human
cuucugugcccagaauacuga

SEQ ID NO: 1983311 - RNA, 14 nt, Human
cuucugugcccaga

SEQ ID NO: 1983312 - RNA, 19 nt, Human
cuucugugcccagaauacu

SEQ ID NO: 1983313 - RNA, 15 nt, Human
cuucuguccaagcag

SEQ ID NO: 1983314 - RNA, 15 nt, Human
cuucuguugcugccu

SEQ ID NO: 1983315 - RNA, 23 nt, Human
cuucugugcccagaauacugaug

SEQ ID NO: 1983316 - RNA, 17 nt, Human
cuucuguguuugaacug

SEQ ID NO: 1983317 - RNA, 21 nt, Human
cuucuguacgucugacaggca

SEQ ID NO: 1983318 - RNA, 14 nt, Human
cuucuguacgucug

SEQ ID NO: 1983319 - RNA, 15 nt, Human
cuucuguacgucuga

SEQ ID NO: 1983320 - RNA, 18 nt, Human
cuucuguacgucugacag

SEQ ID NO: 1983321 - RNA, 20 nt, Human
cuucuguacgucugacaggc

SEQ ID NO: 1983322 - RNA, 16 nt, Human
cuucuguccuacucug

SEQ ID NO: 1983323 - RNA, 17 nt, Human
cuucuguccuacucugu

SEQ ID NO: 1983324 - RNA, 18 nt, Human
cuucuguccuacucugug

SEQ ID NO: 1983325 - RNA, 19 nt, Human
cuucuguccuacucugugu

SEQ ID NO: 1983326 - RNA, 21 nt, Human
cuucuguccuacucuguguca

SEQ ID NO: 1983327 - RNA, 18 nt, Human
cuucuggugaccuuccaa

SEQ ID NO: 1983328 - RNA, 20 nt, Human
cuucuggugaccuuccaaga

SEQ ID NO: 1983329 - RNA, 21 nt, Human
cuucuggugaccuuccaagag

SEQ ID NO: 1983330 - RNA, 14 nt, Human
cuucugguugaugc

SEQ ID NO: 1983331 - RNA, 16 nt, Human
cuucuggguuccuucc

SEQ ID NO: 1983332 - RNA, 17 nt, Human
cuucuggguuccuuccu

SEQ ID NO: 1983333 - RNA, 23 nt, Human
cuucuggguuccuuccucugagc

SEQ ID NO: 1983334 - RNA, 13 nt, Human
cuucugcuucagc

SEQ ID NO: 1983335 - RNA, 23 nt, Human
cuucugccugaggggcagccugc

SEQ ID NO: 1983336 - RNA, 19 nt, Human
cuucucuccagccccugga

SEQ ID NO: 1983337 - RNA, 17 nt, Human
cuucucuccagccccug

SEQ ID NO: 1983338 - RNA, 15 nt, Human
cuucucuccagcccc

SEQ ID NO: 1983339 - RNA, 13 nt, Human
cuucucuccagcc

SEQ ID NO: 1983340 - RNA, 12 nt, Human
cuucucuccagc

SEQ ID NO: 1983341 - RNA, 19 nt, Human
cuucuccuucaccuuuguc

SEQ ID NO: 1983342 - RNA, 13 nt, Human
cuucucugaagga

SEQ ID NO: 1983343 - RNA, 13 nt, Human
cuucucucugcuc

SEQ ID NO: 1983344 - RNA, 14 nt, Human
cuucucucugcucu

SEQ ID NO: 1983345 - RNA, 20 nt, Human
cuucuccacuuucuagccag

SEQ ID NO: 1983346 - RNA, 11 nt, Human
cuucuccacuu

SEQ ID NO: 1983347 - RNA, 13 nt, Human
cuucuccacugga

SEQ ID NO: 1983348 - RNA, 14 nt, Human
cuucuccacuggau

SEQ ID NO: 1983349 - RNA, 15 nt, Human
cuucuccacuggaug

SEQ ID NO: 1983350 - RNA, 23 nt, Human
cuuccuggccggugugggggccc

SEQ ID NO: 1983351 - RNA, 18 nt, Human
cuuccugggcacacgcug

SEQ ID NO: 1983352 - RNA, 19 nt, Human
cuuccugggcacacgcugc

SEQ ID NO: 1983353 - RNA, 15 nt, Human
cuuccucccucauuc

SEQ ID NO: 1983354 - RNA, 20 nt, Human
cuuccugggcacacgcugcu

SEQ ID NO: 1983355 - RNA, 21 nt, Human
cuuccugggcacacgcugcuc

SEQ ID NO: 1983356 - RNA, 22 nt, Human
cuuccugggcacacgcugcucu

SEQ ID NO: 1983357 - RNA, 23 nt, Human
cuuccugggcacacgcugcucug

SEQ ID NO: 1983358 - RNA, 17 nt, Human
cuuccuggucgaaaguu

SEQ ID NO: 1983359 - RNA, 21 nt, Human
cuuccugucaagcaaucaaga

SEQ ID NO: 1983360 - RNA, 12 nt, Human
cuucuccaggcu

SEQ ID NO: 1983361 - RNA, 17 nt, Human
cuucuccacuggaugga

SEQ ID NO: 1983362 - RNA, 13 nt, Human
cuucuccaggcug

SEQ ID NO: 1983363 - RNA, 17 nt, Human
cuucucccccauccuac

SEQ ID NO: 1983364 - RNA, 15 nt, Human
cuucuccccuuccau

SEQ ID NO: 1983365 - RNA, 14 nt, Human
cuucuccccuucca

SEQ ID NO: 1983366 - RNA, 19 nt, Human
cuucuccccuuccauuucu

SEQ ID NO: 1983367 - RNA, 20 nt, Human
cuucuccccuuccauuucug

SEQ ID NO: 1983368 - RNA, 14 nt, Human
cuuugaccucugca

SEQ ID NO: 1983369 - RNA, 15 nt, Human
cuuugaccucugcag

SEQ ID NO: 1983370 - RNA, 12 nt, Human
cuuucuuccucu

SEQ ID NO: 1983371 - RNA, 13 nt, Human
cuuucuuccucug

SEQ ID NO: 1983372 - RNA, 14 nt, Human
cuuucuuccucugc

SEQ ID NO: 1983373 - RNA, 15 nt, Human
cuuucuuccucugcu

SEQ ID NO: 1983374 - RNA, 17 nt, Human
cuuugaccucugcagca

SEQ ID NO: 1983375 - RNA, 18 nt, Human
cuuugaccucugcagcaa

SEQ ID NO: 1983376 - RNA, 20 nt, Human
cuuugaccucugcagcaaua

SEQ ID NO: 1983377 - RNA, 24 nt, Human
cuuugaccucugcagcaauaaagc

SEQ ID NO: 1983378 - RNA, 21 nt, Human
cuuugcaguucccaucuccuu

SEQ ID NO: 1983379 - RNA, 16 nt, Human
cuuugcagacaggcaa

SEQ ID NO: 1983380 - RNA, 13 nt, Human
cuuugaccucugc

SEQ ID NO: 1983381 - RNA, 20 nt, Human
cuuugcagacaggcaagcac

SEQ ID NO: 1983382 - RNA, 15 nt, Human
cuuuguccccaccgc

SEQ ID NO: 1983383 - RNA, 20 nt, Human
cuuugucuaagaaacauugg

SEQ ID NO: 1983384 - RNA, 23 nt, Human
cuuugucuacuucaaaaguuugu

SEQ ID NO: 1983385 - RNA, 21 nt, Human
cuuugucuaagaaacauugga

SEQ ID NO: 1983386 - RNA, 23 nt, Human
cuuugucuaagaaacauuggaag

SEQ ID NO: 1983387 - RNA, 19 nt, Human
cuuugucuccucuauccug

SEQ ID NO: 1983388 - RNA, 15 nt, Human
cuuugugaggaagcc

SEQ ID NO: 1983389 - RNA, 14 nt, Human
cuuuguccccaccg

SEQ ID NO: 1983390 - RNA, 22 nt, Human
cuuuguauuguccuauuagugu

SEQ ID NO: 1983391 - RNA, 12 nt, Human
cuuuguauuguc

SEQ ID NO: 1983392 - RNA, 15 nt, Human
cuuuguauuguccua

SEQ ID NO: 1983393 - RNA, 16 nt, Human
cuuuguauuguccuau

SEQ ID NO: 1983394 - RNA, 22 nt, Human
cuuuggccugaugaccaauuuu

SEQ ID NO: 1983395 - RNA, 19 nt, Human
cuuuggcuaugagggccuu

SEQ ID NO: 1983396 - RNA, 19 nt, Human
cuuuggcuauuagagauca

SEQ ID NO: 1983397 - RNA, 16 nt, Human
cuuucccucccuuccu

SEQ ID NO: 1983398 - RNA, 14 nt, Human
cuuucccucccuuc

SEQ ID NO: 1983399 - RNA, 13 nt, Human
cuuucccucccuu

SEQ ID NO: 1983400 - RNA, 11 nt, Human
cuuucccuccc

SEQ ID NO: 1983401 - RNA, 12 nt, Human
cuuucccuucca

SEQ ID NO: 1983402 - RNA, 12 nt, Human
cuuuccugaggc

SEQ ID NO: 1983403 - RNA, 13 nt, Human
cuuucccuuccag

SEQ ID NO: 1983404 - RNA, 14 nt, Human
cuuucccuuccagu

SEQ ID NO: 1983405 - RNA, 14 nt, Human
cuuucccuuccucc

SEQ ID NO: 1983406 - RNA, 15 nt, Human
cuuucccaaaggcau

SEQ ID NO: 1983407 - RNA, 15 nt, Human
cuuuccaggaaggcu

SEQ ID NO: 1983408 - RNA, 23 nt, Human
cuuuccauauccauagugacuuu

SEQ ID NO: 1983409 - RNA, 15 nt, Human
cuuuccaucuacccu

SEQ ID NO: 1983410 - RNA, 14 nt, Human
cuuucucugaggac

SEQ ID NO: 1983411 - RNA, 15 nt, Human
cuuucucugaggaca

SEQ ID NO: 1983412 - RNA, 21 nt, Human
cuuucucuucauauucagcuu

SEQ ID NO: 1983413 - RNA, 15 nt, Human
cuuuccugaggcugg

SEQ ID NO: 1983414 - RNA, 13 nt, Human
cuuuccugaggcu

SEQ ID NO: 1983415 - RNA, 12 nt, Human
cuuucucugagg

SEQ ID NO: 1983416 - RNA, 15 nt, Human
cuuucccuuccucca

SEQ ID NO: 1983417 - RNA, 17 nt, Human
cuuucuggcuaugcauu

SEQ ID NO: 1983418 - RNA, 18 nt, Human
cuuucuggcuaugcauuu

SEQ ID NO: 1983419 - RNA, 19 nt, Human
cuuucuggcuaugcauuug

SEQ ID NO: 1983420 - RNA, 20 nt, Human
cuuucuggcuaugcauuuga

SEQ ID NO: 1983421 - RNA, 11 nt, Human
cuuucuuccuc

SEQ ID NO: 1983422 - RNA, 12 nt, Human
cuuucuuccuca

SEQ ID NO: 1983423 - RNA, 17 nt, Human
cuuucuuccucauuccc

SEQ ID NO: 1983424 - RNA, 21 nt, Human
cuuucuuccucauucccucgu

SEQ ID NO: 1983425 - RNA, 17 nt, Human
cuuucugggguuuuucu

SEQ ID NO: 1983426 - RNA, 18 nt, Human
cuuucugggguuuuucug

SEQ ID NO: 1983427 - RNA, 19 nt, Human
cuuucugggguuuuucugu

SEQ ID NO: 1983428 - RNA, 20 nt, Human
cuuucugggguuuuucuguu

SEQ ID NO: 1983429 - RNA, 20 nt, Human
cuuucugggcaccggggccu

SEQ ID NO: 1983430 - RNA, 16 nt, Human
cuuguaaauagcucag

SEQ ID NO: 1983431 - RNA, 23 nt, Human
cuugaguuguuuuuguauauugg

SEQ ID NO: 1983432 - RNA, 23 nt, Human
cuuggggggcugaggugggagga

SEQ ID NO: 1983433 - RNA, 21 nt, Human
cuugaguuguuuuuguauauu

SEQ ID NO: 1983434 - RNA, 22 nt, Human
cuugaguuguuuuuguauauug

SEQ ID NO: 1983435 - RNA, 21 nt, Human
cuugaguuggggccauugcuu

SEQ ID NO: 1983436 - RNA, 18 nt, Human
cuugaguuguuuuuguau

SEQ ID NO: 1983437 - RNA, 19 nt, Human
cuugaguuguuuuuguaua

SEQ ID NO: 1983438 - RNA, 20 nt, Human
cuugaguuguuuuuguauau

SEQ ID NO: 1983439 - RNA, 19 nt, Human
cuugaguuuaaauuguaau

SEQ ID NO: 1983440 - RNA, 15 nt, Human
cuuguacauaaugcg

SEQ ID NO: 1983441 - RNA, 12 nt, Human
cuuguacauaau

SEQ ID NO: 1983442 - RNA, 17 nt, Human
cuuguaaauagcucagg

SEQ ID NO: 1983443 - RNA, 18 nt, Human
cuuguaaauagcucaggu

SEQ ID NO: 1983444 - RNA, 19 nt, Human
cuuguacauaaugcgugca

SEQ ID NO: 1983445 - RNA, 21 nt, Human
cuuguacauaaugcgugcaua

SEQ ID NO: 1983446 - RNA, 22 nt, Human
cuuguacauaaugcgugcauac

SEQ ID NO: 1983447 - RNA, 21 nt, Human
cuuguaaauagcucagguguc

SEQ ID NO: 1983448 - RNA, 15 nt, Human
cuugucauuuugguc

SEQ ID NO: 1983449 - RNA, 15 nt, Human
cuuguauauucuauu

SEQ ID NO: 1983450 - RNA, 13 nt, Human
cuuguaguucuuu

SEQ ID NO: 1983451 - RNA, 15 nt, Human
cuuguaguucuuuaa

SEQ ID NO: 1983452 - RNA, 20 nt, Human
cuuguaguucuuuaaacugu

SEQ ID NO: 1983453 - RNA, 16 nt, Human
cuuguuauucaacagc

SEQ ID NO: 1983454 - RNA, 22 nt, Human
cuuuaccuuuuuuauacauaaa

SEQ ID NO: 1983455 - RNA, 12 nt, Human
cuuuaaaauucu

SEQ ID NO: 1983456 - RNA, 13 nt, Human
cuuuacuauggcc

SEQ ID NO: 1983457 - RNA, 16 nt, Human
cuuuagcaaagaacuc

SEQ ID NO: 1983458 - RNA, 19 nt, Human
cuuuauaauucuacuuuga

SEQ ID NO: 1983459 - RNA, 13 nt, Human
cuuuauaauucua

SEQ ID NO: 1983460 - RNA, 14 nt, Human
cuuuagcgcccagu

SEQ ID NO: 1983461 - RNA, 15 nt, Human
cuuuagcgcccaguu

SEQ ID NO: 1983462 - RNA, 15 nt, Human
cuuuaugcacaaaau

SEQ ID NO: 1983463 - RNA, 23 nt, Human
cuuuaucuugaauaauguaagac

SEQ ID NO: 1983464 - RNA, 19 nt, Human
cuuuaucuaccaacuuuca

SEQ ID NO: 1983465 - RNA, 20 nt, Human
cuuuaucuaccaacuuucaa

SEQ ID NO: 1983466 - RNA, 21 nt, Human
cuuuaucuaccaacuuucaag

SEQ ID NO: 1983467 - RNA, 22 nt, Human
cuuuaucuaccaacuuucaaga

SEQ ID NO: 1983468 - RNA, 21 nt, Human
cuuuaucuugaauaauguaag

SEQ ID NO: 1983469 - RNA, 18 nt, Human
cuuuaucuugaauaaugu

SEQ ID NO: 1983470 - RNA, 22 nt, Human
gaaagcagaacagugauuacca

SEQ ID NO: 1983471 - RNA, 17 nt, Human
gaaagcagaacagugau

SEQ ID NO: 1983472 - RNA, 22 nt, Human
gaaagaggguaauaaccagaca

SEQ ID NO: 1983473 - RNA, 16 nt, Human
gaaagaguaggaagac

SEQ ID NO: 1983474 - RNA, 15 nt, Human
gaaagaguaggaaga

SEQ ID NO: 1983475 - RNA, 21 nt, Human
gaaagaguacucuuguuuccu

SEQ ID NO: 1983476 - RNA, 18 nt, Human
gaaagaggcacccuucca

SEQ ID NO: 1983477 - RNA, 19 nt, Human
gaaagaggcacccuuccau

SEQ ID NO: 1983478 - RNA, 21 nt, Human
gaaagaggaaugaaguacuca

SEQ ID NO: 1983479 - RNA, 15 nt, Human
gaaagaggaaaagaa

SEQ ID NO: 1983480 - RNA, 16 nt, Human
gaaagaggaaaagaaa

SEQ ID NO: 1983481 - RNA, 17 nt, Human
gaaagacuguacaaagu

SEQ ID NO: 1983482 - RNA, 17 nt, Human
gaaacucuauggucuua

SEQ ID NO: 1983483 - RNA, 19 nt, Human
gaaagacuuuuccaacccu

SEQ ID NO: 1983484 - RNA, 14 nt, Human
gaaagcagggacuu

SEQ ID NO: 1983485 - RNA, 22 nt, Human
gaaagcccugagcuuucugcua

SEQ ID NO: 1983486 - RNA, 21 nt, Human
gaaagcccugagcuuucugcu

SEQ ID NO: 1983487 - RNA, 17 nt, Human
gaaagcccugagcuuuc

SEQ ID NO: 1983488 - RNA, 22 nt, Human
gaaagccuuucauuuugcuuua

SEQ ID NO: 1983489 - RNA, 23 nt, Human
gaaagccuuucauuuugcuuuaa

SEQ ID NO: 1983490 - RNA, 14 nt, Human
gaaagccuuucauu

SEQ ID NO: 1983491 - RNA, 17 nt, Human
gaaagccuuucauuuug

SEQ ID NO: 1983492 - RNA, 21 nt, Human
gaaagccuuucauuuugcuuu

SEQ ID NO: 1983493 - RNA, 18 nt, Human
gaaagccuuaagcugcag

SEQ ID NO: 1983494 - RNA, 19 nt, Human
gaaagccuuaagcugcagg

SEQ ID NO: 1983495 - RNA, 16 nt, Human
gaaagccuuagggaag

SEQ ID NO: 1983496 - RNA, 21 nt, Human
gaaagcugcugugaucccagu

SEQ ID NO: 1983497 - RNA, 14 nt, Human
gaaacaauuucugu

SEQ ID NO: 1983498 - RNA, 15 nt, Human
gaaaccaaagaagaa

SEQ ID NO: 1983499 - RNA, 16 nt, Human
gaaaccaaagaagaaa

SEQ ID NO: 1983500 - RNA, 19 nt, Human
gaaacccagcucuggucca

SEQ ID NO: 1983501 - RNA, 18 nt, Human
gaaacccagcucuggucc

SEQ ID NO: 1983502 - RNA, 16 nt, Human
gaaacccagcucuggu

SEQ ID NO: 1983503 - RNA, 15 nt, Human
gaaacccagcucugg

SEQ ID NO: 1983504 - RNA, 14 nt, Human
gaaacccagcucug

SEQ ID NO: 1983505 - RNA, 13 nt, Human
gaaacccagcucu

SEQ ID NO: 1983506 - RNA, 23 nt, Human
gaaacccagcucugguccauaga

SEQ ID NO: 1983507 - RNA, 19 nt, Human
gaaaccccuguaggccuca

SEQ ID NO: 1983508 - RNA, 17 nt, Human
gaaaccuaguacugccc

SEQ ID NO: 1983509 - RNA, 18 nt, Human
gaaaccuaguacugcccc

SEQ ID NO: 1983510 - RNA, 14 nt, Human
gaaacccugucucu

SEQ ID NO: 1983511 - RNA, 13 nt, Human
gaaaccugucuga

SEQ ID NO: 1983512 - RNA, 21 nt, Human
gaaacuagcuguuuaaaguuu

SEQ ID NO: 1983513 - RNA, 13 nt, Human
gaaacuaggucug

SEQ ID NO: 1983514 - RNA, 15 nt, Human
gaaacuccagaugcc

SEQ ID NO: 1983515 - RNA, 18 nt, Human
gaaacuaggucugauauu

SEQ ID NO: 1983516 - RNA, 11 nt, Human
cuuuuguucuu

SEQ ID NO: 1983517 - RNA, 12 nt, Human
cuuuuguucuug

SEQ ID NO: 1983518 - RNA, 15 nt, Human
cuuuguuaauuugga

SEQ ID NO: 1983519 - RNA, 16 nt, Human
cuuuuguucauuucau

SEQ ID NO: 1983520 - RNA, 18 nt, Human
cuuuuguucauuucaucc

SEQ ID NO: 1983521 - RNA, 19 nt, Human
cuuuuguucauuucauccu

SEQ ID NO: 1983522 - RNA, 20 nt, Human
cuuuguggauucugaggccc

SEQ ID NO: 1983523 - RNA, 18 nt, Human
cuuuguuaguuucuccaa

SEQ ID NO: 1983524 - RNA, 13 nt, Human
cuuuuuauuuaua

SEQ ID NO: 1983525 - RNA, 14 nt, Human
cuuuuuauuuauau

SEQ ID NO: 1983526 - RNA, 17 nt, Human
cuuuuuauuuauaugua

SEQ ID NO: 1983527 - RNA, 18 nt, Human
cuuuuuauuuauauguau

SEQ ID NO: 1983528 - RNA, 19 nt, Human
cuuuuuauuuauauguaug

SEQ ID NO: 1983529 - RNA, 12 nt, Human
cuuuuucuggac

SEQ ID NO: 1983530 - RNA, 16 nt, Human
cuuuuucuggacucug

SEQ ID NO: 1983531 - RNA, 19 nt, Human
cuuuuucuggacucuggac

SEQ ID NO: 1983532 - RNA, 12 nt, Human
cuuuuucuuaau

SEQ ID NO: 1983533 - RNA, 15 nt, Human
cuuuuucuuaaucau

SEQ ID NO: 1983534 - RNA, 22 nt, Human
cuuuuguucauuucauccuuuc

SEQ ID NO: 1983535 - RNA, 20 nt, Human
cuuuuguucuugguuuguaa

SEQ ID NO: 1983536 - RNA, 17 nt, Human
cuuuuuauggccuguga

SEQ ID NO: 1983537 - RNA, 16 nt, Human
cuuuuuuggcugcuga

SEQ ID NO: 1983538 - RNA, 15 nt, Human
gaaaaaggaggaaga

SEQ ID NO: 1983539 - RNA, 12 nt, Human
gaaaaaggagga

SEQ ID NO: 1983540 - RNA, 18 nt, Human
gaaaacacauuuuucuua

SEQ ID NO: 1983541 - RNA, 19 nt, Human
gaaaacacauuuuucuuag

SEQ ID NO: 1983542 - RNA, 18 nt, Human
gaaaacacuguucucugc

SEQ ID NO: 1983543 - RNA, 22 nt, Human
cuuuuuuggcugcugaaggcuc

SEQ ID NO: 1983544 - RNA, 20 nt, Human
cuuuuuuggcugcugaaggc

SEQ ID NO: 1983545 - RNA, 17 nt, Human
cuuuuuuggcugcugaa

SEQ ID NO: 1983546 - RNA, 16 nt, Human
cuuuuugaaaguaauu

SEQ ID NO: 1983547 - RNA, 13 nt, Human
gaaaacagaaauu

SEQ ID NO: 1983548 - RNA, 14 nt, Human
gaaaacagaaauug

SEQ ID NO: 1983549 - RNA, 15 nt, Human
gaaaacagaaauugg

SEQ ID NO: 1983550 - RNA, 20 nt, Human
gaaaacagaaauugguaccu

SEQ ID NO: 1983551 - RNA, 22 nt, Human
gaaaacacuguucucugcccuc

SEQ ID NO: 1983552 - RNA, 17 nt, Human
gaaaacacccagggaac

SEQ ID NO: 1983553 - RNA, 15 nt, Human
gaaaacacuguuauc

SEQ ID NO: 1983554 - RNA, 22 nt, Human
gaaaacacuguuaucauuuuuu

SEQ ID NO: 1983555 - RNA, 24 nt, Human
gaaaacacuguucucugcccucca

SEQ ID NO: 1983556 - RNA, 22 nt, Human
gaaaacguggcugcuucaagga

SEQ ID NO: 1983557 - RNA, 20 nt, Human
gaaaacguggcugcuucaag

SEQ ID NO: 1983558 - RNA, 19 nt, Human
gaaaagcugcugacagugu

SEQ ID NO: 1983559 - RNA, 19 nt, Human
gaaaacguggcugcuucaa

SEQ ID NO: 1983560 - RNA, 14 nt, Human
gaaaaguugaauuu

SEQ ID NO: 1983561 - RNA, 15 nt, Human
gaaaaguugaauuuu

SEQ ID NO: 1983562 - RNA, 16 nt, Human
gaaaaggccaagaggu

SEQ ID NO: 1983563 - RNA, 12 nt, Human
gaaaacuaaguu

SEQ ID NO: 1983564 - RNA, 14 nt, Human
gaaaagcuuuguuu

SEQ ID NO: 1983565 - RNA, 16 nt, Human
gaaaagcuuuguuugu

SEQ ID NO: 1983566 - RNA, 22 nt, Human
gaaaagcuuuguuuguucuugu

SEQ ID NO: 1983567 - RNA, 19 nt, Human
gaaaaggaagguaguucaa

SEQ ID NO: 1983568 - RNA, 13 nt, Human
gaaaauauuuaaa

SEQ ID NO: 1983569 - RNA, 16 nt, Human
gaaaauaaaaaaaaga

SEQ ID NO: 1983570 - RNA, 22 nt, Human
gaaaauaaaaaaaagaaaaaag

SEQ ID NO: 1983571 - RNA, 19 nt, Human
gaaaauaaaaaaagaaaaa

SEQ ID NO: 1983572 - RNA, 17 nt, Human
gaaaauaaaaaaaagaa

SEQ ID NO: 1983573 - RNA, 18 nt, Human
gaaaauaaaaaaaagaaa

SEQ ID NO: 1983574 - RNA, 19 nt, Human
gaaaauaaaaaaaagaaaa

SEQ ID NO: 1983575 - RNA, 21 nt, Human
gaaaauaaaaaaaagaaaaaa

SEQ ID NO: 1983576 - RNA, 22 nt, Human
gaaaaucagccugcuccagcug

SEQ ID NO: 1983577 - RNA, 20 nt, Human
gaaaaucagccugcuccagc

SEQ ID NO: 1983578 - RNA, 22 nt, Human
gaaaaucuacacuccagugaga

SEQ ID NO: 1983579 - RNA, 18 nt, Human
gaaaaucuuauaauuuaa

SEQ ID NO: 1983580 - RNA, 17 nt, Human
gaaaaucugaauuggaa

SEQ ID NO: 1983581 - RNA, 18 nt, Human
gaaaaucugaauuggaau

SEQ ID NO: 1983582 - RNA, 20 nt, Human
gaaaaucugaauuggaaugc

SEQ ID NO: 1983583 - RNA, 17 nt, Human
ccuggguuagacugcca

SEQ ID NO: 1983584 - RNA, 19 nt, Human
ccuggguuagacugccagc

SEQ ID NO: 1983585 - RNA, 20 nt, Human
ccuggguuagacugccagcu

SEQ ID NO: 1983586 - RNA, 21 nt, Human
ccuggguuagacugccagcuc

SEQ ID NO: 1983587 - RNA, 22 nt, Human
ccuggguuagacugccagcucu

SEQ ID NO: 1983588 - RNA, 20 nt, Human
ccugguccucacacucaccc

SEQ ID NO: 1983589 - RNA, 21 nt, Human
ccuggucgccuuccaccucug

SEQ ID NO: 1983590 - RNA, 16 nt, Human
ccuggucgccuuccac

SEQ ID NO: 1983591 - RNA, 21 nt, Human
ccugguggcagcucaccucuc

SEQ ID NO: 1983592 - RNA, 19 nt, Human
ccugguggcagcucaccuc

SEQ ID NO: 1983593 - RNA, 22 nt, Human
ccugguggcagcucaccucucc

SEQ ID NO: 1983594 - RNA, 14 nt, Human
ccugguggcagcug

SEQ ID NO: 1983595 - RNA, 15 nt, Human
ccugguggcagcugc

SEQ ID NO: 1983596 - RNA, 16 nt, Human
ccugguggcagcugcg

SEQ ID NO: 1983597 - RNA, 17 nt, Human
ccugguggcagcugcgg

SEQ ID NO: 1983598 - RNA, 18 nt, Human
ccugguggcagcugcggu

SEQ ID NO: 1983599 - RNA, 13 nt, Human
ccugucaggaggc

SEQ ID NO: 1983600 - RNA, 16 nt, Human
ccugucaggaggcaga

SEQ ID NO: 1983601 - RNA, 21 nt, Human
ccugucaucugagaaugaaca

SEQ ID NO: 1983602 - RNA, 15 nt, Human
ccugucccccugaca

SEQ ID NO: 1983603 - RNA, 14 nt, Human
ccugucccccugac

SEQ ID NO: 1983604 - RNA, 13 nt, Human
ccugucccccuga

SEQ ID NO: 1983605 - RNA, 12 nt, Human
ccugucccccug

SEQ ID NO: 1983606 - RNA, 10 nt, Human
ccuguaccuc

SEQ ID NO: 1983607 - RNA, 12 nt, Human
ccuguaccucuu

SEQ ID NO: 1983608 - RNA, 15 nt, Human
ccugguggcaguggg

SEQ ID NO: 1983609 - RNA, 13 nt, Human
ccuggucuuugag

SEQ ID NO: 1983610 - RNA, 20 nt, Human
ccuggucuuugagcucccac

SEQ ID NO: 1983611 - RNA, 13 nt, Human
ccugguggcagug

SEQ ID NO: 1983612 - RNA, 14 nt, Human
ccugguggcagugg

SEQ ID NO: 1983613 - RNA, 16 nt, Human
ccuguagagugggagc

SEQ ID NO: 1983614 - RNA, 15 nt, Human
ccuguagagugggag

SEQ ID NO: 1983615 - RNA, 13 nt, Human
ccuguagcccuaa

SEQ ID NO: 1983616 - RNA, 14 nt, Human
ccuggcaugggaau

SEQ ID NO: 1983617 - RNA, 21 nt, Human
ccugggguggggauagggagc

SEQ ID NO: 1983618 - RNA, 18 nt, Human
ccuggguacugaaagccu

SEQ ID NO: 1983619 - RNA, 22 nt, Human
ccuggggucaggccgggcagag

SEQ ID NO: 1983620 - RNA, 20 nt, Human
ccuggggucaggccgggcag

SEQ ID NO: 1983621 - RNA, 18 nt, Human
ccugggggcugggcagag

SEQ ID NO: 1983622 - RNA, 19 nt, Human
ccugggggcugggcagagg

SEQ ID NO: 1983623 - RNA, 21 nt, Human
ccugggggcugggcagaggaa

SEQ ID NO: 1983624 - RNA, 20 nt, Human
ccugggggcugggcagagga

SEQ ID NO: 1983625 - RNA, 22 nt, Human
ccugggaggucaaggcugcagu

SEQ ID NO: 1983626 - RNA, 16 nt, Human
ccugggagugagcugg

SEQ ID NO: 1983627 - RNA, 16 nt, Human
ccugggcagaaggaag

SEQ ID NO: 1983628 - RNA, 18 nt, Human
ccugggagugagcugguu

SEQ ID NO: 1983629 - RNA, 15 nt, Human
ccugggcagaaggaa

SEQ ID NO: 1983630 - RNA, 16 nt, Human
ccuggcccacugcauc

SEQ ID NO: 1983631 - RNA, 13 nt, Human
ccuggcccaugua

SEQ ID NO: 1983632 - RNA, 15 nt, Human
ccuggcccauguaug

SEQ ID NO: 1983633 - RNA, 21 nt, Human
ccuggcccauguauggccagg

SEQ ID NO: 1983634 - RNA, 12 nt, Human
ccuggcucccuc

SEQ ID NO: 1983635 - RNA, 14 nt, Human
ccuggcucccucac

SEQ ID NO: 1983636 - RNA, 19 nt, Human
ccuggcucccucacucuca

SEQ ID NO: 1983637 - RNA, 20 nt, Human
ccuggcucccucacucucag

SEQ ID NO: 1983638 - RNA, 21 nt, Human
ccuggcucccucacucucagg

SEQ ID NO: 1983639 - RNA, 22 nt, Human
ccuggcucccucacucucagga

SEQ ID NO: 1983640 - RNA, 17 nt, Human
ccuggcuuuucacugcu

SEQ ID NO: 1983641 - RNA, 19 nt, Human
ccugggaaagagauuuaaa

SEQ ID NO: 1983642 - RNA, 16 nt, Human
ccuggcuuuucacugc

SEQ ID NO: 1983643 - RNA, 19 nt, Human
ccugggacagggagcagcc

SEQ ID NO: 1983644 - RNA, 19 nt, Human
ccugccuguugggccagga

SEQ ID NO: 1983645 - RNA, 18 nt, Human
ccugccuguugggccagg

SEQ ID NO: 1983646 - RNA, 20 nt, Human
ccugccuguugggccaggag

SEQ ID NO: 1983647 - RNA, 21 nt, Human
ccugcuaauuccccagauugc

SEQ ID NO: 1983648 - RNA, 21 nt, Human
ccugcuacugccaaccucgcu

SEQ ID NO: 1983649 - RNA, 15 nt, Human
ccugcuacugccaac

SEQ ID NO: 1983650 - RNA, 18 nt, Human
ccugcuacugccaaccuc

SEQ ID NO: 1983651 - RNA, 13 nt, Human
ccugcuacugcca

SEQ ID NO: 1983652 - RNA, 19 nt, Human
ccuggcacccggccccugc

SEQ ID NO: 1983653 - RNA, 16 nt, Human
ccuggagaacuagaga

SEQ ID NO: 1983654 - RNA, 12 nt, Human
ccuggagaacua

SEQ ID NO: 1983655 - RNA, 13 nt, Human
ccuggagaacuag

SEQ ID NO: 1983656 - RNA, 12 nt, Human
ccuggcacugcu

SEQ ID NO: 1983657 - RNA, 20 nt, Human
ccuggcacccggccccugcu

SEQ ID NO: 1983658 - RNA, 21 nt, Human
ccuggcacccggccccugcug

SEQ ID NO: 1983659 - RNA, 13 nt, Human
ccuggcaugggaa

SEQ ID NO: 1983660 - RNA, 23 nt, Human
ccuggcaugggaaugaaugucag

SEQ ID NO: 1983661 - RNA, 16 nt, Human
ccuggcacugcuucca

SEQ ID NO: 1983662 - RNA, 13 nt, Human
ccuggcacugcuu

SEQ ID NO: 1983663 - RNA, 12 nt, Human
ccuggcaggcag

SEQ ID NO: 1983664 - RNA, 13 nt, Human
ccuggcaggcagg

SEQ ID NO: 1983665 - RNA, 14 nt, Human
ccuggcaggcaggg

SEQ ID NO: 1983666 - RNA, 15 nt, Human
ccuggcaggcagggg

SEQ ID NO: 1983667 - RNA, 21 nt, Human
ccuggcaggcaggggcccugc

SEQ ID NO: 1983668 - RNA, 23 nt, Human
ccuggcaggcaggggcccugcag

SEQ ID NO: 1983669 - RNA, 21 nt, Human
ccuggccagaugcaccagccc

SEQ ID NO: 1983670 - RNA, 23 nt, Human
ccuggccagaugcaccagcccuu

SEQ ID NO: 1983671 - RNA, 20 nt, Human
ccuggccagaugcaccagcc

SEQ ID NO: 1983672 - RNA, 14 nt, Human
ccuggcccacugca

SEQ ID NO: 1983673 - RNA, 13 nt, Human
ccuggcccacugc

SEQ ID NO: 1983674 - RNA, 13 nt, Human
ccuggccacgccc

SEQ ID NO: 1983675 - RNA, 15 nt, Human
ccugagcugggauga

SEQ ID NO: 1983676 - RNA, 15 nt, Human
ccucuuccaggcccc

SEQ ID NO: 1983677 - RNA, 16 nt, Human
ccuaugaccauaaaau

SEQ ID NO: 1983678 - RNA, 12 nt, Human
ccugaaaauauc

SEQ ID NO: 1983679 - RNA, 15 nt, Human
ccucuuccucuugac

SEQ ID NO: 1983680 - RNA, 16 nt, Human
ccucuuccucuugacc

SEQ ID NO: 1983681 - RNA, 17 nt, Human
ccucuuccucuugaccc

SEQ ID NO: 1983682 - RNA, 20 nt, Human
ccucuuccucuugacccugc

SEQ ID NO: 1983683 - RNA, 23 nt, Human
ccucuuccucuugacccugcacc

SEQ ID NO: 1983684 - RNA, 11 nt, Human
ccucuuccuga

SEQ ID NO: 1983685 - RNA, 14 nt, Human
ccucuuccuggccg

SEQ ID NO: 1983686 - RNA, 21 nt, Human
ccugaagaguccucugaauga

SEQ ID NO: 1983687 - RNA, 19 nt, Human
ccugaagagaagggcaggg

SEQ ID NO: 1983688 - RNA, 19 nt, Human
ccugaaaugugugugaugu

SEQ ID NO: 1983689 - RNA, 18 nt, Human
ccugaaagcccugagcuu

SEQ ID NO: 1983690 - RNA, 12 nt, Human
ccugaaaugugu

SEQ ID NO: 1983691 - RNA, 17 nt, Human
ccugaaaugugugugau

SEQ ID NO: 1983692 - RNA, 18 nt, Human
ccugaaaugugugugaug

SEQ ID NO: 1983693 - RNA, 14 nt, Human
ccugaaagcccuga

SEQ ID NO: 1983694 - RNA, 13 nt, Human
ccugaaagcccug

SEQ ID NO: 1983695 - RNA, 13 nt, Human
ccugaaagaggaa

SEQ ID NO: 1983696 - RNA, 20 nt, Human
ccugaaaccuaguacugccc

SEQ ID NO: 1983697 - RNA, 21 nt, Human
ccugaaggccccgcccaggcu

SEQ ID NO: 1983698 - RNA, 20 nt, Human
ccugaaggccccgcccaggc

SEQ ID NO: 1983699 - RNA, 16 nt, Human
ccugaagggguuuucu

SEQ ID NO: 1983700 - RNA, 22 nt, Human
ccugaaggccccgcccaggcuu

SEQ ID NO: 1983701 - RNA, 19 nt, Human
ccugaaggccccgcccagg

SEQ ID NO: 1983702 - RNA, 18 nt, Human
ccugaaggccccgcccag

SEQ ID NO: 1983703 - RNA, 14 nt, Human
ccugaaggccccgc

SEQ ID NO: 1983704 - RNA, 13 nt, Human
ccugagcccccag

SEQ ID NO: 1983705 - RNA, 14 nt, Human
ccugagcccccagc

SEQ ID NO: 1983706 - RNA, 15 nt, Human
ccugagcccccagcu

SEQ ID NO: 1983707 - RNA, 18 nt, Human
ccugagcccccagcuucc

SEQ ID NO: 1983708 - RNA, 22 nt, Human
ccugaagucuuuguacagacaa

SEQ ID NO: 1983709 - RNA, 19 nt, Human
ccugaaguaagcaaagacu

SEQ ID NO: 1983710 - RNA, 17 nt, Human
ccugaagggguuuucuu

SEQ ID NO: 1983711 - RNA, 20 nt, Human
ccugaaguuauguguaugug

SEQ ID NO: 1983712 - RNA, 20 nt, Human
ccugaagucacacagugagu

SEQ ID NO: 1983713 - RNA, 19 nt, Human
ccugaagucacacagugag

SEQ ID NO: 1983714 - RNA, 18 nt, Human
ccugagccagauuucacu

SEQ ID NO: 1983715 - RNA, 16 nt, Human
ccugagccagauuuca

SEQ ID NO: 1983716 - RNA, 15 nt, Human
ccugagccagauuuc

SEQ ID NO: 1983717 - RNA, 18 nt, Human
ccugaggcccagagggcc

SEQ ID NO: 1983718 - RNA, 17 nt, Human
ccugaggcccagagggc

SEQ ID NO: 1983719 - RNA, 16 nt, Human
ccugaggcccagaggg

SEQ ID NO: 1983720 - RNA, 15 nt, Human
ccugaggcccagagg

SEQ ID NO: 1983721 - RNA, 12 nt, Human
ccugagcuggga

SEQ ID NO: 1983722 - RNA, 16 nt, Human
ccugaggcugggcucc

SEQ ID NO: 1983723 - RNA, 15 nt, Human
ccugaggcugggcuc

SEQ ID NO: 1983724 - RNA, 14 nt, Human
ccugaggcugggcu

SEQ ID NO: 1983725 - RNA, 13 nt, Human
ccugaggcugggc

SEQ ID NO: 1983726 - RNA, 13 nt, Human
ccugaggcuccac

SEQ ID NO: 1983727 - RNA, 14 nt, Human
ccugaggcuccacu

SEQ ID NO: 1983728 - RNA, 17 nt, Human
ccugaggcuccacuugg

SEQ ID NO: 1983729 - RNA, 19 nt, Human
ccugccaauggacuaacuu

SEQ ID NO: 1983730 - RNA, 15 nt, Human
ccugccaccacgccc

SEQ ID NO: 1983731 - RNA, 19 nt, Human
ccugccaccacgcccggcu

SEQ ID NO: 1983732 - RNA, 23 nt, Human
ccugcauuugugaaaugauggug

SEQ ID NO: 1983733 - RNA, 12 nt, Human
ccugccacccug

SEQ ID NO: 1983734 - RNA, 13 nt, Human
ccugccacccugg

SEQ ID NO: 1983735 - RNA, 14 nt, Human
ccugccacccuggg

SEQ ID NO: 1983736 - RNA, 16 nt, Human
ccugccacccugggga

SEQ ID NO: 1983737 - RNA, 22 nt, Human
ccugccacccuggggagaaagu

SEQ ID NO: 1983738 - RNA, 23 nt, Human
ccugaucccuuccaccugcucug

SEQ ID NO: 1983739 - RNA, 19 nt, Human
ccugaucccuuccaccugc

SEQ ID NO: 1983740 - RNA, 22 nt, Human
ccugaucccuuccaccugcucu

SEQ ID NO: 1983741 - RNA, 21 nt, Human
ccugaucccugaucccuucca

SEQ ID NO: 1983742 - RNA, 17 nt, Human
ccugcaaagcccagcuu

SEQ ID NO: 1983743 - RNA, 18 nt, Human
ccugcaaagcccagcuug

SEQ ID NO: 1983744 - RNA, 22 nt, Human
ccugcacaaagcccuuccaugu

SEQ ID NO: 1983745 - RNA, 20 nt, Human
ccugcacaaagcccuuccau

SEQ ID NO: 1983746 - RNA, 15 nt, Human
ccugcaaagcccagc

SEQ ID NO: 1983747 - RNA, 16 nt, Human
ccugcaaagcccagcu

SEQ ID NO: 1983748 - RNA, 14 nt, Human
ccugcaaagcccag

SEQ ID NO: 1983749 - RNA, 23 nt, Human
ccugcacaaagcccuuccauguc

SEQ ID NO: 1983750 - RNA, 21 nt, Human
ccugcacacgcuccuuccucu

SEQ ID NO: 1983751 - RNA, 15 nt, Human
ccugcacugacucug

SEQ ID NO: 1983752 - RNA, 16 nt, Human
ccugcacugacucugg

SEQ ID NO: 1983753 - RNA, 18 nt, Human
ccugcacugacucuggaa

SEQ ID NO: 1983754 - RNA, 11 nt, Human
ccugcacccuc

SEQ ID NO: 1983755 - RNA, 14 nt, Human
ccugcacccuccua

SEQ ID NO: 1983756 - RNA, 16 nt, Human
ccugcacccuccuagg

SEQ ID NO: 1983757 - RNA, 22 nt, Human
ccugccuguugggccaggagcc

SEQ ID NO: 1983758 - RNA, 12 nt, Human
ccugccaggcau

SEQ ID NO: 1983759 - RNA, 14 nt, Human
ccugccaggcacag

SEQ ID NO: 1983760 - RNA, 15 nt, Human
ccugccaggcacagg

SEQ ID NO: 1983761 - RNA, 16 nt, Human
ccugccaggcacaggc

SEQ ID NO: 1983762 - RNA, 18 nt, Human
ccugccaggcacaggcag

SEQ ID NO: 1983763 - RNA, 19 nt, Human
ccugccaggcacaggcagg

SEQ ID NO: 1983764 - RNA, 20 nt, Human
ccugccaggcacaggcaggg

SEQ ID NO: 1983765 - RNA, 21 nt, Human
ccugccaggcacaggcagggc

SEQ ID NO: 1983766 - RNA, 13 nt, Human
ccugccaggcaca

SEQ ID NO: 1983767 - RNA, 14 nt, Human
ccugccccccagcc

SEQ ID NO: 1983768 - RNA, 15 nt, Human
ccugccaggcauggu

SEQ ID NO: 1983769 - RNA, 22 nt, Human
ccugccaggcacaggcagggca

SEQ ID NO: 1983770 - RNA, 23 nt, Human
ccugccaggcacaggcagggcag

SEQ ID NO: 1983771 - RNA, 22 nt, Human
ccugccagggacagagggggug

SEQ ID NO: 1983772 - RNA, 17 nt, Human
ccugccccugagcccau

SEQ ID NO: 1983773 - RNA, 19 nt, Human
ccugccccuccucucugcc

SEQ ID NO: 1983774 - RNA, 20 nt, Human
ccugccccuccucucugccc

SEQ ID NO: 1983775 - RNA, 21 nt, Human
ccugccccuccucucugcccu

SEQ ID NO: 1983776 - RNA, 22 nt, Human
ccugccccuccucucugcccua

SEQ ID NO: 1983777 - RNA, 15 nt, Human
ccugccccucccuuc

SEQ ID NO: 1983778 - RNA, 16 nt, Human
ccugccccucccuuca

SEQ ID NO: 1983779 - RNA, 18 nt, Human
ccugccccucccuucaac

SEQ ID NO: 1983780 - RNA, 18 nt, Human
ccugccccuccucucugc

SEQ ID NO: 1983781 - RNA, 14 nt, Human
ccugccccucccuu

SEQ ID NO: 1983782 - RNA, 14 nt, Human
ccugcccggcugcg

SEQ ID NO: 1983783 - RNA, 16 nt, Human
ccugcccggcugcgga

SEQ ID NO: 1983784 - RNA, 16 nt, Human
ccugccccugcuacug

SEQ ID NO: 1983785 - RNA, 20 nt, Human
ccugcccggauggagcgggg

SEQ ID NO: 1983786 - RNA, 14 nt, Human
ccugcccugugggc

SEQ ID NO: 1983787 - RNA, 12 nt, Human
ccugcccugugg

SEQ ID NO: 1983788 - RNA, 11 nt, Human
ccugcccugug

SEQ ID NO: 1983789 - RNA, 23 nt, Human
ccugcccugguuuccugcccugg

SEQ ID NO: 1983790 - RNA, 18 nt, Human
ccugcccugucaggaggc

SEQ ID NO: 1983791 - RNA, 21 nt, Human
ccugcccugucaggaggcaga

SEQ ID NO: 1983792 - RNA, 20 nt, Human
ccugcccugggaggcaguga

SEQ ID NO: 1983793 - RNA, 22 nt, Human
ccugcccugggaggcagugaug

SEQ ID NO: 1983794 - RNA, 14 nt, Human
ccugcccugguuuc

SEQ ID NO: 1983795 - RNA, 19 nt, Human
ccugcccugguuuccugcc

SEQ ID NO: 1983796 - RNA, 20 nt, Human
ccugcccugguuuccugccc

SEQ ID NO: 1983797 - RNA, 21 nt, Human
ccugcccugguuuccugcccu

SEQ ID NO: 1983798 - RNA, 22 nt, Human
ccugcccugguuuccugcccug

SEQ ID NO: 1983799 - RNA, 10 nt, Human
ccugcccugg

SEQ ID NO: 1983800 - RNA, 12 nt, Human
ccugcccuggga

SEQ ID NO: 1983801 - RNA, 14 nt, Human
ccugcccugggagg

SEQ ID NO: 1983802 - RNA, 15 nt, Human
ccugcccugggaggc

SEQ ID NO: 1983803 - RNA, 12 nt, Human
ccugccucagcc

SEQ ID NO: 1983804 - RNA, 13 nt, Human
ccugccucagccu

SEQ ID NO: 1983805 - RNA, 14 nt, Human
ccugccucagccuc

SEQ ID NO: 1983806 - RNA, 14 nt, Human
ccugccuguugggc

SEQ ID NO: 1983807 - RNA, 22 nt, Human
ccugccuguucccauucuugca

SEQ ID NO: 1983808 - RNA, 22 nt, Human
ccugcccuuaccugccaggaag

SEQ ID NO: 1983809 - RNA, 21 nt, Human
ccugcccuuaccugccaggaa

SEQ ID NO: 1983810 - RNA, 19 nt, Human
ccugcccuuaccugccagg

SEQ ID NO: 1983811 - RNA, 15 nt, Human
ccugcccugugggcc

SEQ ID NO: 1983812 - RNA, 19 nt, Human
ccugcccuuuguccuccug

SEQ ID NO: 1983813 - RNA, 21 nt, Human
ccugcccuuuguccuccugcu

SEQ ID NO: 1983814 - RNA, 14 nt, Human
ccuuugucccagaa

SEQ ID NO: 1983815 - RNA, 14 nt, Human
ccuuuguccccacc

SEQ ID NO: 1983816 - RNA, 18 nt, Human
ccuuuguccccaccgcag

SEQ ID NO: 1983817 - RNA, 16 nt, Human
ccuuuguccccaccgc

SEQ ID NO: 1983818 - RNA, 24 nt, Human
ccuuuguauucucuccuguaccuc

SEQ ID NO: 1983819 - RNA, 23 nt, Human
ccuuuguaaauugucagaugcug

SEQ ID NO: 1983820 - RNA, 14 nt, Human
ccuuuguauucugu

SEQ ID NO: 1983821 - RNA, 22 nt, Human
ccuuuguauucugucuucaucc

SEQ ID NO: 1983822 - RNA, 22 nt, Human
ccuuuguauucucuccuguacc

SEQ ID NO: 1983823 - RNA, 23 nt, Human
ccuuuguauucucuccuguaccu

SEQ ID NO: 1983824 - RNA, 18 nt, Human
ccuugugaucacuuucug

SEQ ID NO: 1983825 - RNA, 20 nt, Human
ccuugugaucacuuucugaa

SEQ ID NO: 1983826 - RNA, 19 nt, Human
ccuuugggugcuguuuugc

SEQ ID NO: 1983827 - RNA, 21 nt, Human
ccuuugggugcuguuuugcca

SEQ ID NO: 1983828 - RNA, 16 nt, Human
ccuuugggugcuguuu

SEQ ID NO: 1983829 - RNA, 21 nt, Human
ccuuuguaaauugucagaugc

SEQ ID NO: 1983830 - RNA, 20 nt, Human
ccuugugggugugagcagca

SEQ ID NO: 1983831 - RNA, 14 nt, Human
ccuuugugaggaag

SEQ ID NO: 1983832 - RNA, 21 nt, Human
ccuuuguccuccugcugccag

SEQ ID NO: 1983833 - RNA, 13 nt, Human
ccuuuguccuccu

SEQ ID NO: 1983834 - RNA, 16 nt, Human
ccuuuguccuccugcu

SEQ ID NO: 1983835 - RNA, 23 nt, Human
ccuuuguccccaccgcagacagg

SEQ ID NO: 1983836 - RNA, 22 nt, Human
ccuuuguccccaccgcagacag

SEQ ID NO: 1983837 - RNA, 23 nt, Human
ccuuugugaggaagccgcugggg

SEQ ID NO: 1983838 - RNA, 17 nt, Human
ccuuugugaggaagccg

SEQ ID NO: 1983839 - RNA, 16 nt, Human
ccuuugugaggaagcc

SEQ ID NO: 1983840 - RNA, 15 nt, Human
ccuuugugaggaagc

SEQ ID NO: 1983841 - RNA, 15 nt, Human
ccuuuuuuggcugcu

SEQ ID NO: 1983842 - RNA, 22 nt, Human
ccuuuuuuauaucuuggcaggu

SEQ ID NO: 1983843 - RNA, 15 nt, Human
ccuuuuuuauaucuu

SEQ ID NO: 1983844 - RNA, 17 nt, Human
ccuuuguugaacuguua

SEQ ID NO: 1983845 - RNA, 20 nt, Human
ccuuuguugaacuguuagaa

SEQ ID NO: 1983846 - RNA, 22 nt, Human
ccuuuuuuggcugcugaaggcu

SEQ ID NO: 1983847 - RNA, 20 nt, Human
ccuuuuuuggcugcugaagg

SEQ ID NO: 1983848 - RNA, 18 nt, Human
ccuuuuuuggcugcugaa

SEQ ID NO: 1983849 - RNA, 17 nt, Human
ccuuuuuuggcugcuga

SEQ ID NO: 1983850 - RNA, 23 nt, Human
cgaaagggacuuggaagcuccgc

SEQ ID NO: 1983851 - RNA, 15 nt, Human
cgaaaggucaccuca

SEQ ID NO: 1983852 - RNA, 16 nt, Human
cgaaaggucaccucac

SEQ ID NO: 1983853 - RNA, 18 nt, Human
cgaaaggucaccucacuc

SEQ ID NO: 1983854 - RNA, 21 nt, Human
cgaaaggucaccucacucagc

SEQ ID NO: 1983855 - RNA, 23 nt, Human
cgaaaggucaccucacucagcac

SEQ ID NO: 1983856 - RNA, 16 nt, Human
cgaaaguuaguaggau

SEQ ID NO: 1983857 - RNA, 15 nt, Human
cgaaaucccugcuca

SEQ ID NO: 1983858 - RNA, 16 nt, Human
cgaaaucccugcucac

SEQ ID NO: 1983859 - RNA, 22 nt, Human
cgaaaucccugcucacugcagc

SEQ ID NO: 1983860 - RNA, 13 nt, Human
cgaaaugcugucu

SEQ ID NO: 1983861 - RNA, 18 nt, Human
cgaagauuucauccagaa

SEQ ID NO: 1983862 - RNA, 18 nt, Human
cgaaaugcugucuuucuu

SEQ ID NO: 1983863 - RNA, 23 nt, Human
cgaacauguuuuucuucucccuc

SEQ ID NO: 1983864 - RNA, 21 nt, Human
cgaacauguuuuucuucuccc

SEQ ID NO: 1983865 - RNA, 14 nt, Human
cgaauauugcugau

SEQ ID NO: 1983866 - RNA, 12 nt, Human
cgaauauugcug

SEQ ID NO: 1983867 - RNA, 11 nt, Human
cgaauauugcu

SEQ ID NO: 1983868 - RNA, 16 nt, Human
cgaauagcugggacua

SEQ ID NO: 1983869 - RNA, 15 nt, Human
cgaauagcugggacu

SEQ ID NO: 1983870 - RNA, 16 nt, Human
cgagacggcacugaga

SEQ ID NO: 1983871 - RNA, 17 nt, Human
cgaauauugcugauggu

SEQ ID NO: 1983872 - RNA, 15 nt, Human
cgaauauugcugaug

SEQ ID NO: 1983873 - RNA, 14 nt, Human
cgaaucauuuguuc

SEQ ID NO: 1983874 - RNA, 17 nt, Human
cgaaucauuuguucaaa

SEQ ID NO: 1983875 - RNA, 17 nt, Human
ccuucgguacccaccac

SEQ ID NO: 1983876 - RNA, 19 nt, Human
ccuucgugacaauguuuac

SEQ ID NO: 1983877 - RNA, 20 nt, Human
ccuucgugacaauguuuaca

SEQ ID NO: 1983878 - RNA, 16 nt, Human
ccuucucuccagcccc

SEQ ID NO: 1983879 - RNA, 15 nt, Human
ccuucucuccagccc

SEQ ID NO: 1983880 - RNA, 13 nt, Human
ccuucucuccagc

SEQ ID NO: 1983881 - RNA, 12 nt, Human
ccuucucuccag

SEQ ID NO: 1983882 - RNA, 13 nt, Human
ccuuccaggggug

SEQ ID NO: 1983883 - RNA, 17 nt, Human
ccuuccauggacuuugu

SEQ ID NO: 1983884 - RNA, 16 nt, Human
ccuuccaucugauucc

SEQ ID NO: 1983885 - RNA, 13 nt, Human
ccuuccugggcac

SEQ ID NO: 1983886 - RNA, 18 nt, Human
ccuuccaugucgccucug

SEQ ID NO: 1983887 - RNA, 17 nt, Human
ccuuccugggcacacgc

SEQ ID NO: 1983888 - RNA, 21 nt, Human
ccuuccugggcacacgcugcu

SEQ ID NO: 1983889 - RNA, 22 nt, Human
ccuuccugggcacacgcugcuc

SEQ ID NO: 1983890 - RNA, 23 nt, Human
ccuuccugggcacacgcugcucu

SEQ ID NO: 1983891 - RNA, 16 nt, Human
ccuucggccuccaucc

SEQ ID NO: 1983892 - RNA, 17 nt, Human
ccuucggccuccauccu

SEQ ID NO: 1983893 - RNA, 15 nt, Human
ccuucgggcugugcc

SEQ ID NO: 1983894 - RNA, 16 nt, Human
ccuucgggcugugccc

SEQ ID NO: 1983895 - RNA, 15 nt, Human
ccuucgguacccacc

SEQ ID NO: 1983896 - RNA, 14 nt, Human
ccuucgggcugugc

SEQ ID NO: 1983897 - RNA, 18 nt, Human
ccuucggccuccauccug

SEQ ID NO: 1983898 - RNA, 20 nt, Human
ccugugggcccccaaaugga

SEQ ID NO: 1983899 - RNA, 20 nt, Human
ccuguggaugauaaaacaca

SEQ ID NO: 1983900 - RNA, 18 nt, Human
ccuguggaucaaauccag

SEQ ID NO: 1983901 - RNA, 16 nt, Human
ccuguggccugccagu

SEQ ID NO: 1983902 - RNA, 17 nt, Human
ccugugccuuuugccau

SEQ ID NO: 1983903 - RNA, 20 nt, Human
ccugugccucugggacugga

SEQ ID NO: 1983904 - RNA, 17 nt, Human
ccuguccuaaggaaccu

SEQ ID NO: 1983905 - RNA, 18 nt, Human
ccuguccuaaggaaccuu

SEQ ID NO: 1983906 - RNA, 21 nt, Human
ccuguccuaaggaaccuuccu

SEQ ID NO: 1983907 - RNA, 19 nt, Human
ccuucucuccagccccugg

SEQ ID NO: 1983908 - RNA, 23 nt, Human
ccuugacauuguagagcuucugg

SEQ ID NO: 1983909 - RNA, 18 nt, Human
ccuucucuccagccccug

SEQ ID NO: 1983910 - RNA, 17 nt, Human
ccuucucuccagccccu

SEQ ID NO: 1983911 - RNA, 18 nt, Human
ccuugacagggcacaccg

SEQ ID NO: 1983912 - RNA, 21 nt, Human
ccuugacagggcacaccgggc

SEQ ID NO: 1983913 - RNA, 21 nt, Human
ccuugaggaaacaacagcuuu

SEQ ID NO: 1983914 - RNA, 18 nt, Human
ccuugaggaaacaacagc

SEQ ID NO: 1983915 - RNA, 15 nt, Human
ccuuggauugucccc

SEQ ID NO: 1983916 - RNA, 22 nt, Human
ccuuggcucaaguccucuuuuc

SEQ ID NO: 1983917 - RNA, 14 nt, Human
ccuuggggagcagg

SEQ ID NO: 1983918 - RNA, 16 nt, Human
ccuugggcucugcuga

SEQ ID NO: 1983919 - RNA, 16 nt, Human
ccuuggcuuggcccug

SEQ ID NO: 1983920 - RNA, 18 nt, Human
ccuuggcuuggcccuggc

SEQ ID NO: 1983921 - RNA, 15 nt, Human
ccuugggcucugcug

SEQ ID NO: 1983922 - RNA, 16 nt, Human
ccuuggcugcagggag

SEQ ID NO: 1983923 - RNA, 20 nt, Human
ccuuggugucgggcaugaca

SEQ ID NO: 1983924 - RNA, 19 nt, Human
ccuuggugucgggcaugac

SEQ ID NO: 1983925 - RNA, 19 nt, Human
ccuuggggacaaccuuggc

SEQ ID NO: 1983926 - RNA, 21 nt, Human
ccuuggugucgggcaugacac

SEQ ID NO: 1983927 - RNA, 13 nt, Human
ccuugguuggaag

SEQ ID NO: 1983928 - RNA, 12 nt, Human
ccuugguuccug

SEQ ID NO: 1983929 - RNA, 17 nt, Human
ccuugguuccuggggca

SEQ ID NO: 1983930 - RNA, 15 nt, Human
ccuuguaauguaacu

SEQ ID NO: 1983931 - RNA, 16 nt, Human
ccuuguaauguaacug

SEQ ID NO: 1983932 - RNA, 18 nt, Human
ccuuguaauguaacugcu

SEQ ID NO: 1983933 - RNA, 21 nt, Human
ccuuguaauguaacugcucuu

SEQ ID NO: 1983934 - RNA, 20 nt, Human
cgggaauuuucaucuaggau

SEQ ID NO: 1983935 - RNA, 20 nt, Human
cgggaagggggcugggacau

SEQ ID NO: 1983936 - RNA, 19 nt, Human
cgggaagggggcugggaca

SEQ ID NO: 1983937 - RNA, 16 nt, Human
cgggaagggggcuggg

SEQ ID NO: 1983938 - RNA, 18 nt, Human
cgggaauuuucaucuagg

SEQ ID NO: 1983939 - RNA, 13 nt, Human
cggcuggccuggc

SEQ ID NO: 1983940 - RNA, 23 nt, Human
cggcuggcagcccaccccucaac

SEQ ID NO: 1983941 - RNA, 14 nt, Human
cggcuggccuggcc

SEQ ID NO: 1983942 - RNA, 14 nt, Human
cggcuggcagccca

SEQ ID NO: 1983943 - RNA, 11 nt, Human
cggccaggcca

SEQ ID NO: 1983944 - RNA, 14 nt, Human
cggauccccuuccu

SEQ ID NO: 1983945 - RNA, 14 nt, Human
cggaucagcugagc

SEQ ID NO: 1983946 - RNA, 16 nt, Human
cggaucaggcucccag

SEQ ID NO: 1983947 - RNA, 17 nt, Human
cggaucaggcucccagg

SEQ ID NO: 1983948 - RNA, 12 nt, Human
cggcccuaaggg

SEQ ID NO: 1983949 - RNA, 12 nt, Human
cggccaggccag

SEQ ID NO: 1983950 - RNA, 20 nt, Human
cggccaggccagagggagug

SEQ ID NO: 1983951 - RNA, 20 nt, Human
cgcccaaaccuuucccccau

SEQ ID NO: 1983952 - RNA, 19 nt, Human
cgcagcccugcagagggca

SEQ ID NO: 1983953 - RNA, 18 nt, Human
cgcagcccugcagagggc

SEQ ID NO: 1983954 - RNA, 18 nt, Human
cgcagcauccgaccaggu

SEQ ID NO: 1983955 - RNA, 13 nt, Human
cgcagcccugcuu

SEQ ID NO: 1983956 - RNA, 15 nt, Human
cgcagcccugcuuug

SEQ ID NO: 1983957 - RNA, 24 nt, Human
cgcagcccugcuuugggcugcccu

SEQ ID NO: 1983958 - RNA, 12 nt, Human
cgcccaaggccc

SEQ ID NO: 1983959 - RNA, 18 nt, Human
cgcccaacuaauuuuugu

SEQ ID NO: 1983960 - RNA, 13 nt, Human
cgcccagucugga

SEQ ID NO: 1983961 - RNA, 19 nt, Human
cgcccagucuggaaugcag

SEQ ID NO: 1983962 - RNA, 21 nt, Human
cgcccagucuggaaugcagug

SEQ ID NO: 1983963 - RNA, 13 nt, Human
cgccccuuccccc

SEQ ID NO: 1983964 - RNA, 18 nt, Human
cgcccggcuaauuuuugu

SEQ ID NO: 1983965 - RNA, 21 nt, Human
cgcgucgcccucccaggcucu

SEQ ID NO: 1983966 - RNA, 24 nt, Human
cgcuacccgggaagggggcuggga

SEQ ID NO: 1983967 - RNA, 21 nt, Human
cgcuacccgggaagggggcug

SEQ ID NO: 1983968 - RNA, 17 nt, Human
cgcuacccgggaagggg

SEQ ID NO: 1983969 - RNA, 18 nt, Human
cgcuaacuugcuuaaaug

SEQ ID NO: 1983970 - RNA, 19 nt, Human
cgcuaacuugcuuaaaugu

SEQ ID NO: 1983971 - RNA, 20 nt, Human
cgcuaacuugcuuaaaugug

SEQ ID NO: 1983972 - RNA, 18 nt, Human
cgcuacccgggaaggggg

SEQ ID NO: 1983973 - RNA, 19 nt, Human
cgcgguggcucacgccugu

SEQ ID NO: 1983974 - RNA, 15 nt, Human
cgcgacaaugcaaac

SEQ ID NO: 1983975 - RNA, 18 nt, Human
cgccuuucagcaggcagc

SEQ ID NO: 1983976 - RNA, 14 nt, Human
cgcgacaaugcaaa

SEQ ID NO: 1983977 - RNA, 17 nt, Human
cggagaaaggaagggcu

SEQ ID NO: 1983978 - RNA, 15 nt, Human
cggagaaaggaaggg

SEQ ID NO: 1983979 - RNA, 17 nt, Human
cggacuuagcugggaga

SEQ ID NO: 1983980 - RNA, 16 nt, Human
cggacuuagcugggag

SEQ ID NO: 1983981 - RNA, 21 nt, Human
cggacagccacggccaggcca

SEQ ID NO: 1983982 - RNA, 22 nt, Human
cggacagccacggccaggccag

SEQ ID NO: 1983983 - RNA, 16 nt, Human
cgcuuucuacccagcg

SEQ ID NO: 1983984 - RNA, 14 nt, Human
cgcuuucuacccag

SEQ ID NO: 1983985 - RNA, 16 nt, Human
cggaauaguuggcuag

SEQ ID NO: 1983986 - RNA, 17 nt, Human
cggaauaguuggcuagg

SEQ ID NO: 1983987 - RNA, 16 nt, Human
cgcucccuugaccugc

SEQ ID NO: 1983988 - RNA, 20 nt, Human
cgcuccgggacguggcaccu

SEQ ID NO: 1983989 - RNA, 21 nt, Human
cgcuaacuugcuuaaauguga

SEQ ID NO: 1983990 - RNA, 14 nt, Human
cgcugugcugcccu

SEQ ID NO: 1983991 - RNA, 13 nt, Human
cgcugugcugccc

SEQ ID NO: 1983992 - RNA, 11 nt, Human
cgcugugcugc

SEQ ID NO: 1983993 - RNA, 19 nt, Human
cgcugugcugcccugccca

SEQ ID NO: 1983994 - RNA, 23 nt, Human
cgcugugcugcccugcccaccug

SEQ ID NO: 1983995 - RNA, 21 nt, Human
cgcugugcugcccugcccacc

SEQ ID NO: 1983996 - RNA, 20 nt, Human
cgcuucccugguucaagcga

SEQ ID NO: 1983997 - RNA, 22 nt, Human
cgcuucccugguucaagcgauu

SEQ ID NO: 1983998 - RNA, 11 nt, Human
cgcuucacagg

SEQ ID NO: 1983999 - RNA, 21 nt, Human
cgagccuuuucacccuucuac

SEQ ID NO: 1984000 - RNA, 14 nt, Human
cgaggacagggagg

SEQ ID NO: 1984001 - RNA, 22 nt, Human
cgagcccuugcccaugcugggc

SEQ ID NO: 1984002 - RNA, 18 nt, Human
cgagcccugguggcagug

SEQ ID NO: 1984003 - RNA, 19 nt, Human
cgagcccugguggcagugg

SEQ ID NO: 1984004 - RNA, 12 nt, Human
cgagagcgcagc

SEQ ID NO: 1984005 - RNA, 16 nt, Human
cgaggacagggaggug

SEQ ID NO: 1984006 - RNA, 17 nt, Human
cgcagcccugcagaggg

SEQ ID NO: 1984007 - RNA, 15 nt, Human
cgcagcccugcagag

SEQ ID NO: 1984008 - RNA, 20 nt, Human
cgcagcauauucaggaagcu

SEQ ID NO: 1984009 - RNA, 19 nt, Human
cgcagcauauucaggaagc

SEQ ID NO: 1984010 - RNA, 19 nt, Human
cgcagagggaauuuuuccc

SEQ ID NO: 1984011 - RNA, 17 nt, Human
cgcacugggcuugggga

SEQ ID NO: 1984012 - RNA, 13 nt, Human
cgcacucuggcag

SEQ ID NO: 1984013 - RNA, 23 nt, Human
cgcacuucgggaggucgaggcag

SEQ ID NO: 1984014 - RNA, 13 nt, Human
cgcacugggcuug

SEQ ID NO: 1984015 - RNA, 18 nt, Human
cgauggauauauguuuuu

SEQ ID NO: 1984016 - RNA, 23 nt, Human
cgaugcagacagggggccagaac

SEQ ID NO: 1984017 - RNA, 19 nt, Human
cgaugcaaacauuggaaga

SEQ ID NO: 1984018 - RNA, 15 nt, Human
cgaugcagacagggg

SEQ ID NO: 1984019 - RNA, 14 nt, Human
cucacuguugccca

SEQ ID NO: 1984020 - RNA, 15 nt, Human
cucacuguugcccag

SEQ ID NO: 1984021 - RNA, 20 nt, Human
cucacuguggugucuguguu

SEQ ID NO: 1984022 - RNA, 20 nt, Human
cucacugcuaagaauauuug

SEQ ID NO: 1984023 - RNA, 21 nt, Human
cucacugcuaagaauauuuga

SEQ ID NO: 1984024 - RNA, 22 nt, Human
cucacugcuaagaauauuugaa

SEQ ID NO: 1984025 - RNA, 23 nt, Human
cucacugcuaagaauauuugaau

SEQ ID NO: 1984026 - RNA, 20 nt, Human
cucacugcauccuccgccuc

SEQ ID NO: 1984027 - RNA, 14 nt, Human
cucacugccucccc

SEQ ID NO: 1984028 - RNA, 14 nt, Human
cucacugcagccuc

SEQ ID NO: 1984029 - RNA, 15 nt, Human
cucacugcagccuca

SEQ ID NO: 1984030 - RNA, 16 nt, Human
cucacugcagccucaa

SEQ ID NO: 1984031 - RNA, 20 nt, Human
cucacagacaggaccccugc

SEQ ID NO: 1984032 - RNA, 22 nt, Human
cucacagacaggaccccugcag

SEQ ID NO: 1984033 - RNA, 23 nt, Human
cucacagacaggaccccugcagu

SEQ ID NO: 1984034 - RNA, 13 nt, Human
cucagaggcccca

SEQ ID NO: 1984035 - RNA, 21 nt, Human
cucagaggccccaauacccca

SEQ ID NO: 1984036 - RNA, 22 nt, Human
cucagaggccccaauaccccau

SEQ ID NO: 1984037 - RNA, 23 nt, Human
cucagaggccccaauaccccaug

SEQ ID NO: 1984038 - RNA, 18 nt, Human
cucagaggacccuuucca

SEQ ID NO: 1984039 - RNA, 19 nt, Human
cucagaggacccuuuccag

SEQ ID NO: 1984040 - RNA, 12 nt, Human
cucagaggcccc

SEQ ID NO: 1984041 - RNA, 16 nt, Human
cucagaucuucugugg

SEQ ID NO: 1984042 - RNA, 19 nt, Human
cucagagagggugggagug

SEQ ID NO: 1984043 - RNA, 23 nt, Human
cucagagagggugggagugggcc

SEQ ID NO: 1984044 - RNA, 15 nt, Human
cucagagccaccccu

SEQ ID NO: 1984045 - RNA, 16 nt, Human
cucacuguugcccagg

SEQ ID NO: 1984046 - RNA, 17 nt, Human
cucacuguugcccaggc

SEQ ID NO: 1984047 - RNA, 18 nt, Human
cucacuguugcccaggcu

SEQ ID NO: 1984048 - RNA, 19 nt, Human
cucacuguugcccaggcug

SEQ ID NO: 1984049 - RNA, 15 nt, Human
cucagcauccuggca

SEQ ID NO: 1984050 - RNA, 15 nt, Human
cucagcauuaccucu

SEQ ID NO: 1984051 - RNA, 19 nt, Human
cucagcauuaccucuuugg

SEQ ID NO: 1984052 - RNA, 20 nt, Human
cucagcauuaccucuuugga

SEQ ID NO: 1984053 - RNA, 22 nt, Human
cucagcauuaccucuuuggaaa

SEQ ID NO: 1984054 - RNA, 14 nt, Human
cucagcccucccug

SEQ ID NO: 1984055 - RNA, 19 nt, Human
cucagcccucccugccccu

SEQ ID NO: 1984056 - RNA, 20 nt, Human
cucagcccucccugccccuc

SEQ ID NO: 1984057 - RNA, 21 nt, Human
cucagcccucccugccccucc

SEQ ID NO: 1984058 - RNA, 21 nt, Human
cucagcaaaagaugcuucuca

SEQ ID NO: 1984059 - RNA, 16 nt, Human
cucagcaggggagggu

SEQ ID NO: 1984060 - RNA, 20 nt, Human
cucagcaaaagaugcuucuc

SEQ ID NO: 1984061 - RNA, 19 nt, Human
cucagcaaaagaugcuucu

SEQ ID NO: 1984062 - RNA, 17 nt, Human
cucagcagugagagcag

SEQ ID NO: 1984063 - RNA, 13 nt, Human
cucagcauccugg

SEQ ID NO: 1984064 - RNA, 21 nt, Human
cucagcauccuggcacccggc

SEQ ID NO: 1984065 - RNA, 22 nt, Human
cucagcauccuggcacccggcc

SEQ ID NO: 1984066 - RNA, 14 nt, Human
cucagcggggacag

SEQ ID NO: 1984067 - RNA, 15 nt, Human
cucagcggggacagc

SEQ ID NO: 1984068 - RNA, 16 nt, Human
cucagcggggacagcu

SEQ ID NO: 1984069 - RNA, 18 nt, Human
cucagcggggacagcucc

SEQ ID NO: 1984070 - RNA, 19 nt, Human
cucagcggggacagcuccu

SEQ ID NO: 1984071 - RNA, 20 nt, Human
cucagcggggacagcuccuu

SEQ ID NO: 1984072 - RNA, 21 nt, Human
cucagcggggacagcuccuuc

SEQ ID NO: 1984073 - RNA, 23 nt, Human
cucagcggggacagcuccuucug

SEQ ID NO: 1984074 - RNA, 19 nt, Human
cucagcucccaaggcucug

SEQ ID NO: 1984075 - RNA, 15 nt, Human
cucagcucccaaggc

SEQ ID NO: 1984076 - RNA, 22 nt, Human
cucagggucccugguggcagcu

SEQ ID NO: 1984077 - RNA, 21 nt, Human
cucagggucccugguggcagc

SEQ ID NO: 1984078 - RNA, 20 nt, Human
cucagggucccugguggcag

SEQ ID NO: 1984079 - RNA, 14 nt, Human
cucagggccugguc

SEQ ID NO: 1984080 - RNA, 24 nt, Human
cucagggucccugguggcagcuca

SEQ ID NO: 1984081 - RNA, 20 nt, Human
cucagguaaucgaccugccu

SEQ ID NO: 1984082 - RNA, 22 nt, Human
cucagguaaucgaccugccucg

SEQ ID NO: 1984083 - RNA, 24 nt, Human
cucagguaaucgaccugccucggc

SEQ ID NO: 1984084 - RNA, 21 nt, Human
cucagguggggucacucuggc

SEQ ID NO: 1984085 - RNA, 20 nt, Human
cucagguggggucacucugg

SEQ ID NO: 1984086 - RNA, 19 nt, Human
cucagguggggucacucug

SEQ ID NO: 1984087 - RNA, 22 nt, Human
cucaggugauccacccaccuca

SEQ ID NO: 1984088 - RNA, 23 nt, Human
cucaggugauccacccaccucag

SEQ ID NO: 1984089 - RNA, 20 nt, Human
cucagggccuggcucaggug

SEQ ID NO: 1984090 - RNA, 19 nt, Human
cucagggccuggcucaggu

SEQ ID NO: 1984091 - RNA, 18 nt, Human
cucagggccuggcucagg

SEQ ID NO: 1984092 - RNA, 18 nt, Human
cucaggcaggugggaugg

SEQ ID NO: 1984093 - RNA, 15 nt, Human
cucaggcagguggga

SEQ ID NO: 1984094 - RNA, 16 nt, Human
cucaggaggcaggacc

SEQ ID NO: 1984095 - RNA, 17 nt, Human
cucaggaggcaggaccu

SEQ ID NO: 1984096 - RNA, 18 nt, Human
cucaggaggcaggaccuu

SEQ ID NO: 1984097 - RNA, 24 nt, Human
cucaggagcccugggaggcucugg

SEQ ID NO: 1984098 - RNA, 23 nt, Human
cucaggagcccugggaggcucug

SEQ ID NO: 1984099 - RNA, 22 nt, Human
cucaggagcccugggaggcucu

SEQ ID NO: 1984100 - RNA, 21 nt, Human
cucaggagcccugggaggcuc

SEQ ID NO: 1984101 - RNA, 20 nt, Human
cucaggagcccugggaggcu

SEQ ID NO: 1984102 - RNA, 17 nt, Human
cucaggagcccugggag

SEQ ID NO: 1984103 - RNA, 16 nt, Human
cucaggagcccuggga

SEQ ID NO: 1984104 - RNA, 15 nt, Human
cucaggagcccuggg

SEQ ID NO: 1984105 - RNA, 14 nt, Human
cucaggagcccugg

SEQ ID NO: 1984106 - RNA, 12 nt, Human
cucaggaccagg

SEQ ID NO: 1984107 - RNA, 13 nt, Human
cucaggagcccug

SEQ ID NO: 1984108 - RNA, 12 nt, Human
cucaggagcccu

SEQ ID NO: 1984109 - RNA, 20 nt, Human
cucaggaaaugcugacccau

SEQ ID NO: 1984110 - RNA, 21 nt, Human
cucaggaaaugcugacccaug

SEQ ID NO: 1984111 - RNA, 22 nt, Human
cucaggaaaugcugacccaugg

SEQ ID NO: 1984112 - RNA, 23 nt, Human
cucaggaaaugcugacccauggg

SEQ ID NO: 1984113 - RNA, 14 nt, Human
cucagcuuccccag

SEQ ID NO: 1984114 - RNA, 18 nt, Human
cucagcuuccccaguagc

SEQ ID NO: 1984115 - RNA, 19 nt, Human
cucagcuuccccaguagcu

SEQ ID NO: 1984116 - RNA, 15 nt, Human
cucaggaaaugcuga

SEQ ID NO: 1984117 - RNA, 19 nt, Human
cucaggaaaugcugaccca

SEQ ID NO: 1984118 - RNA, 18 nt, Human
cucagcucuuggcuccac

SEQ ID NO: 1984119 - RNA, 17 nt, Human
cucagcucuuggcucca

SEQ ID NO: 1984120 - RNA, 20 nt, Human
cucagcucuuggcuccacug

SEQ ID NO: 1984121 - RNA, 19 nt, Human
cucagcugucaaggcucag

SEQ ID NO: 1984122 - RNA, 18 nt, Human
cucagcugucaaggcuca

SEQ ID NO: 1984123 - RNA, 13 nt, Human
cuccccucuuccu

SEQ ID NO: 1984124 - RNA, 14 nt, Human
cuccccucuuccuc

SEQ ID NO: 1984125 - RNA, 15 nt, Human
cuccccucuuccucu

SEQ ID NO: 1984126 - RNA, 16 nt, Human
cuccccucuuccucuu

SEQ ID NO: 1984127 - RNA, 17 nt, Human
cuccccucuuccucuug

SEQ ID NO: 1984128 - RNA, 23 nt, Human
cuccccugcuggguguggcgcag

SEQ ID NO: 1984129 - RNA, 21 nt, Human
cuccccugcuggguguggcgc

SEQ ID NO: 1984130 - RNA, 14 nt, Human
cuccccugcugggu

SEQ ID NO: 1984131 - RNA, 18 nt, Human
cuccccagccagccuggc

SEQ ID NO: 1984132 - RNA, 20 nt, Human
cuccccagccagccuggcug

SEQ ID NO: 1984133 - RNA, 15 nt, Human
cuccccagccagccu

SEQ ID NO: 1984134 - RNA, 16 nt, Human
cuccccagccagccug

SEQ ID NO: 1984135 - RNA, 17 nt, Human
cuccccagccagccugg

SEQ ID NO: 1984136 - RNA, 16 nt, Human
cuccccucuccuuccu

SEQ ID NO: 1984137 - RNA, 20 nt, Human
cuccccagccccaucccaaa

SEQ ID NO: 1984138 - RNA, 18 nt, Human
cucccucagucuggcccu

SEQ ID NO: 1984139 - RNA, 15 nt, Human
cucccuucauccuuc

SEQ ID NO: 1984140 - RNA, 22 nt, Human
cucccuucaaccauuccccaug

SEQ ID NO: 1984141 - RNA, 23 nt, Human
cucccuucaaccauuccccaugg

SEQ ID NO: 1984142 - RNA, 21 nt, Human
cucccuucaaccauuccccau

SEQ ID NO: 1984143 - RNA, 20 nt, Human
cucccgaauagcugggacua

SEQ ID NO: 1984144 - RNA, 23 nt, Human
cucccgaauagcugggacuacag

SEQ ID NO: 1984145 - RNA, 12 nt, Human
cuccccuggacu

SEQ ID NO: 1984146 - RNA, 14 nt, Human
cuccccuggacucc

SEQ ID NO: 1984147 - RNA, 16 nt, Human
cuccccugugccagcc

SEQ ID NO: 1984148 - RNA, 22 nt, Human
cucccucaagccagacucugcc

SEQ ID NO: 1984149 - RNA, 14 nt, Human
cucccucacucuca

SEQ ID NO: 1984150 - RNA, 15 nt, Human
cucccucacucucag

SEQ ID NO: 1984151 - RNA, 16 nt, Human
cucccucacucucagg

SEQ ID NO: 1984152 - RNA, 17 nt, Human
cucccucacucucagga

SEQ ID NO: 1984153 - RNA, 18 nt, Human
cucccucacucucaggaa

SEQ ID NO: 1984154 - RNA, 14 nt, Human
cuccccugugccag

SEQ ID NO: 1984155 - RNA, 20 nt, Human
cucccgagacggcacugaga

SEQ ID NO: 1984156 - RNA, 22 nt, Human
cuccagcucuggcauggcuagg

SEQ ID NO: 1984157 - RNA, 16 nt, Human
cuccagcucuggcaug

SEQ ID NO: 1984158 - RNA, 22 nt, Human
cuccagcuggccgggagccuga

SEQ ID NO: 1984159 - RNA, 23 nt, Human
cuccagcuggccgggagccugau

SEQ ID NO: 1984160 - RNA, 13 nt, Human
cuccaugcugccu

SEQ ID NO: 1984161 - RNA, 14 nt, Human
cuccaugcugccuc

SEQ ID NO: 1984162 - RNA, 15 nt, Human
cuccaugcugccucc

SEQ ID NO: 1984163 - RNA, 16 nt, Human
cuccaugcugccucca

SEQ ID NO: 1984164 - RNA, 17 nt, Human
cuccaugcugccuccag

SEQ ID NO: 1984165 - RNA, 15 nt, Human
cucccaacucacccc

SEQ ID NO: 1984166 - RNA, 14 nt, Human
cucccaacucaccc

SEQ ID NO: 1984167 - RNA, 15 nt, Human
cucccacaaaggaga

SEQ ID NO: 1984168 - RNA, 16 nt, Human
cucccaaagugcuggg

SEQ ID NO: 1984169 - RNA, 23 nt, Human
cucccaaagugcugggauuacag

SEQ ID NO: 1984170 - RNA, 22 nt, Human
cucccaaaagcuagaacacugc

SEQ ID NO: 1984171 - RNA, 16 nt, Human
cuccauuucacuggcu

SEQ ID NO: 1984172 - RNA, 21 nt, Human
cuccauuuuggugucuuucuc

SEQ ID NO: 1984173 - RNA, 22 nt, Human
cuccauuuuggugucuuucucu

SEQ ID NO: 1984174 - RNA, 16 nt, Human
cucccaaaagcuagaa

SEQ ID NO: 1984175 - RNA, 16 nt, Human
cucccaucacuucccu

SEQ ID NO: 1984176 - RNA, 22 nt, Human
cucccagggagcaagggcaggg

SEQ ID NO: 1984177 - RNA, 13 nt, Human
cucccaggcucuc

SEQ ID NO: 1984178 - RNA, 12 nt, Human
cucccaggcucu

SEQ ID NO: 1984179 - RNA, 20 nt, Human
cucccagggagcaagggcag

SEQ ID NO: 1984180 - RNA, 20 nt, Human
cucccaggcgccccuucccc

SEQ ID NO: 1984181 - RNA, 22 nt, Human
cucccaggcgccccuucccccu

SEQ ID NO: 1984182 - RNA, 17 nt, Human
cucccaggcgccccuuc

SEQ ID NO: 1984183 - RNA, 19 nt, Human
cucccaggcgccccuuccc

SEQ ID NO: 1984184 - RNA, 14 nt, Human
cuccaaggccaggc

SEQ ID NO: 1984185 - RNA, 19 nt, Human
cuccaaggccaggccuugg

SEQ ID NO: 1984186 - RNA, 20 nt, Human
cuccaaggccaggccuuggg

SEQ ID NO: 1984187 - RNA, 14 nt, Human
cuccacucuccucu

SEQ ID NO: 1984188 - RNA, 13 nt, Human
cuccacugccuuc

SEQ ID NO: 1984189 - RNA, 14 nt, Human
cuccacugccuucg

SEQ ID NO: 1984190 - RNA, 15 nt, Human
cuccacugccuucga

SEQ ID NO: 1984191 - RNA, 16 nt, Human
cuccacugccuucgau

SEQ ID NO: 1984192 - RNA, 13 nt, Human
cuccacuggaugg

SEQ ID NO: 1984193 - RNA, 14 nt, Human
cuccagccccugga

SEQ ID NO: 1984194 - RNA, 13 nt, Human
cuccagccccugg

SEQ ID NO: 1984195 - RNA, 11 nt, Human
cuccagccccu

SEQ ID NO: 1984196 - RNA, 15 nt, Human
cuccagcucaccagc

SEQ ID NO: 1984197 - RNA, 16 nt, Human
cuccagcucaccagcc

SEQ ID NO: 1984198 - RNA, 18 nt, Human
cuccagcucaccagcccc

SEQ ID NO: 1984199 - RNA, 21 nt, Human
cuccagaccccuggcuuuuca

SEQ ID NO: 1984200 - RNA, 14 nt, Human
cuccacuggaugga

SEQ ID NO: 1984201 - RNA, 20 nt, Human
cuccagaguggggaugacau

SEQ ID NO: 1984202 - RNA, 21 nt, Human
cuccagagcugcggugucucc

SEQ ID NO: 1984203 - RNA, 16 nt, Human
cuccagagucagaagu

SEQ ID NO: 1984204 - RNA, 18 nt, Human
cuccaaaauaaaacuuuu

SEQ ID NO: 1984205 - RNA, 13 nt, Human
cucauuuugcuug

SEQ ID NO: 1984206 - RNA, 17 nt, Human
cuccaagcucccaggca

SEQ ID NO: 1984207 - RNA, 17 nt, Human
cuccaaggacagaaggc

SEQ ID NO: 1984208 - RNA, 20 nt, Human
cuccaaggacagaaggcucc

SEQ ID NO: 1984209 - RNA, 21 nt, Human
cucauuugucacacacuuugg

SEQ ID NO: 1984210 - RNA, 18 nt, Human
cucauuuuaaugauuguu

SEQ ID NO: 1984211 - RNA, 20 nt, Human
cucauuuuaaugauuguuua

SEQ ID NO: 1984212 - RNA, 21 nt, Human
cucauuuuaaugauuguuuaa

SEQ ID NO: 1984213 - RNA, 21 nt, Human
cucauugaccugaggcccuuc

SEQ ID NO: 1984214 - RNA, 19 nt, Human
cucauugaccugaggcccu

SEQ ID NO: 1984215 - RNA, 18 nt, Human
cucauucuccuuguguua

SEQ ID NO: 1984216 - RNA, 22 nt, Human
cucauucuccuuguguuacuaa

SEQ ID NO: 1984217 - RNA, 17 nt, Human
cucauugaccugaggcc

SEQ ID NO: 1984218 - RNA, 12 nt, Human
cucauucuucug

SEQ ID NO: 1984219 - RNA, 16 nt, Human
cucaguucucuucacu

SEQ ID NO: 1984220 - RNA, 17 nt, Human
cucaguucucuucacuc

SEQ ID NO: 1984221 - RNA, 15 nt, Human
cucaguuuuuuuccu

SEQ ID NO: 1984222 - RNA, 12 nt, Human
cucaguuuuucu

SEQ ID NO: 1984223 - RNA, 14 nt, Human
cucaguuuuucuua

SEQ ID NO: 1984224 - RNA, 19 nt, Human
cuauuggggaacucauugu

SEQ ID NO: 1984225 - RNA, 16 nt, Human
cuauugcugcuugagg

SEQ ID NO: 1984226 - RNA, 21 nt, Human
cuauuuaaagaaauauguauu

SEQ ID NO: 1984227 - RNA, 13 nt, Human
cuauuuaaagaaa

SEQ ID NO: 1984228 - RNA, 18 nt, Human
cuauuguuagucucuuga

SEQ ID NO: 1984229 - RNA, 11 nt, Human
cuauugguaaa

SEQ ID NO: 1984230 - RNA, 17 nt, Human
cucacagaacccuugga

SEQ ID NO: 1984231 - RNA, 12 nt, Human
cucacagacagg

SEQ ID NO: 1984232 - RNA, 13 nt, Human
cucacagacagga

SEQ ID NO: 1984233 - RNA, 15 nt, Human
cucacagacaggacc

SEQ ID NO: 1984234 - RNA, 16 nt, Human
cucacagacaggaccc

SEQ ID NO: 1984235 - RNA, 18 nt, Human
cucacagacaggaccccu

SEQ ID NO: 1984236 - RNA, 13 nt, Human
cucacacucaccc

SEQ ID NO: 1984237 - RNA, 23 nt, Human
cucacacggacacucaaaagcug

SEQ ID NO: 1984238 - RNA, 14 nt, Human
cucaaguccucuuu

SEQ ID NO: 1984239 - RNA, 19 nt, Human
cucaagccagacucugcca

SEQ ID NO: 1984240 - RNA, 15 nt, Human
cucaagcccaggagg

SEQ ID NO: 1984241 - RNA, 13 nt, Human
cucaagccaccag

SEQ ID NO: 1984242 - RNA, 21 nt, Human
cucaagccaccagaugugaca

SEQ ID NO: 1984243 - RNA, 16 nt, Human
cucaagcccaggaggg

SEQ ID NO: 1984244 - RNA, 18 nt, Human
cucaacucuccuccagag

SEQ ID NO: 1984245 - RNA, 16 nt, Human
cucaacucuccuccag

SEQ ID NO: 1984246 - RNA, 12 nt, Human
cuauuuauuuau

SEQ ID NO: 1984247 - RNA, 19 nt, Human
cuauuuauuuauuuauuca

SEQ ID NO: 1984248 - RNA, 18 nt, Human
cuauuucaacuucaggaa

SEQ ID NO: 1984249 - RNA, 11 nt, Human
cuauuucuuga

SEQ ID NO: 1984250 - RNA, 14 nt, Human
cucaaauuucuaaa

SEQ ID NO: 1984251 - RNA, 22 nt, Human
cucaacaugucuccuacugagg

SEQ ID NO: 1984252 - RNA, 15 nt, Human
cucaaauuucuaaau

SEQ ID NO: 1984253 - RNA, 17 nt, Human
cucaaauuucuaaaucu

SEQ ID NO: 1984254 - RNA, 14 nt, Human
cucaaccaaauggu

SEQ ID NO: 1984255 - RNA, 20 nt, Human
cucaaccaaaugguacaaaa

SEQ ID NO: 1984256 - RNA, 14 nt, Human
cucaacucuccucc

SEQ ID NO: 1984257 - RNA, 19 nt, Human
cuauagccuaggugacaga

SEQ ID NO: 1984258 - RNA, 18 nt, Human
cuauagccuaggugacag

SEQ ID NO: 1984259 - RNA, 20 nt, Human
cuauagccuaggugacagag

SEQ ID NO: 1984260 - RNA, 21 nt, Human
cuauagccuaggugacagagu

SEQ ID NO: 1984261 - RNA, 21 nt, Human
cuauaccauuuccguaauucu

SEQ ID NO: 1984262 - RNA, 17 nt, Human
cuaggaagacuuuggaa

SEQ ID NO: 1984263 - RNA, 15 nt, Human
cuaggaagacuuugg

SEQ ID NO: 1984264 - RNA, 20 nt, Human
cuaggaacacuccuucacag

SEQ ID NO: 1984265 - RNA, 12 nt, Human
cuauaauuuaaa

SEQ ID NO: 1984266 - RNA, 13 nt, Human
cuauaauuuaaau

SEQ ID NO: 1984267 - RNA, 18 nt, Human
cuauaauuauuauucaga

SEQ ID NO: 1984268 - RNA, 22 nt, Human
cuaugaaguuuuuuuuauacag

SEQ ID NO: 1984269 - RNA, 20 nt, Human
cuaugauguuaguuuuccuu

SEQ ID NO: 1984270 - RNA, 14 nt, Human
cuaugcaaaaagcu

SEQ ID NO: 1984271 - RNA, 19 nt, Human
cuaugauuuggaaaauaaa

SEQ ID NO: 1984272 - RNA, 15 nt, Human
cuaugauuuggaaaa

SEQ ID NO: 1984273 - RNA, 19 nt, Human
cuaugauuuaauuugaaau

SEQ ID NO: 1984274 - RNA, 20 nt, Human
cuaugauuuaauuugaaaua

SEQ ID NO: 1984275 - RNA, 17 nt, Human
cuauucaguaauaacuc

SEQ ID NO: 1984276 - RNA, 16 nt, Human
cuauguaucaaugagu

SEQ ID NO: 1984277 - RNA, 18 nt, Human
cuauuaguguuauaugaa

SEQ ID NO: 1984278 - RNA, 19 nt, Human
cuauuaguguuauaugaac

SEQ ID NO: 1984279 - RNA, 13 nt, Human
cuauguaucaaug

SEQ ID NO: 1984280 - RNA, 19 nt, Human
cuauggggauagaugugug

SEQ ID NO: 1984281 - RNA, 20 nt, Human
cuauggggauagaugugugg

SEQ ID NO: 1984282 - RNA, 21 nt, Human
cuauggggauagaugugugga

SEQ ID NO: 1984283 - RNA, 19 nt, Human
cuaugggggcacugaggac

SEQ ID NO: 1984284 - RNA, 23 nt, Human
cuauucaguaauaacucuacccu

SEQ ID NO: 1984285 - RNA, 16 nt, Human
cuauugagucuucaug

SEQ ID NO: 1984286 - RNA, 17 nt, Human
cuauugagucuucaugu

SEQ ID NO: 1984287 - RNA, 11 nt, Human
cuaggaaaaaa

SEQ ID NO: 1984288 - RNA, 14 nt, Human
cuaggaaaagaaau

SEQ ID NO: 1984289 - RNA, 19 nt, Human
cuaggaaaagaaaucuaua

SEQ ID NO: 1984290 - RNA, 22 nt, Human
cuagcuggagaggagcccugcc

SEQ ID NO: 1984291 - RNA, 23 nt, Human
cuagcuggagaggagcccugccu

SEQ ID NO: 1984292 - RNA, 13 nt, Human
cuagcuggagagg

SEQ ID NO: 1984293 - RNA, 18 nt, Human
cuagcuggagaggagccc

SEQ ID NO: 1984294 - RNA, 19 nt, Human
cuagcuggagaggagcccu

SEQ ID NO: 1984295 - RNA, 21 nt, Human
cuagcuggagaggagcccugc

SEQ ID NO: 1984296 - RNA, 10 nt, Human
cuagcugaau

SEQ ID NO: 1984297 - RNA, 24 nt, Human
cuagauacuguaucaugacaaaga

SEQ ID NO: 1984298 - RNA, 13 nt, Human
cuagauacuguau

SEQ ID NO: 1984299 - RNA, 16 nt, Human
cuagauacuguaucau

SEQ ID NO: 1984300 - RNA, 19 nt, Human
cuagccugugccucuggga

SEQ ID NO: 1984301 - RNA, 21 nt, Human
cuagccugugccucugggacu

SEQ ID NO: 1984302 - RNA, 22 nt, Human
cuagccugugccucugggacug

SEQ ID NO: 1984303 - RNA, 21 nt, Human
cuagccuuagaagucacacag

SEQ ID NO: 1984304 - RNA, 22 nt, Human
cuagccuuagaagucacacagu

SEQ ID NO: 1984305 - RNA, 23 nt, Human
cuagccuuagaagucacacagua

SEQ ID NO: 1984306 - RNA, 16 nt, Human
cuagcguagugcagca

SEQ ID NO: 1984307 - RNA, 19 nt, Human
cuagcguagugcagcaggg

SEQ ID NO: 1984308 - RNA, 20 nt, Human
cuagcguagugcagcagggc

SEQ ID NO: 1984309 - RNA, 22 nt, Human
cuagcguagugcagcagggcag

SEQ ID NO: 1984310 - RNA, 22 nt, Human
cuacucuagagaaguggacugg

SEQ ID NO: 1984311 - RNA, 19 nt, Human
cuacuccugucuucugcuu

SEQ ID NO: 1984312 - RNA, 20 nt, Human
cuacuccugucuucugcuuu

SEQ ID NO: 1984313 - RNA, 21 nt, Human
cuacuccugucuucugcuuug

SEQ ID NO: 1984314 - RNA, 22 nt, Human
cuacuccugucuucugcuuugu

SEQ ID NO: 1984315 - RNA, 22 nt, Human
cuacucuggagguuuguuuaga

SEQ ID NO: 1984316 - RNA, 12 nt, Human
cuacucuguguc

SEQ ID NO: 1984317 - RNA, 13 nt, Human
cuacucuguguca

SEQ ID NO: 1984318 - RNA, 14 nt, Human
cuacugggagccua

SEQ ID NO: 1984319 - RNA, 15 nt, Human
cuacugggagccuac

SEQ ID NO: 1984320 - RNA, 21 nt, Human
cuacuggcagcugauacguuu

SEQ ID NO: 1984321 - RNA, 16 nt, Human
cuacugcauuuaggga

SEQ ID NO: 1984322 - RNA, 17 nt, Human
cuacugcauuuagggag

SEQ ID NO: 1984323 - RNA, 19 nt, Human
cuacugcauuuagggagua

SEQ ID NO: 1984324 - RNA, 14 nt, Human
cuacugccaaccuc

SEQ ID NO: 1984325 - RNA, 19 nt, Human
cuacugccaaccucgcucc

SEQ ID NO: 1984326 - RNA, 22 nt, Human
cuacugccaaccucgcuccaac

SEQ ID NO: 1984327 - RNA, 23 nt, Human
cuacugccaaccucgcuccaacu

SEQ ID NO: 1984328 - RNA, 18 nt, Human
cuacugggagccuaccca

SEQ ID NO: 1984329 - RNA, 17 nt, Human
cuacuggguguagacug

SEQ ID NO: 1984330 - RNA, 19 nt, Human
cuacugguccucuuaacug

SEQ ID NO: 1984331 - RNA, 19 nt, Human
cuacuguccuacccacccu

SEQ ID NO: 1984332 - RNA, 19 nt, Human
cuacucgaguuacagacaa

SEQ ID NO: 1984333 - RNA, 16 nt, Human
cuacucgaguuacaga

SEQ ID NO: 1984334 - RNA, 15 nt, Human
cuacucgaguuacag

SEQ ID NO: 1984335 - RNA, 13 nt, Human
cuacuccugucuu

SEQ ID NO: 1984336 - RNA, 14 nt, Human
cuacuccugucuuc

SEQ ID NO: 1984337 - RNA, 16 nt, Human
cuacuccugucuucug

SEQ ID NO: 1984338 - RNA, 17 nt, Human
cuacuccugucuucugc

SEQ ID NO: 1984339 - RNA, 12 nt, Human
cuacucauuuua

SEQ ID NO: 1984340 - RNA, 16 nt, Human
cuacucauuuuaauga

SEQ ID NO: 1984341 - RNA, 17 nt, Human
cuaccgagucucuucuc

SEQ ID NO: 1984342 - RNA, 19 nt, Human
cuaccgagucucuucucca

SEQ ID NO: 1984343 - RNA, 23 nt, Human
cuaccgagucucuucuccacugg

SEQ ID NO: 1984344 - RNA, 21 nt, Human
cuaccgagucucuucuccacu

SEQ ID NO: 1984345 - RNA, 22 nt, Human
cuaccgagucucuucuccacug

SEQ ID NO: 1984346 - RNA, 14 nt, Human
cuaccuaacccaga

SEQ ID NO: 1984347 - RNA, 21 nt, Human
cuagagaaguggacuggagga

SEQ ID NO: 1984348 - RNA, 22 nt, Human
cuagagaaguggacuggaggag

SEQ ID NO: 1984349 - RNA, 23 nt, Human
cuagagaaguggacuggaggagc

SEQ ID NO: 1984350 - RNA, 20 nt, Human
cuagagagugugauguucac

SEQ ID NO: 1984351 - RNA, 17 nt, Human
cuagagggaccucuccc

SEQ ID NO: 1984352 - RNA, 16 nt, Human
cuagaguagagguaua

SEQ ID NO: 1984353 - RNA, 20 nt, Human
cuagaguagagguauaauug

SEQ ID NO: 1984354 - RNA, 21 nt, Human
cuagaguagagguauaauugu

SEQ ID NO: 1984355 - RNA, 15 nt, Human
cuagagguucaaaga

SEQ ID NO: 1984356 - RNA, 16 nt, Human
cuagagggaccucucc

SEQ ID NO: 1984357 - RNA, 15 nt, Human
cuagagggaccucuc

SEQ ID NO: 1984358 - RNA, 14 nt, Human
cuagagggaccucu

SEQ ID NO: 1984359 - RNA, 23 nt, Human
cuagaggccuuuaguuauaaagg

SEQ ID NO: 1984360 - RNA, 17 nt, Human
cuagagguucaaagaua

SEQ ID NO: 1984361 - RNA, 18 nt, Human
cuagagguucaaagauau

SEQ ID NO: 1984362 - RNA, 21 nt, Human
cuagagguucaaagauauuuu

SEQ ID NO: 1984363 - RNA, 18 nt, Human
cuagacugccacaaggaa

SEQ ID NO: 1984364 - RNA, 22 nt, Human
cuacuuuuaaagaauuucuuua

SEQ ID NO: 1984365 - RNA, 18 nt, Human
cuacuguuuaagugaauu

SEQ ID NO: 1984366 - RNA, 23 nt, Human
cuacuguucagcuuuuauuccug

SEQ ID NO: 1984367 - RNA, 20 nt, Human
cuacuguccuacccacccuc

SEQ ID NO: 1984368 - RNA, 15 nt, Human
cuacuuuuuaacaga

SEQ ID NO: 1984369 - RNA, 17 nt, Human
cuacuuagcaugucccu

SEQ ID NO: 1984370 - RNA, 16 nt, Human
cuacuuagcacuucag

SEQ ID NO: 1984371 - RNA, 22 nt, Human
cuacuuagcaugucccuaccga

SEQ ID NO: 1984372 - RNA, 19 nt, Human
cuacuuagcacuucagggc

SEQ ID NO: 1984373 - RNA, 11 nt, Human
cuacagggccg

SEQ ID NO: 1984374 - RNA, 15 nt, Human
cuacaggcacccacc

SEQ ID NO: 1984375 - RNA, 17 nt, Human
cuacaggcacccaccau

SEQ ID NO: 1984376 - RNA, 14 nt, Human
cuacaggagugagc

SEQ ID NO: 1984377 - RNA, 15 nt, Human
cuacaggagugagca

SEQ ID NO: 1984378 - RNA, 16 nt, Human
cuacaggagugagcac

SEQ ID NO: 1984379 - RNA, 14 nt, Human
cuacaggugugagu

SEQ ID NO: 1984380 - RNA, 16 nt, Human
cuacaggugugaguca

SEQ ID NO: 1984381 - RNA, 20 nt, Human
cuacauggaguauaugucaa

SEQ ID NO: 1984382 - RNA, 18 nt, Human
cuacauggaguauauguc

SEQ ID NO: 1984383 - RNA, 13 nt, Human
cuacaguccuccc

SEQ ID NO: 1984384 - RNA, 22 nt, Human
cuacagcuugaccgugaggcca

SEQ ID NO: 1984385 - RNA, 19 nt, Human
cuacagcuugaccgugagg

SEQ ID NO: 1984386 - RNA, 23 nt, Human
cuacagcuugaccgugaggccag

SEQ ID NO: 1984387 - RNA, 21 nt, Human
cuacagcuaaucagcauucuc

SEQ ID NO: 1984388 - RNA, 22 nt, Human
cuacagcuaaucagcauucuca

SEQ ID NO: 1984389 - RNA, 14 nt, Human
cuacagcuccccca

SEQ ID NO: 1984390 - RNA, 19 nt, Human
cuacagcucccccagcucc

SEQ ID NO: 1984391 - RNA, 18 nt, Human
cuacagcuaaucagcauu

SEQ ID NO: 1984392 - RNA, 19 nt, Human
cuacagcuaaucagcauuc

SEQ ID NO: 1984393 - RNA, 17 nt, Human
cuacacugugcugaguc

SEQ ID NO: 1984394 - RNA, 14 nt, Human
cuacacugugcuga

SEQ ID NO: 1984395 - RNA, 13 nt, Human
cuacacugugcug

SEQ ID NO: 1984396 - RNA, 22 nt, Human
cuacagaggccaugggccuccu

SEQ ID NO: 1984397 - RNA, 18 nt, Human
cuacagaggccaugggcc

SEQ ID NO: 1984398 - RNA, 20 nt, Human
cuacagaggccaugggccuc

SEQ ID NO: 1984399 - RNA, 17 nt, Human
cuacccucuuagaaaaa

SEQ ID NO: 1984400 - RNA, 13 nt, Human
cuacccaggugcu

SEQ ID NO: 1984401 - RNA, 18 nt, Human
cuacccagcgagcccugg

SEQ ID NO: 1984402 - RNA, 13 nt, Human
cuacccacccucc

SEQ ID NO: 1984403 - RNA, 15 nt, Human
cuacccagcgagccc

SEQ ID NO: 1984404 - RNA, 17 nt, Human
cuacccagcgagcccug

SEQ ID NO: 1984405 - RNA, 14 nt, Human
cuacauuuccgcca

SEQ ID NO: 1984406 - RNA, 13 nt, Human
cuacauucuguua

SEQ ID NO: 1984407 - RNA, 14 nt, Human
cuacauucuguuaa

SEQ ID NO: 1984408 - RNA, 22 nt, Human
cuacauuauaaaugucucuuua

SEQ ID NO: 1984409 - RNA, 17 nt, Human
cuacaugcuuugugaac

SEQ ID NO: 1984410 - RNA, 19 nt, Human
cuacaugcuuguugacaga

SEQ ID NO: 1984411 - RNA, 22 nt, Human
cuacauggggucuggguggggg

SEQ ID NO: 1984412 - RNA, 18 nt, Human
cuaccacggccuccuuuc

SEQ ID NO: 1984413 - RNA, 19 nt, Human
cuaccacggccuccuuucc

SEQ ID NO: 1984414 - RNA, 21 nt, Human
cuaccacggccuccuuuccgu

SEQ ID NO: 1984415 - RNA, 18 nt, Human
cuaccauccccuguagag

SEQ ID NO: 1984416 - RNA, 15 nt, Human
cuaccaaaggacacu

SEQ ID NO: 1984417 - RNA, 13 nt, Human
cuaccaacuuuca

SEQ ID NO: 1984418 - RNA, 14 nt, Human
cuaccaacuuucaa

SEQ ID NO: 1984419 - RNA, 23 nt, Human
cuaccaacuuucaagaacuuguu

SEQ ID NO: 1984420 - RNA, 21 nt, Human
cuacacaggggaaaagaggag

SEQ ID NO: 1984421 - RNA, 13 nt, Human
cuacacaggacag

SEQ ID NO: 1984422 - RNA, 21 nt, Human
cuacacauauaaauugucuua

SEQ ID NO: 1984423 - RNA, 15 nt, Human
cuacacaggacaggg

SEQ ID NO: 1984424 - RNA, 22 nt, Human
cuacacaggacagggguuccuu

SEQ ID NO: 1984425 - RNA, 14 nt, Human
cuaauuccacagcu

SEQ ID NO: 1984426 - RNA, 15 nt, Human
cuaauuccacagcug

SEQ ID NO: 1984427 - RNA, 16 nt, Human
cuaauuccacagcugc

SEQ ID NO: 1984428 - RNA, 23 nt, Human
cuacacgguucaaaccugugaag

SEQ ID NO: 1984429 - RNA, 23 nt, Human
cuacacgagauacagaauuuuau

SEQ ID NO: 1984430 - RNA, 22 nt, Human
cuaaugcgcaggcuggcccugc

SEQ ID NO: 1984431 - RNA, 23 nt, Human
cuaaugcgcaggcuggcccugcc

SEQ ID NO: 1984432 - RNA, 12 nt, Human
cuaaugggacac

SEQ ID NO: 1984433 - RNA, 13 nt, Human
cuaaugggacacu

SEQ ID NO: 1984434 - RNA, 22 nt, Human
cuaauuauacccccugcaaagc

SEQ ID NO: 1984435 - RNA, 14 nt, Human
cuaauuaauuucag

SEQ ID NO: 1984436 - RNA, 15 nt, Human
cuaauuaauuucagu

SEQ ID NO: 1984437 - RNA, 17 nt, Human
cuaauuaauuucaguaa

SEQ ID NO: 1984438 - RNA, 18 nt, Human
cuaauauguaacaagcca

SEQ ID NO: 1984439 - RNA, 22 nt, Human
cuaauauccacuuguccaugug

SEQ ID NO: 1984440 - RNA, 20 nt, Human
cuaaucagcauucucacucc

SEQ ID NO: 1984441 - RNA, 21 nt, Human
cuaaucagcauucucacuccu

SEQ ID NO: 1984442 - RNA, 15 nt, Human
cuaaugcgcaggcug

SEQ ID NO: 1984443 - RNA, 16 nt, Human
cuaaugcgcaggcugg

SEQ ID NO: 1984444 - RNA, 19 nt, Human
cuaaugcgcaggcuggccc

SEQ ID NO: 1984445 - RNA, 20 nt, Human
cuaaugcgcaggcuggcccu

SEQ ID NO: 1984446 - RNA, 22 nt, Human
cuaagcuauucaguaauaacuc

SEQ ID NO: 1984447 - RNA, 13 nt, Human
cuaagauguuaua

SEQ ID NO: 1984448 - RNA, 14 nt, Human
cuaagauguuauau

SEQ ID NO: 1984449 - RNA, 19 nt, Human
cuaagauguuauauuuuuc

SEQ ID NO: 1984450 - RNA, 20 nt, Human
cuaagauguuauauuuuucu

SEQ ID NO: 1984451 - RNA, 15 nt, Human
cuaagauuaauagca

SEQ ID NO: 1984452 - RNA, 21 nt, Human
cuaagcuucacuguaaaauaa

SEQ ID NO: 1984453 - RNA, 14 nt, Human
cuaaggaaccuucc

SEQ ID NO: 1984454 - RNA, 15 nt, Human
cuaaggaaccuuccu

SEQ ID NO: 1984455 - RNA, 21 nt, Human
cuaaggacaagguaaggaggg

SEQ ID NO: 1984456 - RNA, 14 nt, Human
cuaauaaagcugug

SEQ ID NO: 1984457 - RNA, 17 nt, Human
cuaauaacaugugaaaa

SEQ ID NO: 1984458 - RNA, 18 nt, Human
cuaauaaucauuggauuc

SEQ ID NO: 1984459 - RNA, 17 nt, Human
cuaauaagcuaguugaa

SEQ ID NO: 1984460 - RNA, 22 nt, Human
cuaauaagcuaguugaauacuu

SEQ ID NO: 1984461 - RNA, 12 nt, Human
cuaauaauaaau

SEQ ID NO: 1984462 - RNA, 13 nt, Human
cuaauaauaaaua

SEQ ID NO: 1984463 - RNA, 14 nt, Human
cuaauaauaaauag

SEQ ID NO: 1984464 - RNA, 15 nt, Human
cuaauaauaaauagu

SEQ ID NO: 1984465 - RNA, 16 nt, Human
cuaauaauaaauaguu

SEQ ID NO: 1984466 - RNA, 17 nt, Human
cuaauaauaaauaguuc

SEQ ID NO: 1984467 - RNA, 20 nt, Human
cuaauaauaaauaguucuuc

SEQ ID NO: 1984468 - RNA, 21 nt, Human
cuaauacagccccuuuucccu

SEQ ID NO: 1984469 - RNA, 17 nt, Human
cuaauagacaauuuauu

SEQ ID NO: 1984470 - RNA, 19 nt, Human
cuaauagacaauuuauuau

SEQ ID NO: 1984471 - RNA, 23 nt, Human
cuaauagacaauuuauuauggca

SEQ ID NO: 1984472 - RNA, 19 nt, Human
cuaauagcuacaucuacuu

SEQ ID NO: 1984473 - RNA, 16 nt, Human
cuaauauccacuuguc

SEQ ID NO: 1984474 - RNA, 13 nt, Human
cguuuucaaaauu

SEQ ID NO: 1984475 - RNA, 13 nt, Human
cguuuuaaggacu

SEQ ID NO: 1984476 - RNA, 16 nt, Human
cguuuuaaggacugac

SEQ ID NO: 1984477 - RNA, 23 nt, Human
cguuuuaaggacugacugaggca

SEQ ID NO: 1984478 - RNA, 13 nt, Human
cuaaaaauaaagc

SEQ ID NO: 1984479 - RNA, 14 nt, Human
cuaaaaauaaagca

SEQ ID NO: 1984480 - RNA, 15 nt, Human
cuaaaaauaaagcac

SEQ ID NO: 1984481 - RNA, 17 nt, Human
cuaaaaauaacuguaau

SEQ ID NO: 1984482 - RNA, 22 nt, Human
cuaaaaauaacuguaauuauuu

SEQ ID NO: 1984483 - RNA, 23 nt, Human
cuaaaaauaacuguaauuauuug

SEQ ID NO: 1984484 - RNA, 14 nt, Human
cuaaaauaagaaua

SEQ ID NO: 1984485 - RNA, 15 nt, Human
cuaaaauaauuuugu

SEQ ID NO: 1984486 - RNA, 17 nt, Human
cuaaaauaauuuuguaa

SEQ ID NO: 1984487 - RNA, 18 nt, Human
cuaaaauaauuuuguaau

SEQ ID NO: 1984488 - RNA, 23 nt, Human
cgggaggauguucugggacacag

SEQ ID NO: 1984489 - RNA, 18 nt, Human
cgggacguggcaccuccu

SEQ ID NO: 1984490 - RNA, 21 nt, Human
cgggaggauguucugggacac

SEQ ID NO: 1984491 - RNA, 15 nt, Human
cgggacguggcaccu

SEQ ID NO: 1984492 - RNA, 20 nt, Human
cguuuguuccccaagacauu

SEQ ID NO: 1984493 - RNA, 19 nt, Human
cguuugauuugucacugcu

SEQ ID NO: 1984494 - RNA, 20 nt, Human
cgggaggcagagguugcagu

SEQ ID NO: 1984495 - RNA, 15 nt, Human
cuaaacuaggcuccu

SEQ ID NO: 1984496 - RNA, 17 nt, Human
cuaaacuaggcuccuuc

SEQ ID NO: 1984497 - RNA, 16 nt, Human
cuaaacucugaauaag

SEQ ID NO: 1984498 - RNA, 12 nt, Human
cuaaacugcccc

SEQ ID NO: 1984499 - RNA, 13 nt, Human
cuaaacugccccc

SEQ ID NO: 1984500 - RNA, 22 nt, Human
cuaaaauauuuaugaagaaaau

SEQ ID NO: 1984501 - RNA, 20 nt, Human
cuaaaauauuuaugaagaaa

SEQ ID NO: 1984502 - RNA, 21 nt, Human
cuaaaauauuuaugaagaaaa

SEQ ID NO: 1984503 - RNA, 22 nt, Human
cuaaaauaucuggguggcuuaa

SEQ ID NO: 1984504 - RNA, 10 nt, Human
cuaaaauauu

SEQ ID NO: 1984505 - RNA, 15 nt, Human
cuaaaauauuuauga

SEQ ID NO: 1984506 - RNA, 16 nt, Human
cuaaaauauuuaugaa

SEQ ID NO: 1984507 - RNA, 21 nt, Human
cuaaaucuccaaaauaaaacu

SEQ ID NO: 1984508 - RNA, 17 nt, Human
cuaaauauauuuuaaga

SEQ ID NO: 1984509 - RNA, 22 nt, Human
cuaaaugaaaaucgugacaaca

SEQ ID NO: 1984510 - RNA, 18 nt, Human
cuaaauaaguuauaaaga

SEQ ID NO: 1984511 - RNA, 21 nt, Human
cuaaacugcccccucugcccu

SEQ ID NO: 1984512 - RNA, 13 nt, Human
cuaaaauguucua

SEQ ID NO: 1984513 - RNA, 18 nt, Human
cuaagauauacuuguuuu

SEQ ID NO: 1984514 - RNA, 22 nt, Human
cuaagauauacuuguuuuugua

SEQ ID NO: 1984515 - RNA, 23 nt, Human
cuaagauauacuuguuuuuguaa

SEQ ID NO: 1984516 - RNA, 17 nt, Human
cuaagaucgguuaacaa

SEQ ID NO: 1984517 - RNA, 18 nt, Human
cuaagaucgguuaacaaa

SEQ ID NO: 1984518 - RNA, 20 nt, Human
cuaagaucgguuaacaaaua

SEQ ID NO: 1984519 - RNA, 21 nt, Human
cuaagaucgguuaacaaauaa

SEQ ID NO: 1984520 - RNA, 23 nt, Human
cuaagagggagggagggcuccag

SEQ ID NO: 1984521 - RNA, 22 nt, Human
cuaagagggagggagggcucca

SEQ ID NO: 1984522 - RNA, 15 nt, Human
cuaagagggagggag

SEQ ID NO: 1984523 - RNA, 13 nt, Human
cuaagagggaggg

SEQ ID NO: 1984524 - RNA, 18 nt, Human
cuaagaggaaaguacauu

SEQ ID NO: 1984525 - RNA, 12 nt, Human
cuaaccagggcc

SEQ ID NO: 1984526 - RNA, 12 nt, Human
cuaaccacgcug

SEQ ID NO: 1984527 - RNA, 14 nt, Human
cuaaccacgcugga

SEQ ID NO: 1984528 - RNA, 15 nt, Human
cuaaccacagcuccu

SEQ ID NO: 1984529 - RNA, 21 nt, Human
cuaacagcaguuucagguaga

SEQ ID NO: 1984530 - RNA, 19 nt, Human
cuaaauucuuucauuuuag

SEQ ID NO: 1984531 - RNA, 19 nt, Human
cuaaauugacacuuaaaaa

SEQ ID NO: 1984532 - RNA, 16 nt, Human
cuaaauucaugcugcu

SEQ ID NO: 1984533 - RNA, 20 nt, Human
cuaacaacauuguagccuca

SEQ ID NO: 1984534 - RNA, 23 nt, Human
cuaacaaacagauucuuuuaugu

SEQ ID NO: 1984535 - RNA, 23 nt, Human
cccucccucuuucccucccuucc

SEQ ID NO: 1984536 - RNA, 17 nt, Human
cccucccggcccugccu

SEQ ID NO: 1984537 - RNA, 14 nt, Human
cccucccugccccu

SEQ ID NO: 1984538 - RNA, 21 nt, Human
cccucgucuuucccaaaggca

SEQ ID NO: 1984539 - RNA, 14 nt, Human
cccgcucagcccuc

SEQ ID NO: 1984540 - RNA, 12 nt, Human
cccgcucagccc

SEQ ID NO: 1984541 - RNA, 13 nt, Human
cccgcucagcccu

SEQ ID NO: 1984542 - RNA, 15 nt, Human
cccgcucagcccucc

SEQ ID NO: 1984543 - RNA, 22 nt, Human
cccucuggcuccagcuggccgg

SEQ ID NO: 1984544 - RNA, 12 nt, Human
cccucuggcucc

SEQ ID NO: 1984545 - RNA, 16 nt, Human
cccucuggcuccagcu

SEQ ID NO: 1984546 - RNA, 17 nt, Human
cccucuggcuccagcug

SEQ ID NO: 1984547 - RNA, 20 nt, Human
cccucuguucugcacacagc

SEQ ID NO: 1984548 - RNA, 21 nt, Human
cccucuguucugcacacagca

SEQ ID NO: 1984549 - RNA, 14 nt, Human
cccucuucccuggu

SEQ ID NO: 1984550 - RNA, 22 nt, Human
cccucuucccugguaagaaaaa

SEQ ID NO: 1984551 - RNA, 12 nt, Human
cccucuuccucu

SEQ ID NO: 1984552 - RNA, 13 nt, Human
cccucuuccucuu

SEQ ID NO: 1984553 - RNA, 18 nt, Human
cccucuuccucuugaccc

SEQ ID NO: 1984554 - RNA, 23 nt, Human
cccucuuccucuugacccugcac

SEQ ID NO: 1984555 - RNA, 20 nt, Human
cccucuuucccucccuuccu

SEQ ID NO: 1984556 - RNA, 17 nt, Human
cccucuuucccucccuu

SEQ ID NO: 1984557 - RNA, 12 nt, Human
cccucuuucccu

SEQ ID NO: 1984558 - RNA, 16 nt, Human
cccucuucuucucaag

SEQ ID NO: 1984559 - RNA, 12 nt, Human
cccucugcccug

SEQ ID NO: 1984560 - RNA, 13 nt, Human
cccucugcccugc

SEQ ID NO: 1984561 - RNA, 14 nt, Human
cccucugcccugcg

SEQ ID NO: 1984562 - RNA, 17 nt, Human
cccucuccuuccugugu

SEQ ID NO: 1984563 - RNA, 19 nt, Human
cccucugcccacucccugc

SEQ ID NO: 1984564 - RNA, 18 nt, Human
cccucugcccacucccug

SEQ ID NO: 1984565 - RNA, 15 nt, Human
cccucugcccacucc

SEQ ID NO: 1984566 - RNA, 14 nt, Human
cccucuccuuccug

SEQ ID NO: 1984567 - RNA, 11 nt, Human
cccucugccca

SEQ ID NO: 1984568 - RNA, 13 nt, Human
cccucuccagcag

SEQ ID NO: 1984569 - RNA, 17 nt, Human
cccugcaguuccccugg

SEQ ID NO: 1984570 - RNA, 21 nt, Human
cccugcaguuccccuggaagc

SEQ ID NO: 1984571 - RNA, 22 nt, Human
cccugcaguuccccuggaagca

SEQ ID NO: 1984572 - RNA, 11 nt, Human
cccugccuccu

SEQ ID NO: 1984573 - RNA, 14 nt, Human
cccugccucucugc

SEQ ID NO: 1984574 - RNA, 13 nt, Human
cccugccucucug

SEQ ID NO: 1984575 - RNA, 21 nt, Human
cccugaggcagguccccagac

SEQ ID NO: 1984576 - RNA, 13 nt, Human
cccugcagcucuc

SEQ ID NO: 1984577 - RNA, 21 nt, Human
cccugcagcucucaugcugcc

SEQ ID NO: 1984578 - RNA, 17 nt, Human
cccugaggcaggucccc

SEQ ID NO: 1984579 - RNA, 18 nt, Human
cccugaggcaggucccca

SEQ ID NO: 1984580 - RNA, 20 nt, Human
cccugaggcagguccccaga

SEQ ID NO: 1984581 - RNA, 12 nt, Human
cccugaggccca

SEQ ID NO: 1984582 - RNA, 19 nt, Human
cccugcuccagaagauagc

SEQ ID NO: 1984583 - RNA, 10 nt, Human
cccugcuccc

SEQ ID NO: 1984584 - RNA, 11 nt, Human
cccugcucccu

SEQ ID NO: 1984585 - RNA, 22 nt, Human
cccugcuacugccaaccucgcu

SEQ ID NO: 1984586 - RNA, 13 nt, Human
cccugcucacugc

SEQ ID NO: 1984587 - RNA, 19 nt, Human
cccugcgggucacaggagg

SEQ ID NO: 1984588 - RNA, 21 nt, Human
cccugcgggucacaggaggga

SEQ ID NO: 1984589 - RNA, 15 nt, Human
cccugccucucugca

SEQ ID NO: 1984590 - RNA, 13 nt, Human
cccugccucuccg

SEQ ID NO: 1984591 - RNA, 14 nt, Human
cccugccucuccgc

SEQ ID NO: 1984592 - RNA, 16 nt, Human
cccugccucuccgccc

SEQ ID NO: 1984593 - RNA, 21 nt, Human
cccugccucuccgccccugag

SEQ ID NO: 1984594 - RNA, 22 nt, Human
cccugccucuccgccccugagc

SEQ ID NO: 1984595 - RNA, 23 nt, Human
cccugccucuccgccccugagcc

SEQ ID NO: 1984596 - RNA, 22 nt, Human
cccugcucuccgaccagacacc

SEQ ID NO: 1984597 - RNA, 21 nt, Human
cccugcugagucccaggcuga

SEQ ID NO: 1984598 - RNA, 21 nt, Human
cccugcucuccgaccagacac

SEQ ID NO: 1984599 - RNA, 23 nt, Human
cccugcucccuccgggucuuccu

SEQ ID NO: 1984600 - RNA, 23 nt, Human
cccugcugagucccaggcugagc

SEQ ID NO: 1984601 - RNA, 16 nt, Human
cccuggugcugccaca

SEQ ID NO: 1984602 - RNA, 14 nt, Human
cccuuccccuuccu

SEQ ID NO: 1984603 - RNA, 15 nt, Human
cccuuccccuuccuu

SEQ ID NO: 1984604 - RNA, 18 nt, Human
cccuuccccuuccuucuu

SEQ ID NO: 1984605 - RNA, 22 nt, Human
cccuugaggaaacaacagcuuu

SEQ ID NO: 1984606 - RNA, 22 nt, Human
cccuugcuaccacggccuccuu

SEQ ID NO: 1984607 - RNA, 13 nt, Human
cccuugccagcug

SEQ ID NO: 1984608 - RNA, 14 nt, Human
cccuugccagcugc

SEQ ID NO: 1984609 - RNA, 18 nt, Human
cccuugccagcugcugag

SEQ ID NO: 1984610 - RNA, 20 nt, Human
cccuugccagcugcugagcc

SEQ ID NO: 1984611 - RNA, 21 nt, Human
cccuugccagcugcugagccg

SEQ ID NO: 1984612 - RNA, 19 nt, Human
cccuugcccaugcugggcu

SEQ ID NO: 1984613 - RNA, 18 nt, Human
cccuucaaccauucccca

SEQ ID NO: 1984614 - RNA, 14 nt, Human
cccuucaaccauuc

SEQ ID NO: 1984615 - RNA, 18 nt, Human
cccuuccaguuuauucca

SEQ ID NO: 1984616 - RNA, 19 nt, Human
cccuuccaccugcucugcu

SEQ ID NO: 1984617 - RNA, 16 nt, Human
cccuuccaccugcucu

SEQ ID NO: 1984618 - RNA, 17 nt, Human
cccuuccaccugcucug

SEQ ID NO: 1984619 - RNA, 12 nt, Human
cccuuccaugga

SEQ ID NO: 1984620 - RNA, 20 nt, Human
cccuuccaugucgccucugc

SEQ ID NO: 1984621 - RNA, 17 nt, Human
cccuuccaucugauucc

SEQ ID NO: 1984622 - RNA, 23 nt, Human
cccuuccaucugauuccagcaca

SEQ ID NO: 1984623 - RNA, 18 nt, Human
cccuuccauuucugccuu

SEQ ID NO: 1984624 - RNA, 20 nt, Human
cccuuccauuucugccuuuu

SEQ ID NO: 1984625 - RNA, 23 nt, Human
cccuuagcagggaaacagcuaau

SEQ ID NO: 1984626 - RNA, 14 nt, Human
cccuuaucccugcu

SEQ ID NO: 1984627 - RNA, 17 nt, Human
cccuuacgugaguccug

SEQ ID NO: 1984628 - RNA, 15 nt, Human
cccuuacgugagucc

SEQ ID NO: 1984629 - RNA, 14 nt, Human
cccuuagcagggaa

SEQ ID NO: 1984630 - RNA, 20 nt, Human
cccuuagaaguuuguuguga

SEQ ID NO: 1984631 - RNA, 23 nt, Human
cccuuaagaaugaguuucuuaga

SEQ ID NO: 1984632 - RNA, 13 nt, Human
cccuggugcugcc

SEQ ID NO: 1984633 - RNA, 14 nt, Human
cccuggugcugcca

SEQ ID NO: 1984634 - RNA, 21 nt, Human
cccuggugaccagcaccaucu

SEQ ID NO: 1984635 - RNA, 21 nt, Human
cccugguggcagcucaccucu

SEQ ID NO: 1984636 - RNA, 13 nt, Human
cccugguggcagu

SEQ ID NO: 1984637 - RNA, 14 nt, Human
cccugguggcagug

SEQ ID NO: 1984638 - RNA, 18 nt, Human
cccugcuuggcccagggg

SEQ ID NO: 1984639 - RNA, 14 nt, Human
cccugcuuggccca

SEQ ID NO: 1984640 - RNA, 16 nt, Human
cccugcuuggcccagg

SEQ ID NO: 1984641 - RNA, 20 nt, Human
cccugcugucauugcuucuu

SEQ ID NO: 1984642 - RNA, 13 nt, Human
cccugcuguuuau

SEQ ID NO: 1984643 - RNA, 14 nt, Human
cccugcuguuuauc

SEQ ID NO: 1984644 - RNA, 15 nt, Human
cccuguaggccucag

SEQ ID NO: 1984645 - RNA, 15 nt, Human
cccuggugcugccac

SEQ ID NO: 1984646 - RNA, 14 nt, Human
cccuguaggccuca

SEQ ID NO: 1984647 - RNA, 15 nt, Human
cccugucaaacauua

SEQ ID NO: 1984648 - RNA, 14 nt, Human
cccugucaggaggc

SEQ ID NO: 1984649 - RNA, 14 nt, Human
cccuguucuggcag

SEQ ID NO: 1984650 - RNA, 13 nt, Human
cccuguucuggca

SEQ ID NO: 1984651 - RNA, 23 nt, Human
cccuuaccugccaggaagccagc

SEQ ID NO: 1984652 - RNA, 20 nt, Human
cccuuaccugccaggaagcc

SEQ ID NO: 1984653 - RNA, 17 nt, Human
cccuuaccugccaggaa

SEQ ID NO: 1984654 - RNA, 19 nt, Human
cccuguuuguuucugaaag

SEQ ID NO: 1984655 - RNA, 15 nt, Human
ccuaacgaaguaucc

SEQ ID NO: 1984656 - RNA, 18 nt, Human
ccuacaggagugagcacu

SEQ ID NO: 1984657 - RNA, 18 nt, Human
ccuaaccagggccagaag

SEQ ID NO: 1984658 - RNA, 19 nt, Human
ccuaacccagaaaaucuga

SEQ ID NO: 1984659 - RNA, 12 nt, Human
ccuaacccuggc

SEQ ID NO: 1984660 - RNA, 14 nt, Human
ccguugcugacuua

SEQ ID NO: 1984661 - RNA, 15 nt, Human
ccguugcugacuuag

SEQ ID NO: 1984662 - RNA, 17 nt, Human
ccguugcugacuuagaa

SEQ ID NO: 1984663 - RNA, 22 nt, Human
ccgggucaucuguaccucugcc

SEQ ID NO: 1984664 - RNA, 11 nt, Human
ccguggcuucc

SEQ ID NO: 1984665 - RNA, 20 nt, Human
ccuacucuucucucugcucu

SEQ ID NO: 1984666 - RNA, 21 nt, Human
ccuacucuucucucugcucug

SEQ ID NO: 1984667 - RNA, 23 nt, Human
ccuaggcauuugcugaauacaga

SEQ ID NO: 1984668 - RNA, 13 nt, Human
ccuacucuucucu

SEQ ID NO: 1984669 - RNA, 18 nt, Human
ccuacucuucucucugcu

SEQ ID NO: 1984670 - RNA, 19 nt, Human
ccuacucuucucucugcuc

SEQ ID NO: 1984671 - RNA, 15 nt, Human
ccuacuccugucuuc

SEQ ID NO: 1984672 - RNA, 16 nt, Human
ccuacuccugucuucu

SEQ ID NO: 1984673 - RNA, 18 nt, Human
ccuacuccugucuucugc

SEQ ID NO: 1984674 - RNA, 19 nt, Human
ccuacuccugucuucugcu

SEQ ID NO: 1984675 - RNA, 20 nt, Human
ccuacuccugucuucugcuu

SEQ ID NO: 1984676 - RNA, 22 nt, Human
ccuacuccugucuucugcuuug

SEQ ID NO: 1984677 - RNA, 18 nt, Human
ccuaggugacagagugag

SEQ ID NO: 1984678 - RNA, 13 nt, Human
ccuaguacugccc

SEQ ID NO: 1984679 - RNA, 21 nt, Human
ccuacaguugaaaaacagcug

SEQ ID NO: 1984680 - RNA, 16 nt, Human
ccuaccgagucucuuc

SEQ ID NO: 1984681 - RNA, 17 nt, Human
ccuaccgagucucuucu

SEQ ID NO: 1984682 - RNA, 21 nt, Human
ccuaccgagucucuucuccac

SEQ ID NO: 1984683 - RNA, 19 nt, Human
ccuaccgagucucuucucc

SEQ ID NO: 1984684 - RNA, 20 nt, Human
ccuaccgagucucuucucca

SEQ ID NO: 1984685 - RNA, 14 nt, Human
ccguggcuucccgc

SEQ ID NO: 1984686 - RNA, 17 nt, Human
ccgccuccuacagccca

SEQ ID NO: 1984687 - RNA, 12 nt, Human
ccgccucuuccc

SEQ ID NO: 1984688 - RNA, 11 nt, Human
ccgcuggggcc

SEQ ID NO: 1984689 - RNA, 14 nt, Human
ccgcuggggccagu

SEQ ID NO: 1984690 - RNA, 15 nt, Human
ccggaggggccuggc

SEQ ID NO: 1984691 - RNA, 16 nt, Human
ccggaggggccuggca

SEQ ID NO: 1984692 - RNA, 14 nt, Human
ccggaggggccugg

SEQ ID NO: 1984693 - RNA, 15 nt, Human
ccgggcucugccucc

SEQ ID NO: 1984694 - RNA, 14 nt, Human
ccgggcucugccuc

SEQ ID NO: 1984695 - RNA, 13 nt, Human
ccgggcucugccu

SEQ ID NO: 1984696 - RNA, 18 nt, Human
ccgggcucugccucccau

SEQ ID NO: 1984697 - RNA, 18 nt, Human
ccgugaggccagagacac

SEQ ID NO: 1984698 - RNA, 16 nt, Human
ccggcuccaggcuccu

SEQ ID NO: 1984699 - RNA, 21 nt, Human
ccggcuccaggcuccuuuagc

SEQ ID NO: 1984700 - RNA, 22 nt, Human
ccgggcacucagaagacacuga

SEQ ID NO: 1984701 - RNA, 13 nt, Human
ccgggcagagcac

SEQ ID NO: 1984702 - RNA, 20 nt, Human
ccgggcagagcacagcgggg

SEQ ID NO: 1984703 - RNA, 13 nt, Human
ccgggccacagag

SEQ ID NO: 1984704 - RNA, 14 nt, Human
ccgcagaagcccug

SEQ ID NO: 1984705 - RNA, 23 nt, Human
ccgcacugggcuuggggaccaga

SEQ ID NO: 1984706 - RNA, 19 nt, Human
ccgagucucuucuccacug

SEQ ID NO: 1984707 - RNA, 20 nt, Human
ccgagucucuucuccacugg

SEQ ID NO: 1984708 - RNA, 21 nt, Human
ccgagucucuucuccacugga

SEQ ID NO: 1984709 - RNA, 22 nt, Human
ccgccggcaauaaaagcccagg

SEQ ID NO: 1984710 - RNA, 20 nt, Human
ccgccggcaauaaaagccca

SEQ ID NO: 1984711 - RNA, 21 nt, Human
ccgccggcaauaaaagcccag

SEQ ID NO: 1984712 - RNA, 14 nt, Human
ccgaguagcuggga

SEQ ID NO: 1984713 - RNA, 16 nt, Human
ccgaguagcugggacu

SEQ ID NO: 1984714 - RNA, 20 nt, Human
ccgaguagcugagauuauag

SEQ ID NO: 1984715 - RNA, 14 nt, Human
ccgagucucuucuc

SEQ ID NO: 1984716 - RNA, 16 nt, Human
ccgagucucuucucca

SEQ ID NO: 1984717 - RNA, 18 nt, Human
ccgagucucuucuccacu

SEQ ID NO: 1984718 - RNA, 19 nt, Human
ccgagcuuugaaaauucag

SEQ ID NO: 1984719 - RNA, 19 nt, Human
ccgagauugcaccacugca

SEQ ID NO: 1984720 - RNA, 15 nt, Human
ccgagauugcaccac

SEQ ID NO: 1984721 - RNA, 21 nt, Human
ccgagauugcaccacugcacu

SEQ ID NO: 1984722 - RNA, 18 nt, Human
ccgaccuggccugucugu

SEQ ID NO: 1984723 - RNA, 22 nt, Human
ccgaccugaggacauggcuucu

SEQ ID NO: 1984724 - RNA, 14 nt, Human
ccgacuagacacac

SEQ ID NO: 1984725 - RNA, 20 nt, Human
ccgacuagacacacaaagca

SEQ ID NO: 1984726 - RNA, 16 nt, Human
ccgacuagacacacaa

SEQ ID NO: 1984727 - RNA, 17 nt, Human
ccgacuagacacacaaa

SEQ ID NO: 1984728 - RNA, 16 nt, Human
ccccaauaccccaugg

SEQ ID NO: 1984729 - RNA, 19 nt, Human
ccccaauaccccauggacc

SEQ ID NO: 1984730 - RNA, 16 nt, Human
ccccaauaucuugcuu

SEQ ID NO: 1984731 - RNA, 13 nt, Human
ccccaaucccagc

SEQ ID NO: 1984732 - RNA, 18 nt, Human
cccauucagagacugucc

SEQ ID NO: 1984733 - RNA, 21 nt, Human
ccccacccaagggccuggccu

SEQ ID NO: 1984734 - RNA, 11 nt, Human
ccccaccugcg

SEQ ID NO: 1984735 - RNA, 14 nt, Human
ccccaccugcgcuu

SEQ ID NO: 1984736 - RNA, 17 nt, Human
ccccaccugcgcuucac

SEQ ID NO: 1984737 - RNA, 14 nt, Human
ccccaccuggcccu

SEQ ID NO: 1984738 - RNA, 20 nt, Human
ccccaccuggcccucucuga

SEQ ID NO: 1984739 - RNA, 19 nt, Human
ccccaccgcagacaggacc

SEQ ID NO: 1984740 - RNA, 15 nt, Human
ccccaccgcagacag

SEQ ID NO: 1984741 - RNA, 13 nt, Human
ccccacucccagc

SEQ ID NO: 1984742 - RNA, 15 nt, Human
ccccacucccagcau

SEQ ID NO: 1984743 - RNA, 11 nt, Human
ccccacucuca

SEQ ID NO: 1984744 - RNA, 12 nt, Human
ccccacucucag

SEQ ID NO: 1984745 - RNA, 13 nt, Human
ccccacucucaga

SEQ ID NO: 1984746 - RNA, 14 nt, Human
ccccacucucagag

SEQ ID NO: 1984747 - RNA, 16 nt, Human
ccccacucucagaggc

SEQ ID NO: 1984748 - RNA, 17 nt, Human
ccccacucucagaggcc

SEQ ID NO: 1984749 - RNA, 20 nt, Human
ccccacucucagaggcccca

SEQ ID NO: 1984750 - RNA, 15 nt, Human
ccccagaacucugcc

SEQ ID NO: 1984751 - RNA, 17 nt, Human
ccccagaacucugccug

SEQ ID NO: 1984752 - RNA, 17 nt, Human
cccagaaugaggcugcu

SEQ ID NO: 1984753 - RNA, 18 nt, Human
cccagaaugccuccugca

SEQ ID NO: 1984754 - RNA, 17 nt, Human
cccagagagaagagccc

SEQ ID NO: 1984755 - RNA, 18 nt, Human
cccagagagaagagcccc

SEQ ID NO: 1984756 - RNA, 14 nt, Human
cccaguugggugga

SEQ ID NO: 1984757 - RNA, 19 nt, Human
cccaucucuacaaaaagca

SEQ ID NO: 1984758 - RNA, 14 nt, Human
cccaucucuucugg

SEQ ID NO: 1984759 - RNA, 18 nt, Human
cccaugcugggcucccgu

SEQ ID NO: 1984760 - RNA, 22 nt, Human
cccaugagccucagcauccugg

SEQ ID NO: 1984761 - RNA, 12 nt, Human
cccaucugugaa

SEQ ID NO: 1984762 - RNA, 14 nt, Human
cccaugagccucag

SEQ ID NO: 1984763 - RNA, 13 nt, Human
cccccacccaagg

SEQ ID NO: 1984764 - RNA, 24 nt, Human
cccccacccaagggccuggccuga

SEQ ID NO: 1984765 - RNA, 16 nt, Human
cccccacauggugaug

SEQ ID NO: 1984766 - RNA, 14 nt, Human
ccccauccucugua

SEQ ID NO: 1984767 - RNA, 17 nt, Human
ccccaucauugguaccc

SEQ ID NO: 1984768 - RNA, 19 nt, Human
cccccacugaaucccugua

SEQ ID NO: 1984769 - RNA, 13 nt, Human
cccccacugguga

SEQ ID NO: 1984770 - RNA, 11 nt, Human
cccccacuggu

SEQ ID NO: 1984771 - RNA, 15 nt, Human
cccccacuggugaca

SEQ ID NO: 1984772 - RNA, 11 nt, Human
ccccagggcac

SEQ ID NO: 1984773 - RNA, 17 nt, Human
ccccaguagcugggacc

SEQ ID NO: 1984774 - RNA, 17 nt, Human
ccccaguccccuucccg

SEQ ID NO: 1984775 - RNA, 14 nt, Human
ccccagugcccaca

SEQ ID NO: 1984776 - RNA, 15 nt, Human
ccccagugcccacag

SEQ ID NO: 1984777 - RNA, 16 nt, Human
ccccagugcccacagg

SEQ ID NO: 1984778 - RNA, 20 nt, Human
ccccagugcccacaggauca

SEQ ID NO: 1984779 - RNA, 22 nt, Human
ccccauaauuuuuuuuuuccuu

SEQ ID NO: 1984780 - RNA, 15 nt, Human
ccccucaacaccucu

SEQ ID NO: 1984781 - RNA, 23 nt, Human
ccccucaacucuccuccagaguc

SEQ ID NO: 1984782 - RNA, 16 nt, Human
ccccucaacaccucug

SEQ ID NO: 1984783 - RNA, 12 nt, Human
cccccagcuccc

SEQ ID NO: 1984784 - RNA, 22 nt, Human
cccccgucuaaccacagcuccu

SEQ ID NO: 1984785 - RNA, 18 nt, Human
cccccucccccagccacu

SEQ ID NO: 1984786 - RNA, 19 nt, Human
cccccucccccagccacuc

SEQ ID NO: 1984787 - RNA, 12 nt, Human
cccccagccugc

SEQ ID NO: 1984788 - RNA, 19 nt, Human
cccccugacaacacucauu

SEQ ID NO: 1984789 - RNA, 18 nt, Human
cccccugcaaagcccagc

SEQ ID NO: 1984790 - RNA, 19 nt, Human
cccccugcaaagcccagcu

SEQ ID NO: 1984791 - RNA, 21 nt, Human
cccccugcaaagcccagcuug

SEQ ID NO: 1984792 - RNA, 14 nt, Human
cccccucuucccug

SEQ ID NO: 1984793 - RNA, 17 nt, Human
cccccugacaacacuca

SEQ ID NO: 1984794 - RNA, 21 nt, Human
cccccucuggcuccagcuggc

SEQ ID NO: 1984795 - RNA, 12 nt, Human
cccccucuggcu

SEQ ID NO: 1984796 - RNA, 19 nt, Human
cccccucuggcuccagcug

SEQ ID NO: 1984797 - RNA, 13 nt, Human
ccccuccaccugc

SEQ ID NO: 1984798 - RNA, 23 nt, Human
ccccuccaaucccaccaacccuc

SEQ ID NO: 1984799 - RNA, 20 nt, Human
ccccucauagcccucacccu

SEQ ID NO: 1984800 - RNA, 16 nt, Human
ccccucagggucccug

SEQ ID NO: 1984801 - RNA, 15 nt, Human
ccccucccuucaacc

SEQ ID NO: 1984802 - RNA, 13 nt, Human
ccccucccaggga

SEQ ID NO: 1984803 - RNA, 14 nt, Human
ccccucccucucca

SEQ ID NO: 1984804 - RNA, 15 nt, Human
ccccucccucuccag

SEQ ID NO: 1984805 - RNA, 12 nt, Human
ccccuccaugug

SEQ ID NO: 1984806 - RNA, 14 nt, Human
ccccucgcccaguc

SEQ ID NO: 1984807 - RNA, 22 nt, Human
ccccucgcccagucccagcagc

SEQ ID NO: 1984808 - RNA, 23 nt, Human
ccccucgcccagucccagcagcc

SEQ ID NO: 1984809 - RNA, 14 nt, Human
ccccucuccuuccu

SEQ ID NO: 1984810 - RNA, 19 nt, Human
ccccucuccuuccugugug

SEQ ID NO: 1984811 - RNA, 18 nt, Human
ccccuccuccuggacucc

SEQ ID NO: 1984812 - RNA, 22 nt, Human
ccccuccuccuggacuccugca

SEQ ID NO: 1984813 - RNA, 15 nt, Human
ccccuccucucugcc

SEQ ID NO: 1984814 - RNA, 17 nt, Human
ccccuccucucugcccu

SEQ ID NO: 1984815 - RNA, 15 nt, Human
cccgccaaaagcugc

SEQ ID NO: 1984816 - RNA, 13 nt, Human
ccccugccugccc

SEQ ID NO: 1984817 - RNA, 19 nt, Human
ccccugccucucugcaggu

SEQ ID NO: 1984818 - RNA, 17 nt, Human
ccccugccucucugcag

SEQ ID NO: 1984819 - RNA, 16 nt, Human
ccccugccucucugca

SEQ ID NO: 1984820 - RNA, 15 nt, Human
ccccugccucucugc

SEQ ID NO: 1984821 - RNA, 14 nt, Human
ccccugccucucug

SEQ ID NO: 1984822 - RNA, 18 nt, Human
ccccugccccugcuacug

SEQ ID NO: 1984823 - RNA, 17 nt, Human
ccccugcccggcugcgg

SEQ ID NO: 1984824 - RNA, 19 nt, Human
ccccugcccggcugcggaa

SEQ ID NO: 1984825 - RNA, 13 nt, Human
ccccucugcccug

SEQ ID NO: 1984826 - RNA, 12 nt, Human
ccccucugcccu

SEQ ID NO: 1984827 - RNA, 17 nt, Human
ccccugcuggguguggc

SEQ ID NO: 1984828 - RNA, 14 nt, Human
ccccugcugggugu

SEQ ID NO: 1984829 - RNA, 19 nt, Human
ccccugccugcccugucag

SEQ ID NO: 1984830 - RNA, 15 nt, Human
ccccugcuacugcca

SEQ ID NO: 1984831 - RNA, 11 nt, Human
ccccugcuggu

SEQ ID NO: 1984832 - RNA, 13 nt, Human
ccccugcugguuc

SEQ ID NO: 1984833 - RNA, 15 nt, Human
ccccugcugguucag

SEQ ID NO: 1984834 - RNA, 20 nt, Human
ccccugcugguucaggguug

SEQ ID NO: 1984835 - RNA, 15 nt, Human
ccccuggaugcagcc

SEQ ID NO: 1984836 - RNA, 20 nt, Human
ccccuggaagcagugcccag

SEQ ID NO: 1984837 - RNA, 21 nt, Human
ccccuggaagcagugcccagg

SEQ ID NO: 1984838 - RNA, 23 nt, Human
ccccuggaagcagugcccaggug

SEQ ID NO: 1984839 - RNA, 11 nt, Human
ccccuggaccc

SEQ ID NO: 1984840 - RNA, 14 nt, Human
ccccuggaccccag

SEQ ID NO: 1984841 - RNA, 16 nt, Human
ccccuggaccccagcc

SEQ ID NO: 1984842 - RNA, 18 nt, Human
ccccuggaccccagccuc

SEQ ID NO: 1984843 - RNA, 19 nt, Human
ccccuggaccccagccuca

SEQ ID NO: 1984844 - RNA, 17 nt, Human
ccccuggaagcagugcc

SEQ ID NO: 1984845 - RNA, 18 nt, Human
ccccuggaagcagugccc

SEQ ID NO: 1984846 - RNA, 19 nt, Human
ccccuggaagcagugccca

SEQ ID NO: 1984847 - RNA, 19 nt, Human
ccccuggaugcagccucac

SEQ ID NO: 1984848 - RNA, 18 nt, Human
ccccuggaugcagccuca

SEQ ID NO: 1984849 - RNA, 19 nt, Human
cccgcccaaaccuuucccc

SEQ ID NO: 1984850 - RNA, 23 nt, Human
cccgcuaagagggagggagggcu

SEQ ID NO: 1984851 - RNA, 22 nt, Human
cccgcccaggcuuagucacuga

SEQ ID NO: 1984852 - RNA, 20 nt, Human
cccgcccaggcuuagucacu

SEQ ID NO: 1984853 - RNA, 15 nt, Human
cccgacagccuggca

SEQ ID NO: 1984854 - RNA, 18 nt, Human
cccgacagccuggcacag

SEQ ID NO: 1984855 - RNA, 12 nt, Human
cccgacuccagu

SEQ ID NO: 1984856 - RNA, 18 nt, Human
cccgagacggcacugaga

SEQ ID NO: 1984857 - RNA, 12 nt, Human
ccccuggugguu

SEQ ID NO: 1984858 - RNA, 15 nt, Human
ccccuggucuuugag

SEQ ID NO: 1984859 - RNA, 11 nt, Human
ccccuggccuu

SEQ ID NO: 1984860 - RNA, 15 nt, Human
ccccuggccuuggga

SEQ ID NO: 1984861 - RNA, 20 nt, Human
ccccuggcuccaggccaggg

SEQ ID NO: 1984862 - RNA, 18 nt, Human
ccccuggcuuuucacugc

SEQ ID NO: 1984863 - RNA, 20 nt, Human
ccccuggcuuuucacugcug

SEQ ID NO: 1984864 - RNA, 22 nt, Human
ccccuggcuuuucacugcuggc

SEQ ID NO: 1984865 - RNA, 20 nt, Human
ccccuuccauggacuuuguu

SEQ ID NO: 1984866 - RNA, 13 nt, Human
ccccuuccaugga

SEQ ID NO: 1984867 - RNA, 14 nt, Human
cccgacagccuggc

SEQ ID NO: 1984868 - RNA, 17 nt, Human
ccccuuccauuucugcc

SEQ ID NO: 1984869 - RNA, 11 nt, Human
ccccuucccau

SEQ ID NO: 1984870 - RNA, 15 nt, Human
ccccuguucacucua

SEQ ID NO: 1984871 - RNA, 14 nt, Human
ccagagcccaccuu

SEQ ID NO: 1984872 - RNA, 14 nt, Human
ccagauugcaacag

SEQ ID NO: 1984873 - RNA, 16 nt, Human
ccagauugcaacaggc

SEQ ID NO: 1984874 - RNA, 15 nt, Human
ccagauuucacucuc

SEQ ID NO: 1984875 - RNA, 19 nt, Human
ccagauuucacucuccuug

SEQ ID NO: 1984876 - RNA, 18 nt, Human
ccagauuucacucuccuu

SEQ ID NO: 1984877 - RNA, 23 nt, Human
ccagauugcaacaggcugggcuu

SEQ ID NO: 1984878 - RNA, 18 nt, Human
ccagauugcaacaggcug

SEQ ID NO: 1984879 - RNA, 22 nt, Human
ccagauugcaacaggcugggcu

SEQ ID NO: 1984880 - RNA, 24 nt, Human
ccagauuuuuuacagcugccugca

SEQ ID NO: 1984881 - RNA, 12 nt, Human
ccagcacacucc

SEQ ID NO: 1984882 - RNA, 13 nt, Human
ccagcacacuccc

SEQ ID NO: 1984883 - RNA, 23 nt, Human
ccagcacaaccuucaagcugcuu

SEQ ID NO: 1984884 - RNA, 14 nt, Human
ccagcacacucccg

SEQ ID NO: 1984885 - RNA, 15 nt, Human
ccagcacacucccga

SEQ ID NO: 1984886 - RNA, 16 nt, Human
ccagcacacucccgag

SEQ ID NO: 1984887 - RNA, 17 nt, Human
ccagcacacucccgaga

SEQ ID NO: 1984888 - RNA, 17 nt, Human
ccagcaagugagagcug

SEQ ID NO: 1984889 - RNA, 18 nt, Human
ccagcaagugagagcugg

SEQ ID NO: 1984890 - RNA, 19 nt, Human
ccagcaagugagagcuggg

SEQ ID NO: 1984891 - RNA, 18 nt, Human
ccagcaggcucucaggcc

SEQ ID NO: 1984892 - RNA, 17 nt, Human
ccagcaggcucucaggc

SEQ ID NO: 1984893 - RNA, 16 nt, Human
ccagcaggcucucagg

SEQ ID NO: 1984894 - RNA, 18 nt, Human
ccagcaccaucucuccuc

SEQ ID NO: 1984895 - RNA, 17 nt, Human
ccagcaccaucucuccu

SEQ ID NO: 1984896 - RNA, 13 nt, Human
ccagcaccacccu

SEQ ID NO: 1984897 - RNA, 20 nt, Human
ccagcaccacccuccuuccc

SEQ ID NO: 1984898 - RNA, 10 nt, Human
ccagccugcc

SEQ ID NO: 1984899 - RNA, 19 nt, Human
ccagccugagcgacaguga

SEQ ID NO: 1984900 - RNA, 13 nt, Human
ccagccuggguga

SEQ ID NO: 1984901 - RNA, 20 nt, Human
ccagccuggcugggacuggg

SEQ ID NO: 1984902 - RNA, 21 nt, Human
ccagccugggauaggggcaga

SEQ ID NO: 1984903 - RNA, 20 nt, Human
ccagccuggaaaccugucug

SEQ ID NO: 1984904 - RNA, 21 nt, Human
ccagccuggaaaccugucuga

SEQ ID NO: 1984905 - RNA, 23 nt, Human
ccagccuugaccauucuccaccu

SEQ ID NO: 1984906 - RNA, 13 nt, Human
ccagcgagcccug

SEQ ID NO: 1984907 - RNA, 23 nt, Human
ccagcaggcucucaggccagcug

SEQ ID NO: 1984908 - RNA, 21 nt, Human
ccagcaggcucucaggccagc

SEQ ID NO: 1984909 - RNA, 20 nt, Human
ccagcaggcucucaggccag

SEQ ID NO: 1984910 - RNA, 19 nt, Human
ccagcaggcucucaggcca

SEQ ID NO: 1984911 - RNA, 21 nt, Human
ccagcccacgcugacuacagg

SEQ ID NO: 1984912 - RNA, 13 nt, Human
ccagcccagaggc

SEQ ID NO: 1984913 - RNA, 16 nt, Human
ccagcccagaggccga

SEQ ID NO: 1984914 - RNA, 16 nt, Human
ccagcccacuucugcc

SEQ ID NO: 1984915 - RNA, 17 nt, Human
ccagcccacuucugcca

SEQ ID NO: 1984916 - RNA, 18 nt, Human
ccagcccaccccauggcc

SEQ ID NO: 1984917 - RNA, 15 nt, Human
ccagcccaccccaug

SEQ ID NO: 1984918 - RNA, 17 nt, Human
ccagcccaccccauggc

SEQ ID NO: 1984919 - RNA, 13 nt, Human
ccagcccacgcug

SEQ ID NO: 1984920 - RNA, 14 nt, Human
ccagcccugaguuc

SEQ ID NO: 1984921 - RNA, 18 nt, Human
ccagcccugaguuccuag

SEQ ID NO: 1984922 - RNA, 19 nt, Human
ccagccccaaaacucuccu

SEQ ID NO: 1984923 - RNA, 17 nt, Human
ccagcccauuugggcag

SEQ ID NO: 1984924 - RNA, 18 nt, Human
ccagcccauuugggcaga

SEQ ID NO: 1984925 - RNA, 22 nt, Human
ccagcccauuugggcagagagg

SEQ ID NO: 1984926 - RNA, 22 nt, Human
ccagccgagauagccaaggcca

SEQ ID NO: 1984927 - RNA, 20 nt, Human
ccagccgagauagccaaggc

SEQ ID NO: 1984928 - RNA, 17 nt, Human
ccagccgagauagccaa

SEQ ID NO: 1984929 - RNA, 13 nt, Human
ccaccuuggcuca

SEQ ID NO: 1984930 - RNA, 16 nt, Human
ccacccccaggacccc

SEQ ID NO: 1984931 - RNA, 18 nt, Human
ccacccccaggaccccug

SEQ ID NO: 1984932 - RNA, 19 nt, Human
ccacccccaggaccccuga

SEQ ID NO: 1984933 - RNA, 19 nt, Human
ccacccccacccaagggcc

SEQ ID NO: 1984934 - RNA, 14 nt, Human
ccacccuccuuuca

SEQ ID NO: 1984935 - RNA, 14 nt, Human
ccacccuccuuccc

SEQ ID NO: 1984936 - RNA, 15 nt, Human
ccaccugccagggac

SEQ ID NO: 1984937 - RNA, 15 nt, Human
ccaccugcucugcug

SEQ ID NO: 1984938 - RNA, 12 nt, Human
ccaccugccagg

SEQ ID NO: 1984939 - RNA, 14 nt, Human
ccaccugccaggga

SEQ ID NO: 1984940 - RNA, 13 nt, Human
ccaccugccaggg

SEQ ID NO: 1984941 - RNA, 13 nt, Human
ccaccucuuccug

SEQ ID NO: 1984942 - RNA, 17 nt, Human
ccaccucuuccuggccg

SEQ ID NO: 1984943 - RNA, 20 nt, Human
ccaccuggccucugcacucc

SEQ ID NO: 1984944 - RNA, 18 nt, Human
ccaccuggccucugcacu

SEQ ID NO: 1984945 - RNA, 13 nt, Human
ccaccuggccucu

SEQ ID NO: 1984946 - RNA, 12 nt, Human
ccaccuggcccu

SEQ ID NO: 1984947 - RNA, 17 nt, Human
ccaccuggcccucucug

SEQ ID NO: 1984948 - RNA, 18 nt, Human
ccaccuggcccucucuga

SEQ ID NO: 1984949 - RNA, 20 nt, Human
ccaccucucucacuccuuga

SEQ ID NO: 1984950 - RNA, 19 nt, Human
ccaccucucucacuccuug

SEQ ID NO: 1984951 - RNA, 16 nt, Human
ccaccucucucacucc

SEQ ID NO: 1984952 - RNA, 14 nt, Human
ccaccucucucacu

SEQ ID NO: 1984953 - RNA, 18 nt, Human
ccaccuccuaaaaggccc

SEQ ID NO: 1984954 - RNA, 20 nt, Human
ccaccuccuaaaaggcccag

SEQ ID NO: 1984955 - RNA, 21 nt, Human
ccaccuccuaaaaggcccaga

SEQ ID NO: 1984956 - RNA, 22 nt, Human
ccaccuccuaaaaggcccagag

SEQ ID NO: 1984957 - RNA, 23 nt, Human
ccaccuccuaaaaggcccagaga

SEQ ID NO: 1984958 - RNA, 11 nt, Human
ccacccugcuc

SEQ ID NO: 1984959 - RNA, 12 nt, Human
ccacccugcucu

SEQ ID NO: 1984960 - RNA, 18 nt, Human
ccagagaguggcuccucc

SEQ ID NO: 1984961 - RNA, 22 nt, Human
ccagagaguggcuccucccggu

SEQ ID NO: 1984962 - RNA, 16 nt, Human
ccagacccggcugcgu

SEQ ID NO: 1984963 - RNA, 14 nt, Human
ccagagaguggcuc

SEQ ID NO: 1984964 - RNA, 15 nt, Human
ccagagaguggcucc

SEQ ID NO: 1984965 - RNA, 16 nt, Human
ccagagaguggcuccu

SEQ ID NO: 1984966 - RNA, 14 nt, Human
ccagacccggcugc

SEQ ID NO: 1984967 - RNA, 15 nt, Human
ccagacccggcugcg

SEQ ID NO: 1984968 - RNA, 20 nt, Human
ccagacacauguccaagaag

SEQ ID NO: 1984969 - RNA, 17 nt, Human
ccagacacauguccaag

SEQ ID NO: 1984970 - RNA, 22 nt, Human
ccagacacauguccaagaagcc

SEQ ID NO: 1984971 - RNA, 14 nt, Human
ccagacaucaacag

SEQ ID NO: 1984972 - RNA, 24 nt, Human
ccagaccccuggcuuuucacugcu

SEQ ID NO: 1984973 - RNA, 18 nt, Human
ccagaccccuggcuuuuc

SEQ ID NO: 1984974 - RNA, 15 nt, Human
ccagaaugaggcugc

SEQ ID NO: 1984975 - RNA, 11 nt, Human
ccagaaugaag

SEQ ID NO: 1984976 - RNA, 13 nt, Human
ccagaagucaaca

SEQ ID NO: 1984977 - RNA, 12 nt, Human
ccagaauacuga

SEQ ID NO: 1984978 - RNA, 15 nt, Human
ccagaauacugaugg

SEQ ID NO: 1984979 - RNA, 21 nt, Human
ccagaauacugauggaauuuu

SEQ ID NO: 1984980 - RNA, 23 nt, Human
ccagaauacugauggaauuuuuu

SEQ ID NO: 1984981 - RNA, 15 nt, Human
ccagaaguagcuuug

SEQ ID NO: 1984982 - RNA, 16 nt, Human
ccagaaguagcuuugc

SEQ ID NO: 1984983 - RNA, 17 nt, Human
ccagaaguagcuuugca

SEQ ID NO: 1984984 - RNA, 23 nt, Human
ccacugcaucguuucaucuucca

SEQ ID NO: 1984985 - RNA, 21 nt, Human
ccacugcaucguuucaucuuc

SEQ ID NO: 1984986 - RNA, 14 nt, Human
ccaccuucccaugc

SEQ ID NO: 1984987 - RNA, 13 nt, Human
ccacugccucuuc

SEQ ID NO: 1984988 - RNA, 16 nt, Human
ccacugccucuuccuc

SEQ ID NO: 1984989 - RNA, 15 nt, Human
ccacugguucuucuu

SEQ ID NO: 1984990 - RNA, 21 nt, Human
ccacugggguggccugacucc

SEQ ID NO: 1984991 - RNA, 23 nt, Human
ccacuggugacaugucuuuucuu

SEQ ID NO: 1984992 - RNA, 15 nt, Human
ccacugugaagagaa

SEQ ID NO: 1984993 - RNA, 14 nt, Human
ccacugugaagaga

SEQ ID NO: 1984994 - RNA, 11 nt, Human
ccacugcucug

SEQ ID NO: 1984995 - RNA, 12 nt, Human
ccacugcucugg

SEQ ID NO: 1984996 - RNA, 13 nt, Human
ccacugcucuggu

SEQ ID NO: 1984997 - RNA, 15 nt, Human
ccacugcucugguua

SEQ ID NO: 1984998 - RNA, 20 nt, Human
ccacugcuuuuggucugugu

SEQ ID NO: 1984999 - RNA, 21 nt, Human
ccacugccuucgauacaccgg

SEQ ID NO: 1985000 - RNA, 22 nt, Human
ccacugcuuuuggucuguguga

SEQ ID NO: 1985001 - RNA, 16 nt, Human
ccagaacucugccugc

SEQ ID NO: 1985002 - RNA, 17 nt, Human
ccagaacucugccugcc

SEQ ID NO: 1985003 - RNA, 19 nt, Human
ccagaacucugccugcccu

SEQ ID NO: 1985004 - RNA, 20 nt, Human
ccagaacucugccugcccuu

SEQ ID NO: 1985005 - RNA, 15 nt, Human
ccagaacucuguguc

SEQ ID NO: 1985006 - RNA, 14 nt, Human
ccagaacucuuccu

SEQ ID NO: 1985007 - RNA, 15 nt, Human
ccagaacucuuccuc

SEQ ID NO: 1985008 - RNA, 24 nt, Human
ccagaacucuuccuccaaggacag

SEQ ID NO: 1985009 - RNA, 22 nt, Human
ccagaagaaaauagugguguga

SEQ ID NO: 1985010 - RNA, 15 nt, Human
ccagaagcccagaau

SEQ ID NO: 1985011 - RNA, 18 nt, Human
ccagaaaccuuuguuugc

SEQ ID NO: 1985012 - RNA, 21 nt, Human
ccagaaacacccacaggcaug

SEQ ID NO: 1985013 - RNA, 18 nt, Human
ccagaaacgccacauccc

SEQ ID NO: 1985014 - RNA, 19 nt, Human
ccacugugccaugugccag

SEQ ID NO: 1985015 - RNA, 15 nt, Human
ccacugugccaugug

SEQ ID NO: 1985016 - RNA, 16 nt, Human
ccacugugccaugugc

SEQ ID NO: 1985017 - RNA, 19 nt, Human
ccacugugcguggggcucc

SEQ ID NO: 1985018 - RNA, 23 nt, Human
ccaggcugggagagccuuccagg

SEQ ID NO: 1985019 - RNA, 15 nt, Human
ccaggcccucugccc

SEQ ID NO: 1985020 - RNA, 16 nt, Human
ccaggcugggucgccc

SEQ ID NO: 1985021 - RNA, 12 nt, Human
ccaggcuggguc

SEQ ID NO: 1985022 - RNA, 24 nt, Human
ccaggcugggucgcccuggacugu

SEQ ID NO: 1985023 - RNA, 23 nt, Human
ccaggcugggucgcccuggacug

SEQ ID NO: 1985024 - RNA, 22 nt, Human
ccaggcugggucgcccuggacu

SEQ ID NO: 1985025 - RNA, 21 nt, Human
ccaggcugggucgcccuggac

SEQ ID NO: 1985026 - RNA, 23 nt, Human
ccaggcuuagucacugagacagc

SEQ ID NO: 1985027 - RNA, 22 nt, Human
ccaggcuuagucacugagacag

SEQ ID NO: 1985028 - RNA, 21 nt, Human
ccaggcuuagucacugagaca

SEQ ID NO: 1985029 - RNA, 14 nt, Human
ccaggcuggucuca

SEQ ID NO: 1985030 - RNA, 16 nt, Human
ccaggccacuggcccc

SEQ ID NO: 1985031 - RNA, 21 nt, Human
ccaggccacaagacccuugug

SEQ ID NO: 1985032 - RNA, 20 nt, Human
ccaggaggccagccuugacc

SEQ ID NO: 1985033 - RNA, 18 nt, Human
ccaggaggccagccuuga

SEQ ID NO: 1985034 - RNA, 15 nt, Human
ccaggaggccagccu

SEQ ID NO: 1985035 - RNA, 23 nt, Human
ccaggccacuggccccugagauc

SEQ ID NO: 1985036 - RNA, 14 nt, Human
ccaggcccucugcc

SEQ ID NO: 1985037 - RNA, 13 nt, Human
ccaggcccucugc

SEQ ID NO: 1985038 - RNA, 12 nt, Human
ccaggccagagg

SEQ ID NO: 1985039 - RNA, 14 nt, Human
ccaggccccugcca

SEQ ID NO: 1985040 - RNA, 15 nt, Human
ccaggccccugccac

SEQ ID NO: 1985041 - RNA, 16 nt, Human
ccaggccccugccacc

SEQ ID NO: 1985042 - RNA, 16 nt, Human
ccagggcccgggaagc

SEQ ID NO: 1985043 - RNA, 23 nt, Human
ccagugcccacaggaucagucug

SEQ ID NO: 1985044 - RNA, 20 nt, Human
ccauccugaggcuccacuug

SEQ ID NO: 1985045 - RNA, 18 nt, Human
ccauccugaggcuccacu

SEQ ID NO: 1985046 - RNA, 17 nt, Human
ccaucauugaaaucuuu

SEQ ID NO: 1985047 - RNA, 16 nt, Human
ccaucauugaaaucuu

SEQ ID NO: 1985048 - RNA, 14 nt, Human
ccaucauugaaauc

SEQ ID NO: 1985049 - RNA, 15 nt, Human
ccaucucuccuccuu

SEQ ID NO: 1985050 - RNA, 21 nt, Human
ccaucuaggggagccuugauu

SEQ ID NO: 1985051 - RNA, 21 nt, Human
ccaucucacacaugagcauca

SEQ ID NO: 1985052 - RNA, 20 nt, Human
ccaucucacacaugagcauc

SEQ ID NO: 1985053 - RNA, 18 nt, Human
ccaucucacacaugagca

SEQ ID NO: 1985054 - RNA, 17 nt, Human
ccaucucacacaugagc

SEQ ID NO: 1985055 - RNA, 15 nt, Human
ccaucucacacauga

SEQ ID NO: 1985056 - RNA, 14 nt, Human
ccaucucacacaug

SEQ ID NO: 1985057 - RNA, 14 nt, Human
ccaucaagccacca

SEQ ID NO: 1985058 - RNA, 13 nt, Human
ccaucaagccacc

SEQ ID NO: 1985059 - RNA, 16 nt, Human
ccaucaagccaccaac

SEQ ID NO: 1985060 - RNA, 12 nt, Human
ccaucaugucug

SEQ ID NO: 1985061 - RNA, 12 nt, Human
ccaucauugaaa

SEQ ID NO: 1985062 - RNA, 13 nt, Human
ccaucaugucugg

SEQ ID NO: 1985063 - RNA, 15 nt, Human
ccauaugccugggca

SEQ ID NO: 1985064 - RNA, 12 nt, Human
ccaucaagccac

SEQ ID NO: 1985065 - RNA, 22 nt, Human
ccauauuaaguaagucucaagg

SEQ ID NO: 1985066 - RNA, 13 nt, Human
ccauaugccuggg

SEQ ID NO: 1985067 - RNA, 14 nt, Human
ccagugugacaagg

SEQ ID NO: 1985068 - RNA, 23 nt, Human
ccagugugacaaggauugcuacu

SEQ ID NO: 1985069 - RNA, 13 nt, Human
ccagugaggcucu

SEQ ID NO: 1985070 - RNA, 15 nt, Human
ccaguggcagggcac

SEQ ID NO: 1985071 - RNA, 16 nt, Human
ccaguggcagggcaca

SEQ ID NO: 1985072 - RNA, 18 nt, Human
ccaguggcagggcacagg

SEQ ID NO: 1985073 - RNA, 19 nt, Human
ccaguggcagggcacaggg

SEQ ID NO: 1985074 - RNA, 20 nt, Human
ccaguggcagggcacagggc

SEQ ID NO: 1985075 - RNA, 21 nt, Human
ccaguggcagggcacagggcc

SEQ ID NO: 1985076 - RNA, 22 nt, Human
ccaguggcagggcacagggccu

SEQ ID NO: 1985077 - RNA, 23 nt, Human
ccaguggcagggcacagggccug

SEQ ID NO: 1985078 - RNA, 18 nt, Human
ccaguggcuauggccugu

SEQ ID NO: 1985079 - RNA, 23 nt, Human
ccaguaaaugggggugcauuuga

SEQ ID NO: 1985080 - RNA, 23 nt, Human
ccagguuuugcacucuuguuucu

SEQ ID NO: 1985081 - RNA, 20 nt, Human
ccagguuuuguuccgcccag

SEQ ID NO: 1985082 - RNA, 23 nt, Human
ccagguuuuguuccgcccagugg

SEQ ID NO: 1985083 - RNA, 12 nt, Human
ccagugaccugg

SEQ ID NO: 1985084 - RNA, 20 nt, Human
ccagugaccuggaaggccca

SEQ ID NO: 1985085 - RNA, 23 nt, Human
ccagugaccuggaaggcccagca

SEQ ID NO: 1985086 - RNA, 20 nt, Human
ccaguaaaugggggugcauu

SEQ ID NO: 1985087 - RNA, 18 nt, Human
ccagguuuugcacucuug

SEQ ID NO: 1985088 - RNA, 21 nt, Human
ccaguaaaugggggugcauuu

SEQ ID NO: 1985089 - RNA, 22 nt, Human
ccaguaaaugggggugcauuug

SEQ ID NO: 1985090 - RNA, 13 nt, Human
ccagguuuaagcu

SEQ ID NO: 1985091 - RNA, 16 nt, Human
ccagguuucuaugugu

SEQ ID NO: 1985092 - RNA, 17 nt, Human
ccagguugucacugaga

SEQ ID NO: 1985093 - RNA, 20 nt, Human
ccagguggagguggcauccc

SEQ ID NO: 1985094 - RNA, 21 nt, Human
ccaggugcuaggaacacuccu

SEQ ID NO: 1985095 - RNA, 16 nt, Human
ccagguggccacucca

SEQ ID NO: 1985096 - RNA, 21 nt, Human
ccagguggccacuccagaccc

SEQ ID NO: 1985097 - RNA, 17 nt, Human
ccagguagaacgccagg

SEQ ID NO: 1985098 - RNA, 21 nt, Human
ccauucguacauaauacugaa

SEQ ID NO: 1985099 - RNA, 21 nt, Human
ccauuauuaucaaguagacua

SEQ ID NO: 1985100 - RNA, 20 nt, Human
ccauucguacauaauacuga

SEQ ID NO: 1985101 - RNA, 13 nt, Human
ccauuugcuccuu

SEQ ID NO: 1985102 - RNA, 18 nt, Human
ccauuuggagggccuggg

SEQ ID NO: 1985103 - RNA, 11 nt, Human
ccauuuuccug

SEQ ID NO: 1985104 - RNA, 15 nt, Human
ccauucugccugccc

SEQ ID NO: 1985105 - RNA, 13 nt, Human
ccauuucugccuu

SEQ ID NO: 1985106 - RNA, 14 nt, Human
ccauuucugccuuu

SEQ ID NO: 1985107 - RNA, 18 nt, Human
ccauguuuuguuuacggu

SEQ ID NO: 1985108 - RNA, 14 nt, Human
ccauuaacugcuuc

SEQ ID NO: 1985109 - RNA, 18 nt, Human
ccauuaaaauaugcacua

SEQ ID NO: 1985110 - RNA, 12 nt, Human
ccaucugugaau

SEQ ID NO: 1985111 - RNA, 16 nt, Human
ccaucugguuuucucu

SEQ ID NO: 1985112 - RNA, 14 nt, Human
ccaucugugaauaa

SEQ ID NO: 1985113 - RNA, 15 nt, Human
ccaucugugaauaag

SEQ ID NO: 1985114 - RNA, 13 nt, Human
ccaucucugcucc

SEQ ID NO: 1985115 - RNA, 14 nt, Human
ccaucucugcucca

SEQ ID NO: 1985116 - RNA, 14 nt, Human
cccaagggccuggc

SEQ ID NO: 1985117 - RNA, 12 nt, Human
cccaagggccug

SEQ ID NO: 1985118 - RNA, 20 nt, Human
ccauuuuuuauauuucaagu

SEQ ID NO: 1985119 - RNA, 21 nt, Human
ccauuuggagggccugggccu

SEQ ID NO: 1985120 - RNA, 14 nt, Human
ccauuuuuuauauu

SEQ ID NO: 1985121 - RNA, 16 nt, Human
ccauuuuuuauauuuc

SEQ ID NO: 1985122 - RNA, 17 nt, Human
ccauuuuuuauauuuca

SEQ ID NO: 1985123 - RNA, 21 nt, Human
ccauuuuguauuuuacuaaua

SEQ ID NO: 1985124 - RNA, 20 nt, Human
ccauuuugcugucccuuuuc

SEQ ID NO: 1985125 - RNA, 13 nt, Human
ccauuuuccugca

SEQ ID NO: 1985126 - RNA, 16 nt, Human
cccaagggccuggccu

SEQ ID NO: 1985127 - RNA, 21 nt, Human
cccaagguucugggugcagga

SEQ ID NO: 1985128 - RNA, 22 nt, Human
cccaagguucugggugcaggag

SEQ ID NO: 1985129 - RNA, 17 nt, Human
cccacaggaucagucug

SEQ ID NO: 1985130 - RNA, 13 nt, Human
cccacaggaucag

SEQ ID NO: 1985131 - RNA, 23 nt, Human
cccacagacucaaaugcucagac

SEQ ID NO: 1985132 - RNA, 13 nt, Human
cccacagacucaa

SEQ ID NO: 1985133 - RNA, 19 nt, Human
cccacauagugaugguucc

SEQ ID NO: 1985134 - RNA, 16 nt, Human
cccacaggcccuuccu

SEQ ID NO: 1985135 - RNA, 18 nt, Human
cccacaggcccuuccucu

SEQ ID NO: 1985136 - RNA, 22 nt, Human
cccagaauaaacuggcagcuca

SEQ ID NO: 1985137 - RNA, 24 nt, Human
cccagaauaaacuggcagcucagc

SEQ ID NO: 1985138 - RNA, 16 nt, Human
cccagaaugaggcugc

SEQ ID NO: 1985139 - RNA, 14 nt, Human
cccagaagugcaga

SEQ ID NO: 1985140 - RNA, 14 nt, Human
cccagaauacugau

SEQ ID NO: 1985141 - RNA, 14 nt, Human
cccacgcuggagug

SEQ ID NO: 1985142 - RNA, 21 nt, Human
cccacgcugacuacagggccg

SEQ ID NO: 1985143 - RNA, 19 nt, Human
cccacgcccccacugguga

SEQ ID NO: 1985144 - RNA, 17 nt, Human
cccacgcccccacuggu

SEQ ID NO: 1985145 - RNA, 14 nt, Human
cccacgcugacuac

SEQ ID NO: 1985146 - RNA, 16 nt, Human
cccacgcugacuacag

SEQ ID NO: 1985147 - RNA, 19 nt, Human
cccacgcugacuacagggc

SEQ ID NO: 1985148 - RNA, 20 nt, Human
cccacgcugacuacagggcc

SEQ ID NO: 1985149 - RNA, 15 nt, Human
cccaccuuggcucaa

SEQ ID NO: 1985150 - RNA, 22 nt, Human
cccaccuuggcucaaguccucu

SEQ ID NO: 1985151 - RNA, 14 nt, Human
cccaccuuggcugc

SEQ ID NO: 1985152 - RNA, 15 nt, Human
cccaccuuggcugca

SEQ ID NO: 1985153 - RNA, 19 nt, Human
cccaccucucucacuccuu

SEQ ID NO: 1985154 - RNA, 12 nt, Human
cccaccuuggcu

SEQ ID NO: 1985155 - RNA, 17 nt, Human
cccaccucucucacucc

SEQ ID NO: 1985156 - RNA, 14 nt, Human
cccaccucucucac

SEQ ID NO: 1985157 - RNA, 13 nt, Human
cccaccucucuca

SEQ ID NO: 1985158 - RNA, 21 nt, Human
cccaccucagccucccaaagu

SEQ ID NO: 1985159 - RNA, 12 nt, Human
cccaccucagcc

SEQ ID NO: 1985160 - RNA, 14 nt, Human
cccaccucagccuc

SEQ ID NO: 1985161 - RNA, 15 nt, Human
cccaccucagccucc

SEQ ID NO: 1985162 - RNA, 22 nt, Human
cccacauccggggccagcuccg

SEQ ID NO: 1985163 - RNA, 12 nt, Human
cccacaugccag

SEQ ID NO: 1985164 - RNA, 18 nt, Human
cccacaugccaggggccu

SEQ ID NO: 1985165 - RNA, 19 nt, Human
cccacauggugauguugac

SEQ ID NO: 1985166 - RNA, 21 nt, Human
accugugagcugcaccaggua

SEQ ID NO: 1985167 - RNA, 11 nt, Human
accugugucuc

SEQ ID NO: 1985168 - RNA, 15 nt, Human
acuaauagacaauuu

SEQ ID NO: 1985169 - RNA, 13 nt, Human
acuaacuucuaaa

SEQ ID NO: 1985170 - RNA, 16 nt, Human
acuaacuucuaaaacu

SEQ ID NO: 1985171 - RNA, 17 nt, Human
acuaacuucuaaaacug

SEQ ID NO: 1985172 - RNA, 13 nt, Human
acguggcaccucc

SEQ ID NO: 1985173 - RNA, 14 nt, Human
acguggcaccuccu

SEQ ID NO: 1985174 - RNA, 15 nt, Human
acguggcaccuccuc

SEQ ID NO: 1985175 - RNA, 16 nt, Human
acguggcaccuccucg

SEQ ID NO: 1985176 - RNA, 15 nt, Human
acgucugacaggcaa

SEQ ID NO: 1985177 - RNA, 23 nt, Human
acgucugacaggcaaugcuggcu

SEQ ID NO: 1985178 - RNA, 15 nt, Human
acggaauaguuggcu

SEQ ID NO: 1985179 - RNA, 19 nt, Human
acggacgaaccuugaaaac

SEQ ID NO: 1985180 - RNA, 16 nt, Human
acggaagagccuugcg

SEQ ID NO: 1985181 - RNA, 15 nt, Human
acggaagagccuugc

SEQ ID NO: 1985182 - RNA, 19 nt, Human
acgcuggagugcagugagc

SEQ ID NO: 1985183 - RNA, 17 nt, Human
acuagggaagauaauau

SEQ ID NO: 1985184 - RNA, 22 nt, Human
acuaggugcccagaaugaggcu

SEQ ID NO: 1985185 - RNA, 16 nt, Human
acuauuguuagucucu

SEQ ID NO: 1985186 - RNA, 18 nt, Human
acuaggucaaaaaucugu

SEQ ID NO: 1985187 - RNA, 14 nt, Human
acuauugagucuuc

SEQ ID NO: 1985188 - RNA, 17 nt, Human
accucuugagccuugaa

SEQ ID NO: 1985189 - RNA, 19 nt, Human
accucuugagccuugaacu

SEQ ID NO: 1985190 - RNA, 20 nt, Human
accucuugagccuugaacuu

SEQ ID NO: 1985191 - RNA, 21 nt, Human
accucuugagccuugaacuuu

SEQ ID NO: 1985192 - RNA, 11 nt, Human
accugccaggg

SEQ ID NO: 1985193 - RNA, 13 nt, Human
accugccagggac

SEQ ID NO: 1985194 - RNA, 12 nt, Human
accugccaggga

SEQ ID NO: 1985195 - RNA, 18 nt, Human
accugccagggacagagg

SEQ ID NO: 1985196 - RNA, 16 nt, Human
accugccaugccagga

SEQ ID NO: 1985197 - RNA, 16 nt, Human
accugccagggacaga

SEQ ID NO: 1985198 - RNA, 15 nt, Human
accugccagggacag

SEQ ID NO: 1985199 - RNA, 23 nt, Human
accugccccuccucucugcccua

SEQ ID NO: 1985200 - RNA, 19 nt, Human
accugccaugccaggaacc

SEQ ID NO: 1985201 - RNA, 15 nt, Human
accugucuuuuggga

SEQ ID NO: 1985202 - RNA, 17 nt, Human
accugucuuuugggagu

SEQ ID NO: 1985203 - RNA, 14 nt, Human
accccaaucccagc

SEQ ID NO: 1985204 - RNA, 15 nt, Human
accccaagcgcccug

SEQ ID NO: 1985205 - RNA, 16 nt, Human
accccaagcgcccugg

SEQ ID NO: 1985206 - RNA, 19 nt, Human
accccaagcgcccuggccc

SEQ ID NO: 1985207 - RNA, 21 nt, Human
accccaagcgcccuggccccc

SEQ ID NO: 1985208 - RNA, 16 nt, Human
accccacacacgccag

SEQ ID NO: 1985209 - RNA, 22 nt, Human
acccugugauggggcccugccu

SEQ ID NO: 1985210 - RNA, 20 nt, Human
acccugugcagaagggagcu

SEQ ID NO: 1985211 - RNA, 23 nt, Human
accccaagcgcccuggcccccac

SEQ ID NO: 1985212 - RNA, 15 nt, Human
acccaugcugcccug

SEQ ID NO: 1985213 - RNA, 14 nt, Human
acccaugcugcccu

SEQ ID NO: 1985214 - RNA, 17 nt, Human
acccuguuaccauuuug

SEQ ID NO: 1985215 - RNA, 18 nt, Human
acccuguuuugagcccug

SEQ ID NO: 1985216 - RNA, 17 nt, Human
acccuguuuugagcccu

SEQ ID NO: 1985217 - RNA, 15 nt, Human
accggcuggccuggc

SEQ ID NO: 1985218 - RNA, 14 nt, Human
accggcuggccugg

SEQ ID NO: 1985219 - RNA, 18 nt, Human
accggcuggccuggcccc

SEQ ID NO: 1985220 - RNA, 17 nt, Human
accggcuggccuggccc

SEQ ID NO: 1985221 - RNA, 19 nt, Human
accggcuggccuggccccu

SEQ ID NO: 1985222 - RNA, 20 nt, Human
accgggcacucagaagacac

SEQ ID NO: 1985223 - RNA, 15 nt, Human
accguccccucccag

SEQ ID NO: 1985224 - RNA, 16 nt, Human
accguccccucccagg

SEQ ID NO: 1985225 - RNA, 18 nt, Human
accguccccucccaggga

SEQ ID NO: 1985226 - RNA, 14 nt, Human
accgugaggccaga

SEQ ID NO: 1985227 - RNA, 14 nt, Human
accgugaagauacu

SEQ ID NO: 1985228 - RNA, 15 nt, Human
accgggccacagaga

SEQ ID NO: 1985229 - RNA, 19 nt, Human
accgggccacagagaaagu

SEQ ID NO: 1985230 - RNA, 13 nt, Human
accucaggccugg

SEQ ID NO: 1985231 - RNA, 12 nt, Human
accucaggccug

SEQ ID NO: 1985232 - RNA, 17 nt, Human
accgugaggccagagac

SEQ ID NO: 1985233 - RNA, 16 nt, Human
accgugaggccagaga

SEQ ID NO: 1985234 - RNA, 22 nt, Human
accucaggccugggggcugggc

SEQ ID NO: 1985235 - RNA, 14 nt, Human
accucaggccuggg

SEQ ID NO: 1985236 - RNA, 22 nt, Human
accucagguaaucgaccugccu

SEQ ID NO: 1985237 - RNA, 18 nt, Human
accgugaagauacuuugu

SEQ ID NO: 1985238 - RNA, 19 nt, Human
accgugaagauacuuugua

SEQ ID NO: 1985239 - RNA, 20 nt, Human
accgugaagauacuuuguau

SEQ ID NO: 1985240 - RNA, 21 nt, Human
accgugaagauacuuuguauu

SEQ ID NO: 1985241 - RNA, 18 nt, Human
accucaggugagaagcag

SEQ ID NO: 1985242 - RNA, 23 nt, Human
accucagguaaucgaccugccuc

SEQ ID NO: 1985243 - RNA, 14 nt, Human
acuuaaauaaugug

SEQ ID NO: 1985244 - RNA, 22 nt, Human
acuuaaaauauuccugcauuug

SEQ ID NO: 1985245 - RNA, 21 nt, Human
acuuaaaaaugguuuaaaugg

SEQ ID NO: 1985246 - RNA, 20 nt, Human
acuuaaaauauuccugcauu

SEQ ID NO: 1985247 - RNA, 13 nt, Human
acuuaaaaauggu

SEQ ID NO: 1985248 - RNA, 14 nt, Human
acuuaaaaaugguu

SEQ ID NO: 1985249 - RNA, 18 nt, Human
acuucuuauacauuugau

SEQ ID NO: 1985250 - RNA, 17 nt, Human
acuucuuauacauuuga

SEQ ID NO: 1985251 - RNA, 14 nt, Human
acuuggcucugagg

SEQ ID NO: 1985252 - RNA, 23 nt, Human
acuucugccugaggggcagccug

SEQ ID NO: 1985253 - RNA, 14 nt, Human
acuucugcuggcau

SEQ ID NO: 1985254 - RNA, 14 nt, Human
acuucuguuuucaa

SEQ ID NO: 1985255 - RNA, 15 nt, Human
acuucuguuuucaau

SEQ ID NO: 1985256 - RNA, 12 nt, Human
acuucuguuuca

SEQ ID NO: 1985257 - RNA, 16 nt, Human
acuucuguuuucaauc

SEQ ID NO: 1985258 - RNA, 17 nt, Human
acuucuguuuucaaucu

SEQ ID NO: 1985259 - RNA, 22 nt, Human
acuucuguuuucaaucucguau

SEQ ID NO: 1985260 - RNA, 23 nt, Human
acuucuguuuucaaucucguaua

SEQ ID NO: 1985261 - RNA, 20 nt, Human
acuucugccauauucuguug

SEQ ID NO: 1985262 - RNA, 13 nt, Human
acuucagcucugu

SEQ ID NO: 1985263 - RNA, 21 nt, Human
acuuucaaaguggaugcaauu

SEQ ID NO: 1985264 - RNA, 16 nt, Human
acuuucaagaacuugu

SEQ ID NO: 1985265 - RNA, 19 nt, Human
acuuucaagaacuuguuua

SEQ ID NO: 1985266 - RNA, 22 nt, Human
acuuucaggccacauggcuaaa

SEQ ID NO: 1985267 - RNA, 12 nt, Human
acuuuaugcuaa

SEQ ID NO: 1985268 - RNA, 17 nt, Human
acuuuaugcuaagugaa

SEQ ID NO: 1985269 - RNA, 15 nt, Human
acuuuauuuuguguu

SEQ ID NO: 1985270 - RNA, 22 nt, Human
acuugggaggcugagaugggag

SEQ ID NO: 1985271 - RNA, 15 nt, Human
acugcccggcagggu

SEQ ID NO: 1985272 - RNA, 19 nt, Human
acugccagucccccugccc

SEQ ID NO: 1985273 - RNA, 18 nt, Human
acugccagucccccugcc

SEQ ID NO: 1985274 - RNA, 16 nt, Human
acugcuuuuggucugu

SEQ ID NO: 1985275 - RNA, 20 nt, Human
acugcuuuuggucuguguga

SEQ ID NO: 1985276 - RNA, 22 nt, Human
acugcccggcaggguccuagaa

SEQ ID NO: 1985277 - RNA, 15 nt, Human
acugcuuuuggucug

SEQ ID NO: 1985278 - RNA, 22 nt, Human
acugauuuuuuuuuccuucagu

SEQ ID NO: 1985279 - RNA, 21 nt, Human
acugauuuuuuuuuccuucag

SEQ ID NO: 1985280 - RNA, 23 nt, Human
acugauuuuuuuuuccuucagug

SEQ ID NO: 1985281 - RNA, 22 nt, Human
acugauuaguaagucuugccua

SEQ ID NO: 1985282 - RNA, 15 nt, Human
acugaccagccucca

SEQ ID NO: 1985283 - RNA, 20 nt, Human
acugaccagccuccaugcug

SEQ ID NO: 1985284 - RNA, 13 nt, Human
acugaccagccuc

SEQ ID NO: 1985285 - RNA, 14 nt, Human
acugaccagacaag

SEQ ID NO: 1985286 - RNA, 22 nt, Human
acugacauuguuggccaaagcc

SEQ ID NO: 1985287 - RNA, 23 nt, Human
acugacauuguuggccaaagcca

SEQ ID NO: 1985288 - RNA, 13 nt, Human
acugaaucuguac

SEQ ID NO: 1985289 - RNA, 14 nt, Human
acugaaucuguaca

SEQ ID NO: 1985290 - RNA, 15 nt, Human
acugaaucuguacag

SEQ ID NO: 1985291 - RNA, 13 nt, Human
acugaucucucgu

SEQ ID NO: 1985292 - RNA, 23 nt, Human
acugaccagccuccaugcugccu

SEQ ID NO: 1985293 - RNA, 22 nt, Human
acugauggcuaauguacugcau

SEQ ID NO: 1985294 - RNA, 12 nt, Human
acugauggaauu

SEQ ID NO: 1985295 - RNA, 21 nt, Human
acugauggaauuuuuuuguac

SEQ ID NO: 1985296 - RNA, 22 nt, Human
acugauggaauuuuuuuguacg

SEQ ID NO: 1985297 - RNA, 23 nt, Human
acugauggaauuuuuuuguacga

SEQ ID NO: 1985298 - RNA, 12 nt, Human
acugaugggcaa

SEQ ID NO: 1985299 - RNA, 22 nt, Human
acugaugggcaacccccagccu

SEQ ID NO: 1985300 - RNA, 21 nt, Human
acuauuuuuauuuuuaaauua

SEQ ID NO: 1985301 - RNA, 16 nt, Human
acuauuuuuauuuuua

SEQ ID NO: 1985302 - RNA, 14 nt, Human
acucuaaagucugu

SEQ ID NO: 1985303 - RNA, 13 nt, Human
acucuaagauguu

SEQ ID NO: 1985304 - RNA, 14 nt, Human
acucuaagauguua

SEQ ID NO: 1985305 - RNA, 19 nt, Human
acucuaagauguuauauuu

SEQ ID NO: 1985306 - RNA, 16 nt, Human
acucuaaguguuugcu

SEQ ID NO: 1985307 - RNA, 23 nt, Human
acucuaaguguuugcugcaauuu

SEQ ID NO: 1985308 - RNA, 23 nt, Human
acucuaaguuuuaggguacaugu

SEQ ID NO: 1985309 - RNA, 21 nt, Human
acugaaguucugccucugaug

SEQ ID NO: 1985310 - RNA, 12 nt, Human
acugaaguuuga

SEQ ID NO: 1985311 - RNA, 15 nt, Human
acugaaguuugauaa

SEQ ID NO: 1985312 - RNA, 18 nt, Human
acugaaguuugauaaaua

SEQ ID NO: 1985313 - RNA, 19 nt, Human
acugaaguuugauaaauag

SEQ ID NO: 1985314 - RNA, 21 nt, Human
acugaaguuugauaaauagug

SEQ ID NO: 1985315 - RNA, 22 nt, Human
acugaaguuugauaaauagugu

SEQ ID NO: 1985316 - RNA, 23 nt, Human
acugaaguuugauaaauaguguu

SEQ ID NO: 1985317 - RNA, 15 nt, Human
acucugucucagucc

SEQ ID NO: 1985318 - RNA, 17 nt, Human
acucugucucaguccau

SEQ ID NO: 1985319 - RNA, 21 nt, Human
acucugugucagguggggcag

SEQ ID NO: 1985320 - RNA, 19 nt, Human
acucugugucagguggggc

SEQ ID NO: 1985321 - RNA, 19 nt, Human
acucugucucaaaaaaaca

SEQ ID NO: 1985322 - RNA, 21 nt, Human
acucuacuuagcaugucccua

SEQ ID NO: 1985323 - RNA, 20 nt, Human
acucuacuuagcaugucccu

SEQ ID NO: 1985324 - RNA, 19 nt, Human
aauuuauuuuuaagaaaga

SEQ ID NO: 1985325 - RNA, 20 nt, Human
aauuuauuuuuaagaaagaa

SEQ ID NO: 1985326 - RNA, 23 nt, Human
aauuucaacgccugccuuuggca

SEQ ID NO: 1985327 - RNA, 13 nt, Human
aauuucaagcuua

SEQ ID NO: 1985328 - RNA, 15 nt, Human
aauuucaagcuuauu

SEQ ID NO: 1985329 - RNA, 17 nt, Human
aauuucaagcuuauuuu

SEQ ID NO: 1985330 - RNA, 20 nt, Human
aauuucaagcuuauuuugga

SEQ ID NO: 1985331 - RNA, 22 nt, Human
aauuucaagcuuauuuuggaga

SEQ ID NO: 1985332 - RNA, 20 nt, Human
aauuucagagagaaucaaga

SEQ ID NO: 1985333 - RNA, 21 nt, Human
aauuucacgucauaggaaguu

SEQ ID NO: 1985334 - RNA, 22 nt, Human
aauuucacgucauaggaaguua

SEQ ID NO: 1985335 - RNA, 18 nt, Human
aauuuccugggagcuuuu

SEQ ID NO: 1985336 - RNA, 21 nt, Human
aauuuccugggagcuuuugua

SEQ ID NO: 1985337 - RNA, 17 nt, Human
aauuuccugggagcuuu

SEQ ID NO: 1985338 - RNA, 16 nt, Human
aauuucaguaagauca

SEQ ID NO: 1985339 - RNA, 11 nt, Human
aauuguauuuu

SEQ ID NO: 1985340 - RNA, 12 nt, Human
aauuguauuuuu

SEQ ID NO: 1985341 - RNA, 14 nt, Human
aauuguauuuuugu

SEQ ID NO: 1985342 - RNA, 19 nt, Human
aauuguauuuuuguuguug

SEQ ID NO: 1985343 - RNA, 12 nt, Human
aauuguaaggaa

SEQ ID NO: 1985344 - RNA, 16 nt, Human
aauuguaaggaaugau

SEQ ID NO: 1985345 - RNA, 21 nt, Human
aauuggguggggggcuucaua

SEQ ID NO: 1985346 - RNA, 22 nt, Human
aauuggguggggggcuucauac

SEQ ID NO: 1985347 - RNA, 20 nt, Human
aauugguuaucaugggaaag

SEQ ID NO: 1985348 - RNA, 15 nt, Human
aauugguaccuugca

SEQ ID NO: 1985349 - RNA, 19 nt, Human
aauugguguaauggggcag

SEQ ID NO: 1985350 - RNA, 23 nt, Human
aauuggguggggggcuucauaca

SEQ ID NO: 1985351 - RNA, 16 nt, Human
aaugucacaggcaggu

SEQ ID NO: 1985352 - RNA, 19 nt, Human
aaugucacaggcaggucca

SEQ ID NO: 1985353 - RNA, 17 nt, Human
aauuuauuauggcacau

SEQ ID NO: 1985354 - RNA, 11 nt, Human
aauugugaugu

SEQ ID NO: 1985355 - RNA, 14 nt, Human
aauugugauguguc

SEQ ID NO: 1985356 - RNA, 15 nt, Human
aauugugaugugucc

SEQ ID NO: 1985357 - RNA, 19 nt, Human
aauugucuuaauggaugaa

SEQ ID NO: 1985358 - RNA, 19 nt, Human
aauuuauugaggaaaaaua

SEQ ID NO: 1985359 - RNA, 21 nt, Human
aauuuauugaggaaaaauaug

SEQ ID NO: 1985360 - RNA, 22 nt, Human
aauuuauugaggaaaaauaugu

SEQ ID NO: 1985361 - RNA, 23 nt, Human
aauuuauugaggaaaaauaugug

SEQ ID NO: 1985362 - RNA, 20 nt, Human
aauuuauuuaugggauccug

SEQ ID NO: 1985363 - RNA, 15 nt, Human
acaagaaaugaaagc

SEQ ID NO: 1985364 - RNA, 16 nt, Human
acaagaaaugaaagca

SEQ ID NO: 1985365 - RNA, 18 nt, Human
acaaccuucuguggcuca

SEQ ID NO: 1985366 - RNA, 20 nt, Human
acaaagaaccuaacauuuau

SEQ ID NO: 1985367 - RNA, 16 nt, Human
acaacccccagcuccc

SEQ ID NO: 1985368 - RNA, 13 nt, Human
acaaaauggaaua

SEQ ID NO: 1985369 - RNA, 14 nt, Human
acaaaauggaauac

SEQ ID NO: 1985370 - RNA, 22 nt, Human
acaaaaugaaacgcaaccacca

SEQ ID NO: 1985371 - RNA, 13 nt, Human
acaaaaugaaacg

SEQ ID NO: 1985372 - RNA, 16 nt, Human
acaaagaaauuaugug

SEQ ID NO: 1985373 - RNA, 14 nt, Human
acaaagaaauuaug

SEQ ID NO: 1985374 - RNA, 12 nt, Human
acaaagaaauua

SEQ ID NO: 1985375 - RNA, 18 nt, Human
aauuuucaucuaggauuu

SEQ ID NO: 1985376 - RNA, 13 nt, Human
aauuuucagauuu

SEQ ID NO: 1985377 - RNA, 14 nt, Human
aauuuucagauuug

SEQ ID NO: 1985378 - RNA, 17 nt, Human
aauuuucagauuugcac

SEQ ID NO: 1985379 - RNA, 18 nt, Human
aauuuucagauuugcaca

SEQ ID NO: 1985380 - RNA, 20 nt, Human
aauuuucagauuugcacaaa

SEQ ID NO: 1985381 - RNA, 14 nt, Human
aauuuugauguuuu

SEQ ID NO: 1985382 - RNA, 19 nt, Human
aauuuucauuuuacaguua

SEQ ID NO: 1985383 - RNA, 15 nt, Human
aauuuucauuuuaca

SEQ ID NO: 1985384 - RNA, 16 nt, Human
aauuuucauuuuacag

SEQ ID NO: 1985385 - RNA, 10 nt, Human
aauuuucauu

SEQ ID NO: 1985386 - RNA, 12 nt, Human
aauuuucauuuu

SEQ ID NO: 1985387 - RNA, 13 nt, Human
aauuuucauuuua

SEQ ID NO: 1985388 - RNA, 16 nt, Human
aauuuugugcccccau

SEQ ID NO: 1985389 - RNA, 20 nt, Human
acaaggaugaucuaggaaga

SEQ ID NO: 1985390 - RNA, 16 nt, Human
acaaggauugcuacug

SEQ ID NO: 1985391 - RNA, 13 nt, Human
acaauuccaugac

SEQ ID NO: 1985392 - RNA, 19 nt, Human
acaauucaaagaaucaccu

SEQ ID NO: 1985393 - RNA, 14 nt, Human
acaauucagcauua

SEQ ID NO: 1985394 - RNA, 14 nt, Human
acaauuuauuaugg

SEQ ID NO: 1985395 - RNA, 13 nt, Human
acaauuuauuaug

SEQ ID NO: 1985396 - RNA, 12 nt, Human
acaauuauaaac

SEQ ID NO: 1985397 - RNA, 23 nt, Human
acaauuauaaacucauuuugcuu

SEQ ID NO: 1985398 - RNA, 16 nt, Human
acacauuuuuuaaaug

SEQ ID NO: 1985399 - RNA, 18 nt, Human
acacauuuuuuaaaugca

SEQ ID NO: 1985400 - RNA, 19 nt, Human
acacauuuuuuaaaugcac

SEQ ID NO: 1985401 - RNA, 15 nt, Human
acaccacuacauucu

SEQ ID NO: 1985402 - RNA, 14 nt, Human
acacgaauauugcu

SEQ ID NO: 1985403 - RNA, 12 nt, Human
acacgaauauug

SEQ ID NO: 1985404 - RNA, 17 nt, Human
acaccacuacauucugu

SEQ ID NO: 1985405 - RNA, 20 nt, Human
acaccacuacauucuguuaa

SEQ ID NO: 1985406 - RNA, 19 nt, Human
acacagcucuucuccaggc

SEQ ID NO: 1985407 - RNA, 17 nt, Human
acacaaaacaaauccug

SEQ ID NO: 1985408 - RNA, 12 nt, Human
acacaaaaucaa

SEQ ID NO: 1985409 - RNA, 19 nt, Human
acacaaaaguuucucuuuu

SEQ ID NO: 1985410 - RNA, 14 nt, Human
acacauuuuuuaaa

SEQ ID NO: 1985411 - RNA, 22 nt, Human
acacagcucuucuccaggcugu

SEQ ID NO: 1985412 - RNA, 20 nt, Human
acacagcucuucuccaggcu

SEQ ID NO: 1985413 - RNA, 21 nt, Human
acacagcucuucuccaggcug

SEQ ID NO: 1985414 - RNA, 21 nt, Human
acacgaauauugcugauggug

SEQ ID NO: 1985415 - RNA, 15 nt, Human
acacgaauauugcug

SEQ ID NO: 1985416 - RNA, 20 nt, Human
acacguaaugaaacuuggau

SEQ ID NO: 1985417 - RNA, 23 nt, Human
acagaggacaguauuugugggga

SEQ ID NO: 1985418 - RNA, 16 nt, Human
acagaggacacagaga

SEQ ID NO: 1985419 - RNA, 13 nt, Human
acagaggcagccc

SEQ ID NO: 1985420 - RNA, 21 nt, Human
acagaggaccagcacacuccc

SEQ ID NO: 1985421 - RNA, 12 nt, Human
acagaggaccag

SEQ ID NO: 1985422 - RNA, 14 nt, Human
acagaggaccagca

SEQ ID NO: 1985423 - RNA, 15 nt, Human
acagaggaccagcac

SEQ ID NO: 1985424 - RNA, 20 nt, Human
acagaggaccagcacacucc

SEQ ID NO: 1985425 - RNA, 17 nt, Human
acagaggccaugggccu

SEQ ID NO: 1985426 - RNA, 21 nt, Human
acagaggccaugggccuccug

SEQ ID NO: 1985427 - RNA, 23 nt, Human
acagaggccaugggccuccugug

SEQ ID NO: 1985428 - RNA, 19 nt, Human
acagaaggcuccugccccc

SEQ ID NO: 1985429 - RNA, 16 nt, Human
acagaaggcuccugcc

SEQ ID NO: 1985430 - RNA, 18 nt, Human
acagaaggcuccugcccc

SEQ ID NO: 1985431 - RNA, 14 nt, Human
acagacaaagcgug

SEQ ID NO: 1985432 - RNA, 17 nt, Human
acagaaggggacugcca

SEQ ID NO: 1985433 - RNA, 22 nt, Human
acagaaggggacugccaccucc

SEQ ID NO: 1985434 - RNA, 23 nt, Human
acagaaggggacugccaccuccc

SEQ ID NO: 1985435 - RNA, 17 nt, Human
acacugugcugagucug

SEQ ID NO: 1985436 - RNA, 22 nt, Human
acacugugcugagucugaaggc

SEQ ID NO: 1985437 - RNA, 20 nt, Human
acacugugguagguguuuga

SEQ ID NO: 1985438 - RNA, 18 nt, Human
acacugugguagguguuu

SEQ ID NO: 1985439 - RNA, 22 nt, Human
acagaacucgguguccccacca

SEQ ID NO: 1985440 - RNA, 19 nt, Human
acagaacucggugucccca

SEQ ID NO: 1985441 - RNA, 20 nt, Human
acagaacucgguguccccac

SEQ ID NO: 1985442 - RNA, 20 nt, Human
acacugggagaaaugaaaaa

SEQ ID NO: 1985443 - RNA, 14 nt, Human
acacugggaaacag

SEQ ID NO: 1985444 - RNA, 13 nt, Human
acagcugccuggg

SEQ ID NO: 1985445 - RNA, 16 nt, Human
acagcugccugcagua

SEQ ID NO: 1985446 - RNA, 12 nt, Human
acagcugccugc

SEQ ID NO: 1985447 - RNA, 20 nt, Human
acaggcaagcaccuccugcc

SEQ ID NO: 1985448 - RNA, 23 nt, Human
acaggcaagcaccuccugccucg

SEQ ID NO: 1985449 - RNA, 13 nt, Human
acagcucuguccu

SEQ ID NO: 1985450 - RNA, 16 nt, Human
acagcucuguccuggg

SEQ ID NO: 1985451 - RNA, 17 nt, Human
acagcucuguccuggga

SEQ ID NO: 1985452 - RNA, 21 nt, Human
acagaggggguggccucccaa

SEQ ID NO: 1985453 - RNA, 19 nt, Human
acagaggggguggccuccc

SEQ ID NO: 1985454 - RNA, 18 nt, Human
acagaggggguggccucc

SEQ ID NO: 1985455 - RNA, 17 nt, Human
acagaggggguggccuc

SEQ ID NO: 1985456 - RNA, 16 nt, Human
acagcuccuucugucc

SEQ ID NO: 1985457 - RNA, 18 nt, Human
acagcuccuucuguccua

SEQ ID NO: 1985458 - RNA, 23 nt, Human
acagcuccuucuguccuacucug

SEQ ID NO: 1985459 - RNA, 14 nt, Human
acagcucuguccug

SEQ ID NO: 1985460 - RNA, 22 nt, Human
acagugagucgaggacagggag

SEQ ID NO: 1985461 - RNA, 18 nt, Human
acagguguuuauaucucc

SEQ ID NO: 1985462 - RNA, 19 nt, Human
acaggugugaaccaccaca

SEQ ID NO: 1985463 - RNA, 22 nt, Human
acaggugugagucaccaagccc

SEQ ID NO: 1985464 - RNA, 23 nt, Human
acaggugugagucaccaagccca

SEQ ID NO: 1985465 - RNA, 18 nt, Human
acaggugauuaacuugga

SEQ ID NO: 1985466 - RNA, 13 nt, Human
acaggugcccgcc

SEQ ID NO: 1985467 - RNA, 21 nt, Human
acagggcugauaagcuaacac

SEQ ID NO: 1985468 - RNA, 19 nt, Human
acagggccuggcccaugua

SEQ ID NO: 1985469 - RNA, 14 nt, Human
acaggcaaugcugg

SEQ ID NO: 1985470 - RNA, 12 nt, Human
acagggccuggc

SEQ ID NO: 1985471 - RNA, 13 nt, Human
acagggccuggcc

SEQ ID NO: 1985472 - RNA, 14 nt, Human
acagggccuggccc

SEQ ID NO: 1985473 - RNA, 15 nt, Human
acagggccuggccca

SEQ ID NO: 1985474 - RNA, 16 nt, Human
acagggccuggcccau

SEQ ID NO: 1985475 - RNA, 17 nt, Human
acagggccuggcccaug

SEQ ID NO: 1985476 - RNA, 23 nt, Human
acaguguaccauuaaaauaugca

SEQ ID NO: 1985477 - RNA, 19 nt, Human
acaguguaccauuaaaaua

SEQ ID NO: 1985478 - RNA, 20 nt, Human
acaguguaccauuaaaauau

SEQ ID NO: 1985479 - RNA, 18 nt, Human
acaguguaccauuaaaau

SEQ ID NO: 1985480 - RNA, 19 nt, Human
acaguggggaaugaagaua

SEQ ID NO: 1985481 - RNA, 15 nt, Human
acaguggggaaugaa

SEQ ID NO: 1985482 - RNA, 21 nt, Human
acagugcaccugggacaggga

SEQ ID NO: 1985483 - RNA, 21 nt, Human
acagugauuaccagggacuga

SEQ ID NO: 1985484 - RNA, 20 nt, Human
acagugauuaccagggacug

SEQ ID NO: 1985485 - RNA, 23 nt, Human
acagugagucgaggacagggagg

SEQ ID NO: 1985486 - RNA, 18 nt, Human
acaugccucucucaggcc

SEQ ID NO: 1985487 - RNA, 17 nt, Human
acaugccucucucaggc

SEQ ID NO: 1985488 - RNA, 16 nt, Human
acaugccucucucagg

SEQ ID NO: 1985489 - RNA, 15 nt, Human
acaugccucucucag

SEQ ID NO: 1985490 - RNA, 15 nt, Human
acaugccaggggccu

SEQ ID NO: 1985491 - RNA, 20 nt, Human
acauccugucaucugagaau

SEQ ID NO: 1985492 - RNA, 18 nt, Human
acaugcaaggucauuuuu

SEQ ID NO: 1985493 - RNA, 17 nt, Human
acaugcaaggucauuuu

SEQ ID NO: 1985494 - RNA, 16 nt, Human
acaugcaaggucauuu

SEQ ID NO: 1985495 - RNA, 15 nt, Human
acauccuacaagaca

SEQ ID NO: 1985496 - RNA, 18 nt, Human
acauccggggccagcucc

SEQ ID NO: 1985497 - RNA, 19 nt, Human
acauccggggccagcuccg

SEQ ID NO: 1985498 - RNA, 13 nt, Human
acaucauuccuuu

SEQ ID NO: 1985499 - RNA, 19 nt, Human
acaucaucuguaagcuguu

SEQ ID NO: 1985500 - RNA, 20 nt, Human
acaucaucuguaagcuguuu

SEQ ID NO: 1985501 - RNA, 13 nt, Human
acaucaucuguaa

SEQ ID NO: 1985502 - RNA, 14 nt, Human
acaucaucuguaag

SEQ ID NO: 1985503 - RNA, 18 nt, Human
acaucaucuguaagcugu

SEQ ID NO: 1985504 - RNA, 16 nt, Human
acauaagauaaaugug

SEQ ID NO: 1985505 - RNA, 11 nt, Human
acauacaaaug

SEQ ID NO: 1985506 - RNA, 21 nt, Human
acauacaaaugcaucuuugau

SEQ ID NO: 1985507 - RNA, 20 nt, Human
acauaauucaggaagcagcu

SEQ ID NO: 1985508 - RNA, 13 nt, Human
acauaauucuuau

SEQ ID NO: 1985509 - RNA, 22 nt, Human
acaucagcuggucaaacaaacu

SEQ ID NO: 1985510 - RNA, 20 nt, Human
acaucagguuaggcaguaua

SEQ ID NO: 1985511 - RNA, 21 nt, Human
acauaauuaacacuuaagguu

SEQ ID NO: 1985512 - RNA, 13 nt, Human
accagcagagcac

SEQ ID NO: 1985513 - RNA, 12 nt, Human
accagcagagca

SEQ ID NO: 1985514 - RNA, 14 nt, Human
accagcagaaaugc

SEQ ID NO: 1985515 - RNA, 16 nt, Human
accagccccagugccc

SEQ ID NO: 1985516 - RNA, 17 nt, Human
accagccccagugccca

SEQ ID NO: 1985517 - RNA, 16 nt, Human
accagccccacccugu

SEQ ID NO: 1985518 - RNA, 18 nt, Human
accagccccagugcccac

SEQ ID NO: 1985519 - RNA, 19 nt, Human
accagccccagugcccaca

SEQ ID NO: 1985520 - RNA, 20 nt, Human
accagccccagugcccacag

SEQ ID NO: 1985521 - RNA, 20 nt, Human
accaaggcugauuaaaccaa

SEQ ID NO: 1985522 - RNA, 17 nt, Human
accacccgguccccacu

SEQ ID NO: 1985523 - RNA, 16 nt, Human
accacccgguccccac

SEQ ID NO: 1985524 - RNA, 12 nt, Human
accaccugccca

SEQ ID NO: 1985525 - RNA, 14 nt, Human
accacccuccuucc

SEQ ID NO: 1985526 - RNA, 12 nt, Human
accacccuccuu

SEQ ID NO: 1985527 - RNA, 19 nt, Human
accaaggcugauuaaacca

SEQ ID NO: 1985528 - RNA, 18 nt, Human
accaagaaaggaaccugu

SEQ ID NO: 1985529 - RNA, 19 nt, Human
acauuuccgccacaucccu

SEQ ID NO: 1985530 - RNA, 23 nt, Human
acauuucuaagucaaacacuugu

SEQ ID NO: 1985531 - RNA, 17 nt, Human
acauuucucauguugaa

SEQ ID NO: 1985532 - RNA, 17 nt, Human
acauuuccuaaauauau

SEQ ID NO: 1985533 - RNA, 16 nt, Human
acauuuccuaaauaua

SEQ ID NO: 1985534 - RNA, 19 nt, Human
acaugccucucucaggcca

SEQ ID NO: 1985535 - RNA, 23 nt, Human
acaugucuuuucuugcaugaggc

SEQ ID NO: 1985536 - RNA, 14 nt, Human
acaugugaaaagaa

SEQ ID NO: 1985537 - RNA, 17 nt, Human
acaugugaaaagaauag

SEQ ID NO: 1985538 - RNA, 18 nt, Human
acaugugaaaagaauaga

SEQ ID NO: 1985539 - RNA, 14 nt, Human
accaucucuuuacc

SEQ ID NO: 1985540 - RNA, 12 nt, Human
accauccccucc

SEQ ID NO: 1985541 - RNA, 13 nt, Human
accaucugcuguc

SEQ ID NO: 1985542 - RNA, 23 nt, Human
accaucauugaaaucuuuuugcu

SEQ ID NO: 1985543 - RNA, 16 nt, Human
accaucccugaaggcc

SEQ ID NO: 1985544 - RNA, 15 nt, Human
accaucaagccacca

SEQ ID NO: 1985545 - RNA, 14 nt, Human
accauaguugacag

SEQ ID NO: 1985546 - RNA, 15 nt, Human
accaucauugaaauc

SEQ ID NO: 1985547 - RNA, 12 nt, Human
accaucauugaa

SEQ ID NO: 1985548 - RNA, 19 nt, Human
accauaguguucauugaua

SEQ ID NO: 1985549 - RNA, 15 nt, Human
accauaguuacugua

SEQ ID NO: 1985550 - RNA, 18 nt, Human
accauaguuacuguaaaa

SEQ ID NO: 1985551 - RNA, 22 nt, Human
accauaguuacuguaaaaugca

SEQ ID NO: 1985552 - RNA, 14 nt, Human
accaucaagccacc

SEQ ID NO: 1985553 - RNA, 17 nt, Human
accauaggucaccuuua

SEQ ID NO: 1985554 - RNA, 21 nt, Human
accauacuaauuauacccccu

SEQ ID NO: 1985555 - RNA, 13 nt, Human
accauacuaauua

SEQ ID NO: 1985556 - RNA, 16 nt, Human
accauacuaauuauac

SEQ ID NO: 1985557 - RNA, 20 nt, Human
acccauccaccguccccucc

SEQ ID NO: 1985558 - RNA, 13 nt, Human
acccaugcugccc

SEQ ID NO: 1985559 - RNA, 15 nt, Human
acccacccuccuuuc

SEQ ID NO: 1985560 - RNA, 21 nt, Human
acccacccuuucuacuuccaa

SEQ ID NO: 1985561 - RNA, 15 nt, Human
acccacccccaccca

SEQ ID NO: 1985562 - RNA, 12 nt, Human
acccaccacaca

SEQ ID NO: 1985563 - RNA, 17 nt, Human
acccacccccacccaag

SEQ ID NO: 1985564 - RNA, 21 nt, Human
accaucuuuuccucauuuuca

SEQ ID NO: 1985565 - RNA, 14 nt, Human
accaucugcugucu

SEQ ID NO: 1985566 - RNA, 15 nt, Human
accaucugcugucuu

SEQ ID NO: 1985567 - RNA, 21 nt, Human
aagcagaggaaggagaggaga

SEQ ID NO: 1985568 - RNA, 14 nt, Human
aagcagaauuggaa

SEQ ID NO: 1985569 - RNA, 15 nt, Human
aagcagaauuggaaa

SEQ ID NO: 1985570 - RNA, 15 nt, Human
aagcagggacuugaa

SEQ ID NO: 1985571 - RNA, 19 nt, Human
aagccaccaacauacuccc

SEQ ID NO: 1985572 - RNA, 14 nt, Human
aagcagguuaaaug

SEQ ID NO: 1985573 - RNA, 15 nt, Human
aagcagguuaaaugu

SEQ ID NO: 1985574 - RNA, 16 nt, Human
aagcagguuaaauguu

SEQ ID NO: 1985575 - RNA, 17 nt, Human
aagcagguuaaauguuu

SEQ ID NO: 1985576 - RNA, 18 nt, Human
aagcagguuaaauguuuu

SEQ ID NO: 1985577 - RNA, 19 nt, Human
aagauuuugaaauuuuuau

SEQ ID NO: 1985578 - RNA, 13 nt, Human
aagauuuugaucu

SEQ ID NO: 1985579 - RNA, 20 nt, Human
aagauuuugaucucacauuu

SEQ ID NO: 1985580 - RNA, 21 nt, Human
aagauuuugaucucacauuuu

SEQ ID NO: 1985581 - RNA, 23 nt, Human
aagauuuugaucucacauuuuua

SEQ ID NO: 1985582 - RNA, 14 nt, Human
aagauacugaaaua

SEQ ID NO: 1985583 - RNA, 16 nt, Human
aagauacugaaauaaa

SEQ ID NO: 1985584 - RNA, 20 nt, Human
aagauacugaaauaaacguc

SEQ ID NO: 1985585 - RNA, 12 nt, Human
aagauacuuugu

SEQ ID NO: 1985586 - RNA, 13 nt, Human
aagauacuuugua

SEQ ID NO: 1985587 - RNA, 12 nt, Human
aagauacuguuu

SEQ ID NO: 1985588 - RNA, 17 nt, Human
aagauucaaucccagga

SEQ ID NO: 1985589 - RNA, 20 nt, Human
aagauuauaauuguugcaua

SEQ ID NO: 1985590 - RNA, 14 nt, Human
aagauuauaauugu

SEQ ID NO: 1985591 - RNA, 19 nt, Human
aagauuauaauuguugcau

SEQ ID NO: 1985592 - RNA, 14 nt, Human
aagauacuuuguau

SEQ ID NO: 1985593 - RNA, 16 nt, Human
aagauacuuuguauug

SEQ ID NO: 1985594 - RNA, 17 nt, Human
aagauagaguaaaaaga

SEQ ID NO: 1985595 - RNA, 19 nt, Human
aagauagaguaaaaagaaa

SEQ ID NO: 1985596 - RNA, 20 nt, Human
aagauucaaugccccugaau

SEQ ID NO: 1985597 - RNA, 21 nt, Human
aagauucaaugccccugaauu

SEQ ID NO: 1985598 - RNA, 20 nt, Human
aagauucauauuuacuucuu

SEQ ID NO: 1985599 - RNA, 21 nt, Human
aagauucuauguuaauauuuu

SEQ ID NO: 1985600 - RNA, 22 nt, Human
aagauucuauguuaauauuuua

SEQ ID NO: 1985601 - RNA, 17 nt, Human
aagauugauguuuccuu

SEQ ID NO: 1985602 - RNA, 17 nt, Human
aagagacaauuucugca

SEQ ID NO: 1985603 - RNA, 14 nt, Human
aagagacaggcagg

SEQ ID NO: 1985604 - RNA, 18 nt, Human
aagagaagggcagggcug

SEQ ID NO: 1985605 - RNA, 15 nt, Human
aagacuuuuaugaua

SEQ ID NO: 1985606 - RNA, 16 nt, Human
aagacuuuggaaagag

SEQ ID NO: 1985607 - RNA, 21 nt, Human
aagacagggcugauaagcuaa

SEQ ID NO: 1985608 - RNA, 23 nt, Human
aagacagugaaagaaaauaacaa

SEQ ID NO: 1985609 - RNA, 22 nt, Human
aacuuacaggugauuaacuugg

SEQ ID NO: 1985610 - RNA, 20 nt, Human
aacuuacauauuuauuuuua

SEQ ID NO: 1985611 - RNA, 19 nt, Human
aacuguuguauaaauuuau

SEQ ID NO: 1985612 - RNA, 13 nt, Human
aacuguuuagaug

SEQ ID NO: 1985613 - RNA, 13 nt, Human
aacuguuguauaa

SEQ ID NO: 1985614 - RNA, 14 nt, Human
aacuguuguauaaa

SEQ ID NO: 1985615 - RNA, 15 nt, Human
aacuguuguauaaau

SEQ ID NO: 1985616 - RNA, 16 nt, Human
aagacagcauuugugu

SEQ ID NO: 1985617 - RNA, 21 nt, Human
aagacagcccgauccuccccu

SEQ ID NO: 1985618 - RNA, 15 nt, Human
aacuuagagcuuuuu

SEQ ID NO: 1985619 - RNA, 23 nt, Human
aacuuacccuguauaucagggua

SEQ ID NO: 1985620 - RNA, 15 nt, Human
aaguagcacaggcug

SEQ ID NO: 1985621 - RNA, 16 nt, Human
aaguagcacaggcuga

SEQ ID NO: 1985622 - RNA, 22 nt, Human
aaguagccaccugaguuccuga

SEQ ID NO: 1985623 - RNA, 21 nt, Human
aaguagcaaaugagacagcag

SEQ ID NO: 1985624 - RNA, 14 nt, Human
aaguagcacaggcu

SEQ ID NO: 1985625 - RNA, 19 nt, Human
aaguagacuacuguucagc

SEQ ID NO: 1985626 - RNA, 12 nt, Human
aaguagaggagg

SEQ ID NO: 1985627 - RNA, 12 nt, Human
aagguguuugaa

SEQ ID NO: 1985628 - RNA, 13 nt, Human
aagguguuugaaa

SEQ ID NO: 1985629 - RNA, 17 nt, Human
aaggucuguuugcuguu

SEQ ID NO: 1985630 - RNA, 18 nt, Human
aaggucuguuugcuguug

SEQ ID NO: 1985631 - RNA, 14 nt, Human
aaggucuguuuuga

SEQ ID NO: 1985632 - RNA, 16 nt, Human
aaggucuguuuugagu

SEQ ID NO: 1985633 - RNA, 22 nt, Human
aaggucuugcauuuaaaagaca

SEQ ID NO: 1985634 - RNA, 17 nt, Human
aagggacugagaaauuu

SEQ ID NO: 1985635 - RNA, 15 nt, Human
aagggacugagaaau

SEQ ID NO: 1985636 - RNA, 20 nt, Human
aagggacuuggaagcuccgc

SEQ ID NO: 1985637 - RNA, 17 nt, Human
aagggacugauguuugu

SEQ ID NO: 1985638 - RNA, 14 nt, Human
aagggcagggacag

SEQ ID NO: 1985639 - RNA, 19 nt, Human
aagggcagaguuacuugau

SEQ ID NO: 1985640 - RNA, 18 nt, Human
aagggcagaaguagggga

SEQ ID NO: 1985641 - RNA, 13 nt, Human
aagggcagaguua

SEQ ID NO: 1985642 - RNA, 16 nt, Human
aagggcacauagaaag

SEQ ID NO: 1985643 - RNA, 14 nt, Human
aagccaccagaugu

SEQ ID NO: 1985644 - RNA, 20 nt, Human
aagcagguuaaauguuuugu

SEQ ID NO: 1985645 - RNA, 21 nt, Human
aagcagguuaaauguuuugua

SEQ ID NO: 1985646 - RNA, 21 nt, Human
aagccaccaacauacucccau

SEQ ID NO: 1985647 - RNA, 16 nt, Human
aagccacccaaagcag

SEQ ID NO: 1985648 - RNA, 18 nt, Human
aagccagcaggcucucag

SEQ ID NO: 1985649 - RNA, 15 nt, Human
aagccagcaggcucu

SEQ ID NO: 1985650 - RNA, 15 nt, Human
aagcgauucuucugc

SEQ ID NO: 1985651 - RNA, 14 nt, Human
aagcgauucuucug

SEQ ID NO: 1985652 - RNA, 16 nt, Human
aagcgauucuucugcu

SEQ ID NO: 1985653 - RNA, 17 nt, Human
aagcgauucuucugcuu

SEQ ID NO: 1985654 - RNA, 13 nt, Human
aagcugcugugau

SEQ ID NO: 1985655 - RNA, 16 nt, Human
aagcugcugacagugu

SEQ ID NO: 1985656 - RNA, 23 nt, Human
aaggaaugauuaauuaaaacaca

SEQ ID NO: 1985657 - RNA, 21 nt, Human
aaggaauaugggagaaauagu

SEQ ID NO: 1985658 - RNA, 18 nt, Human
aaggaaucuagccaguga

SEQ ID NO: 1985659 - RNA, 23 nt, Human
aaggaaucuagccagugaacaua

SEQ ID NO: 1985660 - RNA, 21 nt, Human
aagcgugagccacugcaccgg

SEQ ID NO: 1985661 - RNA, 17 nt, Human
aagcgugagccacugca

SEQ ID NO: 1985662 - RNA, 20 nt, Human
aagcgugagccacugcaccg

SEQ ID NO: 1985663 - RNA, 12 nt, Human
aagcugccagcc

SEQ ID NO: 1985664 - RNA, 11 nt, Human
aagcugccagc

SEQ ID NO: 1985665 - RNA, 22 nt, Human
aagcugccagccgagauagcca

SEQ ID NO: 1985666 - RNA, 14 nt, Human
aagcugcugacagu

SEQ ID NO: 1985667 - RNA, 13 nt, Human
aaggacuaggguc

SEQ ID NO: 1985668 - RNA, 24 nt, Human
aaggaccuucacucuaagauguua

SEQ ID NO: 1985669 - RNA, 15 nt, Human
aaggaccuaaaaauu

SEQ ID NO: 1985670 - RNA, 20 nt, Human
aaggaccuucacucuaagau

SEQ ID NO: 1985671 - RNA, 21 nt, Human
aaggaccuucacucuaagaug

SEQ ID NO: 1985672 - RNA, 22 nt, Human
aaggaccuucacucuaagaugu

SEQ ID NO: 1985673 - RNA, 23 nt, Human
aaggaccuucacucuaagauguu

SEQ ID NO: 1985674 - RNA, 12 nt, Human
aaggaauuuuau

SEQ ID NO: 1985675 - RNA, 22 nt, Human
aaggacccggaggggccuggca

SEQ ID NO: 1985676 - RNA, 19 nt, Human
aaggaauuuugcuaaguaa

SEQ ID NO: 1985677 - RNA, 15 nt, Human
aaggcaaacauuuga

SEQ ID NO: 1985678 - RNA, 22 nt, Human
aaggcaaaccuuucuauaauuu

SEQ ID NO: 1985679 - RNA, 15 nt, Human
aaggcagaaagcaaa

SEQ ID NO: 1985680 - RNA, 16 nt, Human
aaggcagaaagcaaaa

SEQ ID NO: 1985681 - RNA, 17 nt, Human
aaggcagaaagcaaaau

SEQ ID NO: 1985682 - RNA, 19 nt, Human
aaggcagaaagcaaaauua

SEQ ID NO: 1985683 - RNA, 15 nt, Human
aaugaacaagcauuc

SEQ ID NO: 1985684 - RNA, 21 nt, Human
aaugaacaagcauucucucca

SEQ ID NO: 1985685 - RNA, 14 nt, Human
aaugaacacaaauu

SEQ ID NO: 1985686 - RNA, 17 nt, Human
aaugaacacaaauuaug

SEQ ID NO: 1985687 - RNA, 20 nt, Human
aaugaacacaaauuaugcua

SEQ ID NO: 1985688 - RNA, 16 nt, Human
aaugaacaaagaccaa

SEQ ID NO: 1985689 - RNA, 13 nt, Human
aaugauuaauuaa

SEQ ID NO: 1985690 - RNA, 12 nt, Human
aaugauuaauua

SEQ ID NO: 1985691 - RNA, 19 nt, Human
aaugaugugccugcuucag

SEQ ID NO: 1985692 - RNA, 16 nt, Human
aaugauuaauuaaaac

SEQ ID NO: 1985693 - RNA, 15 nt, Human
aaugauagcuacugu

SEQ ID NO: 1985694 - RNA, 15 nt, Human
aaugauaugcuugua

SEQ ID NO: 1985695 - RNA, 17 nt, Human
aaugauaugcuuguaac

SEQ ID NO: 1985696 - RNA, 23 nt, Human
aaugauguauguugaagccuuug

SEQ ID NO: 1985697 - RNA, 19 nt, Human
aaugauaugcuuguaacua

SEQ ID NO: 1985698 - RNA, 18 nt, Human
aaugauaugcuuguaacu

SEQ ID NO: 1985699 - RNA, 19 nt, Human
aaucucguauagaagucuu

SEQ ID NO: 1985700 - RNA, 20 nt, Human
aaucucguauagaagucuuc

SEQ ID NO: 1985701 - RNA, 18 nt, Human
aaucucggcucacugcau

SEQ ID NO: 1985702 - RNA, 23 nt, Human
aaucucgcucugucgcccaggcu

SEQ ID NO: 1985703 - RNA, 14 nt, Human
aaugaaauguaugu

SEQ ID NO: 1985704 - RNA, 15 nt, Human
aaugaaauguaugug

SEQ ID NO: 1985705 - RNA, 16 nt, Human
aaugaaauguaugugc

SEQ ID NO: 1985706 - RNA, 17 nt, Human
aaugaaauguaugugcu

SEQ ID NO: 1985707 - RNA, 20 nt, Human
aaucuggacuccucugucca

SEQ ID NO: 1985708 - RNA, 17 nt, Human
aaucuggacuccucugu

SEQ ID NO: 1985709 - RNA, 18 nt, Human
aaucuggacuccucuguc

SEQ ID NO: 1985710 - RNA, 15 nt, Human
aaucuggacuccucu

SEQ ID NO: 1985711 - RNA, 16 nt, Human
aaucuggacuccucug

SEQ ID NO: 1985712 - RNA, 24 nt, Human
aaucuggaccccaucugugaauaa

SEQ ID NO: 1985713 - RNA, 15 nt, Human
aauccaaaagaaaaa

SEQ ID NO: 1985714 - RNA, 16 nt, Human
aauccaaaagaaaaac

SEQ ID NO: 1985715 - RNA, 14 nt, Human
aauccaaauauugu

SEQ ID NO: 1985716 - RNA, 16 nt, Human
aauccaaauauuguua

SEQ ID NO: 1985717 - RNA, 21 nt, Human
aauccaaauauuguuaaggga

SEQ ID NO: 1985718 - RNA, 19 nt, Human
aauccaucagugccaaacu

SEQ ID NO: 1985719 - RNA, 19 nt, Human
aauccagaaacuuguucuu

SEQ ID NO: 1985720 - RNA, 20 nt, Human
aauccagaaacuuguucuuc

SEQ ID NO: 1985721 - RNA, 18 nt, Human
aaucauuuguucaaagcu

SEQ ID NO: 1985722 - RNA, 18 nt, Human
aaucauuuuuuauauaua

SEQ ID NO: 1985723 - RNA, 19 nt, Human
aaucauuuuuuauauauau

SEQ ID NO: 1985724 - RNA, 21 nt, Human
aaucauuuuuuauauauaugc

SEQ ID NO: 1985725 - RNA, 22 nt, Human
aaucauuuuuuauauauaugca

SEQ ID NO: 1985726 - RNA, 23 nt, Human
aaucauuuuuuauauauaugcau

SEQ ID NO: 1985727 - RNA, 24 nt, Human
aaucauuuuuuauauauaugcaua

SEQ ID NO: 1985728 - RNA, 11 nt, Human
aaucauuuguu

SEQ ID NO: 1985729 - RNA, 13 nt, Human
aaucaaauaauac

SEQ ID NO: 1985730 - RNA, 13 nt, Human
aaucaaauguaaa

SEQ ID NO: 1985731 - RNA, 16 nt, Human
aaucaaauaauaccuu

SEQ ID NO: 1985732 - RNA, 21 nt, Human
aaucaaauaauaccuuagaag

SEQ ID NO: 1985733 - RNA, 14 nt, Human
aaucaaauguaaag

SEQ ID NO: 1985734 - RNA, 15 nt, Human
aaucaaauguaaagu

SEQ ID NO: 1985735 - RNA, 15 nt, Human
aaugucacaggcagg

SEQ ID NO: 1985736 - RNA, 15 nt, Human
aaugggggugcauuu

SEQ ID NO: 1985737 - RNA, 17 nt, Human
aaugggggugcauuuga

SEQ ID NO: 1985738 - RNA, 21 nt, Human
aaugggaggggaaaugggaau

SEQ ID NO: 1985739 - RNA, 14 nt, Human
aaugggagcucaug

SEQ ID NO: 1985740 - RNA, 13 nt, Human
aaugggacacuaa

SEQ ID NO: 1985741 - RNA, 15 nt, Human
aaugcucagaccagc

SEQ ID NO: 1985742 - RNA, 23 nt, Human
aaugcucuuuacuucauggacuu

SEQ ID NO: 1985743 - RNA, 21 nt, Human
aaugcgugcauaccacuuuug

SEQ ID NO: 1985744 - RNA, 23 nt, Human
aaugcgugcauaccacuuuuguu

SEQ ID NO: 1985745 - RNA, 15 nt, Human
aaugcuagaaaaauu

SEQ ID NO: 1985746 - RNA, 17 nt, Human
aaugcgcaggcuggccc

SEQ ID NO: 1985747 - RNA, 18 nt, Human
aaugcgcaggcuggcccu

SEQ ID NO: 1985748 - RNA, 19 nt, Human
aaugcgcaggcuggcccug

SEQ ID NO: 1985749 - RNA, 20 nt, Human
aaugcgcaggcuggcccugc

SEQ ID NO: 1985750 - RNA, 15 nt, Human
aaugcgcaggcuggc

SEQ ID NO: 1985751 - RNA, 14 nt, Human
aaugcgcaggcugg

SEQ ID NO: 1985752 - RNA, 23 nt, Human
aaugccucuggcucuacacauau

SEQ ID NO: 1985753 - RNA, 16 nt, Human
aaugccucuugucuuc

SEQ ID NO: 1985754 - RNA, 21 nt, Human
aaugccgcccucccagcucug

SEQ ID NO: 1985755 - RNA, 16 nt, Human
aauauaggaacuuaaa

SEQ ID NO: 1985756 - RNA, 15 nt, Human
aauauagauuaaauc

SEQ ID NO: 1985757 - RNA, 17 nt, Human
aauauagauuaaaucau

SEQ ID NO: 1985758 - RNA, 19 nt, Human
aauauagauuaaaucauac

SEQ ID NO: 1985759 - RNA, 19 nt, Human
aauacgugggcauucaaau

SEQ ID NO: 1985760 - RNA, 20 nt, Human
aauacgugggcauucaaaug

SEQ ID NO: 1985761 - RNA, 13 nt, Human
aauaccuuagaag

SEQ ID NO: 1985762 - RNA, 21 nt, Human
aauaccugucccccugacaac

SEQ ID NO: 1985763 - RNA, 21 nt, Human
aauacuguuauucuuugcacu

SEQ ID NO: 1985764 - RNA, 22 nt, Human
aauacuguuauucuuugcacuu

SEQ ID NO: 1985765 - RNA, 17 nt, Human
aauacuguuauucuuug

SEQ ID NO: 1985766 - RNA, 18 nt, Human
aauacuguuauucuuugc

SEQ ID NO: 1985767 - RNA, 19 nt, Human
aauacuguuauucuuugca

SEQ ID NO: 1985768 - RNA, 14 nt, Human
aauacuuaaauguu

SEQ ID NO: 1985769 - RNA, 15 nt, Human
aauacuuaaauguua

SEQ ID NO: 1985770 - RNA, 18 nt, Human
aauacuuaaauguuaugu

SEQ ID NO: 1985771 - RNA, 20 nt, Human
aauacuuaaauguuauguau

SEQ ID NO: 1985772 - RNA, 14 nt, Human
aauacuucuuuuua

SEQ ID NO: 1985773 - RNA, 14 nt, Human
aauacuugaaccau

SEQ ID NO: 1985774 - RNA, 17 nt, Human
aauacuugaaccauaaa

SEQ ID NO: 1985775 - RNA, 19 nt, Human
aauacuugaaccauaaaau

SEQ ID NO: 1985776 - RNA, 22 nt, Human
aauacuugaaccauaaaauguc

SEQ ID NO: 1985777 - RNA, 19 nt, Human
aauagaacaacauauacaa

SEQ ID NO: 1985778 - RNA, 22 nt, Human
aauagaagcuaagguuuagaua

SEQ ID NO: 1985779 - RNA, 20 nt, Human
aauaguuuauuuuaaaacaa

SEQ ID NO: 1985780 - RNA, 22 nt, Human
aauaguuuauuuuaaaacaaua

SEQ ID NO: 1985781 - RNA, 13 nt, Human
aauauaaaaauaa

SEQ ID NO: 1985782 - RNA, 18 nt, Human
aaguugauggugaugaaa

SEQ ID NO: 1985783 - RNA, 15 nt, Human
aaguugaucucccca

SEQ ID NO: 1985784 - RNA, 17 nt, Human
aaguugaucuccccagc

SEQ ID NO: 1985785 - RNA, 12 nt, Human
aauaaaauuuuu

SEQ ID NO: 1985786 - RNA, 10 nt, Human
aauaaaccau

SEQ ID NO: 1985787 - RNA, 12 nt, Human
aauaauaaauag

SEQ ID NO: 1985788 - RNA, 13 nt, Human
aauaauaaauagu

SEQ ID NO: 1985789 - RNA, 14 nt, Human
aauaauaaauaguu

SEQ ID NO: 1985790 - RNA, 16 nt, Human
aauaauaaauaguucu

SEQ ID NO: 1985791 - RNA, 21 nt, Human
aauaaagccuugugaucacuu

SEQ ID NO: 1985792 - RNA, 15 nt, Human
aauaaacgucuuaaa

SEQ ID NO: 1985793 - RNA, 19 nt, Human
aauaaagcuguguggcagu

SEQ ID NO: 1985794 - RNA, 11 nt, Human
aauaaagcugu

SEQ ID NO: 1985795 - RNA, 15 nt, Human
aaguggggacagagc

SEQ ID NO: 1985796 - RNA, 14 nt, Human
aaguucuuugauuc

SEQ ID NO: 1985797 - RNA, 15 nt, Human
aaguucuuugauucu

SEQ ID NO: 1985798 - RNA, 15 nt, Human
aaguucugccucuga

SEQ ID NO: 1985799 - RNA, 16 nt, Human
aaguucugccucugau

SEQ ID NO: 1985800 - RNA, 17 nt, Human
aaguucugccucugaug

SEQ ID NO: 1985801 - RNA, 22 nt, Human
aaguucugccucugauguauuu

SEQ ID NO: 1985802 - RNA, 14 nt, Human
aagugcugcauuua

SEQ ID NO: 1985803 - RNA, 13 nt, Human
aagugcugcauuu

SEQ ID NO: 1985804 - RNA, 13 nt, Human
aagugcuauuacg

SEQ ID NO: 1985805 - RNA, 18 nt, Human
aagugcuauuacgaaguu

SEQ ID NO: 1985806 - RNA, 14 nt, Human
aaguaguucuguau

SEQ ID NO: 1985807 - RNA, 16 nt, Human
aaguaguucuguauuu

SEQ ID NO: 1985808 - RNA, 19 nt, Human
aaguaguucuguauuugaa

SEQ ID NO: 1985809 - RNA, 20 nt, Human
aaguaguucuguauuugaaa

SEQ ID NO: 1985810 - RNA, 21 nt, Human
aaguaguucuguauuugaaag

SEQ ID NO: 1985811 - RNA, 22 nt, Human
aaguaguucuguauuugaaagu

SEQ ID NO: 1985812 - RNA, 23 nt, Human
aaguaguucuguauuugaaagug

SEQ ID NO: 1985813 - RNA, 17 nt, Human
aauaaagcgaaaaacuc

SEQ ID NO: 1985814 - RNA, 16 nt, Human
aauaauaccuuagaag

SEQ ID NO: 1985815 - RNA, 18 nt, Human
aauaauagauugugaaua

SEQ ID NO: 1985816 - RNA, 15 nt, Human
aauaauaccuuagaa

SEQ ID NO: 1985817 - RNA, 20 nt, Human
aauaauauguuuccuucccu

SEQ ID NO: 1985818 - RNA, 17 nt, Human
aaauggaauacucuuau

SEQ ID NO: 1985819 - RNA, 21 nt, Human
aaaugcugauuuaaacuucuu

SEQ ID NO: 1985820 - RNA, 14 nt, Human
aaauggacguguua

SEQ ID NO: 1985821 - RNA, 16 nt, Human
aaaugcugaaaauugc

SEQ ID NO: 1985822 - RNA, 22 nt, Human
aaaugcuaugucauuucauguc

SEQ ID NO: 1985823 - RNA, 20 nt, Human
aaaugcuaugucauuucaug

SEQ ID NO: 1985824 - RNA, 21 nt, Human
aaaugcuaugucauuucaugu

SEQ ID NO: 1985825 - RNA, 12 nt, Human
aaaugcugaaca

SEQ ID NO: 1985826 - RNA, 15 nt, Human
aaaugcugaacauug

SEQ ID NO: 1985827 - RNA, 17 nt, Human
aaaugcugaaaauugcc

SEQ ID NO: 1985828 - RNA, 12 nt, Human
aaaugcugaccc

SEQ ID NO: 1985829 - RNA, 16 nt, Human
aaaugcugacccaugg

SEQ ID NO: 1985830 - RNA, 14 nt, Human
aaaugcugauuuaa

SEQ ID NO: 1985831 - RNA, 17 nt, Human
aaauggacguguuauga

SEQ ID NO: 1985832 - RNA, 15 nt, Human
aaauggacguguuau

SEQ ID NO: 1985833 - RNA, 15 nt, Human
aaaucugaagauugu

SEQ ID NO: 1985834 - RNA, 16 nt, Human
aaaucugaagauuguu

SEQ ID NO: 1985835 - RNA, 17 nt, Human
aaaucugaagauuguuu

SEQ ID NO: 1985836 - RNA, 18 nt, Human
aaaucugaagauuguuua

SEQ ID NO: 1985837 - RNA, 19 nt, Human
aaaucugaagauuguuuau

SEQ ID NO: 1985838 - RNA, 20 nt, Human
aaaucugaagauuguuuauc

SEQ ID NO: 1985839 - RNA, 21 nt, Human
aaaucugaagauuguuuaucu

SEQ ID NO: 1985840 - RNA, 22 nt, Human
aaaucucuacaaauuuuucugu

SEQ ID NO: 1985841 - RNA, 13 nt, Human
aaaucucuucugu

SEQ ID NO: 1985842 - RNA, 12 nt, Human
aaaucucuucug

SEQ ID NO: 1985843 - RNA, 22 nt, Human
aaaucuccaaaauaaaacuuuu

SEQ ID NO: 1985844 - RNA, 15 nt, Human
aaaugcuagaaaaau

SEQ ID NO: 1985845 - RNA, 16 nt, Human
aaaugcuaugucauuu

SEQ ID NO: 1985846 - RNA, 17 nt, Human
aaaugcuaugucauuuc

SEQ ID NO: 1985847 - RNA, 19 nt, Human
aaaugcuaugucauuucau

SEQ ID NO: 1985848 - RNA, 16 nt, Human
aaaucuuaagaaauaa

SEQ ID NO: 1985849 - RNA, 13 nt, Human
aaaucuuaagaaa

SEQ ID NO: 1985850 - RNA, 14 nt, Human
aaaucuuaagaaau

SEQ ID NO: 1985851 - RNA, 12 nt, Human
aaaucuuaagaa

SEQ ID NO: 1985852 - RNA, 23 nt, Human
aaaucugaagauuguuuaucuag

SEQ ID NO: 1985853 - RNA, 15 nt, Human
aaaucugcaaagcau

SEQ ID NO: 1985854 - RNA, 17 nt, Human
aaaucugcaaagcaugu

SEQ ID NO: 1985855 - RNA, 23 nt, Human
aaaucugcaaagcauguuuugca

SEQ ID NO: 1985856 - RNA, 18 nt, Human
aaaucugcuuuuuaaaga

SEQ ID NO: 1985857 - RNA, 20 nt, Human
aaauguucaucaaugaauga

SEQ ID NO: 1985858 - RNA, 15 nt, Human
aaauguucuuccagu

SEQ ID NO: 1985859 - RNA, 13 nt, Human
aaauguucuucca

SEQ ID NO: 1985860 - RNA, 21 nt, Human
aaauguuuuuuuuuaaagacu

SEQ ID NO: 1985861 - RNA, 18 nt, Human
aaauguuuuuuuuuaaag

SEQ ID NO: 1985862 - RNA, 16 nt, Human
aaauugguaccuugca

SEQ ID NO: 1985863 - RNA, 18 nt, Human
aaauugguaccuugcaca

SEQ ID NO: 1985864 - RNA, 20 nt, Human
aaauugguaccuugcacaca

SEQ ID NO: 1985865 - RNA, 15 nt, Human
aaauugggguuuauu

SEQ ID NO: 1985866 - RNA, 14 nt, Human
aacaaacagaugcu

SEQ ID NO: 1985867 - RNA, 17 nt, Human
aacaaacagaugcucug

SEQ ID NO: 1985868 - RNA, 18 nt, Human
aaauugaugggauuuggu

SEQ ID NO: 1985869 - RNA, 13 nt, Human
aaauuaacuuuua

SEQ ID NO: 1985870 - RNA, 14 nt, Human
aaauuaacuuuuau

SEQ ID NO: 1985871 - RNA, 22 nt, Human
aaauugacacuuaaaaaugguu

SEQ ID NO: 1985872 - RNA, 16 nt, Human
aaauugagcugcuuuu

SEQ ID NO: 1985873 - RNA, 23 nt, Human
aaauugagcugcuuuuuuugaaa

SEQ ID NO: 1985874 - RNA, 12 nt, Human
aaauuaacuuuu

SEQ ID NO: 1985875 - RNA, 22 nt, Human
aaauguuuuuuuuuaaagacuu

SEQ ID NO: 1985876 - RNA, 13 nt, Human
aacaaaucuuccu

SEQ ID NO: 1985877 - RNA, 14 nt, Human
aacaaaucuuccug

SEQ ID NO: 1985878 - RNA, 21 nt, Human
aacacauacaggaagguagaa

SEQ ID NO: 1985879 - RNA, 16 nt, Human
aacacaggccacccug

SEQ ID NO: 1985880 - RNA, 18 nt, Human
aacaaauccugcauuuag

SEQ ID NO: 1985881 - RNA, 22 nt, Human
aacaaaggccuaauucuaugcc

SEQ ID NO: 1985882 - RNA, 16 nt, Human
aacaaacucucugaac

SEQ ID NO: 1985883 - RNA, 14 nt, Human
aacaaacugcacau

SEQ ID NO: 1985884 - RNA, 22 nt, Human
aacaaaccuguuucugcagcca

SEQ ID NO: 1985885 - RNA, 19 nt, Human
aacaccucugcacaagcug

SEQ ID NO: 1985886 - RNA, 17 nt, Human
aacacuaacaugauuug

SEQ ID NO: 1985887 - RNA, 18 nt, Human
aacacauaauuaacacuu

SEQ ID NO: 1985888 - RNA, 17 nt, Human
aacacauaauuaacacu

SEQ ID NO: 1985889 - RNA, 13 nt, Human
aaccgggauggga

SEQ ID NO: 1985890 - RNA, 22 nt, Human
aacaugcuacacacugcauguu

SEQ ID NO: 1985891 - RNA, 21 nt, Human
aaccaggcuuucuagaaagaa

SEQ ID NO: 1985892 - RNA, 15 nt, Human
aacauggaaguacua

SEQ ID NO: 1985893 - RNA, 14 nt, Human
aaccaggcuuucua

SEQ ID NO: 1985894 - RNA, 17 nt, Human
aaccaggcuuucuagaa

SEQ ID NO: 1985895 - RNA, 19 nt, Human
aaccaguguuguggauuua

SEQ ID NO: 1985896 - RNA, 17 nt, Human
aaccaguguuguggauu

SEQ ID NO: 1985897 - RNA, 13 nt, Human
aacccuucagugc

SEQ ID NO: 1985898 - RNA, 12 nt, Human
aaccauaguuac

SEQ ID NO: 1985899 - RNA, 15 nt, Human
aaccauaguuacugu

SEQ ID NO: 1985900 - RNA, 18 nt, Human
aaccauaaaauguccagu

SEQ ID NO: 1985901 - RNA, 20 nt, Human
aacagcggcuggacuuggag

SEQ ID NO: 1985902 - RNA, 16 nt, Human
aacagcuaaugggaca

SEQ ID NO: 1985903 - RNA, 13 nt, Human
aacagauuuggaa

SEQ ID NO: 1985904 - RNA, 14 nt, Human
aacagauuuggaaa

SEQ ID NO: 1985905 - RNA, 15 nt, Human
aacagauuuggaaag

SEQ ID NO: 1985906 - RNA, 15 nt, Human
aacaucccuccuggg

SEQ ID NO: 1985907 - RNA, 15 nt, Human
aacauccuacaagac

SEQ ID NO: 1985908 - RNA, 22 nt, Human
aacauccuacaagacacaguga

SEQ ID NO: 1985909 - RNA, 16 nt, Human
aacagcuaugagagga

SEQ ID NO: 1985910 - RNA, 21 nt, Human
aacugagcuuggaagcuucug

SEQ ID NO: 1985911 - RNA, 13 nt, Human
aacugagcuugga

SEQ ID NO: 1985912 - RNA, 17 nt, Human
aacugagcuuggaagcu

SEQ ID NO: 1985913 - RNA, 14 nt, Human
aacuguuaccauug

SEQ ID NO: 1985914 - RNA, 17 nt, Human
aacuguuaccauuggaa

SEQ ID NO: 1985915 - RNA, 18 nt, Human
aacuguuaccauuggaaa

SEQ ID NO: 1985916 - RNA, 19 nt, Human
aacuguuaccauuggaaau

SEQ ID NO: 1985917 - RNA, 23 nt, Human
aacuguuaccauuggaaauuuca

SEQ ID NO: 1985918 - RNA, 14 nt, Human
aacuguuagaaugu

SEQ ID NO: 1985919 - RNA, 16 nt, Human
aacuguuagaauguaa

SEQ ID NO: 1985920 - RNA, 18 nt, Human
aacuguucccaccugcug

SEQ ID NO: 1985921 - RNA, 15 nt, Human
aacuguucccaccug

SEQ ID NO: 1985922 - RNA, 13 nt, Human
aacuguucccacc

SEQ ID NO: 1985923 - RNA, 15 nt, Human
aacucauauuuucau

SEQ ID NO: 1985924 - RNA, 16 nt, Human
aacucauauuuucaug

SEQ ID NO: 1985925 - RNA, 18 nt, Human
aacucauauuuucaugcu

SEQ ID NO: 1985926 - RNA, 13 nt, Human
aacugaaguucug

SEQ ID NO: 1985927 - RNA, 20 nt, Human
aacugaauagcaaguggcau

SEQ ID NO: 1985928 - RNA, 18 nt, Human
aacucaccccagccccaa

SEQ ID NO: 1985929 - RNA, 17 nt, Human
aacucaccccagcccca

SEQ ID NO: 1985930 - RNA, 16 nt, Human
aacucaccccagcccc

SEQ ID NO: 1985931 - RNA, 17 nt, Human
aacucaaccaaauggua

SEQ ID NO: 1985932 - RNA, 19 nt, Human
aacucaaccaaaugguaca

SEQ ID NO: 1985933 - RNA, 23 nt, Human
aacucaaccaaaugguacaaaac

SEQ ID NO: 1985934 - RNA, 17 nt, Human
aacucaaacucuuaaaa

SEQ ID NO: 1985935 - RNA, 15 nt, Human
aacguauaaaagccu

SEQ ID NO: 1985936 - RNA, 21 nt, Human
aacguagucggcacagccugg

SEQ ID NO: 1985937 - RNA, 14 nt, Human
aacgaaaaucauug

SEQ ID NO: 1985938 - RNA, 17 nt, Human
aacgacaaaucugucug

SEQ ID NO: 1985939 - RNA, 18 nt, Human
aacgacaaaucugucugc

SEQ ID NO: 1985940 - RNA, 22 nt, Human
aacgaucacaaaugacuuuauu

SEQ ID NO: 1985941 - RNA, 21 nt, Human
aacgagccuuuucacccuucu

SEQ ID NO: 1985942 - RNA, 17 nt, Human
aacgaucacaaaugacu

SEQ ID NO: 1985943 - RNA, 21 nt, Human
aaagcauuuuguaauaauaaa

SEQ ID NO: 1985944 - RNA, 15 nt, Human
aaagccaaagcuagg

SEQ ID NO: 1985945 - RNA, 14 nt, Human
aaagcauuuuguaa

SEQ ID NO: 1985946 - RNA, 15 nt, Human
aaagcauuuuguaau

SEQ ID NO: 1985947 - RNA, 13 nt, Human
aaagcauuuugua

SEQ ID NO: 1985948 - RNA, 21 nt, Human
aaaggcuccaggagcagccac

SEQ ID NO: 1985949 - RNA, 22 nt, Human
aaaggcuccaggagcagccaca

SEQ ID NO: 1985950 - RNA, 13 nt, Human
aaaggcuguauuc

SEQ ID NO: 1985951 - RNA, 17 nt, Human
aaaggcuaccuuuguau

SEQ ID NO: 1985952 - RNA, 14 nt, Human
aaaggcuaccuuug

SEQ ID NO: 1985953 - RNA, 14 nt, Human
aaaggcuccaggag

SEQ ID NO: 1985954 - RNA, 12 nt, Human
aaagcccaggag

SEQ ID NO: 1985955 - RNA, 13 nt, Human
aaagcccaggagc

SEQ ID NO: 1985956 - RNA, 14 nt, Human
aaagcccaggagcc

SEQ ID NO: 1985957 - RNA, 15 nt, Human
aaagcccaggagccc

SEQ ID NO: 1985958 - RNA, 22 nt, Human
aaagcccaaccucuuccuccug

SEQ ID NO: 1985959 - RNA, 15 nt, Human
aaagcccaaccucuu

SEQ ID NO: 1985960 - RNA, 20 nt, Human
aaagcccaaccucuuccucc

SEQ ID NO: 1985961 - RNA, 15 nt, Human
aaagccaagaggcug

SEQ ID NO: 1985962 - RNA, 19 nt, Human
aaaggcagaagcaacccaa

SEQ ID NO: 1985963 - RNA, 16 nt, Human
aaagccccauuaacug

SEQ ID NO: 1985964 - RNA, 12 nt, Human
aaaggcagcugu

SEQ ID NO: 1985965 - RNA, 14 nt, Human
aaaggcagcuguug

SEQ ID NO: 1985966 - RNA, 17 nt, Human
aaaggcagcuguugucu

SEQ ID NO: 1985967 - RNA, 22 nt, Human
aaaggcagcuguugucucuucu

SEQ ID NO: 1985968 - RNA, 14 nt, Human
aaagugccuuugca

SEQ ID NO: 1985969 - RNA, 12 nt, Human
aaagugccuuug

SEQ ID NO: 1985970 - RNA, 15 nt, Human
aaauaaacgucuuaa

SEQ ID NO: 1985971 - RNA, 16 nt, Human
aaauaaacgucuuaaa

SEQ ID NO: 1985972 - RNA, 14 nt, Human
aaaggcuguauuca

SEQ ID NO: 1985973 - RNA, 18 nt, Human
aaaggcuguauucagcaa

SEQ ID NO: 1985974 - RNA, 20 nt, Human
aaaggcuguauucagcaagg

SEQ ID NO: 1985975 - RNA, 16 nt, Human
aaagucagaacaaauu

SEQ ID NO: 1985976 - RNA, 13 nt, Human
aaagucacaguua

SEQ ID NO: 1985977 - RNA, 15 nt, Human
aaagucaugauguuu

SEQ ID NO: 1985978 - RNA, 16 nt, Human
aaagucaugauguuuu

SEQ ID NO: 1985979 - RNA, 17 nt, Human
aaagucaugauguuuuu

SEQ ID NO: 1985980 - RNA, 18 nt, Human
aaagucaugauguuuuua

SEQ ID NO: 1985981 - RNA, 21 nt, Human
aaagucaugauguuuuuaaaa

SEQ ID NO: 1985982 - RNA, 22 nt, Human
aaagucaugauguuuuuaaaau

SEQ ID NO: 1985983 - RNA, 15 nt, Human
aaagugaugaacugg

SEQ ID NO: 1985984 - RNA, 11 nt, Human
aaauaaauuau

SEQ ID NO: 1985985 - RNA, 13 nt, Human
aaagaggugugca

SEQ ID NO: 1985986 - RNA, 18 nt, Human
aaagaggucgcuugggaa

SEQ ID NO: 1985987 - RNA, 14 nt, Human
aaagauaaauauua

SEQ ID NO: 1985988 - RNA, 15 nt, Human
aaagauaaauauuau

SEQ ID NO: 1985989 - RNA, 13 nt, Human
aaagauaaauauu

SEQ ID NO: 1985990 - RNA, 16 nt, Human
aaagauaaauauuaua

SEQ ID NO: 1985991 - RNA, 15 nt, Human
aaagauacaguuacu

SEQ ID NO: 1985992 - RNA, 18 nt, Human
aaacccagcucuggucca

SEQ ID NO: 1985993 - RNA, 22 nt, Human
aaacccagcugcaccccuuccu

SEQ ID NO: 1985994 - RNA, 23 nt, Human
aaacccagcugcaccccuuccug

SEQ ID NO: 1985995 - RNA, 17 nt, Human
aaaccccaucucuacaa

SEQ ID NO: 1985996 - RNA, 21 nt, Human
aaacccugucucuacuaaaaa

SEQ ID NO: 1985997 - RNA, 14 nt, Human
aaacccuucagugc

SEQ ID NO: 1985998 - RNA, 13 nt, Human
aaaccguguuugu

SEQ ID NO: 1985999 - RNA, 20 nt, Human
aaaccguguuugucucuucu

SEQ ID NO: 1986000 - RNA, 17 nt, Human
aaacccugucaaacauu

SEQ ID NO: 1986001 - RNA, 18 nt, Human
aaacccugucaaacauua

SEQ ID NO: 1986002 - RNA, 17 nt, Human
aaacucuugaccucagg

SEQ ID NO: 1986003 - RNA, 16 nt, Human
aaaccuaguacugccc

SEQ ID NO: 1986004 - RNA, 12 nt, Human
aaacucuuuaac

SEQ ID NO: 1986005 - RNA, 20 nt, Human
aaacucuuuaacuuguaaua

SEQ ID NO: 1986006 - RNA, 21 nt, Human
aaaccguguuugucucuucug

SEQ ID NO: 1986007 - RNA, 19 nt, Human
aaacugauuuuuuuuuccu

SEQ ID NO: 1986008 - RNA, 13 nt, Human
aaacugauuuuuu

SEQ ID NO: 1986009 - RNA, 23 nt, Human
aaacucuuuaacuuguaauaaac

SEQ ID NO: 1986010 - RNA, 20 nt, Human
aaacugauuuuuuuuuccuu

SEQ ID NO: 1986011 - RNA, 18 nt, Human
aaagaacuaucuucaucu

SEQ ID NO: 1986012 - RNA, 20 nt, Human
aaagaacuaucuucaucuga

SEQ ID NO: 1986013 - RNA, 22 nt, Human
aaagaacuaucuucaucugaga

SEQ ID NO: 1986014 - RNA, 19 nt, Human
aaagaagaaauaguucugu

SEQ ID NO: 1986015 - RNA, 20 nt, Human
aaagaacgcugauuuaaaga

SEQ ID NO: 1986016 - RNA, 16 nt, Human
aaagaacuaucuucau

SEQ ID NO: 1986017 - RNA, 15 nt, Human
aaagaacgcugauuu

SEQ ID NO: 1986018 - RNA, 18 nt, Human
aaagaacgcugauuuaaa

SEQ ID NO: 1986019 - RNA, 18 nt, Human
aaagaaccuaacauuuau

SEQ ID NO: 1986020 - RNA, 12 nt, Human
aaagaaacaugg

SEQ ID NO: 1986021 - RNA, 15 nt, Human
aaaauaaaaaacacu

SEQ ID NO: 1986022 - RNA, 21 nt, Human
aaaauaaaaaaaagaaaaaag

SEQ ID NO: 1986023 - RNA, 15 nt, Human
aaaauaaaaaaaaga

SEQ ID NO: 1986024 - RNA, 16 nt, Human
aaaauaaaaaaaagaa

SEQ ID NO: 1986025 - RNA, 17 nt, Human
aaaauaaaaaaaagaaa

SEQ ID NO: 1986026 - RNA, 18 nt, Human
aaaauaaaaaaaagaaaa

SEQ ID NO: 1986027 - RNA, 14 nt, Human
aaaaucaaauaaua

SEQ ID NO: 1986028 - RNA, 17 nt, Human
aaaauauuuuuuuuucu

SEQ ID NO: 1986029 - RNA, 15 nt, Human
aaaaucaaguauuau

SEQ ID NO: 1986030 - RNA, 16 nt, Human
aaaaucaaguauuaua

SEQ ID NO: 1986031 - RNA, 21 nt, Human
aaaauccacuuuaucuugaau

SEQ ID NO: 1986032 - RNA, 14 nt, Human
aaaauccaaauauu

SEQ ID NO: 1986033 - RNA, 16 nt, Human
aaaauccaaauauugu

SEQ ID NO: 1986034 - RNA, 19 nt, Human
aaaauccaaauauuguuaa

SEQ ID NO: 1986035 - RNA, 18 nt, Human
aaaaucaauaugcagaau

SEQ ID NO: 1986036 - RNA, 12 nt, Human
aaaauuaagaaa

SEQ ID NO: 1986037 - RNA, 22 nt, Human
aaaauuaacaugaauauuuagu

SEQ ID NO: 1986038 - RNA, 22 nt, Human
aaaauccaaauauuguuaaggg

SEQ ID NO: 1986039 - RNA, 12 nt, Human
aaaauccagaaa

SEQ ID NO: 1986040 - RNA, 21 nt, Human
aaaauccagaaacuuguucuu

SEQ ID NO: 1986041 - RNA, 22 nt, Human
aaaauccagaaacuuguucuuc

SEQ ID NO: 1986042 - RNA, 23 nt, Human
aaaauuaaucugggccagaauuu

SEQ ID NO: 1986043 - RNA, 17 nt, Human
aaaauuaagguguuuga

SEQ ID NO: 1986044 - RNA, 18 nt, Human
aaaauuaagguguuugaa

SEQ ID NO: 1986045 - RNA, 20 nt, Human
aaaauuaagaaaggauaaag

SEQ ID NO: 1986046 - RNA, 13 nt, Human
aaaauuaagaaag

SEQ ID NO: 1986047 - RNA, 15 nt, Human
aaaauuagccaagug

SEQ ID NO: 1986048 - RNA, 20 nt, Human
aaaauuaagguguuugaaaa

SEQ ID NO: 1986049 - RNA, 19 nt, Human
aaaauuaggauuucaugau

SEQ ID NO: 1986050 - RNA, 23 nt, Human
aaaauuauguuugccacuuugca

SEQ ID NO: 1986051 - RNA, 19 nt, Human
aaaauuauugauugcuuuu

SEQ ID NO: 1986052 - RNA, 17 nt, Human
aaaauuagccuaagaua

SEQ ID NO: 1986053 - RNA, 17 nt, Human
aaaauuccagaaugaag

SEQ ID NO: 1986054 - RNA, 17 nt, Human
aaacagcuaaugggaca

SEQ ID NO: 1986055 - RNA, 13 nt, Human
aggaccugcaaac

SEQ ID NO: 1986056 - RNA, 12 nt, Human
aggaccugcccg

SEQ ID NO: 1986057 - RNA, 20 nt, Human
aggagacuguggagacugcu

SEQ ID NO: 1986058 - RNA, 21 nt, Human
aggagacuguggagacugcuc

SEQ ID NO: 1986059 - RNA, 15 nt, Human
aggagaggagagggg

SEQ ID NO: 1986060 - RNA, 21 nt, Human
aggacccggaggggccuggca

SEQ ID NO: 1986061 - RNA, 22 nt, Human
aggacccggaggggccuggcag

SEQ ID NO: 1986062 - RNA, 13 nt, Human
aggacccugccag

SEQ ID NO: 1986063 - RNA, 14 nt, Human
aggacccugccagg

SEQ ID NO: 1986064 - RNA, 15 nt, Human
aggacccugccaggc

SEQ ID NO: 1986065 - RNA, 16 nt, Human
aggacccugccaggca

SEQ ID NO: 1986066 - RNA, 12 nt, Human
aggaccagggcu

SEQ ID NO: 1986067 - RNA, 22 nt, Human
aggaccaggguuggcaccuucc

SEQ ID NO: 1986068 - RNA, 18 nt, Human
aggacccggaggggccug

SEQ ID NO: 1986069 - RNA, 20 nt, Human
aggacccggaggggccuggc

SEQ ID NO: 1986070 - RNA, 22 nt, Human
aggaauauuauauuuggaugca

SEQ ID NO: 1986071 - RNA, 19 nt, Human
aggaauauagauuaaauca

SEQ ID NO: 1986072 - RNA, 18 nt, Human
aggaauaugggagaaaua

SEQ ID NO: 1986073 - RNA, 14 nt, Human
aggaauauuauauu

SEQ ID NO: 1986074 - RNA, 17 nt, Human
aggaauauuauauuugg

SEQ ID NO: 1986075 - RNA, 19 nt, Human
aggaauauuauauuuggau

SEQ ID NO: 1986076 - RNA, 20 nt, Human
aggaauauuauauuuggaug

SEQ ID NO: 1986077 - RNA, 19 nt, Human
aggaacaaggcaaggcugu

SEQ ID NO: 1986078 - RNA, 17 nt, Human
aggaacaaggcaaggcu

SEQ ID NO: 1986079 - RNA, 16 nt, Human
aggaacaaggcaaggc

SEQ ID NO: 1986080 - RNA, 13 nt, Human
aggaacaaggcaa

SEQ ID NO: 1986081 - RNA, 12 nt, Human
aggaacaaggca

SEQ ID NO: 1986082 - RNA, 14 nt, Human
aggaaauuugcagc

SEQ ID NO: 1986083 - RNA, 13 nt, Human
aggaacaaaucuu

SEQ ID NO: 1986084 - RNA, 15 nt, Human
agcuuuuaugugaaa

SEQ ID NO: 1986085 - RNA, 16 nt, Human
agcuuuuacucccuga

SEQ ID NO: 1986086 - RNA, 13 nt, Human
aggaaccaaagcg

SEQ ID NO: 1986087 - RNA, 15 nt, Human
aggaaccaaagcgaa

SEQ ID NO: 1986088 - RNA, 16 nt, Human
aggaaccauaaucaau

SEQ ID NO: 1986089 - RNA, 23 nt, Human
aggaacaaggcaaggcugucaau

SEQ ID NO: 1986090 - RNA, 14 nt, Human
aggaacaaaucuuc

SEQ ID NO: 1986091 - RNA, 15 nt, Human
aggaacaaaucuucc

SEQ ID NO: 1986092 - RNA, 16 nt, Human
aggaacaaaucuuccu

SEQ ID NO: 1986093 - RNA, 17 nt, Human
aggaacaaaucuuccug

SEQ ID NO: 1986094 - RNA, 20 nt, Human
aggaacaaggcaaggcuguc

SEQ ID NO: 1986095 - RNA, 22 nt, Human
aggaacugcugggcuuggcagc

SEQ ID NO: 1986096 - RNA, 21 nt, Human
aggaacuuaaauaaugugaaa

SEQ ID NO: 1986097 - RNA, 23 nt, Human
aggaaccauaguugacaguucca

SEQ ID NO: 1986098 - RNA, 18 nt, Human
aggaauaccugucccccu

SEQ ID NO: 1986099 - RNA, 15 nt, Human
aggaauaccuguccc

SEQ ID NO: 1986100 - RNA, 22 nt, Human
aggaauaccugucccccugaca

SEQ ID NO: 1986101 - RNA, 20 nt, Human
aggaauaaauugcuccuuga

SEQ ID NO: 1986102 - RNA, 19 nt, Human
aggaauaaauugcuccuug

SEQ ID NO: 1986103 - RNA, 23 nt, Human
aggaagugauuuuugagcccuug

SEQ ID NO: 1986104 - RNA, 15 nt, Human
aggaaggcugagagg

SEQ ID NO: 1986105 - RNA, 22 nt, Human
aggaaggcugagaggagagaga

SEQ ID NO: 1986106 - RNA, 15 nt, Human
aggaaggcuuugaaa

SEQ ID NO: 1986107 - RNA, 20 nt, Human
aggaaggcugucucagauaa

SEQ ID NO: 1986108 - RNA, 15 nt, Human
aggaaggcugucuca

SEQ ID NO: 1986109 - RNA, 16 nt, Human
aggaaguagcacaggc

SEQ ID NO: 1986110 - RNA, 18 nt, Human
aggaaguagcacaggcug

SEQ ID NO: 1986111 - RNA, 19 nt, Human
aggaaguagcacaggcuga

SEQ ID NO: 1986112 - RNA, 23 nt, Human
aggaaguccuuaucuagcugcau

SEQ ID NO: 1986113 - RNA, 15 nt, Human
aggaaguagcacagg

SEQ ID NO: 1986114 - RNA, 14 nt, Human
aggaagguaaaaag

SEQ ID NO: 1986115 - RNA, 23 nt, Human
agcuuuguuuguugucagcugaa

SEQ ID NO: 1986116 - RNA, 16 nt, Human
agcuuuuaaacccuau

SEQ ID NO: 1986117 - RNA, 19 nt, Human
agcuucauuuccugugucu

SEQ ID NO: 1986118 - RNA, 17 nt, Human
agcuuccaauuuuccuu

SEQ ID NO: 1986119 - RNA, 21 nt, Human
agcuucaccccaaucccagcu

SEQ ID NO: 1986120 - RNA, 18 nt, Human
agcuucauuuccuguguc

SEQ ID NO: 1986121 - RNA, 20 nt, Human
agcuucaccccaaucccagc

SEQ ID NO: 1986122 - RNA, 18 nt, Human
agcuucaccccaauccca

SEQ ID NO: 1986123 - RNA, 18 nt, Human
agcuucacuguaaaauaa

SEQ ID NO: 1986124 - RNA, 20 nt, Human
agcuuauuuuggagagauag

SEQ ID NO: 1986125 - RNA, 14 nt, Human
agcuuauuuuuaca

SEQ ID NO: 1986126 - RNA, 22 nt, Human
agcuuauuuuuacaguuauaga

SEQ ID NO: 1986127 - RNA, 15 nt, Human
agcuguaacaguucu

SEQ ID NO: 1986128 - RNA, 16 nt, Human
agcuguaacaguucuu

SEQ ID NO: 1986129 - RNA, 17 nt, Human
agcuguaacaguucuuu

SEQ ID NO: 1986130 - RNA, 22 nt, Human
agcugguuuuuagcggagacgg

SEQ ID NO: 1986131 - RNA, 18 nt, Human
agcuggucccacucaguc

SEQ ID NO: 1986132 - RNA, 19 nt, Human
agcuggucccacucagucc

SEQ ID NO: 1986133 - RNA, 13 nt, Human
agcugcugacagu

SEQ ID NO: 1986134 - RNA, 14 nt, Human
agcugcugacagug

SEQ ID NO: 1986135 - RNA, 16 nt, Human
agcuggucccacucag

SEQ ID NO: 1986136 - RNA, 17 nt, Human
agcuggucccacucagu

SEQ ID NO: 1986137 - RNA, 15 nt, Human
agcugcgggcugggu

SEQ ID NO: 1986138 - RNA, 12 nt, Human
agcugcugacag

SEQ ID NO: 1986139 - RNA, 19 nt, Human
agcugcgguccacccagga

SEQ ID NO: 1986140 - RNA, 20 nt, Human
agcugcgguccacccaggag

SEQ ID NO: 1986141 - RNA, 13 nt, Human
agcugcgguccac

SEQ ID NO: 1986142 - RNA, 16 nt, Human
agcugcgguccaccca

SEQ ID NO: 1986143 - RNA, 17 nt, Human
agcugcgguccacccag

SEQ ID NO: 1986144 - RNA, 18 nt, Human
agcugcgguccacccagg

SEQ ID NO: 1986145 - RNA, 15 nt, Human
agcugagccuucuga

SEQ ID NO: 1986146 - RNA, 15 nt, Human
agcugaaccugggua

SEQ ID NO: 1986147 - RNA, 13 nt, Human
agcugaagagcug

SEQ ID NO: 1986148 - RNA, 15 nt, Human
agcugaagagcuggg

SEQ ID NO: 1986149 - RNA, 17 nt, Human
agcugaacacauuucuu

SEQ ID NO: 1986150 - RNA, 19 nt, Human
agcugaacacauuucuuuu

SEQ ID NO: 1986151 - RNA, 22 nt, Human
agcugaacagaugaccccugcc

SEQ ID NO: 1986152 - RNA, 14 nt, Human
agcugaacacauuu

SEQ ID NO: 1986153 - RNA, 16 nt, Human
agcugaacacauuucu

SEQ ID NO: 1986154 - RNA, 14 nt, Human
agcucagagagggu

SEQ ID NO: 1986155 - RNA, 18 nt, Human
agcucagagaggguggga

SEQ ID NO: 1986156 - RNA, 12 nt, Human
agcucagagagg

SEQ ID NO: 1986157 - RNA, 15 nt, Human
agcucagaaccacag

SEQ ID NO: 1986158 - RNA, 19 nt, Human
agcucaccucucccuugga

SEQ ID NO: 1986159 - RNA, 18 nt, Human
agcucaccucucccuugg

SEQ ID NO: 1986160 - RNA, 15 nt, Human
agcucaccucucccu

SEQ ID NO: 1986161 - RNA, 12 nt, Human
agcucaccucuc

SEQ ID NO: 1986162 - RNA, 19 nt, Human
agcucaccagccccagugc

SEQ ID NO: 1986163 - RNA, 20 nt, Human
agcucaccagccccagugcc

SEQ ID NO: 1986164 - RNA, 19 nt, Human
agcuaauucuuugaccugu

SEQ ID NO: 1986165 - RNA, 16 nt, Human
agcucaccagccccag

SEQ ID NO: 1986166 - RNA, 14 nt, Human
agcguuuugcaagg

SEQ ID NO: 1986167 - RNA, 22 nt, Human
agcguuuugcaagguaaaauuu

SEQ ID NO: 1986168 - RNA, 13 nt, Human
agcguuuugcaag

SEQ ID NO: 1986169 - RNA, 18 nt, Human
agcuaauaacaugugaaa

SEQ ID NO: 1986170 - RNA, 21 nt, Human
agcuaaucagcauucucacuc

SEQ ID NO: 1986171 - RNA, 16 nt, Human
agcuaaucagcauucu

SEQ ID NO: 1986172 - RNA, 15 nt, Human
agccuuuguugaacu

SEQ ID NO: 1986173 - RNA, 19 nt, Human
agccuuuguugaacuguua

SEQ ID NO: 1986174 - RNA, 21 nt, Human
agccuuuguugaacuguuaga

SEQ ID NO: 1986175 - RNA, 23 nt, Human
agccuuuguugaacuguuagaau

SEQ ID NO: 1986176 - RNA, 17 nt, Human
agccuuuucacccuucu

SEQ ID NO: 1986177 - RNA, 15 nt, Human
agccuuuggaaacag

SEQ ID NO: 1986178 - RNA, 17 nt, Human
agcgacagugagacucu

SEQ ID NO: 1986179 - RNA, 17 nt, Human
agcgacccauucagaga

SEQ ID NO: 1986180 - RNA, 13 nt, Human
agcgagcccuggu

SEQ ID NO: 1986181 - RNA, 19 nt, Human
agcgagcccugguggcagu

SEQ ID NO: 1986182 - RNA, 22 nt, Human
agcgagggccccagcgugaagc

SEQ ID NO: 1986183 - RNA, 20 nt, Human
agccugggaggucaaggcug

SEQ ID NO: 1986184 - RNA, 12 nt, Human
agccugggaggu

SEQ ID NO: 1986185 - RNA, 16 nt, Human
agccccaucuagggga

SEQ ID NO: 1986186 - RNA, 22 nt, Human
agcccucccugccccucccuuc

SEQ ID NO: 1986187 - RNA, 23 nt, Human
agcccucccugccccucccuuca

SEQ ID NO: 1986188 - RNA, 15 nt, Human
agcccucccugcccc

SEQ ID NO: 1986189 - RNA, 16 nt, Human
agcccucccugccccu

SEQ ID NO: 1986190 - RNA, 17 nt, Human
agcccucccugccccuc

SEQ ID NO: 1986191 - RNA, 19 nt, Human
agcccucccugccccuccc

SEQ ID NO: 1986192 - RNA, 17 nt, Human
agccuggcuucaaauug

SEQ ID NO: 1986193 - RNA, 18 nt, Human
agccuggcuucaaauugu

SEQ ID NO: 1986194 - RNA, 20 nt, Human
agggucucacuauguugccc

SEQ ID NO: 1986195 - RNA, 21 nt, Human
aggucguuuuaaaaacaaaaa

SEQ ID NO: 1986196 - RNA, 14 nt, Human
aggucuauuuggau

SEQ ID NO: 1986197 - RNA, 22 nt, Human
aggucuauuuggauuauucuuu

SEQ ID NO: 1986198 - RNA, 23 nt, Human
aggucccuaauaaagcugugugg

SEQ ID NO: 1986199 - RNA, 19 nt, Human
aggucccuuucauuugcua

SEQ ID NO: 1986200 - RNA, 14 nt, Human
agguacucuccugg

SEQ ID NO: 1986201 - RNA, 13 nt, Human
agguacucuccug

SEQ ID NO: 1986202 - RNA, 16 nt, Human
agguaacaggcagaua

SEQ ID NO: 1986203 - RNA, 22 nt, Human
agguacgaaaagaggggaagag

SEQ ID NO: 1986204 - RNA, 13 nt, Human
agguaacaggcag

SEQ ID NO: 1986205 - RNA, 14 nt, Human
agguaacaggcaga

SEQ ID NO: 1986206 - RNA, 22 nt, Human
aggguuuugccauguuggccag

SEQ ID NO: 1986207 - RNA, 23 nt, Human
aggguuuugccauguuggccagg

SEQ ID NO: 1986208 - RNA, 22 nt, Human
agggauacgagcggaguccccu

SEQ ID NO: 1986209 - RNA, 16 nt, Human
agggauacccauccca

SEQ ID NO: 1986210 - RNA, 16 nt, Human
agggaugguguucaaa

SEQ ID NO: 1986211 - RNA, 13 nt, Human
agggccuggccug

SEQ ID NO: 1986212 - RNA, 12 nt, Human
agggccuggccu

SEQ ID NO: 1986213 - RNA, 15 nt, Human
agggccugcaaggga

SEQ ID NO: 1986214 - RNA, 14 nt, Human
agggccugcaaggg

SEQ ID NO: 1986215 - RNA, 12 nt, Human
aggggcaggagg

SEQ ID NO: 1986216 - RNA, 13 nt, Human
aggggcaggagga

SEQ ID NO: 1986217 - RNA, 18 nt, Human
aggggcaggaggaagggg

SEQ ID NO: 1986218 - RNA, 14 nt, Human
agggccuggccuga

SEQ ID NO: 1986219 - RNA, 13 nt, Human
agggccuggccca

SEQ ID NO: 1986220 - RNA, 14 nt, Human
agggccuggcccau

SEQ ID NO: 1986221 - RNA, 16 nt, Human
agggccuggcccaugu

SEQ ID NO: 1986222 - RNA, 22 nt, Human
aggggcccaaauucuuucagug

SEQ ID NO: 1986223 - RNA, 22 nt, Human
agggucccugguggcagcucac

SEQ ID NO: 1986224 - RNA, 20 nt, Human
agggucccugguggcagcuc

SEQ ID NO: 1986225 - RNA, 17 nt, Human
agggucccugguggcag

SEQ ID NO: 1986226 - RNA, 16 nt, Human
agggucccugguggca

SEQ ID NO: 1986227 - RNA, 13 nt, Human
aggguauuccaga

SEQ ID NO: 1986228 - RNA, 21 nt, Human
aggguaucuggugacuuuccu

SEQ ID NO: 1986229 - RNA, 13 nt, Human
aggggccuggcag

SEQ ID NO: 1986230 - RNA, 12 nt, Human
aggggccuggca

SEQ ID NO: 1986231 - RNA, 14 nt, Human
agggucccuggugg

SEQ ID NO: 1986232 - RNA, 12 nt, Human
agggucccuggu

SEQ ID NO: 1986233 - RNA, 19 nt, Human
agggucacuggggcccaag

SEQ ID NO: 1986234 - RNA, 18 nt, Human
aggcuggguucugauccu

SEQ ID NO: 1986235 - RNA, 23 nt, Human
aggcuaauguuggcagaugcagc

SEQ ID NO: 1986236 - RNA, 19 nt, Human
aggcuaauguuggcagaug

SEQ ID NO: 1986237 - RNA, 22 nt, Human
aggcuaauguuggcagaugcag

SEQ ID NO: 1986238 - RNA, 15 nt, Human
aggcuaccuuuguau

SEQ ID NO: 1986239 - RNA, 13 nt, Human
aggcuaccuuugu

SEQ ID NO: 1986240 - RNA, 14 nt, Human
aggcuaccuuugua

SEQ ID NO: 1986241 - RNA, 15 nt, Human
agggacugaggggag

SEQ ID NO: 1986242 - RNA, 23 nt, Human
agggacugccagucccccugccc

SEQ ID NO: 1986243 - RNA, 15 nt, Human
agggacccuccacca

SEQ ID NO: 1986244 - RNA, 18 nt, Human
aggcuuagucacugagac

SEQ ID NO: 1986245 - RNA, 23 nt, Human
aggcuggucucgaacuccugacc

SEQ ID NO: 1986246 - RNA, 20 nt, Human
aggcuguaucccaugagccu

SEQ ID NO: 1986247 - RNA, 21 nt, Human
aggcuguaucccaugagccuc

SEQ ID NO: 1986248 - RNA, 17 nt, Human
aggcuuagucacugaga

SEQ ID NO: 1986249 - RNA, 22 nt, Human
aggcuguaucccaugagccuca

SEQ ID NO: 1986250 - RNA, 16 nt, Human
aggagaggauggccca

SEQ ID NO: 1986251 - RNA, 14 nt, Human
aggcagagcccaga

SEQ ID NO: 1986252 - RNA, 15 nt, Human
aggcaugguggccca

SEQ ID NO: 1986253 - RNA, 15 nt, Human
aggcaugggccacca

SEQ ID NO: 1986254 - RNA, 17 nt, Human
aggcaugggccaccacg

SEQ ID NO: 1986255 - RNA, 17 nt, Human
aggcaugugaugagagg

SEQ ID NO: 1986256 - RNA, 16 nt, Human
aggcaugggcuugcug

SEQ ID NO: 1986257 - RNA, 22 nt, Human
aggcaugucccaugugagcugc

SEQ ID NO: 1986258 - RNA, 19 nt, Human
aggcauggaugaauaaaug

SEQ ID NO: 1986259 - RNA, 18 nt, Human
aggcagcacgugcacaaa

SEQ ID NO: 1986260 - RNA, 20 nt, Human
aggcaugugaugagaggaaa

SEQ ID NO: 1986261 - RNA, 19 nt, Human
aggcaugugaugagaggaa

SEQ ID NO: 1986262 - RNA, 21 nt, Human
aggcaugugaugagaggaaau

SEQ ID NO: 1986263 - RNA, 17 nt, Human
aggcauguucucugagg

SEQ ID NO: 1986264 - RNA, 17 nt, Human
aggcauuccccaggagg

SEQ ID NO: 1986265 - RNA, 18 nt, Human
aggcauuccccaggaggc

SEQ ID NO: 1986266 - RNA, 18 nt, Human
aggcauguucucugagga

SEQ ID NO: 1986267 - RNA, 19 nt, Human
aggcauguucucugaggac

SEQ ID NO: 1986268 - RNA, 19 nt, Human
aggcccuucucuccagccc

SEQ ID NO: 1986269 - RNA, 15 nt, Human
aggcccuucucucca

SEQ ID NO: 1986270 - RNA, 12 nt, Human
aggcccuucucu

SEQ ID NO: 1986271 - RNA, 22 nt, Human
aggcccuuccucuccacugccu

SEQ ID NO: 1986272 - RNA, 12 nt, Human
aggcccugccca

SEQ ID NO: 1986273 - RNA, 23 nt, Human
aggcccucugcccacucccugca

SEQ ID NO: 1986274 - RNA, 22 nt, Human
aggcccucugcccacucccugc

SEQ ID NO: 1986275 - RNA, 21 nt, Human
aggcccucugcccacucccug

SEQ ID NO: 1986276 - RNA, 14 nt, Human
aggccaggcccucu

SEQ ID NO: 1986277 - RNA, 13 nt, Human
aggccaggcccuc

SEQ ID NO: 1986278 - RNA, 23 nt, Human
aggccagcugcuugggcuucauc

SEQ ID NO: 1986279 - RNA, 20 nt, Human
aggcauuccccaggaggcca

SEQ ID NO: 1986280 - RNA, 19 nt, Human
aggcauuccccaggaggcc

SEQ ID NO: 1986281 - RNA, 14 nt, Human
aggccaucuggaga

SEQ ID NO: 1986282 - RNA, 15 nt, Human
aggccaucuggagag

SEQ ID NO: 1986283 - RNA, 16 nt, Human
aggccaucuggagagc

SEQ ID NO: 1986284 - RNA, 20 nt, Human
aggccaucuggagagcccag

SEQ ID NO: 1986285 - RNA, 21 nt, Human
aggccaucuggagagcccaga

SEQ ID NO: 1986286 - RNA, 16 nt, Human
aggccauggaggcagu

SEQ ID NO: 1986287 - RNA, 20 nt, Human
aggccauggaggcaguagga

SEQ ID NO: 1986288 - RNA, 15 nt, Human
aggccaggccagcug

SEQ ID NO: 1986289 - RNA, 13 nt, Human
aggccaggccagc

SEQ ID NO: 1986290 - RNA, 15 nt, Human
aggccaggcccucug

SEQ ID NO: 1986291 - RNA, 10 nt, Human
aggccaucug

SEQ ID NO: 1986292 - RNA, 11 nt, Human
aggccaucugg

SEQ ID NO: 1986293 - RNA, 23 nt, Human
agccccauccucuguacagagcc

SEQ ID NO: 1986294 - RNA, 17 nt, Human
agccccauccucuguac

SEQ ID NO: 1986295 - RNA, 15 nt, Human
agccccauccucugu

SEQ ID NO: 1986296 - RNA, 17 nt, Human
agccccauucugccugc

SEQ ID NO: 1986297 - RNA, 18 nt, Human
agccccauucugccugcc

SEQ ID NO: 1986298 - RNA, 19 nt, Human
agccccauucugccugccc

SEQ ID NO: 1986299 - RNA, 21 nt, Human
agcccgggcucugccucccau

SEQ ID NO: 1986300 - RNA, 20 nt, Human
agcccgggcucugccuccca

SEQ ID NO: 1986301 - RNA, 18 nt, Human
agcccgggcucugccucc

SEQ ID NO: 1986302 - RNA, 17 nt, Human
agcccgggcucugccuc

SEQ ID NO: 1986303 - RNA, 12 nt, Human
agcccucccugc

SEQ ID NO: 1986304 - RNA, 13 nt, Human
agcccucccugcc

SEQ ID NO: 1986305 - RNA, 21 nt, Human
agcccuccaucuaaacugccc

SEQ ID NO: 1986306 - RNA, 23 nt, Human
agcccuccaucuaaacugccccc

SEQ ID NO: 1986307 - RNA, 21 nt, Human
agccccaaauugucaccugcu

SEQ ID NO: 1986308 - RNA, 13 nt, Human
agcauccuggcac

SEQ ID NO: 1986309 - RNA, 17 nt, Human
agcagcuuuagcaaaga

SEQ ID NO: 1986310 - RNA, 16 nt, Human
agccagcaggcucuca

SEQ ID NO: 1986311 - RNA, 15 nt, Human
agcccaccccucaac

SEQ ID NO: 1986312 - RNA, 16 nt, Human
agcccaccuuggcuca

SEQ ID NO: 1986313 - RNA, 14 nt, Human
agcccaccuuggcu

SEQ ID NO: 1986314 - RNA, 15 nt, Human
agcccacgcccccac

SEQ ID NO: 1986315 - RNA, 20 nt, Human
agcccacgcccccacuggug

SEQ ID NO: 1986316 - RNA, 14 nt, Human
agcccacgccccca

SEQ ID NO: 1986317 - RNA, 23 nt, Human
agcccacgcccccacuggugaca

SEQ ID NO: 1986318 - RNA, 20 nt, Human
agcccacgcugacuacaggg

SEQ ID NO: 1986319 - RNA, 21 nt, Human
agcccacgcugacuacagggc

SEQ ID NO: 1986320 - RNA, 22 nt, Human
agcccacgcugacuacagggcc

SEQ ID NO: 1986321 - RNA, 23 nt, Human
agcccacgcugacuacagggccg

SEQ ID NO: 1986322 - RNA, 18 nt, Human
agccagaggagagaggac

SEQ ID NO: 1986323 - RNA, 17 nt, Human
agccagaggagagagga

SEQ ID NO: 1986324 - RNA, 14 nt, Human
agccagcaggcucu

SEQ ID NO: 1986325 - RNA, 15 nt, Human
agccagaggagagag

SEQ ID NO: 1986326 - RNA, 13 nt, Human
agccagaggagag

SEQ ID NO: 1986327 - RNA, 20 nt, Human
agccaaggccaaaggaagca

SEQ ID NO: 1986328 - RNA, 16 nt, Human
agccaaagcuaggccu

SEQ ID NO: 1986329 - RNA, 18 nt, Human
agccaaagcuaggccugg

SEQ ID NO: 1986330 - RNA, 14 nt, Human
agcauccuggcacc

SEQ ID NO: 1986331 - RNA, 17 nt, Human
agcauccuggcacccgg

SEQ ID NO: 1986332 - RNA, 18 nt, Human
agcauccuggcacccggc

SEQ ID NO: 1986333 - RNA, 15 nt, Human
agcacuucaggaggc

SEQ ID NO: 1986334 - RNA, 19 nt, Human
agcacuucagggcagauuu

SEQ ID NO: 1986335 - RNA, 16 nt, Human
agcacuuccuugccag

SEQ ID NO: 1986336 - RNA, 18 nt, Human
agcacuuccuugccaguc

SEQ ID NO: 1986337 - RNA, 19 nt, Human
agcacuuccuugccagucu

SEQ ID NO: 1986338 - RNA, 20 nt, Human
agcacuuccuugccagucuu

SEQ ID NO: 1986339 - RNA, 17 nt, Human
agcacuucuaaguugag

SEQ ID NO: 1986340 - RNA, 20 nt, Human
agcacuucuaaguugaguau

SEQ ID NO: 1986341 - RNA, 16 nt, Human
agcacagacccugccc

SEQ ID NO: 1986342 - RNA, 17 nt, Human
agcacgauuucuguuua

SEQ ID NO: 1986343 - RNA, 19 nt, Human
agcacgauuucuguuuaga

SEQ ID NO: 1986344 - RNA, 21 nt, Human
agcacgauuucuguuuagaua

SEQ ID NO: 1986345 - RNA, 23 nt, Human
agcaauggugucaguauccaggc

SEQ ID NO: 1986346 - RNA, 22 nt, Human
agcacaaccuucaagcugcuuu

SEQ ID NO: 1986347 - RNA, 18 nt, Human
agcacaaccuucaagcug

SEQ ID NO: 1986348 - RNA, 20 nt, Human
agcacaaccuucaagcugcu

SEQ ID NO: 1986349 - RNA, 18 nt, Human
agcacaacccccagcucc

SEQ ID NO: 1986350 - RNA, 19 nt, Human
agcacaacccccagcuccc

SEQ ID NO: 1986351 - RNA, 22 nt, Human
agcacaacccccagcucccgcu

SEQ ID NO: 1986352 - RNA, 14 nt, Human
agcacaacccccag

SEQ ID NO: 1986353 - RNA, 12 nt, Human
agcacagacccu

SEQ ID NO: 1986354 - RNA, 15 nt, Human
agcacagacccugcc

SEQ ID NO: 1986355 - RNA, 14 nt, Human
agcacagacccugc

SEQ ID NO: 1986356 - RNA, 21 nt, Human
agagugcaagccccugcucca

SEQ ID NO: 1986357 - RNA, 20 nt, Human
agagugccaacuucuuucau

SEQ ID NO: 1986358 - RNA, 14 nt, Human
agaguggccccacc

SEQ ID NO: 1986359 - RNA, 21 nt, Human
agaguggccccaccuggcccu

SEQ ID NO: 1986360 - RNA, 15 nt, Human
agaguggccccaccu

SEQ ID NO: 1986361 - RNA, 19 nt, Human
agaguggccccaccuggcc

SEQ ID NO: 1986362 - RNA, 22 nt, Human
agauguagcaaacccugucaaa

SEQ ID NO: 1986363 - RNA, 23 nt, Human
agauguagcaaacccugucaaac

SEQ ID NO: 1986364 - RNA, 16 nt, Human
agauguagaggagaaa

SEQ ID NO: 1986365 - RNA, 19 nt, Human
agauguagaggagaaacug

SEQ ID NO: 1986366 - RNA, 15 nt, Human
agauguagauuuauu

SEQ ID NO: 1986367 - RNA, 18 nt, Human
agauguagauuuauuuca

SEQ ID NO: 1986368 - RNA, 21 nt, Human
agauguagcaaacccugucaa

SEQ ID NO: 1986369 - RNA, 23 nt, Human
agaugaugaaaauauuuaaaggc

SEQ ID NO: 1986370 - RNA, 19 nt, Human
agauggucauauuuaaaca

SEQ ID NO: 1986371 - RNA, 22 nt, Human
agauggucauauuuaaacagaa

SEQ ID NO: 1986372 - RNA, 18 nt, Human
agaugaugaaaauauuua

SEQ ID NO: 1986373 - RNA, 14 nt, Human
agaugagugagcau

SEQ ID NO: 1986374 - RNA, 22 nt, Human
agcaaagcggguuauaaugaau

SEQ ID NO: 1986375 - RNA, 15 nt, Human
agcaaauggccucau

SEQ ID NO: 1986376 - RNA, 20 nt, Human
agcaaauggccucaugucaa

SEQ ID NO: 1986377 - RNA, 20 nt, Human
agcaaaggagauuggaagga

SEQ ID NO: 1986378 - RNA, 20 nt, Human
agcaaagcggguuauaauga

SEQ ID NO: 1986379 - RNA, 17 nt, Human
agcaaaugucuuccugg

SEQ ID NO: 1986380 - RNA, 20 nt, Human
agcaaaugucuuccuggauu

SEQ ID NO: 1986381 - RNA, 16 nt, Human
agcaaauguggcuccu

SEQ ID NO: 1986382 - RNA, 11 nt, Human
agauucuuuua

SEQ ID NO: 1986383 - RNA, 20 nt, Human
agauugaaccugaauauugc

SEQ ID NO: 1986384 - RNA, 21 nt, Human
agauucuuuccugaggcuggg

SEQ ID NO: 1986385 - RNA, 19 nt, Human
agauucuuuccugaggcug

SEQ ID NO: 1986386 - RNA, 23 nt, Human
agauugcaacaggcugggcuuca

SEQ ID NO: 1986387 - RNA, 20 nt, Human
agauugcaacaggcugggcu

SEQ ID NO: 1986388 - RNA, 21 nt, Human
agauugcaacaggcugggcuu

SEQ ID NO: 1986389 - RNA, 18 nt, Human
agcaaaagaugcuucuca

SEQ ID NO: 1986390 - RNA, 11 nt, Human
agcaaaaggca

SEQ ID NO: 1986391 - RNA, 13 nt, Human
agcaaaaucaaga

SEQ ID NO: 1986392 - RNA, 12 nt, Human
agcaaaaggcau

SEQ ID NO: 1986393 - RNA, 16 nt, Human
agcaaacccugucaaa

SEQ ID NO: 1986394 - RNA, 15 nt, Human
agcaaaaucaagaga

SEQ ID NO: 1986395 - RNA, 20 nt, Human
agcaaaccuaauugcacaac

SEQ ID NO: 1986396 - RNA, 17 nt, Human
agcaaacccugucaaac

SEQ ID NO: 1986397 - RNA, 20 nt, Human
agcaaacccugucaaacauu

SEQ ID NO: 1986398 - RNA, 21 nt, Human
agcaaacccugucaaacauua

SEQ ID NO: 1986399 - RNA, 19 nt, Human
agcaaaccuaauugcacaa

SEQ ID NO: 1986400 - RNA, 20 nt, Human
agacaaugacuuacuguaca

SEQ ID NO: 1986401 - RNA, 17 nt, Human
agacaaauaguaggcaa

SEQ ID NO: 1986402 - RNA, 12 nt, Human
agacaaauagua

SEQ ID NO: 1986403 - RNA, 21 nt, Human
agacaaugacuuacuguacau

SEQ ID NO: 1986404 - RNA, 22 nt, Human
agacaaugacuuacuguacaug

SEQ ID NO: 1986405 - RNA, 15 nt, Human
agacagagcuacaca

SEQ ID NO: 1986406 - RNA, 23 nt, Human
agacaaugacuuacuguacauga

SEQ ID NO: 1986407 - RNA, 13 nt, Human
agacagagcuaca

SEQ ID NO: 1986408 - RNA, 11 nt, Human
agacagagucu

SEQ ID NO: 1986409 - RNA, 19 nt, Human
agacagagucucacuguug

SEQ ID NO: 1986410 - RNA, 20 nt, Human
agacagagucucacuguugc

SEQ ID NO: 1986411 - RNA, 15 nt, Human
agaccacguuucuaa

SEQ ID NO: 1986412 - RNA, 22 nt, Human
agacagccaacuauggccugug

SEQ ID NO: 1986413 - RNA, 15 nt, Human
agacagcauuugugu

SEQ ID NO: 1986414 - RNA, 20 nt, Human
agacagcauuuguguguuac

SEQ ID NO: 1986415 - RNA, 22 nt, Human
agacagauacuccuccaagguu

SEQ ID NO: 1986416 - RNA, 21 nt, Human
agacagagucucacuguugcc

SEQ ID NO: 1986417 - RNA, 13 nt, Human
agaccagcucuuc

SEQ ID NO: 1986418 - RNA, 12 nt, Human
agaccagcucuu

SEQ ID NO: 1986419 - RNA, 17 nt, Human
agacccaaaaggcagaa

SEQ ID NO: 1986420 - RNA, 19 nt, Human
agacccaaaaggcagaagc

SEQ ID NO: 1986421 - RNA, 14 nt, Human
agaauggcauuugc

SEQ ID NO: 1986422 - RNA, 18 nt, Human
agaauggcauuugcaaua

SEQ ID NO: 1986423 - RNA, 21 nt, Human
agaauggcauuugcaauaaaa

SEQ ID NO: 1986424 - RNA, 22 nt, Human
agaaugcacaaacagaggccgc

SEQ ID NO: 1986425 - RNA, 19 nt, Human
agaaugcacaaacagaggc

SEQ ID NO: 1986426 - RNA, 21 nt, Human
agaaugaccuuguaauguaac

SEQ ID NO: 1986427 - RNA, 22 nt, Human
agaaugaccuuguaauguaacu

SEQ ID NO: 1986428 - RNA, 23 nt, Human
agaaugaccuuguaauguaacug

SEQ ID NO: 1986429 - RNA, 12 nt, Human
agaaugaacaaa

SEQ ID NO: 1986430 - RNA, 13 nt, Human
agaaugaacaaag

SEQ ID NO: 1986431 - RNA, 22 nt, Human
agaaugaacaaagaccaauuuu

SEQ ID NO: 1986432 - RNA, 18 nt, Human
agaaugaagguuuuugua

SEQ ID NO: 1986433 - RNA, 19 nt, Human
agaaugaagguuuuuguaa

SEQ ID NO: 1986434 - RNA, 20 nt, Human
agaaugaagguuuuuguaaa

SEQ ID NO: 1986435 - RNA, 22 nt, Human
agaaugaagguuuuuguaaaga

SEQ ID NO: 1986436 - RNA, 12 nt, Human
agaaugaccuug

SEQ ID NO: 1986437 - RNA, 13 nt, Human
agaaugaccuugu

SEQ ID NO: 1986438 - RNA, 14 nt, Human
agaaugaccuugua

SEQ ID NO: 1986439 - RNA, 15 nt, Human
agaaugaccuuguaa

SEQ ID NO: 1986440 - RNA, 16 nt, Human
agaaugaccuuguaau

SEQ ID NO: 1986441 - RNA, 17 nt, Human
agaaugaccuuguaaug

SEQ ID NO: 1986442 - RNA, 20 nt, Human
agaaugaccuuguaauguaa

SEQ ID NO: 1986443 - RNA, 22 nt, Human
agaagucacauuccugaacagg

SEQ ID NO: 1986444 - RNA, 21 nt, Human
agaagucuucuauuuauuuau

SEQ ID NO: 1986445 - RNA, 21 nt, Human
agaagugaaaaucuacacucc

SEQ ID NO: 1986446 - RNA, 18 nt, Human
agaaugaaagggcccaga

SEQ ID NO: 1986447 - RNA, 15 nt, Human
agaaugaaauguaug

SEQ ID NO: 1986448 - RNA, 16 nt, Human
agaaugaaauguaugu

SEQ ID NO: 1986449 - RNA, 17 nt, Human
agaaugaaauguaugug

SEQ ID NO: 1986450 - RNA, 23 nt, Human
agaagagagggugaguccuccag

SEQ ID NO: 1986451 - RNA, 13 nt, Human
agaagaguggcag

SEQ ID NO: 1986452 - RNA, 13 nt, Human
agaaggucuguuu

SEQ ID NO: 1986453 - RNA, 23 nt, Human
agaagguauuaagauuauaauug

SEQ ID NO: 1986454 - RNA, 19 nt, Human
agaaguagggguggcccga

SEQ ID NO: 1986455 - RNA, 18 nt, Human
agaaguaggggaagaaua

SEQ ID NO: 1986456 - RNA, 18 nt, Human
agaagucacauuccugaa

SEQ ID NO: 1986457 - RNA, 20 nt, Human
agaaguauacguuuuucagu

SEQ ID NO: 1986458 - RNA, 20 nt, Human
agaagucacauuccugaaca

SEQ ID NO: 1986459 - RNA, 21 nt, Human
agaagucacauuccugaacag

SEQ ID NO: 1986460 - RNA, 14 nt, Human
agaaguaacuuacu

SEQ ID NO: 1986461 - RNA, 22 nt, Human
agaaguaacuggugauauaucu

SEQ ID NO: 1986462 - RNA, 18 nt, Human
agaagguuucagaaagaa

SEQ ID NO: 1986463 - RNA, 21 nt, Human
agaagguuuacuuuuuggugu

SEQ ID NO: 1986464 - RNA, 21 nt, Human
agaagagauugugguuucauu

SEQ ID NO: 1986465 - RNA, 15 nt, Human
agaagacauuugcca

SEQ ID NO: 1986466 - RNA, 13 nt, Human
agaagacacugau

SEQ ID NO: 1986467 - RNA, 21 nt, Human
agaagacacugaugggcaacc

SEQ ID NO: 1986468 - RNA, 21 nt, Human
acuuuccucuuuggucuacac

SEQ ID NO: 1986469 - RNA, 21 nt, Human
acuuuccucuuagucgagcca

SEQ ID NO: 1986470 - RNA, 13 nt, Human
agaggaaugaagu

SEQ ID NO: 1986471 - RNA, 16 nt, Human
agagggccugcaaggg

SEQ ID NO: 1986472 - RNA, 13 nt, Human
agagggccugcaa

SEQ ID NO: 1986473 - RNA, 22 nt, Human
agaggagugcguggcccaccag

SEQ ID NO: 1986474 - RNA, 19 nt, Human
agaggggguggccucccaa

SEQ ID NO: 1986475 - RNA, 17 nt, Human
agaggggguggccuccc

SEQ ID NO: 1986476 - RNA, 16 nt, Human
agaggacaagggaaau

SEQ ID NO: 1986477 - RNA, 14 nt, Human
agaggacuuuucuu

SEQ ID NO: 1986478 - RNA, 21 nt, Human
agaggacuuuucuuuguggcu

SEQ ID NO: 1986479 - RNA, 22 nt, Human
agaggacuuuucuuuguggcuu

SEQ ID NO: 1986480 - RNA, 23 nt, Human
agaggacuuuucuuuguggcuuc

SEQ ID NO: 1986481 - RNA, 23 nt, Human
agaggagggagcaucagugcccu

SEQ ID NO: 1986482 - RNA, 15 nt, Human
agagccugagaguga

SEQ ID NO: 1986483 - RNA, 14 nt, Human
agagccguaaaaac

SEQ ID NO: 1986484 - RNA, 17 nt, Human
agagccguaaaaacuga

SEQ ID NO: 1986485 - RNA, 19 nt, Human
agagccguaaaaacugaag

SEQ ID NO: 1986486 - RNA, 15 nt, Human
agagcccuucauuug

SEQ ID NO: 1986487 - RNA, 17 nt, Human
agagaggcuaaaauguu

SEQ ID NO: 1986488 - RNA, 18 nt, Human
agagaggcuaaaauguuu

SEQ ID NO: 1986489 - RNA, 19 nt, Human
agagaggcuaaaauguuuu

SEQ ID NO: 1986490 - RNA, 13 nt, Human
agagcccaccuug

SEQ ID NO: 1986491 - RNA, 22 nt, Human
agagagggugaguccuccagaa

SEQ ID NO: 1986492 - RNA, 13 nt, Human
agagccagggucu

SEQ ID NO: 1986493 - RNA, 16 nt, Human
agacugcuuugagaaa

SEQ ID NO: 1986494 - RNA, 16 nt, Human
agagagaccacuuuuc

SEQ ID NO: 1986495 - RNA, 14 nt, Human
agagagaagagccc

SEQ ID NO: 1986496 - RNA, 16 nt, Human
agagagaagagcccca

SEQ ID NO: 1986497 - RNA, 16 nt, Human
agacgcugugcugccc

SEQ ID NO: 1986498 - RNA, 19 nt, Human
agacgcucauucagcaucu

SEQ ID NO: 1986499 - RNA, 18 nt, Human
agacucugucucaaaaaa

SEQ ID NO: 1986500 - RNA, 13 nt, Human
agacucugucuca

SEQ ID NO: 1986501 - RNA, 18 nt, Human
agacucugucucagucca

SEQ ID NO: 1986502 - RNA, 20 nt, Human
agacugaguacguugugcau

SEQ ID NO: 1986503 - RNA, 22 nt, Human
agacugaguacguugugcauuu

SEQ ID NO: 1986504 - RNA, 17 nt, Human
aguugacucugcucuug

SEQ ID NO: 1986505 - RNA, 20 nt, Human
aguucaucccuucucuucca

SEQ ID NO: 1986506 - RNA, 22 nt, Human
aguucaucccuucucuuccagg

SEQ ID NO: 1986507 - RNA, 18 nt, Human
aguugacuagaaucgaca

SEQ ID NO: 1986508 - RNA, 22 nt, Human
aguucaucuugaauuguaagga

SEQ ID NO: 1986509 - RNA, 16 nt, Human
aguugauacuacaguu

SEQ ID NO: 1986510 - RNA, 23 nt, Human
aguugaguauauuauaauagauu

SEQ ID NO: 1986511 - RNA, 18 nt, Human
aguugagcuaugacuuaa

SEQ ID NO: 1986512 - RNA, 19 nt, Human
aguugaguauauuauaaua

SEQ ID NO: 1986513 - RNA, 13 nt, Human
aguugagcuauga

SEQ ID NO: 1986514 - RNA, 15 nt, Human
aguugagcuaugacu

SEQ ID NO: 1986515 - RNA, 17 nt, Human
aguugagcuaugacuua

SEQ ID NO: 1986516 - RNA, 14 nt, Human
aguucagcuugggg

SEQ ID NO: 1986517 - RNA, 19 nt, Human
aguucagggaagauaaguu

SEQ ID NO: 1986518 - RNA, 22 nt, Human
aguucagggaagauaaguugga

SEQ ID NO: 1986519 - RNA, 13 nt, Human
aguucagcuuggg

SEQ ID NO: 1986520 - RNA, 19 nt, Human
aguucaucuugaauuguaa

SEQ ID NO: 1986521 - RNA, 15 nt, Human
aguucaucuugaauu

SEQ ID NO: 1986522 - RNA, 13 nt, Human
aguucaucuugaa

SEQ ID NO: 1986523 - RNA, 18 nt, Human
aguucagguaacaggcag

SEQ ID NO: 1986524 - RNA, 20 nt, Human
agugcuaauuuugaaaaacu

SEQ ID NO: 1986525 - RNA, 18 nt, Human
agugcuaauuuugaaaaa

SEQ ID NO: 1986526 - RNA, 21 nt, Human
aguggccuccgucacuaccug

SEQ ID NO: 1986527 - RNA, 22 nt, Human
aguggccuccgucacuaccugg

SEQ ID NO: 1986528 - RNA, 21 nt, Human
aguggccucgaacuccuggca

SEQ ID NO: 1986529 - RNA, 15 nt, Human
agugccuuauggaac

SEQ ID NO: 1986530 - RNA, 14 nt, Human
agugccuuauggaa

SEQ ID NO: 1986531 - RNA, 13 nt, Human
agugccuuaugga

SEQ ID NO: 1986532 - RNA, 10 nt, Human
agugccuuau

SEQ ID NO: 1986533 - RNA, 15 nt, Human
agugcuaauuuugaa

SEQ ID NO: 1986534 - RNA, 16 nt, Human
agugccuuauggaaca

SEQ ID NO: 1986535 - RNA, 14 nt, Human
agugauucuccugc

SEQ ID NO: 1986536 - RNA, 21 nt, Human
agugauucucaugccucagcc

SEQ ID NO: 1986537 - RNA, 18 nt, Human
agugccuuacacaauggu

SEQ ID NO: 1986538 - RNA, 15 nt, Human
agugauucuccugcc

SEQ ID NO: 1986539 - RNA, 17 nt, Human
agugauucuccugccuc

SEQ ID NO: 1986540 - RNA, 14 nt, Human
agugauccucccac

SEQ ID NO: 1986541 - RNA, 15 nt, Human
agugauccucccacc

SEQ ID NO: 1986542 - RNA, 18 nt, Human
agugauccucccaccuca

SEQ ID NO: 1986543 - RNA, 24 nt, Human
agugauccucccaccucagccucc

SEQ ID NO: 1986544 - RNA, 13 nt, Human
agugucuggcugc

SEQ ID NO: 1986545 - RNA, 14 nt, Human
agugucuggcugca

SEQ ID NO: 1986546 - RNA, 19 nt, Human
agugggacagggcauggcc

SEQ ID NO: 1986547 - RNA, 21 nt, Human
agugggacagggcauggccag

SEQ ID NO: 1986548 - RNA, 12 nt, Human
agugucuggcug

SEQ ID NO: 1986549 - RNA, 19 nt, Human
agugucaaugcagccccca

SEQ ID NO: 1986550 - RNA, 22 nt, Human
aguccucuuuucugagaggacu

SEQ ID NO: 1986551 - RNA, 20 nt, Human
aguccuuaccagcagagcac

SEQ ID NO: 1986552 - RNA, 17 nt, Human
aguccugcaaccaaacu

SEQ ID NO: 1986553 - RNA, 19 nt, Human
aguccucuuuucugagagg

SEQ ID NO: 1986554 - RNA, 19 nt, Human
agucaugcguuuaaucaca

SEQ ID NO: 1986555 - RNA, 22 nt, Human
agucaugauguuuuuaaaaucu

SEQ ID NO: 1986556 - RNA, 23 nt, Human
agucaugauguuuuuaaaaucuu

SEQ ID NO: 1986557 - RNA, 13 nt, Human
agucaugauguuu

SEQ ID NO: 1986558 - RNA, 14 nt, Human
agucaugauguuuu

SEQ ID NO: 1986559 - RNA, 17 nt, Human
agucaugauguuuuuaa

SEQ ID NO: 1986560 - RNA, 18 nt, Human
agucaugauguuuuuaaa

SEQ ID NO: 1986561 - RNA, 19 nt, Human
agucaugauguuuuuaaaa

SEQ ID NO: 1986562 - RNA, 20 nt, Human
agucaugauguuuuuaaaau

SEQ ID NO: 1986563 - RNA, 21 nt, Human
agucaugauguuuuuaaaauc

SEQ ID NO: 1986564 - RNA, 14 nt, Human
agucaugugggcca

SEQ ID NO: 1986565 - RNA, 21 nt, Human
agucaugcuccccugugccag

SEQ ID NO: 1986566 - RNA, 13 nt, Human
agucaugcucccc

SEQ ID NO: 1986567 - RNA, 14 nt, Human
agucaugcuccccu

SEQ ID NO: 1986568 - RNA, 18 nt, Human
agucaugcuccccugugc

SEQ ID NO: 1986569 - RNA, 19 nt, Human
agucaugcuccccugugcc

SEQ ID NO: 1986570 - RNA, 23 nt, Human
agucaugcuccccugugccagcc

SEQ ID NO: 1986571 - RNA, 18 nt, Human
aguccuuaucuagcugca

SEQ ID NO: 1986572 - RNA, 16 nt, Human
aguccuuaucuagcug

SEQ ID NO: 1986573 - RNA, 19 nt, Human
aguccuuaccagcagagca

SEQ ID NO: 1986574 - RNA, 18 nt, Human
agucugaggccguugcug

SEQ ID NO: 1986575 - RNA, 17 nt, Human
agucugagggcuuguag

SEQ ID NO: 1986576 - RNA, 18 nt, Human
agucugagggcuuguagu

SEQ ID NO: 1986577 - RNA, 21 nt, Human
agucugagggcuuguaguucu

SEQ ID NO: 1986578 - RNA, 17 nt, Human
agugaccucagcuuuga

SEQ ID NO: 1986579 - RNA, 16 nt, Human
agucuguugauuaaag

SEQ ID NO: 1986580 - RNA, 16 nt, Human
agucuguucugguaau

SEQ ID NO: 1986581 - RNA, 18 nt, Human
agugaccucagcuuugau

SEQ ID NO: 1986582 - RNA, 22 nt, Human
agugaccuggaaggcccagcac

SEQ ID NO: 1986583 - RNA, 14 nt, Human
agugacgguuccua

SEQ ID NO: 1986584 - RNA, 20 nt, Human
agugacgguuccuacacagg

SEQ ID NO: 1986585 - RNA, 23 nt, Human
agugacgguuccuacacaggaca

SEQ ID NO: 1986586 - RNA, 15 nt, Human
agucaauuacauguu

SEQ ID NO: 1986587 - RNA, 22 nt, Human
agucacacaguauuacuucugc

SEQ ID NO: 1986588 - RNA, 17 nt, Human
aguauuuuguuucagug

SEQ ID NO: 1986589 - RNA, 23 nt, Human
aguaugaggcauuuguuugaacu

SEQ ID NO: 1986590 - RNA, 14 nt, Human
aguauuuuguuuca

SEQ ID NO: 1986591 - RNA, 17 nt, Human
aguaugaggcauuuguu

SEQ ID NO: 1986592 - RNA, 16 nt, Human
aguauuuuuguauuca

SEQ ID NO: 1986593 - RNA, 15 nt, Human
aguaucucagggccu

SEQ ID NO: 1986594 - RNA, 20 nt, Human
aguauccugagagcccagaa

SEQ ID NO: 1986595 - RNA, 20 nt, Human
aguaugaggcauuuguuuga

SEQ ID NO: 1986596 - RNA, 21 nt, Human
aguaugaggcauuuguuugaa

SEQ ID NO: 1986597 - RNA, 11 nt, Human
aguauccaggc

SEQ ID NO: 1986598 - RNA, 23 nt, Human
aguauccaggcuuuguacagagu

SEQ ID NO: 1986599 - RNA, 18 nt, Human
aguacuuuauagaagaau

SEQ ID NO: 1986600 - RNA, 19 nt, Human
aguacuuuauagaagaaug

SEQ ID NO: 1986601 - RNA, 13 nt, Human
aguacuuuauaga

SEQ ID NO: 1986602 - RNA, 16 nt, Human
aguacuuuauagaaga

SEQ ID NO: 1986603 - RNA, 17 nt, Human
aguacuuuauagaagaa

SEQ ID NO: 1986604 - RNA, 16 nt, Human
aguacguugugcauuu

SEQ ID NO: 1986605 - RNA, 17 nt, Human
aguacguugugcauuug

SEQ ID NO: 1986606 - RNA, 18 nt, Human
aguacguugugcauuugg

SEQ ID NO: 1986607 - RNA, 15 nt, Human
aguaagcauuucaaa

SEQ ID NO: 1986608 - RNA, 22 nt, Human
aguacuacaguccucccaucuc

SEQ ID NO: 1986609 - RNA, 19 nt, Human
aguacuacaguccucccau

SEQ ID NO: 1986610 - RNA, 14 nt, Human
aguacuauaauuua

SEQ ID NO: 1986611 - RNA, 17 nt, Human
aguacuucuccacccug

SEQ ID NO: 1986612 - RNA, 13 nt, Human
aguacugugaauc

SEQ ID NO: 1986613 - RNA, 17 nt, Human
aguacugugaauccagu

SEQ ID NO: 1986614 - RNA, 12 nt, Human
aguacuucuuuu

SEQ ID NO: 1986615 - RNA, 14 nt, Human
aguacuauguauca

SEQ ID NO: 1986616 - RNA, 12 nt, Human
aguacuauguau

SEQ ID NO: 1986617 - RNA, 13 nt, Human
aguacucauacau

SEQ ID NO: 1986618 - RNA, 18 nt, Human
aguaaaucucuucugugu

SEQ ID NO: 1986619 - RNA, 18 nt, Human
aguaaaugggggugcauu

SEQ ID NO: 1986620 - RNA, 13 nt, Human
aggucuguucuuu

SEQ ID NO: 1986621 - RNA, 15 nt, Human
aggucuguucuuucc

SEQ ID NO: 1986622 - RNA, 16 nt, Human
aggucuguucuuucca

SEQ ID NO: 1986623 - RNA, 14 nt, Human
aguaaaucucuucu

SEQ ID NO: 1986624 - RNA, 15 nt, Human
aguaaaucucuucug

SEQ ID NO: 1986625 - RNA, 16 nt, Human
aguaaaucucuucugu

SEQ ID NO: 1986626 - RNA, 15 nt, Human
aguacguugugcauu

SEQ ID NO: 1986627 - RNA, 14 nt, Human
aguacguugugcau

SEQ ID NO: 1986628 - RNA, 14 nt, Human
aguaagaucacugu

SEQ ID NO: 1986629 - RNA, 15 nt, Human
aguaagaucacuguu

SEQ ID NO: 1986630 - RNA, 20 nt, Human
aguaagaucacuguuuagau

SEQ ID NO: 1986631 - RNA, 21 nt, Human
aguaagaucacuguuuagauu

SEQ ID NO: 1986632 - RNA, 14 nt, Human
aguaacacaggcca

SEQ ID NO: 1986633 - RNA, 21 nt, Human
auaagccagacaucaacagau

SEQ ID NO: 1986634 - RNA, 22 nt, Human
auaagccagacaucaacagaua

SEQ ID NO: 1986635 - RNA, 23 nt, Human
auaagggacugauguuugugcag

SEQ ID NO: 1986636 - RNA, 13 nt, Human
auaagggaaaaau

SEQ ID NO: 1986637 - RNA, 15 nt, Human
auaagggaaaaauca

SEQ ID NO: 1986638 - RNA, 16 nt, Human
auaagggaaaaaucaa

SEQ ID NO: 1986639 - RNA, 16 nt, Human
auaagccaugagaaug

SEQ ID NO: 1986640 - RNA, 18 nt, Human
auaagccaugagaauguu

SEQ ID NO: 1986641 - RNA, 13 nt, Human
auaauggucagag

SEQ ID NO: 1986642 - RNA, 18 nt, Human
auaaggguaucuggugac

SEQ ID NO: 1986643 - RNA, 15 nt, Human
auaauguaaauaaag

SEQ ID NO: 1986644 - RNA, 20 nt, Human
auacccccugcaaagcccag

SEQ ID NO: 1986645 - RNA, 16 nt, Human
auaccugucccccuga

SEQ ID NO: 1986646 - RNA, 15 nt, Human
auaccugucccccug

SEQ ID NO: 1986647 - RNA, 14 nt, Human
auaccugucccccu

SEQ ID NO: 1986648 - RNA, 21 nt, Human
auacccccugcaaagcccagc

SEQ ID NO: 1986649 - RNA, 13 nt, Human
auacagaaaaguu

SEQ ID NO: 1986650 - RNA, 17 nt, Human
auacccacccccaccca

SEQ ID NO: 1986651 - RNA, 17 nt, Human
auacccccugcaaagcc

SEQ ID NO: 1986652 - RNA, 19 nt, Human
auacccccugcaaagccca

SEQ ID NO: 1986653 - RNA, 16 nt, Human
auacccacccccaccc

SEQ ID NO: 1986654 - RNA, 14 nt, Human
auacccacccccac

SEQ ID NO: 1986655 - RNA, 13 nt, Human
auacccaccccca

SEQ ID NO: 1986656 - RNA, 19 nt, Human
auacacuuggaguuugcau

SEQ ID NO: 1986657 - RNA, 21 nt, Human
auacacuuggaguuugcauuc

SEQ ID NO: 1986658 - RNA, 22 nt, Human
auacacuuacacuuuaugcaca

SEQ ID NO: 1986659 - RNA, 13 nt, Human
auacacuuacacu

SEQ ID NO: 1986660 - RNA, 14 nt, Human
auacaaugcugugc

SEQ ID NO: 1986661 - RNA, 17 nt, Human
auacaaugcugugcccu

SEQ ID NO: 1986662 - RNA, 15 nt, Human
auacaauacauagga

SEQ ID NO: 1986663 - RNA, 18 nt, Human
auacaaucauagcauugu

SEQ ID NO: 1986664 - RNA, 15 nt, Human
aguuguuagauuaag

SEQ ID NO: 1986665 - RNA, 19 nt, Human
aguuguuacauuuuuaagu

SEQ ID NO: 1986666 - RNA, 20 nt, Human
aguuguuacauuuuuaagug

SEQ ID NO: 1986667 - RNA, 22 nt, Human
aguuguuacauuuuuaagugcu

SEQ ID NO: 1986668 - RNA, 22 nt, Human
aguuguuaccccaagcgcccug

SEQ ID NO: 1986669 - RNA, 24 nt, Human
aguuguuaccccaagcgcccuggc

SEQ ID NO: 1986670 - RNA, 17 nt, Human
aguuugauuaaauucuu

SEQ ID NO: 1986671 - RNA, 18 nt, Human
aguuugauuaaauucuug

SEQ ID NO: 1986672 - RNA, 20 nt, Human
aguuugauuaaauucuugca

SEQ ID NO: 1986673 - RNA, 22 nt, Human
aguuugauuaaauucuugcaaa

SEQ ID NO: 1986674 - RNA, 19 nt, Human
aguuugagaucagccuggg

SEQ ID NO: 1986675 - RNA, 18 nt, Human
aguuugagaucagccugg

SEQ ID NO: 1986676 - RNA, 20 nt, Human
aguuugagaucagccugggc

SEQ ID NO: 1986677 - RNA, 16 nt, Human
aguuugauuaaauucu

SEQ ID NO: 1986678 - RNA, 12 nt, Human
auaaaacccuua

SEQ ID NO: 1986679 - RNA, 16 nt, Human
aguuuggcaaacucuc

SEQ ID NO: 1986680 - RNA, 18 nt, Human
aguuuggcaaacucucca

SEQ ID NO: 1986681 - RNA, 10 nt, Human
aguuugcacu

SEQ ID NO: 1986682 - RNA, 18 nt, Human
aguuugcacucaaaucuu

SEQ ID NO: 1986683 - RNA, 20 nt, Human
aguuugcacucaaaucuuaa

SEQ ID NO: 1986684 - RNA, 22 nt, Human
aguuugcacucaaaucuuaaga

SEQ ID NO: 1986685 - RNA, 23 nt, Human
aguuugcacucaaaucuuaagaa

SEQ ID NO: 1986686 - RNA, 23 nt, Human
aguuugauuaaauucuugcaaag

SEQ ID NO: 1986687 - RNA, 18 nt, Human
auaacauguaauuaagua

SEQ ID NO: 1986688 - RNA, 13 nt, Human
auaacauguaauu

SEQ ID NO: 1986689 - RNA, 12 nt, Human
auaacauguaau

SEQ ID NO: 1986690 - RNA, 20 nt, Human
auaacauguaauuaaguacu

SEQ ID NO: 1986691 - RNA, 13 nt, Human
auaaauuuugaaa

SEQ ID NO: 1986692 - RNA, 14 nt, Human
auaaauuuugaaaa

SEQ ID NO: 1986693 - RNA, 15 nt, Human
auaaauuuugaaaag

SEQ ID NO: 1986694 - RNA, 16 nt, Human
auaaauuuugaaaagu

SEQ ID NO: 1986695 - RNA, 21 nt, Human
auaaauuuugaaaaguaauau

SEQ ID NO: 1986696 - RNA, 18 nt, Human
auaaauugucuuaaugga

SEQ ID NO: 1986697 - RNA, 15 nt, Human
auaaauugucuuaau

SEQ ID NO: 1986698 - RNA, 14 nt, Human
auaaauuuauuuac

SEQ ID NO: 1986699 - RNA, 15 nt, Human
auaaauuuauuuacu

SEQ ID NO: 1986700 - RNA, 19 nt, Human
auaaauuuauuuacugcua

SEQ ID NO: 1986701 - RNA, 14 nt, Human
auaaagcaauaaga

SEQ ID NO: 1986702 - RNA, 19 nt, Human
auaaagcaauaagaacaaa

SEQ ID NO: 1986703 - RNA, 14 nt, Human
auaacaaugaaagu

SEQ ID NO: 1986704 - RNA, 22 nt, Human
auacuuugcagcacagcugaga

SEQ ID NO: 1986705 - RNA, 10 nt, Human
auacuuugua

SEQ ID NO: 1986706 - RNA, 13 nt, Human
auacuuuguauug

SEQ ID NO: 1986707 - RNA, 14 nt, Human
auacuuuguauugu

SEQ ID NO: 1986708 - RNA, 18 nt, Human
auacuuuguauuguccua

SEQ ID NO: 1986709 - RNA, 18 nt, Human
auacuuguuguuuaaugu

SEQ ID NO: 1986710 - RNA, 15 nt, Human
auacuuguuuuugua

SEQ ID NO: 1986711 - RNA, 16 nt, Human
auacuuguuuuuguaa

SEQ ID NO: 1986712 - RNA, 19 nt, Human
auacuuguuuuuguaaaga

SEQ ID NO: 1986713 - RNA, 20 nt, Human
auacuuguuuuuguaaagaa

SEQ ID NO: 1986714 - RNA, 15 nt, Human
auagcagcuuauuca

SEQ ID NO: 1986715 - RNA, 15 nt, Human
auagcauuguaaaag

SEQ ID NO: 1986716 - RNA, 15 nt, Human
auagcauugucuauu

SEQ ID NO: 1986717 - RNA, 17 nt, Human
auagcauugucuauuuu

SEQ ID NO: 1986718 - RNA, 16 nt, Human
auagcauuuaugguaa

SEQ ID NO: 1986719 - RNA, 19 nt, Human
auagccccucuccccgcag

SEQ ID NO: 1986720 - RNA, 17 nt, Human
auagcauuuaugguaau

SEQ ID NO: 1986721 - RNA, 15 nt, Human
auagaaaguguucug

SEQ ID NO: 1986722 - RNA, 17 nt, Human
auagaaaguguucuguu

SEQ ID NO: 1986723 - RNA, 18 nt, Human
auagaaaguguucuguua

SEQ ID NO: 1986724 - RNA, 19 nt, Human
auagaaaguguucuguuac

SEQ ID NO: 1986725 - RNA, 20 nt, Human
auagaaaguguucuguuaca

SEQ ID NO: 1986726 - RNA, 22 nt, Human
auagaaaguguucuguuacaaa

SEQ ID NO: 1986727 - RNA, 23 nt, Human
auagaaaguguucuguuacaaaa

SEQ ID NO: 1986728 - RNA, 15 nt, Human
auagaaagcuuuguu

SEQ ID NO: 1986729 - RNA, 23 nt, Human
auagaaacugucuagcacuuccu

SEQ ID NO: 1986730 - RNA, 15 nt, Human
auagcacagacccug

SEQ ID NO: 1986731 - RNA, 18 nt, Human
auagcacagacccugccc

SEQ ID NO: 1986732 - RNA, 17 nt, Human
auagcacagacccugcc

SEQ ID NO: 1986733 - RNA, 16 nt, Human
auaguaaauguaguuc

SEQ ID NO: 1986734 - RNA, 14 nt, Human
auaguaaauguagu

SEQ ID NO: 1986735 - RNA, 13 nt, Human
auaguaauauaau

SEQ ID NO: 1986736 - RNA, 23 nt, Human
auaguaauauaauacacaaaauc

SEQ ID NO: 1986737 - RNA, 13 nt, Human
auaguaaaaauaa

SEQ ID NO: 1986738 - RNA, 14 nt, Human
auaguaaaaauaaa

SEQ ID NO: 1986739 - RNA, 24 nt, Human
auagguuuggacaaaauggaauac

SEQ ID NO: 1986740 - RNA, 18 nt, Human
auagguuuggacaaaaug

SEQ ID NO: 1986741 - RNA, 15 nt, Human
auagccuaggugaca

SEQ ID NO: 1986742 - RNA, 17 nt, Human
auagccuaggugacaga

SEQ ID NO: 1986743 - RNA, 18 nt, Human
auauaauacacaaaauca

SEQ ID NO: 1986744 - RNA, 19 nt, Human
auauaauacacaaaaucaa

SEQ ID NO: 1986745 - RNA, 21 nt, Human
auauaauacacaaaaucaaau

SEQ ID NO: 1986746 - RNA, 18 nt, Human
auauaauauugucucuuu

SEQ ID NO: 1986747 - RNA, 21 nt, Human
auauacaacaccaaaaaauau

SEQ ID NO: 1986748 - RNA, 16 nt, Human
auauaauacacaaaau

SEQ ID NO: 1986749 - RNA, 17 nt, Human
auauaauacacaaaauc

SEQ ID NO: 1986750 - RNA, 19 nt, Human
auauuucccugaaggaacc

SEQ ID NO: 1986751 - RNA, 13 nt, Human
auauuuaugaaga

SEQ ID NO: 1986752 - RNA, 14 nt, Human
auauuuaugaagaa

SEQ ID NO: 1986753 - RNA, 15 nt, Human
auauuuaugaagaaa

SEQ ID NO: 1986754 - RNA, 17 nt, Human
auauuuaugaagaaaau

SEQ ID NO: 1986755 - RNA, 19 nt, Human
auauuuaugaagaaaauac

SEQ ID NO: 1986756 - RNA, 21 nt, Human
auauuuaugaagaaaauacuu

SEQ ID NO: 1986757 - RNA, 19 nt, Human
auauucauaguagaacuuu

SEQ ID NO: 1986758 - RNA, 17 nt, Human
auauucauucuuuuuga

SEQ ID NO: 1986759 - RNA, 22 nt, Human
auauuauuuuauguugcauaga

SEQ ID NO: 1986760 - RNA, 15 nt, Human
auauuauuuuauguu

SEQ ID NO: 1986761 - RNA, 14 nt, Human
auauuauuuuaugu

SEQ ID NO: 1986762 - RNA, 19 nt, Human
auauucaggaagcucaggg

SEQ ID NO: 1986763 - RNA, 15 nt, Human
auauucacacuugaa

SEQ ID NO: 1986764 - RNA, 16 nt, Human
auauucacacuugaac

SEQ ID NO: 1986765 - RNA, 17 nt, Human
auaugcucugcauguua

SEQ ID NO: 1986766 - RNA, 16 nt, Human
auaugcucugcauguu

SEQ ID NO: 1986767 - RNA, 17 nt, Human
auaugcagauuuugccc

SEQ ID NO: 1986768 - RNA, 19 nt, Human
auaugcacuaagucucuuu

SEQ ID NO: 1986769 - RNA, 22 nt, Human
auaugcacacauuuuuuaaaug

SEQ ID NO: 1986770 - RNA, 20 nt, Human
auaugcucugcauguuacau

SEQ ID NO: 1986771 - RNA, 23 nt, Human
auaugcacuaagucucuuuuuua

SEQ ID NO: 1986772 - RNA, 18 nt, Human
auauauuuuuuucugaaa

SEQ ID NO: 1986773 - RNA, 12 nt, Human
augaaaauauuu

SEQ ID NO: 1986774 - RNA, 13 nt, Human
augaaaauauuua

SEQ ID NO: 1986775 - RNA, 14 nt, Human
augaaaauauuuaa

SEQ ID NO: 1986776 - RNA, 16 nt, Human
augaaaauauuuaaag

SEQ ID NO: 1986777 - RNA, 16 nt, Human
augaaaacacauuuuu

SEQ ID NO: 1986778 - RNA, 14 nt, Human
augaaaacacauuu

SEQ ID NO: 1986779 - RNA, 15 nt, Human
augaaaacacauuuu

SEQ ID NO: 1986780 - RNA, 13 nt, Human
augagggucuugg

SEQ ID NO: 1986781 - RNA, 20 nt, Human
augagggucuugguuccagc

SEQ ID NO: 1986782 - RNA, 13 nt, Human
augaggcauuugu

SEQ ID NO: 1986783 - RNA, 14 nt, Human
augaggcauuuguu

SEQ ID NO: 1986784 - RNA, 21 nt, Human
augaggcauuuguuugaacug

SEQ ID NO: 1986785 - RNA, 22 nt, Human
augaggcauuuguuugaacuga

SEQ ID NO: 1986786 - RNA, 16 nt, Human
augacugaaagcacug

SEQ ID NO: 1986787 - RNA, 20 nt, Human
augaccauaaaauuagacau

SEQ ID NO: 1986788 - RNA, 18 nt, Human
augaccacacuccagcug

SEQ ID NO: 1986789 - RNA, 15 nt, Human
augaccacacuccag

SEQ ID NO: 1986790 - RNA, 19 nt, Human
augacguacaaguaguucu

SEQ ID NO: 1986791 - RNA, 20 nt, Human
augacguacaaguaguucug

SEQ ID NO: 1986792 - RNA, 23 nt, Human
augacguacaaguaguucuguau

SEQ ID NO: 1986793 - RNA, 24 nt, Human
augacguacaaguaguucuguauu

SEQ ID NO: 1986794 - RNA, 17 nt, Human
augaaaacauggaacag

SEQ ID NO: 1986795 - RNA, 20 nt, Human
augaaaacauggaacagugu

SEQ ID NO: 1986796 - RNA, 21 nt, Human
augaaguacucauacauguua

SEQ ID NO: 1986797 - RNA, 11 nt, Human
aucuauaauau

SEQ ID NO: 1986798 - RNA, 17 nt, Human
aucuauaacuacauauu

SEQ ID NO: 1986799 - RNA, 19 nt, Human
aucuauaacuacauauuga

SEQ ID NO: 1986800 - RNA, 13 nt, Human
aucuauaaacacu

SEQ ID NO: 1986801 - RNA, 14 nt, Human
aucuauaaacacug

SEQ ID NO: 1986802 - RNA, 15 nt, Human
aucuauaaacacugu

SEQ ID NO: 1986803 - RNA, 12 nt, Human
aucuaguguuug

SEQ ID NO: 1986804 - RNA, 19 nt, Human
aucuaggggagccuugauu

SEQ ID NO: 1986805 - RNA, 20 nt, Human
aucuaggggagccuugauuc

SEQ ID NO: 1986806 - RNA, 14 nt, Human
aucuaguaauauau

SEQ ID NO: 1986807 - RNA, 16 nt, Human
aucuaguaauauauuu

SEQ ID NO: 1986808 - RNA, 18 nt, Human
aucuaguaauauauuuaa

SEQ ID NO: 1986809 - RNA, 19 nt, Human
aucuaguaauauauuuaaa

SEQ ID NO: 1986810 - RNA, 22 nt, Human
aucuaguaauauauuuaaaggg

SEQ ID NO: 1986811 - RNA, 17 nt, Human
aucuaggggagccuuga

SEQ ID NO: 1986812 - RNA, 20 nt, Human
aucuccgucaacucauauuu

SEQ ID NO: 1986813 - RNA, 21 nt, Human
aucucccuuuuccaugacugu

SEQ ID NO: 1986814 - RNA, 21 nt, Human
aucuauaggaagauugaaccu

SEQ ID NO: 1986815 - RNA, 13 nt, Human
aucuauagaaagu

SEQ ID NO: 1986816 - RNA, 14 nt, Human
aucuauagaaagug

SEQ ID NO: 1986817 - RNA, 15 nt, Human
aucuauagaaagugu

SEQ ID NO: 1986818 - RNA, 16 nt, Human
aucuauagaaaguguu

SEQ ID NO: 1986819 - RNA, 17 nt, Human
aucuauagaaaguguuc

SEQ ID NO: 1986820 - RNA, 22 nt, Human
aucuauagaaaguguucuguua

SEQ ID NO: 1986821 - RNA, 23 nt, Human
aucuauagaaaguguucuguuac

SEQ ID NO: 1986822 - RNA, 14 nt, Human
aucuuccucugcua

SEQ ID NO: 1986823 - RNA, 15 nt, Human
aucuuccucugcuaa

SEQ ID NO: 1986824 - RNA, 23 nt, Human
aucuuccuggucgaaaguuagua

SEQ ID NO: 1986825 - RNA, 16 nt, Human
aucuuccucugcuaaa

SEQ ID NO: 1986826 - RNA, 18 nt, Human
aucuuccucugcuaaauu

SEQ ID NO: 1986827 - RNA, 19 nt, Human
aucuuccucugcuaaauug

SEQ ID NO: 1986828 - RNA, 20 nt, Human
aucuuccucugcuaaauuga

SEQ ID NO: 1986829 - RNA, 18 nt, Human
aucuuccuggucgaaagu

SEQ ID NO: 1986830 - RNA, 19 nt, Human
aucuuccuggucgaaaguu

SEQ ID NO: 1986831 - RNA, 20 nt, Human
aucuuccuggucgaaaguua

SEQ ID NO: 1986832 - RNA, 22 nt, Human
aucuuccuggucgaaaguuagu

SEQ ID NO: 1986833 - RNA, 19 nt, Human
aucuggagagcccagaguc

SEQ ID NO: 1986834 - RNA, 18 nt, Human
aucuggagucuuugauaa

SEQ ID NO: 1986835 - RNA, 18 nt, Human
aucuggaguucucaaaga

SEQ ID NO: 1986836 - RNA, 22 nt, Human
aucucugcaggaaauggcugug

SEQ ID NO: 1986837 - RNA, 22 nt, Human
aucuggacuccucuguccaggc

SEQ ID NO: 1986838 - RNA, 16 nt, Human
aucucugcuuuggaaa

SEQ ID NO: 1986839 - RNA, 15 nt, Human
aucuuauuaaaguuu

SEQ ID NO: 1986840 - RNA, 16 nt, Human
aucuuauuaaaguuuc

SEQ ID NO: 1986841 - RNA, 18 nt, Human
aucuuauuaaaguuucaa

SEQ ID NO: 1986842 - RNA, 19 nt, Human
aucuuauuaaaguuucaaa

SEQ ID NO: 1986843 - RNA, 20 nt, Human
aucuuauuaaaguuucaaaa

SEQ ID NO: 1986844 - RNA, 22 nt, Human
aucuuauuaaaguuucaaaaau

SEQ ID NO: 1986845 - RNA, 23 nt, Human
aucuuauuaaaguuucaaaaauc

SEQ ID NO: 1986846 - RNA, 18 nt, Human
aucugggggccucuucug

SEQ ID NO: 1986847 - RNA, 14 nt, Human
aucuuauuaaaguu

SEQ ID NO: 1986848 - RNA, 14 nt, Human
aucuggguagcugu

SEQ ID NO: 1986849 - RNA, 15 nt, Human
aucuggguagcugua

SEQ ID NO: 1986850 - RNA, 17 nt, Human
aucuggguagcuguaag

SEQ ID NO: 1986851 - RNA, 18 nt, Human
aucuggguagcuguaagg

SEQ ID NO: 1986852 - RNA, 21 nt, Human
auauuucccugaaggaaccaa

SEQ ID NO: 1986853 - RNA, 18 nt, Human
auauuuccuauaccauuu

SEQ ID NO: 1986854 - RNA, 23 nt, Human
auauuuccuauaccauuuccgua

SEQ ID NO: 1986855 - RNA, 21 nt, Human
auauuuccuauaccauuuccg

SEQ ID NO: 1986856 - RNA, 22 nt, Human
auauuuccuauaccauuuccgu

SEQ ID NO: 1986857 - RNA, 23 nt, Human
aucaaagagguuuuaaaaaaauc

SEQ ID NO: 1986858 - RNA, 20 nt, Human
aucaaagagguuuuaaaaaa

SEQ ID NO: 1986859 - RNA, 16 nt, Human
aucaaagccacacucu

SEQ ID NO: 1986860 - RNA, 14 nt, Human
aucaaagccacacu

SEQ ID NO: 1986861 - RNA, 14 nt, Human
aucaaauauauuca

SEQ ID NO: 1986862 - RNA, 13 nt, Human
aucacagccucug

SEQ ID NO: 1986863 - RNA, 22 nt, Human
aucaaauauauucagccuggcu

SEQ ID NO: 1986864 - RNA, 20 nt, Human
aucaccaacgucugugccau

SEQ ID NO: 1986865 - RNA, 13 nt, Human
aucaccagacagg

SEQ ID NO: 1986866 - RNA, 23 nt, Human
aucacccgcuaagagggagggag

SEQ ID NO: 1986867 - RNA, 13 nt, Human
aucaccagggcca

SEQ ID NO: 1986868 - RNA, 19 nt, Human
aucaccgaugcaaacauug

SEQ ID NO: 1986869 - RNA, 17 nt, Human
aucaccuaauuaauuuc

SEQ ID NO: 1986870 - RNA, 20 nt, Human
aucaccuaauuaauuucagu

SEQ ID NO: 1986871 - RNA, 15 nt, Human
aucaugaauaacuga

SEQ ID NO: 1986872 - RNA, 23 nt, Human
aucaugaauaacugauuaguaag

SEQ ID NO: 1986873 - RNA, 12 nt, Human
aucaugugaaau

SEQ ID NO: 1986874 - RNA, 14 nt, Human
aucaugucuggcua

SEQ ID NO: 1986875 - RNA, 14 nt, Human
aucgccagcaaaac

SEQ ID NO: 1986876 - RNA, 18 nt, Human
aucgcccuggcaggcagg

SEQ ID NO: 1986877 - RNA, 18 nt, Human
auccuuucacuucuuucc

SEQ ID NO: 1986878 - RNA, 19 nt, Human
auccuuucacuucuuuccc

SEQ ID NO: 1986879 - RNA, 20 nt, Human
auccuuucacuucuuucccu

SEQ ID NO: 1986880 - RNA, 22 nt, Human
auccuuucacuucuuucccuuc

SEQ ID NO: 1986881 - RNA, 19 nt, Human
auccuuguguuuaucagaa

SEQ ID NO: 1986882 - RNA, 15 nt, Human
auccuugucaguugu

SEQ ID NO: 1986883 - RNA, 14 nt, Human
auccuugacuuuuu

SEQ ID NO: 1986884 - RNA, 15 nt, Human
auccuugacuuuuua

SEQ ID NO: 1986885 - RNA, 12 nt, Human
auccuucccacu

SEQ ID NO: 1986886 - RNA, 17 nt, Human
auccucauacccacccc

SEQ ID NO: 1986887 - RNA, 21 nt, Human
auccuuaucuaguguuugauu

SEQ ID NO: 1986888 - RNA, 18 nt, Human
auccuuacaaaugauugc

SEQ ID NO: 1986889 - RNA, 21 nt, Human
auccuuacaaaugauugcuuu

SEQ ID NO: 1986890 - RNA, 16 nt, Human
auccuuacaaaugauu

SEQ ID NO: 1986891 - RNA, 17 nt, Human
auccuuacaaaugauug

SEQ ID NO: 1986892 - RNA, 19 nt, Human
auccagacccggcugcgug

SEQ ID NO: 1986893 - RNA, 13 nt, Human
auccacucgccuu

SEQ ID NO: 1986894 - RNA, 16 nt, Human
auccaccguccccucc

SEQ ID NO: 1986895 - RNA, 19 nt, Human
auccaccguccccucccag

SEQ ID NO: 1986896 - RNA, 18 nt, Human
auccccaagccuggcaag

SEQ ID NO: 1986897 - RNA, 19 nt, Human
aucccaugagccucagcau

SEQ ID NO: 1986898 - RNA, 19 nt, Human
auccucaguuuuugugaaa

SEQ ID NO: 1986899 - RNA, 15 nt, Human
aucccggcugcccuu

SEQ ID NO: 1986900 - RNA, 20 nt, Human
auccccagacuucauagaau

SEQ ID NO: 1986901 - RNA, 14 nt, Human
aucccgugcuuuua

SEQ ID NO: 1986902 - RNA, 13 nt, Human
augcacacauuuu

SEQ ID NO: 1986903 - RNA, 14 nt, Human
augcacacauuuuu

SEQ ID NO: 1986904 - RNA, 15 nt, Human
augcacacauuuuuu

SEQ ID NO: 1986905 - RNA, 19 nt, Human
augcacagaguuguuacau

SEQ ID NO: 1986906 - RNA, 21 nt, Human
augcacagaguuguuacauuu

SEQ ID NO: 1986907 - RNA, 22 nt, Human
augcacagaguuguuacauuuu

SEQ ID NO: 1986908 - RNA, 23 nt, Human
augcacagaguuguuacauuuuu

SEQ ID NO: 1986909 - RNA, 20 nt, Human
augccuggauggggcugcac

SEQ ID NO: 1986910 - RNA, 19 nt, Human
augccugcucuuuggccug

SEQ ID NO: 1986911 - RNA, 19 nt, Human
augccuggauggggcugca

SEQ ID NO: 1986912 - RNA, 12 nt, Human
augccugcucuu

SEQ ID NO: 1986913 - RNA, 17 nt, Human
augcauuaaaagaaaau

SEQ ID NO: 1986914 - RNA, 20 nt, Human
augcauuaaaagaaaauaaa

SEQ ID NO: 1986915 - RNA, 15 nt, Human
augcauuaaaagaaa

SEQ ID NO: 1986916 - RNA, 16 nt, Human
augcauuaaaagaaaa

SEQ ID NO: 1986917 - RNA, 19 nt, Human
augccugucuuaauuuucu

SEQ ID NO: 1986918 - RNA, 18 nt, Human
augaucuuugcagacagg

SEQ ID NO: 1986919 - RNA, 19 nt, Human
augaucuuugcagacaggc

SEQ ID NO: 1986920 - RNA, 13 nt, Human
augaugaaaauau

SEQ ID NO: 1986921 - RNA, 15 nt, Human
augaugaaaauauuu

SEQ ID NO: 1986922 - RNA, 21 nt, Human
augaucuuugcagacaggcaa

SEQ ID NO: 1986923 - RNA, 17 nt, Human
augaucuuugcagacag

SEQ ID NO: 1986924 - RNA, 23 nt, Human
augcacaaauucugucucuggau

SEQ ID NO: 1986925 - RNA, 14 nt, Human
augcacaauuccau

SEQ ID NO: 1986926 - RNA, 22 nt, Human
augcacaaauucugucucugga

SEQ ID NO: 1986927 - RNA, 15 nt, Human
augcacaaauucugu

SEQ ID NO: 1986928 - RNA, 16 nt, Human
augaugggucaguugu

SEQ ID NO: 1986929 - RNA, 20 nt, Human
augaugguuuccaauuucau

SEQ ID NO: 1986930 - RNA, 18 nt, Human
augcacaaacagaggccg

SEQ ID NO: 1986931 - RNA, 15 nt, Human
augaugauccuaggc

SEQ ID NO: 1986932 - RNA, 14 nt, Human
augaugauuucaga

SEQ ID NO: 1986933 - RNA, 23 nt, Human
augaugaaaugaggucagagccu

SEQ ID NO: 1986934 - RNA, 19 nt, Human
augaugaaaauauuuaaag

SEQ ID NO: 1986935 - RNA, 18 nt, Human
augaugaaaugaggucag

SEQ ID NO: 1986936 - RNA, 13 nt, Human
augcugacccaug

SEQ ID NO: 1986937 - RNA, 16 nt, Human
augcugacccaugggc

SEQ ID NO: 1986938 - RNA, 19 nt, Human
augcugacuguacuccucc

SEQ ID NO: 1986939 - RNA, 20 nt, Human
augcugacuguacuccuccc

SEQ ID NO: 1986940 - RNA, 21 nt, Human
augcugacuguacuccuccca

SEQ ID NO: 1986941 - RNA, 17 nt, Human
augcugacccaugggca

SEQ ID NO: 1986942 - RNA, 19 nt, Human
augcugacccaugggcagg

SEQ ID NO: 1986943 - RNA, 15 nt, Human
augcugcccugugag

SEQ ID NO: 1986944 - RNA, 14 nt, Human
augcugcccuguga

SEQ ID NO: 1986945 - RNA, 13 nt, Human
augcugcccugug

SEQ ID NO: 1986946 - RNA, 16 nt, Human
augcugcccugugagu

SEQ ID NO: 1986947 - RNA, 12 nt, Human
augcugccucca

SEQ ID NO: 1986948 - RNA, 15 nt, Human
augcugccuccagaa

SEQ ID NO: 1986949 - RNA, 18 nt, Human
auggcuuuugugcauuau

SEQ ID NO: 1986950 - RNA, 16 nt, Human
auggcuuuugugcauu

SEQ ID NO: 1986951 - RNA, 17 nt, Human
auggcuuuugugcauua

SEQ ID NO: 1986952 - RNA, 18 nt, Human
auggcuggagcuagaauu

SEQ ID NO: 1986953 - RNA, 15 nt, Human
auggcugugccucug

SEQ ID NO: 1986954 - RNA, 16 nt, Human
auggcugugccucugc

SEQ ID NO: 1986955 - RNA, 17 nt, Human
auggcugugccucugcc

SEQ ID NO: 1986956 - RNA, 17 nt, Human
auggauaggcacaggaa

SEQ ID NO: 1986957 - RNA, 18 nt, Human
auggauaggcacaggaaa

SEQ ID NO: 1986958 - RNA, 16 nt, Human
augcuuguacauaaug

SEQ ID NO: 1986959 - RNA, 15 nt, Human
augcuuguacauaau

SEQ ID NO: 1986960 - RNA, 15 nt, Human
augcuuguguuucuu

SEQ ID NO: 1986961 - RNA, 14 nt, Human
augcuuuagcuuau

SEQ ID NO: 1986962 - RNA, 15 nt, Human
augcuuuagcuuauu

SEQ ID NO: 1986963 - RNA, 18 nt, Human
augcuuuaggauguacag

SEQ ID NO: 1986964 - RNA, 12 nt, Human
augguaguuucu

SEQ ID NO: 1986965 - RNA, 13 nt, Human
augguaguuucug

SEQ ID NO: 1986966 - RNA, 15 nt, Human
augguaguuucugug

SEQ ID NO: 1986967 - RNA, 18 nt, Human
augguaguuucugugguu

SEQ ID NO: 1986968 - RNA, 19 nt, Human
augguaguuucugugguug

SEQ ID NO: 1986969 - RNA, 22 nt, Human
augguaguuucugugguuggcu

SEQ ID NO: 1986970 - RNA, 23 nt, Human
augguaguuucugugguuggcug

SEQ ID NO: 1986971 - RNA, 15 nt, Human
augguaguuuuacag

SEQ ID NO: 1986972 - RNA, 21 nt, Human
augguaguuuuacaguguuuc

SEQ ID NO: 1986973 - RNA, 22 nt, Human
augguaguuuuacaguguuucu

SEQ ID NO: 1986974 - RNA, 15 nt, Human
augguccauagcacu

SEQ ID NO: 1986975 - RNA, 15 nt, Human
augguaaucauauua

SEQ ID NO: 1986976 - RNA, 15 nt, Human
augguaaaauuuugu

SEQ ID NO: 1986977 - RNA, 21 nt, Human
auggguguuguauggggaggc

SEQ ID NO: 1986978 - RNA, 23 nt, Human
augggugcuuggaggaaggaaac

SEQ ID NO: 1986979 - RNA, 21 nt, Human
augggugcuuggaggaaggaa

SEQ ID NO: 1986980 - RNA, 20 nt, Human
augggugcuuggaggaagga

SEQ ID NO: 1986981 - RNA, 14 nt, Human
augugaaaucauuc

SEQ ID NO: 1986982 - RNA, 14 nt, Human
augugaaacauguu

SEQ ID NO: 1986983 - RNA, 19 nt, Human
augucacaggcagguccag

SEQ ID NO: 1986984 - RNA, 18 nt, Human
augucaaugaacaagcau

SEQ ID NO: 1986985 - RNA, 16 nt, Human
augugaacagcggcug

SEQ ID NO: 1986986 - RNA, 18 nt, Human
augugaaaucauucauuu

SEQ ID NO: 1986987 - RNA, 17 nt, Human
augugaaaucauucauu

SEQ ID NO: 1986988 - RNA, 20 nt, Human
auguaacuuugguuaaaauc

SEQ ID NO: 1986989 - RNA, 12 nt, Human
auguaauuuugu

SEQ ID NO: 1986990 - RNA, 13 nt, Human
auguaauuugugu

SEQ ID NO: 1986991 - RNA, 18 nt, Human
auguaacuguuaccauug

SEQ ID NO: 1986992 - RNA, 21 nt, Human
auguaacuguuaccauuggaa

SEQ ID NO: 1986993 - RNA, 22 nt, Human
auguaacuguuaccauuggaaa

SEQ ID NO: 1986994 - RNA, 23 nt, Human
auguaacuguuaccauuggaaau

SEQ ID NO: 1986995 - RNA, 15 nt, Human
auguaacugcucuug

SEQ ID NO: 1986996 - RNA, 20 nt, Human
auguaacugcucuugggcaa

SEQ ID NO: 1986997 - RNA, 13 nt, Human
auguaacuguuac

SEQ ID NO: 1986998 - RNA, 14 nt, Human
auguaacuguuacc

SEQ ID NO: 1986999 - RNA, 17 nt, Human
auguaacuguuaccauu

SEQ ID NO: 1987000 - RNA, 14 nt, Human
auguaacugcucuu

SEQ ID NO: 1987001 - RNA, 15 nt, Human
auguaauuuugugua

SEQ ID NO: 1987002 - RNA, 16 nt, Human
auguaauuuuguguaa

SEQ ID NO: 1987003 - RNA, 17 nt, Human
auguaauuuuguguaag

SEQ ID NO: 1987004 - RNA, 22 nt, Human
auguaauuuuguguaagaaaua

SEQ ID NO: 1987005 - RNA, 23 nt, Human
auguaauuuuguguaagaaauac

SEQ ID NO: 1987006 - RNA, 13 nt, Human
augucacaggcag

SEQ ID NO: 1987007 - RNA, 19 nt, Human
auguguaagacaaaaagcu

SEQ ID NO: 1987008 - RNA, 17 nt, Human
auguguaagacaaaaag

SEQ ID NO: 1987009 - RNA, 13 nt, Human
auguguaaguauu

SEQ ID NO: 1987010 - RNA, 15 nt, Human
auguucccacuucaa

SEQ ID NO: 1987011 - RNA, 13 nt, Human
auguucccuccgg

SEQ ID NO: 1987012 - RNA, 15 nt, Human
auguucugggacaca

SEQ ID NO: 1987013 - RNA, 17 nt, Human
auguucucugaggacac

SEQ ID NO: 1987014 - RNA, 14 nt, Human
auguucugggacac

SEQ ID NO: 1987015 - RNA, 16 nt, Human
auguucucucuucucc

SEQ ID NO: 1987016 - RNA, 17 nt, Human
auguucucucuucucca

SEQ ID NO: 1987017 - RNA, 13 nt, Human
auguucucugagg

SEQ ID NO: 1987018 - RNA, 14 nt, Human
auguucuuaauucu

SEQ ID NO: 1987019 - RNA, 14 nt, Human
auguuuccuucccu

SEQ ID NO: 1987020 - RNA, 15 nt, Human
auguuuccuucccuc

SEQ ID NO: 1987021 - RNA, 13 nt, Human
auguuucuaaggu

SEQ ID NO: 1987022 - RNA, 15 nt, Human
auguuugccucugcc

SEQ ID NO: 1987023 - RNA, 17 nt, Human
auguuugccucugccuc

SEQ ID NO: 1987024 - RNA, 14 nt, Human
auguuugccucugc

SEQ ID NO: 1987025 - RNA, 14 nt, Human
cucuuggagccugc

SEQ ID NO: 1987026 - RNA, 20 nt, Human
cugaaaaccucuccucaugu

SEQ ID NO: 1987027 - RNA, 17 nt, Human
cugaaaaccucuccuca

SEQ ID NO: 1987028 - RNA, 15 nt, Human
cugaaaaccucuccu

SEQ ID NO: 1987029 - RNA, 14 nt, Human
cugaaaaccucucc

SEQ ID NO: 1987030 - RNA, 15 nt, Human
cucuuggagccugca

SEQ ID NO: 1987031 - RNA, 16 nt, Human
cucuugccacugccuc

SEQ ID NO: 1987032 - RNA, 17 nt, Human
cucuugccacugccucu

SEQ ID NO: 1987033 - RNA, 18 nt, Human
cucuugccacugccucuu

SEQ ID NO: 1987034 - RNA, 19 nt, Human
cucuugccacugccucuuc

SEQ ID NO: 1987035 - RNA, 20 nt, Human
cucuugccacugccucuucc

SEQ ID NO: 1987036 - RNA, 18 nt, Human
cugaaggccccgcccagg

SEQ ID NO: 1987037 - RNA, 17 nt, Human
cugaaggccccgcccag

SEQ ID NO: 1987038 - RNA, 14 nt, Human
cugaaggccccgcc

SEQ ID NO: 1987039 - RNA, 13 nt, Human
cugaaggccccgc

SEQ ID NO: 1987040 - RNA, 19 nt, Human
cugaaggacauugcggaca

SEQ ID NO: 1987041 - RNA, 20 nt, Human
cugaaggacauugcggacag

SEQ ID NO: 1987042 - RNA, 21 nt, Human
cugaaggacauugcggacagc

SEQ ID NO: 1987043 - RNA, 16 nt, Human
cugaaggaggccaccu

SEQ ID NO: 1987044 - RNA, 17 nt, Human
cugaaggaggccaccuc

SEQ ID NO: 1987045 - RNA, 18 nt, Human
cugaaggaggccaccucc

SEQ ID NO: 1987046 - RNA, 19 nt, Human
cugaaggaggccaccuccu

SEQ ID NO: 1987047 - RNA, 16 nt, Human
cugaaaauguaugugu

SEQ ID NO: 1987048 - RNA, 22 nt, Human
cugaaggaauaaauugcuccuu

SEQ ID NO: 1987049 - RNA, 15 nt, Human
cugacagacacaggc

SEQ ID NO: 1987050 - RNA, 18 nt, Human
cugacagaaucucugaau

SEQ ID NO: 1987051 - RNA, 12 nt, Human
cugacagacaca

SEQ ID NO: 1987052 - RNA, 14 nt, Human
cugacagacacagg

SEQ ID NO: 1987053 - RNA, 14 nt, Human
cugacagaaggacu

SEQ ID NO: 1987054 - RNA, 19 nt, Human
cugaagggguuuucuugau

SEQ ID NO: 1987055 - RNA, 20 nt, Human
cugaagggguuuucuugaua

SEQ ID NO: 1987056 - RNA, 16 nt, Human
cugaagggguuuucuu

SEQ ID NO: 1987057 - RNA, 18 nt, Human
cugaagggguuuucuuga

SEQ ID NO: 1987058 - RNA, 12 nt, Human
cugaccucaaau

SEQ ID NO: 1987059 - RNA, 15 nt, Human
cugaccuuaaaugca

SEQ ID NO: 1987060 - RNA, 19 nt, Human
cugaccuuaaaugcaacca

SEQ ID NO: 1987061 - RNA, 20 nt, Human
cugacccaugcugcccugug

SEQ ID NO: 1987062 - RNA, 19 nt, Human
cugacccaugcugcccugu

SEQ ID NO: 1987063 - RNA, 17 nt, Human
cugacccaugcugcccu

SEQ ID NO: 1987064 - RNA, 18 nt, Human
cugacccaugcugcccug

SEQ ID NO: 1987065 - RNA, 23 nt, Human
cugacccugcuucaaauauuucc

SEQ ID NO: 1987066 - RNA, 18 nt, Human
cucugguccauagagagc

SEQ ID NO: 1987067 - RNA, 16 nt, Human
cucugguccauagaga

SEQ ID NO: 1987068 - RNA, 19 nt, Human
cucugguccauagagagca

SEQ ID NO: 1987069 - RNA, 15 nt, Human
cucugguuaucuaau

SEQ ID NO: 1987070 - RNA, 14 nt, Human
cucugguuccuccc

SEQ ID NO: 1987071 - RNA, 17 nt, Human
cucugcugacagacaca

SEQ ID NO: 1987072 - RNA, 18 nt, Human
cucugcugacagacacag

SEQ ID NO: 1987073 - RNA, 19 nt, Human
cucugcugacagacacagg

SEQ ID NO: 1987074 - RNA, 15 nt, Human
cucugguccauagag

SEQ ID NO: 1987075 - RNA, 21 nt, Human
cucuguacagagcccacgccc

SEQ ID NO: 1987076 - RNA, 17 nt, Human
cucuguacagagcccac

SEQ ID NO: 1987077 - RNA, 16 nt, Human
cucuguacauauuagc

SEQ ID NO: 1987078 - RNA, 18 nt, Human
cucuguacauauuagcga

SEQ ID NO: 1987079 - RNA, 22 nt, Human
cucuuagaaaaggugauaaaau

SEQ ID NO: 1987080 - RNA, 13 nt, Human
cucugcuaaauug

SEQ ID NO: 1987081 - RNA, 17 nt, Human
cucugcuaaauugaugu

SEQ ID NO: 1987082 - RNA, 20 nt, Human
cucugcuaaauugauguuga

SEQ ID NO: 1987083 - RNA, 22 nt, Human
cucugcuccaaccgggauggga

SEQ ID NO: 1987084 - RNA, 23 nt, Human
cucugcagcaauaaagcagcguu

SEQ ID NO: 1987085 - RNA, 18 nt, Human
cucugcagcaauaaagca

SEQ ID NO: 1987086 - RNA, 19 nt, Human
cucugcagcaauaaagcag

SEQ ID NO: 1987087 - RNA, 14 nt, Human
cucugcacuccccu

SEQ ID NO: 1987088 - RNA, 20 nt, Human
cucgggauuaguacacacuu

SEQ ID NO: 1987089 - RNA, 14 nt, Human
cuccgcuucccugg

SEQ ID NO: 1987090 - RNA, 20 nt, Human
cucuauuccccacccucccc

SEQ ID NO: 1987091 - RNA, 14 nt, Human
cucuauuucccccu

SEQ ID NO: 1987092 - RNA, 17 nt, Human
cucuauuucccccuuuc

SEQ ID NO: 1987093 - RNA, 18 nt, Human
cucuauuucccccuuucu

SEQ ID NO: 1987094 - RNA, 23 nt, Human
cucuauuuagaugcauauuacug

SEQ ID NO: 1987095 - RNA, 22 nt, Human
cucuauuucccccuuucuuccu

SEQ ID NO: 1987096 - RNA, 23 nt, Human
cucuauuucccccuuucuuccuc

SEQ ID NO: 1987097 - RNA, 14 nt, Human
cucucacuccuuga

SEQ ID NO: 1987098 - RNA, 12 nt, Human
cucucacuccuu

SEQ ID NO: 1987099 - RNA, 19 nt, Human
cucucagauuguaccauug

SEQ ID NO: 1987100 - RNA, 21 nt, Human
cucucacuuguuuuauuuaac

SEQ ID NO: 1987101 - RNA, 14 nt, Human
cucucacugccucc

SEQ ID NO: 1987102 - RNA, 15 nt, Human
cucucacuccuugaa

SEQ ID NO: 1987103 - RNA, 12 nt, Human
cucucuggccuu

SEQ ID NO: 1987104 - RNA, 20 nt, Human
cucuccucauguucugcuuu

SEQ ID NO: 1987105 - RNA, 11 nt, Human
cucucuggccu

SEQ ID NO: 1987106 - RNA, 15 nt, Human
cucugaaggacauug

SEQ ID NO: 1987107 - RNA, 15 nt, Human
cucucagaggcccca

SEQ ID NO: 1987108 - RNA, 18 nt, Human
cucuccgccccugagccc

SEQ ID NO: 1987109 - RNA, 20 nt, Human
cucuccgccccugagcccac

SEQ ID NO: 1987110 - RNA, 21 nt, Human
cucuccgaccagacaccuuga

SEQ ID NO: 1987111 - RNA, 17 nt, Human
cucuccgccccugagcc

SEQ ID NO: 1987112 - RNA, 12 nt, Human
cucauguucuua

SEQ ID NO: 1987113 - RNA, 14 nt, Human
cucauguucuuaau

SEQ ID NO: 1987114 - RNA, 18 nt, Human
cucauguucuuaauucuu

SEQ ID NO: 1987115 - RNA, 19 nt, Human
cucauguucuuaauucuua

SEQ ID NO: 1987116 - RNA, 18 nt, Human
cucaugccucagccuccu

SEQ ID NO: 1987117 - RNA, 20 nt, Human
cucaugccucagccuccuga

SEQ ID NO: 1987118 - RNA, 12 nt, Human
cucaugcugccc

SEQ ID NO: 1987119 - RNA, 14 nt, Human
cucaugcugccccu

SEQ ID NO: 1987120 - RNA, 18 nt, Human
cucaugcugccccugccu

SEQ ID NO: 1987121 - RNA, 19 nt, Human
cucaugcugccccugccuu

SEQ ID NO: 1987122 - RNA, 20 nt, Human
cucaugcugccccugccuug

SEQ ID NO: 1987123 - RNA, 15 nt, Human
cuccaaccccucgcc

SEQ ID NO: 1987124 - RNA, 18 nt, Human
cuccaaccccucgcccag

SEQ ID NO: 1987125 - RNA, 19 nt, Human
cuccaaccccucgcccagu

SEQ ID NO: 1987126 - RNA, 20 nt, Human
cuccaaccccucgcccaguc

SEQ ID NO: 1987127 - RNA, 14 nt, Human
cuccaacauccacu

SEQ ID NO: 1987128 - RNA, 16 nt, Human
cuccaaagucucugga

SEQ ID NO: 1987129 - RNA, 22 nt, Human
cuccaaaguauuguacaaauaa

SEQ ID NO: 1987130 - RNA, 21 nt, Human
cucaucuugacagagccugcc

SEQ ID NO: 1987131 - RNA, 22 nt, Human
cucaucuugacagagccugccc

SEQ ID NO: 1987132 - RNA, 13 nt, Human
cucagugccacua

SEQ ID NO: 1987133 - RNA, 18 nt, Human
cucagucuggcccuuccu

SEQ ID NO: 1987134 - RNA, 17 nt, Human
cucagucuggcccuucc

SEQ ID NO: 1987135 - RNA, 21 nt, Human
cucaggccugggggcugggca

SEQ ID NO: 1987136 - RNA, 20 nt, Human
cucaggccugggggcugggc

SEQ ID NO: 1987137 - RNA, 14 nt, Human
cucaggccuggggg

SEQ ID NO: 1987138 - RNA, 16 nt, Human
cucaggcccaaagccu

SEQ ID NO: 1987139 - RNA, 13 nt, Human
cucaggccugggg

SEQ ID NO: 1987140 - RNA, 22 nt, Human
cucagccucccaaagugcuggg

SEQ ID NO: 1987141 - RNA, 13 nt, Human
cucagccucccga

SEQ ID NO: 1987142 - RNA, 23 nt, Human
cucagccucccgaauagcuggga

SEQ ID NO: 1987143 - RNA, 21 nt, Human
cucagccucccaaagugcugg

SEQ ID NO: 1987144 - RNA, 17 nt, Human
cuaucccggcugcccuu

SEQ ID NO: 1987145 - RNA, 14 nt, Human
cucagccucccaaa

SEQ ID NO: 1987146 - RNA, 16 nt, Human
cucagccucccaaagu

SEQ ID NO: 1987147 - RNA, 13 nt, Human
cucagccucccaa

SEQ ID NO: 1987148 - RNA, 15 nt, Human
cuaucccggcugccc

SEQ ID NO: 1987149 - RNA, 16 nt, Human
cuaucccggcugcccu

SEQ ID NO: 1987150 - RNA, 12 nt, Human
cucagccuccug

SEQ ID NO: 1987151 - RNA, 13 nt, Human
cucagccuccuga

SEQ ID NO: 1987152 - RNA, 22 nt, Human
cucaggccagcugcuugggcuu

SEQ ID NO: 1987153 - RNA, 21 nt, Human
cucaggccagcugcuugggcu

SEQ ID NO: 1987154 - RNA, 20 nt, Human
cucaggccagcugcuugggc

SEQ ID NO: 1987155 - RNA, 15 nt, Human
cucaggccagcugcu

SEQ ID NO: 1987156 - RNA, 14 nt, Human
cucaggccagcugc

SEQ ID NO: 1987157 - RNA, 13 nt, Human
cucaggccagcug

SEQ ID NO: 1987158 - RNA, 14 nt, Human
cucagcgaaugaau

SEQ ID NO: 1987159 - RNA, 13 nt, Human
cucagcggggaca

SEQ ID NO: 1987160 - RNA, 19 nt, Human
cuccagacacauguccaag

SEQ ID NO: 1987161 - RNA, 17 nt, Human
cuccagacacaugucca

SEQ ID NO: 1987162 - RNA, 23 nt, Human
cuccagaagauagcuucacccca

SEQ ID NO: 1987163 - RNA, 18 nt, Human
cuccagaauuucccaaag

SEQ ID NO: 1987164 - RNA, 15 nt, Human
cuccagaauuuccca

SEQ ID NO: 1987165 - RNA, 15 nt, Human
cuccagaagauagcu

SEQ ID NO: 1987166 - RNA, 14 nt, Human
cuccagaagauagc

SEQ ID NO: 1987167 - RNA, 16 nt, Human
cuccagaacucuuccu

SEQ ID NO: 1987168 - RNA, 17 nt, Human
cuccagaacucuuccuc

SEQ ID NO: 1987169 - RNA, 19 nt, Human
cuccagaacucuuccucca

SEQ ID NO: 1987170 - RNA, 22 nt, Human
cuccaaccgggaugggagccgg

SEQ ID NO: 1987171 - RNA, 19 nt, Human
cuccagaaaugucccuuuc

SEQ ID NO: 1987172 - RNA, 20 nt, Human
cuccagaaaugucccuuucu

SEQ ID NO: 1987173 - RNA, 22 nt, Human
cuccacuuucuagccagaggag

SEQ ID NO: 1987174 - RNA, 18 nt, Human
cuccaagaccuucuccuu

SEQ ID NO: 1987175 - RNA, 17 nt, Human
cuccaagaccuucuccu

SEQ ID NO: 1987176 - RNA, 23 nt, Human
cuccaaccccucgcccaguccca

SEQ ID NO: 1987177 - RNA, 19 nt, Human
cuccaaccgggaugggagc

SEQ ID NO: 1987178 - RNA, 16 nt, Human
cuccaagaccuucucc

SEQ ID NO: 1987179 - RNA, 11 nt, Human
cuccaggugca

SEQ ID NO: 1987180 - RNA, 22 nt, Human
cuccagucauuauguuaauauu

SEQ ID NO: 1987181 - RNA, 14 nt, Human
cuccaguccccaga

SEQ ID NO: 1987182 - RNA, 15 nt, Human
cuccaguccccagaa

SEQ ID NO: 1987183 - RNA, 16 nt, Human
cuccaguccccagaac

SEQ ID NO: 1987184 - RNA, 19 nt, Human
cuccgcuuucuacccagcg

SEQ ID NO: 1987185 - RNA, 15 nt, Human
cuccgccucccgggu

SEQ ID NO: 1987186 - RNA, 12 nt, Human
cucccaccucag

SEQ ID NO: 1987187 - RNA, 13 nt, Human
cucccaccucagc

SEQ ID NO: 1987188 - RNA, 17 nt, Human
cuccaguccccagaacu

SEQ ID NO: 1987189 - RNA, 23 nt, Human
cuccaguccccagaacucugccu

SEQ ID NO: 1987190 - RNA, 21 nt, Human
cuccagugagacagcucugca

SEQ ID NO: 1987191 - RNA, 18 nt, Human
cucccuccgggucuuccu

SEQ ID NO: 1987192 - RNA, 19 nt, Human
cucccuccgggucuuccua

SEQ ID NO: 1987193 - RNA, 16 nt, Human
cuccccucagagugca

SEQ ID NO: 1987194 - RNA, 13 nt, Human
cuccccucagagu

SEQ ID NO: 1987195 - RNA, 20 nt, Human
cuccccgcaguguuugugug

SEQ ID NO: 1987196 - RNA, 14 nt, Human
cucccccuuuuccc

SEQ ID NO: 1987197 - RNA, 15 nt, Human
cucccccuuuucccu

SEQ ID NO: 1987198 - RNA, 23 nt, Human
cuccccgccguacaguucuccag

SEQ ID NO: 1987199 - RNA, 20 nt, Human
cucccuccgggucuuccuac

SEQ ID NO: 1987200 - RNA, 24 nt, Human
cucccugacugggggcagacaugg

SEQ ID NO: 1987201 - RNA, 22 nt, Human
cucccugacugggggcagacau

SEQ ID NO: 1987202 - RNA, 18 nt, Human
cuaaagauagaguaaaaa

SEQ ID NO: 1987203 - RNA, 15 nt, Human
cuaacuucaccauau

SEQ ID NO: 1987204 - RNA, 12 nt, Human
cuaagaaacauu

SEQ ID NO: 1987205 - RNA, 13 nt, Human
cuaagaaacauug

SEQ ID NO: 1987206 - RNA, 14 nt, Human
cuaagaaacauugg

SEQ ID NO: 1987207 - RNA, 18 nt, Human
cuaagaaacauuggaagc

SEQ ID NO: 1987208 - RNA, 19 nt, Human
cuaagaaacauuggaagca

SEQ ID NO: 1987209 - RNA, 22 nt, Human
cuaagaaacauuggaagcaggu

SEQ ID NO: 1987210 - RNA, 19 nt, Human
cuaacuugcuuaaauguga

SEQ ID NO: 1987211 - RNA, 17 nt, Human
cuaacuugcuuaaaugu

SEQ ID NO: 1987212 - RNA, 18 nt, Human
cuaacuugcuuaaaugug

SEQ ID NO: 1987213 - RNA, 17 nt, Human
cuaacuucuaaaacugu

SEQ ID NO: 1987214 - RNA, 18 nt, Human
cuaacuucuaaaacugua

SEQ ID NO: 1987215 - RNA, 14 nt, Human
cuaacuugcuuaaa

SEQ ID NO: 1987216 - RNA, 16 nt, Human
cuaacuugcuuaaaug

SEQ ID NO: 1987217 - RNA, 20 nt, Human
cuaacuugcuuaaaugugaa

SEQ ID NO: 1987218 - RNA, 16 nt, Human
cuaacuucaccauauu

SEQ ID NO: 1987219 - RNA, 13 nt, Human
cuaacuucuaaaa

SEQ ID NO: 1987220 - RNA, 16 nt, Human
cuaacuucuaaaacug

SEQ ID NO: 1987221 - RNA, 16 nt, Human
cgugaccuggucaggg

SEQ ID NO: 1987222 - RNA, 12 nt, Human
cgugaccugguc

SEQ ID NO: 1987223 - RNA, 23 nt, Human
cuaaacugcccccucugcccugc

SEQ ID NO: 1987224 - RNA, 22 nt, Human
cuaaacugcccccucugcccug

SEQ ID NO: 1987225 - RNA, 14 nt, Human
cguggucuuuuccu

SEQ ID NO: 1987226 - RNA, 13 nt, Human
cgugagaccugcc

SEQ ID NO: 1987227 - RNA, 14 nt, Human
cgugagaccugccc

SEQ ID NO: 1987228 - RNA, 16 nt, Human
cgugagaccugccccu

SEQ ID NO: 1987229 - RNA, 23 nt, Human
cgugagccaccgugccuggccac

SEQ ID NO: 1987230 - RNA, 20 nt, Human
cuaagugaaauaagccagac

SEQ ID NO: 1987231 - RNA, 23 nt, Human
cuaagugaaauaagccagacauc

SEQ ID NO: 1987232 - RNA, 18 nt, Human
cuacauacaauuccaaac

SEQ ID NO: 1987233 - RNA, 21 nt, Human
cuacauaaaauaaaucuacug

SEQ ID NO: 1987234 - RNA, 15 nt, Human
cuaccuccucuccug

SEQ ID NO: 1987235 - RNA, 16 nt, Human
cuaccuccucuccuga

SEQ ID NO: 1987236 - RNA, 15 nt, Human
cuacaugagguacug

SEQ ID NO: 1987237 - RNA, 13 nt, Human
cuacaguugaaaa

SEQ ID NO: 1987238 - RNA, 18 nt, Human
cuacaguccucccaucuc

SEQ ID NO: 1987239 - RNA, 17 nt, Human
cuacaguccucccaucu

SEQ ID NO: 1987240 - RNA, 16 nt, Human
cuacaguccucccauc

SEQ ID NO: 1987241 - RNA, 15 nt, Human
cuacaguccucccau

SEQ ID NO: 1987242 - RNA, 18 nt, Human
cuaagugaggaugaaaaa

SEQ ID NO: 1987243 - RNA, 20 nt, Human
cuaagugauccucccaccuc

SEQ ID NO: 1987244 - RNA, 22 nt, Human
cuaagugauccucccaccucag

SEQ ID NO: 1987245 - RNA, 16 nt, Human
cuagaacucccuuuca

SEQ ID NO: 1987246 - RNA, 17 nt, Human
cuagaacucccuuucaa

SEQ ID NO: 1987247 - RNA, 18 nt, Human
cuagaacucccuuucaac

SEQ ID NO: 1987248 - RNA, 19 nt, Human
cuagaacucccuuucaaca

SEQ ID NO: 1987249 - RNA, 22 nt, Human
cuagcagcagggagggcuucug

SEQ ID NO: 1987250 - RNA, 12 nt, Human
cuagcagcaggg

SEQ ID NO: 1987251 - RNA, 18 nt, Human
cuagccaccgccuccuac

SEQ ID NO: 1987252 - RNA, 19 nt, Human
cuagcauuucccaacacaa

SEQ ID NO: 1987253 - RNA, 17 nt, Human
cuagcauggcugccaau

SEQ ID NO: 1987254 - RNA, 23 nt, Human
cuagcagcagggagggcuucugc

SEQ ID NO: 1987255 - RNA, 19 nt, Human
cuagaaauuccccacccug

SEQ ID NO: 1987256 - RNA, 14 nt, Human
cuaccugaggggcc

SEQ ID NO: 1987257 - RNA, 11 nt, Human
cuaccugaggg

SEQ ID NO: 1987258 - RNA, 15 nt, Human
cuaccugaggggccu

SEQ ID NO: 1987259 - RNA, 13 nt, Human
cuagcccugcccg

SEQ ID NO: 1987260 - RNA, 13 nt, Human
cuagccucacgcu

SEQ ID NO: 1987261 - RNA, 22 nt, Human
cuagccucacgcuccuuucuga

SEQ ID NO: 1987262 - RNA, 23 nt, Human
cuagccucacgcuccuuucugau

SEQ ID NO: 1987263 - RNA, 19 nt, Human
cuagggaaaaaccagcgug

SEQ ID NO: 1987264 - RNA, 21 nt, Human
cuagggaaaaaccagcgugug

SEQ ID NO: 1987265 - RNA, 20 nt, Human
cuaguuccaccaucaagcca

SEQ ID NO: 1987266 - RNA, 18 nt, Human
cuaguuccaccaucaagc

SEQ ID NO: 1987267 - RNA, 13 nt, Human
cuauaacacugug

SEQ ID NO: 1987268 - RNA, 17 nt, Human
cuauaacacugugaaga

SEQ ID NO: 1987269 - RNA, 19 nt, Human
cuauaacacugugaagagc

SEQ ID NO: 1987270 - RNA, 23 nt, Human
cuaguugaauacuugaaccauaa

SEQ ID NO: 1987271 - RNA, 20 nt, Human
cuaguugaauacuugaacca

SEQ ID NO: 1987272 - RNA, 21 nt, Human
cuaguugaauacuugaaccau

SEQ ID NO: 1987273 - RNA, 13 nt, Human
cuauaaauuauau

SEQ ID NO: 1987274 - RNA, 22 nt, Human
cuaguuccaccaucaagccacc

SEQ ID NO: 1987275 - RNA, 12 nt, Human
cuaguugaauac

SEQ ID NO: 1987276 - RNA, 13 nt, Human
cuaguugaauacu

SEQ ID NO: 1987277 - RNA, 15 nt, Human
cuaguugaauacuug

SEQ ID NO: 1987278 - RNA, 17 nt, Human
cuaguugaauacuugaa

SEQ ID NO: 1987279 - RNA, 18 nt, Human
cuaguugaauacuugaac

SEQ ID NO: 1987280 - RNA, 19 nt, Human
cuauaacauagaauugcaa

SEQ ID NO: 1987281 - RNA, 20 nt, Human
cuauaacuacauauugaaua

SEQ ID NO: 1987282 - RNA, 18 nt, Human
ccuucuggccucccacag

SEQ ID NO: 1987283 - RNA, 20 nt, Human
ccuucuggccucccacagac

SEQ ID NO: 1987284 - RNA, 12 nt, Human
ccuucugggcau

SEQ ID NO: 1987285 - RNA, 22 nt, Human
ccuucugacccaugcugcccug

SEQ ID NO: 1987286 - RNA, 21 nt, Human
ccuucugacccaugcugcccu

SEQ ID NO: 1987287 - RNA, 23 nt, Human
ccuucugacccaugcugcccugu

SEQ ID NO: 1987288 - RNA, 18 nt, Human
ccuucucuuccaggcagc

SEQ ID NO: 1987289 - RNA, 19 nt, Human
ccuucucuuccaggcagcc

SEQ ID NO: 1987290 - RNA, 19 nt, Human
ccuucugagcuggccucuc

SEQ ID NO: 1987291 - RNA, 20 nt, Human
ccuucugagcuggccucuca

SEQ ID NO: 1987292 - RNA, 23 nt, Human
ccuucugcacauaaacucuuuua

SEQ ID NO: 1987293 - RNA, 17 nt, Human
ccuucuggccucccaca

SEQ ID NO: 1987294 - RNA, 22 nt, Human
ccuucuggaauaaggagaauga

SEQ ID NO: 1987295 - RNA, 20 nt, Human
ccuucugacccaugcugccc

SEQ ID NO: 1987296 - RNA, 17 nt, Human
ccuucugacccaugcug

SEQ ID NO: 1987297 - RNA, 16 nt, Human
ccuucugacccaugcu

SEQ ID NO: 1987298 - RNA, 12 nt, Human
ccuucugaccca

SEQ ID NO: 1987299 - RNA, 15 nt, Human
ccuggccugagcugg

SEQ ID NO: 1987300 - RNA, 14 nt, Human
ccuggccugagcug

SEQ ID NO: 1987301 - RNA, 20 nt, Human
ccuggccugagcugggauga

SEQ ID NO: 1987302 - RNA, 13 nt, Human
ccuucucuuccag

SEQ ID NO: 1987303 - RNA, 14 nt, Human
ccuucucuuccagg

SEQ ID NO: 1987304 - RNA, 17 nt, Human
ccuucucuuccaggcag

SEQ ID NO: 1987305 - RNA, 20 nt, Human
ccuugccgucuaccugaggg

SEQ ID NO: 1987306 - RNA, 17 nt, Human
ccuugccgucuaccuga

SEQ ID NO: 1987307 - RNA, 20 nt, Human
ccuugcccacuccugcucug

SEQ ID NO: 1987308 - RNA, 21 nt, Human
ccuugcccacuccugcucugc

SEQ ID NO: 1987309 - RNA, 22 nt, Human
ccuugcccacuccugcucugcu

SEQ ID NO: 1987310 - RNA, 23 nt, Human
ccuugcccacuccugcucugcuc

SEQ ID NO: 1987311 - RNA, 17 nt, Human
ccuugcccacuccugcu

SEQ ID NO: 1987312 - RNA, 18 nt, Human
ccuugcccacuccugcuc

SEQ ID NO: 1987313 - RNA, 19 nt, Human
ccuugcccacuccugcucu

SEQ ID NO: 1987314 - RNA, 13 nt, Human
ccuuuucuguguu

SEQ ID NO: 1987315 - RNA, 14 nt, Human
ccuuuucuguguuu

SEQ ID NO: 1987316 - RNA, 11 nt, Human
ccuuucccacu

SEQ ID NO: 1987317 - RNA, 14 nt, Human
ccuuuagcgcccag

SEQ ID NO: 1987318 - RNA, 20 nt, Human
ccuuuagcgcccaguugggu

SEQ ID NO: 1987319 - RNA, 14 nt, Human
ccuuuagcuguguu

SEQ ID NO: 1987320 - RNA, 22 nt, Human
ccuuggaaaucaaauguaaagu

SEQ ID NO: 1987321 - RNA, 20 nt, Human
ccuuggaaaucaaauguaaa

SEQ ID NO: 1987322 - RNA, 16 nt, Human
ccuuggacauuuuaug

SEQ ID NO: 1987323 - RNA, 18 nt, Human
ccuuggacauuuuauguc

SEQ ID NO: 1987324 - RNA, 21 nt, Human
ccuuggacauuuuaugucuuu

SEQ ID NO: 1987325 - RNA, 15 nt, Human
cgacagugagacucu

SEQ ID NO: 1987326 - RNA, 16 nt, Human
cgacagugagacucug

SEQ ID NO: 1987327 - RNA, 17 nt, Human
ccuuuuuuauacauaaa

SEQ ID NO: 1987328 - RNA, 18 nt, Human
ccuuuuuuauacauaaac

SEQ ID NO: 1987329 - RNA, 19 nt, Human
ccuuuuuuauacauaaaca

SEQ ID NO: 1987330 - RNA, 23 nt, Human
cgaccagacaccuugacagggca

SEQ ID NO: 1987331 - RNA, 12 nt, Human
cgaccaccugcc

SEQ ID NO: 1987332 - RNA, 14 nt, Human
cgaccaccugccca

SEQ ID NO: 1987333 - RNA, 15 nt, Human
ccuuuugcaggcucc

SEQ ID NO: 1987334 - RNA, 19 nt, Human
ccuuuuguucauuucaucc

SEQ ID NO: 1987335 - RNA, 11 nt, Human
ccuuuuguguu

SEQ ID NO: 1987336 - RNA, 12 nt, Human
ccuuuuuuauac

SEQ ID NO: 1987337 - RNA, 14 nt, Human
cggagucccaccuu

SEQ ID NO: 1987338 - RNA, 16 nt, Human
cggaggggccuggcag

SEQ ID NO: 1987339 - RNA, 18 nt, Human
cggaggggccuggcagcc

SEQ ID NO: 1987340 - RNA, 20 nt, Human
cggagcggauugcaaagcaa

SEQ ID NO: 1987341 - RNA, 23 nt, Human
cggagucauuuuguguugaagag

SEQ ID NO: 1987342 - RNA, 21 nt, Human
cggcucacugcauccuccgcc

SEQ ID NO: 1987343 - RNA, 19 nt, Human
cggcucacugcagccucaa

SEQ ID NO: 1987344 - RNA, 17 nt, Human
cggcucacugcauccuc

SEQ ID NO: 1987345 - RNA, 18 nt, Human
cggcucacugcagccuca

SEQ ID NO: 1987346 - RNA, 15 nt, Human
cggcggccucagagu

SEQ ID NO: 1987347 - RNA, 17 nt, Human
cgccucggaucagcuga

SEQ ID NO: 1987348 - RNA, 12 nt, Human
cgccaaggcugg

SEQ ID NO: 1987349 - RNA, 19 nt, Human
cgcaggcuggcccugcccu

SEQ ID NO: 1987350 - RNA, 20 nt, Human
cgcaggcuggcccugcccug

SEQ ID NO: 1987351 - RNA, 14 nt, Human
cgcaggcuggcccu

SEQ ID NO: 1987352 - RNA, 15 nt, Human
cgcaggcuggcccug

SEQ ID NO: 1987353 - RNA, 17 nt, Human
cgcaggcuggcccugcc

SEQ ID NO: 1987354 - RNA, 18 nt, Human
cgcaggcuggcccugccc

SEQ ID NO: 1987355 - RNA, 16 nt, Human
cgccaaggcuggggga

SEQ ID NO: 1987356 - RNA, 13 nt, Human
cgccaaggcuggg

SEQ ID NO: 1987357 - RNA, 23 nt, Human
cgccaaggcugggggaagaagcu

SEQ ID NO: 1987358 - RNA, 21 nt, Human
cgaguguguuucauccuuccc

SEQ ID NO: 1987359 - RNA, 15 nt, Human
cgccgcccagcccac

SEQ ID NO: 1987360 - RNA, 20 nt, Human
cgccggcaauaaaagcccag

SEQ ID NO: 1987361 - RNA, 21 nt, Human
cgccggcaauaaaagcccagg

SEQ ID NO: 1987362 - RNA, 22 nt, Human
cgccggcaauaaaagcccagga

SEQ ID NO: 1987363 - RNA, 14 nt, Human
cgccuacaggagug

SEQ ID NO: 1987364 - RNA, 17 nt, Human
cgaguguguuucauccu

SEQ ID NO: 1987365 - RNA, 18 nt, Human
cgaguuacagacaaagcg

SEQ ID NO: 1987366 - RNA, 17 nt, Human
cgaguuacagacaaagc

SEQ ID NO: 1987367 - RNA, 13 nt, Human
cgaguagcuggga

SEQ ID NO: 1987368 - RNA, 14 nt, Human
cgaguagcugggac

SEQ ID NO: 1987369 - RNA, 15 nt, Human
cgaguagcugggacu

SEQ ID NO: 1987370 - RNA, 16 nt, Human
cgaguagcugggacua

SEQ ID NO: 1987371 - RNA, 17 nt, Human
cgaccuggccugucugu

SEQ ID NO: 1987372 - RNA, 16 nt, Human
cgaccugccucggccu

SEQ ID NO: 1987373 - RNA, 23 nt, Human
cgaccugaggacauggcuucuga

SEQ ID NO: 1987374 - RNA, 12 nt, Human
cgaccagccagg

SEQ ID NO: 1987375 - RNA, 14 nt, Human
cgaccacuuccagg

SEQ ID NO: 1987376 - RNA, 18 nt, Human
ccuaggauucacacccca

SEQ ID NO: 1987377 - RNA, 19 nt, Human
ccuaggauucacaccccac

SEQ ID NO: 1987378 - RNA, 23 nt, Human
ccuaggauucacaccccaccugc

SEQ ID NO: 1987379 - RNA, 20 nt, Human
ccuaggauucacaccccacc

SEQ ID NO: 1987380 - RNA, 22 nt, Human
ccuaggauucacaccccaccug

SEQ ID NO: 1987381 - RNA, 13 nt, Human
ccuaaggaaccuu

SEQ ID NO: 1987382 - RNA, 16 nt, Human
ccuaaggaaccuuccu

SEQ ID NO: 1987383 - RNA, 21 nt, Human
ccuaagauauacuuguuuuug

SEQ ID NO: 1987384 - RNA, 18 nt, Human
ccgucucugguuccuccc

SEQ ID NO: 1987385 - RNA, 14 nt, Human
ccuaauaaagcugu

SEQ ID NO: 1987386 - RNA, 23 nt, Human
ccuaauaaagcuguguggcaguc

SEQ ID NO: 1987387 - RNA, 18 nt, Human
ccuaaucacucagagcag

SEQ ID NO: 1987388 - RNA, 16 nt, Human
ccguagguuauuuuca

SEQ ID NO: 1987389 - RNA, 22 nt, Human
ccggcuaugggggcacugagga

SEQ ID NO: 1987390 - RNA, 23 nt, Human
ccggcuaugggggcacugaggac

SEQ ID NO: 1987391 - RNA, 17 nt, Human
ccggcuaugggggcacu

SEQ ID NO: 1987392 - RNA, 19 nt, Human
ccggcuaauuuuuguauuu

SEQ ID NO: 1987393 - RNA, 21 nt, Human
ccggcuaagcaggcgcaaggg

SEQ ID NO: 1987394 - RNA, 16 nt, Human
ccggcuaagcaggcgc

SEQ ID NO: 1987395 - RNA, 13 nt, Human
ccgucacauccca

SEQ ID NO: 1987396 - RNA, 11 nt, Human
ccgucucaggu

SEQ ID NO: 1987397 - RNA, 17 nt, Human
ccgucacuaccuggcug

SEQ ID NO: 1987398 - RNA, 14 nt, Human
ccuccaaggccagg

SEQ ID NO: 1987399 - RNA, 15 nt, Human
ccucccacagugcug

SEQ ID NO: 1987400 - RNA, 14 nt, Human
ccucccaggcgccc

SEQ ID NO: 1987401 - RNA, 20 nt, Human
ccucccaggcgccccuuccc

SEQ ID NO: 1987402 - RNA, 12 nt, Human
ccucccagcucc

SEQ ID NO: 1987403 - RNA, 22 nt, Human
ccucccaaggggcccaaauucu

SEQ ID NO: 1987404 - RNA, 22 nt, Human
ccuccaaucccaccaacccuca

SEQ ID NO: 1987405 - RNA, 13 nt, Human
ccuccaaggccag

SEQ ID NO: 1987406 - RNA, 18 nt, Human
ccucauuagcauuuugcu

SEQ ID NO: 1987407 - RNA, 21 nt, Human
ccuccaagcuccaucuccacu

SEQ ID NO: 1987408 - RNA, 22 nt, Human
ccuccaagcuccaucuccacuc

SEQ ID NO: 1987409 - RNA, 19 nt, Human
ccucauguucuuaauucuu

SEQ ID NO: 1987410 - RNA, 20 nt, Human
ccucauguccacugguucuu

SEQ ID NO: 1987411 - RNA, 13 nt, Human
ccucauguucuua

SEQ ID NO: 1987412 - RNA, 15 nt, Human
ccucauguccacugg

SEQ ID NO: 1987413 - RNA, 13 nt, Human
ccucagccuccug

SEQ ID NO: 1987414 - RNA, 23 nt, Human
ccucagccucccaaagugcuggg

SEQ ID NO: 1987415 - RNA, 22 nt, Human
ccucagccucccgaauagcugg

SEQ ID NO: 1987416 - RNA, 16 nt, Human
ccucaaccuccugggc

SEQ ID NO: 1987417 - RNA, 15 nt, Human
ccuauuucuugauaa

SEQ ID NO: 1987418 - RNA, 15 nt, Human
ccuauuuuaauaaac

SEQ ID NO: 1987419 - RNA, 11 nt, Human
ccuauuucaga

SEQ ID NO: 1987420 - RNA, 12 nt, Human
ccuauuucagaa

SEQ ID NO: 1987421 - RNA, 11 nt, Human
ccucagccucc

SEQ ID NO: 1987422 - RNA, 22 nt, Human
ccucagccucccaaagugcugg

SEQ ID NO: 1987423 - RNA, 15 nt, Human
ccucaagagaaggca

SEQ ID NO: 1987424 - RNA, 15 nt, Human
ccucaacucuccucc

SEQ ID NO: 1987425 - RNA, 13 nt, Human
cccuggcagcccc

SEQ ID NO: 1987426 - RNA, 12 nt, Human
cccuggcagccc

SEQ ID NO: 1987427 - RNA, 21 nt, Human
cccugcccugugggcccccaa

SEQ ID NO: 1987428 - RNA, 20 nt, Human
cccugcccugugggccccca

SEQ ID NO: 1987429 - RNA, 16 nt, Human
cccugcccugugggcc

SEQ ID NO: 1987430 - RNA, 15 nt, Human
cccugcccugugggc

SEQ ID NO: 1987431 - RNA, 14 nt, Human
cccugcccuguggg

SEQ ID NO: 1987432 - RNA, 11 nt, Human
cccugcccugu

SEQ ID NO: 1987433 - RNA, 12 nt, Human
cccugcccugug

SEQ ID NO: 1987434 - RNA, 13 nt, Human
cccugcccugugg

SEQ ID NO: 1987435 - RNA, 15 nt, Human
cccucaaagaggcag

SEQ ID NO: 1987436 - RNA, 21 nt, Human
cccuauuuaacagggucucua

SEQ ID NO: 1987437 - RNA, 23 nt, Human
cccuauuuaacagggucucuagu

SEQ ID NO: 1987438 - RNA, 13 nt, Human
cccuggcuccagg

SEQ ID NO: 1987439 - RNA, 16 nt, Human
cccuggcuccaggcca

SEQ ID NO: 1987440 - RNA, 17 nt, Human
cccuggcucccacaggc

SEQ ID NO: 1987441 - RNA, 19 nt, Human
cccuggcucccacaggccc

SEQ ID NO: 1987442 - RNA, 13 nt, Human
cccuggcuuuuca

SEQ ID NO: 1987443 - RNA, 14 nt, Human
cccuggcuuccuua

SEQ ID NO: 1987444 - RNA, 12 nt, Human
cccuggccccca

SEQ ID NO: 1987445 - RNA, 17 nt, Human
cccuggcccccacaugg

SEQ ID NO: 1987446 - RNA, 16 nt, Human
cccuggcagccccugu

SEQ ID NO: 1987447 - RNA, 14 nt, Human
cccuggcagccccu

SEQ ID NO: 1987448 - RNA, 15 nt, Human
cccuggcagcccgca

SEQ ID NO: 1987449 - RNA, 14 nt, Human
cccuggcaggcagg

SEQ ID NO: 1987450 - RNA, 15 nt, Human
cccuggcaggcaggg

SEQ ID NO: 1987451 - RNA, 24 nt, Human
cccugugccuuggugugcuguauc

SEQ ID NO: 1987452 - RNA, 13 nt, Human
cccugugccagcc

SEQ ID NO: 1987453 - RNA, 23 nt, Human
cccuucugacccaugcugcccug

SEQ ID NO: 1987454 - RNA, 22 nt, Human
cccuucugacccaugcugcccu

SEQ ID NO: 1987455 - RNA, 21 nt, Human
cccuucugacccaugcugccc

SEQ ID NO: 1987456 - RNA, 12 nt, Human
cccuucucuucc

SEQ ID NO: 1987457 - RNA, 13 nt, Human
cccuucucuucca

SEQ ID NO: 1987458 - RNA, 16 nt, Human
cccuucuaccuuccug

SEQ ID NO: 1987459 - RNA, 16 nt, Human
cccuucgcuccugugu

SEQ ID NO: 1987460 - RNA, 18 nt, Human
cccuucgcuccugugucu

SEQ ID NO: 1987461 - RNA, 20 nt, Human
ccgcccaggcuuagucacug

SEQ ID NO: 1987462 - RNA, 16 nt, Human
ccgccaugcuccuggc

SEQ ID NO: 1987463 - RNA, 14 nt, Human
cccuucucuuccag

SEQ ID NO: 1987464 - RNA, 15 nt, Human
cccuucucuuccagg

SEQ ID NO: 1987465 - RNA, 17 nt, Human
cccuucucuuccaggca

SEQ ID NO: 1987466 - RNA, 19 nt, Human
cccuucucuuccaggcagc

SEQ ID NO: 1987467 - RNA, 20 nt, Human
ccgaauagcugggacuacag

SEQ ID NO: 1987468 - RNA, 13 nt, Human
ccgacaagcacag

SEQ ID NO: 1987469 - RNA, 17 nt, Human
ccgccaaggcuggggga

SEQ ID NO: 1987470 - RNA, 16 nt, Human
ccgacccuugccgucu

SEQ ID NO: 1987471 - RNA, 21 nt, Human
ccgccaaaagcugcucaggga

SEQ ID NO: 1987472 - RNA, 14 nt, Human
ccgccacaucccuc

SEQ ID NO: 1987473 - RNA, 15 nt, Human
ccuggccucugcacu

SEQ ID NO: 1987474 - RNA, 14 nt, Human
ccuggccucugcac

SEQ ID NO: 1987475 - RNA, 13 nt, Human
ccuggccugagcu

SEQ ID NO: 1987476 - RNA, 16 nt, Human
ccuggccucugcacuc

SEQ ID NO: 1987477 - RNA, 12 nt, Human
ccuggccucugc

SEQ ID NO: 1987478 - RNA, 20 nt, Human
ccugcuggguguggcgcagc

SEQ ID NO: 1987479 - RNA, 14 nt, Human
ccugcugggugugg

SEQ ID NO: 1987480 - RNA, 12 nt, Human
ccugcugggugu

SEQ ID NO: 1987481 - RNA, 21 nt, Human
ccugcuggccggacacccgac

SEQ ID NO: 1987482 - RNA, 14 nt, Human
ccugcccaggcccc

SEQ ID NO: 1987483 - RNA, 15 nt, Human
ccugcccaggccccu

SEQ ID NO: 1987484 - RNA, 16 nt, Human
ccugcccaggccccug

SEQ ID NO: 1987485 - RNA, 13 nt, Human
ccuggaugcagcc

SEQ ID NO: 1987486 - RNA, 21 nt, Human
ccuggauccaucaggccacuu

SEQ ID NO: 1987487 - RNA, 17 nt, Human
ccuggaugcagccucac

SEQ ID NO: 1987488 - RNA, 14 nt, Human
ccuggaugcagccu

SEQ ID NO: 1987489 - RNA, 19 nt, Human
ccuggaugcagccucacag

SEQ ID NO: 1987490 - RNA, 19 nt, Human
ccuggaggcucaaauuuug

SEQ ID NO: 1987491 - RNA, 20 nt, Human
ccuggaggcucaaauuuuga

SEQ ID NO: 1987492 - RNA, 17 nt, Human
ccuggaguucugguucc

SEQ ID NO: 1987493 - RNA, 16 nt, Human
ccuggaguucugguuc

SEQ ID NO: 1987494 - RNA, 15 nt, Human
ccuggaguucugguu

SEQ ID NO: 1987495 - RNA, 18 nt, Human
ccuggcacccggccccug

SEQ ID NO: 1987496 - RNA, 16 nt, Human
ccuggcacagggcagu

SEQ ID NO: 1987497 - RNA, 17 nt, Human
ccuggcacagggcagug

SEQ ID NO: 1987498 - RNA, 18 nt, Human
ccuggcacagggcagugg

SEQ ID NO: 1987499 - RNA, 12 nt, Human
ccucucucaggc

SEQ ID NO: 1987500 - RNA, 17 nt, Human
ccucucucacuccuuga

SEQ ID NO: 1987501 - RNA, 15 nt, Human
ccucucucacuccuu

SEQ ID NO: 1987502 - RNA, 14 nt, Human
ccucucucacuccu

SEQ ID NO: 1987503 - RNA, 13 nt, Human
ccucucucacucc

SEQ ID NO: 1987504 - RNA, 14 nt, Human
ccucucucaggcca

SEQ ID NO: 1987505 - RNA, 20 nt, Human
ccucucugcaggucccuaau

SEQ ID NO: 1987506 - RNA, 15 nt, Human
ccucucugcaggucc

SEQ ID NO: 1987507 - RNA, 13 nt, Human
ccucucugcaggu

SEQ ID NO: 1987508 - RNA, 18 nt, Human
ccucucugaaggaggcca

SEQ ID NO: 1987509 - RNA, 20 nt, Human
ccucucugaaggaggccacc

SEQ ID NO: 1987510 - RNA, 22 nt, Human
ccucucugaaggaggccaccuc

SEQ ID NO: 1987511 - RNA, 23 nt, Human
ccucucugaaggaggccaccucc

SEQ ID NO: 1987512 - RNA, 18 nt, Human
ccucugcugcuggcuggu

SEQ ID NO: 1987513 - RNA, 17 nt, Human
ccucugcugcuggcugg

SEQ ID NO: 1987514 - RNA, 16 nt, Human
ccucugcugcuggcug

SEQ ID NO: 1987515 - RNA, 15 nt, Human
ccucugcugcuggcu

SEQ ID NO: 1987516 - RNA, 14 nt, Human
ccucugcugcuggc

SEQ ID NO: 1987517 - RNA, 13 nt, Human
ccucugcugcugg

SEQ ID NO: 1987518 - RNA, 15 nt, Human
ccucugcugauccuc

SEQ ID NO: 1987519 - RNA, 18 nt, Human
ccucugcugauccuccca

SEQ ID NO: 1987520 - RNA, 22 nt, Human
ccucucugcaggucccuaauaa

SEQ ID NO: 1987521 - RNA, 21 nt, Human
ccucucugcaggucccuaaua

SEQ ID NO: 1987522 - RNA, 23 nt, Human
ccucucugcaggucccuaauaaa

SEQ ID NO: 1987523 - RNA, 12 nt, Human
ccucucugcccu

SEQ ID NO: 1987524 - RNA, 19 nt, Human
ccucugcucccccuuuucc

SEQ ID NO: 1987525 - RNA, 12 nt, Human
ccucugccuguc

SEQ ID NO: 1987526 - RNA, 22 nt, Human
ccucugccugaagucacacagu

SEQ ID NO: 1987527 - RNA, 10 nt, Human
ccugcagcuc

SEQ ID NO: 1987528 - RNA, 12 nt, Human
ccugcagcuccc

SEQ ID NO: 1987529 - RNA, 12 nt, Human
ccugcagcucuc

SEQ ID NO: 1987530 - RNA, 15 nt, Human
ccugcagcucucaug

SEQ ID NO: 1987531 - RNA, 22 nt, Human
ccugcacuugcagacucuacag

SEQ ID NO: 1987532 - RNA, 21 nt, Human
ccugcacuugggggcucagca

SEQ ID NO: 1987533 - RNA, 22 nt, Human
ccugcacuugggggcucagcaa

SEQ ID NO: 1987534 - RNA, 15 nt, Human
ccugcacuugggggc

SEQ ID NO: 1987535 - RNA, 16 nt, Human
ccugcacuugggggcu

SEQ ID NO: 1987536 - RNA, 18 nt, Human
ccugcacuugggggcuca

SEQ ID NO: 1987537 - RNA, 20 nt, Human
ccugcacuugggggcucagc

SEQ ID NO: 1987538 - RNA, 22 nt, Human
ccugaguaaaaaagcugugugc

SEQ ID NO: 1987539 - RNA, 15 nt, Human
ccugagaggggaagc

SEQ ID NO: 1987540 - RNA, 20 nt, Human
ccugagaggggaagcggccc

SEQ ID NO: 1987541 - RNA, 13 nt, Human
ccucuugagccuu

SEQ ID NO: 1987542 - RNA, 19 nt, Human
ccucuugagccuugaacuu

SEQ ID NO: 1987543 - RNA, 15 nt, Human
ccucuugacccugca

SEQ ID NO: 1987544 - RNA, 16 nt, Human
ccucuugacccugcac

SEQ ID NO: 1987545 - RNA, 17 nt, Human
ccucuugacccugcacc

SEQ ID NO: 1987546 - RNA, 22 nt, Human
ccugaccucaaaugaugugccu

SEQ ID NO: 1987547 - RNA, 22 nt, Human
ccucuugucuuccuauuucaga

SEQ ID NO: 1987548 - RNA, 14 nt, Human
ccucuugcauuuca

SEQ ID NO: 1987549 - RNA, 19 nt, Human
ccucuugucuuccuauuuc

SEQ ID NO: 1987550 - RNA, 13 nt, Human
ccucuuggguuca

SEQ ID NO: 1987551 - RNA, 14 nt, Human
ccugacucucagca

SEQ ID NO: 1987552 - RNA, 16 nt, Human
ccugacugggggcaga

SEQ ID NO: 1987553 - RNA, 17 nt, Human
ccugacugggggcagac

SEQ ID NO: 1987554 - RNA, 19 nt, Human
ccugacugggggcagacau

SEQ ID NO: 1987555 - RNA, 13 nt, Human
ccccuuucuuccu

SEQ ID NO: 1987556 - RNA, 14 nt, Human
ccccuuucuuccuc

SEQ ID NO: 1987557 - RNA, 14 nt, Human
ccccucuucccugg

SEQ ID NO: 1987558 - RNA, 12 nt, Human
ccccucuuccuc

SEQ ID NO: 1987559 - RNA, 13 nt, Human
ccccucuuccucu

SEQ ID NO: 1987560 - RNA, 14 nt, Human
ccccucuuccucuu

SEQ ID NO: 1987561 - RNA, 15 nt, Human
ccccucuuccucuug

SEQ ID NO: 1987562 - RNA, 19 nt, Human
ccccucuuccucuugaccc

SEQ ID NO: 1987563 - RNA, 22 nt, Human
ccccucuuccucuugacccugc

SEQ ID NO: 1987564 - RNA, 12 nt, Human
ccccucuucccu

SEQ ID NO: 1987565 - RNA, 16 nt, Human
ccccuugccagcugcu

SEQ ID NO: 1987566 - RNA, 19 nt, Human
ccccuugccagcugcugag

SEQ ID NO: 1987567 - RNA, 21 nt, Human
ccccuugccagcugcugagcc

SEQ ID NO: 1987568 - RNA, 15 nt, Human
ccccuuucuuccuca

SEQ ID NO: 1987569 - RNA, 14 nt, Human
cccgaauagcuggg

SEQ ID NO: 1987570 - RNA, 21 nt, Human
cccgaaagaggcacccuucca

SEQ ID NO: 1987571 - RNA, 22 nt, Human
cccgaaagaggcacccuuccau

SEQ ID NO: 1987572 - RNA, 24 nt, Human
cccgaaagaggcacccuuccaucu

SEQ ID NO: 1987573 - RNA, 17 nt, Human
cccgaaaggucaccuca

SEQ ID NO: 1987574 - RNA, 19 nt, Human
cccgaaaggucaccucacu

SEQ ID NO: 1987575 - RNA, 20 nt, Human
cccgaaaggucaccucacuc

SEQ ID NO: 1987576 - RNA, 21 nt, Human
cccgaaaggucaccucacuca

SEQ ID NO: 1987577 - RNA, 14 nt, Human
cccggccaccugcg

SEQ ID NO: 1987578 - RNA, 13 nt, Human
cccggccaccugc

SEQ ID NO: 1987579 - RNA, 11 nt, Human
cccggcuccag

SEQ ID NO: 1987580 - RNA, 12 nt, Human
cccggcuccagg

SEQ ID NO: 1987581 - RNA, 13 nt, Human
cccggcuccaggc

SEQ ID NO: 1987582 - RNA, 14 nt, Human
cccggcuccaggcu

SEQ ID NO: 1987583 - RNA, 15 nt, Human
cccggcuccaggcuc

SEQ ID NO: 1987584 - RNA, 16 nt, Human
cccggcuccaggcucc

SEQ ID NO: 1987585 - RNA, 17 nt, Human
cccggccaccugcggug

SEQ ID NO: 1987586 - RNA, 13 nt, Human
cccgggacucugc

SEQ ID NO: 1987587 - RNA, 23 nt, Human
cccgggaggcagagguugcagug

SEQ ID NO: 1987588 - RNA, 18 nt, Human
cccuauuagagaagagau

SEQ ID NO: 1987589 - RNA, 17 nt, Human
cccuauugguaaagaau

SEQ ID NO: 1987590 - RNA, 19 nt, Human
ccccucuggcuccagcugg

SEQ ID NO: 1987591 - RNA, 21 nt, Human
ccccagacuccaccaagccug

SEQ ID NO: 1987592 - RNA, 20 nt, Human
ccccagacuccaccaagccu

SEQ ID NO: 1987593 - RNA, 23 nt, Human
ccccaaaacucuccucugcugcu

SEQ ID NO: 1987594 - RNA, 22 nt, Human
cccauuguggucacaggaagua

SEQ ID NO: 1987595 - RNA, 23 nt, Human
cccauuguggucacaggaaguag

SEQ ID NO: 1987596 - RNA, 22 nt, Human
ccccaaaacucuccucugcugc

SEQ ID NO: 1987597 - RNA, 22 nt, Human
cccccaaauggaaaugggcaga

SEQ ID NO: 1987598 - RNA, 23 nt, Human
ccccgacccuugccgucuaccug

SEQ ID NO: 1987599 - RNA, 21 nt, Human
ccccagcaagugagagcuggg

SEQ ID NO: 1987600 - RNA, 22 nt, Human
ccccagcaagugagagcugggu

SEQ ID NO: 1987601 - RNA, 23 nt, Human
ccccgaggccuucucugaaggac

SEQ ID NO: 1987602 - RNA, 13 nt, Human
cccauccuccagg

SEQ ID NO: 1987603 - RNA, 13 nt, Human
cccauccucugua

SEQ ID NO: 1987604 - RNA, 16 nt, Human
cccaggaaaggcccag

SEQ ID NO: 1987605 - RNA, 22 nt, Human
cccagcuugggcagaucuccca

SEQ ID NO: 1987606 - RNA, 15 nt, Human
cccagcuugaaaccu

SEQ ID NO: 1987607 - RNA, 18 nt, Human
cccagcuuccagcaggag

SEQ ID NO: 1987608 - RNA, 19 nt, Human
cccagcuuccagcaggagg

SEQ ID NO: 1987609 - RNA, 16 nt, Human
cccagcuucucagcuc

SEQ ID NO: 1987610 - RNA, 14 nt, Human
cccagcuugggcag

SEQ ID NO: 1987611 - RNA, 17 nt, Human
cccagcuucacuucuga

SEQ ID NO: 1987612 - RNA, 22 nt, Human
cccagcuucacuucugacucuu

SEQ ID NO: 1987613 - RNA, 13 nt, Human
cccagcuuccagc

SEQ ID NO: 1987614 - RNA, 15 nt, Human
cccagcuuccagcag

SEQ ID NO: 1987615 - RNA, 16 nt, Human
cccagcuuccagcagg

SEQ ID NO: 1987616 - RNA, 17 nt, Human
cccagcuuccagcagga

SEQ ID NO: 1987617 - RNA, 19 nt, Human
cccaggcuggagugcagug

SEQ ID NO: 1987618 - RNA, 18 nt, Human
cccaggcuggagugcagu

SEQ ID NO: 1987619 - RNA, 13 nt, Human
cccaggcuggcgu

SEQ ID NO: 1987620 - RNA, 17 nt, Human
cccaggcuggcgugcag

SEQ ID NO: 1987621 - RNA, 20 nt, Human
cccauauuuguacaccaaua

SEQ ID NO: 1987622 - RNA, 23 nt, Human
cccagcucugguccauagagagc

SEQ ID NO: 1987623 - RNA, 14 nt, Human
cccagccacucccc

SEQ ID NO: 1987624 - RNA, 15 nt, Human
cccagccacucccca

SEQ ID NO: 1987625 - RNA, 16 nt, Human
cccagccacuccccag

SEQ ID NO: 1987626 - RNA, 12 nt, Human
cccagcugcacc

SEQ ID NO: 1987627 - RNA, 13 nt, Human
cccagcugcaccc

SEQ ID NO: 1987628 - RNA, 18 nt, Human
cccagcugcaccccuucc

SEQ ID NO: 1987629 - RNA, 20 nt, Human
cccagcugcaccccuuccug

SEQ ID NO: 1987630 - RNA, 22 nt, Human
cccacugcuuuuggucugugug

SEQ ID NO: 1987631 - RNA, 19 nt, Human
cccacugcuuuuggucugu

SEQ ID NO: 1987632 - RNA, 12 nt, Human
cccacugcucug

SEQ ID NO: 1987633 - RNA, 13 nt, Human
cccacugcucugg

SEQ ID NO: 1987634 - RNA, 20 nt, Human
cccacugugcguggggcucc

SEQ ID NO: 1987635 - RNA, 21 nt, Human
cccacccugcuuggcccaggg

SEQ ID NO: 1987636 - RNA, 20 nt, Human
cccacccugcuuggcccagg

SEQ ID NO: 1987637 - RNA, 18 nt, Human
cccacuagacccacugga

SEQ ID NO: 1987638 - RNA, 18 nt, Human
cccacuccaagccagcaa

SEQ ID NO: 1987639 - RNA, 22 nt, Human
cccacccaagggccuggccuga

SEQ ID NO: 1987640 - RNA, 21 nt, Human
cccacccaagggccuggccug

SEQ ID NO: 1987641 - RNA, 20 nt, Human
cccacccaagggccuggccu

SEQ ID NO: 1987642 - RNA, 18 nt, Human
cccacccugaaagcccug

SEQ ID NO: 1987643 - RNA, 11 nt, Human
cccacccugcu

SEQ ID NO: 1987644 - RNA, 17 nt, Human
cccacccccacccaagg

SEQ ID NO: 1987645 - RNA, 15 nt, Human
cccacccccacccaa

SEQ ID NO: 1987646 - RNA, 12 nt, Human
cccacccccacc

SEQ ID NO: 1987647 - RNA, 15 nt, Human
ccaguucagcuuggg

SEQ ID NO: 1987648 - RNA, 17 nt, Human
ccaguuggguggaugcc

SEQ ID NO: 1987649 - RNA, 19 nt, Human
ccaguuggguggaugccug

SEQ ID NO: 1987650 - RNA, 20 nt, Human
ccaguuggguggaugccugg

SEQ ID NO: 1987651 - RNA, 20 nt, Human
ccaucccugaaggccccgcc

SEQ ID NO: 1987652 - RNA, 17 nt, Human
ccaucccugaaggcccc

SEQ ID NO: 1987653 - RNA, 15 nt, Human
ccaucccugaaggcc

SEQ ID NO: 1987654 - RNA, 14 nt, Human
ccaucccugaaggc

SEQ ID NO: 1987655 - RNA, 15 nt, Human
ccaugaauguuccug

SEQ ID NO: 1987656 - RNA, 13 nt, Human
ccaucccagcccc

SEQ ID NO: 1987657 - RNA, 15 nt, Human
ccaucccagccccaa

SEQ ID NO: 1987658 - RNA, 14 nt, Human
ccaucccagcccca

SEQ ID NO: 1987659 - RNA, 23 nt, Human
ccaguuggucccccuuccaugga

SEQ ID NO: 1987660 - RNA, 21 nt, Human
ccaguuguuagauuaagaaau

SEQ ID NO: 1987661 - RNA, 18 nt, Human
ccaguuuauuccagagcu

SEQ ID NO: 1987662 - RNA, 21 nt, Human
ccaugagccucagcauccugg

SEQ ID NO: 1987663 - RNA, 23 nt, Human
ccaugagccucagcauccuggca

SEQ ID NO: 1987664 - RNA, 20 nt, Human
ccauggucggaaaacaugcu

SEQ ID NO: 1987665 - RNA, 11 nt, Human
ccauguaugca

SEQ ID NO: 1987666 - RNA, 15 nt, Human
ccauguaugcauaau

SEQ ID NO: 1987667 - RNA, 14 nt, Human
ccauguauggccag

SEQ ID NO: 1987668 - RNA, 15 nt, Human
ccauguauggccagg

SEQ ID NO: 1987669 - RNA, 18 nt, Human
ccauguauggccaggaag

SEQ ID NO: 1987670 - RNA, 21 nt, Human
ccauguauggccaggaaguag

SEQ ID NO: 1987671 - RNA, 16 nt, Human
ccaggcacugcugccc

SEQ ID NO: 1987672 - RNA, 18 nt, Human
ccaggcacugcugcccag

SEQ ID NO: 1987673 - RNA, 13 nt, Human
ccaggcaccuccc

SEQ ID NO: 1987674 - RNA, 20 nt, Human
ccaggcacaggcagggcagg

SEQ ID NO: 1987675 - RNA, 18 nt, Human
ccaggcacaggcagggca

SEQ ID NO: 1987676 - RNA, 19 nt, Human
ccaggcacaggcagggcag

SEQ ID NO: 1987677 - RNA, 14 nt, Human
ccaggcacaggcag

SEQ ID NO: 1987678 - RNA, 15 nt, Human
ccaggcacaggcagg

SEQ ID NO: 1987679 - RNA, 16 nt, Human
ccaggcacaggcaggg

SEQ ID NO: 1987680 - RNA, 17 nt, Human
ccaggcacaggcagggc

SEQ ID NO: 1987681 - RNA, 12 nt, Human
ccaggcacaggc

SEQ ID NO: 1987682 - RNA, 13 nt, Human
ccaggcacaggca

SEQ ID NO: 1987683 - RNA, 17 nt, Human
ccaggggugggacaccc

SEQ ID NO: 1987684 - RNA, 14 nt, Human
ccaggggugggaca

SEQ ID NO: 1987685 - RNA, 19 nt, Human
ccaggggugggacacccug

SEQ ID NO: 1987686 - RNA, 23 nt, Human
ccaggggugggacacccugugau

SEQ ID NO: 1987687 - RNA, 13 nt, Human
ccaggggugggac

SEQ ID NO: 1987688 - RNA, 20 nt, Human
ccaggggaaaaucagccugc

SEQ ID NO: 1987689 - RNA, 21 nt, Human
ccagggcuggggcagccucug

SEQ ID NO: 1987690 - RNA, 22 nt, Human
ccagggcuggggcagccucugg

SEQ ID NO: 1987691 - RNA, 19 nt, Human
ccaggggaaaaucagccug

SEQ ID NO: 1987692 - RNA, 20 nt, Human
ccaggcuccuuuagcgccca

SEQ ID NO: 1987693 - RNA, 21 nt, Human
ccaggcuccuuuagcgcccag

SEQ ID NO: 1987694 - RNA, 16 nt, Human
ccaggcuggcgugcag

SEQ ID NO: 1987695 - RNA, 18 nt, Human
ccagggcuggggcagccu

SEQ ID NO: 1987696 - RNA, 19 nt, Human
ccaggcuggcgugcagugg

SEQ ID NO: 1987697 - RNA, 17 nt, Human
ccaggcuggcgugcagu

SEQ ID NO: 1987698 - RNA, 18 nt, Human
ccaggcuggcgugcagug

SEQ ID NO: 1987699 - RNA, 13 nt, Human
ccagggucccugg

SEQ ID NO: 1987700 - RNA, 18 nt, Human
ccagaugcaccagcccuu

SEQ ID NO: 1987701 - RNA, 17 nt, Human
ccagaugcaccagcccu

SEQ ID NO: 1987702 - RNA, 15 nt, Human
ccagaugcaccagcc

SEQ ID NO: 1987703 - RNA, 21 nt, Human
ccagaguggggaugacaugca

SEQ ID NO: 1987704 - RNA, 23 nt, Human
ccagagucuagcguagugcagca

SEQ ID NO: 1987705 - RNA, 23 nt, Human
ccagaguccccccacucccagca

SEQ ID NO: 1987706 - RNA, 22 nt, Human
ccagagucuagcguagugcagc

SEQ ID NO: 1987707 - RNA, 12 nt, Human
ccagauccuggg

SEQ ID NO: 1987708 - RNA, 20 nt, Human
ccagagggccugcaagggag

SEQ ID NO: 1987709 - RNA, 21 nt, Human
ccagaguccccccacucccag

SEQ ID NO: 1987710 - RNA, 22 nt, Human
ccagaguccccccacucccagc

SEQ ID NO: 1987711 - RNA, 19 nt, Human
ccagagggccugcaaggga

SEQ ID NO: 1987712 - RNA, 18 nt, Human
ccagagggccugcaaggg

SEQ ID NO: 1987713 - RNA, 17 nt, Human
ccagagggccugcaagg

SEQ ID NO: 1987714 - RNA, 16 nt, Human
ccaccuuggcucaagu

SEQ ID NO: 1987715 - RNA, 16 nt, Human
ccagcagccagccaaa

SEQ ID NO: 1987716 - RNA, 12 nt, Human
ccagcaggaggg

SEQ ID NO: 1987717 - RNA, 13 nt, Human
ccagcaggaggga

SEQ ID NO: 1987718 - RNA, 16 nt, Human
ccagcaggagggacag

SEQ ID NO: 1987719 - RNA, 20 nt, Human
ccagcaggagggacagucuc

SEQ ID NO: 1987720 - RNA, 15 nt, Human
ccagcaggcucucag

SEQ ID NO: 1987721 - RNA, 13 nt, Human
ccagcaggcucuc

SEQ ID NO: 1987722 - RNA, 12 nt, Human
ccagcagccagc

SEQ ID NO: 1987723 - RNA, 13 nt, Human
ccagcagccagcc

SEQ ID NO: 1987724 - RNA, 14 nt, Human
ccagcagccagcca

SEQ ID NO: 1987725 - RNA, 15 nt, Human
ccagcagccagccaa

SEQ ID NO: 1987726 - RNA, 13 nt, Human
ccaggaagccagc

SEQ ID NO: 1987727 - RNA, 12 nt, Human
ccaggaagccag

SEQ ID NO: 1987728 - RNA, 15 nt, Human
ccaggaaaggcucca

SEQ ID NO: 1987729 - RNA, 14 nt, Human
ccaggaaaggcucc

SEQ ID NO: 1987730 - RNA, 16 nt, Human
ccaggaaaggcuccag

SEQ ID NO: 1987731 - RNA, 12 nt, Human
ccagccccugga

SEQ ID NO: 1987732 - RNA, 11 nt, Human
ccagccccugg

SEQ ID NO: 1987733 - RNA, 12 nt, Human
ccagcaggccca

SEQ ID NO: 1987734 - RNA, 17 nt, Human
ccagcaggcccauggga

SEQ ID NO: 1987735 - RNA, 15 nt, Human
ccagcucaccagccc

SEQ ID NO: 1987736 - RNA, 16 nt, Human
ccagcucaccagcccc

SEQ ID NO: 1987737 - RNA, 16 nt, Human
ccagcuguucagcugg

SEQ ID NO: 1987738 - RNA, 22 nt, Human
ccagcucaccagccccagugcc

SEQ ID NO: 1987739 - RNA, 17 nt, Human
ccagcuguucagcuggu

SEQ ID NO: 1987740 - RNA, 19 nt, Human
ccagcuuaaaggggcuaga

SEQ ID NO: 1987741 - RNA, 21 nt, Human
cagggucucuaccauccccug

SEQ ID NO: 1987742 - RNA, 19 nt, Human
cagggucucuagugcugug

SEQ ID NO: 1987743 - RNA, 20 nt, Human
cagggucucuagugcuguga

SEQ ID NO: 1987744 - RNA, 21 nt, Human
cagggucucuagugcugugaa

SEQ ID NO: 1987745 - RNA, 22 nt, Human
cagggucucuagugcugugaaa

SEQ ID NO: 1987746 - RNA, 23 nt, Human
cagggucucuagugcugugaaaa

SEQ ID NO: 1987747 - RNA, 18 nt, Human
cagggugagcccaugugg

SEQ ID NO: 1987748 - RNA, 15 nt, Human
caggguuggccccug

SEQ ID NO: 1987749 - RNA, 16 nt, Human
caggguuggccccugc

SEQ ID NO: 1987750 - RNA, 23 nt, Human
cagggucucacucugucgcccag

SEQ ID NO: 1987751 - RNA, 15 nt, Human
caguauuugugggga

SEQ ID NO: 1987752 - RNA, 17 nt, Human
cagucaccccggccacc

SEQ ID NO: 1987753 - RNA, 16 nt, Human
cagucaccccggccac

SEQ ID NO: 1987754 - RNA, 14 nt, Human
cagucaccccggcc

SEQ ID NO: 1987755 - RNA, 13 nt, Human
caguauuuuagug

SEQ ID NO: 1987756 - RNA, 15 nt, Human
caguauuuuagugga

SEQ ID NO: 1987757 - RNA, 23 nt, Human
caguauuuuaguggacccugaaa

SEQ ID NO: 1987758 - RNA, 19 nt, Human
caguaaaugggggugcauu

SEQ ID NO: 1987759 - RNA, 18 nt, Human
caguaaaugggggugcau

SEQ ID NO: 1987760 - RNA, 20 nt, Human
caggguuucaccauguuggc

SEQ ID NO: 1987761 - RNA, 17 nt, Human
caggugcucaaaaugca

SEQ ID NO: 1987762 - RNA, 13 nt, Human
caggugcugccau

SEQ ID NO: 1987763 - RNA, 14 nt, Human
caggugcugccauc

SEQ ID NO: 1987764 - RNA, 17 nt, Human
caggguuggccccugcc

SEQ ID NO: 1987765 - RNA, 21 nt, Human
caggguuggccccugcccggc

SEQ ID NO: 1987766 - RNA, 14 nt, Human
cagguucugaaaga

SEQ ID NO: 1987767 - RNA, 18 nt, Human
cagguucugaaagagucu

SEQ ID NO: 1987768 - RNA, 23 nt, Human
cagguucugaaagagucuuucuu

SEQ ID NO: 1987769 - RNA, 15 nt, Human
cagguugaagaccua

SEQ ID NO: 1987770 - RNA, 22 nt, Human
cagguugaagaccuaaccaggg

SEQ ID NO: 1987771 - RNA, 23 nt, Human
cagguugaagaccuaaccagggc

SEQ ID NO: 1987772 - RNA, 23 nt, Human
cagguuuuuggucugacccacug

SEQ ID NO: 1987773 - RNA, 16 nt, Human
cagguugacaggaggu

SEQ ID NO: 1987774 - RNA, 11 nt, Human
cagguugacag

SEQ ID NO: 1987775 - RNA, 20 nt, Human
cagggcuggggcagccucug

SEQ ID NO: 1987776 - RNA, 15 nt, Human
cagggcuggggcagc

SEQ ID NO: 1987777 - RNA, 19 nt, Human
cagggcuggggcagccucu

SEQ ID NO: 1987778 - RNA, 22 nt, Human
caggccugggggcugggcagag

SEQ ID NO: 1987779 - RNA, 20 nt, Human
caggccugggggcugggcag

SEQ ID NO: 1987780 - RNA, 20 nt, Human
caggcugggagagccuucca

SEQ ID NO: 1987781 - RNA, 19 nt, Human
caggcugggagagccuucc

SEQ ID NO: 1987782 - RNA, 18 nt, Human
caggcugggagagccuuc

SEQ ID NO: 1987783 - RNA, 16 nt, Human
caggcugggagagccu

SEQ ID NO: 1987784 - RNA, 23 nt, Human
caggccugggggcugggcagagg

SEQ ID NO: 1987785 - RNA, 17 nt, Human
caggcuggcgugcagug

SEQ ID NO: 1987786 - RNA, 18 nt, Human
caggcuggcgugcagugg

SEQ ID NO: 1987787 - RNA, 19 nt, Human
caggcuggcgugcaguggu

SEQ ID NO: 1987788 - RNA, 14 nt, Human
caggcugggcuuca

SEQ ID NO: 1987789 - RNA, 12 nt, Human
caggcugggcug

SEQ ID NO: 1987790 - RNA, 13 nt, Human
caggcugggcugg

SEQ ID NO: 1987791 - RNA, 14 nt, Human
caggcugggcuggg

SEQ ID NO: 1987792 - RNA, 16 nt, Human
caggcugggcugggca

SEQ ID NO: 1987793 - RNA, 17 nt, Human
caggcugggcugggcac

SEQ ID NO: 1987794 - RNA, 19 nt, Human
caggcugggcugggcacug

SEQ ID NO: 1987795 - RNA, 22 nt, Human
cagggaggacgcucucuggccu

SEQ ID NO: 1987796 - RNA, 15 nt, Human
caggcugggcuucag

SEQ ID NO: 1987797 - RNA, 21 nt, Human
caggcugggcugggcacugcu

SEQ ID NO: 1987798 - RNA, 20 nt, Human
cagggcucagcggggacagc

SEQ ID NO: 1987799 - RNA, 12 nt, Human
cagggcucagcg

SEQ ID NO: 1987800 - RNA, 15 nt, Human
cagggcucagcgggg

SEQ ID NO: 1987801 - RNA, 16 nt, Human
cagggagggcuucugc

SEQ ID NO: 1987802 - RNA, 17 nt, Human
cagggagggccugggcc

SEQ ID NO: 1987803 - RNA, 18 nt, Human
cagggagggccugggccc

SEQ ID NO: 1987804 - RNA, 22 nt, Human
caggaaaggcuccaggagcagc

SEQ ID NO: 1987805 - RNA, 21 nt, Human
caggaaaggcuccaggagcag

SEQ ID NO: 1987806 - RNA, 23 nt, Human
caggaaaggcuccaggagcagcc

SEQ ID NO: 1987807 - RNA, 19 nt, Human
caggaaaagcugcugacag

SEQ ID NO: 1987808 - RNA, 20 nt, Human
caggaaaagcugcugacagu

SEQ ID NO: 1987809 - RNA, 16 nt, Human
cagcuuauucacaaga

SEQ ID NO: 1987810 - RNA, 17 nt, Human
cagcuuauucacaagac

SEQ ID NO: 1987811 - RNA, 23 nt, Human
cagcuguguccggcccaguuuug

SEQ ID NO: 1987812 - RNA, 15 nt, Human
cagcuguucagcugg

SEQ ID NO: 1987813 - RNA, 16 nt, Human
cagcuguucagcuggu

SEQ ID NO: 1987814 - RNA, 19 nt, Human
cagcuguucagcugguuga

SEQ ID NO: 1987815 - RNA, 21 nt, Human
caggaaaguggcaccugucug

SEQ ID NO: 1987816 - RNA, 22 nt, Human
caggaaaguggcaccugucugc

SEQ ID NO: 1987817 - RNA, 15 nt, Human
caggccagcugccuc

SEQ ID NO: 1987818 - RNA, 16 nt, Human
caggccaggcccucug

SEQ ID NO: 1987819 - RNA, 15 nt, Human
caggccaggcccucu

SEQ ID NO: 1987820 - RNA, 14 nt, Human
caggccaggcccuc

SEQ ID NO: 1987821 - RNA, 13 nt, Human
caggccaggcccu

SEQ ID NO: 1987822 - RNA, 15 nt, Human
caggccagcugcuug

SEQ ID NO: 1987823 - RNA, 13 nt, Human
caggccagcugcu

SEQ ID NO: 1987824 - RNA, 23 nt, Human
caggcacugcugcccagccucca

SEQ ID NO: 1987825 - RNA, 16 nt, Human
caggccacccugugca

SEQ ID NO: 1987826 - RNA, 17 nt, Human
caggccacccugugcag

SEQ ID NO: 1987827 - RNA, 21 nt, Human
caggcaaugcuggcuguuggc

SEQ ID NO: 1987828 - RNA, 14 nt, Human
caggaggcagaagg

SEQ ID NO: 1987829 - RNA, 17 nt, Human
caggaggccaagguggg

SEQ ID NO: 1987830 - RNA, 16 nt, Human
caggcacugcugccca

SEQ ID NO: 1987831 - RNA, 17 nt, Human
caggcacugcugcccag

SEQ ID NO: 1987832 - RNA, 13 nt, Human
caggaggccagcc

SEQ ID NO: 1987833 - RNA, 12 nt, Human
caggaggccagc

SEQ ID NO: 1987834 - RNA, 19 nt, Human
caggcaaugcuggcuguug

SEQ ID NO: 1987835 - RNA, 20 nt, Human
caggcaaugcuggcuguugg

SEQ ID NO: 1987836 - RNA, 17 nt, Human
caggacaggagaugcug

SEQ ID NO: 1987837 - RNA, 21 nt, Human
caggacaggagaugcugugcc

SEQ ID NO: 1987838 - RNA, 15 nt, Human
caggacagggguucc

SEQ ID NO: 1987839 - RNA, 16 nt, Human
caggacagggguuccu

SEQ ID NO: 1987840 - RNA, 17 nt, Human
caggacagggguuccuu

SEQ ID NO: 1987841 - RNA, 21 nt, Human
caggacagggguuccuucugg

SEQ ID NO: 1987842 - RNA, 12 nt, Human
caggacccugcc

SEQ ID NO: 1987843 - RNA, 13 nt, Human
caggacccugcca

SEQ ID NO: 1987844 - RNA, 14 nt, Human
caggacccugccag

SEQ ID NO: 1987845 - RNA, 15 nt, Human
caggacccugccagg

SEQ ID NO: 1987846 - RNA, 22 nt, Human
caggacccugccaggcacaggc

SEQ ID NO: 1987847 - RNA, 20 nt, Human
caggacccugccaggcacag

SEQ ID NO: 1987848 - RNA, 21 nt, Human
caggacccugccaggcacagg

SEQ ID NO: 1987849 - RNA, 16 nt, Human
caggacccugccaggc

SEQ ID NO: 1987850 - RNA, 17 nt, Human
caggacccugccaggca

SEQ ID NO: 1987851 - RNA, 18 nt, Human
caggacccugccaggcac

SEQ ID NO: 1987852 - RNA, 19 nt, Human
caggacccugccaggcaca

SEQ ID NO: 1987853 - RNA, 21 nt, Human
caggaccagggauuuccauga

SEQ ID NO: 1987854 - RNA, 13 nt, Human
caggaccagggau

SEQ ID NO: 1987855 - RNA, 15 nt, Human
caggaggcaggaccu

SEQ ID NO: 1987856 - RNA, 18 nt, Human
caggaggcaggaccuucg

SEQ ID NO: 1987857 - RNA, 13 nt, Human
caggaccucaggu

SEQ ID NO: 1987858 - RNA, 16 nt, Human
cagaucauugugaaau

SEQ ID NO: 1987859 - RNA, 22 nt, Human
cagauacuacugaccagacaag

SEQ ID NO: 1987860 - RNA, 18 nt, Human
cagauacuacugaccaga

SEQ ID NO: 1987861 - RNA, 15 nt, Human
cagauaccaagcaug

SEQ ID NO: 1987862 - RNA, 22 nt, Human
cagaucauugugaaauuauuca

SEQ ID NO: 1987863 - RNA, 23 nt, Human
cagauacaggaaaagcugcugac

SEQ ID NO: 1987864 - RNA, 16 nt, Human
cagagcugcgggcugg

SEQ ID NO: 1987865 - RNA, 16 nt, Human
cagagcugcuuccccg

SEQ ID NO: 1987866 - RNA, 22 nt, Human
cagagcugcggugucucccugc

SEQ ID NO: 1987867 - RNA, 22 nt, Human
cagagcuacacaggggaaaaga

SEQ ID NO: 1987868 - RNA, 17 nt, Human
cagagcuacacagggga

SEQ ID NO: 1987869 - RNA, 16 nt, Human
cagagcgacagagcag

SEQ ID NO: 1987870 - RNA, 16 nt, Human
cagagagggugggagu

SEQ ID NO: 1987871 - RNA, 15 nt, Human
cagagaggcuguggu

SEQ ID NO: 1987872 - RNA, 22 nt, Human
cagagagggugggagugggccc

SEQ ID NO: 1987873 - RNA, 20 nt, Human
cagagagggugggagugggc

SEQ ID NO: 1987874 - RNA, 14 nt, Human
cagagccugcaguu

SEQ ID NO: 1987875 - RNA, 13 nt, Human
cagagccugcccc

SEQ ID NO: 1987876 - RNA, 14 nt, Human
cagagccugcccca

SEQ ID NO: 1987877 - RNA, 19 nt, Human
cagagccugccccagcgcu

SEQ ID NO: 1987878 - RNA, 15 nt, Human
cagagccugccccag

SEQ ID NO: 1987879 - RNA, 17 nt, Human
cagagccugccccagcg

SEQ ID NO: 1987880 - RNA, 20 nt, Human
cagagacuccugcaggcagc

SEQ ID NO: 1987881 - RNA, 22 nt, Human
cagagacuccugcaggcagcca

SEQ ID NO: 1987882 - RNA, 21 nt, Human
cagagacuccugcaggcagcc

SEQ ID NO: 1987883 - RNA, 23 nt, Human
cagagacuccugcaggcagccag

SEQ ID NO: 1987884 - RNA, 19 nt, Human
cagagagagauacucuggg

SEQ ID NO: 1987885 - RNA, 12 nt, Human
cagagagcauua

SEQ ID NO: 1987886 - RNA, 19 nt, Human
cagcguuucuaugacacau

SEQ ID NO: 1987887 - RNA, 16 nt, Human
cagcguuucuaugaca

SEQ ID NO: 1987888 - RNA, 14 nt, Human
cagcguuucuauga

SEQ ID NO: 1987889 - RNA, 11 nt, Human
cagccugccac

SEQ ID NO: 1987890 - RNA, 12 nt, Human
cagccugccacu

SEQ ID NO: 1987891 - RNA, 16 nt, Human
cagccugccacucagg

SEQ ID NO: 1987892 - RNA, 17 nt, Human
cagccugccacucaggc

SEQ ID NO: 1987893 - RNA, 21 nt, Human
cagccugccuugcccacuccu

SEQ ID NO: 1987894 - RNA, 23 nt, Human
cagccugcacuugggggcucagc

SEQ ID NO: 1987895 - RNA, 18 nt, Human
cagccugccuugcccacu

SEQ ID NO: 1987896 - RNA, 17 nt, Human
cagcggcuggaauuggg

SEQ ID NO: 1987897 - RNA, 16 nt, Human
cagcggcuggacuugg

SEQ ID NO: 1987898 - RNA, 18 nt, Human
cagcggcuggacuuggag

SEQ ID NO: 1987899 - RNA, 16 nt, Human
cagcgggaauggcagc

SEQ ID NO: 1987900 - RNA, 22 nt, Human
cagcgggaauggcagcugccac

SEQ ID NO: 1987901 - RNA, 23 nt, Human
cagcgggaauggcagcugccacg

SEQ ID NO: 1987902 - RNA, 14 nt, Human
cagcggggacagcu

SEQ ID NO: 1987903 - RNA, 23 nt, Human
cagccugagcgacagugagacuc

SEQ ID NO: 1987904 - RNA, 13 nt, Human
cagcccuuagcag

SEQ ID NO: 1987905 - RNA, 23 nt, Human
cagccgccaugcuccuggcccac

SEQ ID NO: 1987906 - RNA, 13 nt, Human
cagccgcuccaga

SEQ ID NO: 1987907 - RNA, 14 nt, Human
cagccgcuccagag

SEQ ID NO: 1987908 - RNA, 18 nt, Human
cagccgcuccagagucag

SEQ ID NO: 1987909 - RNA, 18 nt, Human
cagccgccuucacagcag

SEQ ID NO: 1987910 - RNA, 20 nt, Human
cagccgccuucacagcaguc

SEQ ID NO: 1987911 - RNA, 13 nt, Human
cagccgccuucac

SEQ ID NO: 1987912 - RNA, 19 nt, Human
cagccccgugggguuccuc

SEQ ID NO: 1987913 - RNA, 13 nt, Human
cagcccccugguc

SEQ ID NO: 1987914 - RNA, 13 nt, Human
cagccccugcaca

SEQ ID NO: 1987915 - RNA, 18 nt, Human
cagccccucccuccucug

SEQ ID NO: 1987916 - RNA, 21 nt, Human
cagccccucccuccucugaga

SEQ ID NO: 1987917 - RNA, 19 nt, Human
cagccccauucugccugcc

SEQ ID NO: 1987918 - RNA, 20 nt, Human
cagccccauucugccugccc

SEQ ID NO: 1987919 - RNA, 22 nt, Human
cagccccauucugccugcccag

SEQ ID NO: 1987920 - RNA, 23 nt, Human
cagccccauucugccugcccagg

SEQ ID NO: 1987921 - RNA, 24 nt, Human
cagccccauucugccugcccaggc

SEQ ID NO: 1987922 - RNA, 18 nt, Human
cagauuucacucuccuug

SEQ ID NO: 1987923 - RNA, 16 nt, Human
cagauuucacucuccu

SEQ ID NO: 1987924 - RNA, 15 nt, Human
cagauuucacucucc

SEQ ID NO: 1987925 - RNA, 13 nt, Human
cagauuucacucu

SEQ ID NO: 1987926 - RNA, 13 nt, Human
cagauuugagcuc

SEQ ID NO: 1987927 - RNA, 14 nt, Human
cagauuugagcuca

SEQ ID NO: 1987928 - RNA, 16 nt, Human
cagauuugagcucagc

SEQ ID NO: 1987929 - RNA, 13 nt, Human
cagauuugcacaa

SEQ ID NO: 1987930 - RNA, 14 nt, Human
cagauuugcacaaa

SEQ ID NO: 1987931 - RNA, 17 nt, Human
cagauuugcacaaaaag

SEQ ID NO: 1987932 - RNA, 20 nt, Human
cagauuugcacaaaaagaua

SEQ ID NO: 1987933 - RNA, 13 nt, Human
cagauuuggaaag

SEQ ID NO: 1987934 - RNA, 21 nt, Human
cagauuggauuuuauguugac

SEQ ID NO: 1987935 - RNA, 23 nt, Human
cagauuggauuuuauguugacau

SEQ ID NO: 1987936 - RNA, 12 nt, Human
cagauuggauuu

SEQ ID NO: 1987937 - RNA, 15 nt, Human
cagauuggauuuuau

SEQ ID NO: 1987938 - RNA, 19 nt, Human
cagauugcugaauggaguu

SEQ ID NO: 1987939 - RNA, 21 nt, Human
cagauugcaacaggcugggcu

SEQ ID NO: 1987940 - RNA, 24 nt, Human
cagcacauaggguucccacgaagc

SEQ ID NO: 1987941 - RNA, 18 nt, Human
cagcauauucaggaagcu

SEQ ID NO: 1987942 - RNA, 17 nt, Human
cagcauauucaggaagc

SEQ ID NO: 1987943 - RNA, 16 nt, Human
cagcauauucaggaag

SEQ ID NO: 1987944 - RNA, 22 nt, Human
cauggcuggagcuagaauuuga

SEQ ID NO: 1987945 - RNA, 22 nt, Human
cauggcugccaaugggagcuca

SEQ ID NO: 1987946 - RNA, 19 nt, Human
cauggcgaaaacaucuccu

SEQ ID NO: 1987947 - RNA, 21 nt, Human
cauguucccacuucaaaacaa

SEQ ID NO: 1987948 - RNA, 21 nt, Human
cauggcgaaaacaucuccuua

SEQ ID NO: 1987949 - RNA, 15 nt, Human
cauuaggauggcuag

SEQ ID NO: 1987950 - RNA, 12 nt, Human
cauuaucuagau

SEQ ID NO: 1987951 - RNA, 16 nt, Human
cauuaucuagauacug

SEQ ID NO: 1987952 - RNA, 17 nt, Human
cauuaucuagauacugu

SEQ ID NO: 1987953 - RNA, 15 nt, Human
cauguucucugagga

SEQ ID NO: 1987954 - RNA, 18 nt, Human
cauuagcaguuugcuuug

SEQ ID NO: 1987955 - RNA, 16 nt, Human
cauucuccuuguguua

SEQ ID NO: 1987956 - RNA, 20 nt, Human
cauucuccuuagcuucuggc

SEQ ID NO: 1987957 - RNA, 18 nt, Human
cauuaucuagauacugua

SEQ ID NO: 1987958 - RNA, 13 nt, Human
cauuaugaugugu

SEQ ID NO: 1987959 - RNA, 13 nt, Human
cauucucaguuuu

SEQ ID NO: 1987960 - RNA, 15 nt, Human
cauucucaguuuuuc

SEQ ID NO: 1987961 - RNA, 18 nt, Human
cauucucaguuuuucuua

SEQ ID NO: 1987962 - RNA, 19 nt, Human
cauucucaguuuuucuuaa

SEQ ID NO: 1987963 - RNA, 20 nt, Human
cauucucaguuuuucuuaau

SEQ ID NO: 1987964 - RNA, 17 nt, Human
cauucucacuccuaccu

SEQ ID NO: 1987965 - RNA, 14 nt, Human
cauuauguuaauau

SEQ ID NO: 1987966 - RNA, 16 nt, Human
cauucucacuccuacc

SEQ ID NO: 1987967 - RNA, 18 nt, Human
cauugcugggcuugucug

SEQ ID NO: 1987968 - RNA, 14 nt, Human
cauugcggacagcc

SEQ ID NO: 1987969 - RNA, 15 nt, Human
cauugcggacagcca

SEQ ID NO: 1987970 - RNA, 17 nt, Human
cauugcggacagccacg

SEQ ID NO: 1987971 - RNA, 21 nt, Human
cauugcggacagccacggcca

SEQ ID NO: 1987972 - RNA, 21 nt, Human
cauugccugauuuguuccuuc

SEQ ID NO: 1987973 - RNA, 23 nt, Human
cauugccugauuuguuccuucug

SEQ ID NO: 1987974 - RNA, 22 nt, Human
cauuuggugguuucagaaaugu

SEQ ID NO: 1987975 - RNA, 23 nt, Human
cauuuggugguuucagaaaugug

SEQ ID NO: 1987976 - RNA, 23 nt, Human
cauuuuucuuagggaaggauaca

SEQ ID NO: 1987977 - RNA, 18 nt, Human
cauuuuugaauacaggca

SEQ ID NO: 1987978 - RNA, 20 nt, Human
cauuuuugaauacaggcaua

SEQ ID NO: 1987979 - RNA, 17 nt, Human
ccaaaacucuccucugc

SEQ ID NO: 1987980 - RNA, 17 nt, Human
ccaaaaaaugcuugcuu

SEQ ID NO: 1987981 - RNA, 14 nt, Human
cauugcuuaccuug

SEQ ID NO: 1987982 - RNA, 17 nt, Human
cauugcuuaccuugguu

SEQ ID NO: 1987983 - RNA, 22 nt, Human
cauuggcucuugaacugagcuu

SEQ ID NO: 1987984 - RNA, 16 nt, Human
cauuuauucugcucac

SEQ ID NO: 1987985 - RNA, 15 nt, Human
cauuucacugucugu

SEQ ID NO: 1987986 - RNA, 18 nt, Human
cauuucauuugugccaga

SEQ ID NO: 1987987 - RNA, 11 nt, Human
cauuucagaaa

SEQ ID NO: 1987988 - RNA, 17 nt, Human
cauuucagaaagccuuu

SEQ ID NO: 1987989 - RNA, 17 nt, Human
cauugggccauguuuaa

SEQ ID NO: 1987990 - RNA, 13 nt, Human
ccaaugccaaaaa

SEQ ID NO: 1987991 - RNA, 20 nt, Human
ccaauguucucucuucucca

SEQ ID NO: 1987992 - RNA, 22 nt, Human
ccaaugcacuuuguucuggcuc

SEQ ID NO: 1987993 - RNA, 20 nt, Human
ccaaugcacuuuguucuggc

SEQ ID NO: 1987994 - RNA, 23 nt, Human
ccaaugcacuuuguucuggcucu

SEQ ID NO: 1987995 - RNA, 14 nt, Human
ccaaugcagaacuc

SEQ ID NO: 1987996 - RNA, 20 nt, Human
ccaagcuggucccacucagu

SEQ ID NO: 1987997 - RNA, 22 nt, Human
ccaacuuucaagaacuuguuua

SEQ ID NO: 1987998 - RNA, 22 nt, Human
ccaagcuuaggguauuuuuccu

SEQ ID NO: 1987999 - RNA, 22 nt, Human
ccaaagugcugggauuacaggc

SEQ ID NO: 1988000 - RNA, 19 nt, Human
ccaaagugcugggauuaca

SEQ ID NO: 1988001 - RNA, 22 nt, Human
ccaaagugcugggauuacaggu

SEQ ID NO: 1988002 - RNA, 22 nt, Human
ccaaaugagggucuugguucca

SEQ ID NO: 1988003 - RNA, 18 nt, Human
ccaaauguucaucaauga

SEQ ID NO: 1988004 - RNA, 12 nt, Human
ccaaauuaagag

SEQ ID NO: 1988005 - RNA, 16 nt, Human
ccaacuuucaagaacu

SEQ ID NO: 1988006 - RNA, 19 nt, Human
ccaacuuucaagaacuugu

SEQ ID NO: 1988007 - RNA, 13 nt, Human
ccaacuugccuuu

SEQ ID NO: 1988008 - RNA, 11 nt, Human
ccaacuuguaa

SEQ ID NO: 1988009 - RNA, 14 nt, Human
ccaccagaagccca

SEQ ID NO: 1988010 - RNA, 15 nt, Human
ccaccagaagcccag

SEQ ID NO: 1988011 - RNA, 16 nt, Human
ccaccagaagcccaga

SEQ ID NO: 1988012 - RNA, 18 nt, Human
ccaccagaagcccagaau

SEQ ID NO: 1988013 - RNA, 17 nt, Human
ccaccaucaagccacca

SEQ ID NO: 1988014 - RNA, 16 nt, Human
ccaccaucaagccacc

SEQ ID NO: 1988015 - RNA, 11 nt, Human
ccaccagaagc

SEQ ID NO: 1988016 - RNA, 12 nt, Human
ccaccagaagcc

SEQ ID NO: 1988017 - RNA, 13 nt, Human
ccaccagaagccc

SEQ ID NO: 1988018 - RNA, 22 nt, Human
ccacacuucaggcucuucuccu

SEQ ID NO: 1988019 - RNA, 20 nt, Human
ccacccugcuuggcccaggg

SEQ ID NO: 1988020 - RNA, 17 nt, Human
ccaccgcagacaggacc

SEQ ID NO: 1988021 - RNA, 14 nt, Human
ccaccgcagacagg

SEQ ID NO: 1988022 - RNA, 20 nt, Human
ccaccaucaagccaccaaca

SEQ ID NO: 1988023 - RNA, 18 nt, Human
ccaccaucaccagacagg

SEQ ID NO: 1988024 - RNA, 13 nt, Human
ccacccugcucuc

SEQ ID NO: 1988025 - RNA, 17 nt, Human
ccacccugcuuggccca

SEQ ID NO: 1988026 - RNA, 18 nt, Human
ccacccugcuuggcccag

SEQ ID NO: 1988027 - RNA, 19 nt, Human
ccacccugcuuggcccagg

SEQ ID NO: 1988028 - RNA, 18 nt, Human
ccaccgcagacaggacca

SEQ ID NO: 1988029 - RNA, 19 nt, Human
ccaccgcagacaggaccag

SEQ ID NO: 1988030 - RNA, 23 nt, Human
ccaccgggcugggagcucugcag

SEQ ID NO: 1988031 - RNA, 13 nt, Human
ccaccguccccuc

SEQ ID NO: 1988032 - RNA, 14 nt, Human
ccaccguccccucc

SEQ ID NO: 1988033 - RNA, 14 nt, Human
ccaccuuggcucaa

SEQ ID NO: 1988034 - RNA, 15 nt, Human
ccaccuuggcucaag

SEQ ID NO: 1988035 - RNA, 14 nt, Human
caugacacgaauau

SEQ ID NO: 1988036 - RNA, 14 nt, Human
caugaauuugugaa

SEQ ID NO: 1988037 - RNA, 18 nt, Human
caugacacgaauauugcu

SEQ ID NO: 1988038 - RNA, 17 nt, Human
caugacacgaauauugc

SEQ ID NO: 1988039 - RNA, 18 nt, Human
caugcugcccugugagua

SEQ ID NO: 1988040 - RNA, 16 nt, Human
caugcugcccugugag

SEQ ID NO: 1988041 - RNA, 19 nt, Human
cauggccuuugcuugaaag

SEQ ID NO: 1988042 - RNA, 22 nt, Human
cauggccuuugcuugaaagaaa

SEQ ID NO: 1988043 - RNA, 14 nt, Human
caugcugccuccag

SEQ ID NO: 1988044 - RNA, 12 nt, Human
caugcugccucc

SEQ ID NO: 1988045 - RNA, 17 nt, Human
caugcaaggucauuuuu

SEQ ID NO: 1988046 - RNA, 18 nt, Human
caugcaaggucauuuuuu

SEQ ID NO: 1988047 - RNA, 20 nt, Human
caugauugcagaauuguuua

SEQ ID NO: 1988048 - RNA, 22 nt, Human
caugauugcagaauuguuuaga

SEQ ID NO: 1988049 - RNA, 16 nt, Human
caugcaaguauucuca

SEQ ID NO: 1988050 - RNA, 22 nt, Human
caugcaaggucauuuuuuuuaa

SEQ ID NO: 1988051 - RNA, 19 nt, Human
caucagcacgauuucuguu

SEQ ID NO: 1988052 - RNA, 13 nt, Human
caucaggccaggc

SEQ ID NO: 1988053 - RNA, 17 nt, Human
caucagcacgauuucug

SEQ ID NO: 1988054 - RNA, 18 nt, Human
caucagcacgauuucugu

SEQ ID NO: 1988055 - RNA, 23 nt, Human
cauccuggcacccggccccugcu

SEQ ID NO: 1988056 - RNA, 16 nt, Human
cauccugucaucugag

SEQ ID NO: 1988057 - RNA, 19 nt, Human
cauccugucaucugagaau

SEQ ID NO: 1988058 - RNA, 22 nt, Human
cauccccacguggacaagaaag

SEQ ID NO: 1988059 - RNA, 23 nt, Human
caucaggccaggcccucugccca

SEQ ID NO: 1988060 - RNA, 22 nt, Human
caucaggccaggcccucugccc

SEQ ID NO: 1988061 - RNA, 21 nt, Human
caucaggccaggcccucugcc

SEQ ID NO: 1988062 - RNA, 20 nt, Human
caucaggccaggcccucugc

SEQ ID NO: 1988063 - RNA, 14 nt, Human
caucaggccaggcc

SEQ ID NO: 1988064 - RNA, 14 nt, Human
caucccagccccaa

SEQ ID NO: 1988065 - RNA, 13 nt, Human
caucccagcccca

SEQ ID NO: 1988066 - RNA, 16 nt, Human
caucccagccccaaug

SEQ ID NO: 1988067 - RNA, 17 nt, Human
caucccagccccaauga

SEQ ID NO: 1988068 - RNA, 22 nt, Human
caucuuagguuggcaaaaaggc

SEQ ID NO: 1988069 - RNA, 21 nt, Human
caucuuagguuggcaaaaagg

SEQ ID NO: 1988070 - RNA, 11 nt, Human
caucugugaau

SEQ ID NO: 1988071 - RNA, 13 nt, Human
caucugugaauaa

SEQ ID NO: 1988072 - RNA, 19 nt, Human
caucugugaaaggaaagag

SEQ ID NO: 1988073 - RNA, 18 nt, Human
caucugugaaaggaaaga

SEQ ID NO: 1988074 - RNA, 12 nt, Human
caucgcaaugua

SEQ ID NO: 1988075 - RNA, 17 nt, Human
cauccuuucacuucuuu

SEQ ID NO: 1988076 - RNA, 19 nt, Human
cauccuuucacuucuuucc

SEQ ID NO: 1988077 - RNA, 20 nt, Human
cauccuuucacuucuuuccc

SEQ ID NO: 1988078 - RNA, 21 nt, Human
cauccuuucacuucuuucccu

SEQ ID NO: 1988079 - RNA, 18 nt, Human
cagucaccccggccaccu

SEQ ID NO: 1988080 - RNA, 13 nt, Human
caguuguuugaug

SEQ ID NO: 1988081 - RNA, 14 nt, Human
cauaaugcgugcau

SEQ ID NO: 1988082 - RNA, 17 nt, Human
cauaaugcgugcauacc

SEQ ID NO: 1988083 - RNA, 23 nt, Human
cauaaucuggacuccucugucca

SEQ ID NO: 1988084 - RNA, 21 nt, Human
cauaaucuggacuccucuguc

SEQ ID NO: 1988085 - RNA, 22 nt, Human
cauaaucuggacuccucugucc

SEQ ID NO: 1988086 - RNA, 20 nt, Human
cauaaucuggacuccucugu

SEQ ID NO: 1988087 - RNA, 19 nt, Human
cauaaucuggacuccucug

SEQ ID NO: 1988088 - RNA, 17 nt, Human
caguuuggcaaacucuc

SEQ ID NO: 1988089 - RNA, 12 nt, Human
caguuugcuuug

SEQ ID NO: 1988090 - RNA, 14 nt, Human
caguuugcuuugua

SEQ ID NO: 1988091 - RNA, 21 nt, Human
caguuugcuuuguaugcacuu

SEQ ID NO: 1988092 - RNA, 14 nt, Human
caguuuauauggaa

SEQ ID NO: 1988093 - RNA, 15 nt, Human
caguuuacugguuua

SEQ ID NO: 1988094 - RNA, 16 nt, Human
cauaggccugcuuugu

SEQ ID NO: 1988095 - RNA, 19 nt, Human
cauaggaaguuaaaagcac

SEQ ID NO: 1988096 - RNA, 17 nt, Human
cauaggaaguuagccuu

SEQ ID NO: 1988097 - RNA, 20 nt, Human
cauaggaaguuagccuuuau

SEQ ID NO: 1988098 - RNA, 17 nt, Human
cauauuaccacagacau

SEQ ID NO: 1988099 - RNA, 20 nt, Human
cauauuaccacagacauacu

SEQ ID NO: 1988100 - RNA, 21 nt, Human
cauauuaccacagacauacua

SEQ ID NO: 1988101 - RNA, 22 nt, Human
cauacaaaugcaucuuugaugu

SEQ ID NO: 1988102 - RNA, 15 nt, Human
cauacaauuccaaac

SEQ ID NO: 1988103 - RNA, 21 nt, Human
cauaaugcgugcauaccacuu

SEQ ID NO: 1988104 - RNA, 17 nt, Human
cauacaaacaagcauau

SEQ ID NO: 1988105 - RNA, 21 nt, Human
cauacaaacaagcauauaaaa

SEQ ID NO: 1988106 - RNA, 19 nt, Human
cauacaaaugcaucuuuga

SEQ ID NO: 1988107 - RNA, 20 nt, Human
cauacaaaugcaucuuugau

SEQ ID NO: 1988108 - RNA, 22 nt, Human
cauacacaagcgugucaggcug

SEQ ID NO: 1988109 - RNA, 14 nt, Human
cauagcauaggaca

SEQ ID NO: 1988110 - RNA, 14 nt, Human
cauagccaaaaugu

SEQ ID NO: 1988111 - RNA, 16 nt, Human
cauagccaaaauguga

SEQ ID NO: 1988112 - RNA, 12 nt, Human
cauagcccucac

SEQ ID NO: 1988113 - RNA, 15 nt, Human
cauagcccucacccu

SEQ ID NO: 1988114 - RNA, 19 nt, Human
cauagcccucacccugggg

SEQ ID NO: 1988115 - RNA, 17 nt, Human
cacacagcucuguccug

SEQ ID NO: 1988116 - RNA, 20 nt, Human
cacacagcucuguccuggga

SEQ ID NO: 1988117 - RNA, 14 nt, Human
cacaagagcccagg

SEQ ID NO: 1988118 - RNA, 15 nt, Human
cacaagcuccaagcu

SEQ ID NO: 1988119 - RNA, 14 nt, Human
cacaagcuccaagc

SEQ ID NO: 1988120 - RNA, 13 nt, Human
cacaagcuccaag

SEQ ID NO: 1988121 - RNA, 16 nt, Human
cacaagagcccaggcc

SEQ ID NO: 1988122 - RNA, 23 nt, Human
cacaagcugcacccucaggcagg

SEQ ID NO: 1988123 - RNA, 17 nt, Human
cacaagcugcacccuca

SEQ ID NO: 1988124 - RNA, 23 nt, Human
cacaagcuccaagcucccaggca

SEQ ID NO: 1988125 - RNA, 17 nt, Human
cacaagcuccaagcucc

SEQ ID NO: 1988126 - RNA, 17 nt, Human
cacaagagcccaggccu

SEQ ID NO: 1988127 - RNA, 11 nt, Human
caauggcagcc

SEQ ID NO: 1988128 - RNA, 12 nt, Human
caauggcagccu

SEQ ID NO: 1988129 - RNA, 15 nt, Human
caauucuugccaaau

SEQ ID NO: 1988130 - RNA, 20 nt, Human
caauggagacugucucaaga

SEQ ID NO: 1988131 - RNA, 22 nt, Human
cacaggcccuuccucuccacug

SEQ ID NO: 1988132 - RNA, 23 nt, Human
cacaggcccuuccucuccacugc

SEQ ID NO: 1988133 - RNA, 13 nt, Human
cacagccugcacu

SEQ ID NO: 1988134 - RNA, 14 nt, Human
cacagccugcacuu

SEQ ID NO: 1988135 - RNA, 22 nt, Human
cacagccugcacuugggggcuc

SEQ ID NO: 1988136 - RNA, 23 nt, Human
cacagccugcacuugggggcuca

SEQ ID NO: 1988137 - RNA, 18 nt, Human
cacaggggaaaagaggag

SEQ ID NO: 1988138 - RNA, 17 nt, Human
cacaggggaaaagagga

SEQ ID NO: 1988139 - RNA, 15 nt, Human
cacaggugcccgcca

SEQ ID NO: 1988140 - RNA, 17 nt, Human
cacaggggacacccaga

SEQ ID NO: 1988141 - RNA, 19 nt, Human
cacaggggaaaagaggagu

SEQ ID NO: 1988142 - RNA, 20 nt, Human
cacaguauuacuucugcuac

SEQ ID NO: 1988143 - RNA, 21 nt, Human
cacaguauuacuucugcuaca

SEQ ID NO: 1988144 - RNA, 18 nt, Human
cacaggugcccgccacca

SEQ ID NO: 1988145 - RNA, 14 nt, Human
cacagucagguuga

SEQ ID NO: 1988146 - RNA, 17 nt, Human
cacagucagguugaaga

SEQ ID NO: 1988147 - RNA, 22 nt, Human
cacagaaaauggaagacagcuc

SEQ ID NO: 1988148 - RNA, 20 nt, Human
cacagaaaauggaagacagc

SEQ ID NO: 1988149 - RNA, 19 nt, Human
cacagaaaauggaagacag

SEQ ID NO: 1988150 - RNA, 18 nt, Human
cacagaaaauggaagaca

SEQ ID NO: 1988151 - RNA, 22 nt, Human
cacacaugagcaucaggccagg

SEQ ID NO: 1988152 - RNA, 21 nt, Human
cacacaugagcaucaggccag

SEQ ID NO: 1988153 - RNA, 18 nt, Human
cacagacauacuaaccag

SEQ ID NO: 1988154 - RNA, 19 nt, Human
cacagaaaauucuucucca

SEQ ID NO: 1988155 - RNA, 23 nt, Human
cacagaaaauggaagacagcucu

SEQ ID NO: 1988156 - RNA, 13 nt, Human
cacagacccugcc

SEQ ID NO: 1988157 - RNA, 11 nt, Human
cacagccucug

SEQ ID NO: 1988158 - RNA, 19 nt, Human
cacagacauacuaaccagc

SEQ ID NO: 1988159 - RNA, 21 nt, Human
cacagacauacuaaccagcag

SEQ ID NO: 1988160 - RNA, 16 nt, Human
cacacagcucuguccu

SEQ ID NO: 1988161 - RNA, 18 nt, Human
cacacagugagucgagga

SEQ ID NO: 1988162 - RNA, 20 nt, Human
cacacaguauuacuucugcu

SEQ ID NO: 1988163 - RNA, 23 nt, Human
cacacaguauuacuucugcuaca

SEQ ID NO: 1988164 - RNA, 15 nt, Human
cacacauacacacac

SEQ ID NO: 1988165 - RNA, 21 nt, Human
cacacagugagucgaggacag

SEQ ID NO: 1988166 - RNA, 23 nt, Human
cacacagugagucgaggacaggg

SEQ ID NO: 1988167 - RNA, 20 nt, Human
cacacaugagcaucaggcca

SEQ ID NO: 1988168 - RNA, 14 nt, Human
cacacaucaucugu

SEQ ID NO: 1988169 - RNA, 15 nt, Human
cacacaucaucugua

SEQ ID NO: 1988170 - RNA, 21 nt, Human
cacacaucaucuguaagcugu

SEQ ID NO: 1988171 - RNA, 22 nt, Human
cacacaucaucuguaagcuguu

SEQ ID NO: 1988172 - RNA, 17 nt, Human
caauaaagcaauaagaa

SEQ ID NO: 1988173 - RNA, 19 nt, Human
caauaaagcagcguuucua

SEQ ID NO: 1988174 - RNA, 11 nt, Human
caauaaagcaa

SEQ ID NO: 1988175 - RNA, 16 nt, Human
caaggccaaaggaagc

SEQ ID NO: 1988176 - RNA, 15 nt, Human
caaggccaaaggaag

SEQ ID NO: 1988177 - RNA, 18 nt, Human
caaggccaaaggaagcac

SEQ ID NO: 1988178 - RNA, 17 nt, Human
caaggccaaaggaagca

SEQ ID NO: 1988179 - RNA, 16 nt, Human
caaguaugaauaaaga

SEQ ID NO: 1988180 - RNA, 17 nt, Human
caaguaguucuguauuu

SEQ ID NO: 1988181 - RNA, 18 nt, Human
caaguaguucuguauuug

SEQ ID NO: 1988182 - RNA, 19 nt, Human
caaguaguucuguauuuga

SEQ ID NO: 1988183 - RNA, 20 nt, Human
caaguaguucuguauuugaa

SEQ ID NO: 1988184 - RNA, 21 nt, Human
caaguaguucuguauuugaaa

SEQ ID NO: 1988185 - RNA, 23 nt, Human
caaguaguucuguauuugaaagu

SEQ ID NO: 1988186 - RNA, 17 nt, Human
caagucaagugaaaaag

SEQ ID NO: 1988187 - RNA, 13 nt, Human
caagucaagugaa

SEQ ID NO: 1988188 - RNA, 19 nt, Human
caaguaugaauaaagacac

SEQ ID NO: 1988189 - RNA, 21 nt, Human
caaguaugaauaaagacaccu

SEQ ID NO: 1988190 - RNA, 20 nt, Human
caagcugcacccucaggcag

SEQ ID NO: 1988191 - RNA, 18 nt, Human
caagcugcacccucaggc

SEQ ID NO: 1988192 - RNA, 14 nt, Human
caagcugcacccuc

SEQ ID NO: 1988193 - RNA, 13 nt, Human
caagcugcacccu

SEQ ID NO: 1988194 - RNA, 14 nt, Human
caagcucugcuccu

SEQ ID NO: 1988195 - RNA, 12 nt, Human
caagcuccaagc

SEQ ID NO: 1988196 - RNA, 13 nt, Human
caagcucugcucc

SEQ ID NO: 1988197 - RNA, 19 nt, Human
caagcucuaucaccaagga

SEQ ID NO: 1988198 - RNA, 14 nt, Human
caagcucacuugcu

SEQ ID NO: 1988199 - RNA, 18 nt, Human
caagcucacuugcuuuag

SEQ ID NO: 1988200 - RNA, 18 nt, Human
cacugggaaacagaggcu

SEQ ID NO: 1988201 - RNA, 13 nt, Human
cacugggaaacag

SEQ ID NO: 1988202 - RNA, 18 nt, Human
cacugggagaaaugaaaa

SEQ ID NO: 1988203 - RNA, 16 nt, Human
cacugcauguuuguga

SEQ ID NO: 1988204 - RNA, 14 nt, Human
cacugcauccuccg

SEQ ID NO: 1988205 - RNA, 16 nt, Human
cacugcauccuccgcc

SEQ ID NO: 1988206 - RNA, 21 nt, Human
cacugcagaacagcuucaugu

SEQ ID NO: 1988207 - RNA, 13 nt, Human
cacugcagccuca

SEQ ID NO: 1988208 - RNA, 18 nt, Human
cacugcauccuccgccuc

SEQ ID NO: 1988209 - RNA, 19 nt, Human
cacugcacuauagccuagg

SEQ ID NO: 1988210 - RNA, 19 nt, Human
cacugcacuccagccuggg

SEQ ID NO: 1988211 - RNA, 18 nt, Human
cacugcacuccagccugg

SEQ ID NO: 1988212 - RNA, 16 nt, Human
cacugcacuccagccu

SEQ ID NO: 1988213 - RNA, 15 nt, Human
cacugcacuccagcc

SEQ ID NO: 1988214 - RNA, 20 nt, Human
cacugcacuccagccugggu

SEQ ID NO: 1988215 - RNA, 21 nt, Human
cacugcagaagacaguauggc

SEQ ID NO: 1988216 - RNA, 12 nt, Human
cacugcagccuc

SEQ ID NO: 1988217 - RNA, 22 nt, Human
cacugguucuucuuggucucag

SEQ ID NO: 1988218 - RNA, 23 nt, Human
cacugguggcccgacagccuggc

SEQ ID NO: 1988219 - RNA, 21 nt, Human
cacuuaccugaguugaagagg

SEQ ID NO: 1988220 - RNA, 18 nt, Human
cacuuacacuuuaugcac

SEQ ID NO: 1988221 - RNA, 16 nt, Human
cacuuacacuuuaugc

SEQ ID NO: 1988222 - RNA, 16 nt, Human
cacuuguagauuugau

SEQ ID NO: 1988223 - RNA, 17 nt, Human
cacuuguagauuugauu

SEQ ID NO: 1988224 - RNA, 14 nt, Human
cacuuguagauuug

SEQ ID NO: 1988225 - RNA, 15 nt, Human
cacuuguagauuuga

SEQ ID NO: 1988226 - RNA, 23 nt, Human
cacuuaggaacguaaucgugucc

SEQ ID NO: 1988227 - RNA, 24 nt, Human
cacuuagaaauugcauuuccugac

SEQ ID NO: 1988228 - RNA, 20 nt, Human
cacuuagccuuucuuuucuu

SEQ ID NO: 1988229 - RNA, 21 nt, Human
cacuuagcuggagaugucucu

SEQ ID NO: 1988230 - RNA, 15 nt, Human
cacuccaagccagca

SEQ ID NO: 1988231 - RNA, 16 nt, Human
cacuccagccugggug

SEQ ID NO: 1988232 - RNA, 11 nt, Human
cacuccagcug

SEQ ID NO: 1988233 - RNA, 12 nt, Human
cacuccagcugg

SEQ ID NO: 1988234 - RNA, 15 nt, Human
cacuccagcugggau

SEQ ID NO: 1988235 - RNA, 14 nt, Human
cacuaggcuucugg

SEQ ID NO: 1988236 - RNA, 22 nt, Human
cacugaauuuuuaugugugauu

SEQ ID NO: 1988237 - RNA, 15 nt, Human
cacugaaguuugaua

SEQ ID NO: 1988238 - RNA, 21 nt, Human
cacugaaguuugauaaauagu

SEQ ID NO: 1988239 - RNA, 22 nt, Human
cacugaaguuugauaaauagug

SEQ ID NO: 1988240 - RNA, 15 nt, Human
cacugaaucccugua

SEQ ID NO: 1988241 - RNA, 13 nt, Human
cacugaaucugua

SEQ ID NO: 1988242 - RNA, 14 nt, Human
cacugaaucuguac

SEQ ID NO: 1988243 - RNA, 15 nt, Human
cacugaaucuguaca

SEQ ID NO: 1988244 - RNA, 16 nt, Human
cacugaaucuguacag

SEQ ID NO: 1988245 - RNA, 17 nt, Human
cacugaaucuguacaga

SEQ ID NO: 1988246 - RNA, 20 nt, Human
cacugaaucuguacagagcc

SEQ ID NO: 1988247 - RNA, 15 nt, Human
cacuccccugcuggg

SEQ ID NO: 1988248 - RNA, 14 nt, Human
cacuccccugcugg

SEQ ID NO: 1988249 - RNA, 13 nt, Human
cacuccccugcug

SEQ ID NO: 1988250 - RNA, 12 nt, Human
cacuccccugcu

SEQ ID NO: 1988251 - RNA, 21 nt, Human
cacucuuggagccugcagagc

SEQ ID NO: 1988252 - RNA, 22 nt, Human
cacucuuggagccugcagagcu

SEQ ID NO: 1988253 - RNA, 23 nt, Human
cacucuuggagccugcagagcug

SEQ ID NO: 1988254 - RNA, 14 nt, Human
cacucuuguuucuc

SEQ ID NO: 1988255 - RNA, 21 nt, Human
cacucuuguuucucccgugcu

SEQ ID NO: 1988256 - RNA, 11 nt, Human
caccccagccc

SEQ ID NO: 1988257 - RNA, 13 nt, Human
caccccaccugcg

SEQ ID NO: 1988258 - RNA, 16 nt, Human
caccccaccugcgcuu

SEQ ID NO: 1988259 - RNA, 12 nt, Human
caccccaccugc

SEQ ID NO: 1988260 - RNA, 24 nt, Human
caccugccuguugggccaggagcc

SEQ ID NO: 1988261 - RNA, 19 nt, Human
caccugccuguugggccag

SEQ ID NO: 1988262 - RNA, 17 nt, Human
caccugccuguugggcc

SEQ ID NO: 1988263 - RNA, 14 nt, Human
caccuuggcugcag

SEQ ID NO: 1988264 - RNA, 14 nt, Human
caccuuggcucaag

SEQ ID NO: 1988265 - RNA, 15 nt, Human
caccuuggcucaagu

SEQ ID NO: 1988266 - RNA, 13 nt, Human
caccuuggcugca

SEQ ID NO: 1988267 - RNA, 16 nt, Human
caccugccccucaacu

SEQ ID NO: 1988268 - RNA, 15 nt, Human
caccugccccucaac

SEQ ID NO: 1988269 - RNA, 14 nt, Human
caccugccccucaa

SEQ ID NO: 1988270 - RNA, 14 nt, Human
caccucagccuccc

SEQ ID NO: 1988271 - RNA, 15 nt, Human
caccuaauuaauuuc

SEQ ID NO: 1988272 - RNA, 13 nt, Human
caccucagccucc

SEQ ID NO: 1988273 - RNA, 17 nt, Human
cacccugaaagcccuga

SEQ ID NO: 1988274 - RNA, 21 nt, Human
cacccugaacaacgagccuuu

SEQ ID NO: 1988275 - RNA, 15 nt, Human
cacccuggggagaaa

SEQ ID NO: 1988276 - RNA, 16 nt, Human
cacccuggggagaaag

SEQ ID NO: 1988277 - RNA, 14 nt, Human
cacccucaggcagg

SEQ ID NO: 1988278 - RNA, 16 nt, Human
cacccuccccuuccca

SEQ ID NO: 1988279 - RNA, 20 nt, Human
cacccuccccuucccagggc

SEQ ID NO: 1988280 - RNA, 18 nt, Human
caaagauauuuugcuuug

SEQ ID NO: 1988281 - RNA, 20 nt, Human
caaagauauuuugcuuugug

SEQ ID NO: 1988282 - RNA, 17 nt, Human
caaaaggcauuucccac

SEQ ID NO: 1988283 - RNA, 21 nt, Human
caaaaggcauuucccacccug

SEQ ID NO: 1988284 - RNA, 15 nt, Human
caaaaggcagaagca

SEQ ID NO: 1988285 - RNA, 18 nt, Human
caaaagaugcuucucacu

SEQ ID NO: 1988286 - RNA, 20 nt, Human
caaaaaaaaaaaaaaauuag

SEQ ID NO: 1988287 - RNA, 18 nt, Human
auuuuuuuuuuuaaucua

SEQ ID NO: 1988288 - RNA, 21 nt, Human
auuuuuuuuuuuaaucuacug

SEQ ID NO: 1988289 - RNA, 16 nt, Human
caaaagaugcuucuca

SEQ ID NO: 1988290 - RNA, 20 nt, Human
caaaagaguguaaaauauuu

SEQ ID NO: 1988291 - RNA, 15 nt, Human
caaaagaguguaaaa

SEQ ID NO: 1988292 - RNA, 16 nt, Human
caaaagaguguaaaau

SEQ ID NO: 1988293 - RNA, 18 nt, Human
caaaagaguguaaaauau

SEQ ID NO: 1988294 - RNA, 19 nt, Human
caaaagaguguaaaauauu

SEQ ID NO: 1988295 - RNA, 16 nt, Human
auuuuuuuuucuuuca

SEQ ID NO: 1988296 - RNA, 19 nt, Human
caaaccaucauugaaaucu

SEQ ID NO: 1988297 - RNA, 21 nt, Human
caaaccaucauugaaaucuuu

SEQ ID NO: 1988298 - RNA, 17 nt, Human
caaacccacccuuucua

SEQ ID NO: 1988299 - RNA, 15 nt, Human
caaaaggcuugcaga

SEQ ID NO: 1988300 - RNA, 19 nt, Human
caaaaggcuugcagaacuu

SEQ ID NO: 1988301 - RNA, 16 nt, Human
caaacagaugcucuga

SEQ ID NO: 1988302 - RNA, 18 nt, Human
caaacagauucuuuuaug

SEQ ID NO: 1988303 - RNA, 14 nt, Human
caacaauucagcau

SEQ ID NO: 1988304 - RNA, 17 nt, Human
caacaaucccaaggccc

SEQ ID NO: 1988305 - RNA, 23 nt, Human
caacaauucucccgggacucugc

SEQ ID NO: 1988306 - RNA, 20 nt, Human
caacaccucugcacaagcug

SEQ ID NO: 1988307 - RNA, 22 nt, Human
caaauggaaaugggcagagcag

SEQ ID NO: 1988308 - RNA, 21 nt, Human
caaauggaaaugggcagagca

SEQ ID NO: 1988309 - RNA, 16 nt, Human
caacaaggcaaaaaca

SEQ ID NO: 1988310 - RNA, 19 nt, Human
caacaaggcuugcugcaga

SEQ ID NO: 1988311 - RNA, 20 nt, Human
caaauggaaaugggcagagc

SEQ ID NO: 1988312 - RNA, 14 nt, Human
caaauggaaacaga

SEQ ID NO: 1988313 - RNA, 20 nt, Human
caaauggaaacagaggacca

SEQ ID NO: 1988314 - RNA, 21 nt, Human
caaauggaaacagaggaccag

SEQ ID NO: 1988315 - RNA, 18 nt, Human
caaauccugcauuuagau

SEQ ID NO: 1988316 - RNA, 14 nt, Human
caacacuaacauga

SEQ ID NO: 1988317 - RNA, 17 nt, Human
caaagcagugcaugcug

SEQ ID NO: 1988318 - RNA, 15 nt, Human
caaagcagugcaugc

SEQ ID NO: 1988319 - RNA, 22 nt, Human
caaaguacacuguuucaaacuu

SEQ ID NO: 1988320 - RNA, 17 nt, Human
caaaguacagguacuuu

SEQ ID NO: 1988321 - RNA, 19 nt, Human
caaaguacagguacuuugu

SEQ ID NO: 1988322 - RNA, 20 nt, Human
caaaguacagguacuuuguc

SEQ ID NO: 1988323 - RNA, 21 nt, Human
caaaguacagguacuuugucu

SEQ ID NO: 1988324 - RNA, 21 nt, Human
caaaguagaagucuuagaugu

SEQ ID NO: 1988325 - RNA, 14 nt, Human
caaaguagaagucu

SEQ ID NO: 1988326 - RNA, 21 nt, Human
caaagucucuggaauuugaaa

SEQ ID NO: 1988327 - RNA, 15 nt, Human
caaauccgaaaucag

SEQ ID NO: 1988328 - RNA, 21 nt, Human
caaauccaggacccugccagg

SEQ ID NO: 1988329 - RNA, 22 nt, Human
caaauccaggacccugccaggc

SEQ ID NO: 1988330 - RNA, 22 nt, Human
caaagugcuauuacgaaguuca

SEQ ID NO: 1988331 - RNA, 22 nt, Human
caaagauauuuugcuuugugau

SEQ ID NO: 1988332 - RNA, 23 nt, Human
caaagauauuuugcuuugugauu

SEQ ID NO: 1988333 - RNA, 17 nt, Human
caaagcaaaccaacaag

SEQ ID NO: 1988334 - RNA, 15 nt, Human
caaagcagagagcau

SEQ ID NO: 1988335 - RNA, 18 nt, Human
caaagcagcaacacacau

SEQ ID NO: 1988336 - RNA, 17 nt, Human
caaagcaccaaaauaag

SEQ ID NO: 1988337 - RNA, 18 nt, Human
caaagcaccaaaauaaga

SEQ ID NO: 1988338 - RNA, 19 nt, Human
caaagcaccaaaauaagaa

SEQ ID NO: 1988339 - RNA, 21 nt, Human
caaagcaccaaaauaagaaaa

SEQ ID NO: 1988340 - RNA, 22 nt, Human
caaagcaccaaaauaagaaaag

SEQ ID NO: 1988341 - RNA, 24 nt, Human
caaagcaccaaaauaagaaaagau

SEQ ID NO: 1988342 - RNA, 16 nt, Human
auuugcagcuuccaau

SEQ ID NO: 1988343 - RNA, 16 nt, Human
auuugauuuguacaga

SEQ ID NO: 1988344 - RNA, 19 nt, Human
auuugauuuuuauuauuaa

SEQ ID NO: 1988345 - RNA, 14 nt, Human
auuugauuuauuaa

SEQ ID NO: 1988346 - RNA, 15 nt, Human
auuugauuuauuaac

SEQ ID NO: 1988347 - RNA, 17 nt, Human
auuugauuuauuaacuu

SEQ ID NO: 1988348 - RNA, 18 nt, Human
auuugauuuauuaacuua

SEQ ID NO: 1988349 - RNA, 22 nt, Human
auuugauuuauuaacuuaauaa

SEQ ID NO: 1988350 - RNA, 16 nt, Human
auuugcuaugagcugg

SEQ ID NO: 1988351 - RNA, 20 nt, Human
auuugcuaugagcuggggau

SEQ ID NO: 1988352 - RNA, 15 nt, Human
auuugccaauaauaa

SEQ ID NO: 1988353 - RNA, 16 nt, Human
auuugccaauaauaau

SEQ ID NO: 1988354 - RNA, 13 nt, Human
auuugccauagag

SEQ ID NO: 1988355 - RNA, 15 nt, Human
auuugccauagagua

SEQ ID NO: 1988356 - RNA, 21 nt, Human
auuugccauagaguacacugc

SEQ ID NO: 1988357 - RNA, 15 nt, Human
auuugugauacaaug

SEQ ID NO: 1988358 - RNA, 17 nt, Human
auuugugauacaaugcu

SEQ ID NO: 1988359 - RNA, 20 nt, Human
auuugugauacaaugcugug

SEQ ID NO: 1988360 - RNA, 17 nt, Human
auuugugauguacugua

SEQ ID NO: 1988361 - RNA, 14 nt, Human
auuugugccagaau

SEQ ID NO: 1988362 - RNA, 13 nt, Human
auuugcuccuuuc

SEQ ID NO: 1988363 - RNA, 15 nt, Human
auuugcuaucucuau

SEQ ID NO: 1988364 - RNA, 13 nt, Human
auuuggaaaauaa

SEQ ID NO: 1988365 - RNA, 12 nt, Human
auuuggaaaaua

SEQ ID NO: 1988366 - RNA, 22 nt, Human
auuugcuuaaauauccauauua

SEQ ID NO: 1988367 - RNA, 14 nt, Human
auuugcuuuggaag

SEQ ID NO: 1988368 - RNA, 15 nt, Human
auuugcuuuggaagu

SEQ ID NO: 1988369 - RNA, 13 nt, Human
auuugcuuuggaa

SEQ ID NO: 1988370 - RNA, 15 nt, Human
auuugcucauaugaa

SEQ ID NO: 1988371 - RNA, 14 nt, Human
auuugugugcuaaa

SEQ ID NO: 1988372 - RNA, 15 nt, Human
auuugugugcuaaac

SEQ ID NO: 1988373 - RNA, 16 nt, Human
auuuguugauucucuc

SEQ ID NO: 1988374 - RNA, 15 nt, Human
auuuguggugauuug

SEQ ID NO: 1988375 - RNA, 22 nt, Human
auuuguggggagggauuugggg

SEQ ID NO: 1988376 - RNA, 22 nt, Human
auuuguuugaacugauaaagau

SEQ ID NO: 1988377 - RNA, 23 nt, Human
auuuguuugaacugauaaagaug

SEQ ID NO: 1988378 - RNA, 18 nt, Human
auuuguugauucucucca

SEQ ID NO: 1988379 - RNA, 14 nt, Human
auuuguuuaaagua

SEQ ID NO: 1988380 - RNA, 17 nt, Human
auuuuauagcuacuaau

SEQ ID NO: 1988381 - RNA, 21 nt, Human
auuuguuugguuauagugcaa

SEQ ID NO: 1988382 - RNA, 23 nt, Human
auuuguuugguuauagugcaaua

SEQ ID NO: 1988383 - RNA, 19 nt, Human
auuuuauagcuacuaauuu

SEQ ID NO: 1988384 - RNA, 19 nt, Human
auucauagcagcuuauuca

SEQ ID NO: 1988385 - RNA, 22 nt, Human
auucauagcagcuuauucacaa

SEQ ID NO: 1988386 - RNA, 19 nt, Human
auucauaaugacuuaagca

SEQ ID NO: 1988387 - RNA, 21 nt, Human
auucauaauuauuauuuggcc

SEQ ID NO: 1988388 - RNA, 15 nt, Human
auucauaaugacuua

SEQ ID NO: 1988389 - RNA, 14 nt, Human
auucauaaugacuu

SEQ ID NO: 1988390 - RNA, 23 nt, Human
auuaugcaugaaguaauaugcac

SEQ ID NO: 1988391 - RNA, 18 nt, Human
auucaauuaaagaaauaa

SEQ ID NO: 1988392 - RNA, 19 nt, Human
auucaauuaaagaaauaau

SEQ ID NO: 1988393 - RNA, 21 nt, Human
auucaauuaaagaaauaauuu

SEQ ID NO: 1988394 - RNA, 22 nt, Human
auucaauuaaagaaauaauuuu

SEQ ID NO: 1988395 - RNA, 12 nt, Human
auucaauuaaag

SEQ ID NO: 1988396 - RNA, 17 nt, Human
auucaauuaaagaaaua

SEQ ID NO: 1988397 - RNA, 16 nt, Human
auucaaauguauuaca

SEQ ID NO: 1988398 - RNA, 18 nt, Human
auucaaugccccugaauu

SEQ ID NO: 1988399 - RNA, 20 nt, Human
auucaaugccccugaauuua

SEQ ID NO: 1988400 - RNA, 14 nt, Human
auucacaccccacc

SEQ ID NO: 1988401 - RNA, 15 nt, Human
auucacaccccaccu

SEQ ID NO: 1988402 - RNA, 16 nt, Human
auucacaccccaccug

SEQ ID NO: 1988403 - RNA, 17 nt, Human
auucacaccccaccugc

SEQ ID NO: 1988404 - RNA, 18 nt, Human
auucacaccccaccugcg

SEQ ID NO: 1988405 - RNA, 16 nt, Human
auucacacuugaacca

SEQ ID NO: 1988406 - RNA, 19 nt, Human
auucacaagacccaaaagg

SEQ ID NO: 1988407 - RNA, 18 nt, Human
auuaugaaacuuuuggaa

SEQ ID NO: 1988408 - RNA, 21 nt, Human
auuaggugugacugaauuucu

SEQ ID NO: 1988409 - RNA, 15 nt, Human
auuagguauaucucc

SEQ ID NO: 1988410 - RNA, 17 nt, Human
auuagggcucuaauuuc

SEQ ID NO: 1988411 - RNA, 16 nt, Human
auuaggugugacugaa

SEQ ID NO: 1988412 - RNA, 18 nt, Human
auuaggugugacugaauu

SEQ ID NO: 1988413 - RNA, 14 nt, Human
auuaauucucuuuc

SEQ ID NO: 1988414 - RNA, 16 nt, Human
auuaauuaucgugucu

SEQ ID NO: 1988415 - RNA, 16 nt, Human
auuaauguugauuucu

SEQ ID NO: 1988416 - RNA, 17 nt, Human
auuaauguugauuucua

SEQ ID NO: 1988417 - RNA, 20 nt, Human
auuacaagccuggaaaaaaa

SEQ ID NO: 1988418 - RNA, 12 nt, Human
auuaauguugau

SEQ ID NO: 1988419 - RNA, 14 nt, Human
auuaauguugauuu

SEQ ID NO: 1988420 - RNA, 15 nt, Human
auuaauguugauuuc

SEQ ID NO: 1988421 - RNA, 20 nt, Human
auuagcgacaacagauugga

SEQ ID NO: 1988422 - RNA, 17 nt, Human
auuagcaguuugcuuug

SEQ ID NO: 1988423 - RNA, 23 nt, Human
auuagauuucucauuugccaaua

SEQ ID NO: 1988424 - RNA, 20 nt, Human
auuagauuuuaaaacuucau

SEQ ID NO: 1988425 - RNA, 14 nt, Human
auuagcaaaaaaag

SEQ ID NO: 1988426 - RNA, 16 nt, Human
auuagcaaaaaaaguu

SEQ ID NO: 1988427 - RNA, 17 nt, Human
auuagcaaaaaaaguug

SEQ ID NO: 1988428 - RNA, 18 nt, Human
auuagcaaaaaaaguugu

SEQ ID NO: 1988429 - RNA, 19 nt, Human
auuagcaaaaaaaguugua

SEQ ID NO: 1988430 - RNA, 20 nt, Human
auuagcaaaaaaaguuguau

SEQ ID NO: 1988431 - RNA, 21 nt, Human
auuagcaaaaaaaguuguaug

SEQ ID NO: 1988432 - RNA, 22 nt, Human
auuagcaaaaaaaguuguauga

SEQ ID NO: 1988433 - RNA, 19 nt, Human
auuacaguggggaaugaag

SEQ ID NO: 1988434 - RNA, 23 nt, Human
auuacagucucacucagaacugu

SEQ ID NO: 1988435 - RNA, 15 nt, Human
auuacagugccuaaa

SEQ ID NO: 1988436 - RNA, 18 nt, Human
auuacagugccuaaaaua

SEQ ID NO: 1988437 - RNA, 19 nt, Human
auuacagugccuaaaauaa

SEQ ID NO: 1988438 - RNA, 17 nt, Human
auuacaggaaguacugg

SEQ ID NO: 1988439 - RNA, 16 nt, Human
auuacaggugugaacc

SEQ ID NO: 1988440 - RNA, 18 nt, Human
auguuugccucugccucu

SEQ ID NO: 1988441 - RNA, 23 nt, Human
auguuugggagacugcugaguca

SEQ ID NO: 1988442 - RNA, 17 nt, Human
auguuugguaccaagaa

SEQ ID NO: 1988443 - RNA, 14 nt, Human
auguuuguacaaga

SEQ ID NO: 1988444 - RNA, 18 nt, Human
auguuuguacaagauugu

SEQ ID NO: 1988445 - RNA, 17 nt, Human
auguuugugcaguaacu

SEQ ID NO: 1988446 - RNA, 19 nt, Human
auguuugugcaguaacuug

SEQ ID NO: 1988447 - RNA, 22 nt, Human
auguuugugcaguaacuuggga

SEQ ID NO: 1988448 - RNA, 22 nt, Human
auuguuguccgguuuacuuuaa

SEQ ID NO: 1988449 - RNA, 20 nt, Human
auuguugcauagguuagaua

SEQ ID NO: 1988450 - RNA, 19 nt, Human
auugcugauggugcaauga

SEQ ID NO: 1988451 - RNA, 18 nt, Human
auugcugauggugcaaug

SEQ ID NO: 1988452 - RNA, 16 nt, Human
auugcugauggugcaa

SEQ ID NO: 1988453 - RNA, 15 nt, Human
auugcugauggugca

SEQ ID NO: 1988454 - RNA, 21 nt, Human
auugcugaauggaguuaaacu

SEQ ID NO: 1988455 - RNA, 12 nt, Human
auugcuccuuga

SEQ ID NO: 1988456 - RNA, 20 nt, Human
auugcuccugcucagaucuu

SEQ ID NO: 1988457 - RNA, 13 nt, Human
auugcucacaguu

SEQ ID NO: 1988458 - RNA, 17 nt, Human
auugcucacaguuauua

SEQ ID NO: 1988459 - RNA, 21 nt, Human
auugcucacaguuauuacaua

SEQ ID NO: 1988460 - RNA, 14 nt, Human
auugcuugagcuca

SEQ ID NO: 1988461 - RNA, 13 nt, Human
auugcuucuucug

SEQ ID NO: 1988462 - RNA, 14 nt, Human
auugcuucuucuga

SEQ ID NO: 1988463 - RNA, 10 nt, Human
auugcuucuu

SEQ ID NO: 1988464 - RNA, 23 nt, Human
auugcugauggugcaaugaccuu

SEQ ID NO: 1988465 - RNA, 12 nt, Human
auugcugcuuga

SEQ ID NO: 1988466 - RNA, 23 nt, Human
auugugucucuugguccugcugc

SEQ ID NO: 1988467 - RNA, 21 nt, Human
auugugucucuugguccugcu

SEQ ID NO: 1988468 - RNA, 22 nt, Human
auuguaauguugugaauaauua

SEQ ID NO: 1988469 - RNA, 23 nt, Human
auuguaauguugugaauaauuac

SEQ ID NO: 1988470 - RNA, 18 nt, Human
auuguaauuaauaauaga

SEQ ID NO: 1988471 - RNA, 14 nt, Human
auugugugaacuug

SEQ ID NO: 1988472 - RNA, 18 nt, Human
auugugugauauuucaga

SEQ ID NO: 1988473 - RNA, 20 nt, Human
auugugugauauuucagaaa

SEQ ID NO: 1988474 - RNA, 16 nt, Human
auuguuagucucuuga

SEQ ID NO: 1988475 - RNA, 15 nt, Human
auuguuacuccauau

SEQ ID NO: 1988476 - RNA, 15 nt, Human
auuguucaauuccca

SEQ ID NO: 1988477 - RNA, 14 nt, Human
auuguaaaauggug

SEQ ID NO: 1988478 - RNA, 18 nt, Human
auugcuugagcucaggag

SEQ ID NO: 1988479 - RNA, 23 nt, Human
auuguaauaggcguaacuaauuu

SEQ ID NO: 1988480 - RNA, 12 nt, Human
auuguaauguug

SEQ ID NO: 1988481 - RNA, 14 nt, Human
auuguaauguugug

SEQ ID NO: 1988482 - RNA, 17 nt, Human
auuguaauguugugaau

SEQ ID NO: 1988483 - RNA, 20 nt, Human
auuguaauguugugaauaau

SEQ ID NO: 1988484 - RNA, 13 nt, Human
auucuuuccugag

SEQ ID NO: 1988485 - RNA, 12 nt, Human
auucugaaguua

SEQ ID NO: 1988486 - RNA, 14 nt, Human
auucugaaguuaua

SEQ ID NO: 1988487 - RNA, 15 nt, Human
auucugaaguuauau

SEQ ID NO: 1988488 - RNA, 18 nt, Human
auucugaaguuauauuuc

SEQ ID NO: 1988489 - RNA, 20 nt, Human
auucugaaguuauauuuccu

SEQ ID NO: 1988490 - RNA, 22 nt, Human
auucugaaguuauauuuccuau

SEQ ID NO: 1988491 - RNA, 12 nt, Human
auucucuuuuca

SEQ ID NO: 1988492 - RNA, 11 nt, Human
auucuucugcu

SEQ ID NO: 1988493 - RNA, 12 nt, Human
auucuucugcuu

SEQ ID NO: 1988494 - RNA, 14 nt, Human
auucugaccuuaaa

SEQ ID NO: 1988495 - RNA, 11 nt, Human
auucuuuccug

SEQ ID NO: 1988496 - RNA, 21 nt, Human
auucuugaugaaaagcuuugu

SEQ ID NO: 1988497 - RNA, 22 nt, Human
auucuugaugaaaagcuuuguu

SEQ ID NO: 1988498 - RNA, 17 nt, Human
auucuugaucaguaguu

SEQ ID NO: 1988499 - RNA, 19 nt, Human
auucuugaucaguaguuug

SEQ ID NO: 1988500 - RNA, 21 nt, Human
auucuugaucaguaguuugca

SEQ ID NO: 1988501 - RNA, 22 nt, Human
auucuugaucaguaguuugcau

SEQ ID NO: 1988502 - RNA, 10 nt, Human
auucuugaug

SEQ ID NO: 1988503 - RNA, 14 nt, Human
auucuugaugaaaa

SEQ ID NO: 1988504 - RNA, 18 nt, Human
auucuugaugaaaagcuu

SEQ ID NO: 1988505 - RNA, 14 nt, Human
auucuucugcuuca

SEQ ID NO: 1988506 - RNA, 12 nt, Human
auucuucugauc

SEQ ID NO: 1988507 - RNA, 15 nt, Human
auucuucugaucacu

SEQ ID NO: 1988508 - RNA, 22 nt, Human
auugagucauuuuauauaugaa

SEQ ID NO: 1988509 - RNA, 21 nt, Human
auugauaagaaccuuuugagu

SEQ ID NO: 1988510 - RNA, 17 nt, Human
auugauaaccauagcau

SEQ ID NO: 1988511 - RNA, 15 nt, Human
auugcuacuguccua

SEQ ID NO: 1988512 - RNA, 13 nt, Human
auugauagaauaa

SEQ ID NO: 1988513 - RNA, 17 nt, Human
auugauaugcuuauaca

SEQ ID NO: 1988514 - RNA, 20 nt, Human
auugcuacuguccuacccac

SEQ ID NO: 1988515 - RNA, 22 nt, Human
auugcuacuguccuacccaccc

SEQ ID NO: 1988516 - RNA, 17 nt, Human
gccuccaaccccucgcc

SEQ ID NO: 1988517 - RNA, 17 nt, Human
gccuccaagcuccaucu

SEQ ID NO: 1988518 - RNA, 20 nt, Human
gccuccaaccccucgcccag

SEQ ID NO: 1988519 - RNA, 21 nt, Human
gccuccaaccccucgcccagu

SEQ ID NO: 1988520 - RNA, 22 nt, Human
gccuccaaccccucgcccaguc

SEQ ID NO: 1988521 - RNA, 22 nt, Human
gccuccaauuuuuuaagugaaa

SEQ ID NO: 1988522 - RNA, 16 nt, Human
gccuccauccugaggc

SEQ ID NO: 1988523 - RNA, 20 nt, Human
gccuccauccugaggcucca

SEQ ID NO: 1988524 - RNA, 21 nt, Human
gccuccuuugugaggaagccg

SEQ ID NO: 1988525 - RNA, 20 nt, Human
gccuccuuugugaggaagcc

SEQ ID NO: 1988526 - RNA, 19 nt, Human
gccuccuuugugaggaagc

SEQ ID NO: 1988527 - RNA, 11 nt, Human
gccuccaugcu

SEQ ID NO: 1988528 - RNA, 13 nt, Human
gccugcuccagcu

SEQ ID NO: 1988529 - RNA, 18 nt, Human
gccucgcaggccucccug

SEQ ID NO: 1988530 - RNA, 19 nt, Human
gccucgcaggccucccugc

SEQ ID NO: 1988531 - RNA, 21 nt, Human
gccucgcaggccucccugcca

SEQ ID NO: 1988532 - RNA, 15 nt, Human
gccucgacacguggg

SEQ ID NO: 1988533 - RNA, 22 nt, Human
gccucgacacgugggcuccccu

SEQ ID NO: 1988534 - RNA, 20 nt, Human
gccuccuugauauuuguauu

SEQ ID NO: 1988535 - RNA, 13 nt, Human
gccucggacuuag

SEQ ID NO: 1988536 - RNA, 17 nt, Human
gccugcuaauuccccag

SEQ ID NO: 1988537 - RNA, 23 nt, Human
gccugcuaauuccccagauugca

SEQ ID NO: 1988538 - RNA, 13 nt, Human
gccugcccuguca

SEQ ID NO: 1988539 - RNA, 19 nt, Human
gccugcccugucaggaggc

SEQ ID NO: 1988540 - RNA, 16 nt, Human
gccugcccuuuguccu

SEQ ID NO: 1988541 - RNA, 19 nt, Human
gccugcccuuuguccuccu

SEQ ID NO: 1988542 - RNA, 20 nt, Human
gccugcccuuuguccuccug

SEQ ID NO: 1988543 - RNA, 22 nt, Human
gccugcccuuuguccuccugcu

SEQ ID NO: 1988544 - RNA, 17 nt, Human
gcgauucuucugcuuca

SEQ ID NO: 1988545 - RNA, 21 nt, Human
gcgauucucuugccucagcuu

SEQ ID NO: 1988546 - RNA, 14 nt, Human
gcgauucuucugcu

SEQ ID NO: 1988547 - RNA, 13 nt, Human
gcgauucuucugc

SEQ ID NO: 1988548 - RNA, 15 nt, Human
gcgagagucccugca

SEQ ID NO: 1988549 - RNA, 13 nt, Human
gcggccucagagu

SEQ ID NO: 1988550 - RNA, 18 nt, Human
gcgugcacacaccagagc

SEQ ID NO: 1988551 - RNA, 20 nt, Human
gcgugaucaaagccacacuc

SEQ ID NO: 1988552 - RNA, 14 nt, Human
gcgugcacacacca

SEQ ID NO: 1988553 - RNA, 20 nt, Human
gcgugguggacaugcacagc

SEQ ID NO: 1988554 - RNA, 22 nt, Human
gcguggcccaccaggccccccu

SEQ ID NO: 1988555 - RNA, 17 nt, Human
gcguggcccaccaggcc

SEQ ID NO: 1988556 - RNA, 13 nt, Human
gcguggggcuccc

SEQ ID NO: 1988557 - RNA, 18 nt, Human
gcguggggcucccgccuc

SEQ ID NO: 1988558 - RNA, 17 nt, Human
gcuacuugggaggcuga

SEQ ID NO: 1988559 - RNA, 19 nt, Human
gcuagaaaaauuguuaagg

SEQ ID NO: 1988560 - RNA, 16 nt, Human
gcuacuugguggguuu

SEQ ID NO: 1988561 - RNA, 19 nt, Human
gcuacuguaaggcaaucau

SEQ ID NO: 1988562 - RNA, 18 nt, Human
gcuacuguaaggcaauca

SEQ ID NO: 1988563 - RNA, 19 nt, Human
gcuacuguccuacccaccc

SEQ ID NO: 1988564 - RNA, 20 nt, Human
gcuacuguccuacccacccu

SEQ ID NO: 1988565 - RNA, 17 nt, Human
gcguuucuaugacacau

SEQ ID NO: 1988566 - RNA, 14 nt, Human
gcuaauucuuugca

SEQ ID NO: 1988567 - RNA, 15 nt, Human
gcuaauucuuugcaa

SEQ ID NO: 1988568 - RNA, 17 nt, Human
gcuaauucuuugcaaaa

SEQ ID NO: 1988569 - RNA, 12 nt, Human
gcuaauuguacc

SEQ ID NO: 1988570 - RNA, 18 nt, Human
gcuaauuuugaaaaacug

SEQ ID NO: 1988571 - RNA, 16 nt, Human
gcuaauuuuucauuuu

SEQ ID NO: 1988572 - RNA, 17 nt, Human
gcccaggccccugccac

SEQ ID NO: 1988573 - RNA, 18 nt, Human
gcccaggccccugccacc

SEQ ID NO: 1988574 - RNA, 13 nt, Human
gcccaggcagguc

SEQ ID NO: 1988575 - RNA, 12 nt, Human
gcccaggcaggu

SEQ ID NO: 1988576 - RNA, 13 nt, Human
gcccaggagggag

SEQ ID NO: 1988577 - RNA, 14 nt, Human
gcccaggcaggucu

SEQ ID NO: 1988578 - RNA, 16 nt, Human
gcccaggcaggucuug

SEQ ID NO: 1988579 - RNA, 15 nt, Human
gcccaggccccugcc

SEQ ID NO: 1988580 - RNA, 13 nt, Human
gcccaggccccug

SEQ ID NO: 1988581 - RNA, 16 nt, Human
gccaugugcuucugcc

SEQ ID NO: 1988582 - RNA, 15 nt, Human
gcccaggagcccauu

SEQ ID NO: 1988583 - RNA, 11 nt, Human
gcccaggagcc

SEQ ID NO: 1988584 - RNA, 13 nt, Human
gcccaggagccca

SEQ ID NO: 1988585 - RNA, 14 nt, Human
gcccaggagcccau

SEQ ID NO: 1988586 - RNA, 15 nt, Human
gccaucaacuaaagu

SEQ ID NO: 1988587 - RNA, 21 nt, Human
gccaucaacuaaaguuguacu

SEQ ID NO: 1988588 - RNA, 14 nt, Human
gccaugugccaggu

SEQ ID NO: 1988589 - RNA, 11 nt, Human
gcccuaucugu

SEQ ID NO: 1988590 - RNA, 16 nt, Human
gcccucacccuggggc

SEQ ID NO: 1988591 - RNA, 17 nt, Human
gcccuauuucuugauaa

SEQ ID NO: 1988592 - RNA, 17 nt, Human
gcccucacccuggggcu

SEQ ID NO: 1988593 - RNA, 15 nt, Human
gccccuggaugcagc

SEQ ID NO: 1988594 - RNA, 21 nt, Human
gccccaaguuuugugaaauuu

SEQ ID NO: 1988595 - RNA, 15 nt, Human
gccccacaccagccc

SEQ ID NO: 1988596 - RNA, 16 nt, Human
gccccugccucucugc

SEQ ID NO: 1988597 - RNA, 15 nt, Human
gccccugccucucug

SEQ ID NO: 1988598 - RNA, 18 nt, Human
gccccugccucucugcag

SEQ ID NO: 1988599 - RNA, 17 nt, Human
gccccugccucucugca

SEQ ID NO: 1988600 - RNA, 22 nt, Human
gccccugcugguucaggguugg

SEQ ID NO: 1988601 - RNA, 14 nt, Human
gccaggauggaaug

SEQ ID NO: 1988602 - RNA, 12 nt, Human
gccaggcacagg

SEQ ID NO: 1988603 - RNA, 13 nt, Human
gccaggcacaggc

SEQ ID NO: 1988604 - RNA, 14 nt, Human
gccaggcacaggca

SEQ ID NO: 1988605 - RNA, 15 nt, Human
gccaggcacaggcag

SEQ ID NO: 1988606 - RNA, 16 nt, Human
gccaggcacaggcagg

SEQ ID NO: 1988607 - RNA, 17 nt, Human
gccaggcacaggcaggg

SEQ ID NO: 1988608 - RNA, 19 nt, Human
gccaggcacaggcagggca

SEQ ID NO: 1988609 - RNA, 20 nt, Human
gccaggcacaggcagggcag

SEQ ID NO: 1988610 - RNA, 16 nt, Human
gccagcccagaggccg

SEQ ID NO: 1988611 - RNA, 17 nt, Human
gccagcccauuugggca

SEQ ID NO: 1988612 - RNA, 18 nt, Human
gccagcccauuugggcag

SEQ ID NO: 1988613 - RNA, 19 nt, Human
gccagcccauuugggcaga

SEQ ID NO: 1988614 - RNA, 22 nt, Human
gccagcccauuugggcagagag

SEQ ID NO: 1988615 - RNA, 13 nt, Human
gccaggccagcug

SEQ ID NO: 1988616 - RNA, 14 nt, Human
gccaggcccucugc

SEQ ID NO: 1988617 - RNA, 13 nt, Human
gccaggcccucug

SEQ ID NO: 1988618 - RNA, 18 nt, Human
gccaggccacaagacccu

SEQ ID NO: 1988619 - RNA, 13 nt, Human
gccaggccacaag

SEQ ID NO: 1988620 - RNA, 21 nt, Human
gccaggccacaagacccuugu

SEQ ID NO: 1988621 - RNA, 15 nt, Human
gccaggccagaggga

SEQ ID NO: 1988622 - RNA, 12 nt, Human
gccaggccagcu

SEQ ID NO: 1988623 - RNA, 22 nt, Human
gccaggccagagggagugacag

SEQ ID NO: 1988624 - RNA, 13 nt, Human
gccaguugguccc

SEQ ID NO: 1988625 - RNA, 18 nt, Human
gccagugcgggugcagac

SEQ ID NO: 1988626 - RNA, 13 nt, Human
gccagugugacaa

SEQ ID NO: 1988627 - RNA, 14 nt, Human
gccaguggcuggau

SEQ ID NO: 1988628 - RNA, 23 nt, Human
gccaguggcuggaucugugaggg

SEQ ID NO: 1988629 - RNA, 21 nt, Human
gccaguuggucccccuuccau

SEQ ID NO: 1988630 - RNA, 20 nt, Human
gccaguuggucccccuucca

SEQ ID NO: 1988631 - RNA, 18 nt, Human
gccaguuggucccccuuc

SEQ ID NO: 1988632 - RNA, 16 nt, Human
gccaguuggucccccu

SEQ ID NO: 1988633 - RNA, 20 nt, Human
gccaguuuuguuuccuuuca

SEQ ID NO: 1988634 - RNA, 21 nt, Human
gccaguucuuuccauaauaaa

SEQ ID NO: 1988635 - RNA, 23 nt, Human
gccaguuggucccccuuccaugg

SEQ ID NO: 1988636 - RNA, 22 nt, Human
gccaguuggucccccuuccaug

SEQ ID NO: 1988637 - RNA, 16 nt, Human
gccauaugaaaaggcu

SEQ ID NO: 1988638 - RNA, 20 nt, Human
gccauaagcaacaauuuuca

SEQ ID NO: 1988639 - RNA, 21 nt, Human
gccauaagcaacaauuuucag

SEQ ID NO: 1988640 - RNA, 23 nt, Human
gccauaagcaacaauuuucagau

SEQ ID NO: 1988641 - RNA, 17 nt, Human
gccauagaguacacugc

SEQ ID NO: 1988642 - RNA, 18 nt, Human
gccauagaguacacugcc

SEQ ID NO: 1988643 - RNA, 19 nt, Human
gccauagaguacacugccu

SEQ ID NO: 1988644 - RNA, 22 nt, Human
gccauagaguacacugccugcc

SEQ ID NO: 1988645 - RNA, 15 nt, Human
gccauaggcccuuuc

SEQ ID NO: 1988646 - RNA, 16 nt, Human
gccauaggcccuuuca

SEQ ID NO: 1988647 - RNA, 17 nt, Human
gcuuugaucccuucuua

SEQ ID NO: 1988648 - RNA, 14 nt, Human
gcuuugaucccuuc

SEQ ID NO: 1988649 - RNA, 15 nt, Human
gcuuuuggucugugu

SEQ ID NO: 1988650 - RNA, 18 nt, Human
gcuuuugucuaugggacu

SEQ ID NO: 1988651 - RNA, 12 nt, Human
gcuuuugugcau

SEQ ID NO: 1988652 - RNA, 20 nt, Human
gcuuuuuuaucaugugaaau

SEQ ID NO: 1988653 - RNA, 18 nt, Human
gcuuuuuuaucaugugaa

SEQ ID NO: 1988654 - RNA, 15 nt, Human
gcuuuuuuaucaugu

SEQ ID NO: 1988655 - RNA, 15 nt, Human
ggaaacagaggacca

SEQ ID NO: 1988656 - RNA, 16 nt, Human
ggaaacagaggaccag

SEQ ID NO: 1988657 - RNA, 17 nt, Human
ggaaacagaggaccagc

SEQ ID NO: 1988658 - RNA, 23 nt, Human
ggaaacacuaaauguuaaagaug

SEQ ID NO: 1988659 - RNA, 16 nt, Human
ggaaacacuaaauguu

SEQ ID NO: 1988660 - RNA, 17 nt, Human
ggaaacacuaaauguua

SEQ ID NO: 1988661 - RNA, 19 nt, Human
ggaaacacuaaauguuaaa

SEQ ID NO: 1988662 - RNA, 21 nt, Human
ggaaacacuaaauguuaaaga

SEQ ID NO: 1988663 - RNA, 16 nt, Human
ggaaacccagcucugg

SEQ ID NO: 1988664 - RNA, 16 nt, Human
ggaaacaacagcuuua

SEQ ID NO: 1988665 - RNA, 13 nt, Human
ggaaacaacagcu

SEQ ID NO: 1988666 - RNA, 13 nt, Human
gcuuuuuuugaaa

SEQ ID NO: 1988667 - RNA, 22 nt, Human
gcuuuuuucucugauacagaaa

SEQ ID NO: 1988668 - RNA, 18 nt, Human
ggaaaauuuuaaaaauac

SEQ ID NO: 1988669 - RNA, 20 nt, Human
ggaagacuucaucccucugg

SEQ ID NO: 1988670 - RNA, 17 nt, Human
ggaagacuucaucccuc

SEQ ID NO: 1988671 - RNA, 19 nt, Human
ggaagaauuuacuuuggaa

SEQ ID NO: 1988672 - RNA, 19 nt, Human
ggaacacuccuucacagau

SEQ ID NO: 1988673 - RNA, 15 nt, Human
ggaacacuccuucac

SEQ ID NO: 1988674 - RNA, 23 nt, Human
ggaacaaggcaaggcugucaauu

SEQ ID NO: 1988675 - RNA, 13 nt, Human
ggaacaaguugag

SEQ ID NO: 1988676 - RNA, 23 nt, Human
ggaacaaguugagcuaugacuua

SEQ ID NO: 1988677 - RNA, 13 nt, Human
ggaacaccuccuc

SEQ ID NO: 1988678 - RNA, 17 nt, Human
ggaacaccauaggucac

SEQ ID NO: 1988679 - RNA, 14 nt, Human
ggaacugcugggcu

SEQ ID NO: 1988680 - RNA, 15 nt, Human
ggaacugcugggcuu

SEQ ID NO: 1988681 - RNA, 15 nt, Human
ggaagaaaacacugu

SEQ ID NO: 1988682 - RNA, 16 nt, Human
ggaagacaaugugaaa

SEQ ID NO: 1988683 - RNA, 14 nt, Human
ggaagacaauguga

SEQ ID NO: 1988684 - RNA, 21 nt, Human
ggaacaaggcaaggcugucaa

SEQ ID NO: 1988685 - RNA, 17 nt, Human
ggaacaaggcaaggcug

SEQ ID NO: 1988686 - RNA, 15 nt, Human
ggaacaaggcaaggc

SEQ ID NO: 1988687 - RNA, 13 nt, Human
ggaacaaaucuuc

SEQ ID NO: 1988688 - RNA, 15 nt, Human
ggaacaaaucuuccu

SEQ ID NO: 1988689 - RNA, 17 nt, Human
ggaaaugucaacaagua

SEQ ID NO: 1988690 - RNA, 18 nt, Human
ggaaaugguauccagaau

SEQ ID NO: 1988691 - RNA, 14 nt, Human
ggaaauuaagaaga

SEQ ID NO: 1988692 - RNA, 19 nt, Human
ggaaauuaagaagaaacua

SEQ ID NO: 1988693 - RNA, 12 nt, Human
ggaaauuucacg

SEQ ID NO: 1988694 - RNA, 22 nt, Human
ggaaaugggcagagcagagacc

SEQ ID NO: 1988695 - RNA, 18 nt, Human
ggaaaugggcagagcaga

SEQ ID NO: 1988696 - RNA, 17 nt, Human
ggaaaugggcagagcag

SEQ ID NO: 1988697 - RNA, 16 nt, Human
ggaaaugggcagagca

SEQ ID NO: 1988698 - RNA, 14 nt, Human
ggaaaugggcagag

SEQ ID NO: 1988699 - RNA, 14 nt, Human
ggaaaugcugauuu

SEQ ID NO: 1988700 - RNA, 14 nt, Human
ggaaaccugucuga

SEQ ID NO: 1988701 - RNA, 23 nt, Human
gcugguucaggguuggccccugc

SEQ ID NO: 1988702 - RNA, 20 nt, Human
gcuguagacauuugcuauga

SEQ ID NO: 1988703 - RNA, 19 nt, Human
gcuguauuagucacagaga

SEQ ID NO: 1988704 - RNA, 13 nt, Human
gcuggaucuguga

SEQ ID NO: 1988705 - RNA, 17 nt, Human
gcuggaguuggggcaga

SEQ ID NO: 1988706 - RNA, 20 nt, Human
gcuggaguuggggcagagga

SEQ ID NO: 1988707 - RNA, 19 nt, Human
gcuggagugcaguggcgaa

SEQ ID NO: 1988708 - RNA, 14 nt, Human
gcuucaaggauccu

SEQ ID NO: 1988709 - RNA, 16 nt, Human
gcuucaaauuguaagc

SEQ ID NO: 1988710 - RNA, 14 nt, Human
gcuucaguggcagc

SEQ ID NO: 1988711 - RNA, 15 nt, Human
gcuucaguggcagcu

SEQ ID NO: 1988712 - RNA, 17 nt, Human
gcuuaaaaaaaacucuu

SEQ ID NO: 1988713 - RNA, 13 nt, Human
gcuuaauuccaau

SEQ ID NO: 1988714 - RNA, 22 nt, Human
gcuuaauuauugauguuuucau

SEQ ID NO: 1988715 - RNA, 13 nt, Human
gcuguuggcuggg

SEQ ID NO: 1988716 - RNA, 21 nt, Human
gcuguugcugauuuuauucuu

SEQ ID NO: 1988717 - RNA, 14 nt, Human
gcuguuggcugggg

SEQ ID NO: 1988718 - RNA, 23 nt, Human
gcuguuggccucugcaaaggaaa

SEQ ID NO: 1988719 - RNA, 16 nt, Human
gcuguuugguuuuaaa

SEQ ID NO: 1988720 - RNA, 19 nt, Human
gcuguuugguuuuaaaaua

SEQ ID NO: 1988721 - RNA, 12 nt, Human
gcugugccucug

SEQ ID NO: 1988722 - RNA, 22 nt, Human
gcuuccagugaggcucugcccu

SEQ ID NO: 1988723 - RNA, 19 nt, Human
gcuuugagguggaagaggg

SEQ ID NO: 1988724 - RNA, 22 nt, Human
gcuuugagguggaagagggcug

SEQ ID NO: 1988725 - RNA, 12 nt, Human
gcuuugauauau

SEQ ID NO: 1988726 - RNA, 19 nt, Human
gcuuuccucaucaggccau

SEQ ID NO: 1988727 - RNA, 17 nt, Human
gcuuuccuacuugcacu

SEQ ID NO: 1988728 - RNA, 13 nt, Human
gcuuucucuucau

SEQ ID NO: 1988729 - RNA, 14 nt, Human
gcuuucucuucaua

SEQ ID NO: 1988730 - RNA, 15 nt, Human
gcuuucucuucauau

SEQ ID NO: 1988731 - RNA, 16 nt, Human
gcuuuccucuuccuga

SEQ ID NO: 1988732 - RNA, 15 nt, Human
gcuuuccuaaaacag

SEQ ID NO: 1988733 - RNA, 18 nt, Human
gcuuguaaauagcucagg

SEQ ID NO: 1988734 - RNA, 19 nt, Human
gcuuguaaauagcucaggu

SEQ ID NO: 1988735 - RNA, 22 nt, Human
gcuuuccccaugucucgacuca

SEQ ID NO: 1988736 - RNA, 21 nt, Human
gcuuuccccaugucucgacuc

SEQ ID NO: 1988737 - RNA, 18 nt, Human
gcuugaccuuuaagagaa

SEQ ID NO: 1988738 - RNA, 23 nt, Human
gcuugaccgugaggccagagaca

SEQ ID NO: 1988739 - RNA, 22 nt, Human
gcuugaccuuuaagagaaauga

SEQ ID NO: 1988740 - RNA, 17 nt, Human
gcuuguaaauagcucag

SEQ ID NO: 1988741 - RNA, 18 nt, Human
gcuugaagcaaacaguug

SEQ ID NO: 1988742 - RNA, 20 nt, Human
gcuugaccgugaggccagag

SEQ ID NO: 1988743 - RNA, 15 nt, Human
gcuucuucagagacu

SEQ ID NO: 1988744 - RNA, 12 nt, Human
gcuucuucagag

SEQ ID NO: 1988745 - RNA, 15 nt, Human
gcuuccugaggggag

SEQ ID NO: 1988746 - RNA, 23 nt, Human
gcuuccugaggggagacagagca

SEQ ID NO: 1988747 - RNA, 23 nt, Human
gcuuccagugaggcucugcccuu

SEQ ID NO: 1988748 - RNA, 21 nt, Human
gcuggagaggagcccugccuc

SEQ ID NO: 1988749 - RNA, 22 nt, Human
gcuggagaggagcccugccucu

SEQ ID NO: 1988750 - RNA, 22 nt, Human
gcuggagauacuuggucacagc

SEQ ID NO: 1988751 - RNA, 12 nt, Human
gcugcugugaag

SEQ ID NO: 1988752 - RNA, 17 nt, Human
gcugccccuggcagccc

SEQ ID NO: 1988753 - RNA, 13 nt, Human
gcugccccugccu

SEQ ID NO: 1988754 - RNA, 14 nt, Human
gcugccccugccuu

SEQ ID NO: 1988755 - RNA, 16 nt, Human
gcugccccuggcagcc

SEQ ID NO: 1988756 - RNA, 15 nt, Human
gcugccccuggcagc

SEQ ID NO: 1988757 - RNA, 13 nt, Human
gcugccccuggca

SEQ ID NO: 1988758 - RNA, 17 nt, Human
gcugccauccagguuca

SEQ ID NO: 1988759 - RNA, 12 nt, Human
gcugcugacagu

SEQ ID NO: 1988760 - RNA, 12 nt, Human
gcugcugagccg

SEQ ID NO: 1988761 - RNA, 14 nt, Human
gcugcugagccgca

SEQ ID NO: 1988762 - RNA, 18 nt, Human
gcugcugagccgcagaga

SEQ ID NO: 1988763 - RNA, 15 nt, Human
gcugcugagccgcag

SEQ ID NO: 1988764 - RNA, 16 nt, Human
gcugcugagccgcaga

SEQ ID NO: 1988765 - RNA, 15 nt, Human
gcugcaccagguaga

SEQ ID NO: 1988766 - RNA, 14 nt, Human
gcugcaccccuucc

SEQ ID NO: 1988767 - RNA, 15 nt, Human
gcugcaccccuuccu

SEQ ID NO: 1988768 - RNA, 16 nt, Human
gcugcaccccuuccug

SEQ ID NO: 1988769 - RNA, 15 nt, Human
gcugcacccucaggc

SEQ ID NO: 1988770 - RNA, 13 nt, Human
gcugcacccucag

SEQ ID NO: 1988771 - RNA, 21 nt, Human
gcugcagagcagugggccugg

SEQ ID NO: 1988772 - RNA, 13 nt, Human
gcugcagagcagu

SEQ ID NO: 1988773 - RNA, 20 nt, Human
gcugcagagcagugggccug

SEQ ID NO: 1988774 - RNA, 19 nt, Human
gcugcaccccuuccugggc

SEQ ID NO: 1988775 - RNA, 20 nt, Human
gcugcaccccuuccugggca

SEQ ID NO: 1988776 - RNA, 21 nt, Human
gcugcaccccuuccugggcac

SEQ ID NO: 1988777 - RNA, 16 nt, Human
gcugcacccucaggca

SEQ ID NO: 1988778 - RNA, 16 nt, Human
gcugcagccugcgcca

SEQ ID NO: 1988779 - RNA, 21 nt, Human
gcugcagccugcgccaccgcc

SEQ ID NO: 1988780 - RNA, 17 nt, Human
gcugcagggcuuuaaaa

SEQ ID NO: 1988781 - RNA, 19 nt, Human
gcugcagggcuuuaaaauu

SEQ ID NO: 1988782 - RNA, 22 nt, Human
gcugccaguggggccugaggcu

SEQ ID NO: 1988783 - RNA, 17 nt, Human
gcugccaguaccagccc

SEQ ID NO: 1988784 - RNA, 12 nt, Human
gcugccauccag

SEQ ID NO: 1988785 - RNA, 13 nt, Human
gcugccauccagg

SEQ ID NO: 1988786 - RNA, 15 nt, Human
gcugaguagcucugc

SEQ ID NO: 1988787 - RNA, 18 nt, Human
gcugaguagcucugccuu

SEQ ID NO: 1988788 - RNA, 15 nt, Human
gcugaggugggagga

SEQ ID NO: 1988789 - RNA, 20 nt, Human
gcucucaggccagcugcuug

SEQ ID NO: 1988790 - RNA, 19 nt, Human
gcucucaggccagcugcuu

SEQ ID NO: 1988791 - RNA, 18 nt, Human
gcucucaggccagcugcu

SEQ ID NO: 1988792 - RNA, 17 nt, Human
gcucucaggccagcugc

SEQ ID NO: 1988793 - RNA, 18 nt, Human
gcucucaaguuaucaggg

SEQ ID NO: 1988794 - RNA, 19 nt, Human
gcucucaccuugguuccug

SEQ ID NO: 1988795 - RNA, 21 nt, Human
gcucucaccuugguuccuggg

SEQ ID NO: 1988796 - RNA, 19 nt, Human
gcucuacugaggugcuaug

SEQ ID NO: 1988797 - RNA, 16 nt, Human
gcuccucuccccagca

SEQ ID NO: 1988798 - RNA, 19 nt, Human
gcuccucuccccagcaagu

SEQ ID NO: 1988799 - RNA, 20 nt, Human
gcuccacuuggucugugaga

SEQ ID NO: 1988800 - RNA, 9 nt, Human
gcuccagac

SEQ ID NO: 1988801 - RNA, 21 nt, Human
gcuccagacacauguccaaga

SEQ ID NO: 1988802 - RNA, 18 nt, Human
gcuccagacacaugucca

SEQ ID NO: 1988803 - RNA, 23 nt, Human
gcuccagacacauguccaagaag

SEQ ID NO: 1988804 - RNA, 19 nt, Human
gcuccucccggugcccaag

SEQ ID NO: 1988805 - RNA, 16 nt, Human
gcuccucccggugccc

SEQ ID NO: 1988806 - RNA, 15 nt, Human
gcuccucuccccagc

SEQ ID NO: 1988807 - RNA, 13 nt, Human
gcuccagcucacc

SEQ ID NO: 1988808 - RNA, 14 nt, Human
gcuccagcucacca

SEQ ID NO: 1988809 - RNA, 11 nt, Human
gcuccagccug

SEQ ID NO: 1988810 - RNA, 23 nt, Human
gcucccaggcauuccccaggagg

SEQ ID NO: 1988811 - RNA, 17 nt, Human
gcuccagcucaccagcc

SEQ ID NO: 1988812 - RNA, 20 nt, Human
gcucugaucauccacugugc

SEQ ID NO: 1988813 - RNA, 14 nt, Human
gcucugacaaagcu

SEQ ID NO: 1988814 - RNA, 17 nt, Human
gcucucuuuuauucugu

SEQ ID NO: 1988815 - RNA, 21 nt, Human
gcucugcccauccugccccug

SEQ ID NO: 1988816 - RNA, 16 nt, Human
gcucuggagcccacug

SEQ ID NO: 1988817 - RNA, 15 nt, Human
gcucuggagcccacu

SEQ ID NO: 1988818 - RNA, 15 nt, Human
gcucugcccauccug

SEQ ID NO: 1988819 - RNA, 19 nt, Human
gcucugacaaagcuucccg

SEQ ID NO: 1988820 - RNA, 21 nt, Human
gcucugaucauccacugugcc

SEQ ID NO: 1988821 - RNA, 22 nt, Human
gcucugaucauccacugugcca

SEQ ID NO: 1988822 - RNA, 17 nt, Human
gcugaauacagaggcaa

SEQ ID NO: 1988823 - RNA, 22 nt, Human
gcugaauugagccuaaaaauaa

SEQ ID NO: 1988824 - RNA, 23 nt, Human
gcugaaggcucgagcaugccugg

SEQ ID NO: 1988825 - RNA, 20 nt, Human
gcugaacuuguuuucuggga

SEQ ID NO: 1988826 - RNA, 14 nt, Human
gcugaggccucuca

SEQ ID NO: 1988827 - RNA, 16 nt, Human
gcugagccuucugagc

SEQ ID NO: 1988828 - RNA, 13 nt, Human
gcugacagacaca

SEQ ID NO: 1988829 - RNA, 12 nt, Human
gcugagccucag

SEQ ID NO: 1988830 - RNA, 16 nt, Human
gcugagccucagucuc

SEQ ID NO: 1988831 - RNA, 22 nt, Human
gcugaaaauugccuuucugugu

SEQ ID NO: 1988832 - RNA, 23 nt, Human
gcugaacagaugaccccugccca

SEQ ID NO: 1988833 - RNA, 15 nt, Human
gcugaacauugcaua

SEQ ID NO: 1988834 - RNA, 17 nt, Human
gcugaacauugcauaua

SEQ ID NO: 1988835 - RNA, 12 nt, Human
gcucuuuuccua

SEQ ID NO: 1988836 - RNA, 17 nt, Human
gcucuggagcccacugu

SEQ ID NO: 1988837 - RNA, 17 nt, Human
gcucugugcccacccuc

SEQ ID NO: 1988838 - RNA, 23 nt, Human
gcucugucgcccaggcuggagug

SEQ ID NO: 1988839 - RNA, 12 nt, Human
ggccugagcugg

SEQ ID NO: 1988840 - RNA, 15 nt, Human
ggccugagcugggau

SEQ ID NO: 1988841 - RNA, 13 nt, Human
ggccuccauccug

SEQ ID NO: 1988842 - RNA, 16 nt, Human
ggccuugaguccccca

SEQ ID NO: 1988843 - RNA, 15 nt, Human
ggccuucucugaagg

SEQ ID NO: 1988844 - RNA, 16 nt, Human
ggccuucucugaagga

SEQ ID NO: 1988845 - RNA, 13 nt, Human
ggccuuuggcuuc

SEQ ID NO: 1988846 - RNA, 13 nt, Human
ggccuuucccacu

SEQ ID NO: 1988847 - RNA, 22 nt, Human
ggcgagaccugauuucuccugc

SEQ ID NO: 1988848 - RNA, 14 nt, Human
ggccuuuggcuuca

SEQ ID NO: 1988849 - RNA, 18 nt, Human
ggcgaaaucccugcucac

SEQ ID NO: 1988850 - RNA, 22 nt, Human
ggcgaaaucccugcucacugca

SEQ ID NO: 1988851 - RNA, 15 nt, Human
ggcgaaucauuuguu

SEQ ID NO: 1988852 - RNA, 22 nt, Human
ggccugagugagaggggaggcc

SEQ ID NO: 1988853 - RNA, 20 nt, Human
ggccugagugagaggggagg

SEQ ID NO: 1988854 - RNA, 21 nt, Human
ggccuggccagaugcaccagc

SEQ ID NO: 1988855 - RNA, 21 nt, Human
ggccugugucuaguuguuuga

SEQ ID NO: 1988856 - RNA, 12 nt, Human
ggccuggcccau

SEQ ID NO: 1988857 - RNA, 20 nt, Human
ggccuguggaucaaauccag

SEQ ID NO: 1988858 - RNA, 23 nt, Human
ggccuucggccuccauccugagg

SEQ ID NO: 1988859 - RNA, 12 nt, Human
ggccuucucuga

SEQ ID NO: 1988860 - RNA, 17 nt, Human
ggcucacugcagccuca

SEQ ID NO: 1988861 - RNA, 16 nt, Human
ggcucacugcauccuc

SEQ ID NO: 1988862 - RNA, 19 nt, Human
ggcucacugcauccuccgc

SEQ ID NO: 1988863 - RNA, 16 nt, Human
ggcucacugcagccuc

SEQ ID NO: 1988864 - RNA, 14 nt, Human
ggcgugcaguggug

SEQ ID NO: 1988865 - RNA, 19 nt, Human
ggcgugcaguggugcgauc

SEQ ID NO: 1988866 - RNA, 14 nt, Human
ggcucagcaaggcc

SEQ ID NO: 1988867 - RNA, 15 nt, Human
ggcucagcaaggcca

SEQ ID NO: 1988868 - RNA, 17 nt, Human
ggcucagcaaggccacc

SEQ ID NO: 1988869 - RNA, 18 nt, Human
ggcucagcaaggccaccu

SEQ ID NO: 1988870 - RNA, 19 nt, Human
ggcucagcaaggccaccuc

SEQ ID NO: 1988871 - RNA, 20 nt, Human
ggcucagcaaggccaccucu

SEQ ID NO: 1988872 - RNA, 21 nt, Human
ggcucagcaaggccaccucuu

SEQ ID NO: 1988873 - RNA, 22 nt, Human
ggcucagcaaggccaccucuuc

SEQ ID NO: 1988874 - RNA, 19 nt, Human
ggcucagcaaaagaugcuu

SEQ ID NO: 1988875 - RNA, 13 nt, Human
ggcucagcaaggc

SEQ ID NO: 1988876 - RNA, 23 nt, Human
ggcucagcaaaagaugcuucuca

SEQ ID NO: 1988877 - RNA, 21 nt, Human
ggcucagcggggacagcuccu

SEQ ID NO: 1988878 - RNA, 22 nt, Human
ggcucagcggggacagcuccuu

SEQ ID NO: 1988879 - RNA, 23 nt, Human
ggcucagcggggacagcuccuuc

SEQ ID NO: 1988880 - RNA, 17 nt, Human
ggcagugggagcugccu

SEQ ID NO: 1988881 - RNA, 20 nt, Human
ggcacagggccuggcccaug

SEQ ID NO: 1988882 - RNA, 16 nt, Human
ggcaccagcagccugg

SEQ ID NO: 1988883 - RNA, 15 nt, Human
ggcaccagcagccug

SEQ ID NO: 1988884 - RNA, 24 nt, Human
ggcacugcuuccagugaggcucug

SEQ ID NO: 1988885 - RNA, 18 nt, Human
ggcagugggagcugccug

SEQ ID NO: 1988886 - RNA, 19 nt, Human
ggcagugggagcugccugu

SEQ ID NO: 1988887 - RNA, 23 nt, Human
ggcauauauguacuaguggcaug

SEQ ID NO: 1988888 - RNA, 18 nt, Human
ggcauccaguaucuugaa

SEQ ID NO: 1988889 - RNA, 21 nt, Human
ggcaucaagaggugggagggc

SEQ ID NO: 1988890 - RNA, 20 nt, Human
ggcauauauuaaaagcaggc

SEQ ID NO: 1988891 - RNA, 13 nt, Human
ggcauccaugggg

SEQ ID NO: 1988892 - RNA, 22 nt, Human
ggcauccauggggucucucaca

SEQ ID NO: 1988893 - RNA, 18 nt, Human
ggcauuuuacuguacaga

SEQ ID NO: 1988894 - RNA, 22 nt, Human
ggcauuuucccccuuggcucuc

SEQ ID NO: 1988895 - RNA, 16 nt, Human
ggccaggcuggucuca

SEQ ID NO: 1988896 - RNA, 18 nt, Human
ggccaggcuggucucaaa

SEQ ID NO: 1988897 - RNA, 14 nt, Human
ggccaggcuggucu

SEQ ID NO: 1988898 - RNA, 23 nt, Human
ggccaaaagcuucccucccugcu

SEQ ID NO: 1988899 - RNA, 15 nt, Human
ggccaaacaggcccu

SEQ ID NO: 1988900 - RNA, 15 nt, Human
ggccaaaagcuuccc

SEQ ID NO: 1988901 - RNA, 17 nt, Human
ggccaaacucaccugcc

SEQ ID NO: 1988902 - RNA, 21 nt, Human
ggccaaacucaccugccccuc

SEQ ID NO: 1988903 - RNA, 19 nt, Human
ggccaguggcuggaucugu

SEQ ID NO: 1988904 - RNA, 16 nt, Human
ggccagugugacaagg

SEQ ID NO: 1988905 - RNA, 14 nt, Human
ggccaucuggagag

SEQ ID NO: 1988906 - RNA, 16 nt, Human
ggccaucuggagagcc

SEQ ID NO: 1988907 - RNA, 20 nt, Human
ggccaucuggagagcccaga

SEQ ID NO: 1988908 - RNA, 19 nt, Human
ggcccagggggcuuccuga

SEQ ID NO: 1988909 - RNA, 22 nt, Human
ggcccagggggcuuccugaggg

SEQ ID NO: 1988910 - RNA, 13 nt, Human
ggccccaccugca

SEQ ID NO: 1988911 - RNA, 16 nt, Human
ggccccaccugcagcu

SEQ ID NO: 1988912 - RNA, 19 nt, Human
ggccccaccugcagcuccc

SEQ ID NO: 1988913 - RNA, 13 nt, Human
ggccccaccuggc

SEQ ID NO: 1988914 - RNA, 15 nt, Human
ggccccaccuggccc

SEQ ID NO: 1988915 - RNA, 22 nt, Human
ggccccaccuggcccucucuga

SEQ ID NO: 1988916 - RNA, 17 nt, Human
ggcccugugccuuggug

SEQ ID NO: 1988917 - RNA, 17 nt, Human
ggcccuucucuccagcc

SEQ ID NO: 1988918 - RNA, 16 nt, Human
ggcccuucucuccagc

SEQ ID NO: 1988919 - RNA, 13 nt, Human
ggcccuuccucuc

SEQ ID NO: 1988920 - RNA, 15 nt, Human
ggcccuuccucucca

SEQ ID NO: 1988921 - RNA, 18 nt, Human
ggcccuucucuccagccc

SEQ ID NO: 1988922 - RNA, 17 nt, Human
ggcccuuccucuccacu

SEQ ID NO: 1988923 - RNA, 16 nt, Human
ggccgauggggcaguc

SEQ ID NO: 1988924 - RNA, 22 nt, Human
ggagcauuggggauguuuuucu

SEQ ID NO: 1988925 - RNA, 16 nt, Human
ggagcaucagugcccu

SEQ ID NO: 1988926 - RNA, 20 nt, Human
ggaggucaaggcugcaguga

SEQ ID NO: 1988927 - RNA, 14 nt, Human
ggaggucgaggcag

SEQ ID NO: 1988928 - RNA, 14 nt, Human
ggaggugaccccag

SEQ ID NO: 1988929 - RNA, 21 nt, Human
ggagguagcuuugagguggaa

SEQ ID NO: 1988930 - RNA, 20 nt, Human
ggaggccuugggcucugcug

SEQ ID NO: 1988931 - RNA, 16 nt, Human
ggaggggggagguggg

SEQ ID NO: 1988932 - RNA, 11 nt, Human
ggaggccagcc

SEQ ID NO: 1988933 - RNA, 13 nt, Human
ggaggccaccucc

SEQ ID NO: 1988934 - RNA, 14 nt, Human
ggaggccaccuccu

SEQ ID NO: 1988935 - RNA, 18 nt, Human
ggaggccaccuccuaaaa

SEQ ID NO: 1988936 - RNA, 12 nt, Human
ggaggccagccu

SEQ ID NO: 1988937 - RNA, 22 nt, Human
ggaggaccagggcuggggcagc

SEQ ID NO: 1988938 - RNA, 13 nt, Human
ggaggaccagggc

SEQ ID NO: 1988939 - RNA, 12 nt, Human
ggaggaccaggg

SEQ ID NO: 1988940 - RNA, 18 nt, Human
ggagcuggcuccagccug

SEQ ID NO: 1988941 - RNA, 20 nt, Human
ggagcuggcuccagccugga

SEQ ID NO: 1988942 - RNA, 19 nt, Human
ggaggaaggaaacccagcu

SEQ ID NO: 1988943 - RNA, 23 nt, Human
ggaggaaggaaacccagcucugg

SEQ ID NO: 1988944 - RNA, 20 nt, Human
ggaggaaggaaacccagcuc

SEQ ID NO: 1988945 - RNA, 13 nt, Human
ggagccaggaggg

SEQ ID NO: 1988946 - RNA, 12 nt, Human
ggagcccaggag

SEQ ID NO: 1988947 - RNA, 13 nt, Human
ggagcccaggagu

SEQ ID NO: 1988948 - RNA, 18 nt, Human
ggagcccaggagucccac

SEQ ID NO: 1988949 - RNA, 16 nt, Human
ggagccaauggagacu

SEQ ID NO: 1988950 - RNA, 16 nt, Human
ggagccccgaggccuu

SEQ ID NO: 1988951 - RNA, 22 nt, Human
ggagccccgaggccuucucuga

SEQ ID NO: 1988952 - RNA, 12 nt, Human
ggagcugccugu

SEQ ID NO: 1988953 - RNA, 21 nt, Human
ggagcugccuguucagcucca

SEQ ID NO: 1988954 - RNA, 22 nt, Human
ggauguugaaaaaguucugcag

SEQ ID NO: 1988955 - RNA, 16 nt, Human
ggauguucugggacac

SEQ ID NO: 1988956 - RNA, 13 nt, Human
ggauguucuggga

SEQ ID NO: 1988957 - RNA, 13 nt, Human
ggaugucugggcc

SEQ ID NO: 1988958 - RNA, 15 nt, Human
ggauguucugggaca

SEQ ID NO: 1988959 - RNA, 16 nt, Human
ggcaauguuuugcuuu

SEQ ID NO: 1988960 - RNA, 24 nt, Human
ggcacagaaaauggaagacagcuc

SEQ ID NO: 1988961 - RNA, 22 nt, Human
ggcacaaucucggcucacugca

SEQ ID NO: 1988962 - RNA, 13 nt, Human
ggcacagggagag

SEQ ID NO: 1988963 - RNA, 21 nt, Human
ggcacaggcagggcaggacca

SEQ ID NO: 1988964 - RNA, 12 nt, Human
ggcacaggcagg

SEQ ID NO: 1988965 - RNA, 13 nt, Human
ggcacaggcaggg

SEQ ID NO: 1988966 - RNA, 14 nt, Human
ggcacaggcagggc

SEQ ID NO: 1988967 - RNA, 15 nt, Human
ggcacaggcagggca

SEQ ID NO: 1988968 - RNA, 16 nt, Human
ggcacaggcagggcag

SEQ ID NO: 1988969 - RNA, 14 nt, Human
ggcacagggccugg

SEQ ID NO: 1988970 - RNA, 15 nt, Human
ggcacagggccuggc

SEQ ID NO: 1988971 - RNA, 17 nt, Human
ggcacagggccuggccc

SEQ ID NO: 1988972 - RNA, 18 nt, Human
ggcacagggccuggccca

SEQ ID NO: 1988973 - RNA, 16 nt, Human
ggcacagggcaguggg

SEQ ID NO: 1988974 - RNA, 16 nt, Human
ggcacagggcaugaaa

SEQ ID NO: 1988975 - RNA, 19 nt, Human
ggcacagggcaugaaauga

SEQ ID NO: 1988976 - RNA, 12 nt, Human
ggcacagggccu

SEQ ID NO: 1988977 - RNA, 13 nt, Human
ggcacagggccug

SEQ ID NO: 1988978 - RNA, 12 nt, Human
ggcacagccugc

SEQ ID NO: 1988979 - RNA, 13 nt, Human
ggcacagccugca

SEQ ID NO: 1988980 - RNA, 12 nt, Human
ggcacagccugg

SEQ ID NO: 1988981 - RNA, 14 nt, Human
ggcacagccugcac

SEQ ID NO: 1988982 - RNA, 15 nt, Human
ggcacagccugcacu

SEQ ID NO: 1988983 - RNA, 15 nt, Human
ggagugcagugagcc

SEQ ID NO: 1988984 - RNA, 12 nt, Human
ggagugcagugg

SEQ ID NO: 1988985 - RNA, 22 nt, Human
ggagugcaguggcgaaaucccu

SEQ ID NO: 1988986 - RNA, 14 nt, Human
ggaguggccacaga

SEQ ID NO: 1988987 - RNA, 12 nt, Human
ggaguucuucuu

SEQ ID NO: 1988988 - RNA, 15 nt, Human
ggaguucugguuccu

SEQ ID NO: 1988989 - RNA, 21 nt, Human
ggaguuggaagugugugaucu

SEQ ID NO: 1988990 - RNA, 18 nt, Human
ggaguuggaguagaaugu

SEQ ID NO: 1988991 - RNA, 14 nt, Human
ggauccugagccag

SEQ ID NO: 1988992 - RNA, 13 nt, Human
ggauccugagcca

SEQ ID NO: 1988993 - RNA, 14 nt, Human
ggauccuccaggug

SEQ ID NO: 1988994 - RNA, 15 nt, Human
ggauccuccaggugc

SEQ ID NO: 1988995 - RNA, 16 nt, Human
ggauggggcugcaccg

SEQ ID NO: 1988996 - RNA, 21 nt, Human
ggauguacaaggacagccccu

SEQ ID NO: 1988997 - RNA, 22 nt, Human
ggaugggcagucauuuugcaga

SEQ ID NO: 1988998 - RNA, 15 nt, Human
ggauggcccagggug

SEQ ID NO: 1988999 - RNA, 18 nt, Human
ggauggauuuccagccaa

SEQ ID NO: 1989000 - RNA, 18 nt, Human
ggauggaggaagaacuga

SEQ ID NO: 1989001 - RNA, 16 nt, Human
gggaagagcuuagaaa

SEQ ID NO: 1989002 - RNA, 16 nt, Human
gggacagcuccuucug

SEQ ID NO: 1989003 - RNA, 23 nt, Human
gggacagaggggguggccuccca

SEQ ID NO: 1989004 - RNA, 22 nt, Human
gggacagaggggguggccuccc

SEQ ID NO: 1989005 - RNA, 13 nt, Human
gggacagaggggg

SEQ ID NO: 1989006 - RNA, 13 nt, Human
gggaaggauacaa

SEQ ID NO: 1989007 - RNA, 16 nt, Human
gggaaggauacaaaag

SEQ ID NO: 1989008 - RNA, 15 nt, Human
gggaagcuggccuga

SEQ ID NO: 1989009 - RNA, 16 nt, Human
gggaagcuggccugag

SEQ ID NO: 1989010 - RNA, 21 nt, Human
gggacagcuccuucuguccua

SEQ ID NO: 1989011 - RNA, 23 nt, Human
gggacagggaggugugaggcagg

SEQ ID NO: 1989012 - RNA, 21 nt, Human
aaaaauaugaccacacuccag

SEQ ID NO: 1989013 - RNA, 23 nt, Human
aaaaauaugaccacacuccagcu

SEQ ID NO: 1989014 - RNA, 14 nt, Human
aaaaauaucaaauu

SEQ ID NO: 1989015 - RNA, 15 nt, Human
aaaaauaucaaauua

SEQ ID NO: 1989016 - RNA, 16 nt, Human
aaaaauaucaaauuaa

SEQ ID NO: 1989017 - RNA, 15 nt, Human
aaaaauaucuguaag

SEQ ID NO: 1989018 - RNA, 18 nt, Human
aaaaauauacauguuuau

SEQ ID NO: 1989019 - RNA, 12 nt, Human
aaaaauauacau

SEQ ID NO: 1989020 - RNA, 14 nt, Human
aaaaauauacaugu

SEQ ID NO: 1989021 - RNA, 16 nt, Human
aaaaauauacauguuu

SEQ ID NO: 1989022 - RNA, 17 nt, Human
aaaaauauacauguuua

SEQ ID NO: 1989023 - RNA, 18 nt, Human
aaaaauccaaauauuguu

SEQ ID NO: 1989024 - RNA, 21 nt, Human
aaaaauccaaauauuguuaag

SEQ ID NO: 1989025 - RNA, 14 nt, Human
aaaaauccagaaac

SEQ ID NO: 1989026 - RNA, 12 nt, Human
aaaaaucaagua

SEQ ID NO: 1989027 - RNA, 18 nt, Human
aaaaauauuuuuuuuucu

SEQ ID NO: 1989028 - RNA, 13 nt, Human
aaaaauaugugaa

SEQ ID NO: 1989029 - RNA, 16 nt, Human
aaaaauaugugaagga

SEQ ID NO: 1989030 - RNA, 23 nt, Human
aaaaauaugugaaggaccuucac

SEQ ID NO: 1989031 - RNA, 13 nt, Human
aaaaauauuuaau

SEQ ID NO: 1989032 - RNA, 15 nt, Human
aaaaauauuuaaugu

SEQ ID NO: 1989033 - RNA, 16 nt, Human
aaaaauauuuaauguu

SEQ ID NO: 1989034 - RNA, 13 nt, Human
aaaagaugcuucu

SEQ ID NO: 1989035 - RNA, 23 nt, Human
aaaacugcugacuguuuucucuu

SEQ ID NO: 1989036 - RNA, 15 nt, Human
aaaacuguacuuuga

SEQ ID NO: 1989037 - RNA, 19 nt, Human
aaaacuguacuuugauuca

SEQ ID NO: 1989038 - RNA, 20 nt, Human
aaaacuguacuuugauucac

SEQ ID NO: 1989039 - RNA, 21 nt, Human
aaaacuguacuuugauucaca

SEQ ID NO: 1989040 - RNA, 22 nt, Human
aaaacugcugacuguuuucucu

SEQ ID NO: 1989041 - RNA, 12 nt, Human
aaaacccagcug

SEQ ID NO: 1989042 - RNA, 14 nt, Human
aaaacccagcugca

SEQ ID NO: 1989043 - RNA, 19 nt, Human
aaaacccagcugcaccccu

SEQ ID NO: 1989044 - RNA, 22 nt, Human
aaaacccagcugcaccccuucc

SEQ ID NO: 1989045 - RNA, 15 nt, Human
aaaacccagauaaag

SEQ ID NO: 1989046 - RNA, 19 nt, Human
aaaacucaaccaaauggua

SEQ ID NO: 1989047 - RNA, 23 nt, Human
aaaacucaaccaaaugguacaaa

SEQ ID NO: 1989048 - RNA, 19 nt, Human
aaaaccguguuugucucuu

SEQ ID NO: 1989049 - RNA, 21 nt, Human
aaaaccguguuugucucuucu

SEQ ID NO: 1989050 - RNA, 23 nt, Human
aaaaccguguuugucucuucugg

SEQ ID NO: 1989051 - RNA, 21 nt, Human
aaaaccaauguucucucuucu

SEQ ID NO: 1989052 - RNA, 14 nt, Human
aaaacaucauuccu

SEQ ID NO: 1989053 - RNA, 15 nt, Human
aaaacaugcuacaca

SEQ ID NO: 1989054 - RNA, 13 nt, Human
aaaacauguaugu

SEQ ID NO: 1989055 - RNA, 19 nt, Human
aaaacaucauuccuuuuua

SEQ ID NO: 1989056 - RNA, 21 nt, Human
aaaacaucauuccuuuuuauu

SEQ ID NO: 1989057 - RNA, 18 nt, Human
aaaacaguaguguauuaa

SEQ ID NO: 1989058 - RNA, 19 nt, Human
aaaaaugcugaacauugca

SEQ ID NO: 1989059 - RNA, 15 nt, Human
aaaaaugcugaacau

SEQ ID NO: 1989060 - RNA, 16 nt, Human
aaaaaugcugaacauu

SEQ ID NO: 1989061 - RNA, 14 nt, Human
aaaaaucucaaauu

SEQ ID NO: 1989062 - RNA, 14 nt, Human
aaaaaugcugaaca

SEQ ID NO: 1989063 - RNA, 14 nt, Human
gggaugggccugag

SEQ ID NO: 1989064 - RNA, 14 nt, Human
gggauggggcuggg

SEQ ID NO: 1989065 - RNA, 15 nt, Human
gggaugggagccggg

SEQ ID NO: 1989066 - RNA, 16 nt, Human
gggaugggagccgggc

SEQ ID NO: 1989067 - RNA, 13 nt, Human
gggauguuuuucu

SEQ ID NO: 1989068 - RNA, 22 nt, Human
gggaugugugugugcagagcug

SEQ ID NO: 1989069 - RNA, 14 nt, Human
gggaugucucucau

SEQ ID NO: 1989070 - RNA, 16 nt, Human
gggaugguguucaaaa

SEQ ID NO: 1989071 - RNA, 19 nt, Human
gggaggucgaggcaggagg

SEQ ID NO: 1989072 - RNA, 18 nt, Human
gggaggucgaggcaggag

SEQ ID NO: 1989073 - RNA, 17 nt, Human
gggaggucgaggcagga

SEQ ID NO: 1989074 - RNA, 18 nt, Human
gggagggcuccagacaca

SEQ ID NO: 1989075 - RNA, 17 nt, Human
gggagggcuccagacac

SEQ ID NO: 1989076 - RNA, 15 nt, Human
gggagggcuccagac

SEQ ID NO: 1989077 - RNA, 14 nt, Human
gggagggcuccaga

SEQ ID NO: 1989078 - RNA, 22 nt, Human
gggaggcucuggagcccacugu

SEQ ID NO: 1989079 - RNA, 19 nt, Human
gggagaaugucaguaugug

SEQ ID NO: 1989080 - RNA, 22 nt, Human
gggagaaugucaguauguggaa

SEQ ID NO: 1989081 - RNA, 16 nt, Human
aaaagcagcucucccc

SEQ ID NO: 1989082 - RNA, 14 nt, Human
aaaagcagcauaaa

SEQ ID NO: 1989083 - RNA, 17 nt, Human
aaaagcagcucuccccu

SEQ ID NO: 1989084 - RNA, 22 nt, Human
aaaagcaggcuucuaugaaaga

SEQ ID NO: 1989085 - RNA, 21 nt, Human
aaaagcacacucauccccuca

SEQ ID NO: 1989086 - RNA, 22 nt, Human
aaaacuguacuuugauucacau

SEQ ID NO: 1989087 - RNA, 14 nt, Human
aaaagauguagauu

SEQ ID NO: 1989088 - RNA, 22 nt, Human
aaaagauguagauuuauuucau

SEQ ID NO: 1989089 - RNA, 15 nt, Human
aaaagaugcaaugua

SEQ ID NO: 1989090 - RNA, 13 nt, Human
aaaagauguagau

SEQ ID NO: 1989091 - RNA, 13 nt, Human
gggagacagagca

SEQ ID NO: 1989092 - RNA, 19 nt, Human
gggaggccaucuggagagc

SEQ ID NO: 1989093 - RNA, 12 nt, Human
gggagcagcccc

SEQ ID NO: 1989094 - RNA, 19 nt, Human
gggaggccaaggugggagg

SEQ ID NO: 1989095 - RNA, 15 nt, Human
gggauuacaggugug

SEQ ID NO: 1989096 - RNA, 12 nt, Human
gggauuacaggu

SEQ ID NO: 1989097 - RNA, 14 nt, Human
gggauuacaggcgu

SEQ ID NO: 1989098 - RNA, 13 nt, Human
gggauuacaggcu

SEQ ID NO: 1989099 - RNA, 16 nt, Human
gggauuacaggcuccu

SEQ ID NO: 1989100 - RNA, 21 nt, Human
gggauuacaggcuccugccac

SEQ ID NO: 1989101 - RNA, 15 nt, Human
gggauugggccccug

SEQ ID NO: 1989102 - RNA, 18 nt, Human
gggauugauuuuaaaaug

SEQ ID NO: 1989103 - RNA, 16 nt, Human
gggauuguaaaauggu

SEQ ID NO: 1989104 - RNA, 17 nt, Human
gggauuguaaaauggug

SEQ ID NO: 1989105 - RNA, 14 nt, Human
gggcagaggaaagc

SEQ ID NO: 1989106 - RNA, 22 nt, Human
gggcagagcagagaccaucccu

SEQ ID NO: 1989107 - RNA, 17 nt, Human
gggcagagcagagacca

SEQ ID NO: 1989108 - RNA, 16 nt, Human
gggcaacccccagccu

SEQ ID NO: 1989109 - RNA, 18 nt, Human
gggcaacccccagccugc

SEQ ID NO: 1989110 - RNA, 16 nt, Human
gggcagagcagagacc

SEQ ID NO: 1989111 - RNA, 19 nt, Human
aaaagguaugcaaucaaau

SEQ ID NO: 1989112 - RNA, 19 nt, Human
aaaagggacugagaaauuu

SEQ ID NO: 1989113 - RNA, 14 nt, Human
gggcagccugccuu

SEQ ID NO: 1989114 - RNA, 16 nt, Human
gggcagaucucccaca

SEQ ID NO: 1989115 - RNA, 23 nt, Human
gggcagaggagaacuugcugccu

SEQ ID NO: 1989116 - RNA, 15 nt, Human
gggcagaggagaacu

SEQ ID NO: 1989117 - RNA, 21 nt, Human
gggcagaggagaacuugcugc

SEQ ID NO: 1989118 - RNA, 20 nt, Human
gggcuggguucuacccaggu

SEQ ID NO: 1989119 - RNA, 16 nt, Human
gggcugggcacugcuc

SEQ ID NO: 1989120 - RNA, 17 nt, Human
gggcugggcacugcucu

SEQ ID NO: 1989121 - RNA, 20 nt, Human
gggcugggcacugcucucac

SEQ ID NO: 1989122 - RNA, 16 nt, Human
gggcugggagcucugc

SEQ ID NO: 1989123 - RNA, 18 nt, Human
gggcugggagcucugcag

SEQ ID NO: 1989124 - RNA, 13 nt, Human
gggcugcccuggu

SEQ ID NO: 1989125 - RNA, 14 nt, Human
gggcugcccuggug

SEQ ID NO: 1989126 - RNA, 15 nt, Human
gggcugcccuggugc

SEQ ID NO: 1989127 - RNA, 21 nt, Human
gggcugcccuggugcugccac

SEQ ID NO: 1989128 - RNA, 18 nt, Human
gggcucagcaaaagaugc

SEQ ID NO: 1989129 - RNA, 22 nt, Human
gggcugcaccggcuggccuggc

SEQ ID NO: 1989130 - RNA, 10 nt, Human
gggcucagca

SEQ ID NO: 1989131 - RNA, 18 nt, Human
gggcucagagugggguag

SEQ ID NO: 1989132 - RNA, 18 nt, Human
gggcugcaugcgggcuuc

SEQ ID NO: 1989133 - RNA, 21 nt, Human
gggcugcaugcgggcuuccuc

SEQ ID NO: 1989134 - RNA, 20 nt, Human
aaaaugugagugguugaaua

SEQ ID NO: 1989135 - RNA, 18 nt, Human
aaaaugugagugguugaa

SEQ ID NO: 1989136 - RNA, 15 nt, Human
aaaaugugauaugua

SEQ ID NO: 1989137 - RNA, 22 nt, Human
gggcuggguucuacccaggugc

SEQ ID NO: 1989138 - RNA, 22 nt, Human
gggcugggcacugcucucaccu

SEQ ID NO: 1989139 - RNA, 20 nt, Human
aaaauuucuuagaaaacaau

SEQ ID NO: 1989140 - RNA, 12 nt, Human
aaaauuugaaac

SEQ ID NO: 1989141 - RNA, 13 nt, Human
aaaauuugaaaca

SEQ ID NO: 1989142 - RNA, 14 nt, Human
aaaauuugaaacau

SEQ ID NO: 1989143 - RNA, 15 nt, Human
aaaauuugaaacauu

SEQ ID NO: 1989144 - RNA, 16 nt, Human
aaaauuugaaacauug

SEQ ID NO: 1989145 - RNA, 17 nt, Human
aaaauuugaaacauugc

SEQ ID NO: 1989146 - RNA, 14 nt, Human
aaaauguuaggaca

SEQ ID NO: 1989147 - RNA, 12 nt, Human
aaaaugugugug

SEQ ID NO: 1989148 - RNA, 14 nt, Human
aaaauguuaagcau

SEQ ID NO: 1989149 - RNA, 21 nt, Human
aaaauuugaaacauugcuuuu

SEQ ID NO: 1989150 - RNA, 19 nt, Human
aaaauuugaaacauugcuu

SEQ ID NO: 1989151 - RNA, 20 nt, Human
aaaauuugaaacauugcuuu

SEQ ID NO: 1989152 - RNA, 13 nt, Human
aaaauuuguuuaa

SEQ ID NO: 1989153 - RNA, 16 nt, Human
ggggccugaggcuccu

SEQ ID NO: 1989154 - RNA, 23 nt, Human
aaacaugagguucucucuacugg

SEQ ID NO: 1989155 - RNA, 13 nt, Human
aaacaucucagag

SEQ ID NO: 1989156 - RNA, 13 nt, Human
aaacaucuccuua

SEQ ID NO: 1989157 - RNA, 22 nt, Human
aaacauccuacaagacacagug

SEQ ID NO: 1989158 - RNA, 21 nt, Human
aaacaucauuccuuuuuauuu

SEQ ID NO: 1989159 - RNA, 22 nt, Human
aaacaucauuccuuuuuauuua

SEQ ID NO: 1989160 - RNA, 18 nt, Human
aaacauccuacaagacac

SEQ ID NO: 1989161 - RNA, 16 nt, Human
aaacaucauuccuuuu

SEQ ID NO: 1989162 - RNA, 18 nt, Human
aaacaucauuccuuuuua

SEQ ID NO: 1989163 - RNA, 19 nt, Human
aaacaucauuccuuuuuau

SEQ ID NO: 1989164 - RNA, 20 nt, Human
aaacaucauuccuuuuuauu

SEQ ID NO: 1989165 - RNA, 12 nt, Human
ggggacagcucc

SEQ ID NO: 1989166 - RNA, 14 nt, Human
ggggacagcuccuu

SEQ ID NO: 1989167 - RNA, 20 nt, Human
ggggacagcuccuucugucc

SEQ ID NO: 1989168 - RNA, 17 nt, Human
aaacaccggguuccagc

SEQ ID NO: 1989169 - RNA, 18 nt, Human
aaacaccugacagccccu

SEQ ID NO: 1989170 - RNA, 23 nt, Human
aaacaccugacagccccucccuc

SEQ ID NO: 1989171 - RNA, 14 nt, Human
aaacagugcuguuu

SEQ ID NO: 1989172 - RNA, 20 nt, Human
aaacaagaccacguuucuaa

SEQ ID NO: 1989173 - RNA, 16 nt, Human
aaacacauuuuucuua

SEQ ID NO: 1989174 - RNA, 12 nt, Human
aaacacauuuuu

SEQ ID NO: 1989175 - RNA, 20 nt, Human
aaacaagcacuaaacaaaga

SEQ ID NO: 1989176 - RNA, 14 nt, Human
aaaaguauugccaa

SEQ ID NO: 1989177 - RNA, 18 nt, Human
aaaaguagaacuuuguau

SEQ ID NO: 1989178 - RNA, 20 nt, Human
aaaaguagaacuuuguauag

SEQ ID NO: 1989179 - RNA, 22 nt, Human
aaaaucuuauuaaaguuucaaa

SEQ ID NO: 1989180 - RNA, 23 nt, Human
aaaaucuuauuaaaguuucaaaa

SEQ ID NO: 1989181 - RNA, 12 nt, Human
aaaaucuuauua

SEQ ID NO: 1989182 - RNA, 16 nt, Human
aaaaucuuauuaaagu

SEQ ID NO: 1989183 - RNA, 18 nt, Human
aaaaucuuauuaaaguuu

SEQ ID NO: 1989184 - RNA, 21 nt, Human
aaaaucuuauuaaaguuucaa

SEQ ID NO: 1989185 - RNA, 16 nt, Human
aaaaguauugccaaac

SEQ ID NO: 1989186 - RNA, 16 nt, Human
aaaaucuuaauacugu

SEQ ID NO: 1989187 - RNA, 17 nt, Human
aaaaucuuaauacuguu

SEQ ID NO: 1989188 - RNA, 18 nt, Human
aaaaucuuaauacuguua

SEQ ID NO: 1989189 - RNA, 20 nt, Human
aaaaucuuaauacuguuauu

SEQ ID NO: 1989190 - RNA, 22 nt, Human
aaaaucuuaauacuguuauucu

SEQ ID NO: 1989191 - RNA, 21 nt, Human
aaaaugagccuggcaagaaug

SEQ ID NO: 1989192 - RNA, 14 nt, Human
aaaaugagccuggc

SEQ ID NO: 1989193 - RNA, 11 nt, Human
aaaaugaagaa

SEQ ID NO: 1989194 - RNA, 14 nt, Human
aaaaugaagaauuu

SEQ ID NO: 1989195 - RNA, 15 nt, Human
aaaaugaagaauuua

SEQ ID NO: 1989196 - RNA, 16 nt, Human
aaaaugaagaauuuaa

SEQ ID NO: 1989197 - RNA, 20 nt, Human
aaaaugcugaacauugcaua

SEQ ID NO: 1989198 - RNA, 15 nt, Human
aaaaugcugaacauu

SEQ ID NO: 1989199 - RNA, 16 nt, Human
aaaaugcugaacauug

SEQ ID NO: 1989200 - RNA, 18 nt, Human
aaaaugcugaacauugca

SEQ ID NO: 1989201 - RNA, 11 nt, Human
gggccaggagc

SEQ ID NO: 1989202 - RNA, 13 nt, Human
gggccaggcuggg

SEQ ID NO: 1989203 - RNA, 11 nt, Human
gggccagcucc

SEQ ID NO: 1989204 - RNA, 21 nt, Human
gggccaggcugggucgcccug

SEQ ID NO: 1989205 - RNA, 15 nt, Human
gggccaggcuggguc

SEQ ID NO: 1989206 - RNA, 14 nt, Human
gggccaggcugggu

SEQ ID NO: 1989207 - RNA, 21 nt, Human
gggccagucccugaggcaggu

SEQ ID NO: 1989208 - RNA, 18 nt, Human
gggccagucccugaggca

SEQ ID NO: 1989209 - RNA, 15 nt, Human
gggcgggaggauguu

SEQ ID NO: 1989210 - RNA, 23 nt, Human
gggcuacaccuuagccugcccuc

SEQ ID NO: 1989211 - RNA, 20 nt, Human
gggcuacccgugagcccuuc

SEQ ID NO: 1989212 - RNA, 22 nt, Human
gggccucggacuuagcugggag

SEQ ID NO: 1989213 - RNA, 15 nt, Human
gggccuccugugugu

SEQ ID NO: 1989214 - RNA, 13 nt, Human
gggccuccugugu

SEQ ID NO: 1989215 - RNA, 19 nt, Human
gggccucuuaugggcuggg

SEQ ID NO: 1989216 - RNA, 20 nt, Human
gggccucuuaugggcugggu

SEQ ID NO: 1989217 - RNA, 17 nt, Human
gggccugaggcuccuua

SEQ ID NO: 1989218 - RNA, 18 nt, Human
gggccugaggcuccuuag

SEQ ID NO: 1989219 - RNA, 23 nt, Human
gggccaguuggucccccuuccau

SEQ ID NO: 1989220 - RNA, 22 nt, Human
gggccaguuggucccccuucca

SEQ ID NO: 1989221 - RNA, 18 nt, Human
gggccaguuggucccccu

SEQ ID NO: 1989222 - RNA, 14 nt, Human
gggccaguuggucc

SEQ ID NO: 1989223 - RNA, 15 nt, Human
gggccgagccugccu

SEQ ID NO: 1989224 - RNA, 20 nt, Human
ggucuguguguguguaugug

SEQ ID NO: 1989225 - RNA, 21 nt, Human
ggucuguguguguguaugugg

SEQ ID NO: 1989226 - RNA, 13 nt, Human
ggucuuauauuua

SEQ ID NO: 1989227 - RNA, 20 nt, Human
ggugcaaugaccuuucaaua

SEQ ID NO: 1989228 - RNA, 19 nt, Human
ggugcaaugaccuuucaau

SEQ ID NO: 1989229 - RNA, 18 nt, Human
ggugcaaugaccuuucaa

SEQ ID NO: 1989230 - RNA, 10 nt, Human
ggucuuccua

SEQ ID NO: 1989231 - RNA, 17 nt, Human
ggucuuccuacucuucu

SEQ ID NO: 1989232 - RNA, 18 nt, Human
ggucuuccuacucuucuc

SEQ ID NO: 1989233 - RNA, 19 nt, Human
ggucuuccuacucuucucu

SEQ ID NO: 1989234 - RNA, 20 nt, Human
ggugcugggccccugccucu

SEQ ID NO: 1989235 - RNA, 19 nt, Human
ggugcugggccccugccuc

SEQ ID NO: 1989236 - RNA, 21 nt, Human
ggucuuccuacucuucucucu

SEQ ID NO: 1989237 - RNA, 18 nt, Human
aaagcagcucuccccuca

SEQ ID NO: 1989238 - RNA, 17 nt, Human
aaagcagggacuugaac

SEQ ID NO: 1989239 - RNA, 19 nt, Human
aaagcaggcagaacucauc

SEQ ID NO: 1989240 - RNA, 15 nt, Human
aaagcagcucucccc

SEQ ID NO: 1989241 - RNA, 15 nt, Human
aaagcagcguuucua

SEQ ID NO: 1989242 - RNA, 17 nt, Human
aaagcaggcagaacuca

SEQ ID NO: 1989243 - RNA, 16 nt, Human
aaagcagcguuucuau

SEQ ID NO: 1989244 - RNA, 18 nt, Human
aaagcagcguuucuauga

SEQ ID NO: 1989245 - RNA, 22 nt, Human
aaagcagcguuucuaugacaca

SEQ ID NO: 1989246 - RNA, 14 nt, Human
gguggaugccuggu

SEQ ID NO: 1989247 - RNA, 18 nt, Human
ggugcuguuuugccagcc

SEQ ID NO: 1989248 - RNA, 21 nt, Human
gguggaugccugguggcagcu

SEQ ID NO: 1989249 - RNA, 18 nt, Human
ggucgcuugggaauuuua

SEQ ID NO: 1989250 - RNA, 14 nt, Human
ggucggaaaacaug

SEQ ID NO: 1989251 - RNA, 14 nt, Human
ggucgggggggacc

SEQ ID NO: 1989252 - RNA, 21 nt, Human
ggucguuuuaaaaacaaaaau

SEQ ID NO: 1989253 - RNA, 11 nt, Human
ggucugugugu

SEQ ID NO: 1989254 - RNA, 17 nt, Human
ggucuguguguguguau

SEQ ID NO: 1989255 - RNA, 17 nt, Human
ggucuacacugugcuga

SEQ ID NO: 1989256 - RNA, 13 nt, Human
ggucuaauguuua

SEQ ID NO: 1989257 - RNA, 18 nt, Human
gguccuggaggcucaaau

SEQ ID NO: 1989258 - RNA, 20 nt, Human
ggucgcccuggacugugugc

SEQ ID NO: 1989259 - RNA, 13 nt, Human
ggucggaaaacau

SEQ ID NO: 1989260 - RNA, 13 nt, Human
aaagauuucuguu

SEQ ID NO: 1989261 - RNA, 14 nt, Human
aaagauuucuguuc

SEQ ID NO: 1989262 - RNA, 13 nt, Human
aaagcaaaaggca

SEQ ID NO: 1989263 - RNA, 13 nt, Human
aaagcaaaggaga

SEQ ID NO: 1989264 - RNA, 14 nt, Human
aaagcaaaagugcu

SEQ ID NO: 1989265 - RNA, 22 nt, Human
aaagauucugaccuuaaaugca

SEQ ID NO: 1989266 - RNA, 18 nt, Human
aaagauugacaccagguu

SEQ ID NO: 1989267 - RNA, 16 nt, Human
aaagauuguguggugu

SEQ ID NO: 1989268 - RNA, 13 nt, Human
aaagacuaagauc

SEQ ID NO: 1989269 - RNA, 23 nt, Human
gguccugcugcaguugccaguca

SEQ ID NO: 1989270 - RNA, 21 nt, Human
gguccugcugcaguugccagu

SEQ ID NO: 1989271 - RNA, 13 nt, Human
aaagcaaaugucu

SEQ ID NO: 1989272 - RNA, 18 nt, Human
ggguggggggggugcugg

SEQ ID NO: 1989273 - RNA, 15 nt, Human
ggguggggggggugc

SEQ ID NO: 1989274 - RNA, 12 nt, Human
ggguggugaccu

SEQ ID NO: 1989275 - RNA, 17 nt, Human
ggguguggcgcagcaua

SEQ ID NO: 1989276 - RNA, 20 nt, Human
ggguggggaccucaggccug

SEQ ID NO: 1989277 - RNA, 19 nt, Human
gggugggacacccugugau

SEQ ID NO: 1989278 - RNA, 13 nt, Human
ggguggaugccug

SEQ ID NO: 1989279 - RNA, 11 nt, Human
ggggccuggca

SEQ ID NO: 1989280 - RNA, 12 nt, Human
ggggccuggcag

SEQ ID NO: 1989281 - RNA, 15 nt, Human
ggguggcaccagcag

SEQ ID NO: 1989282 - RNA, 17 nt, Human
ggguggaugccuggugg

SEQ ID NO: 1989283 - RNA, 15 nt, Human
gguaaucauauuaga

SEQ ID NO: 1989284 - RNA, 18 nt, Human
gguaaucgaccugccucg

SEQ ID NO: 1989285 - RNA, 14 nt, Human
gguaaucgaccugc

SEQ ID NO: 1989286 - RNA, 17 nt, Human
gguaaucgaccugccuc

SEQ ID NO: 1989287 - RNA, 24 nt, Human
gguacaaccuguucugcuuuccuc

SEQ ID NO: 1989288 - RNA, 16 nt, Human
gguacaauuucuuuug

SEQ ID NO: 1989289 - RNA, 23 nt, Human
gguacaaccuguucugcuuuccu

SEQ ID NO: 1989290 - RNA, 13 nt, Human
gguaccacugaau

SEQ ID NO: 1989291 - RNA, 20 nt, Human
gguaccacugaaucuguaca

SEQ ID NO: 1989292 - RNA, 17 nt, Human
ggguuucuaaagcugcc

SEQ ID NO: 1989293 - RNA, 18 nt, Human
gguaacuagggaagauaa

SEQ ID NO: 1989294 - RNA, 14 nt, Human
gguaauaagggaaa

SEQ ID NO: 1989295 - RNA, 14 nt, Human
gguaacaggcagau

SEQ ID NO: 1989296 - RNA, 20 nt, Human
gguaacaggcagauacagga

SEQ ID NO: 1989297 - RNA, 17 nt, Human
aaagacuaucuaaaugu

SEQ ID NO: 1989298 - RNA, 13 nt, Human
aaagacaccuacu

SEQ ID NO: 1989299 - RNA, 19 nt, Human
aaagacaccuacugagugg

SEQ ID NO: 1989300 - RNA, 16 nt, Human
aaagaauagaagcuaa

SEQ ID NO: 1989301 - RNA, 14 nt, Human
aaagaauaggacuu

SEQ ID NO: 1989302 - RNA, 19 nt, Human
aaagaauaggacuuguuuu

SEQ ID NO: 1989303 - RNA, 22 nt, Human
aaagaaucaccuaauuaauuuc

SEQ ID NO: 1989304 - RNA, 18 nt, Human
aaagacaaauaguaggca

SEQ ID NO: 1989305 - RNA, 12 nt, Human
aaacuuuacuau

SEQ ID NO: 1989306 - RNA, 18 nt, Human
aaacuuuacuauggcccu

SEQ ID NO: 1989307 - RNA, 18 nt, Human
aaagaaguggggacagag

SEQ ID NO: 1989308 - RNA, 17 nt, Human
aaacuuuaccuuuuuua

SEQ ID NO: 1989309 - RNA, 22 nt, Human
aaacuuuaccuuuuuuauacau

SEQ ID NO: 1989310 - RNA, 15 nt, Human
gguccauagagagca

SEQ ID NO: 1989311 - RNA, 18 nt, Human
gguccaguggaugccaca

SEQ ID NO: 1989312 - RNA, 15 nt, Human
gguccauagcugugg

SEQ ID NO: 1989313 - RNA, 12 nt, Human
gguccacccagg

SEQ ID NO: 1989314 - RNA, 13 nt, Human
gguccacccagga

SEQ ID NO: 1989315 - RNA, 15 nt, Human
gguccacccaggagc

SEQ ID NO: 1989316 - RNA, 16 nt, Human
gguccacccaggagcc

SEQ ID NO: 1989317 - RNA, 17 nt, Human
gguccacccaggagccc

SEQ ID NO: 1989318 - RNA, 17 nt, Human
gguagcuuugaggugga

SEQ ID NO: 1989319 - RNA, 21 nt, Human
gguagcuguaaggcaugaagg

SEQ ID NO: 1989320 - RNA, 12 nt, Human
gguagcuguaag

SEQ ID NO: 1989321 - RNA, 14 nt, Human
gguagcuuuucccu

SEQ ID NO: 1989322 - RNA, 14 nt, Human
gguaugcaaucaaa

SEQ ID NO: 1989323 - RNA, 22 nt, Human
gguaugaucacggcucacugca

SEQ ID NO: 1989324 - RNA, 16 nt, Human
gguccacaacacacag

SEQ ID NO: 1989325 - RNA, 15 nt, Human
ggugggauccuccag

SEQ ID NO: 1989326 - RNA, 14 nt, Human
ggugggauccucca

SEQ ID NO: 1989327 - RNA, 14 nt, Human
aaagcgaauuuuaa

SEQ ID NO: 1989328 - RNA, 13 nt, Human
aaagccuuucauu

SEQ ID NO: 1989329 - RNA, 18 nt, Human
aaagccuuucauuuugcu

SEQ ID NO: 1989330 - RNA, 20 nt, Human
ggugggaggauugcuugagc

SEQ ID NO: 1989331 - RNA, 18 nt, Human
aaagccuguuuaagagac

SEQ ID NO: 1989332 - RNA, 16 nt, Human
aaagccuguuuaagag

SEQ ID NO: 1989333 - RNA, 19 nt, Human
aaagccuuagggaagcugg

SEQ ID NO: 1989334 - RNA, 15 nt, Human
aaagccuuagggaag

SEQ ID NO: 1989335 - RNA, 17 nt, Human
aaagcaugccaauuucu

SEQ ID NO: 1989336 - RNA, 22 nt, Human
aaagccuuucauuuugcuuuaa

SEQ ID NO: 1989337 - RNA, 19 nt, Human
ggugggauccuccaggugc

SEQ ID NO: 1989338 - RNA, 13 nt, Human
gguggggcagcuu

SEQ ID NO: 1989339 - RNA, 17 nt, Human
gguggggcagcuugagg

SEQ ID NO: 1989340 - RNA, 23 nt, Human
gguggggucacucuggcagcuca

SEQ ID NO: 1989341 - RNA, 15 nt, Human
gguggggucacucug

SEQ ID NO: 1989342 - RNA, 17 nt, Human
gguggggggggugcugg

SEQ ID NO: 1989343 - RNA, 16 nt, Human
ggugucgggcaugaca

SEQ ID NO: 1989344 - RNA, 13 nt, Human
ggugucgggcaug

SEQ ID NO: 1989345 - RNA, 23 nt, Human
ggugucuguguuccaaccacuga

SEQ ID NO: 1989346 - RNA, 16 nt, Human
ggugugaccacugcag

SEQ ID NO: 1989347 - RNA, 16 nt, Human
ggugugacugaauuuc

SEQ ID NO: 1989348 - RNA, 14 nt, Human
ggugucuuucucuu

SEQ ID NO: 1989349 - RNA, 15 nt, Human
ggugucuuucucuuu

SEQ ID NO: 1989350 - RNA, 13 nt, Human
ggugugagcagca

SEQ ID NO: 1989351 - RNA, 22 nt, Human
ggugugagggcagugcaaggag

SEQ ID NO: 1989352 - RNA, 19 nt, Human
ggugugaggacauaaaucu

SEQ ID NO: 1989353 - RNA, 16 nt, Human
ggugugaggcaggaga

SEQ ID NO: 1989354 - RNA, 18 nt, Human
ggugugagucaccaagcc

SEQ ID NO: 1989355 - RNA, 12 nt, Human
gguguggaagag

SEQ ID NO: 1989356 - RNA, 21 nt, Human
ggugugcggccuuuggcuuca

SEQ ID NO: 1989357 - RNA, 13 nt, Human
ggugugcucugau

SEQ ID NO: 1989358 - RNA, 22 nt, Human
gguucaggguuggccccugccc

SEQ ID NO: 1989359 - RNA, 14 nt, Human
ggugugcuauagcu

SEQ ID NO: 1989360 - RNA, 15 nt, Human
gguucaguguuucug

SEQ ID NO: 1989361 - RNA, 18 nt, Human
gguucaggguuggccccu

SEQ ID NO: 1989362 - RNA, 21 nt, Human
gguucaggguuggccccugcc

SEQ ID NO: 1989363 - RNA, 24 nt, Human
gguuccagcaauucuccugccuca

SEQ ID NO: 1989364 - RNA, 15 nt, Human
gguuccccuguucac

SEQ ID NO: 1989365 - RNA, 23 nt, Human
gguuccagcaauucuccugccuc

SEQ ID NO: 1989366 - RNA, 21 nt, Human
gguucauuuucagauucaggc

SEQ ID NO: 1989367 - RNA, 23 nt, Human
gguucauuuucagauucaggcau

SEQ ID NO: 1989368 - RNA, 22 nt, Human
gguucccuuugacgccauccca

SEQ ID NO: 1989369 - RNA, 15 nt, Human
gguuccuacacagga

SEQ ID NO: 1989370 - RNA, 16 nt, Human
gguuccuccccuccuc

SEQ ID NO: 1989371 - RNA, 18 nt, Human
gguuccuacacaggacag

SEQ ID NO: 1989372 - RNA, 17 nt, Human
gguuccuacacaggaca

SEQ ID NO: 1989373 - RNA, 21 nt, Human
gguucccuuugacgccauccc

SEQ ID NO: 1989374 - RNA, 15 nt, Human
gguuucucuucuccc

SEQ ID NO: 1989375 - RNA, 22 nt, Human
gguuucucuucuccccuuccau

SEQ ID NO: 1989376 - RNA, 13 nt, Human
gguuucucuucuc

SEQ ID NO: 1989377 - RNA, 14 nt, Human
gguuucagaaaugu

SEQ ID NO: 1989378 - RNA, 12 nt, Human
gguuucagaaau

SEQ ID NO: 1989379 - RNA, 13 nt, Human
gguuucagaaaug

SEQ ID NO: 1989380 - RNA, 23 nt, Human
gguuuaucgcccuggcaggcagg

SEQ ID NO: 1989381 - RNA, 19 nt, Human
gguuucaccauguuggcca

SEQ ID NO: 1989382 - RNA, 16 nt, Human
gguuuagaaagcuugc

SEQ ID NO: 1989383 - RNA, 19 nt, Human
gguuccuuccucugagccu

SEQ ID NO: 1989384 - RNA, 20 nt, Human
gguuccuuccucugagccuu

SEQ ID NO: 1989385 - RNA, 22 nt, Human
gguuccuggggcauccaugggg

SEQ ID NO: 1989386 - RNA, 15 nt, Human
guaaauucugauuuc

SEQ ID NO: 1989387 - RNA, 18 nt, Human
guaaauucugauuucuuu

SEQ ID NO: 1989388 - RNA, 12 nt, Human
guaaauucugau

SEQ ID NO: 1989389 - RNA, 13 nt, Human
guaaauucugauu

SEQ ID NO: 1989390 - RNA, 14 nt, Human
guaaauucugauuu

SEQ ID NO: 1989391 - RNA, 16 nt, Human
guaaauuuaugugaug

SEQ ID NO: 1989392 - RNA, 17 nt, Human
guaaauuuaugugaugg

SEQ ID NO: 1989393 - RNA, 14 nt, Human
guaaagauuucugu

SEQ ID NO: 1989394 - RNA, 16 nt, Human
guaaagauuucuguuc

SEQ ID NO: 1989395 - RNA, 19 nt, Human
guaaagcaaccaaaaagaa

SEQ ID NO: 1989396 - RNA, 20 nt, Human
guaaagcaaccaaaaagaaa

SEQ ID NO: 1989397 - RNA, 14 nt, Human
guaaaaugaagaau

SEQ ID NO: 1989398 - RNA, 16 nt, Human
guaaaaugaagaauuu

SEQ ID NO: 1989399 - RNA, 17 nt, Human
guaaaaugaagaauuua

SEQ ID NO: 1989400 - RNA, 15 nt, Human
aaaguuuucccuuga

SEQ ID NO: 1989401 - RNA, 13 nt, Human
aaauaaaaaaaag

SEQ ID NO: 1989402 - RNA, 13 nt, Human
aaaguuuugccua

SEQ ID NO: 1989403 - RNA, 15 nt, Human
aaauaaaaaaaagaa

SEQ ID NO: 1989404 - RNA, 17 nt, Human
aaauaaaaaaaagaaaa

SEQ ID NO: 1989405 - RNA, 20 nt, Human
aaauaaaaaaaagaaaaaag

SEQ ID NO: 1989406 - RNA, 22 nt, Human
aaauaaaaaaaagaaaaaagag

SEQ ID NO: 1989407 - RNA, 18 nt, Human
aaauaaaaaaagaaaaaa

SEQ ID NO: 1989408 - RNA, 13 nt, Human
aaauaaugugaaa

SEQ ID NO: 1989409 - RNA, 12 nt, Human
aaauaaugugaa

SEQ ID NO: 1989410 - RNA, 13 nt, Human
aaauaaugcuguu

SEQ ID NO: 1989411 - RNA, 20 nt, Human
aaaguuauuucccuuuagcu

SEQ ID NO: 1989412 - RNA, 19 nt, Human
aaaguguucuguuacaaaa

SEQ ID NO: 1989413 - RNA, 21 nt, Human
aaaguucccuacuuccuguga

SEQ ID NO: 1989414 - RNA, 16 nt, Human
aaaguguucuguuaca

SEQ ID NO: 1989415 - RNA, 17 nt, Human
aaaguguucuguuacaa

SEQ ID NO: 1989416 - RNA, 18 nt, Human
aaaguguucuguuacaaa

SEQ ID NO: 1989417 - RNA, 22 nt, Human
gguuucuuuuugaaucuuuaau

SEQ ID NO: 1989418 - RNA, 20 nt, Human
gguuuggacaaaauggaaua

SEQ ID NO: 1989419 - RNA, 12 nt, Human
aaaguggugaga

SEQ ID NO: 1989420 - RNA, 14 nt, Human
gguuuggcuccugc

SEQ ID NO: 1989421 - RNA, 17 nt, Human
gguuuggcuccugccca

SEQ ID NO: 1989422 - RNA, 16 nt, Human
aaaguugaauuuuaca

SEQ ID NO: 1989423 - RNA, 23 nt, Human
aaaguucccuacuuccugugacu

SEQ ID NO: 1989424 - RNA, 21 nt, Human
aaaguuucucuuuucaaaaca

SEQ ID NO: 1989425 - RNA, 23 nt, Human
aaaguuucucuuuucaaaacauu

SEQ ID NO: 1989426 - RNA, 12 nt, Human
aaaguuucaaaa

SEQ ID NO: 1989427 - RNA, 18 nt, Human
aaaguuucaaaaaucuga

SEQ ID NO: 1989428 - RNA, 11 nt, Human
aaaguuucaug

SEQ ID NO: 1989429 - RNA, 19 nt, Human
aaaguuucaaaaaucugaa

SEQ ID NO: 1989430 - RNA, 20 nt, Human
aaaguuucaaaaaucugaag

SEQ ID NO: 1989431 - RNA, 21 nt, Human
aaaguuucaaaaaucugaaga

SEQ ID NO: 1989432 - RNA, 24 nt, Human
aaaguuugaucuuccucugcuaaa

SEQ ID NO: 1989433 - RNA, 14 nt, Human
aaaguuuguuugcu

SEQ ID NO: 1989434 - RNA, 16 nt, Human
aaaguuuguugaaaca

SEQ ID NO: 1989435 - RNA, 13 nt, Human
aaaguuucuuuga

SEQ ID NO: 1989436 - RNA, 13 nt, Human
aaaguuugaucuu

SEQ ID NO: 1989437 - RNA, 14 nt, Human
aaaguuugaucuuc

SEQ ID NO: 1989438 - RNA, 22 nt, Human
aaaguuugaucuuccucugcua

SEQ ID NO: 1989439 - RNA, 11 nt, Human
gauucucucca

SEQ ID NO: 1989440 - RNA, 22 nt, Human
gauucucuccauuuuggugucu

SEQ ID NO: 1989441 - RNA, 23 nt, Human
gauucucuugccucagcuucccc

SEQ ID NO: 1989442 - RNA, 14 nt, Human
gauuaguaagucuu

SEQ ID NO: 1989443 - RNA, 13 nt, Human
gauuaguuuagaa

SEQ ID NO: 1989444 - RNA, 13 nt, Human
gauuauaauuguu

SEQ ID NO: 1989445 - RNA, 14 nt, Human
gauuaguuuagaac

SEQ ID NO: 1989446 - RNA, 15 nt, Human
gauuaguuuagaaca

SEQ ID NO: 1989447 - RNA, 20 nt, Human
gauuacaggugugaaccacc

SEQ ID NO: 1989448 - RNA, 20 nt, Human
gauuacaggugugagccacc

SEQ ID NO: 1989449 - RNA, 14 nt, Human
gaugugacauuugu

SEQ ID NO: 1989450 - RNA, 17 nt, Human
gaugugacauuugucau

SEQ ID NO: 1989451 - RNA, 18 nt, Human
gauuacugccuauuuuaa

SEQ ID NO: 1989452 - RNA, 14 nt, Human
gauuaccagggacu

SEQ ID NO: 1989453 - RNA, 15 nt, Human
gauuacauucaguug

SEQ ID NO: 1989454 - RNA, 17 nt, Human
gaucucuugagccuggg

SEQ ID NO: 1989455 - RNA, 16 nt, Human
gaucucuugagccugg

SEQ ID NO: 1989456 - RNA, 12 nt, Human
gaucucuugagc

SEQ ID NO: 1989457 - RNA, 21 nt, Human
gauccaggccccucccucucc

SEQ ID NO: 1989458 - RNA, 16 nt, Human
gauauuuugcuuugug

SEQ ID NO: 1989459 - RNA, 21 nt, Human
gauauucuuuguuaauuugga

SEQ ID NO: 1989460 - RNA, 13 nt, Human
gauauuuuuaaua

SEQ ID NO: 1989461 - RNA, 15 nt, Human
gauauuuuuuucuuu

SEQ ID NO: 1989462 - RNA, 17 nt, Human
gaucucccuuuccuaua

SEQ ID NO: 1989463 - RNA, 16 nt, Human
gauccauuuuuuauau

SEQ ID NO: 1989464 - RNA, 23 nt, Human
gaucucagugguuaagauuccua

SEQ ID NO: 1989465 - RNA, 18 nt, Human
gauccauuuuuuauauuu

SEQ ID NO: 1989466 - RNA, 21 nt, Human
gaucucauuguucaauuccca

SEQ ID NO: 1989467 - RNA, 21 nt, Human
gaugaugaaaugaggucagag

SEQ ID NO: 1989468 - RNA, 20 nt, Human
gaugaucuuugcagacaggc

SEQ ID NO: 1989469 - RNA, 21 nt, Human
gaugaucuuugcagacaggca

SEQ ID NO: 1989470 - RNA, 14 nt, Human
gaugaucuuugcag

SEQ ID NO: 1989471 - RNA, 14 nt, Human
gauacccaucccau

SEQ ID NO: 1989472 - RNA, 13 nt, Human
gauacccauccca

SEQ ID NO: 1989473 - RNA, 14 nt, Human
gauaccuuaaaauu

SEQ ID NO: 1989474 - RNA, 17 nt, Human
gauaccuuaaaauuuga

SEQ ID NO: 1989475 - RNA, 21 nt, Human
gauaccuuaaaauuugaaaca

SEQ ID NO: 1989476 - RNA, 16 nt, Human
gauacuacaguuuguu

SEQ ID NO: 1989477 - RNA, 11 nt, Human
gauacuacagu

SEQ ID NO: 1989478 - RNA, 19 nt, Human
gauaccuuaaaauuugaaa

SEQ ID NO: 1989479 - RNA, 18 nt, Human
gauaugccugcucuuugg

SEQ ID NO: 1989480 - RNA, 12 nt, Human
gauaugcuugua

SEQ ID NO: 1989481 - RNA, 22 nt, Human
gauaugcuuguaacuaaaauaa

SEQ ID NO: 1989482 - RNA, 17 nt, Human
gauacuugaaaauuaac

SEQ ID NO: 1989483 - RNA, 16 nt, Human
gauaugccugcucuuu

SEQ ID NO: 1989484 - RNA, 16 nt, Human
gauacuugaaaauuaa

SEQ ID NO: 1989485 - RNA, 11 nt, Human
gauacucuggg

SEQ ID NO: 1989486 - RNA, 13 nt, Human
gauacucugggaa

SEQ ID NO: 1989487 - RNA, 16 nt, Human
gauacuacugaccaga

SEQ ID NO: 1989488 - RNA, 14 nt, Human
gauacucugggaac

SEQ ID NO: 1989489 - RNA, 13 nt, Human
gauauuaauguau

SEQ ID NO: 1989490 - RNA, 15 nt, Human
gauauucuuuguuaa

SEQ ID NO: 1989491 - RNA, 18 nt, Human
gauauucuuuguuaauuu

SEQ ID NO: 1989492 - RNA, 13 nt, Human
gauaugugaacag

SEQ ID NO: 1989493 - RNA, 14 nt, Human
gauaugugaacagu

SEQ ID NO: 1989494 - RNA, 20 nt, Human
gauauguaccuaacgaagua

SEQ ID NO: 1989495 - RNA, 20 nt, Human
gaguuugggguaugggagag

SEQ ID NO: 1989496 - RNA, 18 nt, Human
gaguuucacagugugauu

SEQ ID NO: 1989497 - RNA, 23 nt, Human
gaguuugccccguucuguuugua

SEQ ID NO: 1989498 - RNA, 19 nt, Human
gaguggacuguucccugag

SEQ ID NO: 1989499 - RNA, 16 nt, Human
gaguuguuacauuuuu

SEQ ID NO: 1989500 - RNA, 20 nt, Human
gaguuguuacauuuuuaagu

SEQ ID NO: 1989501 - RNA, 18 nt, Human
gagugccuuacacaaugg

SEQ ID NO: 1989502 - RNA, 13 nt, Human
gaggucuguucuu

SEQ ID NO: 1989503 - RNA, 14 nt, Human
gaggucuguucuuu

SEQ ID NO: 1989504 - RNA, 16 nt, Human
gaggugcaugccuaau

SEQ ID NO: 1989505 - RNA, 11 nt, Human
gaggugggagg

SEQ ID NO: 1989506 - RNA, 13 nt, Human
gaggugggagggc

SEQ ID NO: 1989507 - RNA, 14 nt, Human
gaggugggagggcc

SEQ ID NO: 1989508 - RNA, 12 nt, Human
gaggugggaucc

SEQ ID NO: 1989509 - RNA, 16 nt, Human
gagucccaccuuggcu

SEQ ID NO: 1989510 - RNA, 20 nt, Human
gagucccaccuuggcugcag

SEQ ID NO: 1989511 - RNA, 15 nt, Human
gagucaccaagccca

SEQ ID NO: 1989512 - RNA, 13 nt, Human
gagucaccaagcc

SEQ ID NO: 1989513 - RNA, 14 nt, Human
gagucaccaagccc

SEQ ID NO: 1989514 - RNA, 18 nt, Human
gagugaggaugucugggc

SEQ ID NO: 1989515 - RNA, 19 nt, Human
gagugaggaauggcaguga

SEQ ID NO: 1989516 - RNA, 16 nt, Human
gagugcaggcccaccc

SEQ ID NO: 1989517 - RNA, 18 nt, Human
gagugcaggcccacccug

SEQ ID NO: 1989518 - RNA, 11 nt, Human
gagugcaguga

SEQ ID NO: 1989519 - RNA, 12 nt, Human
gagugcagugag

SEQ ID NO: 1989520 - RNA, 24 nt, Human
gagugagcacuaaggugugcucug

SEQ ID NO: 1989521 - RNA, 21 nt, Human
gagucccaccuuggcugcagg

SEQ ID NO: 1989522 - RNA, 13 nt, Human
gagucccaccuug

SEQ ID NO: 1989523 - RNA, 12 nt, Human
gagugagcuggu

SEQ ID NO: 1989524 - RNA, 14 nt, Human
gcauacguacacau

SEQ ID NO: 1989525 - RNA, 23 nt, Human
gcauaauucugaaguuauauuuc

SEQ ID NO: 1989526 - RNA, 17 nt, Human
gcauaauaauccugcaa

SEQ ID NO: 1989527 - RNA, 22 nt, Human
gcauaacguauaaaagccuguu

SEQ ID NO: 1989528 - RNA, 17 nt, Human
gcauaccacuuuuguuc

SEQ ID NO: 1989529 - RNA, 20 nt, Human
gcauaccacuuuuguucuug

SEQ ID NO: 1989530 - RNA, 19 nt, Human
gcaguuugaggauuaguuu

SEQ ID NO: 1989531 - RNA, 12 nt, Human
gcaguuucaaua

SEQ ID NO: 1989532 - RNA, 17 nt, Human
gcaguuucaauaaaguu

SEQ ID NO: 1989533 - RNA, 20 nt, Human
gcaguuucaauaaaguuuga

SEQ ID NO: 1989534 - RNA, 12 nt, Human
gcagucauuuug

SEQ ID NO: 1989535 - RNA, 23 nt, Human
gcaggcucucaggccagcugcuu

SEQ ID NO: 1989536 - RNA, 14 nt, Human
gcaggcuggcccug

SEQ ID NO: 1989537 - RNA, 15 nt, Human
gcaggcuggcccugc

SEQ ID NO: 1989538 - RNA, 16 nt, Human
gcaggcuggcccugcc

SEQ ID NO: 1989539 - RNA, 17 nt, Human
gcaggcuggcccugccc

SEQ ID NO: 1989540 - RNA, 18 nt, Human
gcaggcuggcccugcccu

SEQ ID NO: 1989541 - RNA, 19 nt, Human
gcaggcuggcccugcccug

SEQ ID NO: 1989542 - RNA, 20 nt, Human
gcaggcuggcccugcccugg

SEQ ID NO: 1989543 - RNA, 21 nt, Human
gcaggcuggcccugcccuggu

SEQ ID NO: 1989544 - RNA, 22 nt, Human
gcaggcucucaggccagcugcu

SEQ ID NO: 1989545 - RNA, 20 nt, Human
gcaggcucucaggccagcug

SEQ ID NO: 1989546 - RNA, 17 nt, Human
gcagcugcgguccaccc

SEQ ID NO: 1989547 - RNA, 19 nt, Human
gcagcugcgguccacccag

SEQ ID NO: 1989548 - RNA, 20 nt, Human
gcaguauaaagaauaggacu

SEQ ID NO: 1989549 - RNA, 12 nt, Human
gcaguaucauga

SEQ ID NO: 1989550 - RNA, 15 nt, Human
gcaguaucaugaagc

SEQ ID NO: 1989551 - RNA, 13 nt, Human
gcaguaacuuggg

SEQ ID NO: 1989552 - RNA, 16 nt, Human
gcaguaacuugggagu

SEQ ID NO: 1989553 - RNA, 19 nt, Human
gcagggacuugaacccaua

SEQ ID NO: 1989554 - RNA, 13 nt, Human
gcagggaaacagc

SEQ ID NO: 1989555 - RNA, 10 nt, Human
gcagggaggg

SEQ ID NO: 1989556 - RNA, 13 nt, Human
gcagggagggccu

SEQ ID NO: 1989557 - RNA, 14 nt, Human
gcagccaggccaca

SEQ ID NO: 1989558 - RNA, 13 nt, Human
gcagccaggccac

SEQ ID NO: 1989559 - RNA, 16 nt, Human
gcagccaggccacaag

SEQ ID NO: 1989560 - RNA, 22 nt, Human
gcagccccaaauugucaccugc

SEQ ID NO: 1989561 - RNA, 16 nt, Human
gcagccacauuccuga

SEQ ID NO: 1989562 - RNA, 16 nt, Human
gcagagcccugcuccc

SEQ ID NO: 1989563 - RNA, 11 nt, Human
gcagagcccug

SEQ ID NO: 1989564 - RNA, 13 nt, Human
gcagagcccugcu

SEQ ID NO: 1989565 - RNA, 15 nt, Human
gcagagcccugcucc

SEQ ID NO: 1989566 - RNA, 14 nt, Human
gcagccacuauugu

SEQ ID NO: 1989567 - RNA, 18 nt, Human
gcagccacuuaggacaaa

SEQ ID NO: 1989568 - RNA, 12 nt, Human
gcagccaggcca

SEQ ID NO: 1989569 - RNA, 14 nt, Human
gauucugagagcug

SEQ ID NO: 1989570 - RNA, 23 nt, Human
gauucugaccuuaaaugcaacca

SEQ ID NO: 1989571 - RNA, 13 nt, Human
gauucugagagcu

SEQ ID NO: 1989572 - RNA, 20 nt, Human
gauucugaccuuaaaugcaa

SEQ ID NO: 1989573 - RNA, 21 nt, Human
gauucugaccuuaaaugcaac

SEQ ID NO: 1989574 - RNA, 16 nt, Human
gcaaguccugcaacca

SEQ ID NO: 1989575 - RNA, 13 nt, Human
gcaagugagagcu

SEQ ID NO: 1989576 - RNA, 13 nt, Human
gcaauaaauuuug

SEQ ID NO: 1989577 - RNA, 14 nt, Human
gcaauaaauuuuga

SEQ ID NO: 1989578 - RNA, 15 nt, Human
gcaauaaauuuugaa

SEQ ID NO: 1989579 - RNA, 16 nt, Human
gcaauaaauuuugaaa

SEQ ID NO: 1989580 - RNA, 18 nt, Human
gcaauaaauuuugaaaag

SEQ ID NO: 1989581 - RNA, 21 nt, Human
gcaauaaagcagcguuucuau

SEQ ID NO: 1989582 - RNA, 14 nt, Human
gcacaagcugcacc

SEQ ID NO: 1989583 - RNA, 23 nt, Human
gcacaagcuccaagcucccaggc

SEQ ID NO: 1989584 - RNA, 22 nt, Human
gcacaagcuccaagcucccagg

SEQ ID NO: 1989585 - RNA, 19 nt, Human
gcaccggcuggccuggccc

SEQ ID NO: 1989586 - RNA, 19 nt, Human
gcaccgacuagacacacaa

SEQ ID NO: 1989587 - RNA, 20 nt, Human
gcaccgacuagacacacaaa

SEQ ID NO: 1989588 - RNA, 14 nt, Human
gcaccgccucuucc

SEQ ID NO: 1989589 - RNA, 17 nt, Human
gcaccgccucuucccgc

SEQ ID NO: 1989590 - RNA, 20 nt, Human
gcacccuuccaucugauucc

SEQ ID NO: 1989591 - RNA, 23 nt, Human
gcaccggcuggccuggccccuca

SEQ ID NO: 1989592 - RNA, 21 nt, Human
gcaccggcuggccuggccccu

SEQ ID NO: 1989593 - RNA, 18 nt, Human
gcaccggcuggccuggcc

SEQ ID NO: 1989594 - RNA, 19 nt, Human
gcacaugccucucucaggc

SEQ ID NO: 1989595 - RNA, 18 nt, Human
gcacaugccucucucagg

SEQ ID NO: 1989596 - RNA, 17 nt, Human
gcacaugccucucucag

SEQ ID NO: 1989597 - RNA, 14 nt, Human
gcacaugccucucu

SEQ ID NO: 1989598 - RNA, 21 nt, Human
gcacaugccucucucaggcca

SEQ ID NO: 1989599 - RNA, 20 nt, Human
gcacaugccucucucaggcc

SEQ ID NO: 1989600 - RNA, 22 nt, Human
gcacaugccucucucaggccaa

SEQ ID NO: 1989601 - RNA, 20 nt, Human
gcacaugauuucacaaauau

SEQ ID NO: 1989602 - RNA, 22 nt, Human
gcacaugauuucacaaauauua

SEQ ID NO: 1989603 - RNA, 15 nt, Human
gcacccuccuagggc

SEQ ID NO: 1989604 - RNA, 19 nt, Human
gcacaucagcacgauuucu

SEQ ID NO: 1989605 - RNA, 20 nt, Human
gcacaucagcacgauuucug

SEQ ID NO: 1989606 - RNA, 21 nt, Human
gcacaucagcacgauuucugu

SEQ ID NO: 1989607 - RNA, 15 nt, Human
gcacaucuguuuugu

SEQ ID NO: 1989608 - RNA, 13 nt, Human
gcacaugccucuc

SEQ ID NO: 1989609 - RNA, 12 nt, Human
gcacaugauuuc

SEQ ID NO: 1989610 - RNA, 13 nt, Human
gcacaugauuuca

SEQ ID NO: 1989611 - RNA, 14 nt, Human
gcacaugauuucac

SEQ ID NO: 1989612 - RNA, 15 nt, Human
gcacaugauuucaca

SEQ ID NO: 1989613 - RNA, 17 nt, Human
gcacaugauuucacaaa

SEQ ID NO: 1989614 - RNA, 19 nt, Human
gcacaugauuucacaaaua

SEQ ID NO: 1989615 - RNA, 22 nt, Human
gcacaaucucggcucacugcau

SEQ ID NO: 1989616 - RNA, 12 nt, Human
gcacaauuauaa

SEQ ID NO: 1989617 - RNA, 21 nt, Human
gcacaaucucggcucacugca

SEQ ID NO: 1989618 - RNA, 22 nt, Human
gcaauaacaguaguguuacaug

SEQ ID NO: 1989619 - RNA, 14 nt, Human
gcaauaagaacaaa

SEQ ID NO: 1989620 - RNA, 12 nt, Human
gcacugacauug

SEQ ID NO: 1989621 - RNA, 14 nt, Human
gcacugaaguuuga

SEQ ID NO: 1989622 - RNA, 14 nt, Human
gcacugacucugga

SEQ ID NO: 1989623 - RNA, 16 nt, Human
gcacugacucuggaaa

SEQ ID NO: 1989624 - RNA, 17 nt, Human
gcacugacucuggaaaa

SEQ ID NO: 1989625 - RNA, 18 nt, Human
gcacugacucuggaaaag

SEQ ID NO: 1989626 - RNA, 13 nt, Human
gcacugacucugg

SEQ ID NO: 1989627 - RNA, 23 nt, Human
gcagagcaccuuagacagucccu

SEQ ID NO: 1989628 - RNA, 22 nt, Human
gcagagcaccuuagacaguccc

SEQ ID NO: 1989629 - RNA, 19 nt, Human
gcagagcaccuuagacagu

SEQ ID NO: 1989630 - RNA, 14 nt, Human
gcagagaggcugug

SEQ ID NO: 1989631 - RNA, 21 nt, Human
gcagaaauucuguuuuuaaaa

SEQ ID NO: 1989632 - RNA, 16 nt, Human
gcagaaauucuguuuu

SEQ ID NO: 1989633 - RNA, 17 nt, Human
gcagaaauucuguuuuu

SEQ ID NO: 1989634 - RNA, 16 nt, Human
gcagaaaucugaggaa

SEQ ID NO: 1989635 - RNA, 12 nt, Human
gcagaaauucug

SEQ ID NO: 1989636 - RNA, 14 nt, Human
gcagaaauucuguu

SEQ ID NO: 1989637 - RNA, 15 nt, Human
gcagaaauucuguuu

SEQ ID NO: 1989638 - RNA, 13 nt, Human
gcagagaggcugu

SEQ ID NO: 1989639 - RNA, 15 nt, Human
gcagagcagagacca

SEQ ID NO: 1989640 - RNA, 14 nt, Human
gcagagcagagacc

SEQ ID NO: 1989641 - RNA, 12 nt, Human
gcagagcagaga

SEQ ID NO: 1989642 - RNA, 24 nt, Human
gcagagcaccuuagacagucccug

SEQ ID NO: 1989643 - RNA, 21 nt, Human
gcagagcagugggccuggcca

SEQ ID NO: 1989644 - RNA, 20 nt, Human
gcagagcagagaccaucccu

SEQ ID NO: 1989645 - RNA, 19 nt, Human
gcagagcagagaccauccc

SEQ ID NO: 1989646 - RNA, 22 nt, Human
gaaugaaugucagugugacuga

SEQ ID NO: 1989647 - RNA, 18 nt, Human
gaaugaaugucaguguga

SEQ ID NO: 1989648 - RNA, 14 nt, Human
gaaugaaugucagu

SEQ ID NO: 1989649 - RNA, 11 nt, Human
gaaugaauguc

SEQ ID NO: 1989650 - RNA, 16 nt, Human
gaaugagacuggcuug

SEQ ID NO: 1989651 - RNA, 22 nt, Human
gaaugacuaagaggaaaguaca

SEQ ID NO: 1989652 - RNA, 13 nt, Human
gaaugacucguuu

SEQ ID NO: 1989653 - RNA, 20 nt, Human
gaaugacuuccccaauaucu

SEQ ID NO: 1989654 - RNA, 18 nt, Human
gaaugaccuuguaaugua

SEQ ID NO: 1989655 - RNA, 19 nt, Human
gaaugaccuuguaauguaa

SEQ ID NO: 1989656 - RNA, 21 nt, Human
gaaugaccuuguaauguaacu

SEQ ID NO: 1989657 - RNA, 15 nt, Human
gaaugaccuuguaau

SEQ ID NO: 1989658 - RNA, 16 nt, Human
gaaugaccuuguaaug

SEQ ID NO: 1989659 - RNA, 12 nt, Human
gaaugaauuuca

SEQ ID NO: 1989660 - RNA, 19 nt, Human
gaagugugggucugugugu

SEQ ID NO: 1989661 - RNA, 17 nt, Human
gaagugugggucugugu

SEQ ID NO: 1989662 - RNA, 18 nt, Human
gaagugugggucugugug

SEQ ID NO: 1989663 - RNA, 19 nt, Human
gaaaucccugcucacugca

SEQ ID NO: 1989664 - RNA, 15 nt, Human
gaaaucccugcucac

SEQ ID NO: 1989665 - RNA, 18 nt, Human
gaaaucccugcucacugc

SEQ ID NO: 1989666 - RNA, 18 nt, Human
gaaauccagggugguggu

SEQ ID NO: 1989667 - RNA, 13 nt, Human
gaaauccagggug

SEQ ID NO: 1989668 - RNA, 22 nt, Human
gaaaucauauuuggaauaaaaa

SEQ ID NO: 1989669 - RNA, 15 nt, Human
gaagcucagggccug

SEQ ID NO: 1989670 - RNA, 14 nt, Human
gaagcucagggccu

SEQ ID NO: 1989671 - RNA, 19 nt, Human
gaagcucagggccuggcuc

SEQ ID NO: 1989672 - RNA, 18 nt, Human
gaagcucagggccuggcu

SEQ ID NO: 1989673 - RNA, 17 nt, Human
gaagcucagggccuggc

SEQ ID NO: 1989674 - RNA, 16 nt, Human
gaagcucagggccugg

SEQ ID NO: 1989675 - RNA, 21 nt, Human
gaagcucagggccuggcucag

SEQ ID NO: 1989676 - RNA, 20 nt, Human
gaagcucagggccuggcuca

SEQ ID NO: 1989677 - RNA, 23 nt, Human
gaagcucagggccuggcucaggu

SEQ ID NO: 1989678 - RNA, 15 nt, Human
gaaguggggacagag

SEQ ID NO: 1989679 - RNA, 16 nt, Human
gaagugagaaaaugaa

SEQ ID NO: 1989680 - RNA, 16 nt, Human
gaagugacgguuccua

SEQ ID NO: 1989681 - RNA, 22 nt, Human
gaagugacgguuccuacacagg

SEQ ID NO: 1989682 - RNA, 17 nt, Human
gaagugcagaacugcag

SEQ ID NO: 1989683 - RNA, 18 nt, Human
gaagugcagaacugcagu

SEQ ID NO: 1989684 - RNA, 20 nt, Human
gaagugcagaacugcaguca

SEQ ID NO: 1989685 - RNA, 19 nt, Human
gaagggcagggcugaggcc

SEQ ID NO: 1989686 - RNA, 18 nt, Human
gaagucuuuguacagaca

SEQ ID NO: 1989687 - RNA, 20 nt, Human
gaagucuuuguacagacaac

SEQ ID NO: 1989688 - RNA, 19 nt, Human
gaagucuuuguacagacaa

SEQ ID NO: 1989689 - RNA, 13 nt, Human
gaaggccugacuu

SEQ ID NO: 1989690 - RNA, 20 nt, Human
gaaggccugacuucugcugg

SEQ ID NO: 1989691 - RNA, 17 nt, Human
gaaggcucgagcaugcc

SEQ ID NO: 1989692 - RNA, 16 nt, Human
gaaggcucgagcaugc

SEQ ID NO: 1989693 - RNA, 14 nt, Human
gaagcuggccugag

SEQ ID NO: 1989694 - RNA, 15 nt, Human
gaagcuggccugaga

SEQ ID NO: 1989695 - RNA, 19 nt, Human
gaagcuggccugagagggg

SEQ ID NO: 1989696 - RNA, 22 nt, Human
gaagcuggccugagaggggaag

SEQ ID NO: 1989697 - RNA, 15 nt, Human
gaaggcuauggggau

SEQ ID NO: 1989698 - RNA, 19 nt, Human
gaaggcucgagcaugccug

SEQ ID NO: 1989699 - RNA, 21 nt, Human
gacacacagcucuguccuggg

SEQ ID NO: 1989700 - RNA, 12 nt, Human
gaauuuuaaaag

SEQ ID NO: 1989701 - RNA, 15 nt, Human
gaauuuuaaaagaug

SEQ ID NO: 1989702 - RNA, 21 nt, Human
gaauuuuaaaagaugcaaugu

SEQ ID NO: 1989703 - RNA, 23 nt, Human
gaauuuuaaaagaugcaauguag

SEQ ID NO: 1989704 - RNA, 13 nt, Human
gaauuuuaagccu

SEQ ID NO: 1989705 - RNA, 20 nt, Human
gaauuuuaagccuuuguuga

SEQ ID NO: 1989706 - RNA, 19 nt, Human
gaauuuuggcugugucucc

SEQ ID NO: 1989707 - RNA, 22 nt, Human
gaauuuucauuuuacaguuacu

SEQ ID NO: 1989708 - RNA, 21 nt, Human
gaauuuuauuuuuugggaaaa

SEQ ID NO: 1989709 - RNA, 18 nt, Human
gaauuuuauugacacagu

SEQ ID NO: 1989710 - RNA, 11 nt, Human
gaauuuucauu

SEQ ID NO: 1989711 - RNA, 12 nt, Human
gaauuuucauuu

SEQ ID NO: 1989712 - RNA, 13 nt, Human
gaauuuucauuuu

SEQ ID NO: 1989713 - RNA, 14 nt, Human
gaauuuucauuuua

SEQ ID NO: 1989714 - RNA, 16 nt, Human
gaauuuucauuuuaca

SEQ ID NO: 1989715 - RNA, 20 nt, Human
gaauuuucauuuuacaguua

SEQ ID NO: 1989716 - RNA, 12 nt, Human
gaauuaugaaac

SEQ ID NO: 1989717 - RNA, 20 nt, Human
gaauuugugaagguggaaau

SEQ ID NO: 1989718 - RNA, 15 nt, Human
gaauuuuuaugugug

SEQ ID NO: 1989719 - RNA, 18 nt, Human
gaauuuuuaugugugauu

SEQ ID NO: 1989720 - RNA, 21 nt, Human
gaauuuugugcccccauguaa

SEQ ID NO: 1989721 - RNA, 20 nt, Human
gaauuuugugcccccaugua

SEQ ID NO: 1989722 - RNA, 23 nt, Human
gaauuuuggcugugucucccuuc

SEQ ID NO: 1989723 - RNA, 15 nt, Human
gacacacagcucugu

SEQ ID NO: 1989724 - RNA, 17 nt, Human
gacacacagcucugucc

SEQ ID NO: 1989725 - RNA, 18 nt, Human
gacacacagcucuguccu

SEQ ID NO: 1989726 - RNA, 19 nt, Human
gacacacagcucuguccug

SEQ ID NO: 1989727 - RNA, 15 nt, Human
gacaaaauggaauac

SEQ ID NO: 1989728 - RNA, 14 nt, Human
gacacacagcucug

SEQ ID NO: 1989729 - RNA, 13 nt, Human
gacacugaugggc

SEQ ID NO: 1989730 - RNA, 16 nt, Human
gacacuuaaaaauggu

SEQ ID NO: 1989731 - RNA, 15 nt, Human
gacacugaugggcaa

SEQ ID NO: 1989732 - RNA, 23 nt, Human
gacacuuauccacgagagcgcag

SEQ ID NO: 1989733 - RNA, 23 nt, Human
gacagacaacacugggaaacaga

SEQ ID NO: 1989734 - RNA, 14 nt, Human
gacagaaggcuccu

SEQ ID NO: 1989735 - RNA, 19 nt, Human
gacagaaggcuccugcccc

SEQ ID NO: 1989736 - RNA, 20 nt, Human
gacagaaggcuccugccccc

SEQ ID NO: 1989737 - RNA, 23 nt, Human
gacagcccgggcucugccuccca

SEQ ID NO: 1989738 - RNA, 22 nt, Human
gacagcccgggcucugccuccc

SEQ ID NO: 1989739 - RNA, 21 nt, Human
gacagcccgggcucugccucc

SEQ ID NO: 1989740 - RNA, 12 nt, Human
gacagacacagg

SEQ ID NO: 1989741 - RNA, 20 nt, Human
gacaggguuuugccauguug

SEQ ID NO: 1989742 - RNA, 22 nt, Human
gacaggguuuugccauguuggc

SEQ ID NO: 1989743 - RNA, 15 nt, Human
gacagcgcacagcug

SEQ ID NO: 1989744 - RNA, 18 nt, Human
gacagcgcacagcugcuc

SEQ ID NO: 1989745 - RNA, 11 nt, Human
gacagcuccuu

SEQ ID NO: 1989746 - RNA, 13 nt, Human
gacagcccuccau

SEQ ID NO: 1989747 - RNA, 13 nt, Human
gacagccuggcac

SEQ ID NO: 1989748 - RNA, 19 nt, Human
gacagccuggcacagggca

SEQ ID NO: 1989749 - RNA, 15 nt, Human
gacaguauuuguggg

SEQ ID NO: 1989750 - RNA, 14 nt, Human
gacagucucaccau

SEQ ID NO: 1989751 - RNA, 23 nt, Human
gacagucucaccauuuccccagg

SEQ ID NO: 1989752 - RNA, 13 nt, Human
gacagucucacca

SEQ ID NO: 1989753 - RNA, 14 nt, Human
gacagugaaagaaa

SEQ ID NO: 1989754 - RNA, 22 nt, Human
gagaaggacccggaggggccug

SEQ ID NO: 1989755 - RNA, 23 nt, Human
gagaaggacccggaggggccugg

SEQ ID NO: 1989756 - RNA, 12 nt, Human
gagaaggaagcc

SEQ ID NO: 1989757 - RNA, 20 nt, Human
gagaaggacccggaggggcc

SEQ ID NO: 1989758 - RNA, 15 nt, Human
gagaagcggcuggca

SEQ ID NO: 1989759 - RNA, 13 nt, Human
gagaagcggcugg

SEQ ID NO: 1989760 - RNA, 16 nt, Human
gagaagcggcuggcag

SEQ ID NO: 1989761 - RNA, 23 nt, Human
gagacuaaccccaccacacccuc

SEQ ID NO: 1989762 - RNA, 11 nt, Human
gagaccugccc

SEQ ID NO: 1989763 - RNA, 12 nt, Human
gagaccugcccc

SEQ ID NO: 1989764 - RNA, 13 nt, Human
gagaccugccccu

SEQ ID NO: 1989765 - RNA, 21 nt, Human
gagacccugucucaaaaaaag

SEQ ID NO: 1989766 - RNA, 20 nt, Human
gagaagucuucuauuuauuu

SEQ ID NO: 1989767 - RNA, 21 nt, Human
gagaagucuucuauuuauuua

SEQ ID NO: 1989768 - RNA, 14 nt, Human
gagaaucacuugaa

SEQ ID NO: 1989769 - RNA, 18 nt, Human
gagaagugacgguuccua

SEQ ID NO: 1989770 - RNA, 15 nt, Human
gagaaucacuugaac

SEQ ID NO: 1989771 - RNA, 15 nt, Human
gagaaucauguuucu

SEQ ID NO: 1989772 - RNA, 16 nt, Human
gagaaucacaggcugg

SEQ ID NO: 1989773 - RNA, 16 nt, Human
gagaaucauguuucuu

SEQ ID NO: 1989774 - RNA, 17 nt, Human
gagaaucauguuucuuu

SEQ ID NO: 1989775 - RNA, 19 nt, Human
gagaaucauguuucuuuga

SEQ ID NO: 1989776 - RNA, 20 nt, Human
gagaaucauguuucuuugau

SEQ ID NO: 1989777 - RNA, 18 nt, Human
gacuuuugaaaagaggug

SEQ ID NO: 1989778 - RNA, 13 nt, Human
gacuuuugcuuua

SEQ ID NO: 1989779 - RNA, 14 nt, Human
gacuuuugcuuuaa

SEQ ID NO: 1989780 - RNA, 15 nt, Human
gacuuuugcuuuaau

SEQ ID NO: 1989781 - RNA, 17 nt, Human
gacuuuugcuuuaauuc

SEQ ID NO: 1989782 - RNA, 23 nt, Human
gacuuuucuuucagccaagaauu

SEQ ID NO: 1989783 - RNA, 21 nt, Human
gacuuuucuuuguggcuuccu

SEQ ID NO: 1989784 - RNA, 11 nt, Human
gacuuuccucu

SEQ ID NO: 1989785 - RNA, 13 nt, Human
gacuuucucuaau

SEQ ID NO: 1989786 - RNA, 16 nt, Human
gacuuucucuaauaau

SEQ ID NO: 1989787 - RNA, 18 nt, Human
gacuuucucuaauaauaa

SEQ ID NO: 1989788 - RNA, 19 nt, Human
gacuuucucuaauaauaaa

SEQ ID NO: 1989789 - RNA, 20 nt, Human
gacuuucucuaauaauaaau

SEQ ID NO: 1989790 - RNA, 21 nt, Human
gacuuucucuaauaauaaaua

SEQ ID NO: 1989791 - RNA, 22 nt, Human
gacuaucuaaauguugaaagau

SEQ ID NO: 1989792 - RNA, 18 nt, Human
gacuaggguccuggggaa

SEQ ID NO: 1989793 - RNA, 15 nt, Human
gacuaggguccuggg

SEQ ID NO: 1989794 - RNA, 16 nt, Human
gacuaggguccugggg

SEQ ID NO: 1989795 - RNA, 12 nt, Human
gacucugucuca

SEQ ID NO: 1989796 - RNA, 17 nt, Human
gacucuggacuuucucu

SEQ ID NO: 1989797 - RNA, 20 nt, Human
gacucuggacuuucucuaau

SEQ ID NO: 1989798 - RNA, 22 nt, Human
gacucuggacuuucucuaauaa

SEQ ID NO: 1989799 - RNA, 16 nt, Human
gacucugcucuugcau

SEQ ID NO: 1989800 - RNA, 20 nt, Human
gacugaaaaccucuccucau

SEQ ID NO: 1989801 - RNA, 18 nt, Human
gacugaaaaccucuccuc

SEQ ID NO: 1989802 - RNA, 17 nt, Human
gacugaaaaccucuccu

SEQ ID NO: 1989803 - RNA, 16 nt, Human
gacugaaaaccucucc

SEQ ID NO: 1989804 - RNA, 22 nt, Human
gacucuuuuccaaacacaggca

SEQ ID NO: 1989805 - RNA, 14 nt, Human
gagcagggcucagc

SEQ ID NO: 1989806 - RNA, 18 nt, Human
gagcagggaaggccugac

SEQ ID NO: 1989807 - RNA, 13 nt, Human
gagcagggaaggc

SEQ ID NO: 1989808 - RNA, 14 nt, Human
gagcagggaaggcc

SEQ ID NO: 1989809 - RNA, 16 nt, Human
gagcagggaaggccug

SEQ ID NO: 1989810 - RNA, 17 nt, Human
gagcagggaaggccuga

SEQ ID NO: 1989811 - RNA, 12 nt, Human
gagcaucaggcc

SEQ ID NO: 1989812 - RNA, 21 nt, Human
gagcagggcucagcggggaca

SEQ ID NO: 1989813 - RNA, 22 nt, Human
gagcaugccuggauggggcugc

SEQ ID NO: 1989814 - RNA, 17 nt, Human
gagcccccagcuuccag

SEQ ID NO: 1989815 - RNA, 20 nt, Human
gagcccccagcuuccagcag

SEQ ID NO: 1989816 - RNA, 21 nt, Human
gagcccccagcuuccagcagg

SEQ ID NO: 1989817 - RNA, 22 nt, Human
gagcccccagcuuccagcagga

SEQ ID NO: 1989818 - RNA, 12 nt, Human
gagccccacucu

SEQ ID NO: 1989819 - RNA, 13 nt, Human
gagccccacucuc

SEQ ID NO: 1989820 - RNA, 14 nt, Human
gagccccacucuca

SEQ ID NO: 1989821 - RNA, 16 nt, Human
gagccccacucucaga

SEQ ID NO: 1989822 - RNA, 17 nt, Human
gagccccacucucagag

SEQ ID NO: 1989823 - RNA, 18 nt, Human
gagccccacucucagagg

SEQ ID NO: 1989824 - RNA, 19 nt, Human
gagccccacucucagaggc

SEQ ID NO: 1989825 - RNA, 20 nt, Human
gagccccacucucagaggcc

SEQ ID NO: 1989826 - RNA, 21 nt, Human
gagccccacucucagaggccc

SEQ ID NO: 1989827 - RNA, 22 nt, Human
gagccccacucucagaggcccc

SEQ ID NO: 1989828 - RNA, 23 nt, Human
gagccccacucucagaggcccca

SEQ ID NO: 1989829 - RNA, 19 nt, Human
gagcuggggaugucucuca

SEQ ID NO: 1989830 - RNA, 20 nt, Human
gagcuggggagaauggggcu

SEQ ID NO: 1989831 - RNA, 18 nt, Human
gagcugggugucaagagg

SEQ ID NO: 1989832 - RNA, 21 nt, Human
gagcuggggaccagcagucug

SEQ ID NO: 1989833 - RNA, 17 nt, Human
gagccuuccaggggugg

SEQ ID NO: 1989834 - RNA, 16 nt, Human
gagccuuccaggggug

SEQ ID NO: 1989835 - RNA, 15 nt, Human
gagccuuccaggggu

SEQ ID NO: 1989836 - RNA, 14 nt, Human
gagccuuccagggg

SEQ ID NO: 1989837 - RNA, 14 nt, Human
gagcgacagagcag

SEQ ID NO: 1989838 - RNA, 15 nt, Human
gagcgacagagcagu

SEQ ID NO: 1989839 - RNA, 22 nt, Human
gagccuugaacuuugaccucug

SEQ ID NO: 1989840 - RNA, 19 nt, Human
gagccuugaacuuugaccu

SEQ ID NO: 1989841 - RNA, 21 nt, Human
gagcggagaaaggaagggcug

SEQ ID NO: 1989842 - RNA, 18 nt, Human
gagcggagaaaggaaggg

SEQ ID NO: 1989843 - RNA, 20 nt, Human
gagcggagacgggaggccug

SEQ ID NO: 1989844 - RNA, 16 nt, Human
gagcggauugcaaagc

SEQ ID NO: 1989845 - RNA, 18 nt, Human
gagcggauugcaaagcaa

SEQ ID NO: 1989846 - RNA, 21 nt, Human
gagcugccuguucagcuccag

SEQ ID NO: 1989847 - RNA, 22 nt, Human
gagcugccuguucagcuccagc

SEQ ID NO: 1989848 - RNA, 20 nt, Human
gagauuuggggcuaaagacu

SEQ ID NO: 1989849 - RNA, 13 nt, Human
gagauuuacaacu

SEQ ID NO: 1989850 - RNA, 14 nt, Human
gagauguagccccu

SEQ ID NO: 1989851 - RNA, 21 nt, Human
gagaugguaugcacaauucca

SEQ ID NO: 1989852 - RNA, 18 nt, Human
gagauugcaccacugcac

SEQ ID NO: 1989853 - RNA, 21 nt, Human
gagauugcaccacugcacucc

SEQ ID NO: 1989854 - RNA, 12 nt, Human
gagaugucucuu

SEQ ID NO: 1989855 - RNA, 16 nt, Human
gagacuccugcaggca

SEQ ID NO: 1989856 - RNA, 15 nt, Human
gagacuccugcaggc

SEQ ID NO: 1989857 - RNA, 19 nt, Human
gagacuauguaaaaauaac

SEQ ID NO: 1989858 - RNA, 18 nt, Human
gagacuccugcaggcagc

SEQ ID NO: 1989859 - RNA, 17 nt, Human
gagacuccugcaggcag

SEQ ID NO: 1989860 - RNA, 14 nt, Human
gagaggcauccagu

SEQ ID NO: 1989861 - RNA, 20 nt, Human
gagaugaugaaaauauuuaa

SEQ ID NO: 1989862 - RNA, 19 nt, Human
gagaugaugaaaauauuua

SEQ ID NO: 1989863 - RNA, 22 nt, Human
gagaggcauccaguaucuugaa

SEQ ID NO: 1989864 - RNA, 21 nt, Human
gagaugaugccaugggcccuc

SEQ ID NO: 1989865 - RNA, 15 nt, Human
gagaugcugugcccc

SEQ ID NO: 1989866 - RNA, 17 nt, Human
gagaugcugugccccug

SEQ ID NO: 1989867 - RNA, 14 nt, Human
gagaugcugugccc

SEQ ID NO: 1989868 - RNA, 22 nt, Human
cuuuccugaggcugggcucccu

SEQ ID NO: 1989869 - RNA, 13 nt, Human
cuuuccugugcca

SEQ ID NO: 1989870 - RNA, 14 nt, Human
cuuuccugugccag

SEQ ID NO: 1989871 - RNA, 15 nt, Human
cuuuccugugccagg

SEQ ID NO: 1989872 - RNA, 17 nt, Human
cuuuccuguuucucagu

SEQ ID NO: 1989873 - RNA, 19 nt, Human
cuuucaggagcuccauaca

SEQ ID NO: 1989874 - RNA, 20 nt, Human
cuuucagccaagaauucuua

SEQ ID NO: 1989875 - RNA, 23 nt, Human
cuuucagccaagaauucuuaaau

SEQ ID NO: 1989876 - RNA, 16 nt, Human
cuuucacaaccuucug

SEQ ID NO: 1989877 - RNA, 23 nt, Human
cuuucaauaggaaaaacugauuu

SEQ ID NO: 1989878 - RNA, 14 nt, Human
cuuucacaaccuuc

SEQ ID NO: 1989879 - RNA, 16 nt, Human
cuuuguagcauuuggu

SEQ ID NO: 1989880 - RNA, 20 nt, Human
cuuuguagcauuuggugcuu

SEQ ID NO: 1989881 - RNA, 12 nt, Human
cuuuguauaguu

SEQ ID NO: 1989882 - RNA, 15 nt, Human
cuuuguauaguuaug

SEQ ID NO: 1989883 - RNA, 18 nt, Human
cuuuguauaguuauguaa

SEQ ID NO: 1989884 - RNA, 19 nt, Human
cuuuguauaguuauguaaa

SEQ ID NO: 1989885 - RNA, 21 nt, Human
cuuuguauaguuauguaaaua

SEQ ID NO: 1989886 - RNA, 13 nt, Human
cuuuuauaaacuu

SEQ ID NO: 1989887 - RNA, 14 nt, Human
cuuuuauaaacuuu

SEQ ID NO: 1989888 - RNA, 20 nt, Human
cuuuuaguuuuucugucccu

SEQ ID NO: 1989889 - RNA, 14 nt, Human
cuuuuaguuuuucu

SEQ ID NO: 1989890 - RNA, 18 nt, Human
cuuuuaguuuuucugucc

SEQ ID NO: 1989891 - RNA, 14 nt, Human
cuuuuaugugaaac

SEQ ID NO: 1989892 - RNA, 13 nt, Human
cuuuguaaugaaa

SEQ ID NO: 1989893 - RNA, 15 nt, Human
cuuuguaaauuguca

SEQ ID NO: 1989894 - RNA, 15 nt, Human
cuuuguaaauucuga

SEQ ID NO: 1989895 - RNA, 16 nt, Human
cuuuguaaauucugau

SEQ ID NO: 1989896 - RNA, 17 nt, Human
cuuuguaaauucugauu

SEQ ID NO: 1989897 - RNA, 20 nt, Human
cuuugauguguuguucuugg

SEQ ID NO: 1989898 - RNA, 12 nt, Human
cuuuguaaauuc

SEQ ID NO: 1989899 - RNA, 14 nt, Human
cuuugggcugcccu

SEQ ID NO: 1989900 - RNA, 22 nt, Human
cuuugaugucagcaguugcugg

SEQ ID NO: 1989901 - RNA, 12 nt, Human
cuuugauguguu

SEQ ID NO: 1989902 - RNA, 13 nt, Human
cuuugauguguug

SEQ ID NO: 1989903 - RNA, 15 nt, Human
cuuugauguguuguu

SEQ ID NO: 1989904 - RNA, 16 nt, Human
cuuugauguguuguuc

SEQ ID NO: 1989905 - RNA, 18 nt, Human
cuuugauguguuguucuu

SEQ ID NO: 1989906 - RNA, 15 nt, Human
cuuugggcugcccug

SEQ ID NO: 1989907 - RNA, 19 nt, Human
cuuugggcugcccuggugc

SEQ ID NO: 1989908 - RNA, 20 nt, Human
cuuugggcugcccuggugcu

SEQ ID NO: 1989909 - RNA, 21 nt, Human
cuuugggcugcccuggugcug

SEQ ID NO: 1989910 - RNA, 15 nt, Human
cuuucuagccagagg

SEQ ID NO: 1989911 - RNA, 16 nt, Human
cuuucuacucauuuua

SEQ ID NO: 1989912 - RNA, 15 nt, Human
cuuucuacuuccaag

SEQ ID NO: 1989913 - RNA, 16 nt, Human
cuuucuacuuccaaga

SEQ ID NO: 1989914 - RNA, 14 nt, Human
cuuucuagaaagaa

SEQ ID NO: 1989915 - RNA, 18 nt, Human
cuuucuagaaagaauaaa

SEQ ID NO: 1989916 - RNA, 17 nt, Human
cuuucuacccagcgagc

SEQ ID NO: 1989917 - RNA, 16 nt, Human
cuuucuagccagagga

SEQ ID NO: 1989918 - RNA, 11 nt, Human
cuuugauguca

SEQ ID NO: 1989919 - RNA, 20 nt, Human
cuuugaucaugaauaacuga

SEQ ID NO: 1989920 - RNA, 14 nt, Human
cuuugaucaugaau

SEQ ID NO: 1989921 - RNA, 22 nt, Human
cuuugauauuuucaacgcagcc

SEQ ID NO: 1989922 - RNA, 22 nt, Human
cuuugauauauaggacauugau

SEQ ID NO: 1989923 - RNA, 19 nt, Human
gaaacuuugagaucuaaaa

SEQ ID NO: 1989924 - RNA, 13 nt, Human
gaaacuuuuggaa

SEQ ID NO: 1989925 - RNA, 15 nt, Human
gaaacuuuuggaagg

SEQ ID NO: 1989926 - RNA, 22 nt, Human
gaaacuuugagaucuaaaaaua

SEQ ID NO: 1989927 - RNA, 22 nt, Human
gaaaggcuccaggagcagccac

SEQ ID NO: 1989928 - RNA, 20 nt, Human
gaaaggcuccaggagcagcc

SEQ ID NO: 1989929 - RNA, 21 nt, Human
gaaaggcuccaggagcagcca

SEQ ID NO: 1989930 - RNA, 20 nt, Human
gaaagacuaucuaaauguug

SEQ ID NO: 1989931 - RNA, 21 nt, Human
gaaagaaaauaccaaggaaca

SEQ ID NO: 1989932 - RNA, 19 nt, Human
gaaaucaccgaaaacgugg

SEQ ID NO: 1989933 - RNA, 16 nt, Human
gaaaucaguaaacacu

SEQ ID NO: 1989934 - RNA, 19 nt, Human
gaaaucaguaaacacugug

SEQ ID NO: 1989935 - RNA, 16 nt, Human
gaaaucauauuuggaa

SEQ ID NO: 1989936 - RNA, 20 nt, Human
gaaagggacgcuacccggga

SEQ ID NO: 1989937 - RNA, 19 nt, Human
gaaagggacuuggaagcuc

SEQ ID NO: 1989938 - RNA, 22 nt, Human
gaaagggacuuggaagcuccgc

SEQ ID NO: 1989939 - RNA, 16 nt, Human
gaaaggucaccucacu

SEQ ID NO: 1989940 - RNA, 18 nt, Human
gaaaggucaccucacuca

SEQ ID NO: 1989941 - RNA, 20 nt, Human
gaaaggucaccucacucagc

SEQ ID NO: 1989942 - RNA, 12 nt, Human
gaaagggucucc

SEQ ID NO: 1989943 - RNA, 14 nt, Human
gaaaggucaccuca

SEQ ID NO: 1989944 - RNA, 19 nt, Human
gaaaauugccuuucugugu

SEQ ID NO: 1989945 - RNA, 20 nt, Human
gaaaauugccuuucuguguu

SEQ ID NO: 1989946 - RNA, 21 nt, Human
gaaaauugccuuucuguguuu

SEQ ID NO: 1989947 - RNA, 14 nt, Human
gaaaaacugauuuu

SEQ ID NO: 1989948 - RNA, 11 nt, Human
gaaaacuuugu

SEQ ID NO: 1989949 - RNA, 13 nt, Human
gaaaacuuuguua

SEQ ID NO: 1989950 - RNA, 16 nt, Human
gaaaacuuuguuaggc

SEQ ID NO: 1989951 - RNA, 18 nt, Human
gaaaacuuuguuaggcca

SEQ ID NO: 1989952 - RNA, 9 nt, Human
gaaaagaaa

SEQ ID NO: 1989953 - RNA, 10 nt, Human
gaaaagaaaa

SEQ ID NO: 1989954 - RNA, 11 nt, Human
gaaaagaaaaa

SEQ ID NO: 1989955 - RNA, 12 nt, Human
gaaaagaaaaaa

SEQ ID NO: 1989956 - RNA, 17 nt, Human
gaaaagaaaaaaaaaga

SEQ ID NO: 1989957 - RNA, 19 nt, Human
gaaaagaaaaaaaaagaaa

SEQ ID NO: 1989958 - RNA, 20 nt, Human
gaaaagaaaaaaaaagaaaa

SEQ ID NO: 1989959 - RNA, 18 nt, Human
gaaaagaaaaaugagccu

SEQ ID NO: 1989960 - RNA, 21 nt, Human
gaaaauggaagacagcucuua

SEQ ID NO: 1989961 - RNA, 23 nt, Human
gaaaaugcuguauuagucacaga

SEQ ID NO: 1989962 - RNA, 15 nt, Human
gaaaauguaugugua

SEQ ID NO: 1989963 - RNA, 19 nt, Human
gaaaauugcauugaagccc

SEQ ID NO: 1989964 - RNA, 17 nt, Human
gaaaauugccuuucugu

SEQ ID NO: 1989965 - RNA, 18 nt, Human
gaaaauugccuuucugug

SEQ ID NO: 1989966 - RNA, 23 nt, Human
gaaaauggacguguuaugacucc

SEQ ID NO: 1989967 - RNA, 19 nt, Human
gaaaauggacguguuauga

SEQ ID NO: 1989968 - RNA, 13 nt, Human
cuuuugccauuga

SEQ ID NO: 1989969 - RNA, 18 nt, Human
cuuuuggaagguauuuaa

SEQ ID NO: 1989970 - RNA, 16 nt, Human
cuuuugccguuauuaa

SEQ ID NO: 1989971 - RNA, 13 nt, Human
cuuuuggagucag

SEQ ID NO: 1989972 - RNA, 23 nt, Human
cuuuugcccacacuugggagcaa

SEQ ID NO: 1989973 - RNA, 15 nt, Human
cuuuuggcauuuuac

SEQ ID NO: 1989974 - RNA, 21 nt, Human
cuuuugguuaugaauacuuug

SEQ ID NO: 1989975 - RNA, 19 nt, Human
cuuuugguucauuuucaga

SEQ ID NO: 1989976 - RNA, 15 nt, Human
cuuuugggaaaugcu

SEQ ID NO: 1989977 - RNA, 18 nt, Human
cuuuugucuaugggacuc

SEQ ID NO: 1989978 - RNA, 20 nt, Human
gaaaaacucaaccaaauggu

SEQ ID NO: 1989979 - RNA, 21 nt, Human
cuuuuuuuuuuuugagacaga

SEQ ID NO: 1989980 - RNA, 11 nt, Human
gaaaaaaaaga

SEQ ID NO: 1989981 - RNA, 16 nt, Human
gaaaaaaaagaaaaaa

SEQ ID NO: 1989982 - RNA, 23 nt, Human
cuuuuuuggcugcugaaggcucg

SEQ ID NO: 1989983 - RNA, 12 nt, Human
cuuuugugcauu

SEQ ID NO: 1989984 - RNA, 13 nt, Human
cuuuugugcauua

SEQ ID NO: 1989985 - RNA, 17 nt, Human
cuuuuuuucucuagagu

SEQ ID NO: 1989986 - RNA, 20 nt, Human
cuuuuuuuuuuuugagacag

SEQ ID NO: 1989987 - RNA, 22 nt, Human
cuuuuuuuuuuaagugaaauuu

SEQ ID NO: 1989988 - RNA, 15 nt, Human
cuuuuuuuuuuaagu

SEQ ID NO: 1989989 - RNA, 21 nt, Human
cuuuuuuuuuuaagugaaauu

SEQ ID NO: 1989990 - RNA, 21 nt, Human
cuucuucccacaaagaauaua

SEQ ID NO: 1989991 - RNA, 23 nt, Human
cuucugacccaugcugcccugug

SEQ ID NO: 1989992 - RNA, 17 nt, Human
cuucugagcuggccucu

SEQ ID NO: 1989993 - RNA, 20 nt, Human
cuucugaucacugaaauaaa

SEQ ID NO: 1989994 - RNA, 22 nt, Human
cuucugcacauaaacucuuuua

SEQ ID NO: 1989995 - RNA, 22 nt, Human
cuucugacccaugcugcccugu

SEQ ID NO: 1989996 - RNA, 21 nt, Human
cuucugacccaugcugcccug

SEQ ID NO: 1989997 - RNA, 20 nt, Human
cuucugacccaugcugcccu

SEQ ID NO: 1989998 - RNA, 21 nt, Human
cuucuguugcugccucaugcu

SEQ ID NO: 1989999 - RNA, 23 nt, Human
cuucuucagagacuccugcaggc

SEQ ID NO: 1990000 - RNA, 17 nt, Human
cuucuguugcugccuca

SEQ ID NO: 1990001 - RNA, 18 nt, Human
cuucuguugcugccucau

SEQ ID NO: 1990002 - RNA, 19 nt, Human
cuucuguugcugccucaug

SEQ ID NO: 1990003 - RNA, 20 nt, Human
cuucuguugcugccucaugc

SEQ ID NO: 1990004 - RNA, 17 nt, Human
cuuccugcaacaccuug

SEQ ID NO: 1990005 - RNA, 23 nt, Human
cuuccugaggggagacagagcaa

SEQ ID NO: 1990006 - RNA, 19 nt, Human
cuuccugauugguuucucu

SEQ ID NO: 1990007 - RNA, 20 nt, Human
cuuccugauugguuucucuu

SEQ ID NO: 1990008 - RNA, 18 nt, Human
cuuccuccugacacccca

SEQ ID NO: 1990009 - RNA, 19 nt, Human
cuuccuccugacaccccac

SEQ ID NO: 1990010 - RNA, 14 nt, Human
cuuccuccugacac

SEQ ID NO: 1990011 - RNA, 15 nt, Human
cuuccuccugacacc

SEQ ID NO: 1990012 - RNA, 22 nt, Human
cuuccugauugguuucucuucu

SEQ ID NO: 1990013 - RNA, 23 nt, Human
cuuccugauugguuucucuucuc

SEQ ID NO: 1990014 - RNA, 17 nt, Human
cuucuagaaccaggcaa

SEQ ID NO: 1990015 - RNA, 13 nt, Human
cuucuagaaccag

SEQ ID NO: 1990016 - RNA, 21 nt, Human
cuucuaaguugaguauauuau

SEQ ID NO: 1990017 - RNA, 19 nt, Human
cuugaauuguaaggaauga

SEQ ID NO: 1990018 - RNA, 18 nt, Human
cuugaaggaaaaauucaa

SEQ ID NO: 1990019 - RNA, 18 nt, Human
cuugaauuguaaggaaug

SEQ ID NO: 1990020 - RNA, 13 nt, Human
cuugaaggaaaaa

SEQ ID NO: 1990021 - RNA, 14 nt, Human
cuugaaggaaaaau

SEQ ID NO: 1990022 - RNA, 15 nt, Human
cuugaaggaaaaauu

SEQ ID NO: 1990023 - RNA, 15 nt, Human
cuugaagccugcucc

SEQ ID NO: 1990024 - RNA, 16 nt, Human
cuugaagccugcuccu

SEQ ID NO: 1990025 - RNA, 20 nt, Human
cuugaagccugcuccuuccc

SEQ ID NO: 1990026 - RNA, 14 nt, Human
cuugacagggcaca

SEQ ID NO: 1990027 - RNA, 15 nt, Human
cuugacagggcacac

SEQ ID NO: 1990028 - RNA, 16 nt, Human
cuugacaaagucaagc

SEQ ID NO: 1990029 - RNA, 19 nt, Human
cuugacaaagucaagccac

SEQ ID NO: 1990030 - RNA, 13 nt, Human
cuugacagggcac

SEQ ID NO: 1990031 - RNA, 22 nt, Human
cuugacaaagucaagccacaug

SEQ ID NO: 1990032 - RNA, 20 nt, Human
cuugacagggcacaccgggc

SEQ ID NO: 1990033 - RNA, 18 nt, Human
cuugacaaacuucuuuca

SEQ ID NO: 1990034 - RNA, 19 nt, Human
cuugacaaacuucuuucac

SEQ ID NO: 1990035 - RNA, 16 nt, Human
cuugauaauuuuccuu

SEQ ID NO: 1990036 - RNA, 22 nt, Human
cuugauaauuuuccuuuaauau

SEQ ID NO: 1990037 - RNA, 23 nt, Human
cuugauagccucauuaaagcauu

SEQ ID NO: 1990038 - RNA, 20 nt, Human
cuuggcgcugccccuggcag

SEQ ID NO: 1990039 - RNA, 17 nt, Human
cuuggcgcugccccugg

SEQ ID NO: 1990040 - RNA, 14 nt, Human
cuuggcgcugcccc

SEQ ID NO: 1990041 - RNA, 12 nt, Human
cuuggcgcugcc

SEQ ID NO: 1990042 - RNA, 23 nt, Human
cuuggcagguaggaauauuauau

SEQ ID NO: 1990043 - RNA, 13 nt, Human
cuugaugccuggc

SEQ ID NO: 1990044 - RNA, 21 nt, Human
cuugaugaaauaacacagcag

SEQ ID NO: 1990045 - RNA, 22 nt, Human
cuugaugaaauaacacagcagu

SEQ ID NO: 1990046 - RNA, 12 nt, Human
cuugaugccugg

SEQ ID NO: 1990047 - RNA, 23 nt, Human
cuuggcaauaaauuuugaaaagu

SEQ ID NO: 1990048 - RNA, 14 nt, Human
cuugccuuugaaga

SEQ ID NO: 1990049 - RNA, 19 nt, Human
cugugcugagucugaaggc

SEQ ID NO: 1990050 - RNA, 14 nt, Human
cugugcugagucug

SEQ ID NO: 1990051 - RNA, 12 nt, Human
cugugcugaguc

SEQ ID NO: 1990052 - RNA, 16 nt, Human
cuuauggaacacucug

SEQ ID NO: 1990053 - RNA, 13 nt, Human
cuuauggaacacu

SEQ ID NO: 1990054 - RNA, 12 nt, Human
cuuaugcuucca

SEQ ID NO: 1990055 - RNA, 19 nt, Human
cuucacggaagagccuugc

SEQ ID NO: 1990056 - RNA, 15 nt, Human
cuucacggaagagcc

SEQ ID NO: 1990057 - RNA, 20 nt, Human
cuuauuguagcauccuggaa

SEQ ID NO: 1990058 - RNA, 22 nt, Human
cuucaccuuuguccccaccgca

SEQ ID NO: 1990059 - RNA, 18 nt, Human
cuuauuggcagcucuacu

SEQ ID NO: 1990060 - RNA, 23 nt, Human
cuuauuguagcauccuggaauau

SEQ ID NO: 1990061 - RNA, 21 nt, Human
cuucaccuuuguccccaccgc

SEQ ID NO: 1990062 - RNA, 16 nt, Human
cuuauuccauauuaga

SEQ ID NO: 1990063 - RNA, 22 nt, Human
cuuauuccauauuagaaaacuu

SEQ ID NO: 1990064 - RNA, 21 nt, Human
cuuauggaacacucugagacu

SEQ ID NO: 1990065 - RNA, 13 nt, Human
cuuaugcuuccag

SEQ ID NO: 1990066 - RNA, 14 nt, Human
cuuaugcuuccaga

SEQ ID NO: 1990067 - RNA, 15 nt, Human
cuuaugcuuccagaa

SEQ ID NO: 1990068 - RNA, 16 nt, Human
cuuaugcuuccagaaa

SEQ ID NO: 1990069 - RNA, 20 nt, Human
cuuauggaacacucugagac

SEQ ID NO: 1990070 - RNA, 19 nt, Human
cuuauggaacacucugaga

SEQ ID NO: 1990071 - RNA, 17 nt, Human
cuuauggaacacucuga

SEQ ID NO: 1990072 - RNA, 23 nt, Human
cuucccaccucucucacuccuug

SEQ ID NO: 1990073 - RNA, 21 nt, Human
cuucccaccucucucacuccu

SEQ ID NO: 1990074 - RNA, 11 nt, Human
cuucccaccuc

SEQ ID NO: 1990075 - RNA, 11 nt, Human
cuuccauaauc

SEQ ID NO: 1990076 - RNA, 21 nt, Human
cuuccauaaucuggacuccuc

SEQ ID NO: 1990077 - RNA, 17 nt, Human
cuucacucuaagauguu

SEQ ID NO: 1990078 - RNA, 23 nt, Human
cuucacuaagaacaaaagaagca

SEQ ID NO: 1990079 - RNA, 17 nt, Human
cuucagagacuccugca

SEQ ID NO: 1990080 - RNA, 15 nt, Human
cuucacuguaaaaua

SEQ ID NO: 1990081 - RNA, 19 nt, Human
cuucagagacuccugcagg

SEQ ID NO: 1990082 - RNA, 18 nt, Human
cuucagagacuccugcag

SEQ ID NO: 1990083 - RNA, 17 nt, Human
cuucacuguccuccaag

SEQ ID NO: 1990084 - RNA, 20 nt, Human
cuucagagacuccugcaggc

SEQ ID NO: 1990085 - RNA, 9 nt, Human
cuucauaca

SEQ ID NO: 1990086 - RNA, 10 nt, Human
cuucauacac

SEQ ID NO: 1990087 - RNA, 16 nt, Human
cuucaguuuuuguguu

SEQ ID NO: 1990088 - RNA, 12 nt, Human
cuucauacaggg

SEQ ID NO: 1990089 - RNA, 13 nt, Human
cuucauacaggga

SEQ ID NO: 1990090 - RNA, 22 nt, Human
cuucauacagggaugguguuca

SEQ ID NO: 1990091 - RNA, 14 nt, Human
cuucauauucagcu

SEQ ID NO: 1990092 - RNA, 16 nt, Human
cuucauagaauacuca

SEQ ID NO: 1990093 - RNA, 16 nt, Human
cuuccaguuacuuucc

SEQ ID NO: 1990094 - RNA, 19 nt, Human
cuuccaguuacuuuccaau

SEQ ID NO: 1990095 - RNA, 19 nt, Human
cuuccaguuuauuccagag

SEQ ID NO: 1990096 - RNA, 20 nt, Human
cuuccaguuuauuccagagc

SEQ ID NO: 1990097 - RNA, 21 nt, Human
cuuccaguuuauuccagagcu

SEQ ID NO: 1990098 - RNA, 23 nt, Human
cuuccaguuuauuccagagcugc

SEQ ID NO: 1990099 - RNA, 23 nt, Human
cuuccagugaggcucugcccuug

SEQ ID NO: 1990100 - RNA, 22 nt, Human
cuuccagugaggcucugcccuu

SEQ ID NO: 1990101 - RNA, 21 nt, Human
cuuccagugaggcucugcccu

SEQ ID NO: 1990102 - RNA, 13 nt, Human
cuucaugaaaugc

SEQ ID NO: 1990103 - RNA, 14 nt, Human
cuucaugaaaugcu

SEQ ID NO: 1990104 - RNA, 17 nt, Human
cuucaugaaaugcuaug

SEQ ID NO: 1990105 - RNA, 23 nt, Human
cuucaugaaaugcuaugucauuu

SEQ ID NO: 1990106 - RNA, 12 nt, Human
cuucaugaaaug

SEQ ID NO: 1990107 - RNA, 16 nt, Human
cugguuuccugcccug

SEQ ID NO: 1990108 - RNA, 22 nt, Human
cugguuuccugcccugggaggc

SEQ ID NO: 1990109 - RNA, 18 nt, Human
cugguuuccugcccuggg

SEQ ID NO: 1990110 - RNA, 21 nt, Human
cugguuuccugcccugggagg

SEQ ID NO: 1990111 - RNA, 15 nt, Human
cugucacugcugcuu

SEQ ID NO: 1990112 - RNA, 18 nt, Human
cugucagccauuccuguu

SEQ ID NO: 1990113 - RNA, 20 nt, Human
cugucauuugagcagggcuc

SEQ ID NO: 1990114 - RNA, 12 nt, Human
cuguccugccua

SEQ ID NO: 1990115 - RNA, 17 nt, Human
cugucauuugagcaggg

SEQ ID NO: 1990116 - RNA, 18 nt, Human
cugucauuugagcagggc

SEQ ID NO: 1990117 - RNA, 16 nt, Human
cugucauuugagcagg

SEQ ID NO: 1990118 - RNA, 14 nt, Human
cuguaaaaugcaaa

SEQ ID NO: 1990119 - RNA, 18 nt, Human
cuguaaaaugcaaaaaau

SEQ ID NO: 1990120 - RNA, 20 nt, Human
cuguaaaaugcaaaaaaucu

SEQ ID NO: 1990121 - RNA, 19 nt, Human
cuguaaaagcaaguccugc

SEQ ID NO: 1990122 - RNA, 20 nt, Human
cuguaaaagcaaguccugca

SEQ ID NO: 1990123 - RNA, 14 nt, Human
cuguaaaagaaaaa

SEQ ID NO: 1990124 - RNA, 23 nt, Human
cuguacuugcucuugaugccugg

SEQ ID NO: 1990125 - RNA, 12 nt, Human
cuguacuuugau

SEQ ID NO: 1990126 - RNA, 15 nt, Human
cuguacuuugauuca

SEQ ID NO: 1990127 - RNA, 19 nt, Human
cuguacuuugauucacaug

SEQ ID NO: 1990128 - RNA, 21 nt, Human
cuguacuuugauucacauguu

SEQ ID NO: 1990129 - RNA, 24 nt, Human
cuguacuuugauucacauguuuuc

SEQ ID NO: 1990130 - RNA, 21 nt, Human
cuguacuugcucuugaugccu

SEQ ID NO: 1990131 - RNA, 22 nt, Human
cuguacuugcucuugaugccug

SEQ ID NO: 1990132 - RNA, 19 nt, Human
cugucacccgaucgccagc

SEQ ID NO: 1990133 - RNA, 21 nt, Human
cuguaggaagguuaauguuca

SEQ ID NO: 1990134 - RNA, 12 nt, Human
cuguaggccuca

SEQ ID NO: 1990135 - RNA, 13 nt, Human
cuguaggccucag

SEQ ID NO: 1990136 - RNA, 22 nt, Human
cuguaggccucaggugaaacuc

SEQ ID NO: 1990137 - RNA, 18 nt, Human
cuguaggaguucuauuuu

SEQ ID NO: 1990138 - RNA, 15 nt, Human
cugugaagagaacca

SEQ ID NO: 1990139 - RNA, 16 nt, Human
cugugagaugcuagaa

SEQ ID NO: 1990140 - RNA, 21 nt, Human
cugugagaugcuagaacuccc

SEQ ID NO: 1990141 - RNA, 14 nt, Human
cugugcucuggaca

SEQ ID NO: 1990142 - RNA, 13 nt, Human
cugucgcccaguc

SEQ ID NO: 1990143 - RNA, 16 nt, Human
cugucgcccaggcugg

SEQ ID NO: 1990144 - RNA, 14 nt, Human
cugucgagccuggg

SEQ ID NO: 1990145 - RNA, 23 nt, Human
cugucgagccugggggcuggagc

SEQ ID NO: 1990146 - RNA, 20 nt, Human
cuggugaugcgcaguugcug

SEQ ID NO: 1990147 - RNA, 21 nt, Human
cuggugaugcgcaguugcugu

SEQ ID NO: 1990148 - RNA, 13 nt, Human
cuggugagcauua

SEQ ID NO: 1990149 - RNA, 19 nt, Human
cuggugaugcgcaguugcu

SEQ ID NO: 1990150 - RNA, 15 nt, Human
cuggugauauaucuc

SEQ ID NO: 1990151 - RNA, 23 nt, Human
cuggugacuuuccucuuuggucu

SEQ ID NO: 1990152 - RNA, 17 nt, Human
cuggguguggcgcagca

SEQ ID NO: 1990153 - RNA, 16 nt, Human
cuggguuagacugcca

SEQ ID NO: 1990154 - RNA, 18 nt, Human
cuggguuagacugccagc

SEQ ID NO: 1990155 - RNA, 19 nt, Human
cuggguuagacugccagcu

SEQ ID NO: 1990156 - RNA, 20 nt, Human
cuggguuagacugccagcuc

SEQ ID NO: 1990157 - RNA, 21 nt, Human
cuggguuagacugccagcucu

SEQ ID NO: 1990158 - RNA, 23 nt, Human
cuggguuagacugccagcucuuc

SEQ ID NO: 1990159 - RNA, 16 nt, Human
cuggguguggcgcagc

SEQ ID NO: 1990160 - RNA, 22 nt, Human
cuggguggcaccagcagccugg

SEQ ID NO: 1990161 - RNA, 23 nt, Human
cuggguggcaccagcagccugga

SEQ ID NO: 1990162 - RNA, 21 nt, Human
cuggugacuuuccucuuuggu

SEQ ID NO: 1990163 - RNA, 20 nt, Human
cuggugacuuuccucuuugg

SEQ ID NO: 1990164 - RNA, 15 nt, Human
cuggugacuuuccuc

SEQ ID NO: 1990165 - RNA, 23 nt, Human
cuggguuccuuccucugagccuu

SEQ ID NO: 1990166 - RNA, 14 nt, Human
cuggguucacugca

SEQ ID NO: 1990167 - RNA, 22 nt, Human
cuggguuccagcaauucuccug

SEQ ID NO: 1990168 - RNA, 18 nt, Human
cuggguuccuuccucuga

SEQ ID NO: 1990169 - RNA, 22 nt, Human
cuggguuccuuccucugagccu

SEQ ID NO: 1990170 - RNA, 17 nt, Human
cugggcagaaggaagac

SEQ ID NO: 1990171 - RNA, 16 nt, Human
cugggcagaaggaaga

SEQ ID NO: 1990172 - RNA, 18 nt, Human
cugggcagaaggaagacu

SEQ ID NO: 1990173 - RNA, 15 nt, Human
cuggggaaccugacc

SEQ ID NO: 1990174 - RNA, 16 nt, Human
cuggggaaccugaccc

SEQ ID NO: 1990175 - RNA, 17 nt, Human
cuggggaaccugacccc

SEQ ID NO: 1990176 - RNA, 18 nt, Human
cuggggauugggccccug

SEQ ID NO: 1990177 - RNA, 22 nt, Human
cuggggauugggccccugccag

SEQ ID NO: 1990178 - RNA, 16 nt, Human
cuggggauugggcccc

SEQ ID NO: 1990179 - RNA, 22 nt, Human
cuggggaugucucucaugacca

SEQ ID NO: 1990180 - RNA, 18 nt, Human
cuggggaacguucucuuu

SEQ ID NO: 1990181 - RNA, 16 nt, Human
cuggggccgaaagaac

SEQ ID NO: 1990182 - RNA, 18 nt, Human
cuggggccaggcuggguc

SEQ ID NO: 1990183 - RNA, 14 nt, Human
cugggacgcucugc

SEQ ID NO: 1990184 - RNA, 15 nt, Human
cugggacgcucugcu

SEQ ID NO: 1990185 - RNA, 16 nt, Human
cugggacgcucugcug

SEQ ID NO: 1990186 - RNA, 17 nt, Human
cugggacgcucugcugu

SEQ ID NO: 1990187 - RNA, 21 nt, Human
cuggccccucagggucccugg

SEQ ID NO: 1990188 - RNA, 20 nt, Human
cuggccccucagggucccug

SEQ ID NO: 1990189 - RNA, 18 nt, Human
cuggccccucaggguccc

SEQ ID NO: 1990190 - RNA, 17 nt, Human
cuggccccucagggucc

SEQ ID NO: 1990191 - RNA, 11 nt, Human
cuggcuccagc

SEQ ID NO: 1990192 - RNA, 13 nt, Human
cuggcuccagccu

SEQ ID NO: 1990193 - RNA, 16 nt, Human
cuggcuccaggccagg

SEQ ID NO: 1990194 - RNA, 16 nt, Human
cuggcuccagccugga

SEQ ID NO: 1990195 - RNA, 14 nt, Human
cuggcuccagccug

SEQ ID NO: 1990196 - RNA, 15 nt, Human
cuggcuccagccugg

SEQ ID NO: 1990197 - RNA, 15 nt, Human
cuggcucccacaggc

SEQ ID NO: 1990198 - RNA, 13 nt, Human
cuggcuccagcug

SEQ ID NO: 1990199 - RNA, 14 nt, Human
cuggcuccagcugg

SEQ ID NO: 1990200 - RNA, 18 nt, Human
cuggcuccagcuggccgg

SEQ ID NO: 1990201 - RNA, 20 nt, Human
cuggcuccagcuggccggga

SEQ ID NO: 1990202 - RNA, 12 nt, Human
cugggacacagu

SEQ ID NO: 1990203 - RNA, 13 nt, Human
cugggacacaguu

SEQ ID NO: 1990204 - RNA, 13 nt, Human
cuggcaggcaggg

SEQ ID NO: 1990205 - RNA, 11 nt, Human
cuggcaggcag

SEQ ID NO: 1990206 - RNA, 12 nt, Human
cuggcaggcagg

SEQ ID NO: 1990207 - RNA, 15 nt, Human
cuggcagcucagaga

SEQ ID NO: 1990208 - RNA, 21 nt, Human
cuggcaggcaggggcccugca

SEQ ID NO: 1990209 - RNA, 23 nt, Human
cuggcaggcaggggcccugcagc

SEQ ID NO: 1990210 - RNA, 13 nt, Human
cuggccccucagg

SEQ ID NO: 1990211 - RNA, 14 nt, Human
cuggcagcucagag

SEQ ID NO: 1990212 - RNA, 13 nt, Human
cuggcagcucaga

SEQ ID NO: 1990213 - RNA, 17 nt, Human
cuggagacuaaccccac

SEQ ID NO: 1990214 - RNA, 12 nt, Human
cuggcagcucag

SEQ ID NO: 1990215 - RNA, 16 nt, Human
cuggacugugugcuca

SEQ ID NO: 1990216 - RNA, 13 nt, Human
cugcuuaacuuca

SEQ ID NO: 1990217 - RNA, 22 nt, Human
cugcuuuuuaaagaaugcucuu

SEQ ID NO: 1990218 - RNA, 17 nt, Human
cugcuuuuuauggccug

SEQ ID NO: 1990219 - RNA, 14 nt, Human
cugcuucagccucc

SEQ ID NO: 1990220 - RNA, 16 nt, Human
cugcuucagccucccg

SEQ ID NO: 1990221 - RNA, 15 nt, Human
cugcuuaacuucaca

SEQ ID NO: 1990222 - RNA, 17 nt, Human
cugcuuaacuucacaua

SEQ ID NO: 1990223 - RNA, 13 nt, Human
cugcuucagccuc

SEQ ID NO: 1990224 - RNA, 22 nt, Human
cugcuuaaaagaaaauguucac

SEQ ID NO: 1990225 - RNA, 13 nt, Human
cuggacugugugc

SEQ ID NO: 1990226 - RNA, 17 nt, Human
cuggaacucuugacagc

SEQ ID NO: 1990227 - RNA, 17 nt, Human
cuggaacacuaaugagg

SEQ ID NO: 1990228 - RNA, 16 nt, Human
cugcuucagccuccca

SEQ ID NO: 1990229 - RNA, 16 nt, Human
cuggaaauauuaagaa

SEQ ID NO: 1990230 - RNA, 18 nt, Human
cugcuuuuuauggccugu

SEQ ID NO: 1990231 - RNA, 11 nt, Human
cugcugacagu

SEQ ID NO: 1990232 - RNA, 21 nt, Human
cugcugacagacacaggcccg

SEQ ID NO: 1990233 - RNA, 23 nt, Human
cugcugacagacacaggcccggc

SEQ ID NO: 1990234 - RNA, 15 nt, Human
cugcugacagacaca

SEQ ID NO: 1990235 - RNA, 18 nt, Human
cugcugacagacacaggc

SEQ ID NO: 1990236 - RNA, 19 nt, Human
cugcugacagacacaggcc

SEQ ID NO: 1990237 - RNA, 20 nt, Human
cugcugacagacacaggccc

SEQ ID NO: 1990238 - RNA, 14 nt, Human
cugcccugugggcc

SEQ ID NO: 1990239 - RNA, 15 nt, Human
cugccucgaacuggc

SEQ ID NO: 1990240 - RNA, 17 nt, Human
cugccucgaacuggcug

SEQ ID NO: 1990241 - RNA, 18 nt, Human
cugccucgaacuggcugc

SEQ ID NO: 1990242 - RNA, 22 nt, Human
cugccugggaucccucauccuc

SEQ ID NO: 1990243 - RNA, 16 nt, Human
cugccugguccucaca

SEQ ID NO: 1990244 - RNA, 14 nt, Human
cugccuguucagcu

SEQ ID NO: 1990245 - RNA, 15 nt, Human
cugccuguucagcuc

SEQ ID NO: 1990246 - RNA, 23 nt, Human
cugccugggaucccucauccuca

SEQ ID NO: 1990247 - RNA, 12 nt, Human
cugcucagaucc

SEQ ID NO: 1990248 - RNA, 23 nt, Human
cugcucagaucccacuuuugcca

SEQ ID NO: 1990249 - RNA, 21 nt, Human
cugcucagcagugagagcaga

SEQ ID NO: 1990250 - RNA, 23 nt, Human
cugcucagcagugagagcagaug

SEQ ID NO: 1990251 - RNA, 15 nt, Human
cugcuacagagcaga

SEQ ID NO: 1990252 - RNA, 12 nt, Human
cugcucacugca

SEQ ID NO: 1990253 - RNA, 19 nt, Human
cugccuguugggccaggag

SEQ ID NO: 1990254 - RNA, 18 nt, Human
cugccuguugggccagga

SEQ ID NO: 1990255 - RNA, 14 nt, Human
cugccuguugggcc

SEQ ID NO: 1990256 - RNA, 16 nt, Human
cugccuguugggccag

SEQ ID NO: 1990257 - RNA, 15 nt, Human
cugcuaauucuuugc

SEQ ID NO: 1990258 - RNA, 22 nt, Human
cugcuaauucuuugcaaaaauc

SEQ ID NO: 1990259 - RNA, 23 nt, Human
cugcuaauucuuugcaaaaaucc

SEQ ID NO: 1990260 - RNA, 16 nt, Human
cugcuaauuccccaga

SEQ ID NO: 1990261 - RNA, 13 nt, Human
cugcauguuacau

SEQ ID NO: 1990262 - RNA, 15 nt, Human
cugcauguuugugau

SEQ ID NO: 1990263 - RNA, 20 nt, Human
cugcauuuaaaagauacagu

SEQ ID NO: 1990264 - RNA, 22 nt, Human
cugcauuuaaaagauacaguua

SEQ ID NO: 1990265 - RNA, 13 nt, Human
cugcauuugugaa

SEQ ID NO: 1990266 - RNA, 13 nt, Human
cugcauuuaggga

SEQ ID NO: 1990267 - RNA, 22 nt, Human
cugcauuuagggaguauucuaa

SEQ ID NO: 1990268 - RNA, 23 nt, Human
cugcauuuagggaguauucuaau

SEQ ID NO: 1990269 - RNA, 20 nt, Human
cugcauucaggaucaaaccc

SEQ ID NO: 1990270 - RNA, 16 nt, Human
cugcauucuucugauc

SEQ ID NO: 1990271 - RNA, 22 nt, Human
cugcauucuucugaucacugaa

SEQ ID NO: 1990272 - RNA, 17 nt, Human
cugccaaugggagcuca

SEQ ID NO: 1990273 - RNA, 15 nt, Human
cugccaaugggagcu

SEQ ID NO: 1990274 - RNA, 14 nt, Human
cugccaaccucgcu

SEQ ID NO: 1990275 - RNA, 17 nt, Human
cugccaaccucgcucca

SEQ ID NO: 1990276 - RNA, 21 nt, Human
cugccaaccucgcuccaacuc

SEQ ID NO: 1990277 - RNA, 23 nt, Human
cugccaaccucgcuccaacucca

SEQ ID NO: 1990278 - RNA, 19 nt, Human
cugccaacugaucuguuau

SEQ ID NO: 1990279 - RNA, 17 nt, Human
cugcauuugucuggccu

SEQ ID NO: 1990280 - RNA, 14 nt, Human
cugcauuugugaaa

SEQ ID NO: 1990281 - RNA, 15 nt, Human
cugcauuugugaaau

SEQ ID NO: 1990282 - RNA, 17 nt, Human
cugcauuugugaaauga

SEQ ID NO: 1990283 - RNA, 22 nt, Human
cugcauuugugaaaugauggug

SEQ ID NO: 1990284 - RNA, 18 nt, Human
cugcccugugggccccca

SEQ ID NO: 1990285 - RNA, 16 nt, Human
cugcccugugggcccc

SEQ ID NO: 1990286 - RNA, 15 nt, Human
cugcccugugggccc

SEQ ID NO: 1990287 - RNA, 13 nt, Human
cugcccugugagu

SEQ ID NO: 1990288 - RNA, 12 nt, Human
cugcccugugag

SEQ ID NO: 1990289 - RNA, 17 nt, Human
cugcccugucaggaggc

SEQ ID NO: 1990290 - RNA, 20 nt, Human
cugcccugucaggaggcaga

SEQ ID NO: 1990291 - RNA, 20 nt, Human
cugcccuggugcugccacac

SEQ ID NO: 1990292 - RNA, 21 nt, Human
cugcccuggugcugccacacu

SEQ ID NO: 1990293 - RNA, 22 nt, Human
cugcccugguuuccugcccugg

SEQ ID NO: 1990294 - RNA, 23 nt, Human
cugcccugguuuccugcccuggg

SEQ ID NO: 1990295 - RNA, 22 nt, Human
cugccccucaacucuccuccag

SEQ ID NO: 1990296 - RNA, 14 nt, Human
cugccccucaacuc

SEQ ID NO: 1990297 - RNA, 16 nt, Human
cugcccccucugcccu

SEQ ID NO: 1990298 - RNA, 17 nt, Human
cugcccccucugcccug

SEQ ID NO: 1990299 - RNA, 18 nt, Human
cugcccccucugcccugc

SEQ ID NO: 1990300 - RNA, 19 nt, Human
cugcccccucugcccugcg

SEQ ID NO: 1990301 - RNA, 17 nt, Human
cugcccuggugcugcca

SEQ ID NO: 1990302 - RNA, 16 nt, Human
cugcccuggugcugcc

SEQ ID NO: 1990303 - RNA, 18 nt, Human
cugcccuggugcugccac

SEQ ID NO: 1990304 - RNA, 19 nt, Human
cugcccuggugcugccaca

SEQ ID NO: 1990305 - RNA, 14 nt, Human
cugcccccuccuga

SEQ ID NO: 1990306 - RNA, 15 nt, Human
cugcccccuccugag

SEQ ID NO: 1990307 - RNA, 19 nt, Human
cugccccagggcucccggc

SEQ ID NO: 1990308 - RNA, 13 nt, Human
cugcccccuccug

SEQ ID NO: 1990309 - RNA, 14 nt, Human
cugcccccucugcc

SEQ ID NO: 1990310 - RNA, 15 nt, Human
cugcccccucugccc

SEQ ID NO: 1990311 - RNA, 23 nt, Human
cugccaucauguuuacagaggac

SEQ ID NO: 1990312 - RNA, 19 nt, Human
cugccccagcuugggcaga

SEQ ID NO: 1990313 - RNA, 17 nt, Human
cugccaucauguuuaca

SEQ ID NO: 1990314 - RNA, 22 nt, Human
cugccaucauguuuacagagga

SEQ ID NO: 1990315 - RNA, 12 nt, Human
cugccauccagg

SEQ ID NO: 1990316 - RNA, 15 nt, Human
cugccagggacagag

SEQ ID NO: 1990317 - RNA, 12 nt, Human
cugccagggaca

SEQ ID NO: 1990318 - RNA, 11 nt, Human
cugccagggac

SEQ ID NO: 1990319 - RNA, 20 nt, Human
cugccauauucuguuggcca

SEQ ID NO: 1990320 - RNA, 21 nt, Human
cugccauauucuguuggccag

SEQ ID NO: 1990321 - RNA, 22 nt, Human
cugccauauucuguuggccagu

SEQ ID NO: 1990322 - RNA, 23 nt, Human
cugccauauucuguuggccagug

SEQ ID NO: 1990323 - RNA, 20 nt, Human
cugagacucgcgacaaugca

SEQ ID NO: 1990324 - RNA, 19 nt, Human
cugagacucgcgacaaugc

SEQ ID NO: 1990325 - RNA, 17 nt, Human
cugagacucgcgacaau

SEQ ID NO: 1990326 - RNA, 12 nt, Human
aucuguuuacag

SEQ ID NO: 1990327 - RNA, 12 nt, Human
aucuuacuuugu

SEQ ID NO: 1990328 - RNA, 13 nt, Human
aucuuacuuugua

SEQ ID NO: 1990329 - RNA, 14 nt, Human
aucuuacuuuguaa

SEQ ID NO: 1990330 - RNA, 21 nt, Human
aucuuacuuuguaaauucuga

SEQ ID NO: 1990331 - RNA, 22 nt, Human
aucuuacuuuguaaauucugau

SEQ ID NO: 1990332 - RNA, 16 nt, Human
aucuuacuuuguaaau

SEQ ID NO: 1990333 - RNA, 17 nt, Human
aucuuacuuuguaaauu

SEQ ID NO: 1990334 - RNA, 19 nt, Human
aucuuacuuuguaaauucu

SEQ ID NO: 1990335 - RNA, 20 nt, Human
aucuuacuuuguaaauucug

SEQ ID NO: 1990336 - RNA, 23 nt, Human
aucuguuauagguccuuuagaaa

SEQ ID NO: 1990337 - RNA, 11 nt, Human
aucugugaaua

SEQ ID NO: 1990338 - RNA, 12 nt, Human
aucugugaauaa

SEQ ID NO: 1990339 - RNA, 13 nt, Human
aucugugaauaag

SEQ ID NO: 1990340 - RNA, 18 nt, Human
aucuugaauuguaaggaa

SEQ ID NO: 1990341 - RNA, 14 nt, Human
aucuugacagagcc

SEQ ID NO: 1990342 - RNA, 17 nt, Human
aucuugcucugcugaca

SEQ ID NO: 1990343 - RNA, 19 nt, Human
aucuugcucugcugacaga

SEQ ID NO: 1990344 - RNA, 23 nt, Human
aucugugaaaggaaagagggagg

SEQ ID NO: 1990345 - RNA, 16 nt, Human
aucuguaccucugccu

SEQ ID NO: 1990346 - RNA, 17 nt, Human
aucuguaagaguguuua

SEQ ID NO: 1990347 - RNA, 12 nt, Human
aucuguaagcug

SEQ ID NO: 1990348 - RNA, 14 nt, Human
aucuguaagcuguu

SEQ ID NO: 1990349 - RNA, 15 nt, Human
aucuguaagcuguuu

SEQ ID NO: 1990350 - RNA, 17 nt, Human
aucuguaagcuguuugg

SEQ ID NO: 1990351 - RNA, 17 nt, Human
aucuggguucacugcaa

SEQ ID NO: 1990352 - RNA, 19 nt, Human
aucuggguucacugcaacc

SEQ ID NO: 1990353 - RNA, 22 nt, Human
uugccgcgucgcccucccaggc

SEQ ID NO: 1990354 - RNA, 18 nt, Human
uugccgucuaccugaggg

SEQ ID NO: 1990355 - RNA, 15 nt, Human
uugccgucuaccuga

SEQ ID NO: 1990356 - RNA, 19 nt, Human
uugccgucuaccugagggg

SEQ ID NO: 1990357 - RNA, 14 nt, Human
uugccguuauuaaa

SEQ ID NO: 1990358 - RNA, 21 nt, Human
uugccgcgucgcccucccagg

SEQ ID NO: 1990359 - RNA, 18 nt, Human
uugccgcgucgcccuccc

SEQ ID NO: 1990360 - RNA, 22 nt, Human
uugcccuuuacuugucuuucug

SEQ ID NO: 1990361 - RNA, 13 nt, Human
uugccgucuaccu

SEQ ID NO: 1990362 - RNA, 20 nt, Human
aucugagaggccacagugca

SEQ ID NO: 1990363 - RNA, 18 nt, Human
uugccucagcuuccccag

SEQ ID NO: 1990364 - RNA, 19 nt, Human
uugccucagcuuccccagu

SEQ ID NO: 1990365 - RNA, 20 nt, Human
uugccuauaagccaaaauua

SEQ ID NO: 1990366 - RNA, 17 nt, Human
uugccuauauuuuccug

SEQ ID NO: 1990367 - RNA, 18 nt, Human
uugccuauauuuuccuga

SEQ ID NO: 1990368 - RNA, 18 nt, Human
aucugaugcaagcaagaa

SEQ ID NO: 1990369 - RNA, 16 nt, Human
aucugcaaagcauguu

SEQ ID NO: 1990370 - RNA, 21 nt, Human
aucugcaaagcauguuuugca

SEQ ID NO: 1990371 - RNA, 14 nt, Human
aucugauuccagca

SEQ ID NO: 1990372 - RNA, 22 nt, Human
aucugcaaagcauguuuugcau

SEQ ID NO: 1990373 - RNA, 12 nt, Human
uugauguguugu

SEQ ID NO: 1990374 - RNA, 13 nt, Human
uugauguguuguu

SEQ ID NO: 1990375 - RNA, 14 nt, Human
uugauguguuguuc

SEQ ID NO: 1990376 - RNA, 14 nt, Human
uugauucacauguu

SEQ ID NO: 1990377 - RNA, 16 nt, Human
uugauucacauguuuu

SEQ ID NO: 1990378 - RNA, 18 nt, Human
uugauucacauguuuuca

SEQ ID NO: 1990379 - RNA, 19 nt, Human
uugauucacauguuuucaa

SEQ ID NO: 1990380 - RNA, 20 nt, Human
uugauucacauguuuucaaa

SEQ ID NO: 1990381 - RNA, 23 nt, Human
uugauucacauguuuucaaaugg

SEQ ID NO: 1990382 - RNA, 14 nt, Human
uugauucagacagc

SEQ ID NO: 1990383 - RNA, 23 nt, Human
uugauggugaugaaauguaaaua

SEQ ID NO: 1990384 - RNA, 14 nt, Human
uugauguaaagaug

SEQ ID NO: 1990385 - RNA, 23 nt, Human
uugauguaaagauguucuggaua

SEQ ID NO: 1990386 - RNA, 12 nt, Human
uugaugucagca

SEQ ID NO: 1990387 - RNA, 18 nt, Human
uugaugucagcaguugcu

SEQ ID NO: 1990388 - RNA, 15 nt, Human
uugaugggauuuggu

SEQ ID NO: 1990389 - RNA, 21 nt, Human
uugaugggaugauugaagaaa

SEQ ID NO: 1990390 - RNA, 22 nt, Human
uugaugggaugauugaagaaac

SEQ ID NO: 1990391 - RNA, 12 nt, Human
uugaugccuggc

SEQ ID NO: 1990392 - RNA, 19 nt, Human
aucucuucuggguuccuuc

SEQ ID NO: 1990393 - RNA, 23 nt, Human
uugaugcauuaaaagaaaauaaa

SEQ ID NO: 1990394 - RNA, 14 nt, Human
uugcaucugaaaau

SEQ ID NO: 1990395 - RNA, 18 nt, Human
uugcaucuggguagcugu

SEQ ID NO: 1990396 - RNA, 19 nt, Human
uugcaucuggguagcugua

SEQ ID NO: 1990397 - RNA, 20 nt, Human
uugcaucuggguagcuguaa

SEQ ID NO: 1990398 - RNA, 21 nt, Human
uugcaucuggguagcuguaag

SEQ ID NO: 1990399 - RNA, 16 nt, Human
uugauucagacagcug

SEQ ID NO: 1990400 - RNA, 15 nt, Human
uugauucagacagcu

SEQ ID NO: 1990401 - RNA, 15 nt, Human
uugcacaaaaagaua

SEQ ID NO: 1990402 - RNA, 22 nt, Human
uugcacaaaaagauaccuuaaa

SEQ ID NO: 1990403 - RNA, 23 nt, Human
uugcacaaaaagauaccuuaaaa

SEQ ID NO: 1990404 - RNA, 15 nt, Human
uugcacaauuauaaa

SEQ ID NO: 1990405 - RNA, 15 nt, Human
uugcacacaucaucu

SEQ ID NO: 1990406 - RNA, 17 nt, Human
uugcacacaucaucugu

SEQ ID NO: 1990407 - RNA, 20 nt, Human
uugcacacaucaucuguaag

SEQ ID NO: 1990408 - RNA, 18 nt, Human
uugcacacaucaucugua

SEQ ID NO: 1990409 - RNA, 19 nt, Human
uugcacacaucaucuguaa

SEQ ID NO: 1990410 - RNA, 13 nt, Human
aucucccccagcc

SEQ ID NO: 1990411 - RNA, 12 nt, Human
aucucccccagc

SEQ ID NO: 1990412 - RNA, 14 nt, Human
aucucccccagccc

SEQ ID NO: 1990413 - RNA, 13 nt, Human
aucucccacaugc

SEQ ID NO: 1990414 - RNA, 21 nt, Human
aucucccacaugccaggggcc

SEQ ID NO: 1990415 - RNA, 16 nt, Human
aucuccccaucauugg

SEQ ID NO: 1990416 - RNA, 23 nt, Human
aucucagugguuaagauuccuaa

SEQ ID NO: 1990417 - RNA, 13 nt, Human
aucuccaaaauaa

SEQ ID NO: 1990418 - RNA, 15 nt, Human
aucuccacuccagau

SEQ ID NO: 1990419 - RNA, 15 nt, Human
aucucacacaugagc

SEQ ID NO: 1990420 - RNA, 16 nt, Human
aucucacacaugagca

SEQ ID NO: 1990421 - RNA, 19 nt, Human
auccuaguuccaccaucaa

SEQ ID NO: 1990422 - RNA, 15 nt, Human
auccuaguuccacca

SEQ ID NO: 1990423 - RNA, 11 nt, Human
aucucagccca

SEQ ID NO: 1990424 - RNA, 14 nt, Human
aucucagauauuug

SEQ ID NO: 1990425 - RNA, 15 nt, Human
aucucagauauuugc

SEQ ID NO: 1990426 - RNA, 16 nt, Human
aucucagauauuugca

SEQ ID NO: 1990427 - RNA, 17 nt, Human
aucucagauauuugcac

SEQ ID NO: 1990428 - RNA, 14 nt, Human
aucucagggccugg

SEQ ID NO: 1990429 - RNA, 17 nt, Human
aucucagcccugcaacu

SEQ ID NO: 1990430 - RNA, 16 nt, Human
aucuuuagaaaaggca

SEQ ID NO: 1990431 - RNA, 18 nt, Human
aucuuugcagacaggcaa

SEQ ID NO: 1990432 - RNA, 21 nt, Human
aucuuuaauuuuacauuuccu

SEQ ID NO: 1990433 - RNA, 16 nt, Human
aucuuuaauuuuacau

SEQ ID NO: 1990434 - RNA, 22 nt, Human
aucuuuaauuuuacauuuccua

SEQ ID NO: 1990435 - RNA, 13 nt, Human
uuggcugcaggga

SEQ ID NO: 1990436 - RNA, 13 nt, Human
aucuuuuuauuca

SEQ ID NO: 1990437 - RNA, 22 nt, Human
aucuuuuguuacucuugggaca

SEQ ID NO: 1990438 - RNA, 19 nt, Human
aucuuuuuaaccucuguuc

SEQ ID NO: 1990439 - RNA, 12 nt, Human
augaaagauuca

SEQ ID NO: 1990440 - RNA, 19 nt, Human
augaaagcauggcuaauag

SEQ ID NO: 1990441 - RNA, 15 nt, Human
augaaagcagggacu

SEQ ID NO: 1990442 - RNA, 21 nt, Human
aucuuuuuaaccucuguucag

SEQ ID NO: 1990443 - RNA, 12 nt, Human
uuggaugaguuu

SEQ ID NO: 1990444 - RNA, 18 nt, Human
uuggaugaguuuugggaa

SEQ ID NO: 1990445 - RNA, 17 nt, Human
uuggaguuggaguagaa

SEQ ID NO: 1990446 - RNA, 19 nt, Human
uuggaguuugcauucuuau

SEQ ID NO: 1990447 - RNA, 14 nt, Human
uuggaguucauuca

SEQ ID NO: 1990448 - RNA, 16 nt, Human
uuggaguucauucaua

SEQ ID NO: 1990449 - RNA, 12 nt, Human
aucuugcuugaa

SEQ ID NO: 1990450 - RNA, 18 nt, Human
uuggaguucauucauauu

SEQ ID NO: 1990451 - RNA, 19 nt, Human
uuggaguucauucauauua

SEQ ID NO: 1990452 - RNA, 21 nt, Human
uuggaguucauucauauuaca

SEQ ID NO: 1990453 - RNA, 22 nt, Human
uuggaguucauucauauuacaa

SEQ ID NO: 1990454 - RNA, 23 nt, Human
uuggcgcugccccuggcagcccc

SEQ ID NO: 1990455 - RNA, 17 nt, Human
uuggauuauucuuucuc

SEQ ID NO: 1990456 - RNA, 21 nt, Human
uuggauuauucuuucuccuuu

SEQ ID NO: 1990457 - RNA, 18 nt, Human
uuggcuagagguucaaag

SEQ ID NO: 1990458 - RNA, 12 nt, Human
uuggcucugagg

SEQ ID NO: 1990459 - RNA, 15 nt, Human
augaacuuauuaaua

SEQ ID NO: 1990460 - RNA, 16 nt, Human
augaagauacugaaau

SEQ ID NO: 1990461 - RNA, 17 nt, Human
augaagauacugaaaua

SEQ ID NO: 1990462 - RNA, 18 nt, Human
augaagauguagaggaga

SEQ ID NO: 1990463 - RNA, 13 nt, Human
augaaugaauggc

SEQ ID NO: 1990464 - RNA, 22 nt, Human
augaaugacuuccccaauaucu

SEQ ID NO: 1990465 - RNA, 23 nt, Human
augaaugacuuccccaauaucuu

SEQ ID NO: 1990466 - RNA, 20 nt, Human
augaaugucagugugacuga

SEQ ID NO: 1990467 - RNA, 13 nt, Human
aucuuuuucacug

SEQ ID NO: 1990468 - RNA, 15 nt, Human
augaaagggcccaga

SEQ ID NO: 1990469 - RNA, 15 nt, Human
augaagauacugaaa

SEQ ID NO: 1990470 - RNA, 24 nt, Human
augaaccuucuggccucccacaga

SEQ ID NO: 1990471 - RNA, 21 nt, Human
augaaccuucuggccucccac

SEQ ID NO: 1990472 - RNA, 12 nt, Human
augaacugaaag

SEQ ID NO: 1990473 - RNA, 16 nt, Human
uuggggauguuuuucu

SEQ ID NO: 1990474 - RNA, 22 nt, Human
uugggggaggggagacuuugau

SEQ ID NO: 1990475 - RNA, 23 nt, Human
uugggggaggggagacuuugaug

SEQ ID NO: 1990476 - RNA, 15 nt, Human
uugggggcucagcaa

SEQ ID NO: 1990477 - RNA, 22 nt, Human
uuggggggcugaggugggagga

SEQ ID NO: 1990478 - RNA, 13 nt, Human
uugguuccugggg

SEQ ID NO: 1990479 - RNA, 14 nt, Human
uuggggauauuuuu

SEQ ID NO: 1990480 - RNA, 18 nt, Human
uugggccccagaggcugg

SEQ ID NO: 1990481 - RNA, 13 nt, Human
augaauguuccug

SEQ ID NO: 1990482 - RNA, 23 nt, Human
augaauguuccugccuccuugau

SEQ ID NO: 1990483 - RNA, 22 nt, Human
uugguuuagcccaaguggagcc

SEQ ID NO: 1990484 - RNA, 12 nt, Human
uugguuggaagg

SEQ ID NO: 1990485 - RNA, 13 nt, Human
uugguugaauaaa

SEQ ID NO: 1990486 - RNA, 16 nt, Human
uugguugaauaaacua

SEQ ID NO: 1990487 - RNA, 20 nt, Human
uuguaggcgaaucauuuguu

SEQ ID NO: 1990488 - RNA, 19 nt, Human
uuguauauugguuuuauga

SEQ ID NO: 1990489 - RNA, 22 nt, Human
uuguauauugguuuuaugauga

SEQ ID NO: 1990490 - RNA, 19 nt, Human
uuguauaguuauguaaaua

SEQ ID NO: 1990491 - RNA, 20 nt, Human
uuguauaguuauguaaauaa

SEQ ID NO: 1990492 - RNA, 21 nt, Human
uuguauaguuauguaaauaau

SEQ ID NO: 1990493 - RNA, 14 nt, Human
uuguauauucuauu

SEQ ID NO: 1990494 - RNA, 22 nt, Human
uuguauauucuauuuuacaacu

SEQ ID NO: 1990495 - RNA, 13 nt, Human
uuguauauugguu

SEQ ID NO: 1990496 - RNA, 14 nt, Human
uuguauauugguuu

SEQ ID NO: 1990497 - RNA, 16 nt, Human
uuguauauugguuuua

SEQ ID NO: 1990498 - RNA, 14 nt, Human
uuguauaguuaugu

SEQ ID NO: 1990499 - RNA, 16 nt, Human
uuguauaguuauguaa

SEQ ID NO: 1990500 - RNA, 17 nt, Human
uuguauaguuauguaaa

SEQ ID NO: 1990501 - RNA, 18 nt, Human
uuguauaguuauguaaau

SEQ ID NO: 1990502 - RNA, 19 nt, Human
uuguaguguucagaaaaaa

SEQ ID NO: 1990503 - RNA, 14 nt, Human
augacacaugcaag

SEQ ID NO: 1990504 - RNA, 22 nt, Human
augacacaugcaaggucauuuu

SEQ ID NO: 1990505 - RNA, 20 nt, Human
augaauuuuuuuauuucugu

SEQ ID NO: 1990506 - RNA, 18 nt, Human
augacacgaauauugcug

SEQ ID NO: 1990507 - RNA, 23 nt, Human
augaccaaauaucaccaggacug

SEQ ID NO: 1990508 - RNA, 13 nt, Human
augaccaauuuua

SEQ ID NO: 1990509 - RNA, 17 nt, Human
augaccaauuuuaacuu

SEQ ID NO: 1990510 - RNA, 20 nt, Human
augaccaauuuuaacuuaga

SEQ ID NO: 1990511 - RNA, 22 nt, Human
augacuuaagcacacuugacau

SEQ ID NO: 1990512 - RNA, 14 nt, Human
augacuuacuguac

SEQ ID NO: 1990513 - RNA, 14 nt, Human
augacuuuuugaaa

SEQ ID NO: 1990514 - RNA, 18 nt, Human
augacuuuuugaaaguaa

SEQ ID NO: 1990515 - RNA, 18 nt, Human
augacuuuauuauuuauu

SEQ ID NO: 1990516 - RNA, 21 nt, Human
augacuuuauugcaucugggu

SEQ ID NO: 1990517 - RNA, 17 nt, Human
augacuuuauuauuuau

SEQ ID NO: 1990518 - RNA, 13 nt, Human
augacuuuauugc

SEQ ID NO: 1990519 - RNA, 16 nt, Human
augacuuuauugcauc

SEQ ID NO: 1990520 - RNA, 16 nt, Human
augacuuacuguacau

SEQ ID NO: 1990521 - RNA, 17 nt, Human
augacuuacuguacaug

SEQ ID NO: 1990522 - RNA, 22 nt, Human
augacuuccccaauaucuugcu

SEQ ID NO: 1990523 - RNA, 19 nt, Human
augacuuccccaauaucuu

SEQ ID NO: 1990524 - RNA, 18 nt, Human
augagaaaucuaaaaaac

SEQ ID NO: 1990525 - RNA, 15 nt, Human
augagaaaucuaaaa

SEQ ID NO: 1990526 - RNA, 21 nt, Human
augagaaagguugaagcacca

SEQ ID NO: 1990527 - RNA, 22 nt, Human
augagaaagguugaagcaccaa

SEQ ID NO: 1990528 - RNA, 23 nt, Human
augagaaaucuaaaaaacgaaaa

SEQ ID NO: 1990529 - RNA, 17 nt, Human
augagaacagauaaaga

SEQ ID NO: 1990530 - RNA, 18 nt, Human
augagaacagauaaagau

SEQ ID NO: 1990531 - RNA, 19 nt, Human
augagaacagauaaagauu

SEQ ID NO: 1990532 - RNA, 11 nt, Human
augagaauguu

SEQ ID NO: 1990533 - RNA, 22 nt, Human
augagacuauguaaaaauaacc

SEQ ID NO: 1990534 - RNA, 15 nt, Human
augagacucuagggu

SEQ ID NO: 1990535 - RNA, 22 nt, Human
augagaacagauaaagauugug

SEQ ID NO: 1990536 - RNA, 13 nt, Human
augcuucauacag

SEQ ID NO: 1990537 - RNA, 15 nt, Human
augcuucauacaggg

SEQ ID NO: 1990538 - RNA, 16 nt, Human
augcuucauacaggga

SEQ ID NO: 1990539 - RNA, 19 nt, Human
augcuucauacagggaugg

SEQ ID NO: 1990540 - RNA, 11 nt, Human
augcuucauac

SEQ ID NO: 1990541 - RNA, 12 nt, Human
augcuucauaca

SEQ ID NO: 1990542 - RNA, 10 nt, Human
augcuucaua

SEQ ID NO: 1990543 - RNA, 23 nt, Human
augcugucccuuacgugaguccu

SEQ ID NO: 1990544 - RNA, 19 nt, Human
augcugucccuuacgugag

SEQ ID NO: 1990545 - RNA, 15 nt, Human
auggaacacucugag

SEQ ID NO: 1990546 - RNA, 14 nt, Human
auggaacacucuga

SEQ ID NO: 1990547 - RNA, 23 nt, Human
augcuucauacagggaugguguu

SEQ ID NO: 1990548 - RNA, 11 nt, Human
auggaacacuc

SEQ ID NO: 1990549 - RNA, 16 nt, Human
auggaacacucugaga

SEQ ID NO: 1990550 - RNA, 16 nt, Human
augcuguaaaagcaag

SEQ ID NO: 1990551 - RNA, 15 nt, Human
auggaagacagcucu

SEQ ID NO: 1990552 - RNA, 20 nt, Human
augcuggccgaagauuucau

SEQ ID NO: 1990553 - RNA, 22 nt, Human
augcuguaacuuucugaaauaa

SEQ ID NO: 1990554 - RNA, 15 nt, Human
augcucugcauguua

SEQ ID NO: 1990555 - RNA, 15 nt, Human
augcuagaacucccu

SEQ ID NO: 1990556 - RNA, 16 nt, Human
augcuagaacucccuu

SEQ ID NO: 1990557 - RNA, 19 nt, Human
augcuagaacucccuuuca

SEQ ID NO: 1990558 - RNA, 22 nt, Human
uuuagauuuuguguuuauucuu

SEQ ID NO: 1990559 - RNA, 23 nt, Human
uuuagcaaagcggguuauaauga

SEQ ID NO: 1990560 - RNA, 17 nt, Human
uuuagauguaauuuugu

SEQ ID NO: 1990561 - RNA, 22 nt, Human
uuuagaugaaugucaguuguua

SEQ ID NO: 1990562 - RNA, 19 nt, Human
uuuagaugugcugcuuuga

SEQ ID NO: 1990563 - RNA, 18 nt, Human
uuuagaugaaugucaguu

SEQ ID NO: 1990564 - RNA, 16 nt, Human
uuuagcuguguuauua

SEQ ID NO: 1990565 - RNA, 17 nt, Human
uuuagcuguguuauuau

SEQ ID NO: 1990566 - RNA, 15 nt, Human
uuuaguagagacagg

SEQ ID NO: 1990567 - RNA, 15 nt, Human
uuuaggacaugaaaa

SEQ ID NO: 1990568 - RNA, 17 nt, Human
uuuaggacaugaaaaua

SEQ ID NO: 1990569 - RNA, 16 nt, Human
uuuaguaucuuuuuau

SEQ ID NO: 1990570 - RNA, 12 nt, Human
uuuaugugaugg

SEQ ID NO: 1990571 - RNA, 11 nt, Human
uuuaugugugu

SEQ ID NO: 1990572 - RNA, 13 nt, Human
uuuaugugugugu

SEQ ID NO: 1990573 - RNA, 16 nt, Human
uuuaugugugauucaa

SEQ ID NO: 1990574 - RNA, 11 nt, Human
uuuauguugac

SEQ ID NO: 1990575 - RNA, 13 nt, Human
uuuauguugacau

SEQ ID NO: 1990576 - RNA, 14 nt, Human
uuuauguugacauu

SEQ ID NO: 1990577 - RNA, 15 nt, Human
uuuauguugacauuu

SEQ ID NO: 1990578 - RNA, 17 nt, Human
uuuauguugacauuugu

SEQ ID NO: 1990579 - RNA, 18 nt, Human
uuuauguugacauuuguu

SEQ ID NO: 1990580 - RNA, 22 nt, Human
uuuauguugacauuuguuuggu

SEQ ID NO: 1990581 - RNA, 13 nt, Human
uuuauguuuuggu

SEQ ID NO: 1990582 - RNA, 14 nt, Human
uuuauguuuugguc

SEQ ID NO: 1990583 - RNA, 20 nt, Human
uuuauguuuugguccacuuu

SEQ ID NO: 1990584 - RNA, 24 nt, Human
uuuauggcuuuugugcauuaucua

SEQ ID NO: 1990585 - RNA, 18 nt, Human
uuuauaguuaaucuauaa

SEQ ID NO: 1990586 - RNA, 22 nt, Human
uuuauauaaugguaugcuugca

SEQ ID NO: 1990587 - RNA, 18 nt, Human
uuuaugguaaucauauua

SEQ ID NO: 1990588 - RNA, 20 nt, Human
uuuauggcuuuugugcauua

SEQ ID NO: 1990589 - RNA, 14 nt, Human
uuuauagcuuuauu

SEQ ID NO: 1990590 - RNA, 14 nt, Human
uuuauaguuaaucu

SEQ ID NO: 1990591 - RNA, 16 nt, Human
uuuauaguuaaucuau

SEQ ID NO: 1990592 - RNA, 17 nt, Human
uuuauaguuaaucuaua

SEQ ID NO: 1990593 - RNA, 22 nt, Human
uuucauguccugugucaguuua

SEQ ID NO: 1990594 - RNA, 17 nt, Human
uuucauguccuguguca

SEQ ID NO: 1990595 - RNA, 21 nt, Human
uuucauguccugugucaguuu

SEQ ID NO: 1990596 - RNA, 12 nt, Human
uuucaugugcuc

SEQ ID NO: 1990597 - RNA, 14 nt, Human
uuuccccagggcac

SEQ ID NO: 1990598 - RNA, 14 nt, Human
uuucccauuuagaa

SEQ ID NO: 1990599 - RNA, 18 nt, Human
auggacagcauugccagu

SEQ ID NO: 1990600 - RNA, 14 nt, Human
auggacaugaucuu

SEQ ID NO: 1990601 - RNA, 22 nt, Human
uuucagaaguuuaaauauuaag

SEQ ID NO: 1990602 - RNA, 21 nt, Human
uuucagaaguuuaaauauuaa

SEQ ID NO: 1990603 - RNA, 23 nt, Human
uuucacugacuuuuuuugugggg

SEQ ID NO: 1990604 - RNA, 17 nt, Human
uuucaucagaacagcug

SEQ ID NO: 1990605 - RNA, 24 nt, Human
uuucaucagaacagcuguugacuc

SEQ ID NO: 1990606 - RNA, 16 nt, Human
uuucaucauauuauac

SEQ ID NO: 1990607 - RNA, 17 nt, Human
uuucaucauauuauaca

SEQ ID NO: 1990608 - RNA, 17 nt, Human
uuucauauuuuaaacag

SEQ ID NO: 1990609 - RNA, 17 nt, Human
uuucauauuuuucaaaa

SEQ ID NO: 1990610 - RNA, 18 nt, Human
uuucauauuuuucaaaau

SEQ ID NO: 1990611 - RNA, 18 nt, Human
uuucauauuuuaauuuca

SEQ ID NO: 1990612 - RNA, 22 nt, Human
uuucauauuuuaauuucaagcu

SEQ ID NO: 1990613 - RNA, 21 nt, Human
auggaaugaugggucaguugu

SEQ ID NO: 1990614 - RNA, 17 nt, Human
auggaauacucuuauau

SEQ ID NO: 1990615 - RNA, 16 nt, Human
auggaauacucuuaua

SEQ ID NO: 1990616 - RNA, 16 nt, Human
auggaagacagcucuu

SEQ ID NO: 1990617 - RNA, 13 nt, Human
uuucagaaaugug

SEQ ID NO: 1990618 - RNA, 20 nt, Human
uuucacugcuggcugccuua

SEQ ID NO: 1990619 - RNA, 22 nt, Human
uuucacugcuggcugccuuaga

SEQ ID NO: 1990620 - RNA, 14 nt, Human
uuucacugcuggcu

SEQ ID NO: 1990621 - RNA, 17 nt, Human
uuucacugcuggcugcc

SEQ ID NO: 1990622 - RNA, 18 nt, Human
uuucacugcuggcugccu

SEQ ID NO: 1990623 - RNA, 17 nt, Human
auggcaacaaacugcac

SEQ ID NO: 1990624 - RNA, 19 nt, Human
auggcaacaaacugcacau

SEQ ID NO: 1990625 - RNA, 20 nt, Human
auggcaacaaacugcacaug

SEQ ID NO: 1990626 - RNA, 22 nt, Human
auggcaacaaacugcacaugau

SEQ ID NO: 1990627 - RNA, 14 nt, Human
auggcaacaaacug

SEQ ID NO: 1990628 - RNA, 23 nt, Human
auggacguguuaugacuccagaa

SEQ ID NO: 1990629 - RNA, 18 nt, Human
auggauuuccagccaaag

SEQ ID NO: 1990630 - RNA, 20 nt, Human
auggacguguuaugacucca

SEQ ID NO: 1990631 - RNA, 19 nt, Human
auggacguguuaugacucc

SEQ ID NO: 1990632 - RNA, 15 nt, Human
auggcacagggcaug

SEQ ID NO: 1990633 - RNA, 22 nt, Human
auggcacaaucucggcucacug

SEQ ID NO: 1990634 - RNA, 16 nt, Human
auggcaauguuuugcu

SEQ ID NO: 1990635 - RNA, 23 nt, Human
auggcaaguuuuccauauuuuua

SEQ ID NO: 1990636 - RNA, 20 nt, Human
auggcaauguuuugcuuuug

SEQ ID NO: 1990637 - RNA, 19 nt, Human
auggcaaggacugcaggga

SEQ ID NO: 1990638 - RNA, 17 nt, Human
auggcacaucagcacga

SEQ ID NO: 1990639 - RNA, 23 nt, Human
auggcacaucagcacgauuucug

SEQ ID NO: 1990640 - RNA, 21 nt, Human
auggcacagggcaugaaauga

SEQ ID NO: 1990641 - RNA, 19 nt, Human
auggcacagggcaugaaau

SEQ ID NO: 1990642 - RNA, 20 nt, Human
auggcacagggcaugaaaug

SEQ ID NO: 1990643 - RNA, 21 nt, Human
auggccgggcgcgguggcuca

SEQ ID NO: 1990644 - RNA, 22 nt, Human
auggccagguggccacuccaga

SEQ ID NO: 1990645 - RNA, 22 nt, Human
auggccaggaaguagcacaggc

SEQ ID NO: 1990646 - RNA, 23 nt, Human
auggccaggaaguagcacaggcu

SEQ ID NO: 1990647 - RNA, 16 nt, Human
auggccagguggccac

SEQ ID NO: 1990648 - RNA, 21 nt, Human
auggccaggaaguagcacagg

SEQ ID NO: 1990649 - RNA, 16 nt, Human
auggccugggggaugu

SEQ ID NO: 1990650 - RNA, 20 nt, Human
auggccuuugcuugaaagaa

SEQ ID NO: 1990651 - RNA, 20 nt, Human
auggcuaguaucaaaagaaa

SEQ ID NO: 1990652 - RNA, 17 nt, Human
auggcuacuugcuuuga

SEQ ID NO: 1990653 - RNA, 15 nt, Human
augccacuaaauuga

SEQ ID NO: 1990654 - RNA, 17 nt, Human
augccacuaaauugaca

SEQ ID NO: 1990655 - RNA, 16 nt, Human
augccaagcacuucag

SEQ ID NO: 1990656 - RNA, 23 nt, Human
augccaagaaguuuaaggaauau

SEQ ID NO: 1990657 - RNA, 14 nt, Human
uuuaauuuuuaaau

SEQ ID NO: 1990658 - RNA, 17 nt, Human
uuuaauuuuuaaaugca

SEQ ID NO: 1990659 - RNA, 13 nt, Human
augcagccucaca

SEQ ID NO: 1990660 - RNA, 15 nt, Human
augcagccucacagu

SEQ ID NO: 1990661 - RNA, 14 nt, Human
augcagccucacag

SEQ ID NO: 1990662 - RNA, 17 nt, Human
augcagccucacagucc

SEQ ID NO: 1990663 - RNA, 22 nt, Human
augcagguuagaaauaauguca

SEQ ID NO: 1990664 - RNA, 13 nt, Human
augcagucuuaga

SEQ ID NO: 1990665 - RNA, 21 nt, Human
augcagucuuagaucauaguu

SEQ ID NO: 1990666 - RNA, 22 nt, Human
augcagucuuagaucauaguuu

SEQ ID NO: 1990667 - RNA, 17 nt, Human
uuuaagugcugcauuua

SEQ ID NO: 1990668 - RNA, 19 nt, Human
uuuaagugcugcauuuaaa

SEQ ID NO: 1990669 - RNA, 16 nt, Human
uuuaaugauuguuuaa

SEQ ID NO: 1990670 - RNA, 15 nt, Human
uuuaagugcugcauu

SEQ ID NO: 1990671 - RNA, 16 nt, Human
uuuaagugcugcauuu

SEQ ID NO: 1990672 - RNA, 16 nt, Human
uuuaagccuaaagauu

SEQ ID NO: 1990673 - RNA, 21 nt, Human
uuuaagccuaaagauuuugau

SEQ ID NO: 1990674 - RNA, 23 nt, Human
uuuaagcuaggaaaagaaaucua

SEQ ID NO: 1990675 - RNA, 20 nt, Human
uuuaagcuaggaaaagaaau

SEQ ID NO: 1990676 - RNA, 22 nt, Human
uuuaagcuaggaaaagaaaucu

SEQ ID NO: 1990677 - RNA, 12 nt, Human
uuuaagccuuug

SEQ ID NO: 1990678 - RNA, 18 nt, Human
uuuaagccuuuguugaac

SEQ ID NO: 1990679 - RNA, 21 nt, Human
uuuaagccuuuguugaacugu

SEQ ID NO: 1990680 - RNA, 23 nt, Human
uuuaagccuuuguugaacuguua

SEQ ID NO: 1990681 - RNA, 19 nt, Human
uuuaaugcuaaucuuguga

SEQ ID NO: 1990682 - RNA, 12 nt, Human
uuuaauuuuaca

SEQ ID NO: 1990683 - RNA, 13 nt, Human
uuuaauuguauuu

SEQ ID NO: 1990684 - RNA, 14 nt, Human
uuuaauuguauuuu

SEQ ID NO: 1990685 - RNA, 17 nt, Human
uuuaauuguauuuuugu

SEQ ID NO: 1990686 - RNA, 20 nt, Human
uuuaauugaaagaauguaaa

SEQ ID NO: 1990687 - RNA, 21 nt, Human
uuuaauugaaagaauguaaag

SEQ ID NO: 1990688 - RNA, 17 nt, Human
uuuaauuccaugaaugu

SEQ ID NO: 1990689 - RNA, 17 nt, Human
uuuaauugaaagaaugu

SEQ ID NO: 1990690 - RNA, 14 nt, Human
uuuaaauguuuuuu

SEQ ID NO: 1990691 - RNA, 13 nt, Human
uuuaaaugucaaa

SEQ ID NO: 1990692 - RNA, 15 nt, Human
uuguuuuacugucuu

SEQ ID NO: 1990693 - RNA, 16 nt, Human
uuguuuucaguguaca

SEQ ID NO: 1990694 - RNA, 13 nt, Human
uuguuuucagugu

SEQ ID NO: 1990695 - RNA, 15 nt, Human
augcacuuuguucug

SEQ ID NO: 1990696 - RNA, 14 nt, Human
uuuaagcagaauug

SEQ ID NO: 1990697 - RNA, 15 nt, Human
uuuaagcagaauugg

SEQ ID NO: 1990698 - RNA, 17 nt, Human
uuuaagcagaauuggaa

SEQ ID NO: 1990699 - RNA, 18 nt, Human
uuuaagcagaauuggaaa

SEQ ID NO: 1990700 - RNA, 19 nt, Human
uuuaagcagaauuggaaaa

SEQ ID NO: 1990701 - RNA, 19 nt, Human
uuuaaauuauguuuuacug

SEQ ID NO: 1990702 - RNA, 23 nt, Human
uuuaaauugcucacaguuauuac

SEQ ID NO: 1990703 - RNA, 15 nt, Human
uuguugucugcaacu

SEQ ID NO: 1990704 - RNA, 19 nt, Human
augauuaaccacuucagcu

SEQ ID NO: 1990705 - RNA, 21 nt, Human
augauuaaccacuucagcuga

SEQ ID NO: 1990706 - RNA, 20 nt, Human
augauuaaccacuucagcug

SEQ ID NO: 1990707 - RNA, 15 nt, Human
augauuccagguggc

SEQ ID NO: 1990708 - RNA, 16 nt, Human
augauuccagguggca

SEQ ID NO: 1990709 - RNA, 15 nt, Human
augauuucacaaaua

SEQ ID NO: 1990710 - RNA, 16 nt, Human
augauuucacaaauau

SEQ ID NO: 1990711 - RNA, 17 nt, Human
augauuucacaaauauu

SEQ ID NO: 1990712 - RNA, 18 nt, Human
augauuucacaaauauua

SEQ ID NO: 1990713 - RNA, 22 nt, Human
augauuucacaaauauuaaaaa

SEQ ID NO: 1990714 - RNA, 13 nt, Human
augauuucacagu

SEQ ID NO: 1990715 - RNA, 17 nt, Human
augauuucagcucacug

SEQ ID NO: 1990716 - RNA, 23 nt, Human
augauuucacaaauauuaaaaag

SEQ ID NO: 1990717 - RNA, 13 nt, Human
augauuucagaaa

SEQ ID NO: 1990718 - RNA, 14 nt, Human
augauuucagaaac

SEQ ID NO: 1990719 - RNA, 21 nt, Human
augauucaaaugucuauaaac

SEQ ID NO: 1990720 - RNA, 13 nt, Human
augauucaaaaag

SEQ ID NO: 1990721 - RNA, 21 nt, Human
augauucaacagguuuuccug

SEQ ID NO: 1990722 - RNA, 19 nt, Human
augauuucagcucacugca

SEQ ID NO: 1990723 - RNA, 15 nt, Human
augauuucagaaaca

SEQ ID NO: 1990724 - RNA, 16 nt, Human
augauuucagaaacaa

SEQ ID NO: 1990725 - RNA, 20 nt, Human
augauuuggggauucagauu

SEQ ID NO: 1990726 - RNA, 12 nt, Human
augcacuuuguu

SEQ ID NO: 1990727 - RNA, 14 nt, Human
augcaccagcccuu

SEQ ID NO: 1990728 - RNA, 13 nt, Human
augcaccagcccu

SEQ ID NO: 1990729 - RNA, 19 nt, Human
uuguucuggcucuuccagg

SEQ ID NO: 1990730 - RNA, 17 nt, Human
uuguguguuuauuguca

SEQ ID NO: 1990731 - RNA, 22 nt, Human
uuguguguucacuaaacucuga

SEQ ID NO: 1990732 - RNA, 22 nt, Human
uuguucuggcucuuccaggcug

SEQ ID NO: 1990733 - RNA, 20 nt, Human
uuguucuggcucuuccaggc

SEQ ID NO: 1990734 - RNA, 13 nt, Human
uugugguuaaucu

SEQ ID NO: 1990735 - RNA, 14 nt, Human
uuguguaagaaaua

SEQ ID NO: 1990736 - RNA, 18 nt, Human
uuguguaagaaauacaga

SEQ ID NO: 1990737 - RNA, 13 nt, Human
uugugugaacuug

SEQ ID NO: 1990738 - RNA, 16 nt, Human
uugugugaacuuggaa

SEQ ID NO: 1990739 - RNA, 17 nt, Human
uugugugauauuucaga

SEQ ID NO: 1990740 - RNA, 18 nt, Human
uugugugauauuucagaa

SEQ ID NO: 1990741 - RNA, 19 nt, Human
uugugugauauuucagaaa

SEQ ID NO: 1990742 - RNA, 20 nt, Human
uugugugauauuucagaaau

SEQ ID NO: 1990743 - RNA, 21 nt, Human
uugugugauauuucagaaaua

SEQ ID NO: 1990744 - RNA, 21 nt, Human
uugugugcuaaacguguaugu

SEQ ID NO: 1990745 - RNA, 23 nt, Human
uugugugccucuagcugaauuga

SEQ ID NO: 1990746 - RNA, 21 nt, Human
uugugugcggagucauuuugu

SEQ ID NO: 1990747 - RNA, 17 nt, Human
uugugugccucuagcug

SEQ ID NO: 1990748 - RNA, 20 nt, Human
uugugugccucuagcugaau

SEQ ID NO: 1990749 - RNA, 21 nt, Human
uugugaggaagccgcuggggc

SEQ ID NO: 1990750 - RNA, 17 nt, Human
uugugacuuuugcuuua

SEQ ID NO: 1990751 - RNA, 17 nt, Human
augagacucuagggucc

SEQ ID NO: 1990752 - RNA, 18 nt, Human
augagacucuagggucca

SEQ ID NO: 1990753 - RNA, 18 nt, Human
uuguggcuccacacacac

SEQ ID NO: 1990754 - RNA, 18 nt, Human
uugugauacaaugcugug

SEQ ID NO: 1990755 - RNA, 14 nt, Human
uugugaguuuguuu

SEQ ID NO: 1990756 - RNA, 18 nt, Human
uugugacuuuugcuuuaa

SEQ ID NO: 1990757 - RNA, 19 nt, Human
uugugauacaaugcugugc

SEQ ID NO: 1990758 - RNA, 16 nt, Human
uugugaguuuguuucu

SEQ ID NO: 1990759 - RNA, 19 nt, Human
uugugaguuuguuucuuug

SEQ ID NO: 1990760 - RNA, 21 nt, Human
uugugaguuuguuucuuugaa

SEQ ID NO: 1990761 - RNA, 22 nt, Human
uugugaguuuguuucuuugaau

SEQ ID NO: 1990762 - RNA, 17 nt, Human
uuccugucacccugagg

SEQ ID NO: 1990763 - RNA, 13 nt, Human
uuccucuccacug

SEQ ID NO: 1990764 - RNA, 14 nt, Human
uuccucuccacugc

SEQ ID NO: 1990765 - RNA, 15 nt, Human
uuccucuccacugcc

SEQ ID NO: 1990766 - RNA, 12 nt, Human
uuccucuccacu

SEQ ID NO: 1990767 - RNA, 20 nt, Human
uuccuacucuucucucugcu

SEQ ID NO: 1990768 - RNA, 21 nt, Human
uuccuacucuucucucugcuc

SEQ ID NO: 1990769 - RNA, 22 nt, Human
uuccuacucuucucucugcucu

SEQ ID NO: 1990770 - RNA, 11 nt, Human
auauuuuccug

SEQ ID NO: 1990771 - RNA, 19 nt, Human
auauuuuccugauagcaua

SEQ ID NO: 1990772 - RNA, 20 nt, Human
uuccuucaaagcaaaugucu

SEQ ID NO: 1990773 - RNA, 15 nt, Human
uuccuucagauauuu

SEQ ID NO: 1990774 - RNA, 22 nt, Human
auauuuuguaugcaagcaguuu

SEQ ID NO: 1990775 - RNA, 13 nt, Human
aucaaauguaaag

SEQ ID NO: 1990776 - RNA, 14 nt, Human
aucaaauguaaagu

SEQ ID NO: 1990777 - RNA, 14 nt, Human
aucaaguuauuuuu

SEQ ID NO: 1990778 - RNA, 22 nt, Human
aucaaguuggcuucuaaucaaa

SEQ ID NO: 1990779 - RNA, 23 nt, Human
aucaaguuggcuucuaaucaaag

SEQ ID NO: 1990780 - RNA, 19 nt, Human
aucaaccccuucgcuccug

SEQ ID NO: 1990781 - RNA, 20 nt, Human
aucaaccccuucgcuccugu

SEQ ID NO: 1990782 - RNA, 22 nt, Human
aucaaccccuucgcuccugugu

SEQ ID NO: 1990783 - RNA, 15 nt, Human
auauuuuacauaaau

SEQ ID NO: 1990784 - RNA, 16 nt, Human
auauuuuaauuucaag

SEQ ID NO: 1990785 - RNA, 17 nt, Human
auauuuuaauuucaagc

SEQ ID NO: 1990786 - RNA, 13 nt, Human
auauuuuaauuuu

SEQ ID NO: 1990787 - RNA, 15 nt, Human
auauuuuaauuuuua

SEQ ID NO: 1990788 - RNA, 16 nt, Human
auauuuuacauaaauu

SEQ ID NO: 1990789 - RNA, 20 nt, Human
auauuuuacauaaauuuagu

SEQ ID NO: 1990790 - RNA, 14 nt, Human
auauuuuaauuuca

SEQ ID NO: 1990791 - RNA, 15 nt, Human
auauuuuaauuucaa

SEQ ID NO: 1990792 - RNA, 23 nt, Human
uucccacugguccaucugguuuu

SEQ ID NO: 1990793 - RNA, 20 nt, Human
uucccacucugucgagccug

SEQ ID NO: 1990794 - RNA, 14 nt, Human
uucccacucuucuc

SEQ ID NO: 1990795 - RNA, 20 nt, Human
uuccccuaaucuuuucugaa

SEQ ID NO: 1990796 - RNA, 14 nt, Human
uucccccuuucuuc

SEQ ID NO: 1990797 - RNA, 15 nt, Human
uucccccuuucuucc

SEQ ID NO: 1990798 - RNA, 16 nt, Human
uucccccuuucuuccu

SEQ ID NO: 1990799 - RNA, 22 nt, Human
uucccccuguuucagaggcuca

SEQ ID NO: 1990800 - RNA, 14 nt, Human
uucccccuccccca

SEQ ID NO: 1990801 - RNA, 20 nt, Human
uucccuuuuuuggcugcuga

SEQ ID NO: 1990802 - RNA, 19 nt, Human
uucccuuuuuuggcugcug

SEQ ID NO: 1990803 - RNA, 18 nt, Human
uucccuuuuuuggcugcu

SEQ ID NO: 1990804 - RNA, 12 nt, Human
uuccuacucuuc

SEQ ID NO: 1990805 - RNA, 15 nt, Human
uuccuacucuucucu

SEQ ID NO: 1990806 - RNA, 17 nt, Human
uuccuacucuucucucu

SEQ ID NO: 1990807 - RNA, 18 nt, Human
uuccuacucuucucucug

SEQ ID NO: 1990808 - RNA, 19 nt, Human
uuccuacucuucucucugc

SEQ ID NO: 1990809 - RNA, 17 nt, Human
uuccuacacaggacagg

SEQ ID NO: 1990810 - RNA, 21 nt, Human
uuccuaccacccgguccccac

SEQ ID NO: 1990811 - RNA, 17 nt, Human
uuccccuguucacucua

SEQ ID NO: 1990812 - RNA, 14 nt, Human
uuccccuguucacu

SEQ ID NO: 1990813 - RNA, 22 nt, Human
uuccccuuccuaauuccacagc

SEQ ID NO: 1990814 - RNA, 13 nt, Human
uuccccuuccuuc

SEQ ID NO: 1990815 - RNA, 14 nt, Human
uuccccuuccuucu

SEQ ID NO: 1990816 - RNA, 17 nt, Human
uucccuacuuccuguga

SEQ ID NO: 1990817 - RNA, 14 nt, Human
uucccuacuuccug

SEQ ID NO: 1990818 - RNA, 16 nt, Human
uucccuacuuccugug

SEQ ID NO: 1990819 - RNA, 15 nt, Human
uuccccuuccuucuu

SEQ ID NO: 1990820 - RNA, 13 nt, Human
uucccuacuuccu

SEQ ID NO: 1990821 - RNA, 13 nt, Human
uucuaaaguaaaa

SEQ ID NO: 1990822 - RNA, 13 nt, Human
uucuaaaguacug

SEQ ID NO: 1990823 - RNA, 17 nt, Human
uucuaaaguacugagca

SEQ ID NO: 1990824 - RNA, 15 nt, Human
uucuaaaguaaaaac

SEQ ID NO: 1990825 - RNA, 13 nt, Human
uucgcuccugugu

SEQ ID NO: 1990826 - RNA, 19 nt, Human
uucuaaaucuccaaaauaa

SEQ ID NO: 1990827 - RNA, 22 nt, Human
uucuaaauaucccuuggacauu

SEQ ID NO: 1990828 - RNA, 14 nt, Human
uucuaacuucauaa

SEQ ID NO: 1990829 - RNA, 22 nt, Human
aucaauaacagccgcuccagag

SEQ ID NO: 1990830 - RNA, 18 nt, Human
aucaauaacagccgcucc

SEQ ID NO: 1990831 - RNA, 14 nt, Human
uucgaccagccagg

SEQ ID NO: 1990832 - RNA, 17 nt, Human
uucgacuugcauuuuug

SEQ ID NO: 1990833 - RNA, 21 nt, Human
uucgcaggauucuuccucccu

SEQ ID NO: 1990834 - RNA, 20 nt, Human
uucgauacaccgggccugga

SEQ ID NO: 1990835 - RNA, 21 nt, Human
uucucacugccaugccagcuu

SEQ ID NO: 1990836 - RNA, 13 nt, Human
uucuauaauuuaa

SEQ ID NO: 1990837 - RNA, 14 nt, Human
uucuauaauuuaaa

SEQ ID NO: 1990838 - RNA, 20 nt, Human
uucuaguaauaaagacucua

SEQ ID NO: 1990839 - RNA, 17 nt, Human
uucuaguuauuuauucu

SEQ ID NO: 1990840 - RNA, 18 nt, Human
uucuagugcagcugaaau

SEQ ID NO: 1990841 - RNA, 13 nt, Human
uucucagaaucuc

SEQ ID NO: 1990842 - RNA, 13 nt, Human
uucucagcuccca

SEQ ID NO: 1990843 - RNA, 14 nt, Human
aucaggccaggccc

SEQ ID NO: 1990844 - RNA, 19 nt, Human
aucaggauuuccucuugaa

SEQ ID NO: 1990845 - RNA, 13 nt, Human
aucaggccaggcc

SEQ ID NO: 1990846 - RNA, 19 nt, Human
aucagacuaugaaguuuuu

SEQ ID NO: 1990847 - RNA, 13 nt, Human
uucuuuuaauuuu

SEQ ID NO: 1990848 - RNA, 19 nt, Human
uucuuuuguuuuuugaagu

SEQ ID NO: 1990849 - RNA, 22 nt, Human
uucuuuuguuuuuugaaguguu

SEQ ID NO: 1990850 - RNA, 16 nt, Human
uugaaaguuuacagga

SEQ ID NO: 1990851 - RNA, 13 nt, Human
uucuuuuucugga

SEQ ID NO: 1990852 - RNA, 14 nt, Human
uucuuuuucuggac

SEQ ID NO: 1990853 - RNA, 16 nt, Human
uucuuuuucuggacuc

SEQ ID NO: 1990854 - RNA, 14 nt, Human
uucuuuuugaaaug

SEQ ID NO: 1990855 - RNA, 15 nt, Human
uucuuuuugaaaugu

SEQ ID NO: 1990856 - RNA, 16 nt, Human
uugaaauaaaaagagu

SEQ ID NO: 1990857 - RNA, 17 nt, Human
uugaaauaaaaagagua

SEQ ID NO: 1990858 - RNA, 20 nt, Human
uugaaauauaggaacuuaaa

SEQ ID NO: 1990859 - RNA, 11 nt, Human
uugaaaucuuu

SEQ ID NO: 1990860 - RNA, 21 nt, Human
uugaaauauggucuuuugguu

SEQ ID NO: 1990861 - RNA, 21 nt, Human
uugaaaucaguaaacacugug

SEQ ID NO: 1990862 - RNA, 23 nt, Human
uugaaaucaguaaacacugugua

SEQ ID NO: 1990863 - RNA, 23 nt, Human
uugaaauauauggucuaauguuu

SEQ ID NO: 1990864 - RNA, 20 nt, Human
uugaaauauauggucuaaug

SEQ ID NO: 1990865 - RNA, 22 nt, Human
uugaaauauauggucuaauguu

SEQ ID NO: 1990866 - RNA, 12 nt, Human
uugaacaaaaua

SEQ ID NO: 1990867 - RNA, 14 nt, Human
uugaacaaaauaaa

SEQ ID NO: 1990868 - RNA, 16 nt, Human
uugaacaaaauaaauu

SEQ ID NO: 1990869 - RNA, 21 nt, Human
uugaaauuuuuauuaaauuau

SEQ ID NO: 1990870 - RNA, 14 nt, Human
uugaaaugauuuca

SEQ ID NO: 1990871 - RNA, 15 nt, Human
uugaacauguggcuu

SEQ ID NO: 1990872 - RNA, 18 nt, Human
uugaacccgggaggcaga

SEQ ID NO: 1990873 - RNA, 14 nt, Human
uugaaccauaaaau

SEQ ID NO: 1990874 - RNA, 16 nt, Human
uugaaccauaaaaugu

SEQ ID NO: 1990875 - RNA, 17 nt, Human
uugaaccauaaaauguc

SEQ ID NO: 1990876 - RNA, 21 nt, Human
uugaaccauaaaauguccagu

SEQ ID NO: 1990877 - RNA, 14 nt, Human
uugaaccauaguua

SEQ ID NO: 1990878 - RNA, 13 nt, Human
auccuaguuccac

SEQ ID NO: 1990879 - RNA, 21 nt, Human
auccuaggcauuugcugaaua

SEQ ID NO: 1990880 - RNA, 12 nt, Human
auccuaaugaau

SEQ ID NO: 1990881 - RNA, 13 nt, Human
auccuaaugaaug

SEQ ID NO: 1990882 - RNA, 14 nt, Human
auccuacaagacac

SEQ ID NO: 1990883 - RNA, 19 nt, Human
auccuaaugaaugcauaaa

SEQ ID NO: 1990884 - RNA, 23 nt, Human
uucuuuguuaauuuggaccauuu

SEQ ID NO: 1990885 - RNA, 11 nt, Human
uucuuugugua

SEQ ID NO: 1990886 - RNA, 16 nt, Human
uucuuuguaaugaaaa

SEQ ID NO: 1990887 - RNA, 11 nt, Human
uucuuugaaaa

SEQ ID NO: 1990888 - RNA, 22 nt, Human
uucuuuguacacccaugaaaga

SEQ ID NO: 1990889 - RNA, 15 nt, Human
uucuuuguagcauuu

SEQ ID NO: 1990890 - RNA, 22 nt, Human
uucuuugaaaauaguuauucag

SEQ ID NO: 1990891 - RNA, 23 nt, Human
uucuuugaaaauaguuauucagu

SEQ ID NO: 1990892 - RNA, 22 nt, Human
uucuuucuggcuaugcauuuga

SEQ ID NO: 1990893 - RNA, 13 nt, Human
uucuuucuuccuc

SEQ ID NO: 1990894 - RNA, 15 nt, Human
uucuuucuuccucug

SEQ ID NO: 1990895 - RNA, 13 nt, Human
uucuugcaaagua

SEQ ID NO: 1990896 - RNA, 21 nt, Human
uucuuggcaauaaauuuugaa

SEQ ID NO: 1990897 - RNA, 22 nt, Human
uucuuggcaauaaauuuugaaa

SEQ ID NO: 1990898 - RNA, 20 nt, Human
uucuugaucaguaguuugca

SEQ ID NO: 1990899 - RNA, 20 nt, Human
uucuugauaauuuuccuuua

SEQ ID NO: 1990900 - RNA, 12 nt, Human
uucuugcaaagu

SEQ ID NO: 1990901 - RNA, 18 nt, Human
uucuugauuaaagugauu

SEQ ID NO: 1990902 - RNA, 22 nt, Human
uucuugaucaguaguuugcauu

SEQ ID NO: 1990903 - RNA, 20 nt, Human
uucuguuuuucuaggccugg

SEQ ID NO: 1990904 - RNA, 13 nt, Human
uucuuaaaaagua

SEQ ID NO: 1990905 - RNA, 14 nt, Human
uucuuaaaaaguaa

SEQ ID NO: 1990906 - RNA, 21 nt, Human
uucuguuggccagugugacaa

SEQ ID NO: 1990907 - RNA, 17 nt, Human
uucuguugcugccucau

SEQ ID NO: 1990908 - RNA, 22 nt, Human
uucuguuuuuaaaaauuagccu

SEQ ID NO: 1990909 - RNA, 18 nt, Human
uucuguucuuucuggcua

SEQ ID NO: 1990910 - RNA, 15 nt, Human
uucuguugcugccuc

SEQ ID NO: 1990911 - RNA, 16 nt, Human
uucuguugcugccuca

SEQ ID NO: 1990912 - RNA, 18 nt, Human
aucccaccccauccucca

SEQ ID NO: 1990913 - RNA, 20 nt, Human
aucccaccccauccuccagg

SEQ ID NO: 1990914 - RNA, 23 nt, Human
uucuuccucccucccucuuuccc

SEQ ID NO: 1990915 - RNA, 11 nt, Human
uucuuccucug

SEQ ID NO: 1990916 - RNA, 12 nt, Human
uucuuccucugc

SEQ ID NO: 1990917 - RNA, 13 nt, Human
uucuuccucugcu

SEQ ID NO: 1990918 - RNA, 11 nt, Human
uucuuccuggu

SEQ ID NO: 1990919 - RNA, 13 nt, Human
uucuuaauucuua

SEQ ID NO: 1990920 - RNA, 20 nt, Human
aucaggccaggcccucugcc

SEQ ID NO: 1990921 - RNA, 23 nt, Human
aucaggccaggcccucugcccac

SEQ ID NO: 1990922 - RNA, 22 nt, Human
aucaggccaggcccucugccca

SEQ ID NO: 1990923 - RNA, 21 nt, Human
aucaggccaggcccucugccc

SEQ ID NO: 1990924 - RNA, 21 nt, Human
aucauuggauucugagagcug

SEQ ID NO: 1990925 - RNA, 22 nt, Human
aucauuggauucugagagcugu

SEQ ID NO: 1990926 - RNA, 21 nt, Human
aucauugaaaucuuuuugcuu

SEQ ID NO: 1990927 - RNA, 14 nt, Human
uucuccugccucag

SEQ ID NO: 1990928 - RNA, 12 nt, Human
uucuccugccuc

SEQ ID NO: 1990929 - RNA, 13 nt, Human
uucuccugccuca

SEQ ID NO: 1990930 - RNA, 19 nt, Human
aucauuuacaagacaacau

SEQ ID NO: 1990931 - RNA, 14 nt, Human
aucauuuacaagac

SEQ ID NO: 1990932 - RNA, 22 nt, Human
aucauuucaccugcugcuugcc

SEQ ID NO: 1990933 - RNA, 13 nt, Human
uucugccgcagcc

SEQ ID NO: 1990934 - RNA, 14 nt, Human
uucugacccaugcu

SEQ ID NO: 1990935 - RNA, 22 nt, Human
uucugacacgacuucuguuuca

SEQ ID NO: 1990936 - RNA, 15 nt, Human
uucugcacacagcac

SEQ ID NO: 1990937 - RNA, 12 nt, Human
uucucuuugaaa

SEQ ID NO: 1990938 - RNA, 21 nt, Human
uucucuuuucaagaaguucuu

SEQ ID NO: 1990939 - RNA, 16 nt, Human
uucucuuuucaaaaca

SEQ ID NO: 1990940 - RNA, 17 nt, Human
uucucuacucuagggaa

SEQ ID NO: 1990941 - RNA, 13 nt, Human
uucucuaauaaua

SEQ ID NO: 1990942 - RNA, 14 nt, Human
uucucuaauaauaa

SEQ ID NO: 1990943 - RNA, 15 nt, Human
uucucuaauaauaaa

SEQ ID NO: 1990944 - RNA, 17 nt, Human
uucucuaauaauaaaua

SEQ ID NO: 1990945 - RNA, 19 nt, Human
uucucuaauaauaaauagu

SEQ ID NO: 1990946 - RNA, 20 nt, Human
uucucuaauaauaaauaguu

SEQ ID NO: 1990947 - RNA, 15 nt, Human
uucugccgcagcccu

SEQ ID NO: 1990948 - RNA, 14 nt, Human
uucugccgcagccc

SEQ ID NO: 1990949 - RNA, 18 nt, Human
uucuggcuaugcauuuga

SEQ ID NO: 1990950 - RNA, 20 nt, Human
uucuggcuaugcauuugaaa

SEQ ID NO: 1990951 - RNA, 22 nt, Human
uucugguugaugccugugaacu

SEQ ID NO: 1990952 - RNA, 19 nt, Human
uucugguuguuuuuaaaca

SEQ ID NO: 1990953 - RNA, 16 nt, Human
aucauuuuuuauauau

SEQ ID NO: 1990954 - RNA, 17 nt, Human
aucauuuuuuauauaua

SEQ ID NO: 1990955 - RNA, 18 nt, Human
aucauuuuuuauauauau

SEQ ID NO: 1990956 - RNA, 21 nt, Human
aucauuuuuuauauauaugca

SEQ ID NO: 1990957 - RNA, 14 nt, Human
aucauuuuuuccug

SEQ ID NO: 1990958 - RNA, 15 nt, Human
aucauuuuuuccugu

SEQ ID NO: 1990959 - RNA, 21 nt, Human
aucauuuuuuccuguuuggga

SEQ ID NO: 1990960 - RNA, 23 nt, Human
aucauuuuuuccuguuugggaag

SEQ ID NO: 1990961 - RNA, 15 nt, Human
auccaaaagaaaaac

SEQ ID NO: 1990962 - RNA, 12 nt, Human
auccaaguggcc

SEQ ID NO: 1990963 - RNA, 13 nt, Human
auccaaguggccu

SEQ ID NO: 1990964 - RNA, 12 nt, Human
auccaaaagaaa

SEQ ID NO: 1990965 - RNA, 14 nt, Human
auccaaaagaaaaa

SEQ ID NO: 1990966 - RNA, 14 nt, Human
auccaguuuuucau

SEQ ID NO: 1990967 - RNA, 15 nt, Human
aucccaccaacccuc

SEQ ID NO: 1990968 - RNA, 17 nt, Human
uucaaaauaaaaaugag

SEQ ID NO: 1990969 - RNA, 20 nt, Human
uucaaaaguuuguuugcuua

SEQ ID NO: 1990970 - RNA, 21 nt, Human
uucaaaauuguuacaaauugu

SEQ ID NO: 1990971 - RNA, 15 nt, Human
uucaagaacuuguuu

SEQ ID NO: 1990972 - RNA, 23 nt, Human
uucaagaaguucuuugauucugu

SEQ ID NO: 1990973 - RNA, 16 nt, Human
uucaaaauuguuacaa

SEQ ID NO: 1990974 - RNA, 19 nt, Human
uucaagaaaugaagagcug

SEQ ID NO: 1990975 - RNA, 14 nt, Human
uucaagaacuuguu

SEQ ID NO: 1990976 - RNA, 17 nt, Human
uucaagcugcuuuuugu

SEQ ID NO: 1990977 - RNA, 14 nt, Human
uucaagcuuauuuu

SEQ ID NO: 1990978 - RNA, 19 nt, Human
uucaagcuuauuuuggaga

SEQ ID NO: 1990979 - RNA, 20 nt, Human
uucaagcuuauuuuggagag

SEQ ID NO: 1990980 - RNA, 21 nt, Human
uucaagcgauucuucugcuuc

SEQ ID NO: 1990981 - RNA, 16 nt, Human
uucaagcgauucucuu

SEQ ID NO: 1990982 - RNA, 23 nt, Human
uucaagcgauucucuugccucag

SEQ ID NO: 1990983 - RNA, 14 nt, Human
uucaagcugcuuuu

SEQ ID NO: 1990984 - RNA, 13 nt, Human
uucaagaucaaaa

SEQ ID NO: 1990985 - RNA, 18 nt, Human
uucaagacugaauuccaa

SEQ ID NO: 1990986 - RNA, 18 nt, Human
uuauuuuuagacagaguc

SEQ ID NO: 1990987 - RNA, 14 nt, Human
uuauuuuuagaauu

SEQ ID NO: 1990988 - RNA, 20 nt, Human
uuauuuuuagaauuuuguga

SEQ ID NO: 1990989 - RNA, 17 nt, Human
uuauuuuuagacagagu

SEQ ID NO: 1990990 - RNA, 16 nt, Human
uuauuuuuaagaaaga

SEQ ID NO: 1990991 - RNA, 22 nt, Human
uuaguuuugcuuuuaguuuuuc

SEQ ID NO: 1990992 - RNA, 14 nt, Human
uuaguuuugcuuuu

SEQ ID NO: 1990993 - RNA, 18 nt, Human
uuaguuuugcuuuuaguu

SEQ ID NO: 1990994 - RNA, 15 nt, Human
uuaguuuuucugucc

SEQ ID NO: 1990995 - RNA, 14 nt, Human
uuaguuuugugcuu

SEQ ID NO: 1990996 - RNA, 22 nt, Human
uuaguuuugugcuuaguuaaau

SEQ ID NO: 1990997 - RNA, 13 nt, Human
uuaguuuugcaua

SEQ ID NO: 1990998 - RNA, 13 nt, Human
uuaguuuugcuuu

SEQ ID NO: 1990999 - RNA, 17 nt, Human
uuaguuuuauuuucuaa

SEQ ID NO: 1991000 - RNA, 13 nt, Human
uuauuuuuuucug

SEQ ID NO: 1991001 - RNA, 17 nt, Human
uuauuuuuuucugaauu

SEQ ID NO: 1991002 - RNA, 23 nt, Human
uucaaaacaaacagaugcucuga

SEQ ID NO: 1991003 - RNA, 16 nt, Human
uucaaaacaaacagau

SEQ ID NO: 1991004 - RNA, 12 nt, Human
uuauuuuugcuu

SEQ ID NO: 1991005 - RNA, 22 nt, Human
uuauuuuuagaauuuugugaaa

SEQ ID NO: 1991006 - RNA, 13 nt, Human
uucacaguucucu

SEQ ID NO: 1991007 - RNA, 15 nt, Human
uucacauguuuucaa

SEQ ID NO: 1991008 - RNA, 20 nt, Human
uucacaguucucuccuucuu

SEQ ID NO: 1991009 - RNA, 15 nt, Human
uucacaguucucucc

SEQ ID NO: 1991010 - RNA, 20 nt, Human
uucacagaugggugcuugga

SEQ ID NO: 1991011 - RNA, 12 nt, Human
uucacacuugaa

SEQ ID NO: 1991012 - RNA, 14 nt, Human
uucacaccccaccu

SEQ ID NO: 1991013 - RNA, 15 nt, Human
uucacaccccaccug

SEQ ID NO: 1991014 - RNA, 16 nt, Human
uucaaguauuuaagcc

SEQ ID NO: 1991015 - RNA, 14 nt, Human
uucacaccugcaga

SEQ ID NO: 1991016 - RNA, 16 nt, Human
uucacaccccaccugc

SEQ ID NO: 1991017 - RNA, 17 nt, Human
uucacaccccaccugcg

SEQ ID NO: 1991018 - RNA, 19 nt, Human
uucacaccccaccugcgcu

SEQ ID NO: 1991019 - RNA, 23 nt, Human
uucacaagacccaaaaggcagaa

SEQ ID NO: 1991020 - RNA, 17 nt, Human
uucaagugauucucaug

SEQ ID NO: 1991021 - RNA, 17 nt, Human
uucaaguacacugaauu

SEQ ID NO: 1991022 - RNA, 14 nt, Human
uucaaguauuuaag

SEQ ID NO: 1991023 - RNA, 15 nt, Human
uucaaguauuuaagc

SEQ ID NO: 1991024 - RNA, 15 nt, Human
uucaaguacacugaa

SEQ ID NO: 1991025 - RNA, 17 nt, Human
auaggaaaaacugauuu

SEQ ID NO: 1991026 - RNA, 16 nt, Human
auaggaaaaacugauu

SEQ ID NO: 1991027 - RNA, 14 nt, Human
auaggaaaaacuga

SEQ ID NO: 1991028 - RNA, 12 nt, Human
auaggaaaaacu

SEQ ID NO: 1991029 - RNA, 15 nt, Human
auagcuuuuuucucu

SEQ ID NO: 1991030 - RNA, 22 nt, Human
auagcuuuucccuuuuuuuaag

SEQ ID NO: 1991031 - RNA, 16 nt, Human
uucacauguuuucaaa

SEQ ID NO: 1991032 - RNA, 17 nt, Human
uucacauguuuucaaau

SEQ ID NO: 1991033 - RNA, 18 nt, Human
uucacauguuuucaaaug

SEQ ID NO: 1991034 - RNA, 19 nt, Human
uucacauguuuucaaaugg

SEQ ID NO: 1991035 - RNA, 20 nt, Human
uucacauguuuucaaaugga

SEQ ID NO: 1991036 - RNA, 22 nt, Human
auaggaauugacccacaagaaa

SEQ ID NO: 1991037 - RNA, 21 nt, Human
auaggaaaugguauccagaau

SEQ ID NO: 1991038 - RNA, 17 nt, Human
auaggcguaacuaauuu

SEQ ID NO: 1991039 - RNA, 13 nt, Human
auaggacuuguuu

SEQ ID NO: 1991040 - RNA, 15 nt, Human
auaggacuuguuuuu

SEQ ID NO: 1991041 - RNA, 16 nt, Human
auaggacuuguuuuug

SEQ ID NO: 1991042 - RNA, 22 nt, Human
auaggccugcuuugucuccucu

SEQ ID NO: 1991043 - RNA, 16 nt, Human
auauaacuuauauugu

SEQ ID NO: 1991044 - RNA, 20 nt, Human
auauaacuuauauuguaaga

SEQ ID NO: 1991045 - RNA, 21 nt, Human
auauaacuuauauuguaagaa

SEQ ID NO: 1991046 - RNA, 13 nt, Human
auauauaaccagu

SEQ ID NO: 1991047 - RNA, 12 nt, Human
auauauaaccag

SEQ ID NO: 1991048 - RNA, 22 nt, Human
auauaacuuauauuguaagaaa

SEQ ID NO: 1991049 - RNA, 15 nt, Human
auauauauauauauu

SEQ ID NO: 1991050 - RNA, 16 nt, Human
auauauauaucuguau

SEQ ID NO: 1991051 - RNA, 21 nt, Human
auauauauuuuuuucugaaau

SEQ ID NO: 1991052 - RNA, 16 nt, Human
auauauaugugugugu

SEQ ID NO: 1991053 - RNA, 22 nt, Human
auauauaugcauauauauaugu

SEQ ID NO: 1991054 - RNA, 15 nt, Human
uucacugucugucug

SEQ ID NO: 1991055 - RNA, 16 nt, Human
uucacugucugucugg

SEQ ID NO: 1991056 - RNA, 22 nt, Human
uucacuguccuccaagccagcg

SEQ ID NO: 1991057 - RNA, 15 nt, Human
uucacuuacagcacc

SEQ ID NO: 1991058 - RNA, 22 nt, Human
uucacuuaaguuaguuccacug

SEQ ID NO: 1991059 - RNA, 18 nt, Human
auauauccacacauuugu

SEQ ID NO: 1991060 - RNA, 16 nt, Human
auauaucccugauaaa

SEQ ID NO: 1991061 - RNA, 17 nt, Human
auauaucccugauaaau

SEQ ID NO: 1991062 - RNA, 20 nt, Human
auauaucccugauaaauauu

SEQ ID NO: 1991063 - RNA, 22 nt, Human
auauaucccugauaaauauuca

SEQ ID NO: 1991064 - RNA, 14 nt, Human
auauaucucaaauu

SEQ ID NO: 1991065 - RNA, 16 nt, Human
auauaucucaaauugu

SEQ ID NO: 1991066 - RNA, 19 nt, Human
auauaucucaaauuguaau

SEQ ID NO: 1991067 - RNA, 19 nt, Human
auauaugaaaacuaaguuc

SEQ ID NO: 1991068 - RNA, 18 nt, Human
auaguucuagugcagcug

SEQ ID NO: 1991069 - RNA, 19 nt, Human
auaguuauguaaauaauuc

SEQ ID NO: 1991070 - RNA, 14 nt, Human
auaguuauguaaau

SEQ ID NO: 1991071 - RNA, 15 nt, Human
auaguuauguaaaua

SEQ ID NO: 1991072 - RNA, 16 nt, Human
auaguuauguaaauaa

SEQ ID NO: 1991073 - RNA, 17 nt, Human
auaguuauguaaauaau

SEQ ID NO: 1991074 - RNA, 18 nt, Human
auaguuauguaaauaauu

SEQ ID NO: 1991075 - RNA, 21 nt, Human
auaguuacuguaaaaugcaaa

SEQ ID NO: 1991076 - RNA, 22 nt, Human
auaguuaagcgugcauaaguua

SEQ ID NO: 1991077 - RNA, 13 nt, Human
auaguuacuguaa

SEQ ID NO: 1991078 - RNA, 15 nt, Human
auaguuacuguaaaa

SEQ ID NO: 1991079 - RNA, 17 nt, Human
auaguuacuguaaaaug

SEQ ID NO: 1991080 - RNA, 18 nt, Human
auaguuacuguaaaaugc

SEQ ID NO: 1991081 - RNA, 18 nt, Human
auaguuuuauuuauauuu

SEQ ID NO: 1991082 - RNA, 24 nt, Human
auaguuuuauuuauauuuauugac

SEQ ID NO: 1991083 - RNA, 16 nt, Human
auaguuuuauuuauau

SEQ ID NO: 1991084 - RNA, 20 nt, Human
auaguuguaccgcaauguga

SEQ ID NO: 1991085 - RNA, 22 nt, Human
auaguuggcuaggaccccucca

SEQ ID NO: 1991086 - RNA, 17 nt, Human
auaguguuauugagaga

SEQ ID NO: 1991087 - RNA, 23 nt, Human
auaguguggaaauuaagaagaaa

SEQ ID NO: 1991088 - RNA, 16 nt, Human
auaguggggagacuuc

SEQ ID NO: 1991089 - RNA, 16 nt, Human
auagugggaccacaua

SEQ ID NO: 1991090 - RNA, 15 nt, Human
auaguggugugauuu

SEQ ID NO: 1991091 - RNA, 17 nt, Human
auaguggcuuaaaacaa

SEQ ID NO: 1991092 - RNA, 21 nt, Human
auagugaggcaucgcaaugua

SEQ ID NO: 1991093 - RNA, 23 nt, Human
auagugacuuuucaaguauuuaa

SEQ ID NO: 1991094 - RNA, 20 nt, Human
auagugcaauauauuuugua

SEQ ID NO: 1991095 - RNA, 12 nt, Human
auagugcaauau

SEQ ID NO: 1991096 - RNA, 13 nt, Human
auagugcaauaua

SEQ ID NO: 1991097 - RNA, 15 nt, Human
auagugcaauauauu

SEQ ID NO: 1991098 - RNA, 18 nt, Human
auagugcaauauauuuug

SEQ ID NO: 1991099 - RNA, 12 nt, Human
auagugacuuuu

SEQ ID NO: 1991100 - RNA, 17 nt, Human
auagugacuuuucaagu

SEQ ID NO: 1991101 - RNA, 18 nt, Human
auagugacuuuucaagua

SEQ ID NO: 1991102 - RNA, 21 nt, Human
auagugacuuuucaaguauuu

SEQ ID NO: 1991103 - RNA, 22 nt, Human
uucccaccucucucacuccuug

SEQ ID NO: 1991104 - RNA, 12 nt, Human
uucccaccucuc

SEQ ID NO: 1991105 - RNA, 14 nt, Human
uucccacccagccu

SEQ ID NO: 1991106 - RNA, 15 nt, Human
uucccacccagccug

SEQ ID NO: 1991107 - RNA, 16 nt, Human
uucccacccagccugg

SEQ ID NO: 1991108 - RNA, 18 nt, Human
uucccaagcucugcuccu

SEQ ID NO: 1991109 - RNA, 13 nt, Human
uucccaacacaaa

SEQ ID NO: 1991110 - RNA, 15 nt, Human
uucccaacacaaaga

SEQ ID NO: 1991111 - RNA, 23 nt, Human
uucccaacuugccuuugaagagu

SEQ ID NO: 1991112 - RNA, 15 nt, Human
uucccaacuugccuu

SEQ ID NO: 1991113 - RNA, 19 nt, Human
uucccaacuugccuuugaa

SEQ ID NO: 1991114 - RNA, 20 nt, Human
uucccaacuugccuuugaag

SEQ ID NO: 1991115 - RNA, 13 nt, Human
uucccaagcucug

SEQ ID NO: 1991116 - RNA, 14 nt, Human
uucccaagcucugc

SEQ ID NO: 1991117 - RNA, 15 nt, Human
uucccaagcucugcu

SEQ ID NO: 1991118 - RNA, 16 nt, Human
uucccaagcucugcuc

SEQ ID NO: 1991119 - RNA, 22 nt, Human
uuccagugaggcucugcccuug

SEQ ID NO: 1991120 - RNA, 21 nt, Human
uuccagugaggcucugcccuu

SEQ ID NO: 1991121 - RNA, 20 nt, Human
uuccagugaggcucugcccu

SEQ ID NO: 1991122 - RNA, 19 nt, Human
uuccagugaggcucugccc

SEQ ID NO: 1991123 - RNA, 17 nt, Human
uuccagugaggcucugc

SEQ ID NO: 1991124 - RNA, 21 nt, Human
uuccaggggugggacacccug

SEQ ID NO: 1991125 - RNA, 20 nt, Human
uuccaguuuauuccagagcu

SEQ ID NO: 1991126 - RNA, 17 nt, Human
uuccaguuacuuuccaa

SEQ ID NO: 1991127 - RNA, 19 nt, Human
uuccauaaucuggacuccu

SEQ ID NO: 1991128 - RNA, 22 nt, Human
uuccauaaucuggacuccucug

SEQ ID NO: 1991129 - RNA, 23 nt, Human
uuccauaaucuggacuccucugu

SEQ ID NO: 1991130 - RNA, 23 nt, Human
uucccaaagcagugcaugcuguc

SEQ ID NO: 1991131 - RNA, 20 nt, Human
uucccaaaugugugcccagc

SEQ ID NO: 1991132 - RNA, 22 nt, Human
uucccaaaugugugcccagcuu

SEQ ID NO: 1991133 - RNA, 16 nt, Human
uuccauaguuaaagaa

SEQ ID NO: 1991134 - RNA, 17 nt, Human
uuccauaguuaaagaag

SEQ ID NO: 1991135 - RNA, 11 nt, Human
uuccaggcagc

SEQ ID NO: 1991136 - RNA, 17 nt, Human
uuccaggcccgaagcau

SEQ ID NO: 1991137 - RNA, 17 nt, Human
uuccaggggugggacac

SEQ ID NO: 1991138 - RNA, 19 nt, Human
uuccaccaucaagccacca

SEQ ID NO: 1991139 - RNA, 19 nt, Human
uuccaaugccucuugucuu

SEQ ID NO: 1991140 - RNA, 22 nt, Human
uuccacaagagcccaggccucc

SEQ ID NO: 1991141 - RNA, 13 nt, Human
uuccaauauguga

SEQ ID NO: 1991142 - RNA, 14 nt, Human
uuccaauaugugau

SEQ ID NO: 1991143 - RNA, 16 nt, Human
uuccaagucuuugcua

SEQ ID NO: 1991144 - RNA, 15 nt, Human
auauguggaguucau

SEQ ID NO: 1991145 - RNA, 16 nt, Human
auaugugccacauuuu

SEQ ID NO: 1991146 - RNA, 12 nt, Human
auaugugauuuu

SEQ ID NO: 1991147 - RNA, 16 nt, Human
auauguggaguucauc

SEQ ID NO: 1991148 - RNA, 12 nt, Human
uucauucauauu

SEQ ID NO: 1991149 - RNA, 18 nt, Human
auaugugccacauuuucu

SEQ ID NO: 1991150 - RNA, 13 nt, Human
uucauucauauua

SEQ ID NO: 1991151 - RNA, 14 nt, Human
uucauucauauuac

SEQ ID NO: 1991152 - RNA, 18 nt, Human
uucauucauauuacaaua

SEQ ID NO: 1991153 - RNA, 23 nt, Human
uucauucauauuacaauauuugu

SEQ ID NO: 1991154 - RNA, 14 nt, Human
uuccaagagccuga

SEQ ID NO: 1991155 - RNA, 22 nt, Human
uuccaagagccugagagugagg

SEQ ID NO: 1991156 - RNA, 20 nt, Human
uuccaagacuuauuuucaca

SEQ ID NO: 1991157 - RNA, 17 nt, Human
uuccaaggguacuaagg

SEQ ID NO: 1991158 - RNA, 15 nt, Human
uuccaaggguacuaa

SEQ ID NO: 1991159 - RNA, 13 nt, Human
uuccaagagccug

SEQ ID NO: 1991160 - RNA, 18 nt, Human
uucauuuaggugaggaag

SEQ ID NO: 1991161 - RNA, 19 nt, Human
auaucuccgucaacucaua

SEQ ID NO: 1991162 - RNA, 20 nt, Human
auaucuccgucaacucauau

SEQ ID NO: 1991163 - RNA, 21 nt, Human
auaucuccgucaacucauauu

SEQ ID NO: 1991164 - RNA, 17 nt, Human
auaucuauaaacacugu

SEQ ID NO: 1991165 - RNA, 22 nt, Human
auaucuaguaauauauuuaaag

SEQ ID NO: 1991166 - RNA, 14 nt, Human
auauauuuuaagac

SEQ ID NO: 1991167 - RNA, 17 nt, Human
auaucuccuuuguauuc

SEQ ID NO: 1991168 - RNA, 23 nt, Human
auaucuccuuuguauucugucuu

SEQ ID NO: 1991169 - RNA, 15 nt, Human
auaugaaaaaugaga

SEQ ID NO: 1991170 - RNA, 16 nt, Human
auaugaaaaaugagau

SEQ ID NO: 1991171 - RNA, 16 nt, Human
auaugaaaacuaaguu

SEQ ID NO: 1991172 - RNA, 20 nt, Human
auaucugaaaauguaugugu

SEQ ID NO: 1991173 - RNA, 17 nt, Human
auaucugaaaauguaug

SEQ ID NO: 1991174 - RNA, 16 nt, Human
auaucugaaaauguau

SEQ ID NO: 1991175 - RNA, 14 nt, Human
auaucuccuuugua

SEQ ID NO: 1991176 - RNA, 14 nt, Human
auaugcacacauuu

SEQ ID NO: 1991177 - RNA, 15 nt, Human
auaugcacacauuuu

SEQ ID NO: 1991178 - RNA, 16 nt, Human
auaugcacacauuuuu

SEQ ID NO: 1991179 - RNA, 21 nt, Human
auaugauuaaaaauaucaaau

SEQ ID NO: 1991180 - RNA, 22 nt, Human
auaugauuaaaaauaucaaauu

SEQ ID NO: 1991181 - RNA, 17 nt, Human
auaugauuaaaaauauc

SEQ ID NO: 1991182 - RNA, 11 nt, Human
auaugauuaaa

SEQ ID NO: 1991183 - RNA, 16 nt, Human
auauguaacaagccac

SEQ ID NO: 1991184 - RNA, 13 nt, Human
auauggucuaaug

SEQ ID NO: 1991185 - RNA, 14 nt, Human
auauggucuaaugu

SEQ ID NO: 1991186 - RNA, 15 nt, Human
auauggucuaauguu

SEQ ID NO: 1991187 - RNA, 16 nt, Human
auauggucuaauguuu

SEQ ID NO: 1991188 - RNA, 17 nt, Human
auauggucuaauguuua

SEQ ID NO: 1991189 - RNA, 21 nt, Human
auauggugguaauaagggaaa

SEQ ID NO: 1991190 - RNA, 17 nt, Human
auauguaacaagccacc

SEQ ID NO: 1991191 - RNA, 22 nt, Human
auauguaaaugguaugucauuc

SEQ ID NO: 1991192 - RNA, 12 nt, Human
auauguacauuu

SEQ ID NO: 1991193 - RNA, 13 nt, Human
auauguacauuuc

SEQ ID NO: 1991194 - RNA, 15 nt, Human
auauguacauuucua

SEQ ID NO: 1991195 - RNA, 18 nt, Human
auaugugaacgcccagag

SEQ ID NO: 1991196 - RNA, 22 nt, Human
auaugugaaggaccuucacucu

SEQ ID NO: 1991197 - RNA, 15 nt, Human
auauaugugugugug

SEQ ID NO: 1991198 - RNA, 14 nt, Human
auauauuuaaaggg

SEQ ID NO: 1991199 - RNA, 20 nt, Human
auauauuuaaagggaaauug

SEQ ID NO: 1991200 - RNA, 21 nt, Human
auauauuuaaagggaaauuga

SEQ ID NO: 1991201 - RNA, 13 nt, Human
auauauuuuaaga

SEQ ID NO: 1991202 - RNA, 12 nt, Human
auauauuuuaag

SEQ ID NO: 1991203 - RNA, 19 nt, Human
uucauauuuaauauaugug

SEQ ID NO: 1991204 - RNA, 13 nt, Human
uucauauuuaauu

SEQ ID NO: 1991205 - RNA, 17 nt, Human
uucaucccucuggggcu

SEQ ID NO: 1991206 - RNA, 14 nt, Human
uucauccccucaga

SEQ ID NO: 1991207 - RNA, 15 nt, Human
uucauccccucagaa

SEQ ID NO: 1991208 - RNA, 19 nt, Human
auauauggucuaauguuua

SEQ ID NO: 1991209 - RNA, 20 nt, Human
auauauggucuaauguuuaa

SEQ ID NO: 1991210 - RNA, 21 nt, Human
uucaucccucuggggcuguuc

SEQ ID NO: 1991211 - RNA, 20 nt, Human
uucagaaagccuuucauuuu

SEQ ID NO: 1991212 - RNA, 21 nt, Human
uucagaaagccuuucauuuug

SEQ ID NO: 1991213 - RNA, 19 nt, Human
uucagaaagccuuucauuu

SEQ ID NO: 1991214 - RNA, 19 nt, Human
uucagaaauacagauaaau

SEQ ID NO: 1991215 - RNA, 11 nt, Human
uucagaaaugu

SEQ ID NO: 1991216 - RNA, 13 nt, Human
uucagaaaugugu

SEQ ID NO: 1991217 - RNA, 13 nt, Human
uucagugccuuau

SEQ ID NO: 1991218 - RNA, 12 nt, Human
uucagugccuua

SEQ ID NO: 1991219 - RNA, 16 nt, Human
uucagugccaaaaaca

SEQ ID NO: 1991220 - RNA, 21 nt, Human
uucauacagggaugguguuca

SEQ ID NO: 1991221 - RNA, 18 nt, Human
uucagugccuuauggaac

SEQ ID NO: 1991222 - RNA, 19 nt, Human
uucauaauuauuauuuggc

SEQ ID NO: 1991223 - RNA, 14 nt, Human
uucauauucagcuu

SEQ ID NO: 1991224 - RNA, 18 nt, Human
uucauauucaugcaagua

SEQ ID NO: 1991225 - RNA, 13 nt, Human
uucauauuacaau

SEQ ID NO: 1991226 - RNA, 15 nt, Human
uucauauuacaauau

SEQ ID NO: 1991227 - RNA, 16 nt, Human
uucauauuacaauauu

SEQ ID NO: 1991228 - RNA, 23 nt, Human
auuucuuuugccguuauuaaaaa

SEQ ID NO: 1991229 - RNA, 24 nt, Human
auuuguacuuucuguuaaaaugca

SEQ ID NO: 1991230 - RNA, 20 nt, Human
auuuuacuguacagacagaa

SEQ ID NO: 1991231 - RNA, 22 nt, Human
auuuuacuguacagacagaaaa

SEQ ID NO: 1991232 - RNA, 13 nt, Human
auuuuaauuucaa

SEQ ID NO: 1991233 - RNA, 18 nt, Human
auuuuaauuucaagcuua

SEQ ID NO: 1991234 - RNA, 19 nt, Human
auuuuaauuucaagcuuau

SEQ ID NO: 1991235 - RNA, 17 nt, Human
auuuuaauuuuuaaaug

SEQ ID NO: 1991236 - RNA, 18 nt, Human
auuuuaauuuuuaaaugc

SEQ ID NO: 1991237 - RNA, 19 nt, Human
auuuuaauuuuuaaaugca

SEQ ID NO: 1991238 - RNA, 16 nt, Human
auuuuauucuugauca

SEQ ID NO: 1991239 - RNA, 18 nt, Human
auuuuauucuugaucagu

SEQ ID NO: 1991240 - RNA, 17 nt, Human
auuuuauuaugcaugaa

SEQ ID NO: 1991241 - RNA, 14 nt, Human
auuuuauuaugcau

SEQ ID NO: 1991242 - RNA, 15 nt, Human
auuuuauuaugcaug

SEQ ID NO: 1991243 - RNA, 13 nt, Human
auuuuauuaugca

SEQ ID NO: 1991244 - RNA, 14 nt, Human
auuuuauguugcau

SEQ ID NO: 1991245 - RNA, 21 nt, Human
auuuuauguugcauagaauaa

SEQ ID NO: 1991246 - RNA, 18 nt, Human
auuuuauguugcauagaa

SEQ ID NO: 1991247 - RNA, 21 nt, Human
auuuuacuuuaaaaggagcca

SEQ ID NO: 1991248 - RNA, 21 nt, Human
auuucuaagucaaacacuugu

SEQ ID NO: 1991249 - RNA, 21 nt, Human
auuucuaaaucuccaaaauaa

SEQ ID NO: 1991250 - RNA, 12 nt, Human
auuucuaaaucu

SEQ ID NO: 1991251 - RNA, 13 nt, Human
auuucuaaaucuc

SEQ ID NO: 1991252 - RNA, 23 nt, Human
auuuccugggagcuuuuguagaa

SEQ ID NO: 1991253 - RNA, 22 nt, Human
auuuccugggagcuuuuguaga

SEQ ID NO: 1991254 - RNA, 16 nt, Human
auuuauuauggcacau

SEQ ID NO: 1991255 - RNA, 14 nt, Human
auuuccugugucuu

SEQ ID NO: 1991256 - RNA, 16 nt, Human
auuuagggaguauucu

SEQ ID NO: 1991257 - RNA, 18 nt, Human
auuuagggaguauucuaa

SEQ ID NO: 1991258 - RNA, 19 nt, Human
auuuagggaguauucuaau

SEQ ID NO: 1991259 - RNA, 20 nt, Human
auuuagggaguauucuaaua

SEQ ID NO: 1991260 - RNA, 24 nt, Human
auuuagggaguauucuaauaagcu

SEQ ID NO: 1991261 - RNA, 20 nt, Human
auuuauuaaaugcccagccc

SEQ ID NO: 1991262 - RNA, 22 nt, Human
auuuauuaaaugcccagccccu

SEQ ID NO: 1991263 - RNA, 13 nt, Human
auuuauuauggca

SEQ ID NO: 1991264 - RNA, 21 nt, Human
auuuggaauaaaaauuccaga

SEQ ID NO: 1991265 - RNA, 22 nt, Human
auuuggaauaaaaauuccagaa

SEQ ID NO: 1991266 - RNA, 14 nt, Human
auuuggaauuagaa

SEQ ID NO: 1991267 - RNA, 15 nt, Human
auuugggguauuuau

SEQ ID NO: 1991268 - RNA, 18 nt, Human
auuuggaccauuuuccug

SEQ ID NO: 1991269 - RNA, 22 nt, Human
auuuggggauucagauuucucu

SEQ ID NO: 1991270 - RNA, 14 nt, Human
auuuggaccauuuu

SEQ ID NO: 1991271 - RNA, 17 nt, Human
auuuggaccauuuuccu

SEQ ID NO: 1991272 - RNA, 18 nt, Human
auuugguaauguuuuuaa

SEQ ID NO: 1991273 - RNA, 15 nt, Human
auuugguauccuuau

SEQ ID NO: 1991274 - RNA, 17 nt, Human
auuuggugguuucagaa

SEQ ID NO: 1991275 - RNA, 15 nt, Human
auuuguacuuucugu

SEQ ID NO: 1991276 - RNA, 18 nt, Human
auuuguacuuucuguuaa

SEQ ID NO: 1991277 - RNA, 19 nt, Human
auuuguacuuucuguuaaa

SEQ ID NO: 1991278 - RNA, 20 nt, Human
auuuguacuuucuguuaaaa

SEQ ID NO: 1991279 - RNA, 22 nt, Human
auuuguacuuucuguuaaaaug

SEQ ID NO: 1991280 - RNA, 21 nt, Human
auuugguuuucacauuggaaa

SEQ ID NO: 1991281 - RNA, 22 nt, Human
auuugguuuucacauuggaaac

SEQ ID NO: 1991282 - RNA, 15 nt, Human
auuugguuuucacau

SEQ ID NO: 1991283 - RNA, 17 nt, Human
auuugguuuucacauug

SEQ ID NO: 1991284 - RNA, 18 nt, Human
auuuggugguuucagaaa

SEQ ID NO: 1991285 - RNA, 20 nt, Human
auuuggugguuucagaaaug

SEQ ID NO: 1991286 - RNA, 20 nt, Human
auuugaauguaugcuucaua

SEQ ID NO: 1991287 - RNA, 21 nt, Human
auuugaauguaugcuucauac

SEQ ID NO: 1991288 - RNA, 22 nt, Human
auuugaauguaugcuucauaca

SEQ ID NO: 1991289 - RNA, 17 nt, Human
auuugaauguaugcuuc

SEQ ID NO: 1991290 - RNA, 18 nt, Human
auuugaauguaugcuuca

SEQ ID NO: 1991291 - RNA, 20 nt, Human
auuucuuuugccguuauuaa

SEQ ID NO: 1991292 - RNA, 20 nt, Human
auuucuuuucaccauucgua

SEQ ID NO: 1991293 - RNA, 15 nt, Human
auuugaggucuguuc

SEQ ID NO: 1991294 - RNA, 23 nt, Human
auuugaggucuguucuuuccaaa

SEQ ID NO: 1991295 - RNA, 17 nt, Human
auuugagcagggcucag

SEQ ID NO: 1991296 - RNA, 22 nt, Human
auuugaggucuguucuuuccaa

SEQ ID NO: 1991297 - RNA, 14 nt, Human
auugcuacuguccu

SEQ ID NO: 1991298 - RNA, 23 nt, Human
auugcaggagucccugccaucau

SEQ ID NO: 1991299 - RNA, 13 nt, Human
auugcagaauugu

SEQ ID NO: 1991300 - RNA, 16 nt, Human
auugcagaauuguuua

SEQ ID NO: 1991301 - RNA, 19 nt, Human
auugcagaauuguuuagau

SEQ ID NO: 1991302 - RNA, 20 nt, Human
auugcagaauuguuuagauu

SEQ ID NO: 1991303 - RNA, 21 nt, Human
auugcaacaaaauacauucuu

SEQ ID NO: 1991304 - RNA, 22 nt, Human
auugcaacaaaauacauucuuu

SEQ ID NO: 1991305 - RNA, 19 nt, Human
auugcaaucuauaauauuu

SEQ ID NO: 1991306 - RNA, 16 nt, Human
auugcaacaggcuggg

SEQ ID NO: 1991307 - RNA, 13 nt, Human
auugcaacaaaau

SEQ ID NO: 1991308 - RNA, 14 nt, Human
auugcaacaaaaua

SEQ ID NO: 1991309 - RNA, 16 nt, Human
auugcaacaaaauaca

SEQ ID NO: 1991310 - RNA, 17 nt, Human
auugcaacaaaauacau

SEQ ID NO: 1991311 - RNA, 21 nt, Human
auugcaacaggcugggcuuca

SEQ ID NO: 1991312 - RNA, 21 nt, Human
auugaccgacagcuuuccagu

SEQ ID NO: 1991313 - RNA, 21 nt, Human
auugacccacaagaaaugaaa

SEQ ID NO: 1991314 - RNA, 18 nt, Human
auugacaggauuauugga

SEQ ID NO: 1991315 - RNA, 13 nt, Human
auugaccugaggc

SEQ ID NO: 1991316 - RNA, 13 nt, Human
auugcaaagcaaa

SEQ ID NO: 1991317 - RNA, 15 nt, Human
auugcaacaggcugg

SEQ ID NO: 1991318 - RNA, 16 nt, Human
auugcggacagccacg

SEQ ID NO: 1991319 - RNA, 18 nt, Human
auugcggacagccacggc

SEQ ID NO: 1991320 - RNA, 19 nt, Human
auugcggacagccacggcc

SEQ ID NO: 1991321 - RNA, 17 nt, Human
auugcccacgcuggagu

SEQ ID NO: 1991322 - RNA, 21 nt, Human
auugcccacgcuggagugcag

SEQ ID NO: 1991323 - RNA, 23 nt, Human
auugccauuucuuccacaagagc

SEQ ID NO: 1991324 - RNA, 21 nt, Human
auugccaaacauuaauguuga

SEQ ID NO: 1991325 - RNA, 22 nt, Human
auugccaaacauuaauguugau

SEQ ID NO: 1991326 - RNA, 16 nt, Human
auugccaaaacccagc

SEQ ID NO: 1991327 - RNA, 16 nt, Human
auugcauuugcuuuug

SEQ ID NO: 1991328 - RNA, 17 nt, Human
auugccaaaacccagcu

SEQ ID NO: 1991329 - RNA, 18 nt, Human
auugccaaaacccagcug

SEQ ID NO: 1991330 - RNA, 19 nt, Human
auugccaaaacccagcugc

SEQ ID NO: 1991331 - RNA, 20 nt, Human
auugccaaaacccagcugca

SEQ ID NO: 1991332 - RNA, 22 nt, Human
auugccaaaacccagcugcacc

SEQ ID NO: 1991333 - RNA, 13 nt, Human
auugccaaacauu

SEQ ID NO: 1991334 - RNA, 14 nt, Human
auugccaaacauua

SEQ ID NO: 1991335 - RNA, 19 nt, Human
auugccaaacauuaauguu

SEQ ID NO: 1991336 - RNA, 16 nt, Human
auugcauuuccugaca

SEQ ID NO: 1991337 - RNA, 17 nt, Human
auugcauuuccugacag

SEQ ID NO: 1991338 - RNA, 18 nt, Human
auucuccaccugccaggg

SEQ ID NO: 1991339 - RNA, 16 nt, Human
auucuacuuugagugc

SEQ ID NO: 1991340 - RNA, 13 nt, Human
auucuacuuugag

SEQ ID NO: 1991341 - RNA, 21 nt, Human
auucucacagcuccaagaauu

SEQ ID NO: 1991342 - RNA, 22 nt, Human
auucucacagcuccaagaauuu

SEQ ID NO: 1991343 - RNA, 19 nt, Human
auucucacagcuccaagaa

SEQ ID NO: 1991344 - RNA, 14 nt, Human
auucucagaaucuc

SEQ ID NO: 1991345 - RNA, 15 nt, Human
auucucaccagcugu

SEQ ID NO: 1991346 - RNA, 18 nt, Human
auucucaccagcuguguc

SEQ ID NO: 1991347 - RNA, 13 nt, Human
auucuccaccugc

SEQ ID NO: 1991348 - RNA, 20 nt, Human
auucucagaaucucaaauaa

SEQ ID NO: 1991349 - RNA, 18 nt, Human
auucucagaaucucaaau

SEQ ID NO: 1991350 - RNA, 17 nt, Human
auucuccaccugccagg

SEQ ID NO: 1991351 - RNA, 16 nt, Human
auucuccaccugccag

SEQ ID NO: 1991352 - RNA, 20 nt, Human
auugacacuuaaaaaugguu

SEQ ID NO: 1991353 - RNA, 19 nt, Human
auuuaaaauugugaugugu

SEQ ID NO: 1991354 - RNA, 14 nt, Human
auuuaaaagacagc

SEQ ID NO: 1991355 - RNA, 17 nt, Human
auuuaaaagacagcuuu

SEQ ID NO: 1991356 - RNA, 20 nt, Human
auuuaaaauugugauguguc

SEQ ID NO: 1991357 - RNA, 19 nt, Human
auuuaaaacauuaaaauau

SEQ ID NO: 1991358 - RNA, 20 nt, Human
auuuaaaacauuaaaauaua

SEQ ID NO: 1991359 - RNA, 21 nt, Human
auuuaaaacauuaaaauauaa

SEQ ID NO: 1991360 - RNA, 17 nt, Human
auuuaaaacuguaauuu

SEQ ID NO: 1991361 - RNA, 20 nt, Human
auuuaacagaaauguacagc

SEQ ID NO: 1991362 - RNA, 17 nt, Human
auuuaacagaaauguac

SEQ ID NO: 1991363 - RNA, 19 nt, Human
auuuaacagaaauguacag

SEQ ID NO: 1991364 - RNA, 18 nt, Human
auuuaaaggcccuaucug

SEQ ID NO: 1991365 - RNA, 20 nt, Human
auuuaaaggcccuaucuguu

SEQ ID NO: 1991366 - RNA, 21 nt, Human
auuuaaaggcccuaucuguuu

SEQ ID NO: 1991367 - RNA, 17 nt, Human
auuuaaagggaaauuga

SEQ ID NO: 1991368 - RNA, 15 nt, Human
auuuaacagaaaugu

SEQ ID NO: 1991369 - RNA, 16 nt, Human
auuuaacagaaaugua

SEQ ID NO: 1991370 - RNA, 22 nt, Human
auuuaacagggucucuagugcu

SEQ ID NO: 1991371 - RNA, 16 nt, Human
auuuaaccucuaaauu

SEQ ID NO: 1991372 - RNA, 18 nt, Human
auuuaaccucuaaauucu

SEQ ID NO: 1991373 - RNA, 19 nt, Human
auuuaauuuuuuugagaca

SEQ ID NO: 1991374 - RNA, 23 nt, Human
auuuaauuuuuuugagacagagu

SEQ ID NO: 1991375 - RNA, 22 nt, Human
auuuacaacugggggaggguga

SEQ ID NO: 1991376 - RNA, 20 nt, Human
auuuacaacacuuuaauggg

SEQ ID NO: 1991377 - RNA, 16 nt, Human
auuuacaaaugggaaa

SEQ ID NO: 1991378 - RNA, 16 nt, Human
auuguaucugucuuuc

SEQ ID NO: 1991379 - RNA, 21 nt, Human
auuggcucuugaacugagcuu

SEQ ID NO: 1991380 - RNA, 23 nt, Human
auuggcuuuggguugcaggaccu

SEQ ID NO: 1991381 - RNA, 15 nt, Human
auugucuuaauggau

SEQ ID NO: 1991382 - RNA, 14 nt, Human
auugucuuaaugga

SEQ ID NO: 1991383 - RNA, 17 nt, Human
auugucuuaauggauga

SEQ ID NO: 1991384 - RNA, 19 nt, Human
auugucuuaauggaugaaa

SEQ ID NO: 1991385 - RNA, 21 nt, Human
auugucuuaauggaugaaauc

SEQ ID NO: 1991386 - RNA, 23 nt, Human
auugucuuaauggaugaaaucau

SEQ ID NO: 1991387 - RNA, 13 nt, Human
auugugccccugc

SEQ ID NO: 1991388 - RNA, 15 nt, Human
auugugaaauuauuc

SEQ ID NO: 1991389 - RNA, 14 nt, Human
auuguauuacaaau

SEQ ID NO: 1991390 - RNA, 15 nt, Human
auuguauuacaaauc

SEQ ID NO: 1991391 - RNA, 20 nt, Human
auuaccucuuuggaaaagga

SEQ ID NO: 1991392 - RNA, 12 nt, Human
auuaccagggac

SEQ ID NO: 1991393 - RNA, 15 nt, Human
auuaccaccaucccg

SEQ ID NO: 1991394 - RNA, 22 nt, Human
auuaccaccaucccgugcuuuu

SEQ ID NO: 1991395 - RNA, 22 nt, Human
auuaccugaauuuuggcugugu

SEQ ID NO: 1991396 - RNA, 19 nt, Human
auuaccacagacauacuaa

SEQ ID NO: 1991397 - RNA, 19 nt, Human
auuacauuuguaauuuaag

SEQ ID NO: 1991398 - RNA, 13 nt, Human
auuacauuuguaa

SEQ ID NO: 1991399 - RNA, 14 nt, Human
auuacauuuguaau

SEQ ID NO: 1991400 - RNA, 15 nt, Human
auuacauuuguaauu

SEQ ID NO: 1991401 - RNA, 18 nt, Human
auuacauuuguaauuuaa

SEQ ID NO: 1991402 - RNA, 12 nt, Human
auuaauauucau

SEQ ID NO: 1991403 - RNA, 14 nt, Human
uuuuuguuuuucug

SEQ ID NO: 1991404 - RNA, 16 nt, Human
uuuuuguuuuucugcu

SEQ ID NO: 1991405 - RNA, 18 nt, Human
uuuuuguuuuguugcacu

SEQ ID NO: 1991406 - RNA, 19 nt, Human
auuaaguaagucucaaggu

SEQ ID NO: 1991407 - RNA, 15 nt, Human
auuaagguguuugaa

SEQ ID NO: 1991408 - RNA, 17 nt, Human
auuaagguguuugaaaa

SEQ ID NO: 1991409 - RNA, 18 nt, Human
auuaagguguuugaaaau

SEQ ID NO: 1991410 - RNA, 20 nt, Human
auuaagguguuugaaaauag

SEQ ID NO: 1991411 - RNA, 20 nt, Human
auuaagagagucuauuuacg

SEQ ID NO: 1991412 - RNA, 16 nt, Human
auuaagaucucagugg

SEQ ID NO: 1991413 - RNA, 22 nt, Human
uuuuuguuccacaaguuaaaua

SEQ ID NO: 1991414 - RNA, 16 nt, Human
auuauauuuacaaaug

SEQ ID NO: 1991415 - RNA, 13 nt, Human
auuauaauguauu

SEQ ID NO: 1991416 - RNA, 14 nt, Human
auuauaauguauuc

SEQ ID NO: 1991417 - RNA, 19 nt, Human
auuauaauguauucauauu

SEQ ID NO: 1991418 - RNA, 21 nt, Human
auuauaauguauucauauuug

SEQ ID NO: 1991419 - RNA, 22 nt, Human
auuauaauguauucauauuugu

SEQ ID NO: 1991420 - RNA, 13 nt, Human
auuauaauuguug

SEQ ID NO: 1991421 - RNA, 15 nt, Human
auuauaauuguugca

SEQ ID NO: 1991422 - RNA, 16 nt, Human
auuauaauuguugcau

SEQ ID NO: 1991423 - RNA, 18 nt, Human
auuauaauuguugcauag

SEQ ID NO: 1991424 - RNA, 14 nt, Human
auuauagagcagaa

SEQ ID NO: 1991425 - RNA, 16 nt, Human
auuauagagcagaaau

SEQ ID NO: 1991426 - RNA, 17 nt, Human
auuauagagcagaaauu

SEQ ID NO: 1991427 - RNA, 19 nt, Human
auuauagagcagaaauucu

SEQ ID NO: 1991428 - RNA, 21 nt, Human
auuauagagcagaaauucugu

SEQ ID NO: 1991429 - RNA, 23 nt, Human
auuauagagcagaaauucuguuu

SEQ ID NO: 1991430 - RNA, 18 nt, Human
auuagaaaacuuuguuag

SEQ ID NO: 1991431 - RNA, 14 nt, Human
auuagaacccuugc

SEQ ID NO: 1991432 - RNA, 12 nt, Human
auuagaaaacuu

SEQ ID NO: 1991433 - RNA, 16 nt, Human
auuagaaaacuuuguu

SEQ ID NO: 1991434 - RNA, 17 nt, Human
auuagaaaacuuuguua

SEQ ID NO: 1991435 - RNA, 18 nt, Human
auuacuuguugccuauaa

SEQ ID NO: 1991436 - RNA, 18 nt, Human
auuauaaucaccagggcc

SEQ ID NO: 1991437 - RNA, 17 nt, Human
auuauauuuacaaaugg

SEQ ID NO: 1991438 - RNA, 21 nt, Human
auuaucaaguagacuacuguu

SEQ ID NO: 1991439 - RNA, 14 nt, Human
auuauguuuuacug

SEQ ID NO: 1991440 - RNA, 18 nt, Human
auuauuuuauguugcaua

SEQ ID NO: 1991441 - RNA, 14 nt, Human
auuauuuuaaaaga

SEQ ID NO: 1991442 - RNA, 16 nt, Human
auuauuuuauguugca

SEQ ID NO: 1991443 - RNA, 13 nt, Human
auuauuuuaaaag

SEQ ID NO: 1991444 - RNA, 23 nt, Human
auuauuuauuaaaugcccagccc

SEQ ID NO: 1991445 - RNA, 20 nt, Human
auuauucuuucuccuuuuuu

SEQ ID NO: 1991446 - RNA, 13 nt, Human
auuauucuuucuc

SEQ ID NO: 1991447 - RNA, 16 nt, Human
auuauucuuucuccuu

SEQ ID NO: 1991448 - RNA, 19 nt, Human
auuauugagagcccuagaa

SEQ ID NO: 1991449 - RNA, 16 nt, Human
auuauuaaugcuuugg

SEQ ID NO: 1991450 - RNA, 14 nt, Human
auuauuaaugcuuu

SEQ ID NO: 1991451 - RNA, 15 nt, Human
auuauuaaugcuuug

SEQ ID NO: 1991452 - RNA, 22 nt, Human
auucaggaagcucagggccugg

SEQ ID NO: 1991453 - RNA, 21 nt, Human
auucaggaagcucagggccug

SEQ ID NO: 1991454 - RNA, 18 nt, Human
auucagcucugcaagaau

SEQ ID NO: 1991455 - RNA, 14 nt, Human
auucagcucugcaa

SEQ ID NO: 1991456 - RNA, 16 nt, Human
auucaguuguuagugu

SEQ ID NO: 1991457 - RNA, 23 nt, Human
auucaggaagcucagggccuggc

SEQ ID NO: 1991458 - RNA, 21 nt, Human
auucaguuguuagugugucuu

SEQ ID NO: 1991459 - RNA, 14 nt, Human
auucagcucaugga

SEQ ID NO: 1991460 - RNA, 12 nt, Human
auucagccuucu

SEQ ID NO: 1991461 - RNA, 14 nt, Human
auucagccuucuuu

SEQ ID NO: 1991462 - RNA, 15 nt, Human
auucagccuucuuuu

SEQ ID NO: 1991463 - RNA, 16 nt, Human
auucagccuucuuuuu

SEQ ID NO: 1991464 - RNA, 17 nt, Human
auucagccuucuuuuuc

SEQ ID NO: 1991465 - RNA, 20 nt, Human
auucagccuucuuuuucugg

SEQ ID NO: 1991466 - RNA, 21 nt, Human
auucagccuucuuuuucugga

SEQ ID NO: 1991467 - RNA, 22 nt, Human
auucagccuucuuuuucuggac

SEQ ID NO: 1991468 - RNA, 16 nt, Human
auucaaaaugauguau

SEQ ID NO: 1991469 - RNA, 16 nt, Human
auuccccaggaggcca

SEQ ID NO: 1991470 - RNA, 20 nt, Human
auuccauuuacugcauucuu

SEQ ID NO: 1991471 - RNA, 20 nt, Human
auuccccagauugcaacagg

SEQ ID NO: 1991472 - RNA, 22 nt, Human
auuccccacccugaaagcccug

SEQ ID NO: 1991473 - RNA, 19 nt, Human
auucccuuguuauucaaca

SEQ ID NO: 1991474 - RNA, 16 nt, Human
auucccuuguuauuca

SEQ ID NO: 1991475 - RNA, 18 nt, Human
auucccuucaaugcaaaa

SEQ ID NO: 1991476 - RNA, 19 nt, Human
auuccccaggaggccagcc

SEQ ID NO: 1991477 - RNA, 13 nt, Human
auuccacagcugc

SEQ ID NO: 1991478 - RNA, 20 nt, Human
auuccacuuauaggaauuga

SEQ ID NO: 1991479 - RNA, 15 nt, Human
auuccaugaauguuc

SEQ ID NO: 1991480 - RNA, 21 nt, Human
uuuuauucagcucauggacuu

SEQ ID NO: 1991481 - RNA, 23 nt, Human
uuuuauguugacauuuguuuggu

SEQ ID NO: 1991482 - RNA, 19 nt, Human
uuuuauuauuaaugcuuug

SEQ ID NO: 1991483 - RNA, 18 nt, Human
uuuucagauuugcacaaa

SEQ ID NO: 1991484 - RNA, 19 nt, Human
uuuucagcuaggaacaaau

SEQ ID NO: 1991485 - RNA, 15 nt, Human
uuuucagauuugcac

SEQ ID NO: 1991486 - RNA, 17 nt, Human
uuuucagauuugcacaa

SEQ ID NO: 1991487 - RNA, 18 nt, Human
uuuucagauucaggcauu

SEQ ID NO: 1991488 - RNA, 13 nt, Human
uuuucagauuugc

SEQ ID NO: 1991489 - RNA, 14 nt, Human
uuuucagauuugca

SEQ ID NO: 1991490 - RNA, 14 nt, Human
uuuucagauucagg

SEQ ID NO: 1991491 - RNA, 21 nt, Human
uuuucauuagcaaaaaaaguu

SEQ ID NO: 1991492 - RNA, 22 nt, Human
uuuucauuagcaaaaaaaguug

SEQ ID NO: 1991493 - RNA, 23 nt, Human
uuuucauuagcaaaaaaaguugu

SEQ ID NO: 1991494 - RNA, 20 nt, Human
uuuucauuagcaaaaaaagu

SEQ ID NO: 1991495 - RNA, 18 nt, Human
uuuuccauauuuuuacaa

SEQ ID NO: 1991496 - RNA, 14 nt, Human
uuuuccaucuaaaa

SEQ ID NO: 1991497 - RNA, 15 nt, Human
uuuuccaucuaaaaa

SEQ ID NO: 1991498 - RNA, 16 nt, Human
uuuuccaucuaaaaau

SEQ ID NO: 1991499 - RNA, 19 nt, Human
uuuuccagguuuaagcugu

SEQ ID NO: 1991500 - RNA, 14 nt, Human
uuuuccaguauuuu

SEQ ID NO: 1991501 - RNA, 17 nt, Human
uuuuccaguauuuuagu

SEQ ID NO: 1991502 - RNA, 18 nt, Human
uuuuaugugaaacauguu

SEQ ID NO: 1991503 - RNA, 12 nt, Human
uuuuauguugac

SEQ ID NO: 1991504 - RNA, 13 nt, Human
uuuuauguugaca

SEQ ID NO: 1991505 - RNA, 19 nt, Human
uuuuaugugaaacauguuu

SEQ ID NO: 1991506 - RNA, 22 nt, Human
uuuuauguugcauagaauaaaa

SEQ ID NO: 1991507 - RNA, 15 nt, Human
uuuuauguugacauu

SEQ ID NO: 1991508 - RNA, 18 nt, Human
uuuuauguugacauuugu

SEQ ID NO: 1991509 - RNA, 15 nt, Human
uuuuauaagaaaacc

SEQ ID NO: 1991510 - RNA, 19 nt, Human
uuuuauaaggacuuccuga

SEQ ID NO: 1991511 - RNA, 20 nt, Human
uuuuauaaggacuuccugau

SEQ ID NO: 1991512 - RNA, 19 nt, Human
uuuuauaaacuuuaccuuu

SEQ ID NO: 1991513 - RNA, 14 nt, Human
uuuuauaaacuuua

SEQ ID NO: 1991514 - RNA, 17 nt, Human
uuuuauaaacuuuaccu

SEQ ID NO: 1991515 - RNA, 16 nt, Human
auguugaagccuuugu

SEQ ID NO: 1991516 - RNA, 15 nt, Human
auguugaagccuuug

SEQ ID NO: 1991517 - RNA, 19 nt, Human
auguucaucaaugaaugaa

SEQ ID NO: 1991518 - RNA, 21 nt, Human
auguucaucauccuaagcuau

SEQ ID NO: 1991519 - RNA, 14 nt, Human
auguuauauuuuuc

SEQ ID NO: 1991520 - RNA, 20 nt, Human
auguuauauuuuucuuaaaa

SEQ ID NO: 1991521 - RNA, 23 nt, Human
auguuauauuuuucuuaaaaagu

SEQ ID NO: 1991522 - RNA, 16 nt, Human
uuuuaagugcugcauu

SEQ ID NO: 1991523 - RNA, 17 nt, Human
uuuuaagugcugcauuu

SEQ ID NO: 1991524 - RNA, 21 nt, Human
uuuuaagugcugcauuuaaaa

SEQ ID NO: 1991525 - RNA, 14 nt, Human
uuuuaagugaaauu

SEQ ID NO: 1991526 - RNA, 15 nt, Human
uuuuaagugaaauuu

SEQ ID NO: 1991527 - RNA, 16 nt, Human
uuuuaagugaaauuua

SEQ ID NO: 1991528 - RNA, 14 nt, Human
auguuauagcugca

SEQ ID NO: 1991529 - RNA, 18 nt, Human
auguuaguuaguguagau

SEQ ID NO: 1991530 - RNA, 15 nt, Human
auguuaguuuuccuu

SEQ ID NO: 1991531 - RNA, 12 nt, Human
uuuuauaaacuu

SEQ ID NO: 1991532 - RNA, 13 nt, Human
uuuuauaaacuuu

SEQ ID NO: 1991533 - RNA, 19 nt, Human
uuuuaguugcaacuuugua

SEQ ID NO: 1991534 - RNA, 13 nt, Human
uuuuaguuuugcu

SEQ ID NO: 1991535 - RNA, 16 nt, Human
uuuuaguuuuucuguc

SEQ ID NO: 1991536 - RNA, 15 nt, Human
auguuggccaggcug

SEQ ID NO: 1991537 - RNA, 23 nt, Human
uuuuagaguugauacuacaguuu

SEQ ID NO: 1991538 - RNA, 19 nt, Human
uuuuagaugugcugcuuug

SEQ ID NO: 1991539 - RNA, 21 nt, Human
auguuggccaggcugcucuca

SEQ ID NO: 1991540 - RNA, 23 nt, Human
uuuuagcaaagcggguuauaaug

SEQ ID NO: 1991541 - RNA, 23 nt, Human
uuuuagcacagcguuaugugucu

SEQ ID NO: 1991542 - RNA, 13 nt, Human
auguuggccaggc

SEQ ID NO: 1991543 - RNA, 14 nt, Human
auguuggccaggcu

SEQ ID NO: 1991544 - RNA, 16 nt, Human
auguuggccaggcugg

SEQ ID NO: 1991545 - RNA, 16 nt, Human
auguuggccaggcugc

SEQ ID NO: 1991546 - RNA, 19 nt, Human
auguugacaucacuggcau

SEQ ID NO: 1991547 - RNA, 21 nt, Human
auguugacaucacuggcaugg

SEQ ID NO: 1991548 - RNA, 12 nt, Human
auguugacauuu

SEQ ID NO: 1991549 - RNA, 13 nt, Human
auguugacauuug

SEQ ID NO: 1991550 - RNA, 14 nt, Human
auguugacauuugu

SEQ ID NO: 1991551 - RNA, 16 nt, Human
auguugacauuuguuu

SEQ ID NO: 1991552 - RNA, 12 nt, Human
auguugauuucu

SEQ ID NO: 1991553 - RNA, 14 nt, Human
auguugaugcaauc

SEQ ID NO: 1991554 - RNA, 21 nt, Human
auguugaugcaauccuuacaa

SEQ ID NO: 1991555 - RNA, 22 nt, Human
auguugaugcaauccuuacaaa

SEQ ID NO: 1991556 - RNA, 13 nt, Human
auguugauuucua

SEQ ID NO: 1991557 - RNA, 15 nt, Human
auguugauuucuagu

SEQ ID NO: 1991558 - RNA, 11 nt, Human
auuaagaaaua

SEQ ID NO: 1991559 - RNA, 12 nt, Human
auuaagaaauag

SEQ ID NO: 1991560 - RNA, 14 nt, Human
auuaagaagaaaau

SEQ ID NO: 1991561 - RNA, 14 nt, Human
auuaagaagaaacu

SEQ ID NO: 1991562 - RNA, 14 nt, Human
auuaagaaagacua

SEQ ID NO: 1991563 - RNA, 13 nt, Human
auuaagaaagacu

SEQ ID NO: 1991564 - RNA, 23 nt, Human
auuaacuuuuauaaacuuuaccu

SEQ ID NO: 1991565 - RNA, 19 nt, Human
auuaacuuaauaaucaaga

SEQ ID NO: 1991566 - RNA, 19 nt, Human
auuaacuuacccuguauau

SEQ ID NO: 1991567 - RNA, 20 nt, Human
auuaacuuggaugaguuuug

SEQ ID NO: 1991568 - RNA, 16 nt, Human
auuaacuuuuauaaac

SEQ ID NO: 1991569 - RNA, 17 nt, Human
auuaacuuuuauaaacu

SEQ ID NO: 1991570 - RNA, 19 nt, Human
auuaacuuuuauaaacuuu

SEQ ID NO: 1991571 - RNA, 20 nt, Human
auuaacuuuuauaaacuuua

SEQ ID NO: 1991572 - RNA, 12 nt, Human
auuaacuuuuau

SEQ ID NO: 1991573 - RNA, 16 nt, Human
auuaacuuaauaauca

SEQ ID NO: 1991574 - RNA, 14 nt, Human
auuaacuuaauaau

SEQ ID NO: 1991575 - RNA, 17 nt, Human
auuaacugcuuccuaua

SEQ ID NO: 1991576 - RNA, 17 nt, Human
auuaaacuuaaucuaaa

SEQ ID NO: 1991577 - RNA, 16 nt, Human
auuaaacuuaaucuaa

SEQ ID NO: 1991578 - RNA, 19 nt, Human
auuaaacuuaaucuaaaug

SEQ ID NO: 1991579 - RNA, 21 nt, Human
auuaaacuuaaucuaaaugga

SEQ ID NO: 1991580 - RNA, 17 nt, Human
auuaaccacuucagcug

SEQ ID NO: 1991581 - RNA, 20 nt, Human
auuaaccacuucagcugacu

SEQ ID NO: 1991582 - RNA, 18 nt, Human
auuaaccacuucagcuga

SEQ ID NO: 1991583 - RNA, 15 nt, Human
auuaaccaagguaga

SEQ ID NO: 1991584 - RNA, 17 nt, Human
auguuuuucuucucccu

SEQ ID NO: 1991585 - RNA, 18 nt, Human
auguuuuuguacucugca

SEQ ID NO: 1991586 - RNA, 21 nt, Human
auguuuuugaaggcagaaagc

SEQ ID NO: 1991587 - RNA, 15 nt, Human
auguuuuugaaggca

SEQ ID NO: 1991588 - RNA, 19 nt, Human
auguuuuugaaggcagaaa

SEQ ID NO: 1991589 - RNA, 18 nt, Human
auguuuuucuucucccuc

SEQ ID NO: 1991590 - RNA, 12 nt, Human
auguuuuugaag

SEQ ID NO: 1991591 - RNA, 14 nt, Human
auguuuuugaaggc

SEQ ID NO: 1991592 - RNA, 13 nt, Human
auuaaaauauaau

SEQ ID NO: 1991593 - RNA, 13 nt, Human
auuaaaagcaggc

SEQ ID NO: 1991594 - RNA, 18 nt, Human
auuaaaauauaaucucua

SEQ ID NO: 1991595 - RNA, 12 nt, Human
auuaaaauaugc

SEQ ID NO: 1991596 - RNA, 13 nt, Human
auuaaaauaugca

SEQ ID NO: 1991597 - RNA, 14 nt, Human
auuaaaauaugcac

SEQ ID NO: 1991598 - RNA, 18 nt, Human
auuaaaauaugcacuaag

SEQ ID NO: 1991599 - RNA, 20 nt, Human
auuaaaauaugcacuaaguc

SEQ ID NO: 1991600 - RNA, 13 nt, Human
auuaaaaagucuu

SEQ ID NO: 1991601 - RNA, 12 nt, Human
auuaaaaagucu

SEQ ID NO: 1991602 - RNA, 17 nt, Human
auuaaaaauaucaaauu

SEQ ID NO: 1991603 - RNA, 14 nt, Human
auuaaaaagucuuu

SEQ ID NO: 1991604 - RNA, 15 nt, Human
auuaaaaagucuuuu

SEQ ID NO: 1991605 - RNA, 18 nt, Human
auuaaaaagucuuuuaaa

SEQ ID NO: 1991606 - RNA, 23 nt, Human
auuaaaaagucuuuuaaaaagua

SEQ ID NO: 1991607 - RNA, 12 nt, Human
auguugugaaua

SEQ ID NO: 1991608 - RNA, 15 nt, Human
auguugugaauaauu

SEQ ID NO: 1991609 - RNA, 17 nt, Human
auguugugaauaauuac

SEQ ID NO: 1991610 - RNA, 19 nt, Human
auguugugaauaauuacag

SEQ ID NO: 1991611 - RNA, 14 nt, Human
auguuuuccaugag

SEQ ID NO: 1991612 - RNA, 15 nt, Human
auguuuacagaggac

SEQ ID NO: 1991613 - RNA, 17 nt, Human
auguuuacagaggacag

SEQ ID NO: 1991614 - RNA, 19 nt, Human
auguuuacagaggacagua

SEQ ID NO: 1991615 - RNA, 23 nt, Human
auguccaagaagcccaggaaagg

SEQ ID NO: 1991616 - RNA, 15 nt, Human
augucaguuguuauu

SEQ ID NO: 1991617 - RNA, 17 nt, Human
augucaguuguuauuua

SEQ ID NO: 1991618 - RNA, 18 nt, Human
auguccaagaagcccagg

SEQ ID NO: 1991619 - RNA, 19 nt, Human
auguccaagaagcccagga

SEQ ID NO: 1991620 - RNA, 16 nt, Human
augucagugugacuga

SEQ ID NO: 1991621 - RNA, 15 nt, Human
augucagugugacug

SEQ ID NO: 1991622 - RNA, 14 nt, Human
augucaguaugugg

SEQ ID NO: 1991623 - RNA, 21 nt, Human
augucagugugacugaucucu

SEQ ID NO: 1991624 - RNA, 22 nt, Human
augucuauaaaccgaacugaug

SEQ ID NO: 1991625 - RNA, 16 nt, Human
auguccacugguucuu

SEQ ID NO: 1991626 - RNA, 21 nt, Human
auguccaguaagaucacuguu

SEQ ID NO: 1991627 - RNA, 20 nt, Human
augucccaacuuguaaaaau

SEQ ID NO: 1991628 - RNA, 24 nt, Human
augucccuaccgagucucuucucc

SEQ ID NO: 1991629 - RNA, 14 nt, Human
augucccagaaaug

SEQ ID NO: 1991630 - RNA, 23 nt, Human
augucaggggcggggagggugac

SEQ ID NO: 1991631 - RNA, 13 nt, Human
augucaguaugug

SEQ ID NO: 1991632 - RNA, 12 nt, Human
auguauguguaa

SEQ ID NO: 1991633 - RNA, 14 nt, Human
auguaugugcauuu

SEQ ID NO: 1991634 - RNA, 21 nt, Human
augucagcaguugcugguaaa

SEQ ID NO: 1991635 - RNA, 22 nt, Human
augucagcaguugcugguaaaa

SEQ ID NO: 1991636 - RNA, 20 nt, Human
auguaugcuucauacaggga

SEQ ID NO: 1991637 - RNA, 17 nt, Human
auguaugcuucauacag

SEQ ID NO: 1991638 - RNA, 16 nt, Human
auguaucugaaaguca

SEQ ID NO: 1991639 - RNA, 15 nt, Human
auguaucugagcagg

SEQ ID NO: 1991640 - RNA, 15 nt, Human
auguaucaaugagua

SEQ ID NO: 1991641 - RNA, 14 nt, Human
auguaguucauacu

SEQ ID NO: 1991642 - RNA, 14 nt, Human
auguaguuugagga

SEQ ID NO: 1991643 - RNA, 15 nt, Human
auguaguuugaggaa

SEQ ID NO: 1991644 - RNA, 19 nt, Human
auguaguuugaggaaauuu

SEQ ID NO: 1991645 - RNA, 20 nt, Human
auguaguuugaggaaauuug

SEQ ID NO: 1991646 - RNA, 23 nt, Human
auguaguuugaggaaauuugcag

SEQ ID NO: 1991647 - RNA, 24 nt, Human
auguaguuugaggaaauuugcagc

SEQ ID NO: 1991648 - RNA, 22 nt, Human
uuugggggaaaauuuagaaaua

SEQ ID NO: 1991649 - RNA, 23 nt, Human
uuugcucagugucuggcugcaga

SEQ ID NO: 1991650 - RNA, 19 nt, Human
uuugcuaugagcuggggau

SEQ ID NO: 1991651 - RNA, 21 nt, Human
uuugcuaaguaaaucucuucu

SEQ ID NO: 1991652 - RNA, 23 nt, Human
uuugcuaaguaaaucucuucugu

SEQ ID NO: 1991653 - RNA, 13 nt, Human
uuugcccuuuacu

SEQ ID NO: 1991654 - RNA, 23 nt, Human
uuugcccuuuacuugucuuucug

SEQ ID NO: 1991655 - RNA, 22 nt, Human
uuugcccccaaacccccauucu

SEQ ID NO: 1991656 - RNA, 23 nt, Human
uuugcccccaaacccccauucug

SEQ ID NO: 1991657 - RNA, 22 nt, Human
uuugccauguuggccaggcugg

SEQ ID NO: 1991658 - RNA, 12 nt, Human
uuugcacaaaaa

SEQ ID NO: 1991659 - RNA, 17 nt, Human
uuugcacaaaaagauac

SEQ ID NO: 1991660 - RNA, 22 nt, Human
uuuggccugaugaccaauuuua

SEQ ID NO: 1991661 - RNA, 17 nt, Human
uuugggaaguuaaaggg

SEQ ID NO: 1991662 - RNA, 21 nt, Human
uuugggaaguuaaagggaaga

SEQ ID NO: 1991663 - RNA, 22 nt, Human
uuugggaggccaaggugggagg

SEQ ID NO: 1991664 - RNA, 14 nt, Human
uuuggggauauuuu

SEQ ID NO: 1991665 - RNA, 19 nt, Human
uuuggggauucagauuucu

SEQ ID NO: 1991666 - RNA, 19 nt, Human
uuugugaggaagccgcugg

SEQ ID NO: 1991667 - RNA, 18 nt, Human
uuugugaggaagccgcug

SEQ ID NO: 1991668 - RNA, 16 nt, Human
uuugugaguuuguuuc

SEQ ID NO: 1991669 - RNA, 15 nt, Human
uuugugaguuuguuu

SEQ ID NO: 1991670 - RNA, 12 nt, Human
uuuguuugaacu

SEQ ID NO: 1991671 - RNA, 17 nt, Human
uuuguuucuuucucuga

SEQ ID NO: 1991672 - RNA, 22 nt, Human
uuuguuucuuugaauuuucauu

SEQ ID NO: 1991673 - RNA, 13 nt, Human
uuuguuugaacug

SEQ ID NO: 1991674 - RNA, 14 nt, Human
uuuguuugaacuga

SEQ ID NO: 1991675 - RNA, 17 nt, Human
uuuguagaagucacauu

SEQ ID NO: 1991676 - RNA, 17 nt, Human
uuuguacuuucuguuaa

SEQ ID NO: 1991677 - RNA, 18 nt, Human
uuuguacuuucuguuaaa

SEQ ID NO: 1991678 - RNA, 16 nt, Human
uuugugagcaggcugu

SEQ ID NO: 1991679 - RNA, 12 nt, Human
uuugucucuucu

SEQ ID NO: 1991680 - RNA, 12 nt, Human
uuugucuccucu

SEQ ID NO: 1991681 - RNA, 14 nt, Human
uuugucucuucugg

SEQ ID NO: 1991682 - RNA, 19 nt, Human
uuugucugccccaaguuuu

SEQ ID NO: 1991683 - RNA, 21 nt, Human
uuugucugccccaaguuuugu

SEQ ID NO: 1991684 - RNA, 13 nt, Human
uuugucuaagaaa

SEQ ID NO: 1991685 - RNA, 16 nt, Human
uuugucuaagaaacau

SEQ ID NO: 1991686 - RNA, 20 nt, Human
uuugucuaagaaacauugga

SEQ ID NO: 1991687 - RNA, 12 nt, Human
uuugucucagau

SEQ ID NO: 1991688 - RNA, 22 nt, Human
uuuguaacuguuuagaugaaug

SEQ ID NO: 1991689 - RNA, 23 nt, Human
uuuguaacuguuuagaugaaugu

SEQ ID NO: 1991690 - RNA, 17 nt, Human
uuuguaaauuuauguga

SEQ ID NO: 1991691 - RNA, 19 nt, Human
uuuguaaauucugauuucu

SEQ ID NO: 1991692 - RNA, 20 nt, Human
uuuguaaauucugauuucuu

SEQ ID NO: 1991693 - RNA, 13 nt, Human
uuuguaaauuguc

SEQ ID NO: 1991694 - RNA, 12 nt, Human
uuuguaaauucu

SEQ ID NO: 1991695 - RNA, 15 nt, Human
uuuguaaauucugau

SEQ ID NO: 1991696 - RNA, 16 nt, Human
uuuguaaauucugauu

SEQ ID NO: 1991697 - RNA, 13 nt, Human
uuuguagagccag

SEQ ID NO: 1991698 - RNA, 12 nt, Human
uuuguacuuucu

SEQ ID NO: 1991699 - RNA, 15 nt, Human
uuuguacuuucuguu

SEQ ID NO: 1991700 - RNA, 16 nt, Human
uuuguacuuucuguua

SEQ ID NO: 1991701 - RNA, 20 nt, Human
uuuguacaugccauugaaaa

SEQ ID NO: 1991702 - RNA, 14 nt, Human
uuuguaccauuuca

SEQ ID NO: 1991703 - RNA, 20 nt, Human
uuuguacgacgucagauguu

SEQ ID NO: 1991704 - RNA, 15 nt, Human
uuuuaagugcugcau

SEQ ID NO: 1991705 - RNA, 16 nt, Human
uuuuaaguaaggaauu

SEQ ID NO: 1991706 - RNA, 23 nt, Human
uuuuaaggguuuguggaaaauga

SEQ ID NO: 1991707 - RNA, 15 nt, Human
uuuuaaggacugacu

SEQ ID NO: 1991708 - RNA, 21 nt, Human
uuuuaagcuaggaaaagaaau

SEQ ID NO: 1991709 - RNA, 20 nt, Human
uuuuaaggguuuguggaaaa

SEQ ID NO: 1991710 - RNA, 16 nt, Human
uuuuaaggacugacug

SEQ ID NO: 1991711 - RNA, 19 nt, Human
uuuuaaggacugacugagg

SEQ ID NO: 1991712 - RNA, 22 nt, Human
uuuuaaggacugacugaggcag

SEQ ID NO: 1991713 - RNA, 19 nt, Human
uuuuaagccuuuguugaac

SEQ ID NO: 1991714 - RNA, 20 nt, Human
uuuuaagccuuuguugaacu

SEQ ID NO: 1991715 - RNA, 17 nt, Human
uuuuaacuuagagcuuu

SEQ ID NO: 1991716 - RNA, 18 nt, Human
uuuuaacuuagagcuuuu

SEQ ID NO: 1991717 - RNA, 14 nt, Human
uuuuaagaaagaaa

SEQ ID NO: 1991718 - RNA, 16 nt, Human
uuuuaagaggcagggu

SEQ ID NO: 1991719 - RNA, 15 nt, Human
uuuuaagaggcaggg

SEQ ID NO: 1991720 - RNA, 18 nt, Human
uuuuaagaaagaaauacu

SEQ ID NO: 1991721 - RNA, 22 nt, Human
uuuuaagaaagaaauacuguau

SEQ ID NO: 1991722 - RNA, 22 nt, Human
uuuguuugguuauagugcaaua

SEQ ID NO: 1991723 - RNA, 18 nt, Human
uuuguuugaacugauaaa

SEQ ID NO: 1991724 - RNA, 11 nt, Human
uuuuaaaaaca

SEQ ID NO: 1991725 - RNA, 11 nt, Human
uuuuaaaaagu

SEQ ID NO: 1991726 - RNA, 14 nt, Human
uuuuaaaaaguauu

SEQ ID NO: 1991727 - RNA, 18 nt, Human
uuuuaaaaaguauugcca

SEQ ID NO: 1991728 - RNA, 20 nt, Human
uuuuaaaaaguauugccaaa

SEQ ID NO: 1991729 - RNA, 21 nt, Human
uuuuaaaaaguauugccaaac

SEQ ID NO: 1991730 - RNA, 13 nt, Human
uuuguuuguucuu

SEQ ID NO: 1991731 - RNA, 14 nt, Human
uuuuaaaaaacuuu

SEQ ID NO: 1991732 - RNA, 16 nt, Human
uuuguuuguucuuguu

SEQ ID NO: 1991733 - RNA, 16 nt, Human
uuuuaaaacacuucca

SEQ ID NO: 1991734 - RNA, 22 nt, Human
uuuuaaaacacuuccauaaucu

SEQ ID NO: 1991735 - RNA, 14 nt, Human
uuuuaaaacuacuu

SEQ ID NO: 1991736 - RNA, 15 nt, Human
uuuuaaaacuacuua

SEQ ID NO: 1991737 - RNA, 18 nt, Human
uuuuaaaacuacuuagca

SEQ ID NO: 1991738 - RNA, 20 nt, Human
uuuuaaaacuacuuagcacu

SEQ ID NO: 1991739 - RNA, 20 nt, Human
uuaguuuagaacagguuuuu

SEQ ID NO: 1991740 - RNA, 22 nt, Human
uuaguuugcaguuacacuaaaa

SEQ ID NO: 1991741 - RNA, 15 nt, Human
uuaguuucuccaagc

SEQ ID NO: 1991742 - RNA, 21 nt, Human
uuaggugugacugaauuucuu

SEQ ID NO: 1991743 - RNA, 16 nt, Human
uuaggugaggaagcaa

SEQ ID NO: 1991744 - RNA, 16 nt, Human
uuaggugugacugaau

SEQ ID NO: 1991745 - RNA, 20 nt, Human
uuagggaaggauacaaaagc

SEQ ID NO: 1991746 - RNA, 16 nt, Human
uuagcgacaacagauu

SEQ ID NO: 1991747 - RNA, 23 nt, Human
uuagcgacaacagauuggauuuu

SEQ ID NO: 1991748 - RNA, 18 nt, Human
uuagcaaauucuguuuuu

SEQ ID NO: 1991749 - RNA, 12 nt, Human
uuagcaccaggg

SEQ ID NO: 1991750 - RNA, 18 nt, Human
uuagauuuuguguuuauu

SEQ ID NO: 1991751 - RNA, 22 nt, Human
uuagauuuuguguuuauucuug

SEQ ID NO: 1991752 - RNA, 23 nt, Human
uuagauuuuguguuuauucuuga

SEQ ID NO: 1991753 - RNA, 14 nt, Human
uuagcaaaaaaagu

SEQ ID NO: 1991754 - RNA, 16 nt, Human
uuagcaaaaaaaguug

SEQ ID NO: 1991755 - RNA, 18 nt, Human
auaauuuaccugaagucu

SEQ ID NO: 1991756 - RNA, 17 nt, Human
auaauugugugauauuu

SEQ ID NO: 1991757 - RNA, 18 nt, Human
auaauugugugauauuuc

SEQ ID NO: 1991758 - RNA, 19 nt, Human
auaauugugugauauuuca

SEQ ID NO: 1991759 - RNA, 21 nt, Human
auaauugugugauauuucaga

SEQ ID NO: 1991760 - RNA, 14 nt, Human
auaauuguugcaua

SEQ ID NO: 1991761 - RNA, 22 nt, Human
auaauugugugauauuucagaa

SEQ ID NO: 1991762 - RNA, 23 nt, Human
auaauugugugauauuucagaaa

SEQ ID NO: 1991763 - RNA, 18 nt, Human
uuagccaagugugguaga

SEQ ID NO: 1991764 - RNA, 11 nt, Human
uuagcacagcg

SEQ ID NO: 1991765 - RNA, 17 nt, Human
uuagcaucuaauuucaa

SEQ ID NO: 1991766 - RNA, 16 nt, Human
uuagccuuugucccag

SEQ ID NO: 1991767 - RNA, 14 nt, Human
uuagcggagacgga

SEQ ID NO: 1991768 - RNA, 15 nt, Human
uuagcgacaacagau

SEQ ID NO: 1991769 - RNA, 22 nt, Human
auaauugacaggauuauuggaa

SEQ ID NO: 1991770 - RNA, 14 nt, Human
auaauucuuuuuua

SEQ ID NO: 1991771 - RNA, 17 nt, Human
auaauucuuuuuuauua

SEQ ID NO: 1991772 - RNA, 19 nt, Human
auaauucuuuuuuauuaau

SEQ ID NO: 1991773 - RNA, 21 nt, Human
auaauucuuuuuuauuaauca

SEQ ID NO: 1991774 - RNA, 22 nt, Human
auaauucuuuuuuauuaaucac

SEQ ID NO: 1991775 - RNA, 14 nt, Human
auaauugugugaua

SEQ ID NO: 1991776 - RNA, 15 nt, Human
auaaugaaugaaaca

SEQ ID NO: 1991777 - RNA, 12 nt, Human
auaaugaaugac

SEQ ID NO: 1991778 - RNA, 15 nt, Human
auaaugcgugcauac

SEQ ID NO: 1991779 - RNA, 18 nt, Human
auaauccugcaaaguaca

SEQ ID NO: 1991780 - RNA, 18 nt, Human
auaaucuggacuccucug

SEQ ID NO: 1991781 - RNA, 19 nt, Human
auaaucuggacuccucugu

SEQ ID NO: 1991782 - RNA, 20 nt, Human
auaaucuggacuccucuguc

SEQ ID NO: 1991783 - RNA, 18 nt, Human
auaauccuaaacauauga

SEQ ID NO: 1991784 - RNA, 14 nt, Human
auaauccugcaaag

SEQ ID NO: 1991785 - RNA, 15 nt, Human
auaauccugcaaagu

SEQ ID NO: 1991786 - RNA, 18 nt, Human
auaauagauugugaauaa

SEQ ID NO: 1991787 - RNA, 19 nt, Human
auaauagucaccugcuguu

SEQ ID NO: 1991788 - RNA, 13 nt, Human
auaauacugaacc

SEQ ID NO: 1991789 - RNA, 14 nt, Human
auaauacugaacca

SEQ ID NO: 1991790 - RNA, 20 nt, Human
auaauacugaaccacuugua

SEQ ID NO: 1991791 - RNA, 15 nt, Human
auaauacugaaccac

SEQ ID NO: 1991792 - RNA, 16 nt, Human
auaauacugaaccacu

SEQ ID NO: 1991793 - RNA, 14 nt, Human
auaauacacaaaau

SEQ ID NO: 1991794 - RNA, 17 nt, Human
auaauacacaaaaucaa

SEQ ID NO: 1991795 - RNA, 22 nt, Human
auaauacacaaaaucaaauaau

SEQ ID NO: 1991796 - RNA, 15 nt, Human
auaauaccuuagaag

SEQ ID NO: 1991797 - RNA, 19 nt, Human
auaauacuugcuuuggaaa

SEQ ID NO: 1991798 - RNA, 18 nt, Human
auaauacaccacuacauu

SEQ ID NO: 1991799 - RNA, 20 nt, Human
auaauacaccacuacauucu

SEQ ID NO: 1991800 - RNA, 12 nt, Human
auaauacaccac

SEQ ID NO: 1991801 - RNA, 13 nt, Human
uuagaacagguuu

SEQ ID NO: 1991802 - RNA, 14 nt, Human
uuagaacagguuuu

SEQ ID NO: 1991803 - RNA, 20 nt, Human
auaagaauagaacaacauau

SEQ ID NO: 1991804 - RNA, 23 nt, Human
auaauaaagaauagcuuuaauga

SEQ ID NO: 1991805 - RNA, 13 nt, Human
auaauaaagaaua

SEQ ID NO: 1991806 - RNA, 14 nt, Human
auaauaaagaauag

SEQ ID NO: 1991807 - RNA, 11 nt, Human
auaauaaauag

SEQ ID NO: 1991808 - RNA, 12 nt, Human
auaauaaauagu

SEQ ID NO: 1991809 - RNA, 13 nt, Human
auaauaaauaguu

SEQ ID NO: 1991810 - RNA, 13 nt, Human
uuagaaacuggaa

SEQ ID NO: 1991811 - RNA, 19 nt, Human
uuagaaacuggaaauacua

SEQ ID NO: 1991812 - RNA, 23 nt, Human
uuagaaacuggaaauacuagauu

SEQ ID NO: 1991813 - RNA, 14 nt, Human
uuacucuugggaca

SEQ ID NO: 1991814 - RNA, 22 nt, Human
uuagaaacacauaauuaacacu

SEQ ID NO: 1991815 - RNA, 12 nt, Human
uuagaaacugga

SEQ ID NO: 1991816 - RNA, 23 nt, Human
uuacucuucaguuaagccuuugg

SEQ ID NO: 1991817 - RNA, 12 nt, Human
uuacucuuggga

SEQ ID NO: 1991818 - RNA, 18 nt, Human
uuaccuugaacugaaggc

SEQ ID NO: 1991819 - RNA, 16 nt, Human
uuaccuugucauuuug

SEQ ID NO: 1991820 - RNA, 20 nt, Human
uuaccuugucauuuuggucu

SEQ ID NO: 1991821 - RNA, 13 nt, Human
uuagacagagucu

SEQ ID NO: 1991822 - RNA, 13 nt, Human
uuagacagucccu

SEQ ID NO: 1991823 - RNA, 20 nt, Human
uuagacagagucucacuguu

SEQ ID NO: 1991824 - RNA, 17 nt, Human
uuagaaauugcauuucc

SEQ ID NO: 1991825 - RNA, 17 nt, Human
uuacccuauaucuauaa

SEQ ID NO: 1991826 - RNA, 21 nt, Human
uuaccucccuacuuucuuaga

SEQ ID NO: 1991827 - RNA, 20 nt, Human
uuaccuuugacaaagguaaa

SEQ ID NO: 1991828 - RNA, 13 nt, Human
uuaccuuugacaa

SEQ ID NO: 1991829 - RNA, 19 nt, Human
uuacccucauguucuuaau

SEQ ID NO: 1991830 - RNA, 16 nt, Human
uuacaggcuccugcca

SEQ ID NO: 1991831 - RNA, 18 nt, Human
uuacaggcuccugccacc

SEQ ID NO: 1991832 - RNA, 24 nt, Human
uuacaggcgugagccaccgugccu

SEQ ID NO: 1991833 - RNA, 15 nt, Human
auaacuuauauugua

SEQ ID NO: 1991834 - RNA, 20 nt, Human
auaacuuauauuguaagaaa

SEQ ID NO: 1991835 - RNA, 11 nt, Human
auaaauuauuu

SEQ ID NO: 1991836 - RNA, 20 nt, Human
auaaauccacccauguuauc

SEQ ID NO: 1991837 - RNA, 18 nt, Human
auaaauccacccauguua

SEQ ID NO: 1991838 - RNA, 14 nt, Human
auaacguauaaaag

SEQ ID NO: 1991839 - RNA, 22 nt, Human
auaacgauaaaagacagugaaa

SEQ ID NO: 1991840 - RNA, 15 nt, Human
auaaagguucaugca

SEQ ID NO: 1991841 - RNA, 21 nt, Human
uuaauugugugaacuuggaag

SEQ ID NO: 1991842 - RNA, 19 nt, Human
auaaaggugugcugugucc

SEQ ID NO: 1991843 - RNA, 13 nt, Human
uuaauuguauuuu

SEQ ID NO: 1991844 - RNA, 16 nt, Human
uuaauugugugaacuu

SEQ ID NO: 1991845 - RNA, 17 nt, Human
auaaagguucaugcaaa

SEQ ID NO: 1991846 - RNA, 13 nt, Human
auaaauaaaaaua

SEQ ID NO: 1991847 - RNA, 15 nt, Human
auaaauaguuuauga

SEQ ID NO: 1991848 - RNA, 15 nt, Human
auaaauaguguuauu

SEQ ID NO: 1991849 - RNA, 14 nt, Human
auaaauaaaaauaa

SEQ ID NO: 1991850 - RNA, 19 nt, Human
uuaacagaaauguacagca

SEQ ID NO: 1991851 - RNA, 15 nt, Human
uuaacacuacucaaa

SEQ ID NO: 1991852 - RNA, 20 nt, Human
uuaacagaaauguacagcaa

SEQ ID NO: 1991853 - RNA, 17 nt, Human
uuaacacuacucaaagc

SEQ ID NO: 1991854 - RNA, 13 nt, Human
uuaaauaauguga

SEQ ID NO: 1991855 - RNA, 16 nt, Human
uuaaauaaugugaaac

SEQ ID NO: 1991856 - RNA, 18 nt, Human
uuaaauaaugugaaacug

SEQ ID NO: 1991857 - RNA, 15 nt, Human
uuaaauaaugugaaa

SEQ ID NO: 1991858 - RNA, 16 nt, Human
uuaaaguaauuguucc

SEQ ID NO: 1991859 - RNA, 20 nt, Human
uuaaaguaauuguuccagag

SEQ ID NO: 1991860 - RNA, 22 nt, Human
uuaaaguaauuguuccagagac

SEQ ID NO: 1991861 - RNA, 16 nt, Human
uuaaacaauaaagcaa

SEQ ID NO: 1991862 - RNA, 13 nt, Human
uuaaacagaggau

SEQ ID NO: 1991863 - RNA, 14 nt, Human
uuaaaaaucucaaa

SEQ ID NO: 1991864 - RNA, 15 nt, Human
uuaaaaaucucaaau

SEQ ID NO: 1991865 - RNA, 16 nt, Human
uuaaaaaucucaaauu

SEQ ID NO: 1991866 - RNA, 17 nt, Human
uuaaaaaucucaaauuu

SEQ ID NO: 1991867 - RNA, 23 nt, Human
aguuuaauugaaagaauguaaag

SEQ ID NO: 1991868 - RNA, 17 nt, Human
uuaaaaaaaacucuuua

SEQ ID NO: 1991869 - RNA, 21 nt, Human
uuaaaaaaaacucuuuaacuu

SEQ ID NO: 1991870 - RNA, 19 nt, Human
uuaaaaaaaauuugcucau

SEQ ID NO: 1991871 - RNA, 13 nt, Human
uuaaaaaaaaucc

SEQ ID NO: 1991872 - RNA, 13 nt, Human
aguuggucccccu

SEQ ID NO: 1991873 - RNA, 11 nt, Human
aguuggucccc

SEQ ID NO: 1991874 - RNA, 17 nt, Human
aguuggucccccuucca

SEQ ID NO: 1991875 - RNA, 20 nt, Human
aguuuaaauauuaagcauga

SEQ ID NO: 1991876 - RNA, 18 nt, Human
aguuuaaauauuaagcau

SEQ ID NO: 1991877 - RNA, 14 nt, Human
aguuuaaauuguaa

SEQ ID NO: 1991878 - RNA, 23 nt, Human
aguugccagucaccccggccacc

SEQ ID NO: 1991879 - RNA, 15 nt, Human
aguugcugguaaaau

SEQ ID NO: 1991880 - RNA, 17 nt, Human
aguugcugguaaaauga

SEQ ID NO: 1991881 - RNA, 18 nt, Human
aguugcugguaaaaugaa

SEQ ID NO: 1991882 - RNA, 21 nt, Human
aguugcugguaaaaugaagaa

SEQ ID NO: 1991883 - RNA, 19 nt, Human
aguugcccagccucuuucc

SEQ ID NO: 1991884 - RNA, 22 nt, Human
aguugccgcauauuauaucaga

SEQ ID NO: 1991885 - RNA, 14 nt, Human
aguugcccagccuc

SEQ ID NO: 1991886 - RNA, 16 nt, Human
aguuggggcagaggag

SEQ ID NO: 1991887 - RNA, 19 nt, Human
aguugggcuuccucauagu

SEQ ID NO: 1991888 - RNA, 23 nt, Human
aguuggaguucauucauauuaca

SEQ ID NO: 1991889 - RNA, 20 nt, Human
aguuggaguucauucauauu

SEQ ID NO: 1991890 - RNA, 21 nt, Human
aguuggaguucauucauauua

SEQ ID NO: 1991891 - RNA, 13 nt, Human
aguugggcuuccu

SEQ ID NO: 1991892 - RNA, 16 nt, Human
aguuggaguagaaugu

SEQ ID NO: 1991893 - RNA, 23 nt, Human
aguuggaaacacuaaauguuaaa

SEQ ID NO: 1991894 - RNA, 17 nt, Human
aguuggaguagaaugua

SEQ ID NO: 1991895 - RNA, 19 nt, Human
aguuggaguucauucauau

SEQ ID NO: 1991896 - RNA, 13 nt, Human
aguuggaaacacu

SEQ ID NO: 1991897 - RNA, 21 nt, Human
aguugcugucagucuugaccu

SEQ ID NO: 1991898 - RNA, 23 nt, Human
aguugcugucagucuugaccucu

SEQ ID NO: 1991899 - RNA, 19 nt, Human
aguuggaaacacuaaaugu

SEQ ID NO: 1991900 - RNA, 20 nt, Human
aguuggaaacacuaaauguu

SEQ ID NO: 1991901 - RNA, 21 nt, Human
aguuggaaacacuaaauguua

SEQ ID NO: 1991902 - RNA, 22 nt, Human
aguuggaaacacuaaauguuaa

SEQ ID NO: 1991903 - RNA, 15 nt, Human
uuaagugcugcauuu

SEQ ID NO: 1991904 - RNA, 16 nt, Human
uuaagugcugcauuua

SEQ ID NO: 1991905 - RNA, 19 nt, Human
uuaagugcugcauuuaaaa

SEQ ID NO: 1991906 - RNA, 14 nt, Human
uuaagugcugcauu

SEQ ID NO: 1991907 - RNA, 20 nt, Human
uuaaguccuacuuuuaaaga

SEQ ID NO: 1991908 - RNA, 13 nt, Human
uuaaggucuguuu

SEQ ID NO: 1991909 - RNA, 22 nt, Human
uuaagguguuugaaaauaguuu

SEQ ID NO: 1991910 - RNA, 14 nt, Human
uuaagguguuugaa

SEQ ID NO: 1991911 - RNA, 16 nt, Human
uuaagguguuugaaaa

SEQ ID NO: 1991912 - RNA, 17 nt, Human
uuaagguguuugaaaau

SEQ ID NO: 1991913 - RNA, 13 nt, Human
uuaaggguaugau

SEQ ID NO: 1991914 - RNA, 9 nt, Human
uuaaggugg

SEQ ID NO: 1991915 - RNA, 22 nt, Human
uuaagaaagacuaucuaaaugu

SEQ ID NO: 1991916 - RNA, 22 nt, Human
uuaagaaauagacagcaugaga

SEQ ID NO: 1991917 - RNA, 20 nt, Human
uuaagaaagaaauacuguau

SEQ ID NO: 1991918 - RNA, 12 nt, Human
uuaagaaauaaa

SEQ ID NO: 1991919 - RNA, 16 nt, Human
uuaagaacuaaaaugu

SEQ ID NO: 1991920 - RNA, 19 nt, Human
uuaagaacuaaaauguucu

SEQ ID NO: 1991921 - RNA, 20 nt, Human
uuaagaacuaaaauguucua

SEQ ID NO: 1991922 - RNA, 13 nt, Human
uuaagaagaaaau

SEQ ID NO: 1991923 - RNA, 13 nt, Human
uuaagaagaaacu

SEQ ID NO: 1991924 - RNA, 22 nt, Human
uuaaucauuaggugugacugaa

SEQ ID NO: 1991925 - RNA, 23 nt, Human
uuaaucauuaggugugacugaau

SEQ ID NO: 1991926 - RNA, 21 nt, Human
uuaaucugggccagaauuuca

SEQ ID NO: 1991927 - RNA, 17 nt, Human
uuaaucucuaacagugg

SEQ ID NO: 1991928 - RNA, 19 nt, Human
uuaauauuuuuacaugcag

SEQ ID NO: 1991929 - RNA, 17 nt, Human
uuaauauuuuuacaugc

SEQ ID NO: 1991930 - RNA, 13 nt, Human
uuaaucauuaggu

SEQ ID NO: 1991931 - RNA, 22 nt, Human
uuaauauuuauaggucacuuug

SEQ ID NO: 1991932 - RNA, 12 nt, Human
uuaauugcugag

SEQ ID NO: 1991933 - RNA, 17 nt, Human
uuaauugauagaauaaa

SEQ ID NO: 1991934 - RNA, 16 nt, Human
uuaauugaucaguuuu

SEQ ID NO: 1991935 - RNA, 16 nt, Human
uuaauugaaagaaugu

SEQ ID NO: 1991936 - RNA, 20 nt, Human
uuaauugaaagaauguaaag

SEQ ID NO: 1991937 - RNA, 19 nt, Human
uuaaugaaagacuguacaa

SEQ ID NO: 1991938 - RNA, 22 nt, Human
uuaaucugguuuauuuuuguuc

SEQ ID NO: 1991939 - RNA, 18 nt, Human
uuaaucucuaacagugga

SEQ ID NO: 1991940 - RNA, 18 nt, Human
uuaaugaaagacuguaca

SEQ ID NO: 1991941 - RNA, 23 nt, Human
aguuuuuauggcuuuugugcauu

SEQ ID NO: 1991942 - RNA, 15 nt, Human
aguuuugugaaauuu

SEQ ID NO: 1991943 - RNA, 12 nt, Human
aguuuugugaaa

SEQ ID NO: 1991944 - RNA, 13 nt, Human
aguuuugugaaau

SEQ ID NO: 1991945 - RNA, 14 nt, Human
aguuuugugaaauu

SEQ ID NO: 1991946 - RNA, 19 nt, Human
aguuuugacaagcuggcuu

SEQ ID NO: 1991947 - RNA, 21 nt, Human
aguuuugcuuuuaguuuuucu

SEQ ID NO: 1991948 - RNA, 17 nt, Human
aguuuugcauaguucua

SEQ ID NO: 1991949 - RNA, 23 nt, Human
aguuuugcuuuuaguuuuucugu

SEQ ID NO: 1991950 - RNA, 16 nt, Human
aguuuugggaaguuaa

SEQ ID NO: 1991951 - RNA, 19 nt, Human
aguuuugggaaguuaaagg

SEQ ID NO: 1991952 - RNA, 20 nt, Human
aguuuugggaaguuaaaggg

SEQ ID NO: 1991953 - RNA, 16 nt, Human
aguuuucuuuuaauuu

SEQ ID NO: 1991954 - RNA, 17 nt, Human
aguuuucuuuuaauuuu

SEQ ID NO: 1991955 - RNA, 17 nt, Human
aguuuugaagauucuau

SEQ ID NO: 1991956 - RNA, 18 nt, Human
aguuuugaagauucuaug

SEQ ID NO: 1991957 - RNA, 14 nt, Human
aguuuugacaagcu

SEQ ID NO: 1991958 - RNA, 15 nt, Human
aguuuugacaagcug

SEQ ID NO: 1991959 - RNA, 18 nt, Human
aguuuugacaagcuggcu

SEQ ID NO: 1991960 - RNA, 18 nt, Human
auaaaagccuguuuaaga

SEQ ID NO: 1991961 - RNA, 16 nt, Human
auaaaagcccaggagc

SEQ ID NO: 1991962 - RNA, 13 nt, Human
auaaaagcccagg

SEQ ID NO: 1991963 - RNA, 15 nt, Human
auaaaagcccaggag

SEQ ID NO: 1991964 - RNA, 13 nt, Human
auaaaagccuguu

SEQ ID NO: 1991965 - RNA, 21 nt, Human
uuaagaaaaaggaugcacaga

SEQ ID NO: 1991966 - RNA, 20 nt, Human
uuaagaaaaaggaugcacag

SEQ ID NO: 1991967 - RNA, 19 nt, Human
uuaagaaaaaggaugcaca

SEQ ID NO: 1991968 - RNA, 16 nt, Human
agugugggucugugug

SEQ ID NO: 1991969 - RNA, 17 nt, Human
agugugggucugugugu

SEQ ID NO: 1991970 - RNA, 15 nt, Human
agugugggucugugu

SEQ ID NO: 1991971 - RNA, 20 nt, Human
aguggagccugacagccaga

SEQ ID NO: 1991972 - RNA, 17 nt, Human
aguggagguuuauaguu

SEQ ID NO: 1991973 - RNA, 19 nt, Human
aguggagccugacagccag

SEQ ID NO: 1991974 - RNA, 16 nt, Human
agugcuuuucuguuua

SEQ ID NO: 1991975 - RNA, 20 nt, Human
uguuauuauagagcagaaau

SEQ ID NO: 1991976 - RNA, 21 nt, Human
uguuauuauagagcagaaauu

SEQ ID NO: 1991977 - RNA, 22 nt, Human
uguuauuauagagcagaaauuc

SEQ ID NO: 1991978 - RNA, 16 nt, Human
uguuauucaacagcaa

SEQ ID NO: 1991979 - RNA, 13 nt, Human
uguuauucuuugc

SEQ ID NO: 1991980 - RNA, 14 nt, Human
uguuauucuuugca

SEQ ID NO: 1991981 - RNA, 16 nt, Human
uguuauucuuugcacu

SEQ ID NO: 1991982 - RNA, 20 nt, Human
uguuauugagagagaugugu

SEQ ID NO: 1991983 - RNA, 19 nt, Human
agugugggucugugugugu

SEQ ID NO: 1991984 - RNA, 23 nt, Human
agugugggucuguguguguguau

SEQ ID NO: 1991985 - RNA, 13 nt, Human
uguuauaugaaca

SEQ ID NO: 1991986 - RNA, 14 nt, Human
uguuauaugaacau

SEQ ID NO: 1991987 - RNA, 13 nt, Human
uguuaucauuuuu

SEQ ID NO: 1991988 - RNA, 18 nt, Human
uguuaucauuuuuuccug

SEQ ID NO: 1991989 - RNA, 16 nt, Human
uguuauauuuuucuua

SEQ ID NO: 1991990 - RNA, 18 nt, Human
uguuauauuuuucuuaaa

SEQ ID NO: 1991991 - RNA, 14 nt, Human
uguuauauuuuucu

SEQ ID NO: 1991992 - RNA, 15 nt, Human
uguuauaugaacaua

SEQ ID NO: 1991993 - RNA, 10 nt, Human
uguucuucca

SEQ ID NO: 1991994 - RNA, 11 nt, Human
uguucuuccaa

SEQ ID NO: 1991995 - RNA, 16 nt, Human
uguucuuccaaagcag

SEQ ID NO: 1991996 - RNA, 18 nt, Human
uguucuuaguuugcaguu

SEQ ID NO: 1991997 - RNA, 21 nt, Human
uguucuuccaguuacuuucca

SEQ ID NO: 1991998 - RNA, 22 nt, Human
uguucuuccaguuacuuuccaa

SEQ ID NO: 1991999 - RNA, 17 nt, Human
uguucuuccaaagcaga

SEQ ID NO: 1992000 - RNA, 20 nt, Human
uguucuuccaaagcagagag

SEQ ID NO: 1992001 - RNA, 11 nt, Human
uguucuuccag

SEQ ID NO: 1992002 - RNA, 13 nt, Human
uguucuuccaguu

SEQ ID NO: 1992003 - RNA, 12 nt, Human
uguucuuccugg

SEQ ID NO: 1992004 - RNA, 18 nt, Human
uguucuagcauggcugcc

SEQ ID NO: 1992005 - RNA, 19 nt, Human
uguuauuuauugaaaugau

SEQ ID NO: 1992006 - RNA, 13 nt, Human
uguuauuuauuga

SEQ ID NO: 1992007 - RNA, 15 nt, Human
uguuauuuauugaaa

SEQ ID NO: 1992008 - RNA, 17 nt, Human
uguuauuuauugaaaug

SEQ ID NO: 1992009 - RNA, 18 nt, Human
uguuauuuauugaaauga

SEQ ID NO: 1992010 - RNA, 14 nt, Human
aguuacuuuuccuu

SEQ ID NO: 1992011 - RNA, 17 nt, Human
aguuacuuuuccuugca

SEQ ID NO: 1992012 - RNA, 18 nt, Human
aguuacuuuuccuugcau

SEQ ID NO: 1992013 - RNA, 20 nt, Human
aguuacuuuuccuugcauac

SEQ ID NO: 1992014 - RNA, 13 nt, Human
aguuacuugauaa

SEQ ID NO: 1992015 - RNA, 21 nt, Human
aguuacuuuccaauucuccuu

SEQ ID NO: 1992016 - RNA, 22 nt, Human
aguuacuuuccaauucuccuuu

SEQ ID NO: 1992017 - RNA, 23 nt, Human
aguuacuuuccaauucuccuuua

SEQ ID NO: 1992018 - RNA, 21 nt, Human
aguuacuuuuccuugcauaca

SEQ ID NO: 1992019 - RNA, 23 nt, Human
aguuacuuuuccuugcauacaaa

SEQ ID NO: 1992020 - RNA, 15 nt, Human
aguuacuguaaaaug

SEQ ID NO: 1992021 - RNA, 16 nt, Human
aguuacuguaaaaugc

SEQ ID NO: 1992022 - RNA, 21 nt, Human
aguuacucuucaguuaagccu

SEQ ID NO: 1992023 - RNA, 20 nt, Human
aguguuauugagagagaugu

SEQ ID NO: 1992024 - RNA, 15 nt, Human
aguguucagaaaaaa

SEQ ID NO: 1992025 - RNA, 22 nt, Human
uguucuugguuuguaaauuaac

SEQ ID NO: 1992026 - RNA, 14 nt, Human
uguucuuguuuuua

SEQ ID NO: 1992027 - RNA, 18 nt, Human
uguucuuguuuuuaaguu

SEQ ID NO: 1992028 - RNA, 20 nt, Human
uguucuugguuuguaaauua

SEQ ID NO: 1992029 - RNA, 19 nt, Human
uguucuuucacccuuuucu

SEQ ID NO: 1992030 - RNA, 13 nt, Human
uguugcccaggcu

SEQ ID NO: 1992031 - RNA, 15 nt, Human
uguugcccaggcugg

SEQ ID NO: 1992032 - RNA, 19 nt, Human
aguguguguuuuucauaaa

SEQ ID NO: 1992033 - RNA, 19 nt, Human
uguugcccaggcuggagug

SEQ ID NO: 1992034 - RNA, 20 nt, Human
uguugcccaggcuggagugc

SEQ ID NO: 1992035 - RNA, 14 nt, Human
aguguuaugagcca

SEQ ID NO: 1992036 - RNA, 13 nt, Human
aguguuauaugaa

SEQ ID NO: 1992037 - RNA, 14 nt, Human
aguguuauaugaac

SEQ ID NO: 1992038 - RNA, 15 nt, Human
aguguuauaugaaca

SEQ ID NO: 1992039 - RNA, 16 nt, Human
aguguuauaugaacau

SEQ ID NO: 1992040 - RNA, 20 nt, Human
aguguuauaugaacauacaa

SEQ ID NO: 1992041 - RNA, 20 nt, Human
aguucggugagcuacaaaug

SEQ ID NO: 1992042 - RNA, 19 nt, Human
aguucggugagcuacaaau

SEQ ID NO: 1992043 - RNA, 20 nt, Human
aguuccuauaacacugugaa

SEQ ID NO: 1992044 - RNA, 23 nt, Human
aguucuacuucauguaauccaaa

SEQ ID NO: 1992045 - RNA, 14 nt, Human
aguucuaccggcuu

SEQ ID NO: 1992046 - RNA, 18 nt, Human
aguucuagugcagcugaa

SEQ ID NO: 1992047 - RNA, 22 nt, Human
aguucuagugcagcugaaauug

SEQ ID NO: 1992048 - RNA, 23 nt, Human
aguucuagugcagcugaaauuga

SEQ ID NO: 1992049 - RNA, 23 nt, Human
aguuccucauuagcauuuugcua

SEQ ID NO: 1992050 - RNA, 15 nt, Human
aguucccuacuuccu

SEQ ID NO: 1992051 - RNA, 22 nt, Human
aguuccccuggaagcagugccc

SEQ ID NO: 1992052 - RNA, 23 nt, Human
aguuccccuggaagcagugccca

SEQ ID NO: 1992053 - RNA, 24 nt, Human
aguuccccuggaagcagugcccag

SEQ ID NO: 1992054 - RNA, 16 nt, Human
aguucccauucuuuca

SEQ ID NO: 1992055 - RNA, 20 nt, Human
aguucccaucuccuuucucu

SEQ ID NO: 1992056 - RNA, 17 nt, Human
aguucaagaaaugaaga

SEQ ID NO: 1992057 - RNA, 18 nt, Human
aguucaagaaaugaagag

SEQ ID NO: 1992058 - RNA, 15 nt, Human
aguucaagaucaaaa

SEQ ID NO: 1992059 - RNA, 20 nt, Human
aguucaagaucaaaaaggcu

SEQ ID NO: 1992060 - RNA, 14 nt, Human
aguuauauuuccua

SEQ ID NO: 1992061 - RNA, 16 nt, Human
aguucaauucucauuu

SEQ ID NO: 1992062 - RNA, 24 nt, Human
aguucaaucuggauucauauuuaa

SEQ ID NO: 1992063 - RNA, 22 nt, Human
uguuuaucuagauguaaauuuu

SEQ ID NO: 1992064 - RNA, 13 nt, Human
uguuuauucaaac

SEQ ID NO: 1992065 - RNA, 16 nt, Human
uguuuauucaaacuga

SEQ ID NO: 1992066 - RNA, 11 nt, Human
uguuuauguaa

SEQ ID NO: 1992067 - RNA, 15 nt, Human
uguuuauguaaacaa

SEQ ID NO: 1992068 - RNA, 20 nt, Human
uguuuauguaaacaaaucuu

SEQ ID NO: 1992069 - RNA, 14 nt, Human
uguuuauugucaaa

SEQ ID NO: 1992070 - RNA, 18 nt, Human
uguuuauucaaacugaaa

SEQ ID NO: 1992071 - RNA, 21 nt, Human
uguuuauucaaacugaaaagc

SEQ ID NO: 1992072 - RNA, 21 nt, Human
uguuuauucuugaugaaaagc

SEQ ID NO: 1992073 - RNA, 13 nt, Human
uguuuauucuuga

SEQ ID NO: 1992074 - RNA, 14 nt, Human
uguuuauucuugau

SEQ ID NO: 1992075 - RNA, 17 nt, Human
uguuuaguaaucauauu

SEQ ID NO: 1992076 - RNA, 14 nt, Human
uguuuaguaaucau

SEQ ID NO: 1992077 - RNA, 20 nt, Human
uguuuagauuuuguguuuau

SEQ ID NO: 1992078 - RNA, 22 nt, Human
uguuuagcuacguuuacucaca

SEQ ID NO: 1992079 - RNA, 13 nt, Human
uguuuaguaauca

SEQ ID NO: 1992080 - RNA, 20 nt, Human
uguuuaucccuuaagaauga

SEQ ID NO: 1992081 - RNA, 16 nt, Human
uguuuaucuagaugua

SEQ ID NO: 1992082 - RNA, 17 nt, Human
uguuuaucuagauguaa

SEQ ID NO: 1992083 - RNA, 18 nt, Human
uguuuaucuagauguaaa

SEQ ID NO: 1992084 - RNA, 20 nt, Human
uguuuaucuagauguaaauu

SEQ ID NO: 1992085 - RNA, 13 nt, Human
uguugucugcaac

SEQ ID NO: 1992086 - RNA, 16 nt, Human
uguugucugcaacucu

SEQ ID NO: 1992087 - RNA, 15 nt, Human
uguugugaauaauua

SEQ ID NO: 1992088 - RNA, 17 nt, Human
uguugugaauaauuaca

SEQ ID NO: 1992089 - RNA, 19 nt, Human
uguugugaauaauuacagu

SEQ ID NO: 1992090 - RNA, 20 nt, Human
uguugugaauaauuacagug

SEQ ID NO: 1992091 - RNA, 16 nt, Human
uguuggggcucuuccu

SEQ ID NO: 1992092 - RNA, 15 nt, Human
uguugucucuucucc

SEQ ID NO: 1992093 - RNA, 17 nt, Human
uguugucucuucuccuu

SEQ ID NO: 1992094 - RNA, 13 nt, Human
uguugucucuucu

SEQ ID NO: 1992095 - RNA, 14 nt, Human
uguuguguguggga

SEQ ID NO: 1992096 - RNA, 15 nt, Human
uguugugugugggag

SEQ ID NO: 1992097 - RNA, 14 nt, Human
uguugugugccucu

SEQ ID NO: 1992098 - RNA, 16 nt, Human
uguugugugugggagu

SEQ ID NO: 1992099 - RNA, 15 nt, Human
uguugugugccucua

SEQ ID NO: 1992100 - RNA, 21 nt, Human
uguugugugccucuagcugaa

SEQ ID NO: 1992101 - RNA, 20 nt, Human
uguuuagauaauacaccacu

SEQ ID NO: 1992102 - RNA, 15 nt, Human
uguuuagaugaaugu

SEQ ID NO: 1992103 - RNA, 20 nt, Human
uguuuagaugaaugucaguu

SEQ ID NO: 1992104 - RNA, 12 nt, Human
uguuuagauuug

SEQ ID NO: 1992105 - RNA, 17 nt, Human
uguuuagauuugccaua

SEQ ID NO: 1992106 - RNA, 15 nt, Human
uguuuagauuuugug

SEQ ID NO: 1992107 - RNA, 17 nt, Human
uguuuagauuuuguguu

SEQ ID NO: 1992108 - RNA, 22 nt, Human
uguggagacugcuccugagccc

SEQ ID NO: 1992109 - RNA, 23 nt, Human
uguggagacugcuccugagcccc

SEQ ID NO: 1992110 - RNA, 15 nt, Human
ugugcugcccugccc

SEQ ID NO: 1992111 - RNA, 13 nt, Human
uguggagacugcu

SEQ ID NO: 1992112 - RNA, 15 nt, Human
uguggagacugcucc

SEQ ID NO: 1992113 - RNA, 18 nt, Human
uguggagacugcuccuga

SEQ ID NO: 1992114 - RNA, 14 nt, Human
ugugcugcccugcc

SEQ ID NO: 1992115 - RNA, 13 nt, Human
ugugcugcccugc

SEQ ID NO: 1992116 - RNA, 16 nt, Human
ugugcucuggacaggc

SEQ ID NO: 1992117 - RNA, 18 nt, Human
ugugcucuggacaggcau

SEQ ID NO: 1992118 - RNA, 18 nt, Human
ugugccucuagcugaauu

SEQ ID NO: 1992119 - RNA, 20 nt, Human
ugugccucuagcugaauuga

SEQ ID NO: 1992120 - RNA, 19 nt, Human
ugugcucuggacaggcaug

SEQ ID NO: 1992121 - RNA, 20 nt, Human
ugugcccuaaaguguauuuu

SEQ ID NO: 1992122 - RNA, 21 nt, Human
ugugcccuaaaguguauuuuu

SEQ ID NO: 1992123 - RNA, 21 nt, Human
agucucacuguugcccaggcu

SEQ ID NO: 1992124 - RNA, 23 nt, Human
agucucaccauuuccccagggca

SEQ ID NO: 1992125 - RNA, 20 nt, Human
agucucacuguugcccaggc

SEQ ID NO: 1992126 - RNA, 18 nt, Human
agucucacuguugcccag

SEQ ID NO: 1992127 - RNA, 19 nt, Human
agucucacuguugcccagg

SEQ ID NO: 1992128 - RNA, 12 nt, Human
ugugccucugcc

SEQ ID NO: 1992129 - RNA, 13 nt, Human
ugugccucugccu

SEQ ID NO: 1992130 - RNA, 14 nt, Human
ugugccucuagcug

SEQ ID NO: 1992131 - RNA, 15 nt, Human
ugugccucuagcuga

SEQ ID NO: 1992132 - RNA, 16 nt, Human
ugugccucuagcugaa

SEQ ID NO: 1992133 - RNA, 22 nt, Human
ugugcucugaucauccacugug

SEQ ID NO: 1992134 - RNA, 12 nt, Human
ugugcucugauc

SEQ ID NO: 1992135 - RNA, 23 nt, Human
ugugcucugaucauccacugugc

SEQ ID NO: 1992136 - RNA, 15 nt, Human
ugugcucuggacagg

SEQ ID NO: 1992137 - RNA, 16 nt, Human
agugcagcugaaauug

SEQ ID NO: 1992138 - RNA, 17 nt, Human
agugcagcugaaauuga

SEQ ID NO: 1992139 - RNA, 20 nt, Human
agugcaccugggacagggag

SEQ ID NO: 1992140 - RNA, 12 nt, Human
agugcaggccca

SEQ ID NO: 1992141 - RNA, 13 nt, Human
agugcaggcccac

SEQ ID NO: 1992142 - RNA, 15 nt, Human
agugcaggcccaccc

SEQ ID NO: 1992143 - RNA, 17 nt, Human
agugcaggcccacccug

SEQ ID NO: 1992144 - RNA, 18 nt, Human
agugcaggcccacccugc

SEQ ID NO: 1992145 - RNA, 19 nt, Human
agugcaggcccacccugcu

SEQ ID NO: 1992146 - RNA, 15 nt, Human
agugcaucucagccc

SEQ ID NO: 1992147 - RNA, 14 nt, Human
agugcaucucagcc

SEQ ID NO: 1992148 - RNA, 16 nt, Human
agugcaucucagccca

SEQ ID NO: 1992149 - RNA, 17 nt, Human
agugcaucucagcccac

SEQ ID NO: 1992150 - RNA, 16 nt, Human
agugccaaaaacaaca

SEQ ID NO: 1992151 - RNA, 13 nt, Human
agugcccaggugg

SEQ ID NO: 1992152 - RNA, 14 nt, Human
agugcccacaggau

SEQ ID NO: 1992153 - RNA, 16 nt, Human
agugagucgaggacag

SEQ ID NO: 1992154 - RNA, 22 nt, Human
agugauucuccugccucagccu

SEQ ID NO: 1992155 - RNA, 24 nt, Human
agugauucuccugccucagccucc

SEQ ID NO: 1992156 - RNA, 15 nt, Human
agugcaauauauuuu

SEQ ID NO: 1992157 - RNA, 16 nt, Human
agugcaauauauuuug

SEQ ID NO: 1992158 - RNA, 21 nt, Human
agugcaauauauuuuguaugc

SEQ ID NO: 1992159 - RNA, 13 nt, Human
uguguguguguau

SEQ ID NO: 1992160 - RNA, 16 nt, Human
uguguguguguaugug

SEQ ID NO: 1992161 - RNA, 14 nt, Human
uguguguuacaaug

SEQ ID NO: 1992162 - RNA, 14 nt, Human
uguguuaugaagca

SEQ ID NO: 1992163 - RNA, 14 nt, Human
uguguuauuauaga

SEQ ID NO: 1992164 - RNA, 19 nt, Human
uguguucacuaaacucuga

SEQ ID NO: 1992165 - RNA, 20 nt, Human
uguguucacuaaacucugaa

SEQ ID NO: 1992166 - RNA, 20 nt, Human
uguguuccaaacaugagguu

SEQ ID NO: 1992167 - RNA, 15 nt, Human
uguguuccaaccacu

SEQ ID NO: 1992168 - RNA, 16 nt, Human
uguguuccaaccacug

SEQ ID NO: 1992169 - RNA, 16 nt, Human
ugugucucuugguccu

SEQ ID NO: 1992170 - RNA, 11 nt, Human
ugugugugugc

SEQ ID NO: 1992171 - RNA, 13 nt, Human
ugugucucuuggu

SEQ ID NO: 1992172 - RNA, 20 nt, Human
ugugucagguggggcagcuu

SEQ ID NO: 1992173 - RNA, 17 nt, Human
ugugucagguggggcag

SEQ ID NO: 1992174 - RNA, 19 nt, Human
ugugucagguggggcagcu

SEQ ID NO: 1992175 - RNA, 19 nt, Human
aguggaaaaauagccugcc

SEQ ID NO: 1992176 - RNA, 18 nt, Human
aguggaaaaauagccugc

SEQ ID NO: 1992177 - RNA, 11 nt, Human
aguggaaaaau

SEQ ID NO: 1992178 - RNA, 19 nt, Human
uguuaaugauagcuacugu

SEQ ID NO: 1992179 - RNA, 18 nt, Human
uguguugccacuuuccaa

SEQ ID NO: 1992180 - RNA, 15 nt, Human
uguguugcuuauguu

SEQ ID NO: 1992181 - RNA, 17 nt, Human
uguguugcuuauguugu

SEQ ID NO: 1992182 - RNA, 21 nt, Human
uguuaacauggacaugaucuu

SEQ ID NO: 1992183 - RNA, 13 nt, Human
uguggucuccacu

SEQ ID NO: 1992184 - RNA, 12 nt, Human
ugugguuucauu

SEQ ID NO: 1992185 - RNA, 19 nt, Human
ugugucagcauagaaguaa

SEQ ID NO: 1992186 - RNA, 16 nt, Human
agugcuuccaaggaug

SEQ ID NO: 1992187 - RNA, 22 nt, Human
agugcugcauuuaaaagauaca

SEQ ID NO: 1992188 - RNA, 20 nt, Human
agugcugggauuacaagcgu

SEQ ID NO: 1992189 - RNA, 20 nt, Human
agugcugggauuacaggcau

SEQ ID NO: 1992190 - RNA, 20 nt, Human
agugcugggauuacaggcgu

SEQ ID NO: 1992191 - RNA, 19 nt, Human
agugcugggauuacaggug

SEQ ID NO: 1992192 - RNA, 21 nt, Human
agugccuguaaucacagcuac

SEQ ID NO: 1992193 - RNA, 15 nt, Human
agugccuuacacaau

SEQ ID NO: 1992194 - RNA, 17 nt, Human
agugccuuacacaaugg

SEQ ID NO: 1992195 - RNA, 20 nt, Human
agugcugcauuuaaaagaua

SEQ ID NO: 1992196 - RNA, 14 nt, Human
agugccuaaaauaa

SEQ ID NO: 1992197 - RNA, 19 nt, Human
agugccuaaaauaagaaua

SEQ ID NO: 1992198 - RNA, 16 nt, Human
agugccgcaucucaca

SEQ ID NO: 1992199 - RNA, 18 nt, Human
agugccgcaucucacagc

SEQ ID NO: 1992200 - RNA, 19 nt, Human
agugccgcaucucacagcu

SEQ ID NO: 1992201 - RNA, 23 nt, Human
agugccgcaucucacagcuaugc

SEQ ID NO: 1992202 - RNA, 14 nt, Human
aguauaaagaauag

SEQ ID NO: 1992203 - RNA, 14 nt, Human
aguaguuugcauuu

SEQ ID NO: 1992204 - RNA, 15 nt, Human
aguaguuugcauuuc

SEQ ID NO: 1992205 - RNA, 16 nt, Human
aguaguuugcauuuca

SEQ ID NO: 1992206 - RNA, 18 nt, Human
aguaguuugcauuucaga

SEQ ID NO: 1992207 - RNA, 20 nt, Human
aguaguuugcauuucagaaa

SEQ ID NO: 1992208 - RNA, 15 nt, Human
aguauguggaagugu

SEQ ID NO: 1992209 - RNA, 17 nt, Human
aguauguggaagugugg

SEQ ID NO: 1992210 - RNA, 19 nt, Human
aguauguggaagugugggu

SEQ ID NO: 1992211 - RNA, 22 nt, Human
aguauuugaaaacagaaauugg

SEQ ID NO: 1992212 - RNA, 20 nt, Human
aguauuugaaaacagaaauu

SEQ ID NO: 1992213 - RNA, 21 nt, Human
aguauuugaaaacagaaauug

SEQ ID NO: 1992214 - RNA, 19 nt, Human
aguauuucuaaaguaauug

SEQ ID NO: 1992215 - RNA, 12 nt, Human
aguauuugaaaa

SEQ ID NO: 1992216 - RNA, 13 nt, Human
aguauuugaaaac

SEQ ID NO: 1992217 - RNA, 17 nt, Human
aguauuugaaaacagaa

SEQ ID NO: 1992218 - RNA, 18 nt, Human
aguauuugaaaacagaaa

SEQ ID NO: 1992219 - RNA, 19 nt, Human
agucacauuccugaacagg

SEQ ID NO: 1992220 - RNA, 18 nt, Human
agucacauuccugaacag

SEQ ID NO: 1992221 - RNA, 20 nt, Human
agucacauuccugaacagga

SEQ ID NO: 1992222 - RNA, 16 nt, Human
aguauuuggaauuaga

SEQ ID NO: 1992223 - RNA, 13 nt, Human
agucaccaagccc

SEQ ID NO: 1992224 - RNA, 14 nt, Human
agucaccaagccca

SEQ ID NO: 1992225 - RNA, 16 nt, Human
ugucagcugaaccugg

SEQ ID NO: 1992226 - RNA, 13 nt, Human
agucacugcacag

SEQ ID NO: 1992227 - RNA, 20 nt, Human
agucacugcacguuuucauc

SEQ ID NO: 1992228 - RNA, 21 nt, Human
agucacugcacguuuucaucu

SEQ ID NO: 1992229 - RNA, 18 nt, Human
agucacugagacagcccg

SEQ ID NO: 1992230 - RNA, 18 nt, Human
agucacugcaaaaccagg

SEQ ID NO: 1992231 - RNA, 19 nt, Human
agucacugagacagcccgg

SEQ ID NO: 1992232 - RNA, 19 nt, Human
ugucagcugaaccugggua

SEQ ID NO: 1992233 - RNA, 19 nt, Human
ugucaggaaaacacccagg

SEQ ID NO: 1992234 - RNA, 22 nt, Human
ugucaggggcggggagggugac

SEQ ID NO: 1992235 - RNA, 19 nt, Human
ugucagggcaguacaaugu

SEQ ID NO: 1992236 - RNA, 16 nt, Human
ugucagguggggcagc

SEQ ID NO: 1992237 - RNA, 11 nt, Human
ugucaggaggc

SEQ ID NO: 1992238 - RNA, 19 nt, Human
ugucaguauguggaagugu

SEQ ID NO: 1992239 - RNA, 20 nt, Human
ugucaguauguggaagugug

SEQ ID NO: 1992240 - RNA, 18 nt, Human
ugucaguauguggaagug

SEQ ID NO: 1992241 - RNA, 14 nt, Human
ugucaguauccagg

SEQ ID NO: 1992242 - RNA, 22 nt, Human
ugucaguauguggaaguguggg

SEQ ID NO: 1992243 - RNA, 15 nt, Human
ugucaguauccaggc

SEQ ID NO: 1992244 - RNA, 23 nt, Human
ugucauuugcuggagcucugccc

SEQ ID NO: 1992245 - RNA, 19 nt, Human
aguagugaagacuccagaa

SEQ ID NO: 1992246 - RNA, 14 nt, Human
aguaguguuacaug

SEQ ID NO: 1992247 - RNA, 18 nt, Human
aguagugaagacuccaga

SEQ ID NO: 1992248 - RNA, 17 nt, Human
aguaguguuacauguau

SEQ ID NO: 1992249 - RNA, 13 nt, Human
aguaguucuguau

SEQ ID NO: 1992250 - RNA, 14 nt, Human
aguaguucuguauu

SEQ ID NO: 1992251 - RNA, 15 nt, Human
aguaguucuguauuu

SEQ ID NO: 1992252 - RNA, 16 nt, Human
aguaguucuguauuug

SEQ ID NO: 1992253 - RNA, 17 nt, Human
aguaguucuguauuuga

SEQ ID NO: 1992254 - RNA, 18 nt, Human
aguaguucuguauuugaa

SEQ ID NO: 1992255 - RNA, 21 nt, Human
aguaguucuguauuugaaagu

SEQ ID NO: 1992256 - RNA, 13 nt, Human
aguaguuugcauu

SEQ ID NO: 1992257 - RNA, 19 nt, Human
aguaggggaagaauaauuu

SEQ ID NO: 1992258 - RNA, 15 nt, Human
aguaggcaagauggc

SEQ ID NO: 1992259 - RNA, 20 nt, Human
aguaggauaugccugcucuu

SEQ ID NO: 1992260 - RNA, 22 nt, Human
aguaggauaugccugcucuuug

SEQ ID NO: 1992261 - RNA, 23 nt, Human
aguaggacaaggugcaggcaggc

SEQ ID NO: 1992262 - RNA, 17 nt, Human
aguagcuuaagaaaaaa

SEQ ID NO: 1992263 - RNA, 20 nt, Human
aguagcuuugcacuuuucua

SEQ ID NO: 1992264 - RNA, 22 nt, Human
aguaggacaaggugcaggcagg

SEQ ID NO: 1992265 - RNA, 19 nt, Human
aguagggguaccacugaau

SEQ ID NO: 1992266 - RNA, 20 nt, Human
aguagggguaccacugaauc

SEQ ID NO: 1992267 - RNA, 21 nt, Human
aguagucucugugaggccuua

SEQ ID NO: 1992268 - RNA, 16 nt, Human
aguaggaagacuuugg

SEQ ID NO: 1992269 - RNA, 16 nt, Human
aguagcuuaagaaaaa

SEQ ID NO: 1992270 - RNA, 22 nt, Human
aguaggaagacuuuggaaagac

SEQ ID NO: 1992271 - RNA, 19 nt, Human
aguaggaagacuuuggaaa

SEQ ID NO: 1992272 - RNA, 18 nt, Human
aguaggaagacuuuggaa

SEQ ID NO: 1992273 - RNA, 17 nt, Human
aguaggaagacuuugga

SEQ ID NO: 1992274 - RNA, 22 nt, Human
uguauuuugugaguuuguuucu

SEQ ID NO: 1992275 - RNA, 15 nt, Human
uguauucauauuugu

SEQ ID NO: 1992276 - RNA, 16 nt, Human
uguauucauauuugua

SEQ ID NO: 1992277 - RNA, 17 nt, Human
uguauucauauuuguac

SEQ ID NO: 1992278 - RNA, 17 nt, Human
uguauucaauuaaagaa

SEQ ID NO: 1992279 - RNA, 14 nt, Human
uguauucaauuaaa

SEQ ID NO: 1992280 - RNA, 21 nt, Human
uguauuuuuccucuuucacuu

SEQ ID NO: 1992281 - RNA, 14 nt, Human
uguauuuuuuuacu

SEQ ID NO: 1992282 - RNA, 17 nt, Human
uguauuuuuuaaugcua

SEQ ID NO: 1992283 - RNA, 16 nt, Human
uguauuuuuuuacuaa

SEQ ID NO: 1992284 - RNA, 21 nt, Human
ugucaagaauagcauuguaaa

SEQ ID NO: 1992285 - RNA, 19 nt, Human
uguauuuuuuaaugcuaau

SEQ ID NO: 1992286 - RNA, 15 nt, Human
ugucaagccauaauu

SEQ ID NO: 1992287 - RNA, 19 nt, Human
ugucaagagggucugagga

SEQ ID NO: 1992288 - RNA, 17 nt, Human
ugucccuuuuccuuuuu

SEQ ID NO: 1992289 - RNA, 12 nt, Human
ugucauuuucau

SEQ ID NO: 1992290 - RNA, 13 nt, Human
ugucauuuucauu

SEQ ID NO: 1992291 - RNA, 14 nt, Human
ugucauuuucauua

SEQ ID NO: 1992292 - RNA, 19 nt, Human
ugucauuuucauuagcaaa

SEQ ID NO: 1992293 - RNA, 20 nt, Human
ugucauuuucauuagcaaaa

SEQ ID NO: 1992294 - RNA, 16 nt, Human
uguccuaaggaaccuu

SEQ ID NO: 1992295 - RNA, 19 nt, Human
uguccuaaggaaccuuccu

SEQ ID NO: 1992296 - RNA, 15 nt, Human
uguccgauuuuucca

SEQ ID NO: 1992297 - RNA, 14 nt, Human
uguccgagcuuuga

SEQ ID NO: 1992298 - RNA, 13 nt, Human
uguccgagcuuug

SEQ ID NO: 1992299 - RNA, 16 nt, Human
uguccuacccacccuc

SEQ ID NO: 1992300 - RNA, 15 nt, Human
uguccuaauggugau

SEQ ID NO: 1992301 - RNA, 18 nt, Human
uguccuaauggugaugca

SEQ ID NO: 1992302 - RNA, 15 nt, Human
ugucgcccaggcugg

SEQ ID NO: 1992303 - RNA, 16 nt, Human
ugucgcccaggcugga

SEQ ID NO: 1992304 - RNA, 15 nt, Human
ugucgggcaugacac

SEQ ID NO: 1992305 - RNA, 14 nt, Human
ugucgggcaugaca

SEQ ID NO: 1992306 - RNA, 17 nt, Human
ugucguuaaaaacagau

SEQ ID NO: 1992307 - RNA, 22 nt, Human
ugucguaguuacucucaggcau

SEQ ID NO: 1992308 - RNA, 12 nt, Human
ugucggcuccag

SEQ ID NO: 1992309 - RNA, 17 nt, Human
ugucggcuccagucccc

SEQ ID NO: 1992310 - RNA, 19 nt, Human
ugucggcuccaguccccag

SEQ ID NO: 1992311 - RNA, 23 nt, Human
ugucggcuccaguccccagaacu

SEQ ID NO: 1992312 - RNA, 12 nt, Human
ugucgggcauga

SEQ ID NO: 1992313 - RNA, 14 nt, Human
ugucgcccagucug

SEQ ID NO: 1992314 - RNA, 15 nt, Human
ugucgcccagucugg

SEQ ID NO: 1992315 - RNA, 22 nt, Human
agucagaaguuucugccgcagc

SEQ ID NO: 1992316 - RNA, 16 nt, Human
agucagacagaugugg

SEQ ID NO: 1992317 - RNA, 19 nt, Human
agucccugaggcagguccc

SEQ ID NO: 1992318 - RNA, 20 nt, Human
agucccugaggcaggucccc

SEQ ID NO: 1992319 - RNA, 21 nt, Human
agucccucaagccaccagaug

SEQ ID NO: 1992320 - RNA, 22 nt, Human
aguccaggcuuuuuuaucaugu

SEQ ID NO: 1992321 - RNA, 17 nt, Human
agucaggcucucugggc

SEQ ID NO: 1992322 - RNA, 23 nt, Human
aguccaggacaggagaugcugug

SEQ ID NO: 1992323 - RNA, 22 nt, Human
agucccugaggcagguccccag

SEQ ID NO: 1992324 - RNA, 23 nt, Human
agucccugaggcagguccccaga

SEQ ID NO: 1992325 - RNA, 12 nt, Human
agucccugccaa

SEQ ID NO: 1992326 - RNA, 20 nt, Human
agucccuguaauuguuguuu

SEQ ID NO: 1992327 - RNA, 23 nt, Human
agucccuguaauuguuguuugua

SEQ ID NO: 1992328 - RNA, 16 nt, Human
agucccuguaauuguu

SEQ ID NO: 1992329 - RNA, 18 nt, Human
agucccuguaauuguugu

SEQ ID NO: 1992330 - RNA, 17 nt, Human
aguccgcagaagcccug

SEQ ID NO: 1992331 - RNA, 18 nt, Human
aguccgcagaagcccuga

SEQ ID NO: 1992332 - RNA, 23 nt, Human
aguccgaaagggacuuggaagcu

SEQ ID NO: 1992333 - RNA, 13 nt, Human
agucccuuuaaag

SEQ ID NO: 1992334 - RNA, 20 nt, Human
aguccgaccuggccugucug

SEQ ID NO: 1992335 - RNA, 21 nt, Human
aguccgaccuggccugucugu

SEQ ID NO: 1992336 - RNA, 15 nt, Human
aguccgcagaagccc

SEQ ID NO: 1992337 - RNA, 16 nt, Human
agucucacuguugccc

SEQ ID NO: 1992338 - RNA, 17 nt, Human
agucucacuguugccca

SEQ ID NO: 1992339 - RNA, 23 nt, Human
agucuagcguagugcagcagggc

SEQ ID NO: 1992340 - RNA, 20 nt, Human
agucucaccauuuccccagg

SEQ ID NO: 1992341 - RNA, 21 nt, Human
agucucaccauuuccccaggg

SEQ ID NO: 1992342 - RNA, 22 nt, Human
agucucaccauuuccccagggc

SEQ ID NO: 1992343 - RNA, 21 nt, Human
agucuagcguagugcagcagg

SEQ ID NO: 1992344 - RNA, 17 nt, Human
uguaauuuaaaauugug

SEQ ID NO: 1992345 - RNA, 20 nt, Human
uguaauuguuguuuguaugu

SEQ ID NO: 1992346 - RNA, 23 nt, Human
uguaauuguuguuuguauguaua

SEQ ID NO: 1992347 - RNA, 18 nt, Human
uguaauuuaaaauuguga

SEQ ID NO: 1992348 - RNA, 20 nt, Human
uguaauuuaaaauugugaug

SEQ ID NO: 1992349 - RNA, 13 nt, Human
uguaauuauuuga

SEQ ID NO: 1992350 - RNA, 14 nt, Human
uguaauuauuugaa

SEQ ID NO: 1992351 - RNA, 15 nt, Human
uguaauuauuugaau

SEQ ID NO: 1992352 - RNA, 17 nt, Human
uguaauuguuguuugua

SEQ ID NO: 1992353 - RNA, 19 nt, Human
uguaauuguuguuuguaug

SEQ ID NO: 1992354 - RNA, 23 nt, Human
uguaauuaaguacuauguaucaa

SEQ ID NO: 1992355 - RNA, 15 nt, Human
uguaaguaaacgguc

SEQ ID NO: 1992356 - RNA, 21 nt, Human
uguaagcguauggcuuuauuu

SEQ ID NO: 1992357 - RNA, 19 nt, Human
uguaagguauaucauucua

SEQ ID NO: 1992358 - RNA, 17 nt, Human
uguaagcguauggcuuu

SEQ ID NO: 1992359 - RNA, 15 nt, Human
uguaagaguguuuau

SEQ ID NO: 1992360 - RNA, 21 nt, Human
uguaacuuugguuaaaaucuc

SEQ ID NO: 1992361 - RNA, 23 nt, Human
uguaagagagaugagcacuucua

SEQ ID NO: 1992362 - RNA, 14 nt, Human
agguuggugggggc

SEQ ID NO: 1992363 - RNA, 18 nt, Human
agguugggugcugcuaau

SEQ ID NO: 1992364 - RNA, 22 nt, Human
agguugggugcugcuaauucuu

SEQ ID NO: 1992365 - RNA, 14 nt, Human
agguuggugaauuu

SEQ ID NO: 1992366 - RNA, 14 nt, Human
agguuguagcaugg

SEQ ID NO: 1992367 - RNA, 17 nt, Human
uguaacuuucugaaaua

SEQ ID NO: 1992368 - RNA, 23 nt, Human
agguugggagaaugucaguaugu

SEQ ID NO: 1992369 - RNA, 17 nt, Human
aggugguuauggagagg

SEQ ID NO: 1992370 - RNA, 15 nt, Human
agguugacaggaggu

SEQ ID NO: 1992371 - RNA, 18 nt, Human
agguggugggcauucucu

SEQ ID NO: 1992372 - RNA, 19 nt, Human
agguggugggcauucucuc

SEQ ID NO: 1992373 - RNA, 21 nt, Human
agguggugggcauucucucuc

SEQ ID NO: 1992374 - RNA, 15 nt, Human
aggugcacaagcucc

SEQ ID NO: 1992375 - RNA, 20 nt, Human
aggugcacaagcuccaagcu

SEQ ID NO: 1992376 - RNA, 18 nt, Human
aggugcacaagcuccaag

SEQ ID NO: 1992377 - RNA, 17 nt, Human
aggugcacaagcuccaa

SEQ ID NO: 1992378 - RNA, 16 nt, Human
aggugcacaagcucca

SEQ ID NO: 1992379 - RNA, 18 nt, Human
aggucuuggugccucugc

SEQ ID NO: 1992380 - RNA, 13 nt, Human
aggucuuggugcc

SEQ ID NO: 1992381 - RNA, 15 nt, Human
aggucuugcucuccu

SEQ ID NO: 1992382 - RNA, 23 nt, Human
aggucuugcucuccuagguagcc

SEQ ID NO: 1992383 - RNA, 11 nt, Human
agguccccaga

SEQ ID NO: 1992384 - RNA, 17 nt, Human
agguccccagcuuuggc

SEQ ID NO: 1992385 - RNA, 10 nt, Human
aggucccuaa

SEQ ID NO: 1992386 - RNA, 18 nt, Human
agguccccagcuuuggcu

SEQ ID NO: 1992387 - RNA, 23 nt, Human
aggucuugaacuccuggccucaa

SEQ ID NO: 1992388 - RNA, 20 nt, Human
aggugggauccuccaggugc

SEQ ID NO: 1992389 - RNA, 21 nt, Human
aggugcacaagcuccaagcuc

SEQ ID NO: 1992390 - RNA, 20 nt, Human
aggugcacuuggggcacagg

SEQ ID NO: 1992391 - RNA, 22 nt, Human
aggugcacuuggggcacaggga

SEQ ID NO: 1992392 - RNA, 23 nt, Human
aggugcacuuggggcacagggag

SEQ ID NO: 1992393 - RNA, 17 nt, Human
agguggccacuccagac

SEQ ID NO: 1992394 - RNA, 14 nt, Human
agguggccacucca

SEQ ID NO: 1992395 - RNA, 13 nt, Human
aggugcaggcagg

SEQ ID NO: 1992396 - RNA, 15 nt, Human
aggugcaggcaggcu

SEQ ID NO: 1992397 - RNA, 22 nt, Human
aguacaaugugacuuugaaaau

SEQ ID NO: 1992398 - RNA, 18 nt, Human
aguacaaugugacuuuga

SEQ ID NO: 1992399 - RNA, 19 nt, Human
aguacaaugugacuuugaa

SEQ ID NO: 1992400 - RNA, 21 nt, Human
aguaauccaagcaaaugugaa

SEQ ID NO: 1992401 - RNA, 15 nt, Human
aguaauccaagcaaa

SEQ ID NO: 1992402 - RNA, 22 nt, Human
aguaauauuuauuaaauuuuuu

SEQ ID NO: 1992403 - RNA, 13 nt, Human
aguaauauuuauu

SEQ ID NO: 1992404 - RNA, 15 nt, Human
aguaauauuuauuaa

SEQ ID NO: 1992405 - RNA, 19 nt, Human
aguaauauuuauuaaauuu

SEQ ID NO: 1992406 - RNA, 17 nt, Human
aguacacugccugccuu

SEQ ID NO: 1992407 - RNA, 19 nt, Human
aguacacugccugccuuaa

SEQ ID NO: 1992408 - RNA, 19 nt, Human
aguacuuuuggcauuuuac

SEQ ID NO: 1992409 - RNA, 16 nt, Human
aguacacuguuucaaa

SEQ ID NO: 1992410 - RNA, 20 nt, Human
aguacacuguuucaaacuuu

SEQ ID NO: 1992411 - RNA, 14 nt, Human
aguacacuguuuca

SEQ ID NO: 1992412 - RNA, 21 nt, Human
aguacacugaauuuuuaugug

SEQ ID NO: 1992413 - RNA, 13 nt, Human
aguacacugagag

SEQ ID NO: 1992414 - RNA, 12 nt, Human
aguacacugccu

SEQ ID NO: 1992415 - RNA, 20 nt, Human
uguaggaagguuaauguuca

SEQ ID NO: 1992416 - RNA, 18 nt, Human
uguaggaagguuaauguu

SEQ ID NO: 1992417 - RNA, 17 nt, Human
aguagaagucuuagaug

SEQ ID NO: 1992418 - RNA, 17 nt, Human
aguagagguauaauugu

SEQ ID NO: 1992419 - RNA, 18 nt, Human
aguagagguauaauugug

SEQ ID NO: 1992420 - RNA, 20 nt, Human
aguagagguauaauugugug

SEQ ID NO: 1992421 - RNA, 22 nt, Human
aguagagguauaauugugugau

SEQ ID NO: 1992422 - RNA, 12 nt, Human
aguagagacagg

SEQ ID NO: 1992423 - RNA, 14 nt, Human
aguagaacuuugua

SEQ ID NO: 1992424 - RNA, 15 nt, Human
aguagaacuuuguau

SEQ ID NO: 1992425 - RNA, 16 nt, Human
aguagaacuuuguaua

SEQ ID NO: 1992426 - RNA, 18 nt, Human
aguagaacuuuguauagu

SEQ ID NO: 1992427 - RNA, 19 nt, Human
aguagaacuuuguauaguu

SEQ ID NO: 1992428 - RNA, 21 nt, Human
aguagaacuuuguauaguuau

SEQ ID NO: 1992429 - RNA, 11 nt, Human
agguuuuccug

SEQ ID NO: 1992430 - RNA, 14 nt, Human
agguuuucuccccc

SEQ ID NO: 1992431 - RNA, 21 nt, Human
agguuuugcacucuuguuucu

SEQ ID NO: 1992432 - RNA, 20 nt, Human
aguaagccgugauuuucauu

SEQ ID NO: 1992433 - RNA, 15 nt, Human
aguaaaaauaaaauu

SEQ ID NO: 1992434 - RNA, 12 nt, Human
aguaaaaauaaa

SEQ ID NO: 1992435 - RNA, 18 nt, Human
aguaauaugcacacauuu

SEQ ID NO: 1992436 - RNA, 19 nt, Human
aguaauaugcacacauuuu

SEQ ID NO: 1992437 - RNA, 17 nt, Human
aguaauaugcacacauu

SEQ ID NO: 1992438 - RNA, 20 nt, Human
aguaauaugcacacauuuuu

SEQ ID NO: 1992439 - RNA, 22 nt, Human
aguaagcggcucaagcccagga

SEQ ID NO: 1992440 - RNA, 19 nt, Human
aguaagggaagcagaagga

SEQ ID NO: 1992441 - RNA, 21 nt, Human
aguaagggaacaaguugagcu

SEQ ID NO: 1992442 - RNA, 15 nt, Human
aguaagggaagcaga

SEQ ID NO: 1992443 - RNA, 21 nt, Human
aguaagcggcucaagcccagg

SEQ ID NO: 1992444 - RNA, 23 nt, Human
aguaaggaauuuuauuuuuuucu

SEQ ID NO: 1992445 - RNA, 21 nt, Human
uguaauuuaaaauugugaugu

SEQ ID NO: 1992446 - RNA, 22 nt, Human
uguaauuuaaaauugugaugug

SEQ ID NO: 1992447 - RNA, 14 nt, Human
uguaauuugugaua

SEQ ID NO: 1992448 - RNA, 19 nt, Human
uguaauuuaaggucuguuu

SEQ ID NO: 1992449 - RNA, 18 nt, Human
uguagaggagaaacugga

SEQ ID NO: 1992450 - RNA, 14 nt, Human
uguagagugggagc

SEQ ID NO: 1992451 - RNA, 13 nt, Human
uguagagugggag

SEQ ID NO: 1992452 - RNA, 18 nt, Human
aggggcuagcuaagccaa

SEQ ID NO: 1992453 - RNA, 18 nt, Human
aggggcuccaugccagcc

SEQ ID NO: 1992454 - RNA, 16 nt, Human
aggggcuccaugccag

SEQ ID NO: 1992455 - RNA, 15 nt, Human
agggggaaggcaggg

SEQ ID NO: 1992456 - RNA, 20 nt, Human
aggggcgugggaguggccug

SEQ ID NO: 1992457 - RNA, 23 nt, Human
aggggagcaaaaucgaugcagug

SEQ ID NO: 1992458 - RNA, 15 nt, Human
aggggccuggcagcc

SEQ ID NO: 1992459 - RNA, 15 nt, Human
aggggagacuuugau

SEQ ID NO: 1992460 - RNA, 18 nt, Human
aggggccuggcagccgug

SEQ ID NO: 1992461 - RNA, 23 nt, Human
aggggccuggcagccgugccuuc

SEQ ID NO: 1992462 - RNA, 19 nt, Human
uggggucacucuggcagcu

SEQ ID NO: 1992463 - RNA, 20 nt, Human
uggggucacucuggcagcuc

SEQ ID NO: 1992464 - RNA, 16 nt, Human
aggggagacagagcaa

SEQ ID NO: 1992465 - RNA, 13 nt, Human
aggggagacuuug

SEQ ID NO: 1992466 - RNA, 16 nt, Human
aggggacugccaccuc

SEQ ID NO: 1992467 - RNA, 17 nt, Human
aggggacugccaccucc

SEQ ID NO: 1992468 - RNA, 14 nt, Human
aggggagacagagc

SEQ ID NO: 1992469 - RNA, 15 nt, Human
aggggagacagagca

SEQ ID NO: 1992470 - RNA, 13 nt, Human
aggggacugccac

SEQ ID NO: 1992471 - RNA, 15 nt, Human
aggggacugccaccu

SEQ ID NO: 1992472 - RNA, 18 nt, Human
aggggguggccucccaac

SEQ ID NO: 1992473 - RNA, 17 nt, Human
aggggguggccucccaa

SEQ ID NO: 1992474 - RNA, 15 nt, Human
aggggguggccuccc

SEQ ID NO: 1992475 - RNA, 22 nt, Human
aggggugggacacccugugaug

SEQ ID NO: 1992476 - RNA, 20 nt, Human
aggggugggacacccuguga

SEQ ID NO: 1992477 - RNA, 24 nt, Human
agggguucccuuuuuuggcugcug

SEQ ID NO: 1992478 - RNA, 19 nt, Human
agggguuccuucugggcau

SEQ ID NO: 1992479 - RNA, 21 nt, Human
agggucucacuauguugccca

SEQ ID NO: 1992480 - RNA, 22 nt, Human
agggucucacuauguugcccag

SEQ ID NO: 1992481 - RNA, 23 nt, Human
agggucucacuauguugcccagg

SEQ ID NO: 1992482 - RNA, 16 nt, Human
uggguggggggcuuca

SEQ ID NO: 1992483 - RNA, 20 nt, Human
uggguggcuuaaaaaaaacu

SEQ ID NO: 1992484 - RNA, 21 nt, Human
ugggugcugcuaauucuuugc

SEQ ID NO: 1992485 - RNA, 16 nt, Human
ugguaaucauauuaga

SEQ ID NO: 1992486 - RNA, 15 nt, Human
ugguaccuugcacac

SEQ ID NO: 1992487 - RNA, 16 nt, Human
ugguaccuugcacaca

SEQ ID NO: 1992488 - RNA, 21 nt, Human
ugguaauaagggaaaaaucaa

SEQ ID NO: 1992489 - RNA, 14 nt, Human
ugguaaucauauua

SEQ ID NO: 1992490 - RNA, 16 nt, Human
ugguaauaagggaaaa

SEQ ID NO: 1992491 - RNA, 16 nt, Human
ugguacuaacuuuccu

SEQ ID NO: 1992492 - RNA, 20 nt, Human
ugguagcuuuucccuucuuu

SEQ ID NO: 1992493 - RNA, 13 nt, Human
ugguaggaacugc

SEQ ID NO: 1992494 - RNA, 21 nt, Human
ugguagcuuuucccuucuuuu

SEQ ID NO: 1992495 - RNA, 20 nt, Human
ugguaggaacugcugggcuu

SEQ ID NO: 1992496 - RNA, 17 nt, Human
ugguagcuuuucccuuc

SEQ ID NO: 1992497 - RNA, 22 nt, Human
uggucacaggacucugccuccu

SEQ ID NO: 1992498 - RNA, 23 nt, Human
uggucacaggacucugccuccuc

SEQ ID NO: 1992499 - RNA, 20 nt, Human
uggucacaggacucugccuc

SEQ ID NO: 1992500 - RNA, 19 nt, Human
ugggugcuuggaggaagga

SEQ ID NO: 1992501 - RNA, 15 nt, Human
ugggugcuuggagga

SEQ ID NO: 1992502 - RNA, 22 nt, Human
uggguggcaccagcagccugga

SEQ ID NO: 1992503 - RNA, 22 nt, Human
ugggugcuuggaggaaggaaac

SEQ ID NO: 1992504 - RNA, 12 nt, Human
ugggucugugug

SEQ ID NO: 1992505 - RNA, 13 nt, Human
ugggucuggagga

SEQ ID NO: 1992506 - RNA, 21 nt, Human
ugggucuggaggaccugcccg

SEQ ID NO: 1992507 - RNA, 15 nt, Human
agggugggagugggc

SEQ ID NO: 1992508 - RNA, 21 nt, Human
ugggucgcccuggacugugug

SEQ ID NO: 1992509 - RNA, 22 nt, Human
agggucucacucugucgcccag

SEQ ID NO: 1992510 - RNA, 21 nt, Human
agggucucacucugucgccca

SEQ ID NO: 1992511 - RNA, 16 nt, Human
agggucucuagugcug

SEQ ID NO: 1992512 - RNA, 18 nt, Human
agggucucuagugcugug

SEQ ID NO: 1992513 - RNA, 20 nt, Human
agggucucuagugcugugaa

SEQ ID NO: 1992514 - RNA, 21 nt, Human
agggucucuagugcugugaaa

SEQ ID NO: 1992515 - RNA, 22 nt, Human
agggucucuagugcugugaaaa

SEQ ID NO: 1992516 - RNA, 13 nt, Human
agguauuaagauu

SEQ ID NO: 1992517 - RNA, 19 nt, Human
aggucaccuuuauucuggc

SEQ ID NO: 1992518 - RNA, 18 nt, Human
aggucaccuuuauucugg

SEQ ID NO: 1992519 - RNA, 19 nt, Human
aggucaccucacucagcac

SEQ ID NO: 1992520 - RNA, 20 nt, Human
aggucaccucacucagcacc

SEQ ID NO: 1992521 - RNA, 21 nt, Human
aggucaccucacucagcacca

SEQ ID NO: 1992522 - RNA, 23 nt, Human
aggucaccucacucagcaccacu

SEQ ID NO: 1992523 - RNA, 14 nt, Human
aggucaccucacuc

SEQ ID NO: 1992524 - RNA, 17 nt, Human
aggucaccucacucagc

SEQ ID NO: 1992525 - RNA, 18 nt, Human
aggucaccucacucagca

SEQ ID NO: 1992526 - RNA, 17 nt, Human
aggucauuuuuuuuaag

SEQ ID NO: 1992527 - RNA, 20 nt, Human
aggucauuuuuuuuaagaaa

SEQ ID NO: 1992528 - RNA, 18 nt, Human
aggucauuuccauguaug

SEQ ID NO: 1992529 - RNA, 21 nt, Human
aggucauuuccauguaugcau

SEQ ID NO: 1992530 - RNA, 12 nt, Human
aggucagagccu

SEQ ID NO: 1992531 - RNA, 21 nt, Human
aggucauuaaggccacaucca

SEQ ID NO: 1992532 - RNA, 21 nt, Human
agguaugcaaucaaaucugcu

SEQ ID NO: 1992533 - RNA, 23 nt, Human
agguaguucaagaaaugaagagc

SEQ ID NO: 1992534 - RNA, 12 nt, Human
agguauaauugu

SEQ ID NO: 1992535 - RNA, 15 nt, Human
agguauaauugugug

SEQ ID NO: 1992536 - RNA, 19 nt, Human
agguauaauugugugauau

SEQ ID NO: 1992537 - RNA, 23 nt, Human
agguauaauucacauuguauuca

SEQ ID NO: 1992538 - RNA, 19 nt, Human
agguauaaguggugugugu

SEQ ID NO: 1992539 - RNA, 20 nt, Human
agguauaaguggugugugua

SEQ ID NO: 1992540 - RNA, 23 nt, Human
agguagaaauaucugaaaaugua

SEQ ID NO: 1992541 - RNA, 23 nt, Human
agguacuuugucuaagaaacauu

SEQ ID NO: 1992542 - RNA, 15 nt, Human
agguagaacgccagg

SEQ ID NO: 1992543 - RNA, 17 nt, Human
agguagaacgccaggga

SEQ ID NO: 1992544 - RNA, 18 nt, Human
agguagaacgccagggac

SEQ ID NO: 1992545 - RNA, 17 nt, Human
agguagaaugaccuugu

SEQ ID NO: 1992546 - RNA, 18 nt, Human
agguagaaugaccuugua

SEQ ID NO: 1992547 - RNA, 21 nt, Human
agguagaaugaccuuguaaug

SEQ ID NO: 1992548 - RNA, 17 nt, Human
agguagaauguuuucaa

SEQ ID NO: 1992549 - RNA, 17 nt, Human
agguaguucaagaaaug

SEQ ID NO: 1992550 - RNA, 19 nt, Human
agguaguucaagaaaugaa

SEQ ID NO: 1992551 - RNA, 22 nt, Human
agguaguucaagaaaugaagag

SEQ ID NO: 1992552 - RNA, 19 nt, Human
agguagaaauaucugaaaa

SEQ ID NO: 1992553 - RNA, 17 nt, Human
agguagaaauaucugaa

SEQ ID NO: 1992554 - RNA, 23 nt, Human
agguacuuucauauuuuaaacag

SEQ ID NO: 1992555 - RNA, 16 nt, Human
agguacuuugucuaag

SEQ ID NO: 1992556 - RNA, 18 nt, Human
aggguuggccccugcccg

SEQ ID NO: 1992557 - RNA, 23 nt, Human
aggguuggccccugcccggcugc

SEQ ID NO: 1992558 - RNA, 17 nt, Human
aggguuggccccugccc

SEQ ID NO: 1992559 - RNA, 19 nt, Human
aggguugggaaaauccaaa

SEQ ID NO: 1992560 - RNA, 14 nt, Human
uggucuccacuggg

SEQ ID NO: 1992561 - RNA, 19 nt, Human
uggucuauaccuuaagaau

SEQ ID NO: 1992562 - RNA, 17 nt, Human
uggucucaaacucuuga

SEQ ID NO: 1992563 - RNA, 23 nt, Human
uggucucaaacucuugaccucag

SEQ ID NO: 1992564 - RNA, 16 nt, Human
uggucucaaacucuug

SEQ ID NO: 1992565 - RNA, 19 nt, Human
uggucuaucuuugagcgcc

SEQ ID NO: 1992566 - RNA, 16 nt, Human
uggucccaccccacac

SEQ ID NO: 1992567 - RNA, 13 nt, Human
uggucccacucag

SEQ ID NO: 1992568 - RNA, 11 nt, Human
uggucagccca

SEQ ID NO: 1992569 - RNA, 12 nt, Human
uggucagcccaa

SEQ ID NO: 1992570 - RNA, 10 nt, Human
uggucagccc

SEQ ID NO: 1992571 - RNA, 20 nt, Human
uggucaccaaaucagcugcu

SEQ ID NO: 1992572 - RNA, 22 nt, Human
uggucagauuugaacucuucaa

SEQ ID NO: 1992573 - RNA, 18 nt, Human
uggucaccaaaucagcug

SEQ ID NO: 1992574 - RNA, 15 nt, Human
uggucccaccccaca

SEQ ID NO: 1992575 - RNA, 14 nt, Human
uggucccaccccac

SEQ ID NO: 1992576 - RNA, 16 nt, Human
uggucugacccacugc

SEQ ID NO: 1992577 - RNA, 17 nt, Human
uggucugacccacugcu

SEQ ID NO: 1992578 - RNA, 10 nt, Human
uggucuuuga

SEQ ID NO: 1992579 - RNA, 11 nt, Human
uggucuuugag

SEQ ID NO: 1992580 - RNA, 13 nt, Human
aggguuauaauaa

SEQ ID NO: 1992581 - RNA, 22 nt, Human
aggguguccggucccuguccca

SEQ ID NO: 1992582 - RNA, 21 nt, Human
agggugucugcccccuccuga

SEQ ID NO: 1992583 - RNA, 15 nt, Human
agggugucugccccc

SEQ ID NO: 1992584 - RNA, 16 nt, Human
ugggccaggagccucc

SEQ ID NO: 1992585 - RNA, 14 nt, Human
ugggccaggagccu

SEQ ID NO: 1992586 - RNA, 20 nt, Human
ugggcccaaugcacuuuguu

SEQ ID NO: 1992587 - RNA, 13 nt, Human
ugggccaggagcc

SEQ ID NO: 1992588 - RNA, 18 nt, Human
ugggccagaauuucaaac

SEQ ID NO: 1992589 - RNA, 17 nt, Human
ugggccagaauuucaaa

SEQ ID NO: 1992590 - RNA, 17 nt, Human
ugggcaacccccagccu

SEQ ID NO: 1992591 - RNA, 20 nt, Human
ugggcaacccccagccugcu

SEQ ID NO: 1992592 - RNA, 12 nt, Human
ugggcacacgcu

SEQ ID NO: 1992593 - RNA, 15 nt, Human
ugggcacacgcugcu

SEQ ID NO: 1992594 - RNA, 17 nt, Human
ugggcacacgcugcucu

SEQ ID NO: 1992595 - RNA, 20 nt, Human
ugggcacacgcugcucugcc

SEQ ID NO: 1992596 - RNA, 21 nt, Human
ugggcacacgcugcucugccc

SEQ ID NO: 1992597 - RNA, 22 nt, Human
ugggcacacgcugcucugcccc

SEQ ID NO: 1992598 - RNA, 23 nt, Human
ugggcacacgcugcucugcccca

SEQ ID NO: 1992599 - RNA, 13 nt, Human
ugggcacagguca

SEQ ID NO: 1992600 - RNA, 19 nt, Human
aggccuuaucuccaagacc

SEQ ID NO: 1992601 - RNA, 17 nt, Human
aggccuuaucuccaaga

SEQ ID NO: 1992602 - RNA, 17 nt, Human
ugggaggucaaggcugc

SEQ ID NO: 1992603 - RNA, 23 nt, Human
ugggaggucaaggcugcagugag

SEQ ID NO: 1992604 - RNA, 20 nt, Human
ugggaggucaaggcugcagu

SEQ ID NO: 1992605 - RNA, 19 nt, Human
ugggaggucaaggcugcag

SEQ ID NO: 1992606 - RNA, 18 nt, Human
ugggaggucaaggcugca

SEQ ID NO: 1992607 - RNA, 16 nt, Human
ugggcaacccccagcc

SEQ ID NO: 1992608 - RNA, 23 nt, Human
agggcccagagaggguggugacc

SEQ ID NO: 1992609 - RNA, 18 nt, Human
agggcccagagagggugg

SEQ ID NO: 1992610 - RNA, 18 nt, Human
agggcagggacagggccg

SEQ ID NO: 1992611 - RNA, 17 nt, Human
agggaggugaccccagg

SEQ ID NO: 1992612 - RNA, 17 nt, Human
agggagugacagaggca

SEQ ID NO: 1992613 - RNA, 18 nt, Human
agggagugacagaggcag

SEQ ID NO: 1992614 - RNA, 19 nt, Human
agggagugacagaggcagc

SEQ ID NO: 1992615 - RNA, 15 nt, Human
agggcagaguuacuu

SEQ ID NO: 1992616 - RNA, 16 nt, Human
agggcagauuuuaguu

SEQ ID NO: 1992617 - RNA, 15 nt, Human
agggagggcuucugc

SEQ ID NO: 1992618 - RNA, 14 nt, Human
ugggcccacauccg

SEQ ID NO: 1992619 - RNA, 19 nt, Human
ugggcccacccaagcagga

SEQ ID NO: 1992620 - RNA, 22 nt, Human
ugggcccacccaagcaggaggc

SEQ ID NO: 1992621 - RNA, 14 nt, Human
uggggcccugccuc

SEQ ID NO: 1992622 - RNA, 23 nt, Human
uggggaccucaggccugggggcu

SEQ ID NO: 1992623 - RNA, 12 nt, Human
uggggagaaagu

SEQ ID NO: 1992624 - RNA, 15 nt, Human
uggggaggggcugug

SEQ ID NO: 1992625 - RNA, 16 nt, Human
uggggcccugccuccu

SEQ ID NO: 1992626 - RNA, 15 nt, Human
uggggcccugccucc

SEQ ID NO: 1992627 - RNA, 20 nt, Human
uggggcuaaagacugaucuc

SEQ ID NO: 1992628 - RNA, 23 nt, Human
uggggcuaggaaauccagggugg

SEQ ID NO: 1992629 - RNA, 18 nt, Human
uggggcggugagagggga

SEQ ID NO: 1992630 - RNA, 15 nt, Human
ugggguagguuggga

SEQ ID NO: 1992631 - RNA, 21 nt, Human
ugggguagguugggagaaugu

SEQ ID NO: 1992632 - RNA, 15 nt, Human
ugggguaugggagag

SEQ ID NO: 1992633 - RNA, 18 nt, Human
uggggucacucuggcagc

SEQ ID NO: 1992634 - RNA, 17 nt, Human
uggggucacucuggcag

SEQ ID NO: 1992635 - RNA, 15 nt, Human
ugggguacccacugc

SEQ ID NO: 1992636 - RNA, 16 nt, Human
ugggguacccacugcu

SEQ ID NO: 1992637 - RNA, 20 nt, Human
ugggguacccacugcucugg

SEQ ID NO: 1992638 - RNA, 22 nt, Human
uggggcugggggaugggccuga

SEQ ID NO: 1992639 - RNA, 13 nt, Human
uggggcuggggga

SEQ ID NO: 1992640 - RNA, 16 nt, Human
uggggcugggggaugg

SEQ ID NO: 1992641 - RNA, 18 nt, Human
uggggcugggggaugggc

SEQ ID NO: 1992642 - RNA, 21 nt, Human
uggggcugggggaugggccug

SEQ ID NO: 1992643 - RNA, 14 nt, Human
uggggcugauugua

SEQ ID NO: 1992644 - RNA, 18 nt, Human
uggggcugggcccaccca

SEQ ID NO: 1992645 - RNA, 20 nt, Human
uggggcugcaccggcuggcc

SEQ ID NO: 1992646 - RNA, 14 nt, Human
ugggguacccacug

SEQ ID NO: 1992647 - RNA, 17 nt, Human
agggcuuuaaaauucuc

SEQ ID NO: 1992648 - RNA, 20 nt, Human
ugggcucccuucccaccucu

SEQ ID NO: 1992649 - RNA, 17 nt, Human
ugggcugcccuggugcu

SEQ ID NO: 1992650 - RNA, 19 nt, Human
ugggcugcccuggugcugc

SEQ ID NO: 1992651 - RNA, 20 nt, Human
ugggcugcccuggugcugcc

SEQ ID NO: 1992652 - RNA, 21 nt, Human
ugggcugcccuggugcugcca

SEQ ID NO: 1992653 - RNA, 19 nt, Human
ugggcucccuucccaccuc

SEQ ID NO: 1992654 - RNA, 18 nt, Human
ugggcucccuucccaccu

SEQ ID NO: 1992655 - RNA, 14 nt, Human
agggcuuguaguuc

SEQ ID NO: 1992656 - RNA, 15 nt, Human
agggcuuguaguucu

SEQ ID NO: 1992657 - RNA, 16 nt, Human
agggcuuguaguucuu

SEQ ID NO: 1992658 - RNA, 17 nt, Human
agggcuuguaguucuuu

SEQ ID NO: 1992659 - RNA, 19 nt, Human
agggcuuguaguucuuuaa

SEQ ID NO: 1992660 - RNA, 14 nt, Human
agggcuuuaaaauu

SEQ ID NO: 1992661 - RNA, 15 nt, Human
agggcuuuaaaauuc

SEQ ID NO: 1992662 - RNA, 16 nt, Human
agggcuuuaaaauucu

SEQ ID NO: 1992663 - RNA, 18 nt, Human
agggcuuuaaaauucucu

SEQ ID NO: 1992664 - RNA, 23 nt, Human
agggcuucugccauuucugagau

SEQ ID NO: 1992665 - RNA, 15 nt, Human
uggggaccagagcug

SEQ ID NO: 1992666 - RNA, 14 nt, Human
uggggaccagagcu

SEQ ID NO: 1992667 - RNA, 20 nt, Human
uggggacaggggcaggagga

SEQ ID NO: 1992668 - RNA, 22 nt, Human
uggggacaggggcaggaggaag

SEQ ID NO: 1992669 - RNA, 17 nt, Human
uggggacagagcagaac

SEQ ID NO: 1992670 - RNA, 18 nt, Human
uggggaccagagcugcca

SEQ ID NO: 1992671 - RNA, 17 nt, Human
uggggaccagagcugcc

SEQ ID NO: 1992672 - RNA, 13 nt, Human
uggggaccucagg

SEQ ID NO: 1992673 - RNA, 21 nt, Human
uggggaccagcagucugccug

SEQ ID NO: 1992674 - RNA, 23 nt, Human
uggggaccagcagucugccugga

SEQ ID NO: 1992675 - RNA, 14 nt, Human
uggggaaugaagau

SEQ ID NO: 1992676 - RNA, 15 nt, Human
uggggaaugaagaua

SEQ ID NO: 1992677 - RNA, 14 nt, Human
ugggcugggcacug

SEQ ID NO: 1992678 - RNA, 19 nt, Human
ugggcuggguucuacccag

SEQ ID NO: 1992679 - RNA, 18 nt, Human
ugggcuggguucuaccca

SEQ ID NO: 1992680 - RNA, 12 nt, Human
ugggcugggcac

SEQ ID NO: 1992681 - RNA, 16 nt, Human
agcuguguggcagucu

SEQ ID NO: 1992682 - RNA, 14 nt, Human
agcuguguggcagu

SEQ ID NO: 1992683 - RNA, 21 nt, Human
agcugugcucuggacaggcau

SEQ ID NO: 1992684 - RNA, 18 nt, Human
agcugugugcucuccaag

SEQ ID NO: 1992685 - RNA, 23 nt, Human
agcugugcucuggacaggcaugu

SEQ ID NO: 1992686 - RNA, 19 nt, Human
agcugugcucuggacaggc

SEQ ID NO: 1992687 - RNA, 20 nt, Human
agcugugcucuggacaggca

SEQ ID NO: 1992688 - RNA, 18 nt, Human
agcuggcuccagccugga

SEQ ID NO: 1992689 - RNA, 15 nt, Human
agcugggacuacagg

SEQ ID NO: 1992690 - RNA, 18 nt, Human
agcugggaccacaggugc

SEQ ID NO: 1992691 - RNA, 15 nt, Human
agcugggaccaguac

SEQ ID NO: 1992692 - RNA, 20 nt, Human
agcuggcuuacacuggcaau

SEQ ID NO: 1992693 - RNA, 20 nt, Human
ugccuguugggccaggagcc

SEQ ID NO: 1992694 - RNA, 19 nt, Human
ugccuguugggccaggagc

SEQ ID NO: 1992695 - RNA, 21 nt, Human
ugccuguucagcuccagcuca

SEQ ID NO: 1992696 - RNA, 16 nt, Human
ugccuuauggaacacu

SEQ ID NO: 1992697 - RNA, 15 nt, Human
ugccuuauggaacac

SEQ ID NO: 1992698 - RNA, 20 nt, Human
agcugugugcucuccaagcc

SEQ ID NO: 1992699 - RNA, 14 nt, Human
agcuguguuauuau

SEQ ID NO: 1992700 - RNA, 14 nt, Human
agcuguuacugucu

SEQ ID NO: 1992701 - RNA, 14 nt, Human
agcuguucagcugg

SEQ ID NO: 1992702 - RNA, 13 nt, Human
agcuguucagcug

SEQ ID NO: 1992703 - RNA, 18 nt, Human
ugccuguucagcuccagc

SEQ ID NO: 1992704 - RNA, 20 nt, Human
ugccuguucagcuccagcuc

SEQ ID NO: 1992705 - RNA, 15 nt, Human
ugccugcccuauucu

SEQ ID NO: 1992706 - RNA, 10 nt, Human
ugccugcccu

SEQ ID NO: 1992707 - RNA, 20 nt, Human
ugccugcccugucaggaggc

SEQ ID NO: 1992708 - RNA, 23 nt, Human
ugccugcccugucaggaggcaga

SEQ ID NO: 1992709 - RNA, 13 nt, Human
ugccugcccuuug

SEQ ID NO: 1992710 - RNA, 15 nt, Human
ugccugcccuuuguc

SEQ ID NO: 1992711 - RNA, 21 nt, Human
ugccugcccuuuguccuccug

SEQ ID NO: 1992712 - RNA, 14 nt, Human
ugccugcccaggcc

SEQ ID NO: 1992713 - RNA, 15 nt, Human
ugccugcccaggccc

SEQ ID NO: 1992714 - RNA, 16 nt, Human
ugccugcccaggcccc

SEQ ID NO: 1992715 - RNA, 12 nt, Human
ugcccaggcagg

SEQ ID NO: 1992716 - RNA, 13 nt, Human
ugcccaggcaggu

SEQ ID NO: 1992717 - RNA, 14 nt, Human
ugcccaggcagguc

SEQ ID NO: 1992718 - RNA, 13 nt, Human
ugccucugccucu

SEQ ID NO: 1992719 - RNA, 14 nt, Human
ugccucugccucug

SEQ ID NO: 1992720 - RNA, 15 nt, Human
ugccucugccucuga

SEQ ID NO: 1992721 - RNA, 22 nt, Human
agcuggaucuccauucucucag

SEQ ID NO: 1992722 - RNA, 21 nt, Human
agcugcuuuugucuaugggac

SEQ ID NO: 1992723 - RNA, 21 nt, Human
agcugcuugggcuucauccuc

SEQ ID NO: 1992724 - RNA, 19 nt, Human
agcugccuguucagcucca

SEQ ID NO: 1992725 - RNA, 21 nt, Human
agcugccuguucagcuccagc

SEQ ID NO: 1992726 - RNA, 22 nt, Human
agcugccuguucagcuccagcu

SEQ ID NO: 1992727 - RNA, 15 nt, Human
ugccuggauggggcu

SEQ ID NO: 1992728 - RNA, 14 nt, Human
ugccuggaggccag

SEQ ID NO: 1992729 - RNA, 14 nt, Human
ugccuggauggggc

SEQ ID NO: 1992730 - RNA, 20 nt, Human
agcugccuguucagcuccag

SEQ ID NO: 1992731 - RNA, 14 nt, Human
agcuugaggguugg

SEQ ID NO: 1992732 - RNA, 18 nt, Human
agcuugaggguugggcug

SEQ ID NO: 1992733 - RNA, 11 nt, Human
agcuugggcag

SEQ ID NO: 1992734 - RNA, 17 nt, Human
agcuugggcagaucucc

SEQ ID NO: 1992735 - RNA, 23 nt, Human
agcuuggggacaggggcaggagg

SEQ ID NO: 1992736 - RNA, 21 nt, Human
agcuugggcagaucucccaca

SEQ ID NO: 1992737 - RNA, 23 nt, Human
agcuugggcagaucucccacaug

SEQ ID NO: 1992738 - RNA, 18 nt, Human
agcuuguaaauagcucag

SEQ ID NO: 1992739 - RNA, 15 nt, Human
agcuuagaaacugga

SEQ ID NO: 1992740 - RNA, 13 nt, Human
agcuuacguaguu

SEQ ID NO: 1992741 - RNA, 15 nt, Human
agcuuacguaguucu

SEQ ID NO: 1992742 - RNA, 19 nt, Human
agcuugaccgugaggccag

SEQ ID NO: 1992743 - RNA, 18 nt, Human
agcuuagaauuauuugca

SEQ ID NO: 1992744 - RNA, 17 nt, Human
agcuguugaugggauga

SEQ ID NO: 1992745 - RNA, 23 nt, Human
agcuguugaugggaugauugaag

SEQ ID NO: 1992746 - RNA, 22 nt, Human
agcuguuggccucugcaaagga

SEQ ID NO: 1992747 - RNA, 13 nt, Human
agcuguugacucu

SEQ ID NO: 1992748 - RNA, 20 nt, Human
agcuguugacucuaguacug

SEQ ID NO: 1992749 - RNA, 21 nt, Human
agcuguugacucuaguacugu

SEQ ID NO: 1992750 - RNA, 23 nt, Human
agcuguugacucuaguacuguga

SEQ ID NO: 1992751 - RNA, 13 nt, Human
agcuguugaccag

SEQ ID NO: 1992752 - RNA, 15 nt, Human
agcuguucuuccugg

SEQ ID NO: 1992753 - RNA, 13 nt, Human
agcuguucuuccu

SEQ ID NO: 1992754 - RNA, 14 nt, Human
agcuguucuuccug

SEQ ID NO: 1992755 - RNA, 14 nt, Human
agcuguugaccagg

SEQ ID NO: 1992756 - RNA, 15 nt, Human
agcuguugaccaggc

SEQ ID NO: 1992757 - RNA, 16 nt, Human
agcuguugaccaggca

SEQ ID NO: 1992758 - RNA, 18 nt, Human
agcuguugaccaggcacc

SEQ ID NO: 1992759 - RNA, 18 nt, Human
ugcuaaguaaaucucuuc

SEQ ID NO: 1992760 - RNA, 20 nt, Human
ugcuaaguaaaucucuucug

SEQ ID NO: 1992761 - RNA, 21 nt, Human
ugcuaaguaaaucucuucugu

SEQ ID NO: 1992762 - RNA, 20 nt, Human
ugcgggcuuccuccuggugu

SEQ ID NO: 1992763 - RNA, 19 nt, Human
ugcggccuuuggcuucacg

SEQ ID NO: 1992764 - RNA, 17 nt, Human
ugcggccuuuggcuuca

SEQ ID NO: 1992765 - RNA, 15 nt, Human
ugcggccuuuucaug

SEQ ID NO: 1992766 - RNA, 17 nt, Human
ugcgggucacaggaggg

SEQ ID NO: 1992767 - RNA, 17 nt, Human
ugcgguccacccaggag

SEQ ID NO: 1992768 - RNA, 14 nt, Human
ugcgggucacagga

SEQ ID NO: 1992769 - RNA, 16 nt, Human
ugcgggucacaggagg

SEQ ID NO: 1992770 - RNA, 14 nt, Human
ugcggggcgggcac

SEQ ID NO: 1992771 - RNA, 18 nt, Human
ugcggggcgggcacaccu

SEQ ID NO: 1992772 - RNA, 21 nt, Human
ugcggugcuaucucccccagc

SEQ ID NO: 1992773 - RNA, 17 nt, Human
ugcggugcuaucucccc

SEQ ID NO: 1992774 - RNA, 18 nt, Human
ugcgguccacccaggagc

SEQ ID NO: 1992775 - RNA, 18 nt, Human
ugccuuugcagcucagaa

SEQ ID NO: 1992776 - RNA, 17 nt, Human
ugccuuugcucuggucu

SEQ ID NO: 1992777 - RNA, 19 nt, Human
ugccuuuggcacucugacu

SEQ ID NO: 1992778 - RNA, 18 nt, Human
ugccuuugaagagugaaa

SEQ ID NO: 1992779 - RNA, 11 nt, Human
ugccuuucugu

SEQ ID NO: 1992780 - RNA, 16 nt, Human
ugccuuucuguguuua

SEQ ID NO: 1992781 - RNA, 12 nt, Human
ugccuuugaaga

SEQ ID NO: 1992782 - RNA, 13 nt, Human
ugccuuugaagag

SEQ ID NO: 1992783 - RNA, 16 nt, Human
ugccuuugaagaguga

SEQ ID NO: 1992784 - RNA, 19 nt, Human
ugcggagucauuuuguguu

SEQ ID NO: 1992785 - RNA, 23 nt, Human
ugcggagucauuuuguguugaag

SEQ ID NO: 1992786 - RNA, 23 nt, Human
ugcggacagccacggccaggcca

SEQ ID NO: 1992787 - RNA, 22 nt, Human
ugcggacagccacggccaggcc

SEQ ID NO: 1992788 - RNA, 17 nt, Human
ugcugucccuuuuccuu

SEQ ID NO: 1992789 - RNA, 13 nt, Human
ugcugugcaaaug

SEQ ID NO: 1992790 - RNA, 12 nt, Human
ugcugugccccu

SEQ ID NO: 1992791 - RNA, 15 nt, Human
ugcugugccccuggc

SEQ ID NO: 1992792 - RNA, 16 nt, Human
ugcugugccccuggcc

SEQ ID NO: 1992793 - RNA, 15 nt, Human
ugcugucccuuuucc

SEQ ID NO: 1992794 - RNA, 19 nt, Human
ugcugucccuuacgugagu

SEQ ID NO: 1992795 - RNA, 15 nt, Human
ugcuguauucccaua

SEQ ID NO: 1992796 - RNA, 17 nt, Human
ugcugucccuuacguga

SEQ ID NO: 1992797 - RNA, 23 nt, Human
ugcuucaaggauccugagccaga

SEQ ID NO: 1992798 - RNA, 21 nt, Human
ugcuucaaggauccugagcca

SEQ ID NO: 1992799 - RNA, 20 nt, Human
ugcuucaaggauccugagcc

SEQ ID NO: 1992800 - RNA, 12 nt, Human
ugcuuccagaaa

SEQ ID NO: 1992801 - RNA, 13 nt, Human
ugcuuccagaaac

SEQ ID NO: 1992802 - RNA, 14 nt, Human
ugcuuccagaaaca

SEQ ID NO: 1992803 - RNA, 18 nt, Human
ugcuucauguuugccuuc

SEQ ID NO: 1992804 - RNA, 16 nt, Human
ugcuuccagugaggcu

SEQ ID NO: 1992805 - RNA, 18 nt, Human
aggacacuaaccacgcug

SEQ ID NO: 1992806 - RNA, 17 nt, Human
aggacagccccuccucc

SEQ ID NO: 1992807 - RNA, 16 nt, Human
aggacagaaggcuccu

SEQ ID NO: 1992808 - RNA, 17 nt, Human
aggacagaaggcuccug

SEQ ID NO: 1992809 - RNA, 19 nt, Human
aggacagaaggcuccugcc

SEQ ID NO: 1992810 - RNA, 21 nt, Human
aggacagaaggcuccugcccc

SEQ ID NO: 1992811 - RNA, 22 nt, Human
aggacagaaggcuccugccccc

SEQ ID NO: 1992812 - RNA, 17 nt, Human
aggacacugcagaacag

SEQ ID NO: 1992813 - RNA, 19 nt, Human
ugcugggauuacaagcgug

SEQ ID NO: 1992814 - RNA, 19 nt, Human
ugcuggcuguuggcugggg

SEQ ID NO: 1992815 - RNA, 21 nt, Human
ugcuggcuguuggcugggggc

SEQ ID NO: 1992816 - RNA, 13 nt, Human
ugcuggcugccuu

SEQ ID NO: 1992817 - RNA, 15 nt, Human
ugcuggccggacacc

SEQ ID NO: 1992818 - RNA, 16 nt, Human
ugcuggccggacaccc

SEQ ID NO: 1992819 - RNA, 23 nt, Human
ugcuguauccauccauggggcug

SEQ ID NO: 1992820 - RNA, 21 nt, Human
ugcugggauuacaagcgugag

SEQ ID NO: 1992821 - RNA, 17 nt, Human
ugcugggauuacaggug

SEQ ID NO: 1992822 - RNA, 15 nt, Human
ugcuguagacauuug

SEQ ID NO: 1992823 - RNA, 23 nt, Human
ugcuguaguguugucuuugauaa

SEQ ID NO: 1992824 - RNA, 18 nt, Human
ugcuggcaucaagaggug

SEQ ID NO: 1992825 - RNA, 21 nt, Human
ugcugcccugcccaccuggcc

SEQ ID NO: 1992826 - RNA, 19 nt, Human
ugcugcccugcccaccugg

SEQ ID NO: 1992827 - RNA, 11 nt, Human
ugcugcccugu

SEQ ID NO: 1992828 - RNA, 17 nt, Human
aggaauggacauuucua

SEQ ID NO: 1992829 - RNA, 18 nt, Human
ugcugcccugcccaccug

SEQ ID NO: 1992830 - RNA, 17 nt, Human
ugcugcccugcccaccu

SEQ ID NO: 1992831 - RNA, 16 nt, Human
ugcugcccugcccacc

SEQ ID NO: 1992832 - RNA, 13 nt, Human
ugcugcccugccc

SEQ ID NO: 1992833 - RNA, 15 nt, Human
aggaauggacauuuc

SEQ ID NO: 1992834 - RNA, 16 nt, Human
aggaauggacauuucu

SEQ ID NO: 1992835 - RNA, 19 nt, Human
aggaaugcacauggaauau

SEQ ID NO: 1992836 - RNA, 19 nt, Human
aggaaaucaccgaaaacgu

SEQ ID NO: 1992837 - RNA, 15 nt, Human
aggaaaucaccgaaa

SEQ ID NO: 1992838 - RNA, 17 nt, Human
aggaagcacaugccucu

SEQ ID NO: 1992839 - RNA, 16 nt, Human
aggaagcacaugccuc

SEQ ID NO: 1992840 - RNA, 11 nt, Human
aggaagcacau

SEQ ID NO: 1992841 - RNA, 14 nt, Human
aggaaauccagggu

SEQ ID NO: 1992842 - RNA, 16 nt, Human
aggaaaggcuccagga

SEQ ID NO: 1992843 - RNA, 15 nt, Human
aggaaaggcuccagg

SEQ ID NO: 1992844 - RNA, 14 nt, Human
aggaaaggcuccag

SEQ ID NO: 1992845 - RNA, 13 nt, Human
aggaaaggcucca

SEQ ID NO: 1992846 - RNA, 16 nt, Human
ugcugacuguuuucuc

SEQ ID NO: 1992847 - RNA, 21 nt, Human
ugcugacuguacuccucccag

SEQ ID NO: 1992848 - RNA, 22 nt, Human
ugcugacuguacuccucccagg

SEQ ID NO: 1992849 - RNA, 23 nt, Human
aggaagccagcaggcucucaggc

SEQ ID NO: 1992850 - RNA, 22 nt, Human
aggaagccagcaggcucucagg

SEQ ID NO: 1992851 - RNA, 21 nt, Human
aggaagccagcaggcucucag

SEQ ID NO: 1992852 - RNA, 22 nt, Human
aggaagcacaugccucucucag

SEQ ID NO: 1992853 - RNA, 20 nt, Human
aggaagccgcuggggccagu

SEQ ID NO: 1992854 - RNA, 19 nt, Human
aggaagccgcuggggccag

SEQ ID NO: 1992855 - RNA, 18 nt, Human
aggaagccgcuggggcca

SEQ ID NO: 1992856 - RNA, 22 nt, Human
aggaaggaaacccagcucuggu

SEQ ID NO: 1992857 - RNA, 20 nt, Human
aggaaggaaacccagcucug

SEQ ID NO: 1992858 - RNA, 23 nt, Human
aggaaggaaacccagcucugguc

SEQ ID NO: 1992859 - RNA, 12 nt, Human
aggaagcucagg

SEQ ID NO: 1992860 - RNA, 15 nt, Human
agcuuuaaaagaaaa

SEQ ID NO: 1992861 - RNA, 13 nt, Human
agcuuuaaaagaa

SEQ ID NO: 1992862 - RNA, 21 nt, Human
agcuuuaaugauaugcuugua

SEQ ID NO: 1992863 - RNA, 19 nt, Human
ugcuaucucccccagcccc

SEQ ID NO: 1992864 - RNA, 18 nt, Human
ugcuauuguagagccaga

SEQ ID NO: 1992865 - RNA, 17 nt, Human
ugcuaugucauuucaug

SEQ ID NO: 1992866 - RNA, 18 nt, Human
ugcuaugucauuucaugu

SEQ ID NO: 1992867 - RNA, 19 nt, Human
ugcuaugucauuucauguc

SEQ ID NO: 1992868 - RNA, 18 nt, Human
ugcuauuacgaaguucaa

SEQ ID NO: 1992869 - RNA, 19 nt, Human
ugcuauuacgaaguucaag

SEQ ID NO: 1992870 - RNA, 20 nt, Human
ugcuaucucccccagcccca

SEQ ID NO: 1992871 - RNA, 16 nt, Human
ugcuaugucauuucau

SEQ ID NO: 1992872 - RNA, 15 nt, Human
ugcuaugucauuuca

SEQ ID NO: 1992873 - RNA, 15 nt, Human
ugcuaucucuauuau

SEQ ID NO: 1992874 - RNA, 18 nt, Human
ugcuccccugugccagcc

SEQ ID NO: 1992875 - RNA, 16 nt, Human
ugcuccccuuccccuu

SEQ ID NO: 1992876 - RNA, 13 nt, Human
ugcucccccuuuu

SEQ ID NO: 1992877 - RNA, 15 nt, Human
ugcucccccuuuucc

SEQ ID NO: 1992878 - RNA, 14 nt, Human
ugcucuggacaggc

SEQ ID NO: 1992879 - RNA, 15 nt, Human
ugcucuggacaggca

SEQ ID NO: 1992880 - RNA, 16 nt, Human
ugcucuggacaggcau

SEQ ID NO: 1992881 - RNA, 14 nt, Human
ugcugacuguacuc

SEQ ID NO: 1992882 - RNA, 16 nt, Human
ugcugacuguacuccu

SEQ ID NO: 1992883 - RNA, 19 nt, Human
ugcugacuguacuccuccc

SEQ ID NO: 1992884 - RNA, 13 nt, Human
uggauuguccccg

SEQ ID NO: 1992885 - RNA, 21 nt, Human
uggauuguccccgacccuugc

SEQ ID NO: 1992886 - RNA, 17 nt, Human
uggauuauauuaugaag

SEQ ID NO: 1992887 - RNA, 16 nt, Human
uggauuauucaggcuu

SEQ ID NO: 1992888 - RNA, 16 nt, Human
uggauuauucuuucuc

SEQ ID NO: 1992889 - RNA, 22 nt, Human
uggauuauucuuucuccuuuuu

SEQ ID NO: 1992890 - RNA, 14 nt, Human
uggaguauauguca

SEQ ID NO: 1992891 - RNA, 13 nt, Human
uggaguagaaugu

SEQ ID NO: 1992892 - RNA, 16 nt, Human
uggaugggcagucauu

SEQ ID NO: 1992893 - RNA, 15 nt, Human
uggauggaaggggcu

SEQ ID NO: 1992894 - RNA, 20 nt, Human
uggagguacgaaaagagggg

SEQ ID NO: 1992895 - RNA, 23 nt, Human
aggccaagaguggccccaccugg

SEQ ID NO: 1992896 - RNA, 19 nt, Human
aggccaagaguggccccac

SEQ ID NO: 1992897 - RNA, 20 nt, Human
aggccaagaguggccccacc

SEQ ID NO: 1992898 - RNA, 21 nt, Human
aggccaagaguggccccaccu

SEQ ID NO: 1992899 - RNA, 22 nt, Human
aggccaagaguggccccaccug

SEQ ID NO: 1992900 - RNA, 16 nt, Human
aggccaaggugggagg

SEQ ID NO: 1992901 - RNA, 13 nt, Human
aggccaagagguu

SEQ ID NO: 1992902 - RNA, 14 nt, Human
aggccaagagguuu

SEQ ID NO: 1992903 - RNA, 21 nt, Human
aggccaagagguuuggcuccu

SEQ ID NO: 1992904 - RNA, 15 nt, Human
aggccaagaguggcc

SEQ ID NO: 1992905 - RNA, 16 nt, Human
aggccaagaguggccc

SEQ ID NO: 1992906 - RNA, 18 nt, Human
aggccaagaguggcccca

SEQ ID NO: 1992907 - RNA, 19 nt, Human
aggccaaaggaagcacaug

SEQ ID NO: 1992908 - RNA, 18 nt, Human
aggccaaaggaagcacau

SEQ ID NO: 1992909 - RNA, 16 nt, Human
aggccaaaggaagcac

SEQ ID NO: 1992910 - RNA, 18 nt, Human
aggcagccaggccacaag

SEQ ID NO: 1992911 - RNA, 16 nt, Human
aggcagccccauucug

SEQ ID NO: 1992912 - RNA, 17 nt, Human
aggcagccccauucugc

SEQ ID NO: 1992913 - RNA, 16 nt, Human
aggcccaugggaggcu

SEQ ID NO: 1992914 - RNA, 18 nt, Human
aggcccaugggaggcugg

SEQ ID NO: 1992915 - RNA, 21 nt, Human
aggcccaugggaggcuggagu

SEQ ID NO: 1992916 - RNA, 23 nt, Human
aggcccagcgcggacauccccug

SEQ ID NO: 1992917 - RNA, 12 nt, Human
aggcccagcacc

SEQ ID NO: 1992918 - RNA, 16 nt, Human
aggccccgcccaggcu

SEQ ID NO: 1992919 - RNA, 16 nt, Human
aggccccaauacccca

SEQ ID NO: 1992920 - RNA, 19 nt, Human
aggccccaauaccccaugg

SEQ ID NO: 1992921 - RNA, 21 nt, Human
aggcccagagggccugcaagg

SEQ ID NO: 1992922 - RNA, 20 nt, Human
aggccagagggagugacaga

SEQ ID NO: 1992923 - RNA, 19 nt, Human
uggcagcucaccucucccu

SEQ ID NO: 1992924 - RNA, 16 nt, Human
aggccacaagacccuu

SEQ ID NO: 1992925 - RNA, 15 nt, Human
uggcagcucaccucu

SEQ ID NO: 1992926 - RNA, 17 nt, Human
uggcagccuuggcaaac

SEQ ID NO: 1992927 - RNA, 18 nt, Human
aggccacaagacccuugu

SEQ ID NO: 1992928 - RNA, 17 nt, Human
aggccacaagacccuug

SEQ ID NO: 1992929 - RNA, 19 nt, Human
aggccacaagacccuugug

SEQ ID NO: 1992930 - RNA, 14 nt, Human
aggccagagggagu

SEQ ID NO: 1992931 - RNA, 18 nt, Human
uggcacagggcaguggga

SEQ ID NO: 1992932 - RNA, 20 nt, Human
uggcaauggaugaacugaaa

SEQ ID NO: 1992933 - RNA, 16 nt, Human
uggcaaugguaguuuc

SEQ ID NO: 1992934 - RNA, 17 nt, Human
uggcaaugguaguuucu

SEQ ID NO: 1992935 - RNA, 18 nt, Human
uggcaaugguaguuucug

SEQ ID NO: 1992936 - RNA, 19 nt, Human
uggcaaugguaguuucugu

SEQ ID NO: 1992937 - RNA, 21 nt, Human
uggcaaugguaguuucugugg

SEQ ID NO: 1992938 - RNA, 18 nt, Human
uggcaauguuuugcuuuu

SEQ ID NO: 1992939 - RNA, 16 nt, Human
uggcacagggcaugaa

SEQ ID NO: 1992940 - RNA, 19 nt, Human
uggcacagggcaugaaaug

SEQ ID NO: 1992941 - RNA, 20 nt, Human
uggcacagggcaugaaauga

SEQ ID NO: 1992942 - RNA, 13 nt, Human
uggcccacgcacu

SEQ ID NO: 1992943 - RNA, 14 nt, Human
uggcccugcccugg

SEQ ID NO: 1992944 - RNA, 14 nt, Human
uggcccaccaggcc

SEQ ID NO: 1992945 - RNA, 19 nt, Human
uggcccaccaggccccccu

SEQ ID NO: 1992946 - RNA, 20 nt, Human
uggcccaacaggggcuccau

SEQ ID NO: 1992947 - RNA, 23 nt, Human
uggccgggcgcgguggcucacgc

SEQ ID NO: 1992948 - RNA, 14 nt, Human
uggcccuggcagcc

SEQ ID NO: 1992949 - RNA, 13 nt, Human
uggccucuucaga

SEQ ID NO: 1992950 - RNA, 21 nt, Human
uggccugaagaguccucugaa

SEQ ID NO: 1992951 - RNA, 19 nt, Human
uggccugaaccacaggaga

SEQ ID NO: 1992952 - RNA, 20 nt, Human
uggccugaaccacaggagag

SEQ ID NO: 1992953 - RNA, 14 nt, Human
uggccugacucccc

SEQ ID NO: 1992954 - RNA, 17 nt, Human
uggccugacucccccag

SEQ ID NO: 1992955 - RNA, 18 nt, Human
uggccugagcugggauga

SEQ ID NO: 1992956 - RNA, 14 nt, Human
uggccucuucuaga

SEQ ID NO: 1992957 - RNA, 21 nt, Human
uggccuguucuucuauggguu

SEQ ID NO: 1992958 - RNA, 15 nt, Human
uggccugagagggga

SEQ ID NO: 1992959 - RNA, 21 nt, Human
uggccuggccccucagggucc

SEQ ID NO: 1992960 - RNA, 18 nt, Human
uggccuggccccucaggg

SEQ ID NO: 1992961 - RNA, 18 nt, Human
aggccugggggcugggca

SEQ ID NO: 1992962 - RNA, 12 nt, Human
aggccuggggac

SEQ ID NO: 1992963 - RNA, 20 nt, Human
aggccugggggcugggcaga

SEQ ID NO: 1992964 - RNA, 14 nt, Human
uggccuucggccuc

SEQ ID NO: 1992965 - RNA, 11 nt, Human
uggccaggugg

SEQ ID NO: 1992966 - RNA, 15 nt, Human
uggccagguggccac

SEQ ID NO: 1992967 - RNA, 15 nt, Human
uggcauuugcaauaa

SEQ ID NO: 1992968 - RNA, 17 nt, Human
uggcauuugcaauaaaa

SEQ ID NO: 1992969 - RNA, 17 nt, Human
uggccaauuaaggcauc

SEQ ID NO: 1992970 - RNA, 21 nt, Human
uggccaaagccaaagcuaggc

SEQ ID NO: 1992971 - RNA, 23 nt, Human
uggccaaagccaaagcuaggccu

SEQ ID NO: 1992972 - RNA, 14 nt, Human
uggccaucauuucu

SEQ ID NO: 1992973 - RNA, 22 nt, Human
uggccauaagcaacaauuuuca

SEQ ID NO: 1992974 - RNA, 23 nt, Human
uggccagugugacaaggauugcu

SEQ ID NO: 1992975 - RNA, 16 nt, Human
uggccagguggccacu

SEQ ID NO: 1992976 - RNA, 17 nt, Human
uggccagguggccacuc

SEQ ID NO: 1992977 - RNA, 19 nt, Human
uggccagguggccacucca

SEQ ID NO: 1992978 - RNA, 19 nt, Human
aggccugacuucugcuggc

SEQ ID NO: 1992979 - RNA, 17 nt, Human
aggccccgcccaggcuu

SEQ ID NO: 1992980 - RNA, 21 nt, Human
aggccugacuucugcuggcau

SEQ ID NO: 1992981 - RNA, 16 nt, Human
aggccugacuucugcu

SEQ ID NO: 1992982 - RNA, 17 nt, Human
aggccugacuucugcug

SEQ ID NO: 1992983 - RNA, 12 nt, Human
aggccccugcca

SEQ ID NO: 1992984 - RNA, 20 nt, Human
aggccccucccucuccagca

SEQ ID NO: 1992985 - RNA, 22 nt, Human
uggcaucaagaggugggagggc

SEQ ID NO: 1992986 - RNA, 23 nt, Human
uggcaucaagaggugggagggcc

SEQ ID NO: 1992987 - RNA, 21 nt, Human
uggacacagcucuucuccagg

SEQ ID NO: 1992988 - RNA, 22 nt, Human
uggacacagcucuucuccaggc

SEQ ID NO: 1992989 - RNA, 13 nt, Human
uggacacagcucu

SEQ ID NO: 1992990 - RNA, 14 nt, Human
uggacacagcucuu

SEQ ID NO: 1992991 - RNA, 18 nt, Human
aggaucucuugagccugg

SEQ ID NO: 1992992 - RNA, 17 nt, Human
aggaucucuugagccug

SEQ ID NO: 1992993 - RNA, 19 nt, Human
aggaucucuugagccuggg

SEQ ID NO: 1992994 - RNA, 20 nt, Human
uggaauuauuuuaaaagaua

SEQ ID NO: 1992995 - RNA, 18 nt, Human
aggcaaauccgaaaucag

SEQ ID NO: 1992996 - RNA, 23 nt, Human
aggcaaacauuuucucuuagaaa

SEQ ID NO: 1992997 - RNA, 22 nt, Human
aggcaaaccuuucuauaauuuu

SEQ ID NO: 1992998 - RNA, 18 nt, Human
aggcaaacauuuucucuu

SEQ ID NO: 1992999 - RNA, 19 nt, Human
aggcaaacauuuucucuua

SEQ ID NO: 1993000 - RNA, 22 nt, Human
aggcaaacauuuucucuuagaa

SEQ ID NO: 1993001 - RNA, 20 nt, Human
uggaccuugaacuggguacu

SEQ ID NO: 1993002 - RNA, 15 nt, Human
uggacccugaggccc

SEQ ID NO: 1993003 - RNA, 23 nt, Human
uggacccuguggaugauaaaaca

SEQ ID NO: 1993004 - RNA, 21 nt, Human
uggacccugaggcccagaggg

SEQ ID NO: 1993005 - RNA, 20 nt, Human
uggacccugaggcccagagg

SEQ ID NO: 1993006 - RNA, 19 nt, Human
uggacccugaggcccagag

SEQ ID NO: 1993007 - RNA, 18 nt, Human
uggacccugaggcccaga

SEQ ID NO: 1993008 - RNA, 16 nt, Human
uggacccugaggccca

SEQ ID NO: 1993009 - RNA, 23 nt, Human
uggacacagcucuucuccaggcu

SEQ ID NO: 1993010 - RNA, 15 nt, Human
uggacugugugcuca

SEQ ID NO: 1993011 - RNA, 14 nt, Human
uggagaacuagaga

SEQ ID NO: 1993012 - RNA, 18 nt, Human
uggacuuucucuaauaau

SEQ ID NO: 1993013 - RNA, 20 nt, Human
uggacuuucucuaauaauaa

SEQ ID NO: 1993014 - RNA, 21 nt, Human
uggacuuucucuaauaauaaa

SEQ ID NO: 1993015 - RNA, 22 nt, Human
uggacuuucucuaauaauaaau

SEQ ID NO: 1993016 - RNA, 23 nt, Human
uggacuuucucuaauaauaaaua

SEQ ID NO: 1993017 - RNA, 22 nt, Human
uggagaagcggcuggcagccca

SEQ ID NO: 1993018 - RNA, 13 nt, Human
uggagaagcggcu

SEQ ID NO: 1993019 - RNA, 13 nt, Human
aggcaaucauggu

SEQ ID NO: 1993020 - RNA, 22 nt, Human
aggcaaguuuucccugaaguua

SEQ ID NO: 1993021 - RNA, 18 nt, Human
uggagcggggcccacccg

SEQ ID NO: 1993022 - RNA, 15 nt, Human
uggagcuauuuuaaa

SEQ ID NO: 1993023 - RNA, 14 nt, Human
aggcaaugcuggcu

SEQ ID NO: 1993024 - RNA, 20 nt, Human
aggcacccaccaucaugucu

SEQ ID NO: 1993025 - RNA, 21 nt, Human
aggcacccaccaucaugucug

SEQ ID NO: 1993026 - RNA, 22 nt, Human
aggcacccaccaucaugucugg

SEQ ID NO: 1993027 - RNA, 20 nt, Human
aggcaccucacaggccccag

SEQ ID NO: 1993028 - RNA, 20 nt, Human
aggcaccuaccaccacgccc

SEQ ID NO: 1993029 - RNA, 13 nt, Human
aggcacccuucca

SEQ ID NO: 1993030 - RNA, 14 nt, Human
ugcuuguacauaau

SEQ ID NO: 1993031 - RNA, 16 nt, Human
ugcuuguacauaaugc

SEQ ID NO: 1993032 - RNA, 22 nt, Human
ugcuuguacauaaugcgugcau

SEQ ID NO: 1993033 - RNA, 12 nt, Human
ugcuuugugauu

SEQ ID NO: 1993034 - RNA, 19 nt, Human
ugcuuguauuuuuuaaugc

SEQ ID NO: 1993035 - RNA, 14 nt, Human
ugcuuugucuccuc

SEQ ID NO: 1993036 - RNA, 15 nt, Human
ugcuuugucuccucu

SEQ ID NO: 1993037 - RNA, 16 nt, Human
ugcuuugucuccucua

SEQ ID NO: 1993038 - RNA, 17 nt, Human
ugcuuugucuccucuau

SEQ ID NO: 1993039 - RNA, 14 nt, Human
ugcuuugugauuuu

SEQ ID NO: 1993040 - RNA, 16 nt, Human
ugcuuugugauuuuug

SEQ ID NO: 1993041 - RNA, 14 nt, Human
ugcuuuuggucugu

SEQ ID NO: 1993042 - RNA, 17 nt, Human
ugcuuuuggucugugug

SEQ ID NO: 1993043 - RNA, 14 nt, Human
ugcuuugugaacaa

SEQ ID NO: 1993044 - RNA, 12 nt, Human
ugcuuguacaua

SEQ ID NO: 1993045 - RNA, 13 nt, Human
ugcuuguacauaa

SEQ ID NO: 1993046 - RNA, 15 nt, Human
ugcuuguaacuaaaa

SEQ ID NO: 1993047 - RNA, 16 nt, Human
ugcuuggaggaaggaa

SEQ ID NO: 1993048 - RNA, 15 nt, Human
ugcuuggaggaagga

SEQ ID NO: 1993049 - RNA, 14 nt, Human
ugcuuggaggaagg

SEQ ID NO: 1993050 - RNA, 12 nt, Human
aggacaguauuu

SEQ ID NO: 1993051 - RNA, 19 nt, Human
aggacaguauuugugggga

SEQ ID NO: 1993052 - RNA, 15 nt, Human
aggacagggguuccu

SEQ ID NO: 1993053 - RNA, 16 nt, Human
aggacagggguuccuu

SEQ ID NO: 1993054 - RNA, 21 nt, Human
ugcuugaggcaacucaucuua

SEQ ID NO: 1993055 - RNA, 18 nt, Human
uggaaaugggcagagcag

SEQ ID NO: 1993056 - RNA, 19 nt, Human
uggaaaucaaauguaaagu

SEQ ID NO: 1993057 - RNA, 17 nt, Human
uggaaaugggcagagca

SEQ ID NO: 1993058 - RNA, 17 nt, Human
uggaaaucaaauguaaa

SEQ ID NO: 1993059 - RNA, 18 nt, Human
uggaaaucaaauguaaag

SEQ ID NO: 1993060 - RNA, 16 nt, Human
uggaagcacagcuuca

SEQ ID NO: 1993061 - RNA, 21 nt, Human
uggaagcacaccaaucuuacu

SEQ ID NO: 1993062 - RNA, 22 nt, Human
uggaagcacaccaaucuuacuu

SEQ ID NO: 1993063 - RNA, 18 nt, Human
uggaagauauuccugagu

SEQ ID NO: 1993064 - RNA, 18 nt, Human
uggaagauuauugagagc

SEQ ID NO: 1993065 - RNA, 18 nt, Human
uggaaguacuauaauuua

SEQ ID NO: 1993066 - RNA, 13 nt, Human
uggaagguauuua

SEQ ID NO: 1993067 - RNA, 17 nt, Human
uggaagguauuuaauag

SEQ ID NO: 1993068 - RNA, 23 nt, Human
uggaaggggacacgugacagccg

SEQ ID NO: 1993069 - RNA, 20 nt, Human
uggaagcuucuggugaccuu

SEQ ID NO: 1993070 - RNA, 23 nt, Human
uggaagcacaccaaucuuacuuu

SEQ ID NO: 1993071 - RNA, 13 nt, Human
uggaaggcccagc

SEQ ID NO: 1993072 - RNA, 15 nt, Human
uggaaggcccagcac

SEQ ID NO: 1993073 - RNA, 21 nt, Human
uggaaggcccagcaccacccu

SEQ ID NO: 1993074 - RNA, 14 nt, Human
aggauccugagcca

SEQ ID NO: 1993075 - RNA, 13 nt, Human
aggauccugagcc

SEQ ID NO: 1993076 - RNA, 15 nt, Human
aggauacugccuccc

SEQ ID NO: 1993077 - RNA, 18 nt, Human
aggauacugccuccccca

SEQ ID NO: 1993078 - RNA, 15 nt, Human
aggauacaggcugga

SEQ ID NO: 1993079 - RNA, 23 nt, Human
aggagcucacuguggugucugug

SEQ ID NO: 1993080 - RNA, 22 nt, Human
aggagcuccauacacacgcugc

SEQ ID NO: 1993081 - RNA, 13 nt, Human
aggagcugggccc

SEQ ID NO: 1993082 - RNA, 16 nt, Human
ugcaggucccuaauaa

SEQ ID NO: 1993083 - RNA, 15 nt, Human
ugcaggucccuaaua

SEQ ID NO: 1993084 - RNA, 14 nt, Human
ugcaggucccuaau

SEQ ID NO: 1993085 - RNA, 12 nt, Human
ugcaggucccua

SEQ ID NO: 1993086 - RNA, 18 nt, Human
ugcaguacuuuaccuccu

SEQ ID NO: 1993087 - RNA, 15 nt, Human
ugcaguaacuuggga

SEQ ID NO: 1993088 - RNA, 17 nt, Human
ugcaguaacuugggagu

SEQ ID NO: 1993089 - RNA, 17 nt, Human
ugcauaaguuaacuucc

SEQ ID NO: 1993090 - RNA, 14 nt, Human
ugcauaaguuaacu

SEQ ID NO: 1993091 - RNA, 23 nt, Human
ugcauaacguauaaaagccuguu

SEQ ID NO: 1993092 - RNA, 22 nt, Human
ugcauaacguauaaaagccugu

SEQ ID NO: 1993093 - RNA, 14 nt, Human
ugcagccugcgcca

SEQ ID NO: 1993094 - RNA, 11 nt, Human
ugcaggucccu

SEQ ID NO: 1993095 - RNA, 15 nt, Human
ugcagccucacaguc

SEQ ID NO: 1993096 - RNA, 13 nt, Human
ugcagccucacag

SEQ ID NO: 1993097 - RNA, 16 nt, Human
ugcagccucacagucc

SEQ ID NO: 1993098 - RNA, 19 nt, Human
ugcagccuccgcuucccug

SEQ ID NO: 1993099 - RNA, 20 nt, Human
ugcagccuccgcuucccugg

SEQ ID NO: 1993100 - RNA, 23 nt, Human
ugcagccuccgcuucccugguuc

SEQ ID NO: 1993101 - RNA, 22 nt, Human
agccugaaagaggaaugaagua

SEQ ID NO: 1993102 - RNA, 17 nt, Human
agccucccaaagugcug

SEQ ID NO: 1993103 - RNA, 14 nt, Human
agccugacagccag

SEQ ID NO: 1993104 - RNA, 15 nt, Human
agccugacagccaga

SEQ ID NO: 1993105 - RNA, 18 nt, Human
agccugacagccagaacu

SEQ ID NO: 1993106 - RNA, 19 nt, Human
agccugacagccagaacuc

SEQ ID NO: 1993107 - RNA, 17 nt, Human
agccucagcauccuggc

SEQ ID NO: 1993108 - RNA, 19 nt, Human
agccucagcauccuggcac

SEQ ID NO: 1993109 - RNA, 20 nt, Human
agccucagcauccuggcacc

SEQ ID NO: 1993110 - RNA, 21 nt, Human
agccucagcauccuggcaccc

SEQ ID NO: 1993111 - RNA, 15 nt, Human
agccuagauguuuua

SEQ ID NO: 1993112 - RNA, 15 nt, Human
agccucauguccacu

SEQ ID NO: 1993113 - RNA, 16 nt, Human
agccuagauguuuuau

SEQ ID NO: 1993114 - RNA, 22 nt, Human
agccucagcauccuggcacccg

SEQ ID NO: 1993115 - RNA, 23 nt, Human
agccucagcauccuggcacccgg

SEQ ID NO: 1993116 - RNA, 20 nt, Human
agccucauguccacugguuc

SEQ ID NO: 1993117 - RNA, 18 nt, Human
agccuccaugcugccucc

SEQ ID NO: 1993118 - RNA, 20 nt, Human
agccuccaugcugccuccag

SEQ ID NO: 1993119 - RNA, 16 nt, Human
agccucccaaagugcu

SEQ ID NO: 1993120 - RNA, 23 nt, Human
agcccuucuaccuuccugcaaca

SEQ ID NO: 1993121 - RNA, 21 nt, Human
agcccuuccucugcucccccu

SEQ ID NO: 1993122 - RNA, 22 nt, Human
agcccuucggaggaccagggcu

SEQ ID NO: 1993123 - RNA, 14 nt, Human
ugcacucaaaucuu

SEQ ID NO: 1993124 - RNA, 15 nt, Human
ugcacucaaaucuua

SEQ ID NO: 1993125 - RNA, 16 nt, Human
ugcacucaaaucuuaa

SEQ ID NO: 1993126 - RNA, 22 nt, Human
ugcacucaaaucuuaagaaaua

SEQ ID NO: 1993127 - RNA, 19 nt, Human
ugcacucaaaucuuaagaa

SEQ ID NO: 1993128 - RNA, 20 nt, Human
ugcacucaaaucuuaagaaa

SEQ ID NO: 1993129 - RNA, 14 nt, Human
ugcacucagacugu

SEQ ID NO: 1993130 - RNA, 15 nt, Human
ugcacucagacugua

SEQ ID NO: 1993131 - RNA, 15 nt, Human
agcccuuccucugcu

SEQ ID NO: 1993132 - RNA, 16 nt, Human
agcccuuccucugcuc

SEQ ID NO: 1993133 - RNA, 17 nt, Human
agcccuuccucugcucc

SEQ ID NO: 1993134 - RNA, 18 nt, Human
agcccuuccucugcuccc

SEQ ID NO: 1993135 - RNA, 19 nt, Human
agcccuuccucugcucccc

SEQ ID NO: 1993136 - RNA, 20 nt, Human
agcccuuccucugcuccccc

SEQ ID NO: 1993137 - RNA, 23 nt, Human
ugcacuauagccuaggugacaga

SEQ ID NO: 1993138 - RNA, 19 nt, Human
agccguuuguuccccaaga

SEQ ID NO: 1993139 - RNA, 22 nt, Human
agccguggcuucccgcucagcc

SEQ ID NO: 1993140 - RNA, 23 nt, Human
agccguggcuucccgcucagccc

SEQ ID NO: 1993141 - RNA, 14 nt, Human
agccguggcuuccc

SEQ ID NO: 1993142 - RNA, 21 nt, Human
agccguggcuucccgcucagc

SEQ ID NO: 1993143 - RNA, 13 nt, Human
agccguggcuucc

SEQ ID NO: 1993144 - RNA, 16 nt, Human
agccgaauagcugaug

SEQ ID NO: 1993145 - RNA, 19 nt, Human
agccgaccugaggacaugg

SEQ ID NO: 1993146 - RNA, 18 nt, Human
ugauucguagauuuaaua

SEQ ID NO: 1993147 - RNA, 15 nt, Human
ugauucuccugccuc

SEQ ID NO: 1993148 - RNA, 19 nt, Human
ugauucuccugccucagcc

SEQ ID NO: 1993149 - RNA, 18 nt, Human
agcccaguucagcuuggg

SEQ ID NO: 1993150 - RNA, 20 nt, Human
ugauucuccugccucagccu

SEQ ID NO: 1993151 - RNA, 18 nt, Human
agcccauggcacucuaug

SEQ ID NO: 1993152 - RNA, 20 nt, Human
agccccaaaacucuccucug

SEQ ID NO: 1993153 - RNA, 22 nt, Human
agccccaaaacucuccucugcu

SEQ ID NO: 1993154 - RNA, 21 nt, Human
agccccaaaacucuccucugc

SEQ ID NO: 1993155 - RNA, 24 nt, Human
agccccaaaacucuccucugcugc

SEQ ID NO: 1993156 - RNA, 17 nt, Human
agccccgaggccuucuc

SEQ ID NO: 1993157 - RNA, 22 nt, Human
agccccgaggccuucucugaag

SEQ ID NO: 1993158 - RNA, 16 nt, Human
agccccgaggccuucu

SEQ ID NO: 1993159 - RNA, 18 nt, Human
agccccuggaugcagccu

SEQ ID NO: 1993160 - RNA, 17 nt, Human
agccccuggaugcagcc

SEQ ID NO: 1993161 - RNA, 19 nt, Human
agccccuggaugcagccuc

SEQ ID NO: 1993162 - RNA, 22 nt, Human
agccccuggaugcagccucaca

SEQ ID NO: 1993163 - RNA, 20 nt, Human
agcccccagcuuccagcagg

SEQ ID NO: 1993164 - RNA, 16 nt, Human
agcccccagcuuccag

SEQ ID NO: 1993165 - RNA, 24 nt, Human
agccccuucugacccaugcugccc

SEQ ID NO: 1993166 - RNA, 20 nt, Human
agccccuucugacccaugcu

SEQ ID NO: 1993167 - RNA, 21 nt, Human
agcccugcuuugggcugcccu

SEQ ID NO: 1993168 - RNA, 21 nt, Human
agcccugguggcagugggagc

SEQ ID NO: 1993169 - RNA, 22 nt, Human
agcccugcuuugggcugcccug

SEQ ID NO: 1993170 - RNA, 23 nt, Human
agcccugcuuugggcugcccugg

SEQ ID NO: 1993171 - RNA, 21 nt, Human
agcccccagcuuccagcagga

SEQ ID NO: 1993172 - RNA, 21 nt, Human
ugcacaagcugcacccucagg

SEQ ID NO: 1993173 - RNA, 18 nt, Human
ugcacaagcugcacccuc

SEQ ID NO: 1993174 - RNA, 12 nt, Human
ugcacacagcac

SEQ ID NO: 1993175 - RNA, 24 nt, Human
ugcacacagcacgggggccaagga

SEQ ID NO: 1993176 - RNA, 22 nt, Human
ugcacacaccagagcccaccuu

SEQ ID NO: 1993177 - RNA, 22 nt, Human
agcccuguaucguauucaccuu

SEQ ID NO: 1993178 - RNA, 15 nt, Human
ugcacaagcugcacc

SEQ ID NO: 1993179 - RNA, 22 nt, Human
agcccugguggcagugggagcu

SEQ ID NO: 1993180 - RNA, 23 nt, Human
agcccugguggcagugggagcug

SEQ ID NO: 1993181 - RNA, 17 nt, Human
ugcacccucaggcaggu

SEQ ID NO: 1993182 - RNA, 16 nt, Human
ugcacccucaggcagg

SEQ ID NO: 1993183 - RNA, 20 nt, Human
ugcacccacuaaugugucau

SEQ ID NO: 1993184 - RNA, 14 nt, Human
ugcacgugugugca

SEQ ID NO: 1993185 - RNA, 15 nt, Human
ugcacgugugugcac

SEQ ID NO: 1993186 - RNA, 10 nt, Human
ugcacacauu

SEQ ID NO: 1993187 - RNA, 20 nt, Human
ugcacacauuuuuuaaaugc

SEQ ID NO: 1993188 - RNA, 21 nt, Human
ugcacacaucaucuguaagcu

SEQ ID NO: 1993189 - RNA, 16 nt, Human
ugcacacaucaucugu

SEQ ID NO: 1993190 - RNA, 17 nt, Human
ugcacacaucaucugua

SEQ ID NO: 1993191 - RNA, 23 nt, Human
ugcacacgagcagacacccuugg

SEQ ID NO: 1993192 - RNA, 14 nt, Human
ugcacacuguccua

SEQ ID NO: 1993193 - RNA, 21 nt, Human
ugcacacuguccuauuauauu

SEQ ID NO: 1993194 - RNA, 18 nt, Human
agcuaggaauuguguuua

SEQ ID NO: 1993195 - RNA, 15 nt, Human
agcuaggaacaaauc

SEQ ID NO: 1993196 - RNA, 16 nt, Human
agcuaggaacaaaucu

SEQ ID NO: 1993197 - RNA, 21 nt, Human
agcuaggaacaaaucuuccug

SEQ ID NO: 1993198 - RNA, 23 nt, Human
agcuaggaacaaaucuuccuggu

SEQ ID NO: 1993199 - RNA, 12 nt, Human
agcuaggccugg

SEQ ID NO: 1993200 - RNA, 16 nt, Human
agcuaggccuggccag

SEQ ID NO: 1993201 - RNA, 12 nt, Human
agcuaggcaggg

SEQ ID NO: 1993202 - RNA, 13 nt, Human
agcuaggcagggu

SEQ ID NO: 1993203 - RNA, 14 nt, Human
agcuaggccuggcc

SEQ ID NO: 1993204 - RNA, 15 nt, Human
agcuaggccuggcca

SEQ ID NO: 1993205 - RNA, 18 nt, Human
agcucaggugucccugca

SEQ ID NO: 1993206 - RNA, 22 nt, Human
agcucaggugucccugcacuug

SEQ ID NO: 1993207 - RNA, 20 nt, Human
agcucaggugucccugcacu

SEQ ID NO: 1993208 - RNA, 21 nt, Human
agcucaggugucccugcacuu

SEQ ID NO: 1993209 - RNA, 15 nt, Human
agcucaguuuucaac

SEQ ID NO: 1993210 - RNA, 20 nt, Human
agcucauucuccuuguguua

SEQ ID NO: 1993211 - RNA, 21 nt, Human
agcucauucuccuuguguuac

SEQ ID NO: 1993212 - RNA, 21 nt, Human
ugcccaagaauagaugcugac

SEQ ID NO: 1993213 - RNA, 22 nt, Human
ugcccaagaauagaugcugacu

SEQ ID NO: 1993214 - RNA, 23 nt, Human
ugcccaagaauagaugcugacug

SEQ ID NO: 1993215 - RNA, 23 nt, Human
ugcccagccucuuucccuuccag

SEQ ID NO: 1993216 - RNA, 16 nt, Human
ugcccagccucuuucc

SEQ ID NO: 1993217 - RNA, 17 nt, Human
ugcccagccucuuuccc

SEQ ID NO: 1993218 - RNA, 18 nt, Human
ugcccagccucuuucccu

SEQ ID NO: 1993219 - RNA, 20 nt, Human
ugcccagccccuucugaccc

SEQ ID NO: 1993220 - RNA, 21 nt, Human
ugcccagccccuucugaccca

SEQ ID NO: 1993221 - RNA, 20 nt, Human
ugcccacaggaucagucuga

SEQ ID NO: 1993222 - RNA, 19 nt, Human
ugcccacaggaucagucug

SEQ ID NO: 1993223 - RNA, 16 nt, Human
ugcccacaggaucagu

SEQ ID NO: 1993224 - RNA, 19 nt, Human
agcgguaccaaugcagaac

SEQ ID NO: 1993225 - RNA, 21 nt, Human
agcgguaccaaugcagaacuc

SEQ ID NO: 1993226 - RNA, 22 nt, Human
ugccagacgcucauucagcauc

SEQ ID NO: 1993227 - RNA, 23 nt, Human
ugccagacgcucauucagcaucu

SEQ ID NO: 1993228 - RNA, 17 nt, Human
ugccagacccccuggag

SEQ ID NO: 1993229 - RNA, 22 nt, Human
ugccacacuucaggcucuucuc

SEQ ID NO: 1993230 - RNA, 23 nt, Human
ugccacacuucaggcucuucucc

SEQ ID NO: 1993231 - RNA, 23 nt, Human
ugccacaaggaagaaauuaacuu

SEQ ID NO: 1993232 - RNA, 19 nt, Human
ugccacuuugcaaaggagc

SEQ ID NO: 1993233 - RNA, 15 nt, Human
agcguagugcagcag

SEQ ID NO: 1993234 - RNA, 19 nt, Human
agcgugagccacugcaccg

SEQ ID NO: 1993235 - RNA, 15 nt, Human
agcgugcauaaguua

SEQ ID NO: 1993236 - RNA, 22 nt, Human
agcgugagccacugcaccgggc

SEQ ID NO: 1993237 - RNA, 14 nt, Human
agcuaccucaacca

SEQ ID NO: 1993238 - RNA, 23 nt, Human
agcuaccucaaccaaugccaaaa

SEQ ID NO: 1993239 - RNA, 19 nt, Human
agcuacuaauuuuaaaaug

SEQ ID NO: 1993240 - RNA, 15 nt, Human
agcuacguuuacuca

SEQ ID NO: 1993241 - RNA, 17 nt, Human
agcuacuugggaggcug

SEQ ID NO: 1993242 - RNA, 18 nt, Human
agcuacuugggaggcuga

SEQ ID NO: 1993243 - RNA, 13 nt, Human
agcuagaauuuga

SEQ ID NO: 1993244 - RNA, 16 nt, Human
agcuagaauuugauau

SEQ ID NO: 1993245 - RNA, 18 nt, Human
agcuagacgagcaggcuu

SEQ ID NO: 1993246 - RNA, 17 nt, Human
agcuaggaaaagaaauc

SEQ ID NO: 1993247 - RNA, 20 nt, Human
agcuaggaaaagaaaucuau

SEQ ID NO: 1993248 - RNA, 22 nt, Human
agccugcuccagcuguucagcu

SEQ ID NO: 1993249 - RNA, 19 nt, Human
agccugcuccagcuguuca

SEQ ID NO: 1993250 - RNA, 16 nt, Human
agccugcuccuucccu

SEQ ID NO: 1993251 - RNA, 14 nt, Human
agccugcuccuucc

SEQ ID NO: 1993252 - RNA, 15 nt, Human
agccugcuccuuccc

SEQ ID NO: 1993253 - RNA, 11 nt, Human
agccugcuccu

SEQ ID NO: 1993254 - RNA, 15 nt, Human
agccuggucagccca

SEQ ID NO: 1993255 - RNA, 16 nt, Human
agccuggucagcccaa

SEQ ID NO: 1993256 - RNA, 22 nt, Human
agccugggugacagagcaagug

SEQ ID NO: 1993257 - RNA, 17 nt, Human
agccugcuccagcuguu

SEQ ID NO: 1993258 - RNA, 16 nt, Human
agccugcuccagcugu

SEQ ID NO: 1993259 - RNA, 15 nt, Human
agccugcuccagcug

SEQ ID NO: 1993260 - RNA, 14 nt, Human
ugcauaccacuuuu

SEQ ID NO: 1993261 - RNA, 12 nt, Human
ugcauaccacuu

SEQ ID NO: 1993262 - RNA, 13 nt, Human
agccuguuuaaga

SEQ ID NO: 1993263 - RNA, 11 nt, Human
agccuguguca

SEQ ID NO: 1993264 - RNA, 14 nt, Human
agccuuagggaagc

SEQ ID NO: 1993265 - RNA, 15 nt, Human
agccuuagggaagcu

SEQ ID NO: 1993266 - RNA, 20 nt, Human
agccuuagggaagcuggccu

SEQ ID NO: 1993267 - RNA, 22 nt, Human
agccuuagggaagcuggccuga

SEQ ID NO: 1993268 - RNA, 21 nt, Human
agccugugccucugggacugg

SEQ ID NO: 1993269 - RNA, 20 nt, Human
agccuggucagcccaaacca

SEQ ID NO: 1993270 - RNA, 21 nt, Human
ugccaauaauaauaccucccu

SEQ ID NO: 1993271 - RNA, 22 nt, Human
ugccaauaauaauaccucccuu

SEQ ID NO: 1993272 - RNA, 17 nt, Human
ugccacaaggaagaaau

SEQ ID NO: 1993273 - RNA, 18 nt, Human
ugccacaaggaagaaauu

SEQ ID NO: 1993274 - RNA, 22 nt, Human
ugccacaaggaagaaauuaacu

SEQ ID NO: 1993275 - RNA, 13 nt, Human
ugccacacuucag

SEQ ID NO: 1993276 - RNA, 14 nt, Human
ugccacacuucagg

SEQ ID NO: 1993277 - RNA, 15 nt, Human
ugccacacuucaggc

SEQ ID NO: 1993278 - RNA, 16 nt, Human
ugccacacuucaggcu

SEQ ID NO: 1993279 - RNA, 21 nt, Human
ugcauuaucuagauacuguau

SEQ ID NO: 1993280 - RNA, 22 nt, Human
ugcauuaucuagauacuguauc

SEQ ID NO: 1993281 - RNA, 16 nt, Human
agcggagaaaggaagg

SEQ ID NO: 1993282 - RNA, 20 nt, Human
ugcauuaucuagauacugua

SEQ ID NO: 1993283 - RNA, 20 nt, Human
agcggagaaaggaagggcug

SEQ ID NO: 1993284 - RNA, 18 nt, Human
agcggagacggaguccca

SEQ ID NO: 1993285 - RNA, 17 nt, Human
agccuuccagggguggg

SEQ ID NO: 1993286 - RNA, 16 nt, Human
agccuuccaggggugg

SEQ ID NO: 1993287 - RNA, 14 nt, Human
agccuuccaggggu

SEQ ID NO: 1993288 - RNA, 11 nt, Human
agccuuccagg

SEQ ID NO: 1993289 - RNA, 23 nt, Human
agccuugugaucacuuucugaaa

SEQ ID NO: 1993290 - RNA, 21 nt, Human
agccuugugggugugagcagc

SEQ ID NO: 1993291 - RNA, 19 nt, Human
ugauucccaagcucugcuc

SEQ ID NO: 1993292 - RNA, 21 nt, Human
ugauucccaagcucugcuccu

SEQ ID NO: 1993293 - RNA, 15 nt, Human
ugauucccaagcucu

SEQ ID NO: 1993294 - RNA, 16 nt, Human
ugauucccaagcucug

SEQ ID NO: 1993295 - RNA, 18 nt, Human
ugauucccaagcucugcu

SEQ ID NO: 1993296 - RNA, 23 nt, Human
agcccaggaaaggcuccaggagc

SEQ ID NO: 1993297 - RNA, 22 nt, Human
agcccaggaaaggcuccaggag

SEQ ID NO: 1993298 - RNA, 24 nt, Human
agcccaggaaaggcuccaggagca

SEQ ID NO: 1993299 - RNA, 14 nt, Human
ugauucagcucugc

SEQ ID NO: 1993300 - RNA, 13 nt, Human
ugauucagcucug

SEQ ID NO: 1993301 - RNA, 15 nt, Human
ugauucauaaugacu

SEQ ID NO: 1993302 - RNA, 21 nt, Human
agcccaggaaaggcuccagga

SEQ ID NO: 1993303 - RNA, 20 nt, Human
agcccaggaaaggcuccagg

SEQ ID NO: 1993304 - RNA, 19 nt, Human
agcccaggaaaggcuccag

SEQ ID NO: 1993305 - RNA, 22 nt, Human
agcccacuucugccauauucug

SEQ ID NO: 1993306 - RNA, 16 nt, Human
agcccagaagugcaga

SEQ ID NO: 1993307 - RNA, 15 nt, Human
agccaggccacuggc

SEQ ID NO: 1993308 - RNA, 22 nt, Human
agccaggccacaagacccuugu

SEQ ID NO: 1993309 - RNA, 21 nt, Human
agccaggccacaagacccuug

SEQ ID NO: 1993310 - RNA, 12 nt, Human
agccagggucuc

SEQ ID NO: 1993311 - RNA, 19 nt, Human
agccaggcgcuagcacagc

SEQ ID NO: 1993312 - RNA, 23 nt, Human
agccaggcgcuagcacagcuccc

SEQ ID NO: 1993313 - RNA, 23 nt, Human
agccaguaaaugggggugcauuu

SEQ ID NO: 1993314 - RNA, 14 nt, Human
agccagugaacaua

SEQ ID NO: 1993315 - RNA, 23 nt, Human
agccagugaacauaauucuuauu

SEQ ID NO: 1993316 - RNA, 14 nt, Human
agccauaggcccuu

SEQ ID NO: 1993317 - RNA, 14 nt, Human
agccaggccacaag

SEQ ID NO: 1993318 - RNA, 12 nt, Human
agccaggccaca

SEQ ID NO: 1993319 - RNA, 11 nt, Human
agccaggaggg

SEQ ID NO: 1993320 - RNA, 12 nt, Human
agccagcugccu

SEQ ID NO: 1993321 - RNA, 13 nt, Human
agccagacucugc

SEQ ID NO: 1993322 - RNA, 22 nt, Human
agccagaagccacccaaagcag

SEQ ID NO: 1993323 - RNA, 16 nt, Human
agccagaacucugugu

SEQ ID NO: 1993324 - RNA, 18 nt, Human
agccagaacucugugucc

SEQ ID NO: 1993325 - RNA, 16 nt, Human
ugauggugcaaugacc

SEQ ID NO: 1993326 - RNA, 23 nt, Human
ugauggugcaaugaccuuucaau

SEQ ID NO: 1993327 - RNA, 17 nt, Human
ugauggugcaaugaccu

SEQ ID NO: 1993328 - RNA, 20 nt, Human
ugaugauccuaggcauuugc

SEQ ID NO: 1993329 - RNA, 14 nt, Human
ugaugauccuaggc

SEQ ID NO: 1993330 - RNA, 17 nt, Human
ugauguuuuaaggaugc

SEQ ID NO: 1993331 - RNA, 18 nt, Human
ugauguuuuaaggaugcu

SEQ ID NO: 1993332 - RNA, 22 nt, Human
ugauuaaaaauaucaaauuaau

SEQ ID NO: 1993333 - RNA, 19 nt, Human
ugauuaaaaauaucaaauu

SEQ ID NO: 1993334 - RNA, 20 nt, Human
ugauuaaaaauaucaaauua

SEQ ID NO: 1993335 - RNA, 18 nt, Human
ugauguuuuuaaaaucuu

SEQ ID NO: 1993336 - RNA, 19 nt, Human
ugauguuuuuaaaaucuua

SEQ ID NO: 1993337 - RNA, 21 nt, Human
ugauguuuuuaaaaucuuauu

SEQ ID NO: 1993338 - RNA, 15 nt, Human
ugauuaaaaauauca

SEQ ID NO: 1993339 - RNA, 15 nt, Human
ugauguuuuuaaaau

SEQ ID NO: 1993340 - RNA, 16 nt, Human
ugauguuuuuaaaauc

SEQ ID NO: 1993341 - RNA, 17 nt, Human
ugauguuuuuaaaaucu

SEQ ID NO: 1993342 - RNA, 14 nt, Human
ugauguuugugcag

SEQ ID NO: 1993343 - RNA, 20 nt, Human
ugauguuugugcaguaacuu

SEQ ID NO: 1993344 - RNA, 14 nt, Human
agccacuuaggaca

SEQ ID NO: 1993345 - RNA, 13 nt, Human
agccacugcaccg

SEQ ID NO: 1993346 - RNA, 21 nt, Human
agccacugcaccgggccacag

SEQ ID NO: 1993347 - RNA, 22 nt, Human
agccacugcaccgggccacaga

SEQ ID NO: 1993348 - RNA, 15 nt, Human
ugauuaaagaugagc

SEQ ID NO: 1993349 - RNA, 22 nt, Human
ugauuaaagaugagcuuugucu

SEQ ID NO: 1993350 - RNA, 12 nt, Human
ugauuaaaccaa

SEQ ID NO: 1993351 - RNA, 15 nt, Human
ugauuaauuaaaaca

SEQ ID NO: 1993352 - RNA, 14 nt, Human
ugauuaccagggac

SEQ ID NO: 1993353 - RNA, 15 nt, Human
agccaccgaagccgc

SEQ ID NO: 1993354 - RNA, 20 nt, Human
agccaccgaagccgccugug

SEQ ID NO: 1993355 - RNA, 21 nt, Human
agccaccgaagccgccugugg

SEQ ID NO: 1993356 - RNA, 22 nt, Human
agccaccgaagccgccugugga

SEQ ID NO: 1993357 - RNA, 18 nt, Human
agccaccgugccuggcca

SEQ ID NO: 1993358 - RNA, 19 nt, Human
agccaccugaguuccugag

SEQ ID NO: 1993359 - RNA, 14 nt, Human
agccaccugaguuc

SEQ ID NO: 1993360 - RNA, 16 nt, Human
agccaccugaguuccu

SEQ ID NO: 1993361 - RNA, 14 nt, Human
agccacggccaggc

SEQ ID NO: 1993362 - RNA, 23 nt, Human
agccaccaacauacucccaucug

SEQ ID NO: 1993363 - RNA, 20 nt, Human
agccaccaacauacucccau

SEQ ID NO: 1993364 - RNA, 19 nt, Human
agccaccaacauacuccca

SEQ ID NO: 1993365 - RNA, 18 nt, Human
agccacauuccugaugcu

SEQ ID NO: 1993366 - RNA, 14 nt, Human
agccacauuccuga

SEQ ID NO: 1993367 - RNA, 13 nt, Human
ugaugaagaggag

SEQ ID NO: 1993368 - RNA, 14 nt, Human
ugaugaagaggagu

SEQ ID NO: 1993369 - RNA, 18 nt, Human
ugauccuuuuggagucag

SEQ ID NO: 1993370 - RNA, 17 nt, Human
ugauccagcccugaguu

SEQ ID NO: 1993371 - RNA, 18 nt, Human
ugauccagcccugaguuc

SEQ ID NO: 1993372 - RNA, 15 nt, Human
ugauccagcccugag

SEQ ID NO: 1993373 - RNA, 15 nt, Human
agccacggccaggcc

SEQ ID NO: 1993374 - RNA, 14 nt, Human
ugagucaccaagcc

SEQ ID NO: 1993375 - RNA, 14 nt, Human
ugaguagcucugcc

SEQ ID NO: 1993376 - RNA, 22 nt, Human
ugaguagcucugccuuugcucu

SEQ ID NO: 1993377 - RNA, 14 nt, Human
ugaguauauuauaa

SEQ ID NO: 1993378 - RNA, 15 nt, Human
ugaguauauuauaau

SEQ ID NO: 1993379 - RNA, 16 nt, Human
ugaguauauuauaaua

SEQ ID NO: 1993380 - RNA, 20 nt, Human
ugagugccuuacacaauggu

SEQ ID NO: 1993381 - RNA, 17 nt, Human
ugagugccuuacacaau

SEQ ID NO: 1993382 - RNA, 16 nt, Human
ugagucaccaagccca

SEQ ID NO: 1993383 - RNA, 17 nt, Human
ugagucaccaagcccag

SEQ ID NO: 1993384 - RNA, 18 nt, Human
ugaguucauaaauuuaug

SEQ ID NO: 1993385 - RNA, 17 nt, Human
ugaguuaggcuuucucu

SEQ ID NO: 1993386 - RNA, 21 nt, Human
ugaguggggggaacgcccacu

SEQ ID NO: 1993387 - RNA, 12 nt, Human
ugaguuaggaac

SEQ ID NO: 1993388 - RNA, 13 nt, Human
ugaguuaggaaca

SEQ ID NO: 1993389 - RNA, 21 nt, Human
ugagugggugaauaauacagu

SEQ ID NO: 1993390 - RNA, 23 nt, Human
ugagugggggaucacagccucug

SEQ ID NO: 1993391 - RNA, 14 nt, Human
ugauacuacaguuu

SEQ ID NO: 1993392 - RNA, 17 nt, Human
ugauacuacaguuuguu

SEQ ID NO: 1993393 - RNA, 20 nt, Human
ugauacaaugcugugcccua

SEQ ID NO: 1993394 - RNA, 12 nt, Human
ugauacagaaaa

SEQ ID NO: 1993395 - RNA, 21 nt, Human
ugauacaaugcugugcccuaa

SEQ ID NO: 1993396 - RNA, 24 nt, Human
ugauaagcagucauccucagauca

SEQ ID NO: 1993397 - RNA, 20 nt, Human
ugauaagaaccuuuugagug

SEQ ID NO: 1993398 - RNA, 17 nt, Human
ugaguucauacccuguu

SEQ ID NO: 1993399 - RNA, 19 nt, Human
ugauaagggacugauguuu

SEQ ID NO: 1993400 - RNA, 23 nt, Human
ugaguacuacaguccucccaucu

SEQ ID NO: 1993401 - RNA, 22 nt, Human
ugaguacuacaguccucccauc

SEQ ID NO: 1993402 - RNA, 21 nt, Human
ugaguacuacaguccucccau

SEQ ID NO: 1993403 - RNA, 17 nt, Human
ugaguacuacaguccuc

SEQ ID NO: 1993404 - RNA, 13 nt, Human
ugaguagcuggga

SEQ ID NO: 1993405 - RNA, 14 nt, Human
agcauauucaggaa

SEQ ID NO: 1993406 - RNA, 16 nt, Human
agcauaugacaaaugu

SEQ ID NO: 1993407 - RNA, 17 nt, Human
agcauaugacaaauguu

SEQ ID NO: 1993408 - RNA, 18 nt, Human
agcauaugacaaauguuu

SEQ ID NO: 1993409 - RNA, 19 nt, Human
agcauaugacaaauguuuc

SEQ ID NO: 1993410 - RNA, 20 nt, Human
agcauaugacaaauguuucu

SEQ ID NO: 1993411 - RNA, 21 nt, Human
agcauaugacaaauguuucua

SEQ ID NO: 1993412 - RNA, 15 nt, Human
ugaguacuacagucc

SEQ ID NO: 1993413 - RNA, 22 nt, Human
ugaguaacugauuuguaacaag

SEQ ID NO: 1993414 - RNA, 16 nt, Human
agcauacguacacauu

SEQ ID NO: 1993415 - RNA, 17 nt, Human
agcauacguacacauuu

SEQ ID NO: 1993416 - RNA, 18 nt, Human
agcauacguacacauuuu

SEQ ID NO: 1993417 - RNA, 19 nt, Human
agcauacguacacauuuua

SEQ ID NO: 1993418 - RNA, 20 nt, Human
agcauacguacacauuuuau

SEQ ID NO: 1993419 - RNA, 21 nt, Human
agcauacguacacauuuuauu

SEQ ID NO: 1993420 - RNA, 14 nt, Human
agcauaaagaauuu

SEQ ID NO: 1993421 - RNA, 12 nt, Human
ugagaauuaccc

SEQ ID NO: 1993422 - RNA, 15 nt, Human
agcauacguacacau

SEQ ID NO: 1993423 - RNA, 21 nt, Human
agcauaauacuugcuuuggaa

SEQ ID NO: 1993424 - RNA, 14 nt, Human
agcauguuuugcau

SEQ ID NO: 1993425 - RNA, 16 nt, Human
agcauguuuugcaugu

SEQ ID NO: 1993426 - RNA, 16 nt, Human
agcaugucuuauuuaa

SEQ ID NO: 1993427 - RNA, 17 nt, Human
agcaugucuuauuuaaa

SEQ ID NO: 1993428 - RNA, 22 nt, Human
agcauuguaagcguauggcuuu

SEQ ID NO: 1993429 - RNA, 15 nt, Human
agcauugucuauuuu

SEQ ID NO: 1993430 - RNA, 22 nt, Human
agcauugucuauuuuucucuuc

SEQ ID NO: 1993431 - RNA, 20 nt, Human
agcauuggggauguuuuucu

SEQ ID NO: 1993432 - RNA, 17 nt, Human
agcauuguaaaagcauu

SEQ ID NO: 1993433 - RNA, 20 nt, Human
agcaucaggccaggcccucu

SEQ ID NO: 1993434 - RNA, 19 nt, Human
agcaucaggccaggcccuc

SEQ ID NO: 1993435 - RNA, 18 nt, Human
agcaucaggccaggcccu

SEQ ID NO: 1993436 - RNA, 17 nt, Human
agcaucaggccaggccc

SEQ ID NO: 1993437 - RNA, 16 nt, Human
agcaucaggccaggcc

SEQ ID NO: 1993438 - RNA, 14 nt, Human
agcaucaggccagg

SEQ ID NO: 1993439 - RNA, 17 nt, Human
agcaugucgucaaagcu

SEQ ID NO: 1993440 - RNA, 20 nt, Human
agcaugucgucaaagcugaa

SEQ ID NO: 1993441 - RNA, 12 nt, Human
agcauggcugcc

SEQ ID NO: 1993442 - RNA, 20 nt, Human
ugauauucaaauggacaaac

SEQ ID NO: 1993443 - RNA, 15 nt, Human
ugauauucuuuguua

SEQ ID NO: 1993444 - RNA, 17 nt, Human
ugauauucuuuguuaau

SEQ ID NO: 1993445 - RNA, 12 nt, Human
ugauauuucaga

SEQ ID NO: 1993446 - RNA, 13 nt, Human
ugauauuucagaa

SEQ ID NO: 1993447 - RNA, 14 nt, Human
ugauauuucagaaa

SEQ ID NO: 1993448 - RNA, 18 nt, Human
ugauauucuuuguuaauu

SEQ ID NO: 1993449 - RNA, 21 nt, Human
ugauauuuguauuuauucuuu

SEQ ID NO: 1993450 - RNA, 15 nt, Human
ugauauuuguauuua

SEQ ID NO: 1993451 - RNA, 18 nt, Human
ugauauuuguauuuauuc

SEQ ID NO: 1993452 - RNA, 19 nt, Human
ugauauuuguauuuauucu

SEQ ID NO: 1993453 - RNA, 15 nt, Human
ugauauuucagaaau

SEQ ID NO: 1993454 - RNA, 16 nt, Human
ugauauuucagaaaua

SEQ ID NO: 1993455 - RNA, 19 nt, Human
ugauauuuucaacgcagcc

SEQ ID NO: 1993456 - RNA, 21 nt, Human
ugauauuuucaacgcagcccu

SEQ ID NO: 1993457 - RNA, 22 nt, Human
ugauauuuucaacgcagcccug

SEQ ID NO: 1993458 - RNA, 23 nt, Human
ugauauuuucaacgcagcccugc

SEQ ID NO: 1993459 - RNA, 21 nt, Human
ugauagaaggcuauggggaua

SEQ ID NO: 1993460 - RNA, 16 nt, Human
ugauacuuuuuugaaa

SEQ ID NO: 1993461 - RNA, 17 nt, Human
ugauacuuuuuugaaau

SEQ ID NO: 1993462 - RNA, 20 nt, Human
ugauacuuuuuugaaaucag

SEQ ID NO: 1993463 - RNA, 15 nt, Human
ugauaugugaacagu

SEQ ID NO: 1993464 - RNA, 16 nt, Human
ugauaugugaacaguu

SEQ ID NO: 1993465 - RNA, 18 nt, Human
ugaucaaagccacacucu

SEQ ID NO: 1993466 - RNA, 19 nt, Human
ugaucacggcucacugcag

SEQ ID NO: 1993467 - RNA, 22 nt, Human
agcauauucaggaagcucaggg

SEQ ID NO: 1993468 - RNA, 20 nt, Human
ugaucacggcucacugcagc

SEQ ID NO: 1993469 - RNA, 21 nt, Human
ugaucacggcucacugcagcc

SEQ ID NO: 1993470 - RNA, 13 nt, Human
agcaucaggccag

SEQ ID NO: 1993471 - RNA, 12 nt, Human
agcaucaggcca

SEQ ID NO: 1993472 - RNA, 16 nt, Human
agaugcagcucuuccu

SEQ ID NO: 1993473 - RNA, 17 nt, Human
agaugcagcucuuccug

SEQ ID NO: 1993474 - RNA, 18 nt, Human
agaugcagcucuuccugg

SEQ ID NO: 1993475 - RNA, 13 nt, Human
agaugcagcucuu

SEQ ID NO: 1993476 - RNA, 14 nt, Human
agaugcagcucuuc

SEQ ID NO: 1993477 - RNA, 17 nt, Human
ugacacuuaaaaauggu

SEQ ID NO: 1993478 - RNA, 16 nt, Human
ugacacuuaaaaaugg

SEQ ID NO: 1993479 - RNA, 23 nt, Human
agaugcugacuguacuccuccca

SEQ ID NO: 1993480 - RNA, 20 nt, Human
agaugcugacuguacuccuc

SEQ ID NO: 1993481 - RNA, 16 nt, Human
agaugccgcauuugga

SEQ ID NO: 1993482 - RNA, 14 nt, Human
agauguuuaaaaca

SEQ ID NO: 1993483 - RNA, 15 nt, Human
agauguuuaaaacac

SEQ ID NO: 1993484 - RNA, 16 nt, Human
agauguuuaaaacacc

SEQ ID NO: 1993485 - RNA, 16 nt, Human
ugacccaugcugcccu

SEQ ID NO: 1993486 - RNA, 12 nt, Human
ugacccaugcug

SEQ ID NO: 1993487 - RNA, 13 nt, Human
agauuaagaaaua

SEQ ID NO: 1993488 - RNA, 21 nt, Human
ugacccaugcugcccugugag

SEQ ID NO: 1993489 - RNA, 19 nt, Human
ugacccaugggcaggagac

SEQ ID NO: 1993490 - RNA, 16 nt, Human
ugacccaugggcagga

SEQ ID NO: 1993491 - RNA, 18 nt, Human
ugacccaugggcaggaga

SEQ ID NO: 1993492 - RNA, 15 nt, Human
ugacccaugcugccc

SEQ ID NO: 1993493 - RNA, 14 nt, Human
ugacccaugcugcc

SEQ ID NO: 1993494 - RNA, 19 nt, Human
ugaccuuccaagagccuga

SEQ ID NO: 1993495 - RNA, 20 nt, Human
ugaccuuccaagagccugag

SEQ ID NO: 1993496 - RNA, 18 nt, Human
ugaccuuccaagagccug

SEQ ID NO: 1993497 - RNA, 14 nt, Human
ugaccuuaaaugca

SEQ ID NO: 1993498 - RNA, 16 nt, Human
ugaccuuaaaugcaac

SEQ ID NO: 1993499 - RNA, 19 nt, Human
ugaccugaggcccuucucu

SEQ ID NO: 1993500 - RNA, 18 nt, Human
ugaccugaggcccuucuc

SEQ ID NO: 1993501 - RNA, 20 nt, Human
ugaccccugcccagaucagc

SEQ ID NO: 1993502 - RNA, 23 nt, Human
ugaccccucauagcccucacccu

SEQ ID NO: 1993503 - RNA, 13 nt, Human
ugaccccugccca

SEQ ID NO: 1993504 - RNA, 18 nt, Human
ugacucccccaguccccu

SEQ ID NO: 1993505 - RNA, 19 nt, Human
ugacucccccaguccccuu

SEQ ID NO: 1993506 - RNA, 22 nt, Human
ugacucccccaguccccuuccc

SEQ ID NO: 1993507 - RNA, 13 nt, Human
ugacuuacuguac

SEQ ID NO: 1993508 - RNA, 15 nt, Human
ugacuuacuguacau

SEQ ID NO: 1993509 - RNA, 16 nt, Human
ugacuuacuguacaug

SEQ ID NO: 1993510 - RNA, 14 nt, Human
ugacuaggaaaaaa

SEQ ID NO: 1993511 - RNA, 13 nt, Human
agauuggaaggaa

SEQ ID NO: 1993512 - RNA, 22 nt, Human
agauugcuguguguugccuggg

SEQ ID NO: 1993513 - RNA, 15 nt, Human
agauuggauuuuaug

SEQ ID NO: 1993514 - RNA, 17 nt, Human
agauuggauuuuauguu

SEQ ID NO: 1993515 - RNA, 22 nt, Human
agauuggauuuuauguugacau

SEQ ID NO: 1993516 - RNA, 19 nt, Human
ugacuuacuguacaugaaa

SEQ ID NO: 1993517 - RNA, 22 nt, Human
agauucauauuuacuucuuaua

SEQ ID NO: 1993518 - RNA, 18 nt, Human
agauuccagagaguggcu

SEQ ID NO: 1993519 - RNA, 23 nt, Human
agauuggauuuuauguugacauu

SEQ ID NO: 1993520 - RNA, 20 nt, Human
agauuucucauuugccaaua

SEQ ID NO: 1993521 - RNA, 17 nt, Human
agauuugaacucuucaa

SEQ ID NO: 1993522 - RNA, 14 nt, Human
agauuucucuuuga

SEQ ID NO: 1993523 - RNA, 13 nt, Human
agauuuuaguuuu

SEQ ID NO: 1993524 - RNA, 15 nt, Human
agauuuuaguuuuau

SEQ ID NO: 1993525 - RNA, 20 nt, Human
agauuuuaguuuuauuuucu

SEQ ID NO: 1993526 - RNA, 15 nt, Human
agauuucucuuugaa

SEQ ID NO: 1993527 - RNA, 11 nt, Human
agauuucuguu

SEQ ID NO: 1993528 - RNA, 12 nt, Human
agauuucuguuc

SEQ ID NO: 1993529 - RNA, 14 nt, Human
agauuucuguucag

SEQ ID NO: 1993530 - RNA, 21 nt, Human
agauuuugaaauuuuuauuaa

SEQ ID NO: 1993531 - RNA, 22 nt, Human
agauuuuaguuuuauuuucuaa

SEQ ID NO: 1993532 - RNA, 23 nt, Human
agauuuuaguuuuauuuucuaaa

SEQ ID NO: 1993533 - RNA, 18 nt, Human
agauuuuguguuuauucu

SEQ ID NO: 1993534 - RNA, 19 nt, Human
agauuuuguguuuauucuu

SEQ ID NO: 1993535 - RNA, 20 nt, Human
agauuuuguguuuauucuug

SEQ ID NO: 1993536 - RNA, 22 nt, Human
agauuuuguguuuauucuugau

SEQ ID NO: 1993537 - RNA, 23 nt, Human
agauuuuguguuuauucuugaug

SEQ ID NO: 1993538 - RNA, 21 nt, Human
agcaacuaaaaugugucuugc

SEQ ID NO: 1993539 - RNA, 14 nt, Human
agcaaaaacaugua

SEQ ID NO: 1993540 - RNA, 20 nt, Human
agcaaaaaaaguuguaugau

SEQ ID NO: 1993541 - RNA, 15 nt, Human
agcaaaaaaaguugu

SEQ ID NO: 1993542 - RNA, 18 nt, Human
agcaaaaaaaguuguaug

SEQ ID NO: 1993543 - RNA, 16 nt, Human
agcaagacgcugugcu

SEQ ID NO: 1993544 - RNA, 13 nt, Human
agcaagacgcugu

SEQ ID NO: 1993545 - RNA, 22 nt, Human
agcaagacgcugugcugcccug

SEQ ID NO: 1993546 - RNA, 21 nt, Human
agcaagacgcugugcugcccu

SEQ ID NO: 1993547 - RNA, 20 nt, Human
agcaagacgcugugcugccc

SEQ ID NO: 1993548 - RNA, 17 nt, Human
agcaagacgcugugcug

SEQ ID NO: 1993549 - RNA, 15 nt, Human
agcaagauguacuau

SEQ ID NO: 1993550 - RNA, 18 nt, Human
agcaagagagcagcaagg

SEQ ID NO: 1993551 - RNA, 23 nt, Human
agcaagagagcagcaaggucuug

SEQ ID NO: 1993552 - RNA, 23 nt, Human
agcaagacgcugugcugcccugc

SEQ ID NO: 1993553 - RNA, 20 nt, Human
ugagaagcagaggaaggaga

SEQ ID NO: 1993554 - RNA, 20 nt, Human
agauauuuugcuuugugauu

SEQ ID NO: 1993555 - RNA, 21 nt, Human
agauauuuugcuuugugauuu

SEQ ID NO: 1993556 - RNA, 18 nt, Human
agaucaaaagguuaauaa

SEQ ID NO: 1993557 - RNA, 14 nt, Human
agaucaaaaaggcu

SEQ ID NO: 1993558 - RNA, 15 nt, Human
agaucaaaaaggcuu

SEQ ID NO: 1993559 - RNA, 16 nt, Human
agaucaaaaaggcuua

SEQ ID NO: 1993560 - RNA, 19 nt, Human
agaucaaaaaggcuuauaa

SEQ ID NO: 1993561 - RNA, 20 nt, Human
agaucaaaaaggcuuauaaa

SEQ ID NO: 1993562 - RNA, 15 nt, Human
agauacuguaucaug

SEQ ID NO: 1993563 - RNA, 16 nt, Human
agauacuguaucauga

SEQ ID NO: 1993564 - RNA, 13 nt, Human
agauauuugcacc

SEQ ID NO: 1993565 - RNA, 11 nt, Human
agauauuuuau

SEQ ID NO: 1993566 - RNA, 22 nt, Human
agauaauauuaaggaagacaau

SEQ ID NO: 1993567 - RNA, 18 nt, Human
agauaauauuaaggaaga

SEQ ID NO: 1993568 - RNA, 13 nt, Human
agauacaguuacu

SEQ ID NO: 1993569 - RNA, 20 nt, Human
agauacaggaaaagcugcug

SEQ ID NO: 1993570 - RNA, 11 nt, Human
agauacuguau

SEQ ID NO: 1993571 - RNA, 22 nt, Human
agauacaguuacucagaauucu

SEQ ID NO: 1993572 - RNA, 17 nt, Human
agaguauuuuuguauuc

SEQ ID NO: 1993573 - RNA, 15 nt, Human
agagucacuggaaca

SEQ ID NO: 1993574 - RNA, 22 nt, Human
agagucagaaguuucugccgca

SEQ ID NO: 1993575 - RNA, 17 nt, Human
agaguuguuacauuuuu

SEQ ID NO: 1993576 - RNA, 22 nt, Human
agaguuuagcuguaacaguucu

SEQ ID NO: 1993577 - RNA, 23 nt, Human
agaguuuagcuguaacaguucuu

SEQ ID NO: 1993578 - RNA, 19 nt, Human
agaguuucguggcuucagg

SEQ ID NO: 1993579 - RNA, 19 nt, Human
agaguuguuacauuuuuaa

SEQ ID NO: 1993580 - RNA, 20 nt, Human
agaguuguuacauuuuuaag

SEQ ID NO: 1993581 - RNA, 17 nt, Human
agaguuugccuuauaaa

SEQ ID NO: 1993582 - RNA, 18 nt, Human
agauaauacaccacuaca

SEQ ID NO: 1993583 - RNA, 21 nt, Human
ugaauuugugaagguggaaau

SEQ ID NO: 1993584 - RNA, 13 nt, Human
ugaauuugugaag

SEQ ID NO: 1993585 - RNA, 23 nt, Human
ugaauuucuuuugccguuauuaa

SEQ ID NO: 1993586 - RNA, 23 nt, Human
ugaauuugugaagguggaaauaa

SEQ ID NO: 1993587 - RNA, 15 nt, Human
ugaauuuuuaugugu

SEQ ID NO: 1993588 - RNA, 18 nt, Human
ugaauuuuuaugugugau

SEQ ID NO: 1993589 - RNA, 23 nt, Human
ugaauuuuuauauauauaucugu

SEQ ID NO: 1993590 - RNA, 22 nt, Human
ugacaaacuucuuucacucaca

SEQ ID NO: 1993591 - RNA, 19 nt, Human
ugacacacagcucuguccu

SEQ ID NO: 1993592 - RNA, 19 nt, Human
ugacaaagacugaguacgu

SEQ ID NO: 1993593 - RNA, 14 nt, Human
ugacaaagcuuccc

SEQ ID NO: 1993594 - RNA, 16 nt, Human
ugacacacagcucugu

SEQ ID NO: 1993595 - RNA, 18 nt, Human
ugacacacagcucugucc

SEQ ID NO: 1993596 - RNA, 12 nt, Human
ugacacaugcaa

SEQ ID NO: 1993597 - RNA, 20 nt, Human
ugacacaugcaaggucauuu

SEQ ID NO: 1993598 - RNA, 22 nt, Human
ugacacauuacaagccuggaaa

SEQ ID NO: 1993599 - RNA, 21 nt, Human
ugacacgacuucuguuucaca

SEQ ID NO: 1993600 - RNA, 17 nt, Human
ugacaccccacuuagcc

SEQ ID NO: 1993601 - RNA, 18 nt, Human
ugaaaguccagaaacugu

SEQ ID NO: 1993602 - RNA, 16 nt, Human
ugaaaguccagaaacu

SEQ ID NO: 1993603 - RNA, 14 nt, Human
ugaaagucaguuua

SEQ ID NO: 1993604 - RNA, 21 nt, Human
ugaaagucaguuuaagaggcu

SEQ ID NO: 1993605 - RNA, 17 nt, Human
ugaaaguauguuuuacu

SEQ ID NO: 1993606 - RNA, 14 nt, Human
agaggcugucuguu

SEQ ID NO: 1993607 - RNA, 16 nt, Human
agaggcugguuccaga

SEQ ID NO: 1993608 - RNA, 16 nt, Human
agagggagggagggcu

SEQ ID NO: 1993609 - RNA, 22 nt, Human
agagggacuguucuuuuguccc

SEQ ID NO: 1993610 - RNA, 12 nt, Human
ugaagccuuugu

SEQ ID NO: 1993611 - RNA, 22 nt, Human
ugaaggggccaaggagggugag

SEQ ID NO: 1993612 - RNA, 20 nt, Human
ugaagcuaucguaaaauuaa

SEQ ID NO: 1993613 - RNA, 22 nt, Human
agaggugugcaagagagggaug

SEQ ID NO: 1993614 - RNA, 23 nt, Human
agaggugugcaagagagggaugc

SEQ ID NO: 1993615 - RNA, 16 nt, Human
agagguggggagcaga

SEQ ID NO: 1993616 - RNA, 15 nt, Human
agagguuaagguggg

SEQ ID NO: 1993617 - RNA, 15 nt, Human
agaguauggauugaa

SEQ ID NO: 1993618 - RNA, 14 nt, Human
ugaauguaugcuuc

SEQ ID NO: 1993619 - RNA, 19 nt, Human
ugaauguaugcuucauaca

SEQ ID NO: 1993620 - RNA, 20 nt, Human
ugaauguaugcuucauacag

SEQ ID NO: 1993621 - RNA, 23 nt, Human
ugaauguaugcuucauacaggga

SEQ ID NO: 1993622 - RNA, 13 nt, Human
ugaauaugauuaa

SEQ ID NO: 1993623 - RNA, 14 nt, Human
ugaauaugauuaaa

SEQ ID NO: 1993624 - RNA, 15 nt, Human
ugaauaugauuaaaa

SEQ ID NO: 1993625 - RNA, 21 nt, Human
ugaauaugauuaaaaauauca

SEQ ID NO: 1993626 - RNA, 22 nt, Human
ugaauaugauuaaaaauaucaa

SEQ ID NO: 1993627 - RNA, 16 nt, Human
ugaauauugccauuau

SEQ ID NO: 1993628 - RNA, 18 nt, Human
ugaauauugccauuaugc

SEQ ID NO: 1993629 - RNA, 15 nt, Human
ugaagucacugcaca

SEQ ID NO: 1993630 - RNA, 16 nt, Human
ugaagucacugcacag

SEQ ID NO: 1993631 - RNA, 21 nt, Human
ugaagucacugcacagugcau

SEQ ID NO: 1993632 - RNA, 16 nt, Human
ugaauaaagacaccua

SEQ ID NO: 1993633 - RNA, 22 nt, Human
ugaaggguaauuauauaguuac

SEQ ID NO: 1993634 - RNA, 15 nt, Human
ugaagggguuuucuu

SEQ ID NO: 1993635 - RNA, 18 nt, Human
ugaagguagaauguuuuc

SEQ ID NO: 1993636 - RNA, 19 nt, Human
ugaagguagaauguuuuca

SEQ ID NO: 1993637 - RNA, 14 nt, Human
ugaagucacacagu

SEQ ID NO: 1993638 - RNA, 14 nt, Human
ugaagucacugcac

SEQ ID NO: 1993639 - RNA, 15 nt, Human
ugaauacuuuauaaa

SEQ ID NO: 1993640 - RNA, 18 nt, Human
ugaauacugcuugaauaa

SEQ ID NO: 1993641 - RNA, 21 nt, Human
ugaauacugcuugaauaaaca

SEQ ID NO: 1993642 - RNA, 13 nt, Human
ugaauacugcuug

SEQ ID NO: 1993643 - RNA, 15 nt, Human
ugaauacugcuugaa

SEQ ID NO: 1993644 - RNA, 16 nt, Human
ugaauacugcuugaau

SEQ ID NO: 1993645 - RNA, 13 nt, Human
ugaauacuugaac

SEQ ID NO: 1993646 - RNA, 15 nt, Human
ugaauacuugaacca

SEQ ID NO: 1993647 - RNA, 16 nt, Human
ugaauacuugaaccau

SEQ ID NO: 1993648 - RNA, 19 nt, Human
ugaauacuugaaccauaaa

SEQ ID NO: 1993649 - RNA, 14 nt, Human
ucuucccauggugc

SEQ ID NO: 1993650 - RNA, 13 nt, Human
ucuuccccaggaa

SEQ ID NO: 1993651 - RNA, 22 nt, Human
ucuucccuacaguugaaaaaca

SEQ ID NO: 1993652 - RNA, 19 nt, Human
ucuucccuacaguugaaaa

SEQ ID NO: 1993653 - RNA, 14 nt, Human
ucuuccucccuccc

SEQ ID NO: 1993654 - RNA, 16 nt, Human
ucuuccuccaaggaca

SEQ ID NO: 1993655 - RNA, 15 nt, Human
ucuuccucccucccu

SEQ ID NO: 1993656 - RNA, 20 nt, Human
ucuuccuccaaggacagaag

SEQ ID NO: 1993657 - RNA, 12 nt, Human
ucuuccuccuga

SEQ ID NO: 1993658 - RNA, 14 nt, Human
ucuuccuccugaca

SEQ ID NO: 1993659 - RNA, 11 nt, Human
ucuuccucugc

SEQ ID NO: 1993660 - RNA, 12 nt, Human
ucuuccucugcu

SEQ ID NO: 1993661 - RNA, 14 nt, Human
ucuuccucugcuga

SEQ ID NO: 1993662 - RNA, 19 nt, Human
ucuuccucugcuaaauuga

SEQ ID NO: 1993663 - RNA, 15 nt, Human
ucuuccucuugaccc

SEQ ID NO: 1993664 - RNA, 16 nt, Human
ucuuccucuugacccu

SEQ ID NO: 1993665 - RNA, 20 nt, Human
ucuuccucuugacccugcac

SEQ ID NO: 1993666 - RNA, 21 nt, Human
ucuuccucugcuaaauugaug

SEQ ID NO: 1993667 - RNA, 17 nt, Human
ucuucucucugcucuga

SEQ ID NO: 1993668 - RNA, 12 nt, Human
ucuucucucugc

SEQ ID NO: 1993669 - RNA, 14 nt, Human
ucuucucucugcuc

SEQ ID NO: 1993670 - RNA, 14 nt, Human
agaaucacuugaac

SEQ ID NO: 1993671 - RNA, 22 nt, Human
agaaucaccuaauuaauuucag

SEQ ID NO: 1993672 - RNA, 13 nt, Human
agaaucacaggcu

SEQ ID NO: 1993673 - RNA, 15 nt, Human
agaaucacaggcugg

SEQ ID NO: 1993674 - RNA, 16 nt, Human
agaaucacaggcuggg

SEQ ID NO: 1993675 - RNA, 19 nt, Human
agaaucaccuaauuaauuu

SEQ ID NO: 1993676 - RNA, 15 nt, Human
ucuucaacucccugc

SEQ ID NO: 1993677 - RNA, 16 nt, Human
ucuucaacugaccagc

SEQ ID NO: 1993678 - RNA, 19 nt, Human
ucuucaacugaccagccuc

SEQ ID NO: 1993679 - RNA, 12 nt, Human
ucuucagagacu

SEQ ID NO: 1993680 - RNA, 18 nt, Human
ucuucagagacuccugca

SEQ ID NO: 1993681 - RNA, 17 nt, Human
ucuucagagacuccugc

SEQ ID NO: 1993682 - RNA, 20 nt, Human
ucuuccaggcugggagagcc

SEQ ID NO: 1993683 - RNA, 17 nt, Human
ucuuccaggcugggaga

SEQ ID NO: 1993684 - RNA, 15 nt, Human
ucuuccaggcuggga

SEQ ID NO: 1993685 - RNA, 20 nt, Human
ucuucagagacuccugcagg

SEQ ID NO: 1993686 - RNA, 21 nt, Human
ucuuccaggcugggagagccu

SEQ ID NO: 1993687 - RNA, 18 nt, Human
ucuucccaacuugccuuu

SEQ ID NO: 1993688 - RNA, 21 nt, Human
ucuucccaacuugccuuugaa

SEQ ID NO: 1993689 - RNA, 13 nt, Human
agacccccuggag

SEQ ID NO: 1993690 - RNA, 14 nt, Human
agacccccuggaga

SEQ ID NO: 1993691 - RNA, 15 nt, Human
agacccccuggagac

SEQ ID NO: 1993692 - RNA, 19 nt, Human
agacccccuggagacuaac

SEQ ID NO: 1993693 - RNA, 21 nt, Human
agacauagaauuaacacauga

SEQ ID NO: 1993694 - RNA, 19 nt, Human
agacauacuaaccagcaga

SEQ ID NO: 1993695 - RNA, 17 nt, Human
agacaucaacagauaaa

SEQ ID NO: 1993696 - RNA, 18 nt, Human
agacaucaacagauaaau

SEQ ID NO: 1993697 - RNA, 14 nt, Human
agacauauuuacaa

SEQ ID NO: 1993698 - RNA, 20 nt, Human
ucuucuguggguuucuaaag

SEQ ID NO: 1993699 - RNA, 12 nt, Human
ucuucuguccaa

SEQ ID NO: 1993700 - RNA, 12 nt, Human
ucuucuguguuu

SEQ ID NO: 1993701 - RNA, 15 nt, Human
ucuucuguacgucug

SEQ ID NO: 1993702 - RNA, 20 nt, Human
ucuucuguacgucugacagg

SEQ ID NO: 1993703 - RNA, 18 nt, Human
ucuucuggguuccuuccu

SEQ ID NO: 1993704 - RNA, 21 nt, Human
ucuucugaacuuggcgcugcc

SEQ ID NO: 1993705 - RNA, 12 nt, Human
ucuucugcuuca

SEQ ID NO: 1993706 - RNA, 19 nt, Human
ucuucugcuucagccuccc

SEQ ID NO: 1993707 - RNA, 19 nt, Human
ucuugguccugcugcaguu

SEQ ID NO: 1993708 - RNA, 17 nt, Human
ucuugguccugcugcag

SEQ ID NO: 1993709 - RNA, 15 nt, Human
ucuugguccugcugc

SEQ ID NO: 1993710 - RNA, 12 nt, Human
ucuuuaacuugu

SEQ ID NO: 1993711 - RNA, 16 nt, Human
ucuuuaacuuguaaua

SEQ ID NO: 1993712 - RNA, 17 nt, Human
ucuuuccugaggcuggg

SEQ ID NO: 1993713 - RNA, 18 nt, Human
ucuuucuaaugugugaau

SEQ ID NO: 1993714 - RNA, 13 nt, Human
ucuuucucugagg

SEQ ID NO: 1993715 - RNA, 15 nt, Human
ucuuucucugaggac

SEQ ID NO: 1993716 - RNA, 17 nt, Human
ucuugggcaauauucuc

SEQ ID NO: 1993717 - RNA, 21 nt, Human
ucuugggcaauauucucugua

SEQ ID NO: 1993718 - RNA, 22 nt, Human
ucuugggcaauauucucuguac

SEQ ID NO: 1993719 - RNA, 24 nt, Human
ucuugggcaauauucucuguacau

SEQ ID NO: 1993720 - RNA, 14 nt, Human
ucuugguccugcug

SEQ ID NO: 1993721 - RNA, 17 nt, Human
ucuuggucagauuugaa

SEQ ID NO: 1993722 - RNA, 16 nt, Human
ucuugggggaaaauac

SEQ ID NO: 1993723 - RNA, 17 nt, Human
ucuuggcuuggugagga

SEQ ID NO: 1993724 - RNA, 16 nt, Human
ucuuggccuuacugua

SEQ ID NO: 1993725 - RNA, 19 nt, Human
ucuugcaauggcagccuug

SEQ ID NO: 1993726 - RNA, 18 nt, Human
ucuugcaauggcagccuu

SEQ ID NO: 1993727 - RNA, 22 nt, Human
ucuugcaauggcagccuuggca

SEQ ID NO: 1993728 - RNA, 21 nt, Human
ucuugaugccuggcggggugg

SEQ ID NO: 1993729 - RNA, 23 nt, Human
ucuugauucguagauuuaauaac

SEQ ID NO: 1993730 - RNA, 13 nt, Human
ucuugauucauaa

SEQ ID NO: 1993731 - RNA, 20 nt, Human
ucuugaguuguuuuuguaua

SEQ ID NO: 1993732 - RNA, 21 nt, Human
ucuugaguuguuuuuguauau

SEQ ID NO: 1993733 - RNA, 18 nt, Human
agacuauguaaaaauaac

SEQ ID NO: 1993734 - RNA, 15 nt, Human
ucuugacucuugccu

SEQ ID NO: 1993735 - RNA, 16 nt, Human
ucuugagccugggagg

SEQ ID NO: 1993736 - RNA, 13 nt, Human
ucuugagccuggg

SEQ ID NO: 1993737 - RNA, 16 nt, Human
ucuugagccuugaacu

SEQ ID NO: 1993738 - RNA, 23 nt, Human
agaccuucuccuucaccuuuguc

SEQ ID NO: 1993739 - RNA, 21 nt, Human
agaccuucuccuucaccuuug

SEQ ID NO: 1993740 - RNA, 18 nt, Human
agaccuucuccuucaccu

SEQ ID NO: 1993741 - RNA, 15 nt, Human
agaccuucuccuuca

SEQ ID NO: 1993742 - RNA, 11 nt, Human
agaccuucucc

SEQ ID NO: 1993743 - RNA, 20 nt, Human
agaccuggggcugcugugaa

SEQ ID NO: 1993744 - RNA, 22 nt, Human
agagccuuccaggggugggaca

SEQ ID NO: 1993745 - RNA, 17 nt, Human
agagccuuccaggggug

SEQ ID NO: 1993746 - RNA, 15 nt, Human
agagccuuccagggg

SEQ ID NO: 1993747 - RNA, 13 nt, Human
agagccuuccagg

SEQ ID NO: 1993748 - RNA, 20 nt, Human
agagcuagcagcagggaggg

SEQ ID NO: 1993749 - RNA, 12 nt, Human
agagcugaacag

SEQ ID NO: 1993750 - RNA, 14 nt, Human
agagcugccaccug

SEQ ID NO: 1993751 - RNA, 14 nt, Human
agagcuaggcaggg

SEQ ID NO: 1993752 - RNA, 19 nt, Human
agagcuauggacagcauug

SEQ ID NO: 1993753 - RNA, 23 nt, Human
agagcuauggacagcauugccag

SEQ ID NO: 1993754 - RNA, 19 nt, Human
agagcaguugagaggacac

SEQ ID NO: 1993755 - RNA, 23 nt, Human
agagcaccuuagacagucccugc

SEQ ID NO: 1993756 - RNA, 21 nt, Human
agagcaccuuagacagucccu

SEQ ID NO: 1993757 - RNA, 23 nt, Human
agagcaaccccuggaccccagcc

SEQ ID NO: 1993758 - RNA, 24 nt, Human
agagcaaccccuggaccccagccu

SEQ ID NO: 1993759 - RNA, 22 nt, Human
agagcaccuuagacagucccug

SEQ ID NO: 1993760 - RNA, 19 nt, Human
agagcagcuccuuccuagc

SEQ ID NO: 1993761 - RNA, 22 nt, Human
agagacuccugcaggcagccag

SEQ ID NO: 1993762 - RNA, 21 nt, Human
agagacuccugcaggcagcca

SEQ ID NO: 1993763 - RNA, 20 nt, Human
agagacuccugcaggcagcc

SEQ ID NO: 1993764 - RNA, 19 nt, Human
agagacuccugcaggcagc

SEQ ID NO: 1993765 - RNA, 18 nt, Human
agagacuccugcaggcag

SEQ ID NO: 1993766 - RNA, 17 nt, Human
agagacuccugcaggca

SEQ ID NO: 1993767 - RNA, 15 nt, Human
agagacuccugcagg

SEQ ID NO: 1993768 - RNA, 16 nt, Human
agagacuccagcuggg

SEQ ID NO: 1993769 - RNA, 12 nt, Human
ugaaacuuuugg

SEQ ID NO: 1993770 - RNA, 12 nt, Human
ugaaacuuugag

SEQ ID NO: 1993771 - RNA, 14 nt, Human
ugaaacuuugagau

SEQ ID NO: 1993772 - RNA, 22 nt, Human
ugaaacuuugagaucuaaaaau

SEQ ID NO: 1993773 - RNA, 23 nt, Human
ugaaacuuugagaucuaaaaaua

SEQ ID NO: 1993774 - RNA, 14 nt, Human
ugaaagaauguaaa

SEQ ID NO: 1993775 - RNA, 15 nt, Human
ugaaagaauguaaag

SEQ ID NO: 1993776 - RNA, 16 nt, Human
ugaaagaauguaaagc

SEQ ID NO: 1993777 - RNA, 15 nt, Human
ugaaagacuguacaa

SEQ ID NO: 1993778 - RNA, 13 nt, Human
ugaaagacuguac

SEQ ID NO: 1993779 - RNA, 23 nt, Human
agagcaagacgcugugcugcccu

SEQ ID NO: 1993780 - RNA, 19 nt, Human
agagcaagacgcugugcug

SEQ ID NO: 1993781 - RNA, 19 nt, Human
agagauguguaauuuuucu

SEQ ID NO: 1993782 - RNA, 18 nt, Human
agagcaaccccuggaccc

SEQ ID NO: 1993783 - RNA, 21 nt, Human
agagcaaccccuggaccccag

SEQ ID NO: 1993784 - RNA, 22 nt, Human
agagcaaccccuggaccccagc

SEQ ID NO: 1993785 - RNA, 20 nt, Human
agagauggcuuacaaaaaga

SEQ ID NO: 1993786 - RNA, 23 nt, Human
agagauggcuuacaaaaagaaau

SEQ ID NO: 1993787 - RNA, 16 nt, Human
agagaugucucuuaua

SEQ ID NO: 1993788 - RNA, 13 nt, Human
agagauguguaau

SEQ ID NO: 1993789 - RNA, 14 nt, Human
agagauguguaauu

SEQ ID NO: 1993790 - RNA, 18 nt, Human
agagauguguaauuuuuc

SEQ ID NO: 1993791 - RNA, 23 nt, Human
agagacuccugcaggcagccagg

SEQ ID NO: 1993792 - RNA, 22 nt, Human
agagaucaaccccuucgcuccu

SEQ ID NO: 1993793 - RNA, 20 nt, Human
agagacaggguuucaccaug

SEQ ID NO: 1993794 - RNA, 22 nt, Human
ucuuuggucuacacugugcuga

SEQ ID NO: 1993795 - RNA, 13 nt, Human
ucuuucucuuuua

SEQ ID NO: 1993796 - RNA, 20 nt, Human
ucuuucuggcuaugcauuug

SEQ ID NO: 1993797 - RNA, 21 nt, Human
ucuuucuggcuaugcauuuga

SEQ ID NO: 1993798 - RNA, 21 nt, Human
ucuuucugguuguuuuuaaac

SEQ ID NO: 1993799 - RNA, 12 nt, Human
agagacaggcag

SEQ ID NO: 1993800 - RNA, 13 nt, Human
agagacaggcagg

SEQ ID NO: 1993801 - RNA, 22 nt, Human
agagacaggcaggugaucugcu

SEQ ID NO: 1993802 - RNA, 14 nt, Human
ucuuuguuaauuug

SEQ ID NO: 1993803 - RNA, 13 nt, Human
ucuuuuaaaaagu

SEQ ID NO: 1993804 - RNA, 14 nt, Human
ucuuuuaaaaagua

SEQ ID NO: 1993805 - RNA, 16 nt, Human
ucuuuuaaaaaguauu

SEQ ID NO: 1993806 - RNA, 17 nt, Human
ucuuuuaaaaaguauug

SEQ ID NO: 1993807 - RNA, 16 nt, Human
ugaaaaaggaggaaga

SEQ ID NO: 1993808 - RNA, 23 nt, Human
ugaaaaaauauauaucaaauaua

SEQ ID NO: 1993809 - RNA, 16 nt, Human
ugaaaaaagcaguucu

SEQ ID NO: 1993810 - RNA, 17 nt, Human
ugaaaaaagcaguucuu

SEQ ID NO: 1993811 - RNA, 22 nt, Human
ugaaaaaguucugcagauaaac

SEQ ID NO: 1993812 - RNA, 22 nt, Human
ugaaaaaggaggaagagaaaaa

SEQ ID NO: 1993813 - RNA, 20 nt, Human
ugaaaaaggaggaagagaaa

SEQ ID NO: 1993814 - RNA, 19 nt, Human
ugaaaaaugagauugaaug

SEQ ID NO: 1993815 - RNA, 14 nt, Human
ugaaaaggccaaga

SEQ ID NO: 1993816 - RNA, 17 nt, Human
ugaaaagcuuuguuugu

SEQ ID NO: 1993817 - RNA, 21 nt, Human
ugaaaagcuuuguuuguucuu

SEQ ID NO: 1993818 - RNA, 18 nt, Human
ugaaaaguaauauuuauu

SEQ ID NO: 1993819 - RNA, 19 nt, Human
ugaaaaguaauauuuauua

SEQ ID NO: 1993820 - RNA, 20 nt, Human
ugaaaaguaauauuuauuaa

SEQ ID NO: 1993821 - RNA, 20 nt, Human
ugaaaauaguuuauuuuaaa

SEQ ID NO: 1993822 - RNA, 21 nt, Human
ugaaaaguaauauuuauuaaa

SEQ ID NO: 1993823 - RNA, 22 nt, Human
ugaaaauaguuuauuuuaaaac

SEQ ID NO: 1993824 - RNA, 23 nt, Human
ugaaaauaguuuauuuuaaaaca

SEQ ID NO: 1993825 - RNA, 13 nt, Human
ugaaaauauauac

SEQ ID NO: 1993826 - RNA, 16 nt, Human
ugaaaauaucggggag

SEQ ID NO: 1993827 - RNA, 11 nt, Human
ugaaaauauuu

SEQ ID NO: 1993828 - RNA, 12 nt, Human
ugaaaauauuua

SEQ ID NO: 1993829 - RNA, 13 nt, Human
ugaaaauauuuaa

SEQ ID NO: 1993830 - RNA, 14 nt, Human
ugaaaauauuuaaa

SEQ ID NO: 1993831 - RNA, 16 nt, Human
ugaaaaucgugacaac

SEQ ID NO: 1993832 - RNA, 12 nt, Human
ugaaacuuggau

SEQ ID NO: 1993833 - RNA, 17 nt, Human
ugaaacugacuugcugu

SEQ ID NO: 1993834 - RNA, 18 nt, Human
ugaaacuccagaugccac

SEQ ID NO: 1993835 - RNA, 19 nt, Human
ugaaacuccagaugccaca

SEQ ID NO: 1993836 - RNA, 17 nt, Human
ugaaacuccagaugcca

SEQ ID NO: 1993837 - RNA, 16 nt, Human
ugaaacgcaaccacca

SEQ ID NO: 1993838 - RNA, 17 nt, Human
ugaaaauguauguguaa

SEQ ID NO: 1993839 - RNA, 19 nt, Human
ugaaaaucgugacaacacu

SEQ ID NO: 1993840 - RNA, 20 nt, Human
ugaaaaucuuauaauuuaaa

SEQ ID NO: 1993841 - RNA, 17 nt, Human
agaagccacccaaagca

SEQ ID NO: 1993842 - RNA, 18 nt, Human
agaagccacccaaagcag

SEQ ID NO: 1993843 - RNA, 12 nt, Human
agaacuuuguau

SEQ ID NO: 1993844 - RNA, 17 nt, Human
agaacuuguuuaauaaa

SEQ ID NO: 1993845 - RNA, 15 nt, Human
agaacuugcugccuc

SEQ ID NO: 1993846 - RNA, 12 nt, Human
agaacuuguuua

SEQ ID NO: 1993847 - RNA, 14 nt, Human
agaacuugcugccu

SEQ ID NO: 1993848 - RNA, 22 nt, Human
agaacuugaagccugcuccuuc

SEQ ID NO: 1993849 - RNA, 23 nt, Human
agaacugcagucacugcacguuu

SEQ ID NO: 1993850 - RNA, 17 nt, Human
agaacuugaagccugcu

SEQ ID NO: 1993851 - RNA, 16 nt, Human
agaagcagaggaagga

SEQ ID NO: 1993852 - RNA, 19 nt, Human
agaagcaacccaaauguuc

SEQ ID NO: 1993853 - RNA, 17 nt, Human
agaacuuuguauaguua

SEQ ID NO: 1993854 - RNA, 13 nt, Human
agaacuuuguaua

SEQ ID NO: 1993855 - RNA, 15 nt, Human
agaacuuuguauagu

SEQ ID NO: 1993856 - RNA, 23 nt, Human
agaagcccaggaaaggcuccagg

SEQ ID NO: 1993857 - RNA, 20 nt, Human
ucugcccauccugccccuga

SEQ ID NO: 1993858 - RNA, 17 nt, Human
ucugcccagcuuuucau

SEQ ID NO: 1993859 - RNA, 18 nt, Human
ucugcccagcuuuucauu

SEQ ID NO: 1993860 - RNA, 23 nt, Human
ucugcccacucccugcaaccuga

SEQ ID NO: 1993861 - RNA, 13 nt, Human
ucugcccagcuuu

SEQ ID NO: 1993862 - RNA, 14 nt, Human
ucugccccagcuug

SEQ ID NO: 1993863 - RNA, 18 nt, Human
ucugccccagcuugggca

SEQ ID NO: 1993864 - RNA, 22 nt, Human
ucugccccaaguuuugugaaau

SEQ ID NO: 1993865 - RNA, 15 nt, Human
ucugccccaaguuuu

SEQ ID NO: 1993866 - RNA, 16 nt, Human
ucugccccaaguuuug

SEQ ID NO: 1993867 - RNA, 23 nt, Human
ucugcccuugguuaggcauugug

SEQ ID NO: 1993868 - RNA, 12 nt, Human
ucugcccuuggu

SEQ ID NO: 1993869 - RNA, 22 nt, Human
ucugcccugcgggucacaggag

SEQ ID NO: 1993870 - RNA, 18 nt, Human
agaacuaucuucaucuga

SEQ ID NO: 1993871 - RNA, 19 nt, Human
agaacuaucuucaucugag

SEQ ID NO: 1993872 - RNA, 13 nt, Human
agaacuaucuuca

SEQ ID NO: 1993873 - RNA, 14 nt, Human
agaacuaucuucau

SEQ ID NO: 1993874 - RNA, 17 nt, Human
agaacuaucuucaucug

SEQ ID NO: 1993875 - RNA, 16 nt, Human
agaacgcugauuuaaa

SEQ ID NO: 1993876 - RNA, 20 nt, Human
agaacuaccuggauuuguau

SEQ ID NO: 1993877 - RNA, 23 nt, Human
agaaccuuuugagugccuuacac

SEQ ID NO: 1993878 - RNA, 22 nt, Human
agaacgccagggaccccagaau

SEQ ID NO: 1993879 - RNA, 19 nt, Human
agaaccuuuugagugccuu

SEQ ID NO: 1993880 - RNA, 17 nt, Human
agaacucccuuucaaca

SEQ ID NO: 1993881 - RNA, 15 nt, Human
agaacucccuuucaa

SEQ ID NO: 1993882 - RNA, 16 nt, Human
agaacucccuuucaac

SEQ ID NO: 1993883 - RNA, 16 nt, Human
agaacugcagucacug

SEQ ID NO: 1993884 - RNA, 18 nt, Human
agaacugcagucacugca

SEQ ID NO: 1993885 - RNA, 17 nt, Human
ucugaaucuucugaaac

SEQ ID NO: 1993886 - RNA, 13 nt, Human
agaaauuagggcu

SEQ ID NO: 1993887 - RNA, 19 nt, Human
agaaauuagggcucuaauu

SEQ ID NO: 1993888 - RNA, 20 nt, Human
agaaauuagggcucuaauuu

SEQ ID NO: 1993889 - RNA, 12 nt, Human
agaaauuaugug

SEQ ID NO: 1993890 - RNA, 21 nt, Human
agaaauuagggcucuaauuuc

SEQ ID NO: 1993891 - RNA, 22 nt, Human
agaaauuagggcucuaauuucc

SEQ ID NO: 1993892 - RNA, 23 nt, Human
agaaauuagggcucuaauuuccu

SEQ ID NO: 1993893 - RNA, 23 nt, Human
ucugcaggucccuaauaaagcug

SEQ ID NO: 1993894 - RNA, 22 nt, Human
ucugcaggucccuaauaaagcu

SEQ ID NO: 1993895 - RNA, 19 nt, Human
ucugcaggucccuaauaaa

SEQ ID NO: 1993896 - RNA, 21 nt, Human
ucugcaggucccuaauaaagc

SEQ ID NO: 1993897 - RNA, 15 nt, Human
ucugaaucuucugaa

SEQ ID NO: 1993898 - RNA, 19 nt, Human
ucugaauaagcacuuuuua

SEQ ID NO: 1993899 - RNA, 19 nt, Human
ucugaaguuauauuuccua

SEQ ID NO: 1993900 - RNA, 15 nt, Human
ucugaauaagcacuu

SEQ ID NO: 1993901 - RNA, 18 nt, Human
ucugaauaagcacuuuuu

SEQ ID NO: 1993902 - RNA, 14 nt, Human
ucugaaguuauauu

SEQ ID NO: 1993903 - RNA, 17 nt, Human
ucugaaguuauauuucc

SEQ ID NO: 1993904 - RNA, 18 nt, Human
ucugaaguuauauuuccu

SEQ ID NO: 1993905 - RNA, 19 nt, Human
ucuggauucauauuuaauu

SEQ ID NO: 1993906 - RNA, 16 nt, Human
ucuggauucauauuua

SEQ ID NO: 1993907 - RNA, 22 nt, Human
ucuggcaauggaugaacugaaa

SEQ ID NO: 1993908 - RNA, 13 nt, Human
ucuggcacagccu

SEQ ID NO: 1993909 - RNA, 14 nt, Human
ucuggcacagccug

SEQ ID NO: 1993910 - RNA, 22 nt, Human
ucugcuuugggguuuaucagaa

SEQ ID NO: 1993911 - RNA, 15 nt, Human
ucugcuuuguugugu

SEQ ID NO: 1993912 - RNA, 18 nt, Human
ucugcuuuguugugugcc

SEQ ID NO: 1993913 - RNA, 22 nt, Human
ucugcuuuguugugugccucua

SEQ ID NO: 1993914 - RNA, 12 nt, Human
ucugccugucuc

SEQ ID NO: 1993915 - RNA, 14 nt, Human
ucugccugucuccc

SEQ ID NO: 1993916 - RNA, 23 nt, Human
ucuggcagaguugaagacagagc

SEQ ID NO: 1993917 - RNA, 20 nt, Human
ucuggcagaguugaagacag

SEQ ID NO: 1993918 - RNA, 17 nt, Human
ucuggcagcucagagag

SEQ ID NO: 1993919 - RNA, 14 nt, Human
ucuggccucccaca

SEQ ID NO: 1993920 - RNA, 13 nt, Human
ucuggccucccac

SEQ ID NO: 1993921 - RNA, 15 nt, Human
ucuggcacagccugc

SEQ ID NO: 1993922 - RNA, 16 nt, Human
ucuggcacagccugca

SEQ ID NO: 1993923 - RNA, 17 nt, Human
ucuggcacagccugcac

SEQ ID NO: 1993924 - RNA, 21 nt, Human
ucuggcagcucagagagggug

SEQ ID NO: 1993925 - RNA, 18 nt, Human
ucuggcagcucagagagg

SEQ ID NO: 1993926 - RNA, 10 nt, Human
ucuggccuuc

SEQ ID NO: 1993927 - RNA, 13 nt, Human
agaagcccugaug

SEQ ID NO: 1993928 - RNA, 13 nt, Human
agaauaaacuggc

SEQ ID NO: 1993929 - RNA, 20 nt, Human
agaauaaacuuacauauuua

SEQ ID NO: 1993930 - RNA, 15 nt, Human
agaauaaaggcagcu

SEQ ID NO: 1993931 - RNA, 23 nt, Human
agaauaaagccuugugaucacuu

SEQ ID NO: 1993932 - RNA, 15 nt, Human
agaauaggacuuguu

SEQ ID NO: 1993933 - RNA, 16 nt, Human
agaauaggacuuguuu

SEQ ID NO: 1993934 - RNA, 17 nt, Human
agaauaggacuuguuuu

SEQ ID NO: 1993935 - RNA, 21 nt, Human
agaauaggacuuguuuuuguu

SEQ ID NO: 1993936 - RNA, 11 nt, Human
agaauacugau

SEQ ID NO: 1993937 - RNA, 14 nt, Human
agaauacugaugga

SEQ ID NO: 1993938 - RNA, 15 nt, Human
agaauacugauggaa

SEQ ID NO: 1993939 - RNA, 15 nt, Human
agaauaauuugguau

SEQ ID NO: 1993940 - RNA, 22 nt, Human
agaaguuugagaucagccuggg

SEQ ID NO: 1993941 - RNA, 13 nt, Human
agaaguuucuguc

SEQ ID NO: 1993942 - RNA, 21 nt, Human
agaaguucuuugauucuguaa

SEQ ID NO: 1993943 - RNA, 12 nt, Human
agaaguuuaaau

SEQ ID NO: 1993944 - RNA, 13 nt, Human
agaaguuuaaaua

SEQ ID NO: 1993945 - RNA, 15 nt, Human
agaaguuuaaggaau

SEQ ID NO: 1993946 - RNA, 16 nt, Human
agaaguuuaaggaaua

SEQ ID NO: 1993947 - RNA, 17 nt, Human
agaaguuuaaggaauau

SEQ ID NO: 1993948 - RNA, 15 nt, Human
agaaguucuuugauu

SEQ ID NO: 1993949 - RNA, 20 nt, Human
agaaguucuuugauucugua

SEQ ID NO: 1993950 - RNA, 16 nt, Human
agaagugacgguuccu

SEQ ID NO: 1993951 - RNA, 17 nt, Human
agaagugacgguuccua

SEQ ID NO: 1993952 - RNA, 23 nt, Human
agaagugacgguuccuacacagg

SEQ ID NO: 1993953 - RNA, 23 nt, Human
agaagcucccugaaguaagcaaa

SEQ ID NO: 1993954 - RNA, 22 nt, Human
agaaagacuaucuaaauguuga

SEQ ID NO: 1993955 - RNA, 20 nt, Human
agaaagacuaucuaaauguu

SEQ ID NO: 1993956 - RNA, 17 nt, Human
agaaagcagaacaguga

SEQ ID NO: 1993957 - RNA, 18 nt, Human
agaaagcagaacagugau

SEQ ID NO: 1993958 - RNA, 15 nt, Human
agaaagcaaaauuau

SEQ ID NO: 1993959 - RNA, 17 nt, Human
agaaagcaaaauuaugu

SEQ ID NO: 1993960 - RNA, 21 nt, Human
agaaagcaaaauuauguuugc

SEQ ID NO: 1993961 - RNA, 15 nt, Human
agaaagcaagaugua

SEQ ID NO: 1993962 - RNA, 20 nt, Human
agaaagcagaacagugauua

SEQ ID NO: 1993963 - RNA, 18 nt, Human
agaaauacagauaaauga

SEQ ID NO: 1993964 - RNA, 20 nt, Human
ucugaaggguaauuauauag

SEQ ID NO: 1993965 - RNA, 18 nt, Human
ucugaaggaggccaccuc

SEQ ID NO: 1993966 - RNA, 19 nt, Human
ucugaaggaggccaccucc

SEQ ID NO: 1993967 - RNA, 20 nt, Human
ucugaaggaggccaccuccu

SEQ ID NO: 1993968 - RNA, 18 nt, Human
ucugaaggcuggguucug

SEQ ID NO: 1993969 - RNA, 17 nt, Human
ucugaaggaggccaccu

SEQ ID NO: 1993970 - RNA, 15 nt, Human
agaaaugccuuaccc

SEQ ID NO: 1993971 - RNA, 21 nt, Human
agaaaucuauagaaaguguuc

SEQ ID NO: 1993972 - RNA, 13 nt, Human
agaaaugaaaaaa

SEQ ID NO: 1993973 - RNA, 12 nt, Human
agaaaugaaaaa

SEQ ID NO: 1993974 - RNA, 19 nt, Human
agaaaucuauagaaagugu

SEQ ID NO: 1993975 - RNA, 20 nt, Human
agaaaucuauagaaaguguu

SEQ ID NO: 1993976 - RNA, 20 nt, Human
agaaauacagauaaaugauu

SEQ ID NO: 1993977 - RNA, 13 nt, Human
agaaauacuguac

SEQ ID NO: 1993978 - RNA, 14 nt, Human
agaaauacuguaca

SEQ ID NO: 1993979 - RNA, 16 nt, Human
agaaauacuguacaau

SEQ ID NO: 1993980 - RNA, 15 nt, Human
agaaauaguucugug

SEQ ID NO: 1993981 - RNA, 16 nt, Human
agaaauaguucuguga

SEQ ID NO: 1993982 - RNA, 21 nt, Human
agaaacuguucccaccugcug

SEQ ID NO: 1993983 - RNA, 15 nt, Human
agaaacuguucccac

SEQ ID NO: 1993984 - RNA, 22 nt, Human
agaaacuguucccaccugcugg

SEQ ID NO: 1993985 - RNA, 23 nt, Human
agaaacugucuagcacuuccuug

SEQ ID NO: 1993986 - RNA, 17 nt, Human
agaaacugucuagcacu

SEQ ID NO: 1993987 - RNA, 22 nt, Human
agaaacugucuagcacuuccuu

SEQ ID NO: 1993988 - RNA, 16 nt, Human
agaaacauuggaagca

SEQ ID NO: 1993989 - RNA, 13 nt, Human
agaaacauuggaa

SEQ ID NO: 1993990 - RNA, 14 nt, Human
agaaacauuggaag

SEQ ID NO: 1993991 - RNA, 18 nt, Human
agaaacacccacaggcau

SEQ ID NO: 1993992 - RNA, 20 nt, Human
agaaacacauaauuaacacu

SEQ ID NO: 1993993 - RNA, 19 nt, Human
agaaaagauguagauuuau

SEQ ID NO: 1993994 - RNA, 13 nt, Human
agaaacaauuucu

SEQ ID NO: 1993995 - RNA, 14 nt, Human
agaaacaauuucug

SEQ ID NO: 1993996 - RNA, 15 nt, Human
agaaacaauuucugu

SEQ ID NO: 1993997 - RNA, 18 nt, Human
agaaaaaugagccuggca

SEQ ID NO: 1993998 - RNA, 13 nt, Human
agaaaaacaaauc

SEQ ID NO: 1993999 - RNA, 21 nt, Human
agaaaacaaaaccaaaaguua

SEQ ID NO: 1994000 - RNA, 16 nt, Human
agaaaaaugugaauuu

SEQ ID NO: 1994001 - RNA, 23 nt, Human
agaaaaaauauuuuccugccagg

SEQ ID NO: 1994002 - RNA, 17 nt, Human
agaaaaaauauuuuccu

SEQ ID NO: 1994003 - RNA, 19 nt, Human
agaaaaaauauuuucccua

SEQ ID NO: 1994004 - RNA, 18 nt, Human
ucucuugguccugcugca

SEQ ID NO: 1994005 - RNA, 17 nt, Human
ucucuugguccugcugc

SEQ ID NO: 1994006 - RNA, 16 nt, Human
ucucuugguccugcug

SEQ ID NO: 1994007 - RNA, 22 nt, Human
ucucugcaggucccuaauaaag

SEQ ID NO: 1994008 - RNA, 21 nt, Human
ucucugcaggucccuaauaaa

SEQ ID NO: 1994009 - RNA, 20 nt, Human
ucucugcaggucccuaauaa

SEQ ID NO: 1994010 - RNA, 19 nt, Human
ucucugcaggucccuaaua

SEQ ID NO: 1994011 - RNA, 21 nt, Human
ucucucaggccaaacucaccu

SEQ ID NO: 1994012 - RNA, 19 nt, Human
ucucuccauuucacuggcu

SEQ ID NO: 1994013 - RNA, 12 nt, Human
ucucucaggcca

SEQ ID NO: 1994014 - RNA, 21 nt, Human
ucucucacuuguuuuauuuaa

SEQ ID NO: 1994015 - RNA, 22 nt, Human
ucucucacuuguuuuauuuaac

SEQ ID NO: 1994016 - RNA, 15 nt, Human
ucucggcucacugca

SEQ ID NO: 1994017 - RNA, 20 nt, Human
ucucggaucaggcucccagg

SEQ ID NO: 1994018 - RNA, 18 nt, Human
ucucgcucuguugcccag

SEQ ID NO: 1994019 - RNA, 19 nt, Human
ucucgcucuguugcccagg

SEQ ID NO: 1994020 - RNA, 21 nt, Human
ucucgcucuguugcccaggcu

SEQ ID NO: 1994021 - RNA, 20 nt, Human
ucucgcuauugucaccaggg

SEQ ID NO: 1994022 - RNA, 17 nt, Human
ucucgaacuccugaccu

SEQ ID NO: 1994023 - RNA, 23 nt, Human
ucuccuuggugucgggcaugaca

SEQ ID NO: 1994024 - RNA, 21 nt, Human
ucuccuuggugucgggcauga

SEQ ID NO: 1994025 - RNA, 17 nt, Human
ucuccuuagcuucuggc

SEQ ID NO: 1994026 - RNA, 18 nt, Human
ucuccuuaagagacaauu

SEQ ID NO: 1994027 - RNA, 19 nt, Human
ucuccuuaagagacaauuu

SEQ ID NO: 1994028 - RNA, 20 nt, Human
agaaaaaaaugucaaaagua

SEQ ID NO: 1994029 - RNA, 19 nt, Human
agaaaaaaaugucaaaagu

SEQ ID NO: 1994030 - RNA, 13 nt, Human
agaaaaaaauguc

SEQ ID NO: 1994031 - RNA, 10 nt, Human
agaaaaaaga

SEQ ID NO: 1994032 - RNA, 18 nt, Human
acuuuguguucaccuugu

SEQ ID NO: 1994033 - RNA, 17 nt, Human
agaaaaaaaaagaaaaa

SEQ ID NO: 1994034 - RNA, 18 nt, Human
agaaaaaaaaagaaaaaa

SEQ ID NO: 1994035 - RNA, 14 nt, Human
agaaaaaaaagaaa

SEQ ID NO: 1994036 - RNA, 19 nt, Human
agaaaaaaaaagaaaaaag

SEQ ID NO: 1994037 - RNA, 23 nt, Human
acuuuguauaguuauguaaauaa

SEQ ID NO: 1994038 - RNA, 15 nt, Human
acuuuguauuguccu

SEQ ID NO: 1994039 - RNA, 24 nt, Human
acuuuguauuguccuauuaguguu

SEQ ID NO: 1994040 - RNA, 16 nt, Human
acuuugucuaagaaac

SEQ ID NO: 1994041 - RNA, 19 nt, Human
acuuugucuaagaaacauu

SEQ ID NO: 1994042 - RNA, 20 nt, Human
acuuugucuaagaaacauug

SEQ ID NO: 1994043 - RNA, 16 nt, Human
acuuuguguucaccuu

SEQ ID NO: 1994044 - RNA, 22 nt, Human
acuuguuuuauuuaaccucuaa

SEQ ID NO: 1994045 - RNA, 15 nt, Human
acuuguggacacagc

SEQ ID NO: 1994046 - RNA, 16 nt, Human
acuuguuuucugggaa

SEQ ID NO: 1994047 - RNA, 16 nt, Human
acuuuaaaaggagcca

SEQ ID NO: 1994048 - RNA, 15 nt, Human
acuuguuuuuguaaa

SEQ ID NO: 1994049 - RNA, 16 nt, Human
acuuguuuuuguaaag

SEQ ID NO: 1994050 - RNA, 20 nt, Human
acuuguuuuuguaaagaaaa

SEQ ID NO: 1994051 - RNA, 21 nt, Human
acuuguuuuuguaaagaaaaa

SEQ ID NO: 1994052 - RNA, 23 nt, Human
acuuguuuuuguuuuuguuuugu

SEQ ID NO: 1994053 - RNA, 17 nt, Human
acuugugacuuuugcuu

SEQ ID NO: 1994054 - RNA, 19 nt, Human
acuugugacuuuugcuuua

SEQ ID NO: 1994055 - RNA, 14 nt, Human
acuugucuuucugg

SEQ ID NO: 1994056 - RNA, 16 nt, Human
acuugucuuucugggg

SEQ ID NO: 1994057 - RNA, 23 nt, Human
acuugucuuucugggguuuuucu

SEQ ID NO: 1994058 - RNA, 14 nt, Human
acuugugacuuuug

SEQ ID NO: 1994059 - RNA, 13 nt, Human
acuugucuuucug

SEQ ID NO: 1994060 - RNA, 23 nt, Human
acuugugacuuuugcuuuaauuc

SEQ ID NO: 1994061 - RNA, 17 nt, Human
acuugugcacaggcaga

SEQ ID NO: 1994062 - RNA, 14 nt, Human
acuuguggacacag

SEQ ID NO: 1994063 - RNA, 13 nt, Human
acuuuagggaagu

SEQ ID NO: 1994064 - RNA, 16 nt, Human
acuuucuucuucccau

SEQ ID NO: 1994065 - RNA, 14 nt, Human
acuuuaaaaauuua

SEQ ID NO: 1994066 - RNA, 16 nt, Human
acuuuaaaaauuuacu

SEQ ID NO: 1994067 - RNA, 19 nt, Human
acuuuaaaaauuuacuaca

SEQ ID NO: 1994068 - RNA, 14 nt, Human
acuuuggaaagagu

SEQ ID NO: 1994069 - RNA, 13 nt, Human
acuuuggaaagag

SEQ ID NO: 1994070 - RNA, 12 nt, Human
acuuuggaaaga

SEQ ID NO: 1994071 - RNA, 23 nt, Human
acuuuggaaagacuuuuccaacc

SEQ ID NO: 1994072 - RNA, 23 nt, Human
acuuuggaaagaguaggaagacu

SEQ ID NO: 1994073 - RNA, 19 nt, Human
acuuuguauaaaagggacu

SEQ ID NO: 1994074 - RNA, 19 nt, Human
acuuuggaaaguagaaaag

SEQ ID NO: 1994075 - RNA, 12 nt, Human
acuuuguauagu

SEQ ID NO: 1994076 - RNA, 14 nt, Human
acuuuguauaguua

SEQ ID NO: 1994077 - RNA, 17 nt, Human
acuuuguauaguuaugu

SEQ ID NO: 1994078 - RNA, 18 nt, Human
acuuuguauaguuaugua

SEQ ID NO: 1994079 - RNA, 21 nt, Human
acuuuguauaguuauguaaau

SEQ ID NO: 1994080 - RNA, 10 nt, Human
acuuugaugu

SEQ ID NO: 1994081 - RNA, 11 nt, Human
acuuugauguc

SEQ ID NO: 1994082 - RNA, 10 nt, Human
acuuugaaau

SEQ ID NO: 1994083 - RNA, 18 nt, Human
acuuugauucacauguuu

SEQ ID NO: 1994084 - RNA, 19 nt, Human
acuuugauucacauguuuu

SEQ ID NO: 1994085 - RNA, 23 nt, Human
acuuugauucacauguuuucaaa

SEQ ID NO: 1994086 - RNA, 12 nt, Human
acuuugauguca

SEQ ID NO: 1994087 - RNA, 16 nt, Human
acuuugaugucagcag

SEQ ID NO: 1994088 - RNA, 17 nt, Human
acuuugaugucagcagu

SEQ ID NO: 1994089 - RNA, 22 nt, Human
acuuugaugucagcaguugcug

SEQ ID NO: 1994090 - RNA, 13 nt, Human
acuuugauucaca

SEQ ID NO: 1994091 - RNA, 17 nt, Human
acuuugauucacauguu

SEQ ID NO: 1994092 - RNA, 22 nt, Human
acuuugcagcacagcugagagg

SEQ ID NO: 1994093 - RNA, 16 nt, Human
acugaaaggcuuuuca

SEQ ID NO: 1994094 - RNA, 14 nt, Human
ucgcccucccaggc

SEQ ID NO: 1994095 - RNA, 13 nt, Human
ucgcccuggcagg

SEQ ID NO: 1994096 - RNA, 17 nt, Human
ucgcccuggcaggcagg

SEQ ID NO: 1994097 - RNA, 17 nt, Human
ucgcccucccaggcucu

SEQ ID NO: 1994098 - RNA, 13 nt, Human
ucgcccucccagg

SEQ ID NO: 1994099 - RNA, 18 nt, Human
ucgcccuggacugugugc

SEQ ID NO: 1994100 - RNA, 14 nt, Human
ucgcuccugugucu

SEQ ID NO: 1994101 - RNA, 17 nt, Human
ucgccucggaucagcug

SEQ ID NO: 1994102 - RNA, 23 nt, Human
ucgccucggaucagcugagccuu

SEQ ID NO: 1994103 - RNA, 15 nt, Human
acugggggcagacau

SEQ ID NO: 1994104 - RNA, 15 nt, Human
acuggguacuugugg

SEQ ID NO: 1994105 - RNA, 21 nt, Human
acugggcuuggggaccagagc

SEQ ID NO: 1994106 - RNA, 18 nt, Human
ucgcucuguugcccaggc

SEQ ID NO: 1994107 - RNA, 22 nt, Human
ucgcuggauggcggaagcugcu

SEQ ID NO: 1994108 - RNA, 23 nt, Human
ucgcugugucagcauagaaguaa

SEQ ID NO: 1994109 - RNA, 20 nt, Human
acuguacaugaaaacacauu

SEQ ID NO: 1994110 - RNA, 21 nt, Human
acuguacaugaaaacacauuu

SEQ ID NO: 1994111 - RNA, 15 nt, Human
acuguacuugcucuu

SEQ ID NO: 1994112 - RNA, 20 nt, Human
acuguacuccucccaggcgc

SEQ ID NO: 1994113 - RNA, 22 nt, Human
acuguacaaugacuuuauugca

SEQ ID NO: 1994114 - RNA, 14 nt, Human
acuguaucaugaca

SEQ ID NO: 1994115 - RNA, 16 nt, Human
acuguacuuugauuca

SEQ ID NO: 1994116 - RNA, 20 nt, Human
acuguacuuugauucacaug

SEQ ID NO: 1994117 - RNA, 22 nt, Human
acuguacuuugauucacauguu

SEQ ID NO: 1994118 - RNA, 23 nt, Human
acuguacuuugauucacauguuu

SEQ ID NO: 1994119 - RNA, 13 nt, Human
acuguacuuugau

SEQ ID NO: 1994120 - RNA, 23 nt, Human
acuguacuugcucuugaugccug

SEQ ID NO: 1994121 - RNA, 19 nt, Human
acuguacaugaaaacacau

SEQ ID NO: 1994122 - RNA, 16 nt, Human
acuguacaugaaaaca

SEQ ID NO: 1994123 - RNA, 18 nt, Human
acuguacagacagaaaaa

SEQ ID NO: 1994124 - RNA, 22 nt, Human
acuguacaaaguagaagucuua

SEQ ID NO: 1994125 - RNA, 16 nt, Human
acuguacaaaguagaa

SEQ ID NO: 1994126 - RNA, 17 nt, Human
acuggguacuuguggac

SEQ ID NO: 1994127 - RNA, 18 nt, Human
acuggguacuuguggaca

SEQ ID NO: 1994128 - RNA, 18 nt, Human
acuguccuccaagccagc

SEQ ID NO: 1994129 - RNA, 16 nt, Human
acuguccuccaagcca

SEQ ID NO: 1994130 - RNA, 18 nt, Human
acuguccuauuauauuca

SEQ ID NO: 1994131 - RNA, 15 nt, Human
acuguccuauuauau

SEQ ID NO: 1994132 - RNA, 16 nt, Human
acuguccuauuauauu

SEQ ID NO: 1994133 - RNA, 23 nt, Human
acuguauugggaaguuacuguua

SEQ ID NO: 1994134 - RNA, 16 nt, Human
acuguaucaugacaaa

SEQ ID NO: 1994135 - RNA, 20 nt, Human
acuguaucaugacaaagacu

SEQ ID NO: 1994136 - RNA, 17 nt, Human
acuguuaauaguucagg

SEQ ID NO: 1994137 - RNA, 21 nt, Human
acuguuaauaguucagguaac

SEQ ID NO: 1994138 - RNA, 13 nt, Human
acuguuaccauug

SEQ ID NO: 1994139 - RNA, 12 nt, Human
ucgggcugugcc

SEQ ID NO: 1994140 - RNA, 13 nt, Human
ucgggcugugccc

SEQ ID NO: 1994141 - RNA, 19 nt, Human
ucggggagaggcugaggac

SEQ ID NO: 1994142 - RNA, 16 nt, Human
ucguauagaagucuuc

SEQ ID NO: 1994143 - RNA, 17 nt, Human
ucguauagaagucuuca

SEQ ID NO: 1994144 - RNA, 20 nt, Human
ucguauagaagucuucauga

SEQ ID NO: 1994145 - RNA, 22 nt, Human
ucguauagaagucuucaugaaa

SEQ ID NO: 1994146 - RNA, 14 nt, Human
ucguacauaauacu

SEQ ID NO: 1994147 - RNA, 15 nt, Human
ucguacauaauacug

SEQ ID NO: 1994148 - RNA, 22 nt, Human
ucguacauaauacugaaccacu

SEQ ID NO: 1994149 - RNA, 14 nt, Human
ucuaaaauuacaua

SEQ ID NO: 1994150 - RNA, 23 nt, Human
ucgucacugcuuaacuucacaua

SEQ ID NO: 1994151 - RNA, 15 nt, Human
ucguauucaccuuca

SEQ ID NO: 1994152 - RNA, 13 nt, Human
ucuaaaggcuacc

SEQ ID NO: 1994153 - RNA, 16 nt, Human
ucuaaaggcuaccuuu

SEQ ID NO: 1994154 - RNA, 17 nt, Human
ucuaaagcugccagccg

SEQ ID NO: 1994155 - RNA, 21 nt, Human
ucuaaacuuuauuccaaguca

SEQ ID NO: 1994156 - RNA, 18 nt, Human
ucuaaacuaggcuccuuc

SEQ ID NO: 1994157 - RNA, 13 nt, Human
ucuaaacugcccc

SEQ ID NO: 1994158 - RNA, 16 nt, Human
ucuaaacugcccccuc

SEQ ID NO: 1994159 - RNA, 22 nt, Human
ucuaaacugcccccucugcccu

SEQ ID NO: 1994160 - RNA, 23 nt, Human
ucuaaacugcccccucugcccug

SEQ ID NO: 1994161 - RNA, 12 nt, Human
ucuaagauguua

SEQ ID NO: 1994162 - RNA, 14 nt, Human
ucuaagauguuaua

SEQ ID NO: 1994163 - RNA, 16 nt, Human
ucuaagauguuauauu

SEQ ID NO: 1994164 - RNA, 18 nt, Human
ucuaagauguuauauuuu

SEQ ID NO: 1994165 - RNA, 21 nt, Human
ucuaagauguuauauuuuucu

SEQ ID NO: 1994166 - RNA, 22 nt, Human
ucuaagauguuauauuuuucuu

SEQ ID NO: 1994167 - RNA, 23 nt, Human
ucuaagauguuauauuuuucuua

SEQ ID NO: 1994168 - RNA, 16 nt, Human
ucuaagaaacauugga

SEQ ID NO: 1994169 - RNA, 17 nt, Human
ucuaagaaacauuggaa

SEQ ID NO: 1994170 - RNA, 18 nt, Human
ucuaagaaacauuggaag

SEQ ID NO: 1994171 - RNA, 23 nt, Human
ucuaagaaacauuggaagcaggu

SEQ ID NO: 1994172 - RNA, 13 nt, Human
ucuaagaaacauu

SEQ ID NO: 1994173 - RNA, 14 nt, Human
ucuaagaaacauug

SEQ ID NO: 1994174 - RNA, 18 nt, Human
ucuaagauuaauagcauu

SEQ ID NO: 1994175 - RNA, 20 nt, Human
ucuaagucgguuaaaaugga

SEQ ID NO: 1994176 - RNA, 22 nt, Human
ucuaagucaaacacuugugacu

SEQ ID NO: 1994177 - RNA, 23 nt, Human
ucuaagucaaacacuugugacuu

SEQ ID NO: 1994178 - RNA, 14 nt, Human
ucuaaguguuugcu

SEQ ID NO: 1994179 - RNA, 21 nt, Human
ucuacccucuuagaaaaacca

SEQ ID NO: 1994180 - RNA, 22 nt, Human
ucuaccccucccggcccugccu

SEQ ID NO: 1994181 - RNA, 23 nt, Human
ucuaccccucccggcccugccug

SEQ ID NO: 1994182 - RNA, 19 nt, Human
ucuaaguugaguauauuau

SEQ ID NO: 1994183 - RNA, 13 nt, Human
acuuacuguacau

SEQ ID NO: 1994184 - RNA, 14 nt, Human
acuuacuguacaug

SEQ ID NO: 1994185 - RNA, 20 nt, Human
acuuagagguggggagcaga

SEQ ID NO: 1994186 - RNA, 15 nt, Human
acuuacuguacauga

SEQ ID NO: 1994187 - RNA, 15 nt, Human
ucuaccucuuggcug

SEQ ID NO: 1994188 - RNA, 19 nt, Human
ucuaccugaggggccucuu

SEQ ID NO: 1994189 - RNA, 12 nt, Human
ucuaccugaggg

SEQ ID NO: 1994190 - RNA, 16 nt, Human
acuucaggcucuucuc

SEQ ID NO: 1994191 - RNA, 15 nt, Human
acuuauauuguaaga

SEQ ID NO: 1994192 - RNA, 17 nt, Human
acuuauauuguaagaaa

SEQ ID NO: 1994193 - RNA, 18 nt, Human
acuuauauuguaagaaau

SEQ ID NO: 1994194 - RNA, 19 nt, Human
acuuauauuguaagaaaua

SEQ ID NO: 1994195 - RNA, 20 nt, Human
acuuauauuguaagaaauac

SEQ ID NO: 1994196 - RNA, 21 nt, Human
acuuauauuguaagaaauacu

SEQ ID NO: 1994197 - RNA, 19 nt, Human
acuuagcaucuaauuucaa

SEQ ID NO: 1994198 - RNA, 15 nt, Human
acuuagccuuucuuu

SEQ ID NO: 1994199 - RNA, 22 nt, Human
acuuagcacuucagggcagauu

SEQ ID NO: 1994200 - RNA, 17 nt, Human
acuuccacugccauccu

SEQ ID NO: 1994201 - RNA, 18 nt, Human
acuuccaauuuacauacu

SEQ ID NO: 1994202 - RNA, 16 nt, Human
acuuccaggggaaccu

SEQ ID NO: 1994203 - RNA, 18 nt, Human
acuuccaggggaaccugc

SEQ ID NO: 1994204 - RNA, 20 nt, Human
acuuccaggggaaccugcca

SEQ ID NO: 1994205 - RNA, 21 nt, Human
acuuccaggggaaccugccau

SEQ ID NO: 1994206 - RNA, 17 nt, Human
acuuccauaaucuggac

SEQ ID NO: 1994207 - RNA, 20 nt, Human
acuucaggcucuucuccuuu

SEQ ID NO: 1994208 - RNA, 17 nt, Human
acuucaggcucuucucc

SEQ ID NO: 1994209 - RNA, 18 nt, Human
acuucaggcucuucuccu

SEQ ID NO: 1994210 - RNA, 16 nt, Human
acuucagggcagauuu

SEQ ID NO: 1994211 - RNA, 17 nt, Human
acuucagggcagauuuu

SEQ ID NO: 1994212 - RNA, 18 nt, Human
acuucagggcagauuuua

SEQ ID NO: 1994213 - RNA, 19 nt, Human
acuucagggcagauuuuag

SEQ ID NO: 1994214 - RNA, 20 nt, Human
acuucagggcagauuuuagu

SEQ ID NO: 1994215 - RNA, 21 nt, Human
acuucagggcagauuuuaguu

SEQ ID NO: 1994216 - RNA, 14 nt, Human
acuucauugaaaau

SEQ ID NO: 1994217 - RNA, 17 nt, Human
acuucauugaaaauaua

SEQ ID NO: 1994218 - RNA, 11 nt, Human
ucuagauguaa

SEQ ID NO: 1994219 - RNA, 16 nt, Human
ucuagauguaaauuuu

SEQ ID NO: 1994220 - RNA, 22 nt, Human
acuuccccaauaucuugcuuga

SEQ ID NO: 1994221 - RNA, 18 nt, Human
acuuccccaauaucuugc

SEQ ID NO: 1994222 - RNA, 21 nt, Human
acuuccccaauaucuugcuug

SEQ ID NO: 1994223 - RNA, 24 nt, Human
ucuagauacuguaucaugacaaag

SEQ ID NO: 1994224 - RNA, 18 nt, Human
ucuagcacuuccuugcca

SEQ ID NO: 1994225 - RNA, 15 nt, Human
ucuagcguagugcag

SEQ ID NO: 1994226 - RNA, 14 nt, Human
ucuagcccugcccg

SEQ ID NO: 1994227 - RNA, 10 nt, Human
ucuagcugaa

SEQ ID NO: 1994228 - RNA, 18 nt, Human
acuuccccauacaaauaa

SEQ ID NO: 1994229 - RNA, 14 nt, Human
ucuagcacuuccuu

SEQ ID NO: 1994230 - RNA, 15 nt, Human
ucuagcacuuccuug

SEQ ID NO: 1994231 - RNA, 17 nt, Human
ucuagcacuuccuugcc

SEQ ID NO: 1994232 - RNA, 22 nt, Human
ucuagcugaauugagccuaaaa

SEQ ID NO: 1994233 - RNA, 16 nt, Human
ucuagcuuuguuuagu

SEQ ID NO: 1994234 - RNA, 17 nt, Human
ucuaguguuugauuguc

SEQ ID NO: 1994235 - RNA, 23 nt, Human
ucuaguuugauuaaauucuugca

SEQ ID NO: 1994236 - RNA, 16 nt, Human
ucuaguuauuuauucu

SEQ ID NO: 1994237 - RNA, 14 nt, Human
ucuaguuauuuauu

SEQ ID NO: 1994238 - RNA, 19 nt, Human
ucuauagcaucacuuaaaa

SEQ ID NO: 1994239 - RNA, 14 nt, Human
ucuauaauuuuaca

SEQ ID NO: 1994240 - RNA, 15 nt, Human
ucuauaauuuuacaa

SEQ ID NO: 1994241 - RNA, 20 nt, Human
ucuauagcaucacuuaaaac

SEQ ID NO: 1994242 - RNA, 14 nt, Human
ucuauaaacacugu

SEQ ID NO: 1994243 - RNA, 15 nt, Human
ucuauaaacacuguu

SEQ ID NO: 1994244 - RNA, 17 nt, Human
ucuauaaacacuguuug

SEQ ID NO: 1994245 - RNA, 21 nt, Human
ucuauaauauuuguguguuca

SEQ ID NO: 1994246 - RNA, 13 nt, Human
ucuauaauuuaaa

SEQ ID NO: 1994247 - RNA, 13 nt, Human
ucuauaaacacug

SEQ ID NO: 1994248 - RNA, 16 nt, Human
ucucaaaaaaagaaaa

SEQ ID NO: 1994249 - RNA, 16 nt, Human
ucuauuuuucucuuca

SEQ ID NO: 1994250 - RNA, 16 nt, Human
ucuauuguuucuuuca

SEQ ID NO: 1994251 - RNA, 13 nt, Human
ucucacuccuacc

SEQ ID NO: 1994252 - RNA, 20 nt, Human
ucucaccauuuccccagggc

SEQ ID NO: 1994253 - RNA, 23 nt, Human
ucucacauuuuuauaccuguuua

SEQ ID NO: 1994254 - RNA, 16 nt, Human
acuuccgucacauccc

SEQ ID NO: 1994255 - RNA, 16 nt, Human
ucucacuccuaccugg

SEQ ID NO: 1994256 - RNA, 17 nt, Human
ucucacuccuaccuggu

SEQ ID NO: 1994257 - RNA, 18 nt, Human
ucucacuccuaccuggua

SEQ ID NO: 1994258 - RNA, 20 nt, Human
acuucgggaggucgaggcag

SEQ ID NO: 1994259 - RNA, 17 nt, Human
acuucgggaggucgagg

SEQ ID NO: 1994260 - RNA, 21 nt, Human
acuuccugauugguuucucuu

SEQ ID NO: 1994261 - RNA, 22 nt, Human
acuuccugauugguuucucuuc

SEQ ID NO: 1994262 - RNA, 23 nt, Human
acuuccugauugguuucucuucu

SEQ ID NO: 1994263 - RNA, 16 nt, Human
acuuccugcuuccuca

SEQ ID NO: 1994264 - RNA, 17 nt, Human
acuuccugcuuccucag

SEQ ID NO: 1994265 - RNA, 23 nt, Human
acuucgccaagguuguagcaugg

SEQ ID NO: 1994266 - RNA, 18 nt, Human
acuucuccacccugcucu

SEQ ID NO: 1994267 - RNA, 23 nt, Human
acuugaacccgggaggcagaggu

SEQ ID NO: 1994268 - RNA, 16 nt, Human
acuugaaaauuaacau

SEQ ID NO: 1994269 - RNA, 18 nt, Human
acuugaaaauuaacauga

SEQ ID NO: 1994270 - RNA, 17 nt, Human
acuugaaaauuaacaug

SEQ ID NO: 1994271 - RNA, 19 nt, Human
acuugagaauuacccuuuu

SEQ ID NO: 1994272 - RNA, 18 nt, Human
acuugaguaaaauacucu

SEQ ID NO: 1994273 - RNA, 21 nt, Human
acuugaguaaaauacucuuuu

SEQ ID NO: 1994274 - RNA, 22 nt, Human
acuugaguggagguuuauaguu

SEQ ID NO: 1994275 - RNA, 19 nt, Human
acuugaagccugcuccuuc

SEQ ID NO: 1994276 - RNA, 20 nt, Human
acuugaagccugcuccuucc

SEQ ID NO: 1994277 - RNA, 14 nt, Human
acuugaagccugcu

SEQ ID NO: 1994278 - RNA, 16 nt, Human
acuugaagccugcucc

SEQ ID NO: 1994279 - RNA, 23 nt, Human
acuugauaagggacugauguuug

SEQ ID NO: 1994280 - RNA, 14 nt, Human
acuugcauuuuugc

SEQ ID NO: 1994281 - RNA, 19 nt, Human
acuugcauuuuugcaggag

SEQ ID NO: 1994282 - RNA, 17 nt, Human
acuugcauuuuugcagg

SEQ ID NO: 1994283 - RNA, 18 nt, Human
acuugcauuuuugcagga

SEQ ID NO: 1994284 - RNA, 23 nt, Human
acuugccgcgucgcccucccagg

SEQ ID NO: 1994285 - RNA, 22 nt, Human
acuugccgcgucgcccucccag

SEQ ID NO: 1994286 - RNA, 14 nt, Human
acuuggaagcuccg

SEQ ID NO: 1994287 - RNA, 23 nt, Human
acuuggaagcacaccaaucuuac

SEQ ID NO: 1994288 - RNA, 14 nt, Human
acuuguauuaugug

SEQ ID NO: 1994289 - RNA, 13 nt, Human
acuuguauuaugu

SEQ ID NO: 1994290 - RNA, 14 nt, Human
acuuguaugaaaga

SEQ ID NO: 1994291 - RNA, 14 nt, Human
acuugucuuuggac

SEQ ID NO: 1994292 - RNA, 15 nt, Human
acuuguauuaugugu

SEQ ID NO: 1994293 - RNA, 15 nt, Human
acuugucggcuccag

SEQ ID NO: 1994294 - RNA, 14 nt, Human
ucacucuuggagcc

SEQ ID NO: 1994295 - RNA, 16 nt, Human
ucacucuuggagccug

SEQ ID NO: 1994296 - RNA, 17 nt, Human
ucacucuuggagccugc

SEQ ID NO: 1994297 - RNA, 18 nt, Human
ucacucuuggagccugca

SEQ ID NO: 1994298 - RNA, 23 nt, Human
ucacugagacagcccgggcucug

SEQ ID NO: 1994299 - RNA, 18 nt, Human
ucacugaaauaaaagcua

SEQ ID NO: 1994300 - RNA, 23 nt, Human
ucacugaaauaaaagcuauauaa

SEQ ID NO: 1994301 - RNA, 14 nt, Human
ucacugaaauaaaa

SEQ ID NO: 1994302 - RNA, 17 nt, Human
ucacucagcaccacuca

SEQ ID NO: 1994303 - RNA, 19 nt, Human
ucacucagaaguccagagu

SEQ ID NO: 1994304 - RNA, 13 nt, Human
ucacucagagcag

SEQ ID NO: 1994305 - RNA, 14 nt, Human
ucacucagagcagu

SEQ ID NO: 1994306 - RNA, 13 nt, Human
ucacucagcacca

SEQ ID NO: 1994307 - RNA, 14 nt, Human
ucacucagcaccac

SEQ ID NO: 1994308 - RNA, 15 nt, Human
ucacucagcaccacu

SEQ ID NO: 1994309 - RNA, 16 nt, Human
ucacucagcaccacuc

SEQ ID NO: 1994310 - RNA, 13 nt, Human
ucacucacaucuu

SEQ ID NO: 1994311 - RNA, 18 nt, Human
ucacucagaaguccagag

SEQ ID NO: 1994312 - RNA, 19 nt, Human
ucacauuccugaacaggau

SEQ ID NO: 1994313 - RNA, 22 nt, Human
ucaccagccccagugcccacag

SEQ ID NO: 1994314 - RNA, 21 nt, Human
ucacuauguugcccaggcagg

SEQ ID NO: 1994315 - RNA, 15 nt, Human
ucacugcacagugca

SEQ ID NO: 1994316 - RNA, 14 nt, Human
ucacuguugcccag

SEQ ID NO: 1994317 - RNA, 18 nt, Human
ucacugcaaccuccgccu

SEQ ID NO: 1994318 - RNA, 21 nt, Human
ucacugcaaccuucgccaccu

SEQ ID NO: 1994319 - RNA, 15 nt, Human
ucacuguugcccagg

SEQ ID NO: 1994320 - RNA, 22 nt, Human
ucacuuaaguuaguuccacuga

SEQ ID NO: 1994321 - RNA, 13 nt, Human
ucacuuaaaacac

SEQ ID NO: 1994322 - RNA, 15 nt, Human
ucacuuaaaacacgu

SEQ ID NO: 1994323 - RNA, 21 nt, Human
accauucuccaccugccaggg

SEQ ID NO: 1994324 - RNA, 20 nt, Human
accauucuccaccugccagg

SEQ ID NO: 1994325 - RNA, 19 nt, Human
accauucuccaccugccag

SEQ ID NO: 1994326 - RNA, 18 nt, Human
accauguuggccaggcug

SEQ ID NO: 1994327 - RNA, 22 nt, Human
accauuuugcugucccuuuucc

SEQ ID NO: 1994328 - RNA, 20 nt, Human
accauguuggccaggcugcu

SEQ ID NO: 1994329 - RNA, 23 nt, Human
accauuuugcugucccuuuuccu

SEQ ID NO: 1994330 - RNA, 21 nt, Human
accauuuugggguacccacug

SEQ ID NO: 1994331 - RNA, 21 nt, Human
acccagauaaagguucaugca

SEQ ID NO: 1994332 - RNA, 21 nt, Human
acccacuggacucaccucccc

SEQ ID NO: 1994333 - RNA, 20 nt, Human
acccacugcuuuuggucugu

SEQ ID NO: 1994334 - RNA, 14 nt, Human
acccacuggacuca

SEQ ID NO: 1994335 - RNA, 17 nt, Human
acccacuggacucaccu

SEQ ID NO: 1994336 - RNA, 16 nt, Human
acccaaauguucauca

SEQ ID NO: 1994337 - RNA, 20 nt, Human
acccaaauguucaucaauga

SEQ ID NO: 1994338 - RNA, 11 nt, Human
acccaaagcag

SEQ ID NO: 1994339 - RNA, 13 nt, Human
acccaaagcagug

SEQ ID NO: 1994340 - RNA, 19 nt, Human
accaugucguaguuacucu

SEQ ID NO: 1994341 - RNA, 17 nt, Human
accaguacauucucagu

SEQ ID NO: 1994342 - RNA, 23 nt, Human
accaugcugucuggcacagccug

SEQ ID NO: 1994343 - RNA, 21 nt, Human
accaugcugucuggcacagcc

SEQ ID NO: 1994344 - RNA, 22 nt, Human
accaugcugucuggcacagccu

SEQ ID NO: 1994345 - RNA, 17 nt, Human
accaugcugucuggcac

SEQ ID NO: 1994346 - RNA, 18 nt, Human
accaugcugucuggcaca

SEQ ID NO: 1994347 - RNA, 20 nt, Human
accaugcugucuggcacagc

SEQ ID NO: 1994348 - RNA, 19 nt, Human
accagguuuuguuccgccc

SEQ ID NO: 1994349 - RNA, 19 nt, Human
accaggguuggcaccuucc

SEQ ID NO: 1994350 - RNA, 21 nt, Human
accaggguuggcaccuucccc

SEQ ID NO: 1994351 - RNA, 20 nt, Human
ucacuucuuucccuuccucc

SEQ ID NO: 1994352 - RNA, 22 nt, Human
ucacuucuuucccuuccuccau

SEQ ID NO: 1994353 - RNA, 13 nt, Human
ucacuucuucugu

SEQ ID NO: 1994354 - RNA, 15 nt, Human
ucacuucuucugucc

SEQ ID NO: 1994355 - RNA, 21 nt, Human
ucacuucuucuguccaagcag

SEQ ID NO: 1994356 - RNA, 13 nt, Human
ucacuucuuuccc

SEQ ID NO: 1994357 - RNA, 14 nt, Human
ucacuucuuucccu

SEQ ID NO: 1994358 - RNA, 19 nt, Human
ucacuucuuucccuuccuc

SEQ ID NO: 1994359 - RNA, 12 nt, Human
ucagaauucuca

SEQ ID NO: 1994360 - RNA, 10 nt, Human
ucagaauucu

SEQ ID NO: 1994361 - RNA, 20 nt, Human
ucagaauucucagaaucuca

SEQ ID NO: 1994362 - RNA, 22 nt, Human
ucagagacuccugcaggcagcc

SEQ ID NO: 1994363 - RNA, 16 nt, Human
ucagaauagaaauuag

SEQ ID NO: 1994364 - RNA, 23 nt, Human
ucagaaguuucugccgcagcccu

SEQ ID NO: 1994365 - RNA, 15 nt, Human
acccagcccacuucu

SEQ ID NO: 1994366 - RNA, 23 nt, Human
ucagagacuccugcaggcagcca

SEQ ID NO: 1994367 - RNA, 16 nt, Human
ucagagacuccugcag

SEQ ID NO: 1994368 - RNA, 21 nt, Human
ucagagccaccccuaaagaga

SEQ ID NO: 1994369 - RNA, 20 nt, Human
ucagagaugcauuuggaaca

SEQ ID NO: 1994370 - RNA, 21 nt, Human
ucagagcccauggcuucccug

SEQ ID NO: 1994371 - RNA, 21 nt, Human
ucagaugcugugcaaauguua

SEQ ID NO: 1994372 - RNA, 15 nt, Human
ucagaucucuaacuu

SEQ ID NO: 1994373 - RNA, 16 nt, Human
ucagaucucuaacuuc

SEQ ID NO: 1994374 - RNA, 15 nt, Human
ucagauuucucuuug

SEQ ID NO: 1994375 - RNA, 16 nt, Human
ucagauuucucuuuga

SEQ ID NO: 1994376 - RNA, 18 nt, Human
ucagauuucucuuugaaa

SEQ ID NO: 1994377 - RNA, 19 nt, Human
ucagauuucucuuugaaac

SEQ ID NO: 1994378 - RNA, 13 nt, Human
acccaggagcccc

SEQ ID NO: 1994379 - RNA, 11 nt, Human
acccagccugg

SEQ ID NO: 1994380 - RNA, 15 nt, Human
acccaggagccccga

SEQ ID NO: 1994381 - RNA, 13 nt, Human
acccagcgagccc

SEQ ID NO: 1994382 - RNA, 16 nt, Human
acccagcgagcccugg

SEQ ID NO: 1994383 - RNA, 17 nt, Human
acccagcgagcccuggu

SEQ ID NO: 1994384 - RNA, 13 nt, Human
accccagguuucu

SEQ ID NO: 1994385 - RNA, 23 nt, Human
acccaggugcuaggaacacuccu

SEQ ID NO: 1994386 - RNA, 11 nt, Human
acccaggugcu

SEQ ID NO: 1994387 - RNA, 22 nt, Human
accccagcuggggccaggcugg

SEQ ID NO: 1994388 - RNA, 19 nt, Human
accccagcuggggccaggc

SEQ ID NO: 1994389 - RNA, 22 nt, Human
accgaaaacguggcugcuucaa

SEQ ID NO: 1994390 - RNA, 21 nt, Human
accgaaaacguggcugcuuca

SEQ ID NO: 1994391 - RNA, 21 nt, Human
accgaacugauguaaguaaac

SEQ ID NO: 1994392 - RNA, 22 nt, Human
ucagguggggucacucuggcag

SEQ ID NO: 1994393 - RNA, 23 nt, Human
ucagguggggucacucuggcagc

SEQ ID NO: 1994394 - RNA, 15 nt, Human
ucaggugucccugca

SEQ ID NO: 1994395 - RNA, 17 nt, Human
ucaggugucccugcacu

SEQ ID NO: 1994396 - RNA, 18 nt, Human
ucaggugucccugcacuu

SEQ ID NO: 1994397 - RNA, 15 nt, Human
acccugcuuggccca

SEQ ID NO: 1994398 - RNA, 16 nt, Human
acccugcuuggcccag

SEQ ID NO: 1994399 - RNA, 17 nt, Human
acccugcuuggcccagg

SEQ ID NO: 1994400 - RNA, 18 nt, Human
acccugcuuggcccaggg

SEQ ID NO: 1994401 - RNA, 14 nt, Human
acccugcugagucu

SEQ ID NO: 1994402 - RNA, 20 nt, Human
acccuugccgucuaccugag

SEQ ID NO: 1994403 - RNA, 20 nt, Human
accgaaaacguggcugcuuc

SEQ ID NO: 1994404 - RNA, 14 nt, Human
acccuuggagcucu

SEQ ID NO: 1994405 - RNA, 18 nt, Human
acccuuggagcucugagu

SEQ ID NO: 1994406 - RNA, 13 nt, Human
ucaguaagccgug

SEQ ID NO: 1994407 - RNA, 13 nt, Human
ucaguaauaacuc

SEQ ID NO: 1994408 - RNA, 17 nt, Human
ucaguagcuuaagaaaa

SEQ ID NO: 1994409 - RNA, 15 nt, Human
ucaguacuuguuucu

SEQ ID NO: 1994410 - RNA, 19 nt, Human
ucaguagcuuaagaaaaaa

SEQ ID NO: 1994411 - RNA, 22 nt, Human
ucagguugucugaagucacugc

SEQ ID NO: 1994412 - RNA, 14 nt, Human
ucaguaaacacugu

SEQ ID NO: 1994413 - RNA, 15 nt, Human
ucaguaaacacugug

SEQ ID NO: 1994414 - RNA, 16 nt, Human
ucaguaaaccugucug

SEQ ID NO: 1994415 - RNA, 17 nt, Human
ucaguaaaccugucuga

SEQ ID NO: 1994416 - RNA, 22 nt, Human
ucaggugucccugcacuugcag

SEQ ID NO: 1994417 - RNA, 19 nt, Human
ucagguuaggcaguauaaa

SEQ ID NO: 1994418 - RNA, 23 nt, Human
ucagguuaggcaguauaaagaau

SEQ ID NO: 1994419 - RNA, 17 nt, Human
ucagguugacaggaggu

SEQ ID NO: 1994420 - RNA, 23 nt, Human
ucagugccuuauggaacacucug

SEQ ID NO: 1994421 - RNA, 22 nt, Human
ucagugccuuauggaacacucu

SEQ ID NO: 1994422 - RNA, 20 nt, Human
ucagugccuuauggaacacu

SEQ ID NO: 1994423 - RNA, 19 nt, Human
ucagugccuuauggaacac

SEQ ID NO: 1994424 - RNA, 14 nt, Human
ucaguaguuugcau

SEQ ID NO: 1994425 - RNA, 15 nt, Human
ucaguaguuugcauu

SEQ ID NO: 1994426 - RNA, 14 nt, Human
ucaguggcagcugc

SEQ ID NO: 1994427 - RNA, 15 nt, Human
ucaguggcagcugcu

SEQ ID NO: 1994428 - RNA, 16 nt, Human
ucaguggcagcugcuu

SEQ ID NO: 1994429 - RNA, 15 nt, Human
ucagugcuucgcaga

SEQ ID NO: 1994430 - RNA, 13 nt, Human
ucaguggcagcug

SEQ ID NO: 1994431 - RNA, 17 nt, Human
ucagugcuagcuuauuu

SEQ ID NO: 1994432 - RNA, 19 nt, Human
ucaguuguuagugugucuu

SEQ ID NO: 1994433 - RNA, 20 nt, Human
ucaguuguuauuuauugaaa

SEQ ID NO: 1994434 - RNA, 15 nt, Human
ucaguuguuauuuau

SEQ ID NO: 1994435 - RNA, 14 nt, Human
ucaguuuauguuuu

SEQ ID NO: 1994436 - RNA, 15 nt, Human
ucaguuuauguuuug

SEQ ID NO: 1994437 - RNA, 16 nt, Human
ucaguuuauguuuugg

SEQ ID NO: 1994438 - RNA, 16 nt, Human
ucaguuucaacaugaa

SEQ ID NO: 1994439 - RNA, 18 nt, Human
ucauaaauaaaguuuguu

SEQ ID NO: 1994440 - RNA, 24 nt, Human
ucauaaagcaggcagaacucaucu

SEQ ID NO: 1994441 - RNA, 16 nt, Human
ucauaagauauuuuau

SEQ ID NO: 1994442 - RNA, 15 nt, Human
acccugccaggcaca

SEQ ID NO: 1994443 - RNA, 16 nt, Human
acccugccaggcacag

SEQ ID NO: 1994444 - RNA, 17 nt, Human
acccugccaggcacagg

SEQ ID NO: 1994445 - RNA, 18 nt, Human
acccugccaggcacaggc

SEQ ID NO: 1994446 - RNA, 19 nt, Human
acccugccaggcacaggca

SEQ ID NO: 1994447 - RNA, 21 nt, Human
acccugccaggcacaggcagg

SEQ ID NO: 1994448 - RNA, 22 nt, Human
acccugccaggcacaggcaggg

SEQ ID NO: 1994449 - RNA, 23 nt, Human
acccugccaggcacaggcagggc

SEQ ID NO: 1994450 - RNA, 22 nt, Human
acccugauuauauccaguaaca

SEQ ID NO: 1994451 - RNA, 14 nt, Human
acccugccaggcac

SEQ ID NO: 1994452 - RNA, 12 nt, Human
acccugcacccu

SEQ ID NO: 1994453 - RNA, 14 nt, Human
acccugcacccucc

SEQ ID NO: 1994454 - RNA, 16 nt, Human
acccugcacccuccua

SEQ ID NO: 1994455 - RNA, 23 nt, Human
acccugaggcccagagggccugc

SEQ ID NO: 1994456 - RNA, 21 nt, Human
acccugaggcccagagggccu

SEQ ID NO: 1994457 - RNA, 19 nt, Human
acccugaggcccagagggc

SEQ ID NO: 1994458 - RNA, 13 nt, Human
acccugaggccca

SEQ ID NO: 1994459 - RNA, 11 nt, Human
acccugaggcc

SEQ ID NO: 1994460 - RNA, 21 nt, Human
acccuccuucccacucuucuc

SEQ ID NO: 1994461 - RNA, 20 nt, Human
acccgggaagggggcuggga

SEQ ID NO: 1994462 - RNA, 19 nt, Human
acccgggaagggggcuggg

SEQ ID NO: 1994463 - RNA, 15 nt, Human
acccggaggggccug

SEQ ID NO: 1994464 - RNA, 22 nt, Human
acccgggaagggggcugggaca

SEQ ID NO: 1994465 - RNA, 14 nt, Human
acccucauguucuu

SEQ ID NO: 1994466 - RNA, 15 nt, Human
acccucauguucuua

SEQ ID NO: 1994467 - RNA, 17 nt, Human
acccucauguucuuaau

SEQ ID NO: 1994468 - RNA, 15 nt, Human
acccgggaggcagag

SEQ ID NO: 1994469 - RNA, 11 nt, Human
acccuccaagg

SEQ ID NO: 1994470 - RNA, 15 nt, Human
acccuccccuuccca

SEQ ID NO: 1994471 - RNA, 17 nt, Human
acccuccccuucccagg

SEQ ID NO: 1994472 - RNA, 19 nt, Human
acccuccccuucccagggc

SEQ ID NO: 1994473 - RNA, 20 nt, Human
acccuccccuucccagggca

SEQ ID NO: 1994474 - RNA, 21 nt, Human
acccuccccuucccagggcaa

SEQ ID NO: 1994475 - RNA, 21 nt, Human
acccuccuuucaccacaugug

SEQ ID NO: 1994476 - RNA, 11 nt, Human
acccuccuucc

SEQ ID NO: 1994477 - RNA, 13 nt, Human
acccuccuuccca

SEQ ID NO: 1994478 - RNA, 15 nt, Human
acccuccuucccacu

SEQ ID NO: 1994479 - RNA, 17 nt, Human
ucaggguuggccccugc

SEQ ID NO: 1994480 - RNA, 23 nt, Human
ucaggggugugcggccuuuggcu

SEQ ID NO: 1994481 - RNA, 19 nt, Human
ucaggggugugcggccuuu

SEQ ID NO: 1994482 - RNA, 12 nt, Human
ucaggggugugc

SEQ ID NO: 1994483 - RNA, 18 nt, Human
ucaggccaggcccucugc

SEQ ID NO: 1994484 - RNA, 17 nt, Human
ucaggccaggcccucug

SEQ ID NO: 1994485 - RNA, 19 nt, Human
ucaggccaggcccucugcc

SEQ ID NO: 1994486 - RNA, 19 nt, Human
acccgcuaagagggaggga

SEQ ID NO: 1994487 - RNA, 14 nt, Human
acccgccccugccc

SEQ ID NO: 1994488 - RNA, 21 nt, Human
ucagguaaucgaccugccucg

SEQ ID NO: 1994489 - RNA, 21 nt, Human
ucagguagaggugcaugccua

SEQ ID NO: 1994490 - RNA, 23 nt, Human
ucaggguuggccccugcccggcu

SEQ ID NO: 1994491 - RNA, 18 nt, Human
ucagguaaucgaccugcc

SEQ ID NO: 1994492 - RNA, 19 nt, Human
ucagguaaucgaccugccu

SEQ ID NO: 1994493 - RNA, 20 nt, Human
ucagguaaucgaccugccuc

SEQ ID NO: 1994494 - RNA, 18 nt, Human
ucaggguuggccccugcc

SEQ ID NO: 1994495 - RNA, 19 nt, Human
ucaggguuggccccugccc

SEQ ID NO: 1994496 - RNA, 16 nt, Human
ucaggccaggcccucu

SEQ ID NO: 1994497 - RNA, 15 nt, Human
ucaggccaggcccuc

SEQ ID NO: 1994498 - RNA, 14 nt, Human
ucaggccaggcccu

SEQ ID NO: 1994499 - RNA, 13 nt, Human
ucaggccaggccc

SEQ ID NO: 1994500 - RNA, 14 nt, Human
ucaggccagcugcu

SEQ ID NO: 1994501 - RNA, 13 nt, Human
ucaggccagcugc

SEQ ID NO: 1994502 - RNA, 13 nt, Human
ucaggccacuuga

SEQ ID NO: 1994503 - RNA, 18 nt, Human
ucaggcaggugggaugga

SEQ ID NO: 1994504 - RNA, 17 nt, Human
ucaggcaggugggaugg

SEQ ID NO: 1994505 - RNA, 13 nt, Human
acccccagccugc

SEQ ID NO: 1994506 - RNA, 12 nt, Human
acccccagccug

SEQ ID NO: 1994507 - RNA, 23 nt, Human
acauuguaagagagaugagcacu

SEQ ID NO: 1994508 - RNA, 22 nt, Human
acauugguucuuucauuugcuu

SEQ ID NO: 1994509 - RNA, 14 nt, Human
acauuuaaaacauu

SEQ ID NO: 1994510 - RNA, 18 nt, Human
acauuuaaaacauuaaaa

SEQ ID NO: 1994511 - RNA, 16 nt, Human
acauuggaaacaaguc

SEQ ID NO: 1994512 - RNA, 14 nt, Human
acauugcuuuuaaa

SEQ ID NO: 1994513 - RNA, 15 nt, Human
acauugcuuuuaaaa

SEQ ID NO: 1994514 - RNA, 17 nt, Human
acauugcuuuuaaaacu

SEQ ID NO: 1994515 - RNA, 18 nt, Human
acauugcuuuuaaaacua

SEQ ID NO: 1994516 - RNA, 12 nt, Human
acauuggaagca

SEQ ID NO: 1994517 - RNA, 15 nt, Human
acauuggaagcaggu

SEQ ID NO: 1994518 - RNA, 20 nt, Human
acauuggaagcagguuaaau

SEQ ID NO: 1994519 - RNA, 23 nt, Human
acauuggaagcagguuaaauguu

SEQ ID NO: 1994520 - RNA, 21 nt, Human
acauuggaagcagguuaaaug

SEQ ID NO: 1994521 - RNA, 22 nt, Human
acauuggaagcagguuaaaugu

SEQ ID NO: 1994522 - RNA, 21 nt, Human
acauugcggacagccacggcc

SEQ ID NO: 1994523 - RNA, 22 nt, Human
acauugcggacagccacggcca

SEQ ID NO: 1994524 - RNA, 22 nt, Human
acauuuaaaacauuaaaauaua

SEQ ID NO: 1994525 - RNA, 13 nt, Human
acauuuuaugucu

SEQ ID NO: 1994526 - RNA, 15 nt, Human
acauuuuaugucuuu

SEQ ID NO: 1994527 - RNA, 15 nt, Human
acauuuuuaagugcu

SEQ ID NO: 1994528 - RNA, 18 nt, Human
acauuuuuaagugcugca

SEQ ID NO: 1994529 - RNA, 18 nt, Human
acauuuuuagccuguguc

SEQ ID NO: 1994530 - RNA, 16 nt, Human
acauuuuuauaccugu

SEQ ID NO: 1994531 - RNA, 20 nt, Human
acauuuuuauaccuguuuaa

SEQ ID NO: 1994532 - RNA, 18 nt, Human
accaaaaaaauccagaaa

SEQ ID NO: 1994533 - RNA, 20 nt, Human
acauuuuuugaaaugcugaa

SEQ ID NO: 1994534 - RNA, 15 nt, Human
acauuuuuugaaaug

SEQ ID NO: 1994535 - RNA, 13 nt, Human
acauuuuuugaaa

SEQ ID NO: 1994536 - RNA, 14 nt, Human
acauuuuuugaaau

SEQ ID NO: 1994537 - RNA, 21 nt, Human
acauuuuuauaccuguuuaaa

SEQ ID NO: 1994538 - RNA, 13 nt, Human
acauuuuucuuag

SEQ ID NO: 1994539 - RNA, 23 nt, Human
acauuuuucuuagggaaggauac

SEQ ID NO: 1994540 - RNA, 16 nt, Human
ucaagugauucuccug

SEQ ID NO: 1994541 - RNA, 21 nt, Human
ucaagugauucucaugccuca

SEQ ID NO: 1994542 - RNA, 22 nt, Human
ucaagugauucucaugccucag

SEQ ID NO: 1994543 - RNA, 19 nt, Human
ucaauaggaaaaacugauu

SEQ ID NO: 1994544 - RNA, 18 nt, Human
ucaauaggaaaaacugau

SEQ ID NO: 1994545 - RNA, 17 nt, Human
ucaagugauucuccugc

SEQ ID NO: 1994546 - RNA, 17 nt, Human
ucaauaggaaaaacuga

SEQ ID NO: 1994547 - RNA, 13 nt, Human
ucaaguacacuga

SEQ ID NO: 1994548 - RNA, 22 nt, Human
ucaauaggaaaaacugauuuuu

SEQ ID NO: 1994549 - RNA, 11 nt, Human
ucaaggcucag

SEQ ID NO: 1994550 - RNA, 19 nt, Human
ucaagaggugggagggccc

SEQ ID NO: 1994551 - RNA, 17 nt, Human
ucaagagggucugagga

SEQ ID NO: 1994552 - RNA, 20 nt, Human
ucaagagggcacugguggcc

SEQ ID NO: 1994553 - RNA, 21 nt, Human
ucaagagggcacugguggccc

SEQ ID NO: 1994554 - RNA, 18 nt, Human
ucaagaggcaaaggaauc

SEQ ID NO: 1994555 - RNA, 17 nt, Human
accacacagaggcugcc

SEQ ID NO: 1994556 - RNA, 23 nt, Human
accacacaacauccaaguggccu

SEQ ID NO: 1994557 - RNA, 15 nt, Human
accacacccagccca

SEQ ID NO: 1994558 - RNA, 14 nt, Human
accacacauuucac

SEQ ID NO: 1994559 - RNA, 21 nt, Human
accacacauuucacugucugu

SEQ ID NO: 1994560 - RNA, 16 nt, Human
accacacccagcccac

SEQ ID NO: 1994561 - RNA, 20 nt, Human
accacacccagcccacuucu

SEQ ID NO: 1994562 - RNA, 21 nt, Human
accacacccagcccacuucug

SEQ ID NO: 1994563 - RNA, 23 nt, Human
accacacccagcccacuucugcc

SEQ ID NO: 1994564 - RNA, 21 nt, Human
accaaugccaaaaaaagacag

SEQ ID NO: 1994565 - RNA, 15 nt, Human
accaacccucagagc

SEQ ID NO: 1994566 - RNA, 21 nt, Human
accaaucuuacuuuguaaauu

SEQ ID NO: 1994567 - RNA, 23 nt, Human
accaaucuuacuuuguaaauucu

SEQ ID NO: 1994568 - RNA, 15 nt, Human
accaaucuuacuuug

SEQ ID NO: 1994569 - RNA, 16 nt, Human
accaaucuuacuuugu

SEQ ID NO: 1994570 - RNA, 17 nt, Human
accaaucuuacuuugua

SEQ ID NO: 1994571 - RNA, 18 nt, Human
accaaucuuacuuuguaa

SEQ ID NO: 1994572 - RNA, 19 nt, Human
accaaucuuacuuuguaaa

SEQ ID NO: 1994573 - RNA, 20 nt, Human
accaaucuuacuuuguaaau

SEQ ID NO: 1994574 - RNA, 19 nt, Human
accaaaaacugaaagugaa

SEQ ID NO: 1994575 - RNA, 12 nt, Human
accaaaaaauau

SEQ ID NO: 1994576 - RNA, 14 nt, Human
accaaaaagaaaaa

SEQ ID NO: 1994577 - RNA, 19 nt, Human
accaaaucagcugcuacua

SEQ ID NO: 1994578 - RNA, 16 nt, Human
accaaaucagcugcua

SEQ ID NO: 1994579 - RNA, 21 nt, Human
accaaauaucaccaggacugu

SEQ ID NO: 1994580 - RNA, 16 nt, Human
accaacauacucccau

SEQ ID NO: 1994581 - RNA, 20 nt, Human
accaaccacugcgaccacaa

SEQ ID NO: 1994582 - RNA, 14 nt, Human
accaaauggaaaca

SEQ ID NO: 1994583 - RNA, 13 nt, Human
accaaaugguaca

SEQ ID NO: 1994584 - RNA, 15 nt, Human
accaaaugguacaaa

SEQ ID NO: 1994585 - RNA, 18 nt, Human
accaaauguaacuauguu

SEQ ID NO: 1994586 - RNA, 22 nt, Human
accaacaagaauaaaggcagcu

SEQ ID NO: 1994587 - RNA, 12 nt, Human
ucaauuuaaaaa

SEQ ID NO: 1994588 - RNA, 13 nt, Human
accacacccaacu

SEQ ID NO: 1994589 - RNA, 13 nt, Human
ucaauuuaaaaaa

SEQ ID NO: 1994590 - RNA, 21 nt, Human
ucacagaacccuuggagccaa

SEQ ID NO: 1994591 - RNA, 11 nt, Human
ucacagacagg

SEQ ID NO: 1994592 - RNA, 14 nt, Human
ucacagacaggacc

SEQ ID NO: 1994593 - RNA, 15 nt, Human
ucacagacaggaccc

SEQ ID NO: 1994594 - RNA, 20 nt, Human
ucacagacaggaccccugca

SEQ ID NO: 1994595 - RNA, 21 nt, Human
ucacagacaggaccccugcag

SEQ ID NO: 1994596 - RNA, 19 nt, Human
ucacagcuccaagaauuuc

SEQ ID NO: 1994597 - RNA, 20 nt, Human
ucacagccagcgaacugaca

SEQ ID NO: 1994598 - RNA, 11 nt, Human
ucacagccagg

SEQ ID NO: 1994599 - RNA, 22 nt, Human
ucacagccaggcgcuagcacag

SEQ ID NO: 1994600 - RNA, 14 nt, Human
ucacagaugggugc

SEQ ID NO: 1994601 - RNA, 15 nt, Human
ucacagaugggugcu

SEQ ID NO: 1994602 - RNA, 16 nt, Human
ucacauauugauuucc

SEQ ID NO: 1994603 - RNA, 18 nt, Human
ucacauauugauuuccgu

SEQ ID NO: 1994604 - RNA, 20 nt, Human
ucacauauugauuuccguua

SEQ ID NO: 1994605 - RNA, 15 nt, Human
ucacaucccacccca

SEQ ID NO: 1994606 - RNA, 13 nt, Human
ucacauuccugaa

SEQ ID NO: 1994607 - RNA, 17 nt, Human
ucacauuccugaacagg

SEQ ID NO: 1994608 - RNA, 17 nt, Human
ucaccagccccagugcc

SEQ ID NO: 1994609 - RNA, 23 nt, Human
ucacauguggggagguuaaucua

SEQ ID NO: 1994610 - RNA, 12 nt, Human
ucacauguuuuc

SEQ ID NO: 1994611 - RNA, 14 nt, Human
ucacauguuuucaa

SEQ ID NO: 1994612 - RNA, 15 nt, Human
ucacauguuuucaaa

SEQ ID NO: 1994613 - RNA, 17 nt, Human
ucacauguuuucaaaug

SEQ ID NO: 1994614 - RNA, 18 nt, Human
ucacauguuuucaaaugg

SEQ ID NO: 1994615 - RNA, 20 nt, Human
ucacauguuuucaaauggag

SEQ ID NO: 1994616 - RNA, 13 nt, Human
uauuuuacauaaa

SEQ ID NO: 1994617 - RNA, 13 nt, Human
uauuuuaauuuca

SEQ ID NO: 1994618 - RNA, 14 nt, Human
uauuuuaauuucaa

SEQ ID NO: 1994619 - RNA, 15 nt, Human
uauuuuaauuucaag

SEQ ID NO: 1994620 - RNA, 16 nt, Human
uauuuuaauuucaagc

SEQ ID NO: 1994621 - RNA, 16 nt, Human
uauuuuaaucucagaa

SEQ ID NO: 1994622 - RNA, 17 nt, Human
uauuuuaauaaacacuc

SEQ ID NO: 1994623 - RNA, 14 nt, Human
uauuuuaauaaaca

SEQ ID NO: 1994624 - RNA, 17 nt, Human
uauuuugauguaaagau

SEQ ID NO: 1994625 - RNA, 20 nt, Human
uauuuugcuuugugauuuuu

SEQ ID NO: 1994626 - RNA, 13 nt, Human
uauuuugcuuugu

SEQ ID NO: 1994627 - RNA, 15 nt, Human
uauuuugcuuuguga

SEQ ID NO: 1994628 - RNA, 13 nt, Human
uauuuuucaaaau

SEQ ID NO: 1994629 - RNA, 18 nt, Human
uauuuuuaagaaagaaau

SEQ ID NO: 1994630 - RNA, 17 nt, Human
uauuuuuguagagccag

SEQ ID NO: 1994631 - RNA, 14 nt, Human
uauuuugugaguuu

SEQ ID NO: 1994632 - RNA, 17 nt, Human
uauuuugugaguuuguu

SEQ ID NO: 1994633 - RNA, 12 nt, Human
uauuuuguaugc

SEQ ID NO: 1994634 - RNA, 13 nt, Human
uauuuuguaugca

SEQ ID NO: 1994635 - RNA, 14 nt, Human
uauuuuguaugcaa

SEQ ID NO: 1994636 - RNA, 16 nt, Human
uauuuuguaugcaagc

SEQ ID NO: 1994637 - RNA, 20 nt, Human
uauuuuguaugcaagcaguu

SEQ ID NO: 1994638 - RNA, 22 nt, Human
uauuuuguaugcaagcaguuuc

SEQ ID NO: 1994639 - RNA, 20 nt, Human
uauuuuguguuuaggaacua

SEQ ID NO: 1994640 - RNA, 17 nt, Human
uauuuuguguuuaggaa

SEQ ID NO: 1994641 - RNA, 23 nt, Human
uauuuugugaguuuguuucuuug

SEQ ID NO: 1994642 - RNA, 15 nt, Human
acaucuuuuucacug

SEQ ID NO: 1994643 - RNA, 19 nt, Human
acaucuuggucagauuuga

SEQ ID NO: 1994644 - RNA, 22 nt, Human
acaucuugcucugcugacagac

SEQ ID NO: 1994645 - RNA, 17 nt, Human
acaucuugcucugcuga

SEQ ID NO: 1994646 - RNA, 18 nt, Human
uaugugggggucugugug

SEQ ID NO: 1994647 - RNA, 19 nt, Human
uaugugggggucugugugu

SEQ ID NO: 1994648 - RNA, 20 nt, Human
uaugugggggucuguguguu

SEQ ID NO: 1994649 - RNA, 19 nt, Human
uaugugccagauuuaugca

SEQ ID NO: 1994650 - RNA, 14 nt, Human
uaugugccagauuu

SEQ ID NO: 1994651 - RNA, 15 nt, Human
acaucuugcucugcu

SEQ ID NO: 1994652 - RNA, 16 nt, Human
acaucuugcucugcug

SEQ ID NO: 1994653 - RNA, 18 nt, Human
uauuugugugcuaaacgu

SEQ ID NO: 1994654 - RNA, 22 nt, Human
uauuuguguguucacuaaacuc

SEQ ID NO: 1994655 - RNA, 20 nt, Human
uauuugucaguguagaucaa

SEQ ID NO: 1994656 - RNA, 14 nt, Human
uauuugucucagau

SEQ ID NO: 1994657 - RNA, 15 nt, Human
uauuugugugcuaaa

SEQ ID NO: 1994658 - RNA, 17 nt, Human
uauuuguauuuauucuu

SEQ ID NO: 1994659 - RNA, 20 nt, Human
uauuuguacuuucuguuaaa

SEQ ID NO: 1994660 - RNA, 15 nt, Human
uauuuguacuuucug

SEQ ID NO: 1994661 - RNA, 16 nt, Human
uauuuguacuuucugu

SEQ ID NO: 1994662 - RNA, 17 nt, Human
uauuuguacuuucuguu

SEQ ID NO: 1994663 - RNA, 15 nt, Human
acaugaaaacacauu

SEQ ID NO: 1994664 - RNA, 16 nt, Human
acaugaaaacacauuu

SEQ ID NO: 1994665 - RNA, 21 nt, Human
uauuuuaaaagauaaauauua

SEQ ID NO: 1994666 - RNA, 22 nt, Human
uauuuuaagacgaaacauuugu

SEQ ID NO: 1994667 - RNA, 14 nt, Human
uauuuuaagacgaa

SEQ ID NO: 1994668 - RNA, 13 nt, Human
uauuuuaaaacaa

SEQ ID NO: 1994669 - RNA, 16 nt, Human
uauuuuaaaauaaacu

SEQ ID NO: 1994670 - RNA, 16 nt, Human
ucaaaagcugggcagg

SEQ ID NO: 1994671 - RNA, 17 nt, Human
ucaaaaguagaacuuug

SEQ ID NO: 1994672 - RNA, 18 nt, Human
ucaaaaguagaacuuugu

SEQ ID NO: 1994673 - RNA, 23 nt, Human
ucaaaaguagaacuuuguauagu

SEQ ID NO: 1994674 - RNA, 18 nt, Human
ucaaacacuugugacuuu

SEQ ID NO: 1994675 - RNA, 13 nt, Human
ucaaagauauuuu

SEQ ID NO: 1994676 - RNA, 20 nt, Human
ucaaagauauuuugcuuugu

SEQ ID NO: 1994677 - RNA, 22 nt, Human
ucaaagauauuuugcuuuguga

SEQ ID NO: 1994678 - RNA, 19 nt, Human
ucaaacacuugugacuuuu

SEQ ID NO: 1994679 - RNA, 15 nt, Human
ucaaagcaaaugucu

SEQ ID NO: 1994680 - RNA, 23 nt, Human
ucaaagcaaaugucuuccuggau

SEQ ID NO: 1994681 - RNA, 16 nt, Human
ucaaagcaaaagugcu

SEQ ID NO: 1994682 - RNA, 15 nt, Human
ucaaagcaaaagugc

SEQ ID NO: 1994683 - RNA, 18 nt, Human
ucaaagcaccaaaauaag

SEQ ID NO: 1994684 - RNA, 20 nt, Human
ucaaagcaccaaaauaagaa

SEQ ID NO: 1994685 - RNA, 21 nt, Human
ucaaauacgugggcauucaaa

SEQ ID NO: 1994686 - RNA, 22 nt, Human
ucaaauacgugggcauucaaau

SEQ ID NO: 1994687 - RNA, 20 nt, Human
ucaaauacgugggcauucaa

SEQ ID NO: 1994688 - RNA, 23 nt, Human
ucaaauacgugggcauucaaaug

SEQ ID NO: 1994689 - RNA, 13 nt, Human
ucaaauauauuca

SEQ ID NO: 1994690 - RNA, 14 nt, Human
ucaaagugcuauua

SEQ ID NO: 1994691 - RNA, 16 nt, Human
ucaaaguggaugcaau

SEQ ID NO: 1994692 - RNA, 15 nt, Human
ucaaagucagaacaa

SEQ ID NO: 1994693 - RNA, 16 nt, Human
ucaaagucaugauguu

SEQ ID NO: 1994694 - RNA, 17 nt, Human
ucaaagucaugauguuu

SEQ ID NO: 1994695 - RNA, 19 nt, Human
ucaaagucaugauguuuuu

SEQ ID NO: 1994696 - RNA, 21 nt, Human
ucaaagucaugauguuuuuaa

SEQ ID NO: 1994697 - RNA, 22 nt, Human
ucaaagucaugauguuuuuaaa

SEQ ID NO: 1994698 - RNA, 22 nt, Human
ucaaagcaccaaaauaagaaaa

SEQ ID NO: 1994699 - RNA, 21 nt, Human
ucaaagcaccaaaauaagaaa

SEQ ID NO: 1994700 - RNA, 23 nt, Human
acaugaaaacacauuuuucuuag

SEQ ID NO: 1994701 - RNA, 22 nt, Human
acaugaaaacacauuuuucuua

SEQ ID NO: 1994702 - RNA, 13 nt, Human
acaugagcaucag

SEQ ID NO: 1994703 - RNA, 11 nt, Human
acauguaugug

SEQ ID NO: 1994704 - RNA, 14 nt, Human
acauguauuaaauu

SEQ ID NO: 1994705 - RNA, 19 nt, Human
acauguauuaaauuacauu

SEQ ID NO: 1994706 - RNA, 20 nt, Human
acauguauuaaauuacauuu

SEQ ID NO: 1994707 - RNA, 21 nt, Human
acauguauuaaauuacauuug

SEQ ID NO: 1994708 - RNA, 22 nt, Human
acauguauuaaauuacauuugu

SEQ ID NO: 1994709 - RNA, 15 nt, Human
acaugguuugacucu

SEQ ID NO: 1994710 - RNA, 20 nt, Human
acaugguuaccucugcauaa

SEQ ID NO: 1994711 - RNA, 19 nt, Human
acaugguggggucuccuca

SEQ ID NO: 1994712 - RNA, 23 nt, Human
acaugguggggucuccucaggac

SEQ ID NO: 1994713 - RNA, 13 nt, Human
acauuaauguuga

SEQ ID NO: 1994714 - RNA, 14 nt, Human
acauuaauguugau

SEQ ID NO: 1994715 - RNA, 15 nt, Human
acauuaauguugauu

SEQ ID NO: 1994716 - RNA, 17 nt, Human
acauuaauguugauuuc

SEQ ID NO: 1994717 - RNA, 18 nt, Human
acauuaauguugauuucu

SEQ ID NO: 1994718 - RNA, 21 nt, Human
acauuaauguugauuucuagu

SEQ ID NO: 1994719 - RNA, 22 nt, Human
acauuaauguugauuucuaguu

SEQ ID NO: 1994720 - RNA, 23 nt, Human
acauuaauguugauuucuaguua

SEQ ID NO: 1994721 - RNA, 21 nt, Human
acaugucuuuucuugcaugag

SEQ ID NO: 1994722 - RNA, 16 nt, Human
acaugagguacugaga

SEQ ID NO: 1994723 - RNA, 14 nt, Human
acauggaaguacua

SEQ ID NO: 1994724 - RNA, 18 nt, Human
acauggaauaacauguaa

SEQ ID NO: 1994725 - RNA, 20 nt, Human
acauggaauaacauguaauu

SEQ ID NO: 1994726 - RNA, 20 nt, Human
acauggaauauauuuuaaua

SEQ ID NO: 1994727 - RNA, 23 nt, Human
acaugagcaucaggccaggcccu

SEQ ID NO: 1994728 - RNA, 19 nt, Human
acauggaguauaugucaag

SEQ ID NO: 1994729 - RNA, 15 nt, Human
acauggaguauaugu

SEQ ID NO: 1994730 - RNA, 14 nt, Human
acauggccuuugcu

SEQ ID NO: 1994731 - RNA, 14 nt, Human
uccagugagacagc

SEQ ID NO: 1994732 - RNA, 17 nt, Human
uccagugaggcucugcc

SEQ ID NO: 1994733 - RNA, 19 nt, Human
uccagugaggcucugcccu

SEQ ID NO: 1994734 - RNA, 18 nt, Human
uccagugaggcucugccc

SEQ ID NO: 1994735 - RNA, 20 nt, Human
uccagugaggcucugcccuu

SEQ ID NO: 1994736 - RNA, 12 nt, Human
uccagugacuuu

SEQ ID NO: 1994737 - RNA, 16 nt, Human
uccauccuccuccuuc

SEQ ID NO: 1994738 - RNA, 15 nt, Human
acggcucacugcagc

SEQ ID NO: 1994739 - RNA, 19 nt, Human
uccagugaaaauaagccau

SEQ ID NO: 1994740 - RNA, 18 nt, Human
acggccccagcuucucag

SEQ ID NO: 1994741 - RNA, 20 nt, Human
acggccccagcuucucagcu

SEQ ID NO: 1994742 - RNA, 14 nt, Human
acggcucacugcag

SEQ ID NO: 1994743 - RNA, 13 nt, Human
acggccuccuuuc

SEQ ID NO: 1994744 - RNA, 17 nt, Human
uccaucugguuuucucu

SEQ ID NO: 1994745 - RNA, 21 nt, Human
uccaucugguuuucucuccag

SEQ ID NO: 1994746 - RNA, 11 nt, Human
uccauccugag

SEQ ID NO: 1994747 - RNA, 20 nt, Human
uccaucucuuguuuaaauuc

SEQ ID NO: 1994748 - RNA, 17 nt, Human
uccauccuccuccuucc

SEQ ID NO: 1994749 - RNA, 18 nt, Human
uccauccuccuccuuccu

SEQ ID NO: 1994750 - RNA, 16 nt, Human
uccaucugauuccagc

SEQ ID NO: 1994751 - RNA, 17 nt, Human
uccaucugauuccagca

SEQ ID NO: 1994752 - RNA, 22 nt, Human
uccaugaagauguagaggagaa

SEQ ID NO: 1994753 - RNA, 19 nt, Human
uccaugaauguuccugccu

SEQ ID NO: 1994754 - RNA, 23 nt, Human
uccaugacaauaugcccuuucug

SEQ ID NO: 1994755 - RNA, 15 nt, Human
uccaugaauguuccu

SEQ ID NO: 1994756 - RNA, 17 nt, Human
uccaugaguccccuguu

SEQ ID NO: 1994757 - RNA, 16 nt, Human
uccaugaguccccugu

SEQ ID NO: 1994758 - RNA, 15 nt, Human
uccaugaguccccug

SEQ ID NO: 1994759 - RNA, 14 nt, Human
ucccacaaaggaga

SEQ ID NO: 1994760 - RNA, 22 nt, Human
uccauuuuggugucuuucucuu

SEQ ID NO: 1994761 - RNA, 15 nt, Human
ucccacaggcccuuc

SEQ ID NO: 1994762 - RNA, 17 nt, Human
ucccacaggcccuuccu

SEQ ID NO: 1994763 - RNA, 21 nt, Human
ucccacaggcccuuccucucc

SEQ ID NO: 1994764 - RNA, 22 nt, Human
ucccacaggcccuuccucucca

SEQ ID NO: 1994765 - RNA, 21 nt, Human
ucccacagugcugggauuaca

SEQ ID NO: 1994766 - RNA, 20 nt, Human
ucccaaagugcugggauuac

SEQ ID NO: 1994767 - RNA, 16 nt, Human
ucccaaagugcuggga

SEQ ID NO: 1994768 - RNA, 13 nt, Human
uccauuuuauaaa

SEQ ID NO: 1994769 - RNA, 20 nt, Human
uccauuuuggugucuuucuc

SEQ ID NO: 1994770 - RNA, 15 nt, Human
ucccaaagugcuggg

SEQ ID NO: 1994771 - RNA, 14 nt, Human
ucccacccguggug

SEQ ID NO: 1994772 - RNA, 14 nt, Human
ucccaccccacaca

SEQ ID NO: 1994773 - RNA, 11 nt, Human
ucccaccccac

SEQ ID NO: 1994774 - RNA, 15 nt, Human
ucccacccagccugg

SEQ ID NO: 1994775 - RNA, 19 nt, Human
ucccaccaacccucagagc

SEQ ID NO: 1994776 - RNA, 15 nt, Human
ucccaccacucccug

SEQ ID NO: 1994777 - RNA, 16 nt, Human
ucccaccacucccugg

SEQ ID NO: 1994778 - RNA, 18 nt, Human
acgcugccuucgguaccc

SEQ ID NO: 1994779 - RNA, 13 nt, Human
acgcugcucugcc

SEQ ID NO: 1994780 - RNA, 14 nt, Human
acgcugcucugccc

SEQ ID NO: 1994781 - RNA, 15 nt, Human
acgcugcucugcccc

SEQ ID NO: 1994782 - RNA, 16 nt, Human
acgcugcucugcccca

SEQ ID NO: 1994783 - RNA, 17 nt, Human
acgcugcucugccccag

SEQ ID NO: 1994784 - RNA, 19 nt, Human
acgcugcucugccccagcu

SEQ ID NO: 1994785 - RNA, 20 nt, Human
acgcugcucugccccagcuu

SEQ ID NO: 1994786 - RNA, 19 nt, Human
acggagucccaccuuggcu

SEQ ID NO: 1994787 - RNA, 19 nt, Human
acggagcggauugcaaagc

SEQ ID NO: 1994788 - RNA, 20 nt, Human
acggagcggauugcaaagca

SEQ ID NO: 1994789 - RNA, 21 nt, Human
acggagcggauugcaaagcaa

SEQ ID NO: 1994790 - RNA, 17 nt, Human
acggaggagaauuaagu

SEQ ID NO: 1994791 - RNA, 17 nt, Human
acgcucucuggccuucg

SEQ ID NO: 1994792 - RNA, 11 nt, Human
acgcucugcug

SEQ ID NO: 1994793 - RNA, 17 nt, Human
acgcugacuacagggcc

SEQ ID NO: 1994794 - RNA, 18 nt, Human
acgcugacuacagggccg

SEQ ID NO: 1994795 - RNA, 16 nt, Human
acgcugacuacagggc

SEQ ID NO: 1994796 - RNA, 13 nt, Human
acggccccagcuu

SEQ ID NO: 1994797 - RNA, 22 nt, Human
acggcacugagagagcgcagcc

SEQ ID NO: 1994798 - RNA, 13 nt, Human
acggccaggccag

SEQ ID NO: 1994799 - RNA, 16 nt, Human
acggccaggccagagg

SEQ ID NO: 1994800 - RNA, 21 nt, Human
acggagucccaccuuggcugc

SEQ ID NO: 1994801 - RNA, 17 nt, Human
acgcuacccgggaaggg

SEQ ID NO: 1994802 - RNA, 13 nt, Human
acgcuacccggga

SEQ ID NO: 1994803 - RNA, 15 nt, Human
acgcucucuggccuu

SEQ ID NO: 1994804 - RNA, 16 nt, Human
acgcucucuggccuuc

SEQ ID NO: 1994805 - RNA, 18 nt, Human
acgcuacccgggaagggg

SEQ ID NO: 1994806 - RNA, 14 nt, Human
acgcccccacuggu

SEQ ID NO: 1994807 - RNA, 18 nt, Human
acgccagggaccccagaa

SEQ ID NO: 1994808 - RNA, 13 nt, Human
acgcccacuuccc

SEQ ID NO: 1994809 - RNA, 15 nt, Human
acgcccacuucccug

SEQ ID NO: 1994810 - RNA, 18 nt, Human
acgcccacuucccugggu

SEQ ID NO: 1994811 - RNA, 20 nt, Human
acgccgcccuaaaagcacac

SEQ ID NO: 1994812 - RNA, 23 nt, Human
acgcgugcacacaccagagccca

SEQ ID NO: 1994813 - RNA, 20 nt, Human
acgcgugcacacaccagagc

SEQ ID NO: 1994814 - RNA, 14 nt, Human
acgaauauugcuga

SEQ ID NO: 1994815 - RNA, 17 nt, Human
uccaggcugggagagcc

SEQ ID NO: 1994816 - RNA, 14 nt, Human
uccaggcugggaga

SEQ ID NO: 1994817 - RNA, 18 nt, Human
uccaggcugggagagccu

SEQ ID NO: 1994818 - RNA, 18 nt, Human
acgccaucccagccccaa

SEQ ID NO: 1994819 - RNA, 15 nt, Human
acgaucacaaaugac

SEQ ID NO: 1994820 - RNA, 16 nt, Human
acgaucacaaaugacu

SEQ ID NO: 1994821 - RNA, 17 nt, Human
acgaucacaaaugacuu

SEQ ID NO: 1994822 - RNA, 18 nt, Human
acgaucacaaaugacuuu

SEQ ID NO: 1994823 - RNA, 19 nt, Human
acgaucacaaaugacuuua

SEQ ID NO: 1994824 - RNA, 11 nt, Human
acgccagggac

SEQ ID NO: 1994825 - RNA, 17 nt, Human
acgccagggaccccaga

SEQ ID NO: 1994826 - RNA, 17 nt, Human
acgccaucccagcccca

SEQ ID NO: 1994827 - RNA, 16 nt, Human
acgccaucccagcccc

SEQ ID NO: 1994828 - RNA, 15 nt, Human
acgccaucccagccc

SEQ ID NO: 1994829 - RNA, 14 nt, Human
acgccaucccagcc

SEQ ID NO: 1994830 - RNA, 11 nt, Human
acgccauccca

SEQ ID NO: 1994831 - RNA, 23 nt, Human
acgccaggggaaaaucagccugc

SEQ ID NO: 1994832 - RNA, 18 nt, Human
acgccaggggaaaaucag

SEQ ID NO: 1994833 - RNA, 14 nt, Human
acgaucacaaauga

SEQ ID NO: 1994834 - RNA, 15 nt, Human
acgacugcccggcag

SEQ ID NO: 1994835 - RNA, 22 nt, Human
acgacaguacuuucaaugaaca

SEQ ID NO: 1994836 - RNA, 21 nt, Human
acgacucuuuuccaaacacag

SEQ ID NO: 1994837 - RNA, 23 nt, Human
acgacucuuuuccaaacacaggc

SEQ ID NO: 1994838 - RNA, 12 nt, Human
accugagcccca

SEQ ID NO: 1994839 - RNA, 17 nt, Human
accugagccccaaaagg

SEQ ID NO: 1994840 - RNA, 23 nt, Human
accugaggcccuucucuccagcc

SEQ ID NO: 1994841 - RNA, 22 nt, Human
accugaagcuaucguaaaauua

SEQ ID NO: 1994842 - RNA, 17 nt, Human
accugaccccugacccc

SEQ ID NO: 1994843 - RNA, 17 nt, Human
accugacagccccuccc

SEQ ID NO: 1994844 - RNA, 19 nt, Human
accugaauuuuggcugugu

SEQ ID NO: 1994845 - RNA, 18 nt, Human
accugaagacucauucuu

SEQ ID NO: 1994846 - RNA, 16 nt, Human
ucauaaguauuuggaa

SEQ ID NO: 1994847 - RNA, 12 nt, Human
ucauaaugacuu

SEQ ID NO: 1994848 - RNA, 16 nt, Human
ucauaauaaguugcau

SEQ ID NO: 1994849 - RNA, 22 nt, Human
accugcaaacgcuucaguuguu

SEQ ID NO: 1994850 - RNA, 20 nt, Human
accugcacacuguccuauua

SEQ ID NO: 1994851 - RNA, 17 nt, Human
accugccaggaagccag

SEQ ID NO: 1994852 - RNA, 16 nt, Human
accugccaggaagcca

SEQ ID NO: 1994853 - RNA, 19 nt, Human
accugccaggaagccagca

SEQ ID NO: 1994854 - RNA, 18 nt, Human
accugccaggaagccagc

SEQ ID NO: 1994855 - RNA, 17 nt, Human
accugccucggccuccc

SEQ ID NO: 1994856 - RNA, 14 nt, Human
accugaggggccuc

SEQ ID NO: 1994857 - RNA, 16 nt, Human
accugaggggccucuu

SEQ ID NO: 1994858 - RNA, 14 nt, Human
accugauugugucu

SEQ ID NO: 1994859 - RNA, 16 nt, Human
ucauuugucacacacu

SEQ ID NO: 1994860 - RNA, 13 nt, Human
ucauuuucucuuu

SEQ ID NO: 1994861 - RNA, 16 nt, Human
ucauuugcuuuggaag

SEQ ID NO: 1994862 - RNA, 14 nt, Human
ucauuugucacaca

SEQ ID NO: 1994863 - RNA, 15 nt, Human
ucauuugcuuuggaa

SEQ ID NO: 1994864 - RNA, 17 nt, Human
ucauuuuuuuuaagaaa

SEQ ID NO: 1994865 - RNA, 18 nt, Human
ucauuuuuuuuaagaaaa

SEQ ID NO: 1994866 - RNA, 14 nt, Human
ucauuuuugaauac

SEQ ID NO: 1994867 - RNA, 19 nt, Human
ucauuuuuaguagagacag

SEQ ID NO: 1994868 - RNA, 13 nt, Human
ucauuuugcuuua

SEQ ID NO: 1994869 - RNA, 17 nt, Human
ucauuuuguguugaaga

SEQ ID NO: 1994870 - RNA, 19 nt, Human
ucauuuuguguugaagagc

SEQ ID NO: 1994871 - RNA, 12 nt, Human
ucauuuugcuuu

SEQ ID NO: 1994872 - RNA, 21 nt, Human
accugcgucucauacucaccu

SEQ ID NO: 1994873 - RNA, 16 nt, Human
accugcggugcuaucu

SEQ ID NO: 1994874 - RNA, 23 nt, Human
accugccuguugggccaggagcc

SEQ ID NO: 1994875 - RNA, 13 nt, Human
accugcgcuucac

SEQ ID NO: 1994876 - RNA, 14 nt, Human
accugcgcuucacu

SEQ ID NO: 1994877 - RNA, 20 nt, Human
accuggaauauauaaccagu

SEQ ID NO: 1994878 - RNA, 14 nt, Human
accugcuucucugc

SEQ ID NO: 1994879 - RNA, 15 nt, Human
accugcuucucugcc

SEQ ID NO: 1994880 - RNA, 21 nt, Human
accugcuucucugcccagcuu

SEQ ID NO: 1994881 - RNA, 12 nt, Human
accugcucuccu

SEQ ID NO: 1994882 - RNA, 17 nt, Human
accugggauuauauauc

SEQ ID NO: 1994883 - RNA, 20 nt, Human
accuggcuuuucuuucuacc

SEQ ID NO: 1994884 - RNA, 22 nt, Human
accugggaaagagauuuaaacu

SEQ ID NO: 1994885 - RNA, 15 nt, Human
accugggacagggag

SEQ ID NO: 1994886 - RNA, 16 nt, Human
accugggacagggagc

SEQ ID NO: 1994887 - RNA, 13 nt, Human
accuggccucugc

SEQ ID NO: 1994888 - RNA, 12 nt, Human
accuggccucug

SEQ ID NO: 1994889 - RNA, 15 nt, Human
accuggcccucucug

SEQ ID NO: 1994890 - RNA, 18 nt, Human
accuggcccucucugaag

SEQ ID NO: 1994891 - RNA, 19 nt, Human
accuggcccucucugaagg

SEQ ID NO: 1994892 - RNA, 23 nt, Human
accuggcccucucugaaggaggc

SEQ ID NO: 1994893 - RNA, 18 nt, Human
uccaccaucaagccacca

SEQ ID NO: 1994894 - RNA, 12 nt, Human
uccacccaccuc

SEQ ID NO: 1994895 - RNA, 13 nt, Human
uccacccaccuca

SEQ ID NO: 1994896 - RNA, 17 nt, Human
uccacccaggagccccg

SEQ ID NO: 1994897 - RNA, 20 nt, Human
uccacccaggagccccgagg

SEQ ID NO: 1994898 - RNA, 18 nt, Human
uccaaggccaggccuugg

SEQ ID NO: 1994899 - RNA, 23 nt, Human
uccaaauuguuuaaauucacaau

SEQ ID NO: 1994900 - RNA, 16 nt, Human
uccaaggacagaaggc

SEQ ID NO: 1994901 - RNA, 23 nt, Human
uccaaggacagaaggcuccugcc

SEQ ID NO: 1994902 - RNA, 19 nt, Human
uccaaaugcagcuuuaaaa

SEQ ID NO: 1994903 - RNA, 20 nt, Human
uccaagggguccccuccagg

SEQ ID NO: 1994904 - RNA, 22 nt, Human
uccaaugccucuugucuuccua

SEQ ID NO: 1994905 - RNA, 17 nt, Human
uccaaugccucuugucu

SEQ ID NO: 1994906 - RNA, 21 nt, Human
uccaaugccucuugucuuccu

SEQ ID NO: 1994907 - RNA, 16 nt, Human
accuugacagggcaca

SEQ ID NO: 1994908 - RNA, 13 nt, Human
accuuugucccca

SEQ ID NO: 1994909 - RNA, 14 nt, Human
accuugcacacauc

SEQ ID NO: 1994910 - RNA, 16 nt, Human
accuugcacacaucau

SEQ ID NO: 1994911 - RNA, 22 nt, Human
accuugcacacaucaucuguaa

SEQ ID NO: 1994912 - RNA, 21 nt, Human
accuugcauuuuagcuaauuu

SEQ ID NO: 1994913 - RNA, 22 nt, Human
accuucuggccucccacagacu

SEQ ID NO: 1994914 - RNA, 18 nt, Human
accuucuggccucccaca

SEQ ID NO: 1994915 - RNA, 13 nt, Human
accuucugacuuu

SEQ ID NO: 1994916 - RNA, 22 nt, Human
accuucuccuucaccuuugucc

SEQ ID NO: 1994917 - RNA, 14 nt, Human
accuucuccuucac

SEQ ID NO: 1994918 - RNA, 14 nt, Human
accuuuuuuauaca

SEQ ID NO: 1994919 - RNA, 16 nt, Human
accuuuguccccaccg

SEQ ID NO: 1994920 - RNA, 15 nt, Human
accuuuguccccacc

SEQ ID NO: 1994921 - RNA, 14 nt, Human
accuuuguccccac

SEQ ID NO: 1994922 - RNA, 16 nt, Human
accuuuuuuauacaua

SEQ ID NO: 1994923 - RNA, 17 nt, Human
accuuuuuuauacauaa

SEQ ID NO: 1994924 - RNA, 18 nt, Human
accuuuuuuauacauaaa

SEQ ID NO: 1994925 - RNA, 17 nt, Human
uccacgagagcgcagca

SEQ ID NO: 1994926 - RNA, 16 nt, Human
accuuccaagagccug

SEQ ID NO: 1994927 - RNA, 17 nt, Human
accuucccaugcccugg

SEQ ID NO: 1994928 - RNA, 17 nt, Human
accuucccccuccccca

SEQ ID NO: 1994929 - RNA, 20 nt, Human
accuucccccucccccagcc

SEQ ID NO: 1994930 - RNA, 16 nt, Human
accuuccuuccugcuu

SEQ ID NO: 1994931 - RNA, 18 nt, Human
accuucgggcugugcccg

SEQ ID NO: 1994932 - RNA, 16 nt, Human
accuucgggcugugcc

SEQ ID NO: 1994933 - RNA, 17 nt, Human
accuucgggcugugccc

SEQ ID NO: 1994934 - RNA, 14 nt, Human
accuucgggcugug

SEQ ID NO: 1994935 - RNA, 15 nt, Human
accuucgggcugugc

SEQ ID NO: 1994936 - RNA, 15 nt, Human
accuucgccaccugg

SEQ ID NO: 1994937 - RNA, 17 nt, Human
accuucgccaccugggu

SEQ ID NO: 1994938 - RNA, 20 nt, Human
accuggggcugcugugaagc

SEQ ID NO: 1994939 - RNA, 21 nt, Human
accuggguaacuagggaagau

SEQ ID NO: 1994940 - RNA, 19 nt, Human
accuggggcugcugugaag

SEQ ID NO: 1994941 - RNA, 22 nt, Human
accuucacucuaagauguuaua

SEQ ID NO: 1994942 - RNA, 20 nt, Human
accuucacucuaagauguua

SEQ ID NO: 1994943 - RNA, 21 nt, Human
accuucacucuaagauguuau

SEQ ID NO: 1994944 - RNA, 14 nt, Human
accuucacucuaag

SEQ ID NO: 1994945 - RNA, 18 nt, Human
accuucacucuaagaugu

SEQ ID NO: 1994946 - RNA, 19 nt, Human
accuucacucuaagauguu

SEQ ID NO: 1994947 - RNA, 15 nt, Human
accuuccaagagccu

SEQ ID NO: 1994948 - RNA, 19 nt, Human
accuucaguuuuuguguuu

SEQ ID NO: 1994949 - RNA, 15 nt, Human
accuucauaagaucu

SEQ ID NO: 1994950 - RNA, 17 nt, Human
acugaaaaccucuccuc

SEQ ID NO: 1994951 - RNA, 20 nt, Human
acugaaagccuuagggaagc

SEQ ID NO: 1994952 - RNA, 17 nt, Human
acugaaaggcuuuucaa

SEQ ID NO: 1994953 - RNA, 16 nt, Human
acugaaaaccucuccu

SEQ ID NO: 1994954 - RNA, 15 nt, Human
acugaaaaccucucc

SEQ ID NO: 1994955 - RNA, 18 nt, Human
uccugacgagauaagcag

SEQ ID NO: 1994956 - RNA, 15 nt, Human
uccugaagaauugaa

SEQ ID NO: 1994957 - RNA, 20 nt, Human
uccucugcucccccuuuucc

SEQ ID NO: 1994958 - RNA, 19 nt, Human
uccucuugccacugccucu

SEQ ID NO: 1994959 - RNA, 15 nt, Human
uccucugcuaaauug

SEQ ID NO: 1994960 - RNA, 18 nt, Human
uccucugcuaaauugaug

SEQ ID NO: 1994961 - RNA, 19 nt, Human
uccucugcuaaauugaugu

SEQ ID NO: 1994962 - RNA, 23 nt, Human
uccucugcuaaauugauguugau

SEQ ID NO: 1994963 - RNA, 12 nt, Human
uccucugcuccc

SEQ ID NO: 1994964 - RNA, 19 nt, Human
uccucugcucccccuuuuc

SEQ ID NO: 1994965 - RNA, 14 nt, Human
uccucugaggcuga

SEQ ID NO: 1994966 - RNA, 23 nt, Human
uccucuuuggucuacacugugcu

SEQ ID NO: 1994967 - RNA, 19 nt, Human
acucuugaaaaaugcaugu

SEQ ID NO: 1994968 - RNA, 14 nt, Human
acucuugaaaaaug

SEQ ID NO: 1994969 - RNA, 21 nt, Human
acucuugaaaaaugcauguug

SEQ ID NO: 1994970 - RNA, 13 nt, Human
uccucccaccuca

SEQ ID NO: 1994971 - RNA, 14 nt, Human
uccucccaccucag

SEQ ID NO: 1994972 - RNA, 15 nt, Human
uccucccaccucagc

SEQ ID NO: 1994973 - RNA, 16 nt, Human
uccucccaccucagcc

SEQ ID NO: 1994974 - RNA, 18 nt, Human
uccucccaccucagccuc

SEQ ID NO: 1994975 - RNA, 20 nt, Human
uccucccaccucagccuccc

SEQ ID NO: 1994976 - RNA, 21 nt, Human
uccucccaccucagccucccg

SEQ ID NO: 1994977 - RNA, 16 nt, Human
uccucccacugcccac

SEQ ID NO: 1994978 - RNA, 17 nt, Human
uccucuccacugccuuc

SEQ ID NO: 1994979 - RNA, 18 nt, Human
uccucuccacugccuucg

SEQ ID NO: 1994980 - RNA, 12 nt, Human
uccucucugccc

SEQ ID NO: 1994981 - RNA, 13 nt, Human
uccucucugcccu

SEQ ID NO: 1994982 - RNA, 14 nt, Human
uccucucugcccua

SEQ ID NO: 1994983 - RNA, 15 nt, Human
uccucucugcccuaa

SEQ ID NO: 1994984 - RNA, 12 nt, Human
uccucugagccu

SEQ ID NO: 1994985 - RNA, 13 nt, Human
uccucugagccuu

SEQ ID NO: 1994986 - RNA, 17 nt, Human
uccucugagccuuggga

SEQ ID NO: 1994987 - RNA, 16 nt, Human
acucgcgacaaugcaa

SEQ ID NO: 1994988 - RNA, 15 nt, Human
acucgcgacaaugca

SEQ ID NO: 1994989 - RNA, 17 nt, Human
acucgcgacaaugcaaa

SEQ ID NO: 1994990 - RNA, 14 nt, Human
acucguauaugucu

SEQ ID NO: 1994991 - RNA, 15 nt, Human
acucgugagcgccag

SEQ ID NO: 1994992 - RNA, 14 nt, Human
acucucagaggccc

SEQ ID NO: 1994993 - RNA, 15 nt, Human
acucucagaggcccc

SEQ ID NO: 1994994 - RNA, 18 nt, Human
acucugacaacagacuuc

SEQ ID NO: 1994995 - RNA, 20 nt, Human
acucugacaacagacuucug

SEQ ID NO: 1994996 - RNA, 22 nt, Human
acucugacaacagacuucugaa

SEQ ID NO: 1994997 - RNA, 23 nt, Human
acucugacaacagacuucugaaa

SEQ ID NO: 1994998 - RNA, 16 nt, Human
acucugccugcccuuu

SEQ ID NO: 1994999 - RNA, 14 nt, Human
acucugccugcccu

SEQ ID NO: 1995000 - RNA, 13 nt, Human
acucugacaacag

SEQ ID NO: 1995001 - RNA, 17 nt, Human
acucugacaacagacuu

SEQ ID NO: 1995002 - RNA, 21 nt, Human
acucucaggaaaugcugaccc

SEQ ID NO: 1995003 - RNA, 22 nt, Human
acucucaggaaaugcugaccca

SEQ ID NO: 1995004 - RNA, 16 nt, Human
acucucagaggcccca

SEQ ID NO: 1995005 - RNA, 17 nt, Human
acucucagaggccccaa

SEQ ID NO: 1995006 - RNA, 23 nt, Human
acucuucucaucuugacagagcc

SEQ ID NO: 1995007 - RNA, 12 nt, Human
acucuucucauu

SEQ ID NO: 1995008 - RNA, 17 nt, Human
acucuucucauuacuug

SEQ ID NO: 1995009 - RNA, 18 nt, Human
acucuucucauuacuugu

SEQ ID NO: 1995010 - RNA, 24 nt, Human
acucuucucauuacuuguugccua

SEQ ID NO: 1995011 - RNA, 13 nt, Human
acucuucucucug

SEQ ID NO: 1995012 - RNA, 18 nt, Human
acucuucucucugcucug

SEQ ID NO: 1995013 - RNA, 19 nt, Human
acucuucucucugcucuga

SEQ ID NO: 1995014 - RNA, 14 nt, Human
acucuucucucugc

SEQ ID NO: 1995015 - RNA, 15 nt, Human
acucuucucucugcu

SEQ ID NO: 1995016 - RNA, 16 nt, Human
acucuucucucugcuc

SEQ ID NO: 1995017 - RNA, 17 nt, Human
acucuucucucugcucu

SEQ ID NO: 1995018 - RNA, 13 nt, Human
acucuugaaaaau

SEQ ID NO: 1995019 - RNA, 20 nt, Human
acucuucaguuaagccuuug

SEQ ID NO: 1995020 - RNA, 21 nt, Human
acucuucaguuaagccuuugg

SEQ ID NO: 1995021 - RNA, 23 nt, Human
acucuucccugaacuuccugcuu

SEQ ID NO: 1995022 - RNA, 17 nt, Human
acucuuccuccaaggac

SEQ ID NO: 1995023 - RNA, 20 nt, Human
acucuuccuccaaggacaga

SEQ ID NO: 1995024 - RNA, 17 nt, Human
acucuggcagcucagag

SEQ ID NO: 1995025 - RNA, 16 nt, Human
acucuggcagcucaga

SEQ ID NO: 1995026 - RNA, 14 nt, Human
acucugcucuugca

SEQ ID NO: 1995027 - RNA, 20 nt, Human
acucuggcagcucagagagg

SEQ ID NO: 1995028 - RNA, 19 nt, Human
acucuggcagcucagagag

SEQ ID NO: 1995029 - RNA, 21 nt, Human
acucuuauugcccacgcugga

SEQ ID NO: 1995030 - RNA, 19 nt, Human
acuccugucuucugcuuug

SEQ ID NO: 1995031 - RNA, 20 nt, Human
acuccugucuucugcuuugu

SEQ ID NO: 1995032 - RNA, 15 nt, Human
acuccugucuucugc

SEQ ID NO: 1995033 - RNA, 16 nt, Human
acuccugucuucugcu

SEQ ID NO: 1995034 - RNA, 17 nt, Human
acuccugucuucugcuu

SEQ ID NO: 1995035 - RNA, 18 nt, Human
acuccugucuucugcuuu

SEQ ID NO: 1995036 - RNA, 14 nt, Human
acucgagucugagg

SEQ ID NO: 1995037 - RNA, 15 nt, Human
acucgagucugaggc

SEQ ID NO: 1995038 - RNA, 16 nt, Human
acucgaguuacagaca

SEQ ID NO: 1995039 - RNA, 21 nt, Human
uccuagccaccgccuccuaca

SEQ ID NO: 1995040 - RNA, 21 nt, Human
uccuagccugugccucuggga

SEQ ID NO: 1995041 - RNA, 20 nt, Human
uccuagccacccaccacacu

SEQ ID NO: 1995042 - RNA, 12 nt, Human
uccuacucugug

SEQ ID NO: 1995043 - RNA, 23 nt, Human
uccuacgaguaauugcauuugcu

SEQ ID NO: 1995044 - RNA, 15 nt, Human
uccggcuaagcaggc

SEQ ID NO: 1995045 - RNA, 16 nt, Human
uccggcuaagcaggcg

SEQ ID NO: 1995046 - RNA, 17 nt, Human
uccggcuaagcaggcgc

SEQ ID NO: 1995047 - RNA, 16 nt, Human
uccggcaccaguagca

SEQ ID NO: 1995048 - RNA, 18 nt, Human
uccggcaccaguagcagg

SEQ ID NO: 1995049 - RNA, 15 nt, Human
uccguuaaaauacca

SEQ ID NO: 1995050 - RNA, 18 nt, Human
uccggcuaagcaggcgca

SEQ ID NO: 1995051 - RNA, 13 nt, Human
uccguuaaaauac

SEQ ID NO: 1995052 - RNA, 13 nt, Human
ucccccacuccca

SEQ ID NO: 1995053 - RNA, 13 nt, Human
acguacacauuuu

SEQ ID NO: 1995054 - RNA, 14 nt, Human
acguacacauuuua

SEQ ID NO: 1995055 - RNA, 12 nt, Human
acguacacauuu

SEQ ID NO: 1995056 - RNA, 13 nt, Human
acguacacacaca

SEQ ID NO: 1995057 - RNA, 21 nt, Human
acuagagggaccucucccagg

SEQ ID NO: 1995058 - RNA, 20 nt, Human
acuagagggaccucucccag

SEQ ID NO: 1995059 - RNA, 13 nt, Human
acuagacacacaa

SEQ ID NO: 1995060 - RNA, 18 nt, Human
acuagacacacaaagcag

SEQ ID NO: 1995061 - RNA, 21 nt, Human
acuagacacacaaagcaguug

SEQ ID NO: 1995062 - RNA, 22 nt, Human
acuagagggaccucucccaggg

SEQ ID NO: 1995063 - RNA, 14 nt, Human
acuacuuagcacuu

SEQ ID NO: 1995064 - RNA, 22 nt, Human
acuaccuguaaugacaggccug

SEQ ID NO: 1995065 - RNA, 13 nt, Human
ucccccagccacu

SEQ ID NO: 1995066 - RNA, 14 nt, Human
ucccccagccacuc

SEQ ID NO: 1995067 - RNA, 15 nt, Human
ucccccagccacucc

SEQ ID NO: 1995068 - RNA, 19 nt, Human
acuaccuuuggcuuaauuc

SEQ ID NO: 1995069 - RNA, 18 nt, Human
acuacggaauaguuggcu

SEQ ID NO: 1995070 - RNA, 21 nt, Human
acuauaauguaagcucuacug

SEQ ID NO: 1995071 - RNA, 15 nt, Human
acuaugauuuggaaa

SEQ ID NO: 1995072 - RNA, 19 nt, Human
acuaugauuuaauuugaaa

SEQ ID NO: 1995073 - RNA, 16 nt, Human
acuaugauuuggaaaa

SEQ ID NO: 1995074 - RNA, 14 nt, Human
acuauaauguaagc

SEQ ID NO: 1995075 - RNA, 13 nt, Human
acuauaauguaag

SEQ ID NO: 1995076 - RNA, 12 nt, Human
acuauaauguaa

SEQ ID NO: 1995077 - RNA, 12 nt, Human
acuauguaucaa

SEQ ID NO: 1995078 - RNA, 13 nt, Human
acuauguugauaa

SEQ ID NO: 1995079 - RNA, 17 nt, Human
acuauguaaaaauaacc

SEQ ID NO: 1995080 - RNA, 18 nt, Human
acuauguaaaaauaaccu

SEQ ID NO: 1995081 - RNA, 15 nt, Human
uccccuaaagccuca

SEQ ID NO: 1995082 - RNA, 22 nt, Human
uccccuaaagccucaaaacaaa

SEQ ID NO: 1995083 - RNA, 18 nt, Human
acucaaguugucucuuua

SEQ ID NO: 1995084 - RNA, 14 nt, Human
acucaaugcacuga

SEQ ID NO: 1995085 - RNA, 19 nt, Human
acucacauuuauucugcuc

SEQ ID NO: 1995086 - RNA, 20 nt, Human
acucacauuuauucugcuca

SEQ ID NO: 1995087 - RNA, 22 nt, Human
ucccugaaggccccgcccaggc

SEQ ID NO: 1995088 - RNA, 21 nt, Human
ucccugaaggccccgcccagg

SEQ ID NO: 1995089 - RNA, 18 nt, Human
ucccugaaggccccgccc

SEQ ID NO: 1995090 - RNA, 17 nt, Human
ucccugaaggccccgcc

SEQ ID NO: 1995091 - RNA, 14 nt, Human
ucccugaacuuccu

SEQ ID NO: 1995092 - RNA, 19 nt, Human
acucaccucccccaucucu

SEQ ID NO: 1995093 - RNA, 20 nt, Human
acucaccucccccaucucuu

SEQ ID NO: 1995094 - RNA, 17 nt, Human
acucaccccagccccaa

SEQ ID NO: 1995095 - RNA, 16 nt, Human
ucccugaaguuaugug

SEQ ID NO: 1995096 - RNA, 23 nt, Human
ucccugaaggccccgcccaggcu

SEQ ID NO: 1995097 - RNA, 13 nt, Human
ucccucccagcuc

SEQ ID NO: 1995098 - RNA, 13 nt, Human
ucccucuuucccu

SEQ ID NO: 1995099 - RNA, 11 nt, Human
ucccucuuucc

SEQ ID NO: 1995100 - RNA, 20 nt, Human
ucccucagucuggcccuucc

SEQ ID NO: 1995101 - RNA, 12 nt, Human
uccccucuuccu

SEQ ID NO: 1995102 - RNA, 13 nt, Human
uccccucuuccuc

SEQ ID NO: 1995103 - RNA, 15 nt, Human
uccccucuuccucuu

SEQ ID NO: 1995104 - RNA, 18 nt, Human
ucccucagucuggcccuu

SEQ ID NO: 1995105 - RNA, 14 nt, Human
ucccucacucucag

SEQ ID NO: 1995106 - RNA, 15 nt, Human
ucccucacucucagg

SEQ ID NO: 1995107 - RNA, 17 nt, Human
ucccucacucucaggaa

SEQ ID NO: 1995108 - RNA, 15 nt, Human
ucccucagaaaauga

SEQ ID NO: 1995109 - RNA, 14 nt, Human
acuccaccaagccu

SEQ ID NO: 1995110 - RNA, 22 nt, Human
acucauugaccugaggcccuuc

SEQ ID NO: 1995111 - RNA, 18 nt, Human
acucauugaccugaggcc

SEQ ID NO: 1995112 - RNA, 19 nt, Human
acucauuuuaaugauuguu

SEQ ID NO: 1995113 - RNA, 14 nt, Human
acucauuuugcuug

SEQ ID NO: 1995114 - RNA, 12 nt, Human
acucauuuugcu

SEQ ID NO: 1995115 - RNA, 17 nt, Human
acucauugaccugaggc

SEQ ID NO: 1995116 - RNA, 16 nt, Human
acucauugaccugagg

SEQ ID NO: 1995117 - RNA, 21 nt, Human
acucaucuagguaaauuacag

SEQ ID NO: 1995118 - RNA, 19 nt, Human
acucaucuggaguucucaa

SEQ ID NO: 1995119 - RNA, 22 nt, Human
acucaucuggaguucucaaaga

SEQ ID NO: 1995120 - RNA, 12 nt, Human
acucaucuuagg

SEQ ID NO: 1995121 - RNA, 16 nt, Human
acucagaaguccagag

SEQ ID NO: 1995122 - RNA, 12 nt, Human
acucagagcagu

SEQ ID NO: 1995123 - RNA, 19 nt, Human
acucagagcagucugugac

SEQ ID NO: 1995124 - RNA, 23 nt, Human
acucaucuagguaaauuacaguu

SEQ ID NO: 1995125 - RNA, 19 nt, Human
acucaccugccccucaacu

SEQ ID NO: 1995126 - RNA, 14 nt, Human
acucaccugccccu

SEQ ID NO: 1995127 - RNA, 21 nt, Human
acucaccugccccucaacucu

SEQ ID NO: 1995128 - RNA, 14 nt, Human
acucagaagacacu

SEQ ID NO: 1995129 - RNA, 15 nt, Human
acucagaagacacug

SEQ ID NO: 1995130 - RNA, 16 nt, Human
acucagaagacacuga

SEQ ID NO: 1995131 - RNA, 17 nt, Human
acucagaagacacugau

SEQ ID NO: 1995132 - RNA, 18 nt, Human
acucagaagacacugaug

SEQ ID NO: 1995133 - RNA, 21 nt, Human
acucagaauucucuaguuuga

SEQ ID NO: 1995134 - RNA, 22 nt, Human
acucagaauucucuaguuugau

SEQ ID NO: 1995135 - RNA, 14 nt, Human
acucagaauucucu

SEQ ID NO: 1995136 - RNA, 12 nt, Human
uaggauucacac

SEQ ID NO: 1995137 - RNA, 20 nt, Human
uaggauucacaccccaccug

SEQ ID NO: 1995138 - RNA, 21 nt, Human
uaggauucacaccccaccugc

SEQ ID NO: 1995139 - RNA, 13 nt, Human
uaggauguugaaa

SEQ ID NO: 1995140 - RNA, 22 nt, Human
uaggauucacaccccaccugcg

SEQ ID NO: 1995141 - RNA, 17 nt, Human
uaggcagggugucugcc

SEQ ID NO: 1995142 - RNA, 20 nt, Human
uaggcagggugucugccccc

SEQ ID NO: 1995143 - RNA, 15 nt, Human
uaggcaguauaaaga

SEQ ID NO: 1995144 - RNA, 16 nt, Human
uaggcaguauaaagaa

SEQ ID NO: 1995145 - RNA, 19 nt, Human
uaggcaguauaaagaauag

SEQ ID NO: 1995146 - RNA, 16 nt, Human
uaggcauaugcuucuu

SEQ ID NO: 1995147 - RNA, 17 nt, Human
uaggauaugccugcucu

SEQ ID NO: 1995148 - RNA, 18 nt, Human
uaggauaugccugcucuu

SEQ ID NO: 1995149 - RNA, 21 nt, Human
uaggauaugccugcucuuugg

SEQ ID NO: 1995150 - RNA, 17 nt, Human
uaggaugggcuucugug

SEQ ID NO: 1995151 - RNA, 15 nt, Human
uaggaaaagaaaucu

SEQ ID NO: 1995152 - RNA, 16 nt, Human
uaggaaaagaaaucua

SEQ ID NO: 1995153 - RNA, 21 nt, Human
uaggaaaagaaaucuauagaa

SEQ ID NO: 1995154 - RNA, 22 nt, Human
uaggaaaagaaaucuauagaaa

SEQ ID NO: 1995155 - RNA, 17 nt, Human
uaggaaaaacugauuuu

SEQ ID NO: 1995156 - RNA, 16 nt, Human
uaggaaaaacugauuu

SEQ ID NO: 1995157 - RNA, 16 nt, Human
uagggguaccacugaa

SEQ ID NO: 1995158 - RNA, 16 nt, Human
uagggcauuguaucug

SEQ ID NO: 1995159 - RNA, 24 nt, Human
uagggcauuguaucugucuuucca

SEQ ID NO: 1995160 - RNA, 15 nt, Human
uaggggaagaauaau

SEQ ID NO: 1995161 - RNA, 17 nt, Human
uaggggaagaauaauuu

SEQ ID NO: 1995162 - RNA, 17 nt, Human
uagggcucuaauuuccu

SEQ ID NO: 1995163 - RNA, 16 nt, Human
uagggcucuaauuucc

SEQ ID NO: 1995164 - RNA, 13 nt, Human
uagggaagauaau

SEQ ID NO: 1995165 - RNA, 19 nt, Human
uagggauggggcugugggg

SEQ ID NO: 1995166 - RNA, 19 nt, Human
uagggaagcuggccugaga

SEQ ID NO: 1995167 - RNA, 15 nt, Human
uagggaguauucuaa

SEQ ID NO: 1995168 - RNA, 14 nt, Human
uagcuaagccaaga

SEQ ID NO: 1995169 - RNA, 21 nt, Human
uagcuucaccccaaucccagc

SEQ ID NO: 1995170 - RNA, 23 nt, Human
uagcuuuaaugauaugcuuguaa

SEQ ID NO: 1995171 - RNA, 13 nt, Human
uagcuuuuuucuc

SEQ ID NO: 1995172 - RNA, 23 nt, Human
uagcuuuuuucucugauacagaa

SEQ ID NO: 1995173 - RNA, 14 nt, Human
uaggaaaaacugau

SEQ ID NO: 1995174 - RNA, 13 nt, Human
uaggaaaaacuga

SEQ ID NO: 1995175 - RNA, 13 nt, Human
uagcuuuucccuu

SEQ ID NO: 1995176 - RNA, 21 nt, Human
uagcuuucugagcaagaggau

SEQ ID NO: 1995177 - RNA, 19 nt, Human
acaaaucugcaaagcaugu

SEQ ID NO: 1995178 - RNA, 22 nt, Human
acaaaucugcaaagcauguuuu

SEQ ID NO: 1995179 - RNA, 14 nt, Human
acaaaucugucugc

SEQ ID NO: 1995180 - RNA, 17 nt, Human
acaaaugacugucucuu

SEQ ID NO: 1995181 - RNA, 15 nt, Human
acaaaucuuuccaua

SEQ ID NO: 1995182 - RNA, 12 nt, Human
acaaaugacuuu

SEQ ID NO: 1995183 - RNA, 13 nt, Human
acaaaugacuuua

SEQ ID NO: 1995184 - RNA, 15 nt, Human
acaaaugacuuuauu

SEQ ID NO: 1995185 - RNA, 20 nt, Human
uagccuuagaagucacacag

SEQ ID NO: 1995186 - RNA, 14 nt, Human
acaauauuucugau

SEQ ID NO: 1995187 - RNA, 12 nt, Human
acaauauuugug

SEQ ID NO: 1995188 - RNA, 14 nt, Human
acaauauuugugug

SEQ ID NO: 1995189 - RNA, 18 nt, Human
acaauauuugugugcuaa

SEQ ID NO: 1995190 - RNA, 19 nt, Human
acaauauuugugugcuaaa

SEQ ID NO: 1995191 - RNA, 21 nt, Human
uagccuuagaagucacacagu

SEQ ID NO: 1995192 - RNA, 14 nt, Human
uagcgcccaguugg

SEQ ID NO: 1995193 - RNA, 17 nt, Human
uagcgcccaguugggug

SEQ ID NO: 1995194 - RNA, 18 nt, Human
acaaugcaaaccaucauu

SEQ ID NO: 1995195 - RNA, 17 nt, Human
acaaugcaaaccaucau

SEQ ID NO: 1995196 - RNA, 16 nt, Human
acaaugcaaaccauca

SEQ ID NO: 1995197 - RNA, 11 nt, Human
acaaugcaaac

SEQ ID NO: 1995198 - RNA, 20 nt, Human
acaaugacuuacuguacaug

SEQ ID NO: 1995199 - RNA, 19 nt, Human
acaaugacuuacuguacau

SEQ ID NO: 1995200 - RNA, 22 nt, Human
acaaugacuuacuguacaugaa

SEQ ID NO: 1995201 - RNA, 13 nt, Human
acaaugacuuuau

SEQ ID NO: 1995202 - RNA, 14 nt, Human
acaaugacuuuauu

SEQ ID NO: 1995203 - RNA, 19 nt, Human
uaggguaagugagagaggg

SEQ ID NO: 1995204 - RNA, 17 nt, Human
uagggguaccacugaau

SEQ ID NO: 1995205 - RNA, 13 nt, Human
uaggguacaugug

SEQ ID NO: 1995206 - RNA, 13 nt, Human
uaggguccugggg

SEQ ID NO: 1995207 - RNA, 17 nt, Human
uaggguuauaauaaugu

SEQ ID NO: 1995208 - RNA, 15 nt, Human
uaggguuauaauaau

SEQ ID NO: 1995209 - RNA, 15 nt, Human
uagggugggccuuca

SEQ ID NO: 1995210 - RNA, 13 nt, Human
acacaagugcagu

SEQ ID NO: 1995211 - RNA, 22 nt, Human
acacaagugcaguagugcaguu

SEQ ID NO: 1995212 - RNA, 21 nt, Human
acaaugcaaaccaucauugaa

SEQ ID NO: 1995213 - RNA, 19 nt, Human
acaaugcaaaccaucauug

SEQ ID NO: 1995214 - RNA, 23 nt, Human
acaaugcaaaccaucauugaaau

SEQ ID NO: 1995215 - RNA, 16 nt, Human
acacaaauuaugcuaa

SEQ ID NO: 1995216 - RNA, 21 nt, Human
acacaaauuaugcuaagaauu

SEQ ID NO: 1995217 - RNA, 22 nt, Human
acacaaauuaugcuaagaauuu

SEQ ID NO: 1995218 - RNA, 12 nt, Human
uaguaaucauau

SEQ ID NO: 1995219 - RNA, 14 nt, Human
uaguagagacaggg

SEQ ID NO: 1995220 - RNA, 14 nt, Human
uagucacugagaca

SEQ ID NO: 1995221 - RNA, 13 nt, Human
uaguagagacggg

SEQ ID NO: 1995222 - RNA, 15 nt, Human
uaguagagacagggu

SEQ ID NO: 1995223 - RNA, 22 nt, Human
uaguagagacaggguuuugcca

SEQ ID NO: 1995224 - RNA, 15 nt, Human
uaguaauauaauaca

SEQ ID NO: 1995225 - RNA, 21 nt, Human
uaguaauauaauacacaaaau

SEQ ID NO: 1995226 - RNA, 13 nt, Human
uaguaauauauuu

SEQ ID NO: 1995227 - RNA, 16 nt, Human
uaguaauauauuuaaa

SEQ ID NO: 1995228 - RNA, 17 nt, Human
uaguaauauauuuaaag

SEQ ID NO: 1995229 - RNA, 18 nt, Human
uaguaauauauuuaaagg

SEQ ID NO: 1995230 - RNA, 19 nt, Human
uaguaauauauuuaaaggg

SEQ ID NO: 1995231 - RNA, 23 nt, Human
uaguaauauauuuaaagggaaau

SEQ ID NO: 1995232 - RNA, 13 nt, Human
uaguaaaaauaaa

SEQ ID NO: 1995233 - RNA, 16 nt, Human
uaguaaaaauaaaauu

SEQ ID NO: 1995234 - RNA, 21 nt, Human
acacaggggacacccagaaac

SEQ ID NO: 1995235 - RNA, 19 nt, Human
acacaguaccauuuaaugg

SEQ ID NO: 1995236 - RNA, 22 nt, Human
uagguuuggacaaaauggaaua

SEQ ID NO: 1995237 - RNA, 23 nt, Human
acacacagauuugagcucagccc

SEQ ID NO: 1995238 - RNA, 16 nt, Human
acacaggcccggcucc

SEQ ID NO: 1995239 - RNA, 17 nt, Human
acacaggcccggcucca

SEQ ID NO: 1995240 - RNA, 18 nt, Human
acacaggcccggcuccag

SEQ ID NO: 1995241 - RNA, 19 nt, Human
acacaggcccggcuccagg

SEQ ID NO: 1995242 - RNA, 20 nt, Human
acacaggcccggcuccaggc

SEQ ID NO: 1995243 - RNA, 21 nt, Human
acacaggcccggcuccaggcu

SEQ ID NO: 1995244 - RNA, 22 nt, Human
acacaggcccggcuccaggcuc

SEQ ID NO: 1995245 - RNA, 23 nt, Human
acacaggcccggcuccaggcucc

SEQ ID NO: 1995246 - RNA, 24 nt, Human
acacaggcccggcuccaggcuccu

SEQ ID NO: 1995247 - RNA, 16 nt, Human
acacaggccacccugu

SEQ ID NO: 1995248 - RNA, 19 nt, Human
acacaggccacccugugca

SEQ ID NO: 1995249 - RNA, 12 nt, Human
acaaaacaaauc

SEQ ID NO: 1995250 - RNA, 15 nt, Human
acaaaacaaauccug

SEQ ID NO: 1995251 - RNA, 22 nt, Human
acaaaaccacaguguaccauua

SEQ ID NO: 1995252 - RNA, 14 nt, Human
acaaaaccaaaagu

SEQ ID NO: 1995253 - RNA, 16 nt, Human
acaaaaccaaaaguua

SEQ ID NO: 1995254 - RNA, 19 nt, Human
acaaaaccaaaaguuauua

SEQ ID NO: 1995255 - RNA, 15 nt, Human
acaaaaccacagugu

SEQ ID NO: 1995256 - RNA, 10 nt, Human
acaaaaggca

SEQ ID NO: 1995257 - RNA, 19 nt, Human
acaaaaauucucaguucuc

SEQ ID NO: 1995258 - RNA, 16 nt, Human
acaaaaagcuacuuau

SEQ ID NO: 1995259 - RNA, 20 nt, Human
aauuuuacauggcuggagcu

SEQ ID NO: 1995260 - RNA, 12 nt, Human
aauuuuacauuu

SEQ ID NO: 1995261 - RNA, 13 nt, Human
acaaaauaaauug

SEQ ID NO: 1995262 - RNA, 14 nt, Human
acaaaauacauucu

SEQ ID NO: 1995263 - RNA, 16 nt, Human
acaaaauacauucuuu

SEQ ID NO: 1995264 - RNA, 13 nt, Human
acaaaaucaaaua

SEQ ID NO: 1995265 - RNA, 16 nt, Human
acaaaauauugaaagg

SEQ ID NO: 1995266 - RNA, 19 nt, Human
acaaauacaauacauagga

SEQ ID NO: 1995267 - RNA, 22 nt, Human
uagagcggagaaaggaagggcu

SEQ ID NO: 1995268 - RNA, 14 nt, Human
uagagccagggucu

SEQ ID NO: 1995269 - RNA, 22 nt, Human
acaaauaguaggcaagauggca

SEQ ID NO: 1995270 - RNA, 17 nt, Human
acaaauaguaggcaaga

SEQ ID NO: 1995271 - RNA, 19 nt, Human
acaaauaguaggcaagaug

SEQ ID NO: 1995272 - RNA, 21 nt, Human
acaaauaguaggcaagauggc

SEQ ID NO: 1995273 - RNA, 20 nt, Human
uagagggaccucucccaggg

SEQ ID NO: 1995274 - RNA, 19 nt, Human
uagagggaccucucccagg

SEQ ID NO: 1995275 - RNA, 15 nt, Human
uagagggaccucucc

SEQ ID NO: 1995276 - RNA, 24 nt, Human
uagaggggaaaagagaugaugaaa

SEQ ID NO: 1995277 - RNA, 14 nt, Human
uagcaaaaacaugu

SEQ ID NO: 1995278 - RNA, 18 nt, Human
uagcaaaaacauguaugu

SEQ ID NO: 1995279 - RNA, 18 nt, Human
uagcaaaaaaaguuguau

SEQ ID NO: 1995280 - RNA, 20 nt, Human
uagcaaaaaaaguuguauga

SEQ ID NO: 1995281 - RNA, 21 nt, Human
uagcaaaaaaaguuguaugau

SEQ ID NO: 1995282 - RNA, 23 nt, Human
uagcaaaaaaaguuguaugaucu

SEQ ID NO: 1995283 - RNA, 13 nt, Human
uagcaaaaaaagu

SEQ ID NO: 1995284 - RNA, 14 nt, Human
uagcaaaaaaaguu

SEQ ID NO: 1995285 - RNA, 15 nt, Human
uagcacagacccugc

SEQ ID NO: 1995286 - RNA, 21 nt, Human
uagcacagacccugcccugug

SEQ ID NO: 1995287 - RNA, 20 nt, Human
uagcacagacccugcccugu

SEQ ID NO: 1995288 - RNA, 14 nt, Human
uagcacagacccug

SEQ ID NO: 1995289 - RNA, 22 nt, Human
uagcaaacccugucaaacauua

SEQ ID NO: 1995290 - RNA, 17 nt, Human
uagcaaacccugucaaa

SEQ ID NO: 1995291 - RNA, 19 nt, Human
uagcaaacccugucaaaca

SEQ ID NO: 1995292 - RNA, 20 nt, Human
uagcaaacccugucaaacau

SEQ ID NO: 1995293 - RNA, 21 nt, Human
uagcaaacccugucaaacauu

SEQ ID NO: 1995294 - RNA, 19 nt, Human
uagccaccgccuccuacag

SEQ ID NO: 1995295 - RNA, 14 nt, Human
uagccaccugaguu

SEQ ID NO: 1995296 - RNA, 17 nt, Human
uagccaccugaguuccu

SEQ ID NO: 1995297 - RNA, 20 nt, Human
acaaauauuucuagacacuu

SEQ ID NO: 1995298 - RNA, 18 nt, Human
uagccacccaccacacug

SEQ ID NO: 1995299 - RNA, 18 nt, Human
uagccaccgccuccuaca

SEQ ID NO: 1995300 - RNA, 21 nt, Human
uagccaacggccccagcuucu

SEQ ID NO: 1995301 - RNA, 13 nt, Human
uagccaaggccaa

SEQ ID NO: 1995302 - RNA, 19 nt, Human
uagccaacggccccagcuu

SEQ ID NO: 1995303 - RNA, 20 nt, Human
uagccaacggccccagcuuc

SEQ ID NO: 1995304 - RNA, 18 nt, Human
uagccaacggccccagcu

SEQ ID NO: 1995305 - RNA, 23 nt, Human
uagccaaaugacugaaagcacug

SEQ ID NO: 1995306 - RNA, 12 nt, Human
uagccaaggcca

SEQ ID NO: 1995307 - RNA, 21 nt, Human
uagcacuucagggcagauuuu

SEQ ID NO: 1995308 - RNA, 20 nt, Human
uagcacuuccuugccagucu

SEQ ID NO: 1995309 - RNA, 21 nt, Human
uagcacuuccuugccagucuu

SEQ ID NO: 1995310 - RNA, 15 nt, Human
uagccaaaaugugag

SEQ ID NO: 1995311 - RNA, 16 nt, Human
uagccaaaaugugagu

SEQ ID NO: 1995312 - RNA, 23 nt, Human
uagccaaaaugugagugguugaa

SEQ ID NO: 1995313 - RNA, 24 nt, Human
uagcacagacccugcccugugggc

SEQ ID NO: 1995314 - RNA, 22 nt, Human
uagcacagacccugcccugugg

SEQ ID NO: 1995315 - RNA, 22 nt, Human
uagaauuugauaugugaacagu

SEQ ID NO: 1995316 - RNA, 20 nt, Human
uagaauuugauaugugaaca

SEQ ID NO: 1995317 - RNA, 19 nt, Human
uagaauuugauaugugaac

SEQ ID NO: 1995318 - RNA, 23 nt, Human
uagaauuuuaagccuuuguugaa

SEQ ID NO: 1995319 - RNA, 21 nt, Human
uagaaguaacuggugauauau

SEQ ID NO: 1995320 - RNA, 21 nt, Human
uagaaggaaaaccuagaaaac

SEQ ID NO: 1995321 - RNA, 12 nt, Human
uagacacacaaa

SEQ ID NO: 1995322 - RNA, 15 nt, Human
uagacacacaaagca

SEQ ID NO: 1995323 - RNA, 16 nt, Human
uagacacacaaagcag

SEQ ID NO: 1995324 - RNA, 18 nt, Human
uagacaauuuauuauggc

SEQ ID NO: 1995325 - RNA, 16 nt, Human
uagacagucccugcca

SEQ ID NO: 1995326 - RNA, 10 nt, Human
uagacagagu

SEQ ID NO: 1995327 - RNA, 18 nt, Human
aauuugggggaaaauuua

SEQ ID NO: 1995328 - RNA, 14 nt, Human
aauuugugauacaa

SEQ ID NO: 1995329 - RNA, 17 nt, Human
aauuugugauacaaugc

SEQ ID NO: 1995330 - RNA, 18 nt, Human
aauuugugauacaaugcu

SEQ ID NO: 1995331 - RNA, 20 nt, Human
aauuugugauacaaugcugu

SEQ ID NO: 1995332 - RNA, 21 nt, Human
uagacauuugcuaugagcugg

SEQ ID NO: 1995333 - RNA, 19 nt, Human
aauuuggaccauuuuccug

SEQ ID NO: 1995334 - RNA, 21 nt, Human
uagacagucccugccaaugga

SEQ ID NO: 1995335 - RNA, 17 nt, Human
uagacagucccugccaa

SEQ ID NO: 1995336 - RNA, 21 nt, Human
uagacagagucucacuguugc

SEQ ID NO: 1995337 - RNA, 14 nt, Human
uagaagaagugugu

SEQ ID NO: 1995338 - RNA, 16 nt, Human
uagaacuuuguauagu

SEQ ID NO: 1995339 - RNA, 16 nt, Human
uagaagaaugcaugcu

SEQ ID NO: 1995340 - RNA, 22 nt, Human
uagaagaaugcaugcuuuccau

SEQ ID NO: 1995341 - RNA, 14 nt, Human
uagaagaaugcaug

SEQ ID NO: 1995342 - RNA, 12 nt, Human
uagaacuuugua

SEQ ID NO: 1995343 - RNA, 13 nt, Human
uagaacuuuguau

SEQ ID NO: 1995344 - RNA, 14 nt, Human
uagaacuuuguaua

SEQ ID NO: 1995345 - RNA, 17 nt, Human
uagaacucccuuucaac

SEQ ID NO: 1995346 - RNA, 18 nt, Human
uagaacucccuuucaaca

SEQ ID NO: 1995347 - RNA, 16 nt, Human
uagaacucccuuucaa

SEQ ID NO: 1995348 - RNA, 22 nt, Human
uagaaaaggugauaaaaucaua

SEQ ID NO: 1995349 - RNA, 12 nt, Human
uagaaaagguga

SEQ ID NO: 1995350 - RNA, 21 nt, Human
uagaaaaggugauaaaaucau

SEQ ID NO: 1995351 - RNA, 11 nt, Human
uagaaaaggca

SEQ ID NO: 1995352 - RNA, 14 nt, Human
uagaaaacuuuguu

SEQ ID NO: 1995353 - RNA, 13 nt, Human
uagaaaacuuugu

SEQ ID NO: 1995354 - RNA, 16 nt, Human
uagaaacacauaauua

SEQ ID NO: 1995355 - RNA, 20 nt, Human
uagaaacacauaauuaacac

SEQ ID NO: 1995356 - RNA, 21 nt, Human
uagaaacacauaauuaacacu

SEQ ID NO: 1995357 - RNA, 17 nt, Human
uagaaacaccaaaaaaa

SEQ ID NO: 1995358 - RNA, 18 nt, Human
uacuuuguauuguccuau

SEQ ID NO: 1995359 - RNA, 15 nt, Human
uacuuuuaaagaauu

SEQ ID NO: 1995360 - RNA, 20 nt, Human
uacuuuuaaagaauuucuuu

SEQ ID NO: 1995361 - RNA, 22 nt, Human
uacuuuuaaagaauuucuuuau

SEQ ID NO: 1995362 - RNA, 14 nt, Human
uacuuuguauuguc

SEQ ID NO: 1995363 - RNA, 16 nt, Human
uacuuuguauuguccu

SEQ ID NO: 1995364 - RNA, 21 nt, Human
uacuuuuccuugcauacaaac

SEQ ID NO: 1995365 - RNA, 22 nt, Human
uacuuuuccuugcauacaaaca

SEQ ID NO: 1995366 - RNA, 11 nt, Human
uacuuuuccuu

SEQ ID NO: 1995367 - RNA, 15 nt, Human
uacuuuuccuugcau

SEQ ID NO: 1995368 - RNA, 19 nt, Human
uagaaaacauuuggcagaa

SEQ ID NO: 1995369 - RNA, 15 nt, Human
uagaaaacaauggaa

SEQ ID NO: 1995370 - RNA, 14 nt, Human
uagaaaaacaaauc

SEQ ID NO: 1995371 - RNA, 16 nt, Human
aauuccacacccucac

SEQ ID NO: 1995372 - RNA, 14 nt, Human
aauuccacagcugc

SEQ ID NO: 1995373 - RNA, 12 nt, Human
aauuccacagcu

SEQ ID NO: 1995374 - RNA, 13 nt, Human
aauuccacagcug

SEQ ID NO: 1995375 - RNA, 21 nt, Human
uacuuugauucacauguuuuc

SEQ ID NO: 1995376 - RNA, 12 nt, Human
uacuuugauuca

SEQ ID NO: 1995377 - RNA, 14 nt, Human
uacuuugauucaca

SEQ ID NO: 1995378 - RNA, 15 nt, Human
uacuuugauucacau

SEQ ID NO: 1995379 - RNA, 17 nt, Human
uacuuugauucacaugu

SEQ ID NO: 1995380 - RNA, 20 nt, Human
uacuuugauucacauguuuu

SEQ ID NO: 1995381 - RNA, 23 nt, Human
uacuuugauucacauguuuucaa

SEQ ID NO: 1995382 - RNA, 14 nt, Human
uacuuuguaaauuc

SEQ ID NO: 1995383 - RNA, 17 nt, Human
uacuuuguaaauucuga

SEQ ID NO: 1995384 - RNA, 18 nt, Human
uacuuuguaaauucugau

SEQ ID NO: 1995385 - RNA, 19 nt, Human
uacuuuguaaauucugauu

SEQ ID NO: 1995386 - RNA, 22 nt, Human
uacuuuguaaauucugauuucu

SEQ ID NO: 1995387 - RNA, 12 nt, Human
uacuuuguauug

SEQ ID NO: 1995388 - RNA, 16 nt, Human
uaucuauaaacacugu

SEQ ID NO: 1995389 - RNA, 15 nt, Human
uaucccggcugcccu

SEQ ID NO: 1995390 - RNA, 15 nt, Human
uaucagcacgugugg

SEQ ID NO: 1995391 - RNA, 19 nt, Human
uauccaacaucaacaucuu

SEQ ID NO: 1995392 - RNA, 14 nt, Human
uauccaaugaaaua

SEQ ID NO: 1995393 - RNA, 14 nt, Human
uaucagcacgugug

SEQ ID NO: 1995394 - RNA, 17 nt, Human
uaucagaauucucagaa

SEQ ID NO: 1995395 - RNA, 19 nt, Human
acagaccgaacuguuguau

SEQ ID NO: 1995396 - RNA, 18 nt, Human
acagaccgaacuguugua

SEQ ID NO: 1995397 - RNA, 23 nt, Human
uaucaaauacauuuaaaacauua

SEQ ID NO: 1995398 - RNA, 21 nt, Human
uaucaaaggcacauggaauau

SEQ ID NO: 1995399 - RNA, 19 nt, Human
uaucacccagaagaaaaua

SEQ ID NO: 1995400 - RNA, 22 nt, Human
uaucacccagaagaaaauagug

SEQ ID NO: 1995401 - RNA, 17 nt, Human
uaucaaauuaauugugu

SEQ ID NO: 1995402 - RNA, 14 nt, Human
uaucaaauuaauug

SEQ ID NO: 1995403 - RNA, 15 nt, Human
uaucaaauuaauugu

SEQ ID NO: 1995404 - RNA, 16 nt, Human
uaucaaauuaauugug

SEQ ID NO: 1995405 - RNA, 16 nt, Human
acacuuacacuuuaug

SEQ ID NO: 1995406 - RNA, 20 nt, Human
acacuguuucaaacuuuacu

SEQ ID NO: 1995407 - RNA, 17 nt, Human
acacucauugaccugag

SEQ ID NO: 1995408 - RNA, 17 nt, Human
acacuguuucaaacuuu

SEQ ID NO: 1995409 - RNA, 18 nt, Human
acacuguuucaaacuuua

SEQ ID NO: 1995410 - RNA, 21 nt, Human
acacuuacacuuuaugcacaa

SEQ ID NO: 1995411 - RNA, 18 nt, Human
acacuuacacuuuaugca

SEQ ID NO: 1995412 - RNA, 15 nt, Human
acacuuagcuggaga

SEQ ID NO: 1995413 - RNA, 23 nt, Human
acacuuaagguugggugcugcua

SEQ ID NO: 1995414 - RNA, 15 nt, Human
acacuucaggcucuu

SEQ ID NO: 1995415 - RNA, 19 nt, Human
acacuucaggcucuucucc

SEQ ID NO: 1995416 - RNA, 22 nt, Human
acacuucaggcucuucuccuuu

SEQ ID NO: 1995417 - RNA, 14 nt, Human
acacuuccauaauc

SEQ ID NO: 1995418 - RNA, 17 nt, Human
acacuucaguuaucuug

SEQ ID NO: 1995419 - RNA, 21 nt, Human
acacuuuuucuuuacaaacaa

SEQ ID NO: 1995420 - RNA, 18 nt, Human
acagacauacuaaccagc

SEQ ID NO: 1995421 - RNA, 19 nt, Human
acagacauacuaaccagca

SEQ ID NO: 1995422 - RNA, 13 nt, Human
acagaaauguaca

SEQ ID NO: 1995423 - RNA, 13 nt, Human
acagacaggaccc

SEQ ID NO: 1995424 - RNA, 18 nt, Human
acagacaggaccccugca

SEQ ID NO: 1995425 - RNA, 19 nt, Human
uauaagugauugcugguuu

SEQ ID NO: 1995426 - RNA, 21 nt, Human
acacucaaaagcugggcaggu

SEQ ID NO: 1995427 - RNA, 22 nt, Human
acacuaaugaggaaacugcacu

SEQ ID NO: 1995428 - RNA, 15 nt, Human
acacuaaugaggaaa

SEQ ID NO: 1995429 - RNA, 20 nt, Human
uagucacugagacagcccgg

SEQ ID NO: 1995430 - RNA, 17 nt, Human
uagucacugagacagcc

SEQ ID NO: 1995431 - RNA, 19 nt, Human
uauacauguuuauguaaac

SEQ ID NO: 1995432 - RNA, 15 nt, Human
uauacaugaaauuca

SEQ ID NO: 1995433 - RNA, 15 nt, Human
uauacauguuuaugu

SEQ ID NO: 1995434 - RNA, 16 nt, Human
uauacauguuuaugua

SEQ ID NO: 1995435 - RNA, 17 nt, Human
uauacauguuuauguaa

SEQ ID NO: 1995436 - RNA, 18 nt, Human
uauacauguuuauguaaa

SEQ ID NO: 1995437 - RNA, 22 nt, Human
uauacacuuggaguuugcauuc

SEQ ID NO: 1995438 - RNA, 14 nt, Human
uauaauuguugcau

SEQ ID NO: 1995439 - RNA, 15 nt, Human
uauaauuguugcaua

SEQ ID NO: 1995440 - RNA, 16 nt, Human
uauaauuguugcauag

SEQ ID NO: 1995441 - RNA, 22 nt, Human
uauacacuuacacuuuaugcac

SEQ ID NO: 1995442 - RNA, 18 nt, Human
uauaauuuaccugaaguc

SEQ ID NO: 1995443 - RNA, 11 nt, Human
uauauauuucc

SEQ ID NO: 1995444 - RNA, 19 nt, Human
uauauauuuuuuucugaaa

SEQ ID NO: 1995445 - RNA, 13 nt, Human
uauauccuuuucu

SEQ ID NO: 1995446 - RNA, 19 nt, Human
uauauccuuuucuguguuu

SEQ ID NO: 1995447 - RNA, 15 nt, Human
uauaucuaaaucugu

SEQ ID NO: 1995448 - RNA, 20 nt, Human
uauaucuauaaacacuguuu

SEQ ID NO: 1995449 - RNA, 18 nt, Human
uauaucuauaaacacugu

SEQ ID NO: 1995450 - RNA, 19 nt, Human
uauaucuaaaucuguccaa

SEQ ID NO: 1995451 - RNA, 16 nt, Human
acacucauugaccuga

SEQ ID NO: 1995452 - RNA, 17 nt, Human
uauagguccuuuagaaa

SEQ ID NO: 1995453 - RNA, 15 nt, Human
uauauagcauuuaug

SEQ ID NO: 1995454 - RNA, 18 nt, Human
uauauagcauuuauggua

SEQ ID NO: 1995455 - RNA, 12 nt, Human
uauaggaauuga

SEQ ID NO: 1995456 - RNA, 23 nt, Human
uauaggaacuuaaauaaugugaa

SEQ ID NO: 1995457 - RNA, 13 nt, Human
uauagcuuuauuu

SEQ ID NO: 1995458 - RNA, 15 nt, Human
uauaggcaccuacca

SEQ ID NO: 1995459 - RNA, 18 nt, Human
uauagccuaggugacaga

SEQ ID NO: 1995460 - RNA, 15 nt, Human
uauagcaucacuuaa

SEQ ID NO: 1995461 - RNA, 16 nt, Human
uauagcaucacuuaaa

SEQ ID NO: 1995462 - RNA, 17 nt, Human
uauagcaucacuuaaaa

SEQ ID NO: 1995463 - RNA, 18 nt, Human
uauagcaucacuuaaaac

SEQ ID NO: 1995464 - RNA, 14 nt, Human
uauagcaucacuua

SEQ ID NO: 1995465 - RNA, 15 nt, Human
uauagauuaaaucau

SEQ ID NO: 1995466 - RNA, 20 nt, Human
uaugaaaacauggaacagug

SEQ ID NO: 1995467 - RNA, 21 nt, Human
uaugaaaacauggaacagugu

SEQ ID NO: 1995468 - RNA, 13 nt, Human
uaugaaaacaugg

SEQ ID NO: 1995469 - RNA, 18 nt, Human
uaugaaaacauggaacag

SEQ ID NO: 1995470 - RNA, 21 nt, Human
acagcccgauccuccccugga

SEQ ID NO: 1995471 - RNA, 23 nt, Human
acagcccgauccuccccuggacu

SEQ ID NO: 1995472 - RNA, 14 nt, Human
uaugaggcauuugu

SEQ ID NO: 1995473 - RNA, 15 nt, Human
uaugaggcauuuguu

SEQ ID NO: 1995474 - RNA, 21 nt, Human
uaugaggcauuuguuugaacu

SEQ ID NO: 1995475 - RNA, 23 nt, Human
uaugaggcauuuguuugaacuga

SEQ ID NO: 1995476 - RNA, 23 nt, Human
uaugaagcuuuuaugugaaacau

SEQ ID NO: 1995477 - RNA, 22 nt, Human
uaugaagcuuuuaugugaaaca

SEQ ID NO: 1995478 - RNA, 20 nt, Human
uaugaagcuuuuaugugaaa

SEQ ID NO: 1995479 - RNA, 16 nt, Human
acagcccgggcucugc

SEQ ID NO: 1995480 - RNA, 23 nt, Human
acagcccuccaucuaaacugccc

SEQ ID NO: 1995481 - RNA, 16 nt, Human
acagccccucccuccu

SEQ ID NO: 1995482 - RNA, 18 nt, Human
acagccccucccuccucu

SEQ ID NO: 1995483 - RNA, 19 nt, Human
acagccccucccuccucug

SEQ ID NO: 1995484 - RNA, 16 nt, Human
acagcccgauccuccc

SEQ ID NO: 1995485 - RNA, 15 nt, Human
acagcccgggcucug

SEQ ID NO: 1995486 - RNA, 14 nt, Human
acagccccuccucc

SEQ ID NO: 1995487 - RNA, 16 nt, Human
acagccccuccuccau

SEQ ID NO: 1995488 - RNA, 19 nt, Human
acagcacgggggccaagga

SEQ ID NO: 1995489 - RNA, 17 nt, Human
acagcagccccugcaca

SEQ ID NO: 1995490 - RNA, 14 nt, Human
acagcacuggggag

SEQ ID NO: 1995491 - RNA, 16 nt, Human
acagcaagugugaaua

SEQ ID NO: 1995492 - RNA, 15 nt, Human
acagcaagugugaau

SEQ ID NO: 1995493 - RNA, 22 nt, Human
acagauuugagcucagcccugg

SEQ ID NO: 1995494 - RNA, 14 nt, Human
acagauuuggaaag

SEQ ID NO: 1995495 - RNA, 15 nt, Human
acagauuuggaaaga

SEQ ID NO: 1995496 - RNA, 21 nt, Human
acagauuuggaaagacuggac

SEQ ID NO: 1995497 - RNA, 22 nt, Human
uaugcaugaaguaauaugcaca

SEQ ID NO: 1995498 - RNA, 17 nt, Human
uaugauacuugaaaauu

SEQ ID NO: 1995499 - RNA, 24 nt, Human
uaugauagguuauuuugauguaaa

SEQ ID NO: 1995500 - RNA, 13 nt, Human
uauggucuaaugu

SEQ ID NO: 1995501 - RNA, 16 nt, Human
uauggucuaauguuua

SEQ ID NO: 1995502 - RNA, 17 nt, Human
uauggucuaauguuuaa

SEQ ID NO: 1995503 - RNA, 23 nt, Human
uauggucuaauguuuaagcagaa

SEQ ID NO: 1995504 - RNA, 18 nt, Human
acagcggcuggacuugga

SEQ ID NO: 1995505 - RNA, 19 nt, Human
acagcggcuggacuuggag

SEQ ID NO: 1995506 - RNA, 22 nt, Human
acagcuaaucagcauucucacu

SEQ ID NO: 1995507 - RNA, 22 nt, Human
uauggccaggaaguagcacagg

SEQ ID NO: 1995508 - RNA, 20 nt, Human
uauggcccuggccuagcaua

SEQ ID NO: 1995509 - RNA, 21 nt, Human
uauggcccuggccuagcauac

SEQ ID NO: 1995510 - RNA, 22 nt, Human
uauggcccuggccuagcauacg

SEQ ID NO: 1995511 - RNA, 16 nt, Human
uaugggacucaaugca

SEQ ID NO: 1995512 - RNA, 23 nt, Human
uaugggacucaaugcacugacau

SEQ ID NO: 1995513 - RNA, 21 nt, Human
uaugguaggaacugcugggcu

SEQ ID NO: 1995514 - RNA, 10 nt, Human
uaugggagag

SEQ ID NO: 1995515 - RNA, 14 nt, Human
uaugggagaaauag

SEQ ID NO: 1995516 - RNA, 23 nt, Human
uauggccaggaaguagcacaggc

SEQ ID NO: 1995517 - RNA, 23 nt, Human
acagcuugaccgugaggccagag

SEQ ID NO: 1995518 - RNA, 22 nt, Human
acagcuugaccgugaggccaga

SEQ ID NO: 1995519 - RNA, 18 nt, Human
acaggaaaagcugcugac

SEQ ID NO: 1995520 - RNA, 19 nt, Human
acaggaaaagcugcugaca

SEQ ID NO: 1995521 - RNA, 20 nt, Human
acaggaaaagcugcugacag

SEQ ID NO: 1995522 - RNA, 21 nt, Human
acaggaaaagcugcugacagu

SEQ ID NO: 1995523 - RNA, 21 nt, Human
acagcuugaccgugaggccag

SEQ ID NO: 1995524 - RNA, 20 nt, Human
acagcuugaccgugaggcca

SEQ ID NO: 1995525 - RNA, 17 nt, Human
acagcuugaccgugagg

SEQ ID NO: 1995526 - RNA, 17 nt, Human
acagcuucauuuccugu

SEQ ID NO: 1995527 - RNA, 19 nt, Human
acagcuucauuuccugugu

SEQ ID NO: 1995528 - RNA, 21 nt, Human
acagcuucauuuccugugucu

SEQ ID NO: 1995529 - RNA, 14 nt, Human
acagcuaugcaaaa

SEQ ID NO: 1995530 - RNA, 21 nt, Human
acagcuaugcaaaaagcuagu

SEQ ID NO: 1995531 - RNA, 15 nt, Human
acagcuaaugggaca

SEQ ID NO: 1995532 - RNA, 16 nt, Human
acagcuaaugggacac

SEQ ID NO: 1995533 - RNA, 17 nt, Human
acagcuaaugggacacu

SEQ ID NO: 1995534 - RNA, 19 nt, Human
acagcuaaugggacacuaa

SEQ ID NO: 1995535 - RNA, 13 nt, Human
acagcuguugacu

SEQ ID NO: 1995536 - RNA, 14 nt, Human
acagcuguugacuc

SEQ ID NO: 1995537 - RNA, 15 nt, Human
acagcuguugacucu

SEQ ID NO: 1995538 - RNA, 12 nt, Human
acagcuuagaau

SEQ ID NO: 1995539 - RNA, 16 nt, Human
acaggcgaaagaaaac

SEQ ID NO: 1995540 - RNA, 20 nt, Human
uaugucgucgagcucccccc

SEQ ID NO: 1995541 - RNA, 21 nt, Human
uaugugauuuuuuuucccauu

SEQ ID NO: 1995542 - RNA, 20 nt, Human
uaugugcacaucuguuuugu

SEQ ID NO: 1995543 - RNA, 22 nt, Human
uaugugauuuuuuuucccauuu

SEQ ID NO: 1995544 - RNA, 22 nt, Human
acaggcccuccucccucccagc

SEQ ID NO: 1995545 - RNA, 23 nt, Human
acaggcccuccucccucccagcu

SEQ ID NO: 1995546 - RNA, 13 nt, Human
acaggcccuuccu

SEQ ID NO: 1995547 - RNA, 15 nt, Human
acaggcccuuccucu

SEQ ID NO: 1995548 - RNA, 22 nt, Human
acaggcccuuccucuccacugc

SEQ ID NO: 1995549 - RNA, 18 nt, Human
acaggcccggcuccaggc

SEQ ID NO: 1995550 - RNA, 20 nt, Human
acaggcccggcuccaggcuc

SEQ ID NO: 1995551 - RNA, 21 nt, Human
acaggcccggcuccaggcucc

SEQ ID NO: 1995552 - RNA, 22 nt, Human
acaggcccggcuccaggcuccu

SEQ ID NO: 1995553 - RNA, 16 nt, Human
acaggcccggcuccag

SEQ ID NO: 1995554 - RNA, 17 nt, Human
acaggcccggcuccagg

SEQ ID NO: 1995555 - RNA, 18 nt, Human
acaggcagggcaggacca

SEQ ID NO: 1995556 - RNA, 21 nt, Human
acaggcagggcaggaccagcc

SEQ ID NO: 1995557 - RNA, 22 nt, Human
acaggcagggcaggaccagccc

SEQ ID NO: 1995558 - RNA, 23 nt, Human
acaggcagggcaggaccagccca

SEQ ID NO: 1995559 - RNA, 12 nt, Human
acaggcagggca

SEQ ID NO: 1995560 - RNA, 13 nt, Human
acaggcagggcag

SEQ ID NO: 1995561 - RNA, 20 nt, Human
acaggaaaauuuuaaaaaua

SEQ ID NO: 1995562 - RNA, 15 nt, Human
acaggcagauacagg

SEQ ID NO: 1995563 - RNA, 19 nt, Human
acaggagaugcugugcccc

SEQ ID NO: 1995564 - RNA, 14 nt, Human
acaggagaugcugu

SEQ ID NO: 1995565 - RNA, 18 nt, Human
acaggagaugcugugccc

SEQ ID NO: 1995566 - RNA, 17 nt, Human
acaggagaagaaagaac

SEQ ID NO: 1995567 - RNA, 16 nt, Human
acaggacucugccucc

SEQ ID NO: 1995568 - RNA, 15 nt, Human
acaggacucugccuc

SEQ ID NO: 1995569 - RNA, 11 nt, Human
aauucaguugu

SEQ ID NO: 1995570 - RNA, 23 nt, Human
aauucagugaugugccuaaauaa

SEQ ID NO: 1995571 - RNA, 22 nt, Human
aauucaguuguuagugugucuu

SEQ ID NO: 1995572 - RNA, 17 nt, Human
aauucaguuguuagugu

SEQ ID NO: 1995573 - RNA, 15 nt, Human
aauucaauaguaaua

SEQ ID NO: 1995574 - RNA, 16 nt, Human
aauucaauaguaauau

SEQ ID NO: 1995575 - RNA, 18 nt, Human
aauucaauaguaauauaa

SEQ ID NO: 1995576 - RNA, 20 nt, Human
aauucaauaguaauauaaua

SEQ ID NO: 1995577 - RNA, 15 nt, Human
aauuauuuuaaaaga

SEQ ID NO: 1995578 - RNA, 12 nt, Human
aauuauuuuaaa

SEQ ID NO: 1995579 - RNA, 12 nt, Human
aauuauuugaau

SEQ ID NO: 1995580 - RNA, 14 nt, Human
aauuauuugaauga

SEQ ID NO: 1995581 - RNA, 22 nt, Human
aauuauuuauuaaaugcccagc

SEQ ID NO: 1995582 - RNA, 18 nt, Human
aauuagaacccuugcaca

SEQ ID NO: 1995583 - RNA, 22 nt, Human
aauuaugugccagauuuaugca

SEQ ID NO: 1995584 - RNA, 21 nt, Human
aauuauuuauuaaaugcccag

SEQ ID NO: 1995585 - RNA, 17 nt, Human
aauuauugauugcuuuu

SEQ ID NO: 1995586 - RNA, 19 nt, Human
aauuauguugaaaagagua

SEQ ID NO: 1995587 - RNA, 22 nt, Human
aauuauguuugccacuuugcaa

SEQ ID NO: 1995588 - RNA, 14 nt, Human
uaccuguuuaaauu

SEQ ID NO: 1995589 - RNA, 13 nt, Human
uaccuguuuaaau

SEQ ID NO: 1995590 - RNA, 16 nt, Human
uaccugccaggaagcc

SEQ ID NO: 1995591 - RNA, 17 nt, Human
uaccugaguugaagagg

SEQ ID NO: 1995592 - RNA, 16 nt, Human
uaccugaggggccucu

SEQ ID NO: 1995593 - RNA, 16 nt, Human
uaccugaguugaagag

SEQ ID NO: 1995594 - RNA, 20 nt, Human
aauuacaggaaguacuggag

SEQ ID NO: 1995595 - RNA, 19 nt, Human
aauuacaggaaguacugga

SEQ ID NO: 1995596 - RNA, 17 nt, Human
aauuacaggaaguacug

SEQ ID NO: 1995597 - RNA, 12 nt, Human
uaccuuaaaauu

SEQ ID NO: 1995598 - RNA, 15 nt, Human
uaccuuaaaauuuga

SEQ ID NO: 1995599 - RNA, 16 nt, Human
uaccuuaaaauuugaa

SEQ ID NO: 1995600 - RNA, 17 nt, Human
uaccuuaaaauuugaaa

SEQ ID NO: 1995601 - RNA, 18 nt, Human
uaccuuaaaauuugaaac

SEQ ID NO: 1995602 - RNA, 20 nt, Human
uaccuuaaaauuugaaacau

SEQ ID NO: 1995603 - RNA, 21 nt, Human
uaccuuaaaauuugaaacauu

SEQ ID NO: 1995604 - RNA, 22 nt, Human
uaccuuaaaauuugaaacauug

SEQ ID NO: 1995605 - RNA, 12 nt, Human
aauuacauuugu

SEQ ID NO: 1995606 - RNA, 15 nt, Human
aauuacauuuguaau

SEQ ID NO: 1995607 - RNA, 17 nt, Human
aauuacauuuguaauuu

SEQ ID NO: 1995608 - RNA, 18 nt, Human
aauuacauuuguaauuua

SEQ ID NO: 1995609 - RNA, 19 nt, Human
aauuacauuuguaauuuaa

SEQ ID NO: 1995610 - RNA, 21 nt, Human
uaccuuaaauuaguacagcac

SEQ ID NO: 1995611 - RNA, 19 nt, Human
aauuacagugccuaaaaua

SEQ ID NO: 1995612 - RNA, 23 nt, Human
aauuacagugccuaaaauaagaa

SEQ ID NO: 1995613 - RNA, 11 nt, Human
aauuacaguuu

SEQ ID NO: 1995614 - RNA, 14 nt, Human
uaccugaagucuuu

SEQ ID NO: 1995615 - RNA, 13 nt, Human
uaccugaagucuu

SEQ ID NO: 1995616 - RNA, 23 nt, Human
uaccugaagcuaucguaaaauua

SEQ ID NO: 1995617 - RNA, 15 nt, Human
uaccugaggggccuc

SEQ ID NO: 1995618 - RNA, 13 nt, Human
uaccugaggggcc

SEQ ID NO: 1995619 - RNA, 16 nt, Human
uaccugaagucuuugu

SEQ ID NO: 1995620 - RNA, 21 nt, Human
uaccugaagggguuuucuuga

SEQ ID NO: 1995621 - RNA, 18 nt, Human
uaccugaagggguuuucu

SEQ ID NO: 1995622 - RNA, 19 nt, Human
uaccugaagggguuuucuu

SEQ ID NO: 1995623 - RNA, 22 nt, Human
uaccucuugagccuugaacuuu

SEQ ID NO: 1995624 - RNA, 23 nt, Human
uacccuauaucuauaaacacugu

SEQ ID NO: 1995625 - RNA, 13 nt, Human
uaccucuuggcug

SEQ ID NO: 1995626 - RNA, 14 nt, Human
uaccucuuuggaaa

SEQ ID NO: 1995627 - RNA, 15 nt, Human
uaccucuuuggaaaa

SEQ ID NO: 1995628 - RNA, 23 nt, Human
uaccucuugagccuugaacuuug

SEQ ID NO: 1995629 - RNA, 23 nt, Human
uacccgggaagggggcugggaca

SEQ ID NO: 1995630 - RNA, 13 nt, Human
uacccuauaucua

SEQ ID NO: 1995631 - RNA, 16 nt, Human
uacccuauaucuauaa

SEQ ID NO: 1995632 - RNA, 14 nt, Human
aauguuauguauau

SEQ ID NO: 1995633 - RNA, 13 nt, Human
aauguucaucaau

SEQ ID NO: 1995634 - RNA, 17 nt, Human
aauguuaguuaguguag

SEQ ID NO: 1995635 - RNA, 13 nt, Human
aauguuauaaagu

SEQ ID NO: 1995636 - RNA, 21 nt, Human
aaugugcugaaugguuuucaa

SEQ ID NO: 1995637 - RNA, 17 nt, Human
uacagggaugguguuca

SEQ ID NO: 1995638 - RNA, 15 nt, Human
uacagagaugucucu

SEQ ID NO: 1995639 - RNA, 16 nt, Human
uacagagaugucucuu

SEQ ID NO: 1995640 - RNA, 22 nt, Human
uacagagaugucucuuauaucu

SEQ ID NO: 1995641 - RNA, 16 nt, Human
aauguucaucaaugaa

SEQ ID NO: 1995642 - RNA, 20 nt, Human
aauguucaucaaugaaugaa

SEQ ID NO: 1995643 - RNA, 19 nt, Human
aauguucauacugaugugu

SEQ ID NO: 1995644 - RNA, 21 nt, Human
aauguuccugccuccuugaua

SEQ ID NO: 1995645 - RNA, 20 nt, Human
aauguuggcagaugcagcuc

SEQ ID NO: 1995646 - RNA, 23 nt, Human
aauguuggcagaugcagcucuuc

SEQ ID NO: 1995647 - RNA, 17 nt, Human
aauuaaguacuauguau

SEQ ID NO: 1995648 - RNA, 16 nt, Human
aauuaaguacuaugua

SEQ ID NO: 1995649 - RNA, 15 nt, Human
aauuaacuuuuauaa

SEQ ID NO: 1995650 - RNA, 16 nt, Human
aauuaacuuuuauaaa

SEQ ID NO: 1995651 - RNA, 12 nt, Human
aauuaacuuuua

SEQ ID NO: 1995652 - RNA, 13 nt, Human
aauuaacuuuuau

SEQ ID NO: 1995653 - RNA, 20 nt, Human
aauguugugaauaauuacag

SEQ ID NO: 1995654 - RNA, 21 nt, Human
aauguugugaauaauuacagu

SEQ ID NO: 1995655 - RNA, 12 nt, Human
aauguugugaau

SEQ ID NO: 1995656 - RNA, 13 nt, Human
aauguugugaaua

SEQ ID NO: 1995657 - RNA, 17 nt, Human
aauguugugaauaauua

SEQ ID NO: 1995658 - RNA, 18 nt, Human
aauguugugaauaauuac

SEQ ID NO: 1995659 - RNA, 13 nt, Human
uaccauuaaaaua

SEQ ID NO: 1995660 - RNA, 14 nt, Human
uaccauuaaaauau

SEQ ID NO: 1995661 - RNA, 21 nt, Human
uaccauuaaaauaugcacuaa

SEQ ID NO: 1995662 - RNA, 15 nt, Human
uaccauuaaaauaug

SEQ ID NO: 1995663 - RNA, 17 nt, Human
uaccauuaaaauaugca

SEQ ID NO: 1995664 - RNA, 15 nt, Human
uacccccugcaaagc

SEQ ID NO: 1995665 - RNA, 19 nt, Human
uacccccugcaaagcccag

SEQ ID NO: 1995666 - RNA, 23 nt, Human
uacccccugcaaagcccagcuug

SEQ ID NO: 1995667 - RNA, 19 nt, Human
uaccagggacugaggggag

SEQ ID NO: 1995668 - RNA, 12 nt, Human
uaccagcagagc

SEQ ID NO: 1995669 - RNA, 22 nt, Human
uacauuuccgccacaucccucu

SEQ ID NO: 1995670 - RNA, 14 nt, Human
uacauuucgauguu

SEQ ID NO: 1995671 - RNA, 19 nt, Human
uacauuucuaagucaaaca

SEQ ID NO: 1995672 - RNA, 14 nt, Human
uaccagcagagcac

SEQ ID NO: 1995673 - RNA, 13 nt, Human
uaccagcagagca

SEQ ID NO: 1995674 - RNA, 22 nt, Human
uaccagcagagcaccuuagaca

SEQ ID NO: 1995675 - RNA, 18 nt, Human
uaccagccaguaaauggg

SEQ ID NO: 1995676 - RNA, 12 nt, Human
uacauucuguua

SEQ ID NO: 1995677 - RNA, 15 nt, Human
uacauucucaguuuu

SEQ ID NO: 1995678 - RNA, 17 nt, Human
uacauucucaguuuuuc

SEQ ID NO: 1995679 - RNA, 20 nt, Human
uacauucucaguuuuucuua

SEQ ID NO: 1995680 - RNA, 21 nt, Human
uacauucucaguuuuucuuaa

SEQ ID NO: 1995681 - RNA, 22 nt, Human
aauuaaguccuacuuuuaaaga

SEQ ID NO: 1995682 - RNA, 13 nt, Human
uacauuuccuaaa

SEQ ID NO: 1995683 - RNA, 20 nt, Human
uaauuuaggaguuuugagaa

SEQ ID NO: 1995684 - RNA, 23 nt, Human
uaauuuaaggucuguuugcuguu

SEQ ID NO: 1995685 - RNA, 21 nt, Human
uaauuuaaggucuguuugcug

SEQ ID NO: 1995686 - RNA, 22 nt, Human
uaauuuaaggucuguuugcugu

SEQ ID NO: 1995687 - RNA, 18 nt, Human
uaauuuaaggucuguuug

SEQ ID NO: 1995688 - RNA, 19 nt, Human
uaauuuaaaauugugaugu

SEQ ID NO: 1995689 - RNA, 20 nt, Human
uaauuuaaaauugugaugug

SEQ ID NO: 1995690 - RNA, 22 nt, Human
uaauuccguagguuauuuucag

SEQ ID NO: 1995691 - RNA, 16 nt, Human
uaauuauugauguuuu

SEQ ID NO: 1995692 - RNA, 22 nt, Human
uaauuauuauucagaaaugacu

SEQ ID NO: 1995693 - RNA, 16 nt, Human
aaugauuucauucaau

SEQ ID NO: 1995694 - RNA, 11 nt, Human
aaugcaaacca

SEQ ID NO: 1995695 - RNA, 12 nt, Human
aaugcaaaccau

SEQ ID NO: 1995696 - RNA, 14 nt, Human
aaugcaaaaaaucu

SEQ ID NO: 1995697 - RNA, 14 nt, Human
aaugcaaaccauca

SEQ ID NO: 1995698 - RNA, 20 nt, Human
aaugcaaaacacaaaacaaa

SEQ ID NO: 1995699 - RNA, 13 nt, Human
aaugcaccuggaa

SEQ ID NO: 1995700 - RNA, 18 nt, Human
aaugcacugggaaaaagu

SEQ ID NO: 1995701 - RNA, 21 nt, Human
aaugaguuucacagugugauu

SEQ ID NO: 1995702 - RNA, 14 nt, Human
aaugaguuucuuag

SEQ ID NO: 1995703 - RNA, 19 nt, Human
aaugaguuucuuagacuuu

SEQ ID NO: 1995704 - RNA, 18 nt, Human
aaugaguccaaacuggaa

SEQ ID NO: 1995705 - RNA, 12 nt, Human
aaugauucaaaa

SEQ ID NO: 1995706 - RNA, 17 nt, Human
aaugauucaaaaaguca

SEQ ID NO: 1995707 - RNA, 22 nt, Human
aaugaguuucuuagacuuuucc

SEQ ID NO: 1995708 - RNA, 24 nt, Human
aaugauuucagcucacugcaaccu

SEQ ID NO: 1995709 - RNA, 13 nt, Human
aaugauuguuuaa

SEQ ID NO: 1995710 - RNA, 14 nt, Human
aaugauuguuuaaa

SEQ ID NO: 1995711 - RNA, 18 nt, Human
aaugauuguuuaaagguu

SEQ ID NO: 1995712 - RNA, 22 nt, Human
aaugauugcuuuuaaaauuuua

SEQ ID NO: 1995713 - RNA, 21 nt, Human
aaugauucaaaaagucacagu

SEQ ID NO: 1995714 - RNA, 13 nt, Human
aaugauugaaaau

SEQ ID NO: 1995715 - RNA, 20 nt, Human
aaugauugaaaauaaugcug

SEQ ID NO: 1995716 - RNA, 12 nt, Human
aaugauugcuuu

SEQ ID NO: 1995717 - RNA, 15 nt, Human
aaugauugcuuuuaa

SEQ ID NO: 1995718 - RNA, 16 nt, Human
aaugauugcuuuuaaa

SEQ ID NO: 1995719 - RNA, 19 nt, Human
aaugauugcuuuuaaaauu

SEQ ID NO: 1995720 - RNA, 20 nt, Human
aaugauugcuuuuaaaauuu

SEQ ID NO: 1995721 - RNA, 13 nt, Human
aaugagccuggca

SEQ ID NO: 1995722 - RNA, 12 nt, Human
aaugagccuggc

SEQ ID NO: 1995723 - RNA, 14 nt, Human
aaugagccuggcaa

SEQ ID NO: 1995724 - RNA, 16 nt, Human
aaugaggucagagccu

SEQ ID NO: 1995725 - RNA, 18 nt, Human
aaugaggucagagccugc

SEQ ID NO: 1995726 - RNA, 20 nt, Human
aaugaccuuucaauaggaaa

SEQ ID NO: 1995727 - RNA, 21 nt, Human
aaugaccuuucaauaggaaaa

SEQ ID NO: 1995728 - RNA, 22 nt, Human
aaugacuaagaggaaaguacau

SEQ ID NO: 1995729 - RNA, 13 nt, Human
aaugacuuuauua

SEQ ID NO: 1995730 - RNA, 14 nt, Human
aaugacuuuauuau

SEQ ID NO: 1995731 - RNA, 15 nt, Human
aaugacuuuauuauu

SEQ ID NO: 1995732 - RNA, 17 nt, Human
aaugacuuuauuauuua

SEQ ID NO: 1995733 - RNA, 19 nt, Human
aaugacuuccccaauaucu

SEQ ID NO: 1995734 - RNA, 21 nt, Human
aaugacuuccccaauaucuug

SEQ ID NO: 1995735 - RNA, 11 nt, Human
aaugacuuuau

SEQ ID NO: 1995736 - RNA, 18 nt, Human
aaugagcaauaucugcua

SEQ ID NO: 1995737 - RNA, 11 nt, Human
aaugagccugg

SEQ ID NO: 1995738 - RNA, 18 nt, Human
aaugagcagcuuuagcaa

SEQ ID NO: 1995739 - RNA, 22 nt, Human
aaugagaaaucuaaaaaacgaa

SEQ ID NO: 1995740 - RNA, 12 nt, Human
aaugagaaaucu

SEQ ID NO: 1995741 - RNA, 21 nt, Human
aauggaguuggaguucauuca

SEQ ID NO: 1995742 - RNA, 13 nt, Human
aauggaguuggag

SEQ ID NO: 1995743 - RNA, 19 nt, Human
aauggaguuggaguucauu

SEQ ID NO: 1995744 - RNA, 20 nt, Human
aauggaguuaaacuuuagug

SEQ ID NO: 1995745 - RNA, 16 nt, Human
aauggaagacagcucu

SEQ ID NO: 1995746 - RNA, 18 nt, Human
aauggaagacagcucuua

SEQ ID NO: 1995747 - RNA, 14 nt, Human
aaugguuuucaaaa

SEQ ID NO: 1995748 - RNA, 12 nt, Human
aauggaugaaau

SEQ ID NO: 1995749 - RNA, 13 nt, Human
aauggaugaaauc

SEQ ID NO: 1995750 - RNA, 22 nt, Human
aauguaaagcaaccaaaaagaa

SEQ ID NO: 1995751 - RNA, 16 nt, Human
aaugguuuucuugugu

SEQ ID NO: 1995752 - RNA, 16 nt, Human
aaugguuuucaaaaua

SEQ ID NO: 1995753 - RNA, 12 nt, Human
aauguaaauaaa

SEQ ID NO: 1995754 - RNA, 19 nt, Human
aauguaaaggucacuuuuc

SEQ ID NO: 1995755 - RNA, 17 nt, Human
aauguaagguauaucau

SEQ ID NO: 1995756 - RNA, 23 nt, Human
aauguaagguauaucauucuaaa

SEQ ID NO: 1995757 - RNA, 17 nt, Human
uacagagacagaaagca

SEQ ID NO: 1995758 - RNA, 19 nt, Human
uacagacaaagcguggugg

SEQ ID NO: 1995759 - RNA, 22 nt, Human
uacagagcccacgcccccacug

SEQ ID NO: 1995760 - RNA, 19 nt, Human
uacagagcccacgccccca

SEQ ID NO: 1995761 - RNA, 23 nt, Human
uacagagcagacaguuaagagaa

SEQ ID NO: 1995762 - RNA, 15 nt, Human
uacagacaaagcgug

SEQ ID NO: 1995763 - RNA, 14 nt, Human
uacagacaaagcgu

SEQ ID NO: 1995764 - RNA, 13 nt, Human
uacagacaaagcg

SEQ ID NO: 1995765 - RNA, 15 nt, Human
uacaccgggccugga

SEQ ID NO: 1995766 - RNA, 17 nt, Human
uacaccgggccuggaga

SEQ ID NO: 1995767 - RNA, 21 nt, Human
aauguaauugauuguauauag

SEQ ID NO: 1995768 - RNA, 19 nt, Human
uacacccaugaaagaaaac

SEQ ID NO: 1995769 - RNA, 20 nt, Human
uacaaugugacuuugaaaau

SEQ ID NO: 1995770 - RNA, 13 nt, Human
uacaaugcugugc

SEQ ID NO: 1995771 - RNA, 14 nt, Human
uacaaugcugugcc

SEQ ID NO: 1995772 - RNA, 16 nt, Human
uacaaugugacuuuga

SEQ ID NO: 1995773 - RNA, 17 nt, Human
uacaaugugacuuugaa

SEQ ID NO: 1995774 - RNA, 14 nt, Human
uacaaugacuuuau

SEQ ID NO: 1995775 - RNA, 18 nt, Human
uacaaugacuuuauugca

SEQ ID NO: 1995776 - RNA, 16 nt, Human
uacaaugcugugcccu

SEQ ID NO: 1995777 - RNA, 15 nt, Human
uaauuuuucuguaua

SEQ ID NO: 1995778 - RNA, 15 nt, Human
uaauuuuuguauuuu

SEQ ID NO: 1995779 - RNA, 12 nt, Human
uaauuuuucugu

SEQ ID NO: 1995780 - RNA, 14 nt, Human
uaauuuuucuguau

SEQ ID NO: 1995781 - RNA, 11 nt, Human
uaauuuuuccu

SEQ ID NO: 1995782 - RNA, 21 nt, Human
uacaaaaaaaaaaaaaaauua

SEQ ID NO: 1995783 - RNA, 22 nt, Human
uaauuuuuuuuuuccuuuuaaa

SEQ ID NO: 1995784 - RNA, 13 nt, Human
uacaaugacuuua

SEQ ID NO: 1995785 - RNA, 18 nt, Human
uaauuuuuuugagacaga

SEQ ID NO: 1995786 - RNA, 14 nt, Human
aaugcaucuuugau

SEQ ID NO: 1995787 - RNA, 15 nt, Human
aaugcaucuuugaug

SEQ ID NO: 1995788 - RNA, 18 nt, Human
aaugcaucuuugaugugu

SEQ ID NO: 1995789 - RNA, 19 nt, Human
aaugcaucuuugauguguu

SEQ ID NO: 1995790 - RNA, 20 nt, Human
aaugcaucuuugauguguug

SEQ ID NO: 1995791 - RNA, 13 nt, Human
aaugcaugcuuuc

SEQ ID NO: 1995792 - RNA, 16 nt, Human
aaugcaugcuuuccau

SEQ ID NO: 1995793 - RNA, 18 nt, Human
aaugcaugcuuuccauau

SEQ ID NO: 1995794 - RNA, 21 nt, Human
aaugcuggcuguuggcugggg

SEQ ID NO: 1995795 - RNA, 22 nt, Human
aaugcuggcuguuggcuggggg

SEQ ID NO: 1995796 - RNA, 20 nt, Human
aaugcaugcuuuccauauuu

SEQ ID NO: 1995797 - RNA, 13 nt, Human
aauggaagacagc

SEQ ID NO: 1995798 - RNA, 21 nt, Human
aaucgcuuuccuaaaacagua

SEQ ID NO: 1995799 - RNA, 15 nt, Human
aaucgggguauaaua

SEQ ID NO: 1995800 - RNA, 19 nt, Human
aaucgggguauaauaggcu

SEQ ID NO: 1995801 - RNA, 16 nt, Human
aaucuauagaaagugu

SEQ ID NO: 1995802 - RNA, 17 nt, Human
aaucuauagaaaguguu

SEQ ID NO: 1995803 - RNA, 18 nt, Human
aaucuauagaaaguguuc

SEQ ID NO: 1995804 - RNA, 23 nt, Human
aaucuauagaaaguguucuguua

SEQ ID NO: 1995805 - RNA, 20 nt, Human
aaucccuguguuaauuuaag

SEQ ID NO: 1995806 - RNA, 15 nt, Human
aaucuaugauuccag

SEQ ID NO: 1995807 - RNA, 18 nt, Human
aaucuaugauuccaggug

SEQ ID NO: 1995808 - RNA, 13 nt, Human
aaucucaaauaac

SEQ ID NO: 1995809 - RNA, 18 nt, Human
aaucugggccagaauuuc

SEQ ID NO: 1995810 - RNA, 20 nt, Human
aauccucaguuuuugugaaa

SEQ ID NO: 1995811 - RNA, 18 nt, Human
aaucccuguguuaauuua

SEQ ID NO: 1995812 - RNA, 19 nt, Human
aaucccuguguuaauuuaa

SEQ ID NO: 1995813 - RNA, 13 nt, Human
aaucccugcucac

SEQ ID NO: 1995814 - RNA, 18 nt, Human
aaucccugcucacugcag

SEQ ID NO: 1995815 - RNA, 17 nt, Human
aaucccauuuaaaaaaa

SEQ ID NO: 1995816 - RNA, 12 nt, Human
aaucccaggaug

SEQ ID NO: 1995817 - RNA, 13 nt, Human
aaucccagcgcac

SEQ ID NO: 1995818 - RNA, 21 nt, Human
uaaguauucuuauuuaaugaa

SEQ ID NO: 1995819 - RNA, 17 nt, Human
uaaguuaguuccacuga

SEQ ID NO: 1995820 - RNA, 19 nt, Human
uaaguuaguuccacugaga

SEQ ID NO: 1995821 - RNA, 17 nt, Human
uaaguguguguuuuuca

SEQ ID NO: 1995822 - RNA, 20 nt, Human
uaaguuaguuccacugagac

SEQ ID NO: 1995823 - RNA, 21 nt, Human
uaaggauacaggcuggaaagu

SEQ ID NO: 1995824 - RNA, 16 nt, Human
uaaggauacaggcugg

SEQ ID NO: 1995825 - RNA, 17 nt, Human
uaaggauacaggcugga

SEQ ID NO: 1995826 - RNA, 17 nt, Human
uaaggagaaucauguuu

SEQ ID NO: 1995827 - RNA, 20 nt, Human
uaaggagaaucauguuucuu

SEQ ID NO: 1995828 - RNA, 22 nt, Human
uaaggagaaucauguuucuuug

SEQ ID NO: 1995829 - RNA, 21 nt, Human
uaagcuauucaguaauaacuc

SEQ ID NO: 1995830 - RNA, 16 nt, Human
uaagcaggcgcaaggg

SEQ ID NO: 1995831 - RNA, 18 nt, Human
uaagcaggcgcaagggag

SEQ ID NO: 1995832 - RNA, 15 nt, Human
uaagcaaaaugugau

SEQ ID NO: 1995833 - RNA, 21 nt, Human
uaagcaaaaugugauauguac

SEQ ID NO: 1995834 - RNA, 14 nt, Human
uaagcaaaauguga

SEQ ID NO: 1995835 - RNA, 14 nt, Human
uaagauucauauuu

SEQ ID NO: 1995836 - RNA, 14 nt, Human
uaagauguuauauu

SEQ ID NO: 1995837 - RNA, 15 nt, Human
uaagauguuauauuu

SEQ ID NO: 1995838 - RNA, 19 nt, Human
uaagauguuauauuuuucu

SEQ ID NO: 1995839 - RNA, 21 nt, Human
uaagauguuauauuuuucuua

SEQ ID NO: 1995840 - RNA, 22 nt, Human
uaagauguuauauuuuucuuaa

SEQ ID NO: 1995841 - RNA, 14 nt, Human
uaagauuauaauug

SEQ ID NO: 1995842 - RNA, 15 nt, Human
uaagauuauaauugu

SEQ ID NO: 1995843 - RNA, 9 nt, Human
uaaggaaua

SEQ ID NO: 1995844 - RNA, 13 nt, Human
uaaggaagacaau

SEQ ID NO: 1995845 - RNA, 15 nt, Human
uaaggaaccuuccuu

SEQ ID NO: 1995846 - RNA, 19 nt, Human
uaaggaaccuuccuuccug

SEQ ID NO: 1995847 - RNA, 18 nt, Human
uaaggaauaccugucccc

SEQ ID NO: 1995848 - RNA, 17 nt, Human
uaaggaauaccuguccc

SEQ ID NO: 1995849 - RNA, 22 nt, Human
uaaggaauuuuauuuuuuucug

SEQ ID NO: 1995850 - RNA, 14 nt, Human
uaaggaauauggga

SEQ ID NO: 1995851 - RNA, 20 nt, Human
uaaggaauaugggagaaaua

SEQ ID NO: 1995852 - RNA, 14 nt, Human
uaaggacugacuga

SEQ ID NO: 1995853 - RNA, 18 nt, Human
uaaggacugacugaggca

SEQ ID NO: 1995854 - RNA, 19 nt, Human
uaaggacugacugaggcag

SEQ ID NO: 1995855 - RNA, 13 nt, Human
uaaggacuuccug

SEQ ID NO: 1995856 - RNA, 14 nt, Human
uaaggacuuccuga

SEQ ID NO: 1995857 - RNA, 13 nt, Human
aauauuuaugaag

SEQ ID NO: 1995858 - RNA, 14 nt, Human
aauauuuaugaaga

SEQ ID NO: 1995859 - RNA, 15 nt, Human
aauauuuaugaagaa

SEQ ID NO: 1995860 - RNA, 18 nt, Human
aauauuuaugaagaaaau

SEQ ID NO: 1995861 - RNA, 22 nt, Human
aauauuuaugaagaaaauacuu

SEQ ID NO: 1995862 - RNA, 12 nt, Human
aauauuuauuaa

SEQ ID NO: 1995863 - RNA, 15 nt, Human
aauauuuauuaaauu

SEQ ID NO: 1995864 - RNA, 15 nt, Human
aauauuuauagguca

SEQ ID NO: 1995865 - RNA, 16 nt, Human
aauauuuauuaaauuu

SEQ ID NO: 1995866 - RNA, 11 nt, Human
aaucagccugc

SEQ ID NO: 1995867 - RNA, 18 nt, Human
aaucagcauucucacucc

SEQ ID NO: 1995868 - RNA, 15 nt, Human
aaucacuguguauau

SEQ ID NO: 1995869 - RNA, 16 nt, Human
aaucacuguguauauu

SEQ ID NO: 1995870 - RNA, 17 nt, Human
aaucacuguguauauuu

SEQ ID NO: 1995871 - RNA, 18 nt, Human
aaucacuguguauauuug

SEQ ID NO: 1995872 - RNA, 19 nt, Human
aaucagcauucucacuccu

SEQ ID NO: 1995873 - RNA, 12 nt, Human
aaucagcauucu

SEQ ID NO: 1995874 - RNA, 12 nt, Human
aaucacucagag

SEQ ID NO: 1995875 - RNA, 15 nt, Human
aaucacucagagcag

SEQ ID NO: 1995876 - RNA, 16 nt, Human
aaucacucagagcagu

SEQ ID NO: 1995877 - RNA, 10 nt, Human
aaucacugug

SEQ ID NO: 1995878 - RNA, 13 nt, Human
aaucacuguguau

SEQ ID NO: 1995879 - RNA, 14 nt, Human
aaucacuguguaua

SEQ ID NO: 1995880 - RNA, 18 nt, Human
aaucagccugcuccagcu

SEQ ID NO: 1995881 - RNA, 13 nt, Human
aaucagccugcuc

SEQ ID NO: 1995882 - RNA, 19 nt, Human
aaucagccugcuccagcug

SEQ ID NO: 1995883 - RNA, 19 nt, Human
aaucacuguguauauuuga

SEQ ID NO: 1995884 - RNA, 21 nt, Human
aaucaguagcuuaagaaaaaa

SEQ ID NO: 1995885 - RNA, 14 nt, Human
aaucaguaaacacu

SEQ ID NO: 1995886 - RNA, 16 nt, Human
aaucaguaaacacugu

SEQ ID NO: 1995887 - RNA, 15 nt, Human
aauagcaauauucuu

SEQ ID NO: 1995888 - RNA, 21 nt, Human
aauagcaaguggcauaaagca

SEQ ID NO: 1995889 - RNA, 19 nt, Human
aauaccugucccccugaca

SEQ ID NO: 1995890 - RNA, 18 nt, Human
aauaccugucccccugac

SEQ ID NO: 1995891 - RNA, 15 nt, Human
aauaccugucccccu

SEQ ID NO: 1995892 - RNA, 13 nt, Human
aauaccaguucug

SEQ ID NO: 1995893 - RNA, 12 nt, Human
aauaccaaggaa

SEQ ID NO: 1995894 - RNA, 14 nt, Human
aauacauuuaaaac

SEQ ID NO: 1995895 - RNA, 17 nt, Human
aauacauuuaaaacauu

SEQ ID NO: 1995896 - RNA, 13 nt, Human
aauacauucuuuu

SEQ ID NO: 1995897 - RNA, 22 nt, Human
aauacauucuuuuugcucuaaa

SEQ ID NO: 1995898 - RNA, 20 nt, Human
aauacauuuaaaacauuaaa

SEQ ID NO: 1995899 - RNA, 21 nt, Human
aauacauuuaaaacauuaaaa

SEQ ID NO: 1995900 - RNA, 22 nt, Human
aauacauuuaaaacauuaaaau

SEQ ID NO: 1995901 - RNA, 23 nt, Human
aauacauuuaaaacauuaaaaua

SEQ ID NO: 1995902 - RNA, 19 nt, Human
aauaccagccaguaaaugg

SEQ ID NO: 1995903 - RNA, 17 nt, Human
aauaccagccaguaaau

SEQ ID NO: 1995904 - RNA, 19 nt, Human
aauacaggauuauuuugau

SEQ ID NO: 1995905 - RNA, 17 nt, Human
aauacaugaugauuuca

SEQ ID NO: 1995906 - RNA, 15 nt, Human
aauacagacuggaug

SEQ ID NO: 1995907 - RNA, 13 nt, Human
aauacagauaaau

SEQ ID NO: 1995908 - RNA, 18 nt, Human
aauacagauaaaugauuc

SEQ ID NO: 1995909 - RNA, 13 nt, Human
aauacagaggcaa

SEQ ID NO: 1995910 - RNA, 17 nt, Human
uaacaaauaacaacuuu

SEQ ID NO: 1995911 - RNA, 22 nt, Human
uaacaaagaaccuaacauuuau

SEQ ID NO: 1995912 - RNA, 21 nt, Human
uaaauuaacuuuuauaaacuu

SEQ ID NO: 1995913 - RNA, 16 nt, Human
uaaauuauguuuuacu

SEQ ID NO: 1995914 - RNA, 17 nt, Human
uaaauuauugaugaaaa

SEQ ID NO: 1995915 - RNA, 16 nt, Human
aagugccuuugcagcu

SEQ ID NO: 1995916 - RNA, 18 nt, Human
aaguguauuuuuuuacua

SEQ ID NO: 1995917 - RNA, 21 nt, Human
aaguguauuuuuuuacuaaua

SEQ ID NO: 1995918 - RNA, 18 nt, Human
uaaaugaaaaucgugaca

SEQ ID NO: 1995919 - RNA, 18 nt, Human
uaaauguuaaagauguag

SEQ ID NO: 1995920 - RNA, 21 nt, Human
uaaauguuaaagauguagcaa

SEQ ID NO: 1995921 - RNA, 22 nt, Human
uaaauguuaaagauguagcaaa

SEQ ID NO: 1995922 - RNA, 18 nt, Human
uaaauguuauagcugcau

SEQ ID NO: 1995923 - RNA, 19 nt, Human
uaaauuaacuuuuauaaac

SEQ ID NO: 1995924 - RNA, 20 nt, Human
uaaauuaacuuuuauaaacu

SEQ ID NO: 1995925 - RNA, 13 nt, Human
uaaaugugguaaa

SEQ ID NO: 1995926 - RNA, 20 nt, Human
uaaaugugugagugcaugua

SEQ ID NO: 1995927 - RNA, 13 nt, Human
uaaauguuaaaga

SEQ ID NO: 1995928 - RNA, 14 nt, Human
uaaauguuaaagau

SEQ ID NO: 1995929 - RNA, 16 nt, Human
uaaauguuaaagaugu

SEQ ID NO: 1995930 - RNA, 17 nt, Human
uaaauguuaaagaugua

SEQ ID NO: 1995931 - RNA, 15 nt, Human
uaagaauuuuuuauu

SEQ ID NO: 1995932 - RNA, 23 nt, Human
uaagaauuuuuuauuuuuuggua

SEQ ID NO: 1995933 - RNA, 23 nt, Human
uaagacaaaaagcuacuuauugu

SEQ ID NO: 1995934 - RNA, 13 nt, Human
uaagaagugaaaa

SEQ ID NO: 1995935 - RNA, 12 nt, Human
uaacuugggagu

SEQ ID NO: 1995936 - RNA, 19 nt, Human
uaacuugggagugugguuu

SEQ ID NO: 1995937 - RNA, 20 nt, Human
uaacuucuaaaacuguacuu

SEQ ID NO: 1995938 - RNA, 23 nt, Human
uaacuucuaaaacuguacuuuga

SEQ ID NO: 1995939 - RNA, 12 nt, Human
uaacuucuaaaa

SEQ ID NO: 1995940 - RNA, 14 nt, Human
uaacuucuaaaacu

SEQ ID NO: 1995941 - RNA, 15 nt, Human
uaacuucuaaaacug

SEQ ID NO: 1995942 - RNA, 16 nt, Human
uaacuucuaaaacugu

SEQ ID NO: 1995943 - RNA, 17 nt, Human
uaacuucuaaaacugua

SEQ ID NO: 1995944 - RNA, 18 nt, Human
uaacuucuaaaacuguac

SEQ ID NO: 1995945 - RNA, 20 nt, Human
uaacuugucuuuggacccug

SEQ ID NO: 1995946 - RNA, 16 nt, Human
uaacuugucuuuggac

SEQ ID NO: 1995947 - RNA, 14 nt, Human
uaacuuguaauaaa

SEQ ID NO: 1995948 - RNA, 15 nt, Human
uaacuuguaauaaac

SEQ ID NO: 1995949 - RNA, 17 nt, Human
uaacuuacccuguauau

SEQ ID NO: 1995950 - RNA, 17 nt, Human
uaacuuagagcuuuuuu

SEQ ID NO: 1995951 - RNA, 15 nt, Human
uaacuuaguuuugca

SEQ ID NO: 1995952 - RNA, 16 nt, Human
uaacuuaguuuugcau

SEQ ID NO: 1995953 - RNA, 17 nt, Human
uaacuuaguuuugcaua

SEQ ID NO: 1995954 - RNA, 17 nt, Human
uaacuuauauuguaaga

SEQ ID NO: 1995955 - RNA, 18 nt, Human
uaacuuauauuguaagaa

SEQ ID NO: 1995956 - RNA, 19 nt, Human
uaacuuauauuguaagaaa

SEQ ID NO: 1995957 - RNA, 20 nt, Human
uaacuuauauuguaagaaau

SEQ ID NO: 1995958 - RNA, 21 nt, Human
uaacuuauauuguaagaaaua

SEQ ID NO: 1995959 - RNA, 15 nt, Human
uaacgugugcugugu

SEQ ID NO: 1995960 - RNA, 17 nt, Human
uaacgugugcuguguuu

SEQ ID NO: 1995961 - RNA, 22 nt, Human
uaacgugugcuguguuugcucc

SEQ ID NO: 1995962 - RNA, 17 nt, Human
uaacguauaaaagccug

SEQ ID NO: 1995963 - RNA, 13 nt, Human
uaacguauaaaag

SEQ ID NO: 1995964 - RNA, 19 nt, Human
uaacaugaauauuuagugu

SEQ ID NO: 1995965 - RNA, 23 nt, Human
uaacagggucucuagugcuguga

SEQ ID NO: 1995966 - RNA, 22 nt, Human
aauauauuuaaagggaaauuga

SEQ ID NO: 1995967 - RNA, 17 nt, Human
aauauauuuuguaugca

SEQ ID NO: 1995968 - RNA, 18 nt, Human
aauauauuuuguaugcaa

SEQ ID NO: 1995969 - RNA, 12 nt, Human
aauauauuuuag

SEQ ID NO: 1995970 - RNA, 13 nt, Human
aauauauuuugua

SEQ ID NO: 1995971 - RNA, 14 nt, Human
aauauauuuuguau

SEQ ID NO: 1995972 - RNA, 16 nt, Human
aauauauuuuguaugc

SEQ ID NO: 1995973 - RNA, 13 nt, Human
aauaucaaauuaa

SEQ ID NO: 1995974 - RNA, 14 nt, Human
aauaucaaauuaau

SEQ ID NO: 1995975 - RNA, 17 nt, Human
uaacagggauugauuuu

SEQ ID NO: 1995976 - RNA, 18 nt, Human
uaacagggauugauuuua

SEQ ID NO: 1995977 - RNA, 20 nt, Human
aauauauuuuguaugcaagc

SEQ ID NO: 1995978 - RNA, 19 nt, Human
uaacaugugaaaagaauag

SEQ ID NO: 1995979 - RNA, 23 nt, Human
uaacgcaccgacuagacacacaa

SEQ ID NO: 1995980 - RNA, 19 nt, Human
uaacauguaauuaaguacu

SEQ ID NO: 1995981 - RNA, 14 nt, Human
uaacaugaauauuu

SEQ ID NO: 1995982 - RNA, 21 nt, Human
uaacaugaauauuuaguguuc

SEQ ID NO: 1995983 - RNA, 20 nt, Human
uaacaugaauauuuaguguu

SEQ ID NO: 1995984 - RNA, 22 nt, Human
aauaguguuauugagagagaug

SEQ ID NO: 1995985 - RNA, 23 nt, Human
aauaguguuauugagagagaugu

SEQ ID NO: 1995986 - RNA, 21 nt, Human
aauauauucagccuggcuuca

SEQ ID NO: 1995987 - RNA, 21 nt, Human
aauaguucagguaacaggcag

SEQ ID NO: 1995988 - RNA, 21 nt, Human
aauauauuuuaagacgaaaca

SEQ ID NO: 1995989 - RNA, 15 nt, Human
aauauauuuaaaggg

SEQ ID NO: 1995990 - RNA, 19 nt, Human
aauauauuuaaagggaaau

SEQ ID NO: 1995991 - RNA, 14 nt, Human
aauauauuuaaagg

SEQ ID NO: 1995992 - RNA, 21 nt, Human
aauagugccgcaauaaacaua

SEQ ID NO: 1995993 - RNA, 18 nt, Human
aauagucauuugugaauu

SEQ ID NO: 1995994 - RNA, 22 nt, Human
guggcgaaaucccugcucacug

SEQ ID NO: 1995995 - RNA, 22 nt, Human
guggcgcagcauauucaggaag

SEQ ID NO: 1995996 - RNA, 17 nt, Human
guggcgaaaucccugcu

SEQ ID NO: 1995997 - RNA, 20 nt, Human
guggcgaaaucccugcucac

SEQ ID NO: 1995998 - RNA, 13 nt, Human
gugggacacccug

SEQ ID NO: 1995999 - RNA, 15 nt, Human
gugggacacccugug

SEQ ID NO: 1996000 - RNA, 14 nt, Human
gugggagcugccug

SEQ ID NO: 1996001 - RNA, 15 nt, Human
guggggucacucugg

SEQ ID NO: 1996002 - RNA, 15 nt, Human
guggggcucccgccu

SEQ ID NO: 1996003 - RNA, 15 nt, Human
gugggagcugccugu

SEQ ID NO: 1996004 - RNA, 18 nt, Human
gugggagcugccuguuca

SEQ ID NO: 1996005 - RNA, 23 nt, Human
gugggaggaucucuugagccugg

SEQ ID NO: 1996006 - RNA, 17 nt, Human
gugggaagggcuacacc

SEQ ID NO: 1996007 - RNA, 17 nt, Human
guggccgcccaaggccc

SEQ ID NO: 1996008 - RNA, 23 nt, Human
aagaggaaugaaguacucauaca

SEQ ID NO: 1996009 - RNA, 22 nt, Human
guggccucccaacucaccccag

SEQ ID NO: 1996010 - RNA, 21 nt, Human
guggccucccaacucacccca

SEQ ID NO: 1996011 - RNA, 23 nt, Human
guggccucgaacuccuggcacua

SEQ ID NO: 1996012 - RNA, 18 nt, Human
guggccugacucccccag

SEQ ID NO: 1996013 - RNA, 16 nt, Human
guggccuggcuugucu

SEQ ID NO: 1996014 - RNA, 13 nt, Human
guggccugccagu

SEQ ID NO: 1996015 - RNA, 22 nt, Human
aagagcaucaguacuuguuucu

SEQ ID NO: 1996016 - RNA, 22 nt, Human
aagagcagcuccuuccuagccu

SEQ ID NO: 1996017 - RNA, 16 nt, Human
aagacuuuggaaagac

SEQ ID NO: 1996018 - RNA, 23 nt, Human
aagacugaguacguugugcauuu

SEQ ID NO: 1996019 - RNA, 19 nt, Human
aagacgcugugcugcccug

SEQ ID NO: 1996020 - RNA, 18 nt, Human
aagacgcugugcugcccu

SEQ ID NO: 1996021 - RNA, 17 nt, Human
aagacgcugugcugccc

SEQ ID NO: 1996022 - RNA, 15 nt, Human
aagacgcugugcugc

SEQ ID NO: 1996023 - RNA, 16 nt, Human
aagacgcaccagccca

SEQ ID NO: 1996024 - RNA, 13 nt, Human
aagacgcugugcu

SEQ ID NO: 1996025 - RNA, 12 nt, Human
aacuugcuuaaa

SEQ ID NO: 1996026 - RNA, 14 nt, Human
aacuugcuuaaaug

SEQ ID NO: 1996027 - RNA, 15 nt, Human
aacuugcuuaaaugu

SEQ ID NO: 1996028 - RNA, 16 nt, Human
aacuugcuuaaaugug

SEQ ID NO: 1996029 - RNA, 17 nt, Human
aacuugcuuaaauguga

SEQ ID NO: 1996030 - RNA, 19 nt, Human
aagaccuucuccuucaccu

SEQ ID NO: 1996031 - RNA, 18 nt, Human
aagaccuucuccuucacc

SEQ ID NO: 1996032 - RNA, 15 nt, Human
aagaccuucuccuuc

SEQ ID NO: 1996033 - RNA, 14 nt, Human
aacuugccuuugaa

SEQ ID NO: 1996034 - RNA, 15 nt, Human
aacuugccuuugaag

SEQ ID NO: 1996035 - RNA, 12 nt, Human
aacuugcugccu

SEQ ID NO: 1996036 - RNA, 14 nt, Human
aacuugcugccucg

SEQ ID NO: 1996037 - RNA, 11 nt, Human
aacuugccuuu

SEQ ID NO: 1996038 - RNA, 23 nt, Human
aacuugcaagggcggccuuuccc

SEQ ID NO: 1996039 - RNA, 13 nt, Human
guguguauguggg

SEQ ID NO: 1996040 - RNA, 15 nt, Human
guguguauguggggg

SEQ ID NO: 1996041 - RNA, 20 nt, Human
gugugucacccuuaggccag

SEQ ID NO: 1996042 - RNA, 18 nt, Human
guguguccaaaacugccu

SEQ ID NO: 1996043 - RNA, 20 nt, Human
gugugugaaaaugugugugu

SEQ ID NO: 1996044 - RNA, 19 nt, Human
gugugggggccccgucuca

SEQ ID NO: 1996045 - RNA, 21 nt, Human
gugugggggccccgucucagg

SEQ ID NO: 1996046 - RNA, 14 nt, Human
gugugggggccccg

SEQ ID NO: 1996047 - RNA, 14 nt, Human
gugugggucugugu

SEQ ID NO: 1996048 - RNA, 16 nt, Human
gugugguagagugugc

SEQ ID NO: 1996049 - RNA, 20 nt, Human
gugucagguggggcagcuug

SEQ ID NO: 1996050 - RNA, 16 nt, Human
gugucaguauccaggc

SEQ ID NO: 1996051 - RNA, 19 nt, Human
gugucaguuuauguuuugg

SEQ ID NO: 1996052 - RNA, 22 nt, Human
gugugacaaggauugcuacugu

SEQ ID NO: 1996053 - RNA, 21 nt, Human
gugugaccacugcagaagaca

SEQ ID NO: 1996054 - RNA, 16 nt, Human
gugucagcauagaagu

SEQ ID NO: 1996055 - RNA, 15 nt, Human
gugucaagcuuccug

SEQ ID NO: 1996056 - RNA, 17 nt, Human
gugucaaguggcaaagc

SEQ ID NO: 1996057 - RNA, 14 nt, Human
gugucaaguggcaa

SEQ ID NO: 1996058 - RNA, 17 nt, Human
guguauuuuuuuacuaa

SEQ ID NO: 1996059 - RNA, 23 nt, Human
guguauuuuuuuacuaauagaca

SEQ ID NO: 1996060 - RNA, 20 nt, Human
gugucaagagggucugagga

SEQ ID NO: 1996061 - RNA, 17 nt, Human
aagauguacuauaacau

SEQ ID NO: 1996062 - RNA, 13 nt, Human
aagauguagagga

SEQ ID NO: 1996063 - RNA, 14 nt, Human
aagaggcugcagcc

SEQ ID NO: 1996064 - RNA, 23 nt, Human
aagagggagggagggcuccagac

SEQ ID NO: 1996065 - RNA, 12 nt, Human
aagaguaggaag

SEQ ID NO: 1996066 - RNA, 22 nt, Human
aagagggucugaggaauccaga

SEQ ID NO: 1996067 - RNA, 19 nt, Human
gugggguagguugggagaa

SEQ ID NO: 1996068 - RNA, 20 nt, Human
guggggucuccucaggacca

SEQ ID NO: 1996069 - RNA, 22 nt, Human
guggggucacucuggcagcuca

SEQ ID NO: 1996070 - RNA, 21 nt, Human
guggggucacucuggcagcuc

SEQ ID NO: 1996071 - RNA, 20 nt, Human
guggggucacucuggcagcu

SEQ ID NO: 1996072 - RNA, 17 nt, Human
guggggucacucuggca

SEQ ID NO: 1996073 - RNA, 16 nt, Human
aagaugcuucucacug

SEQ ID NO: 1996074 - RNA, 17 nt, Human
aagaugcuucucacugc

SEQ ID NO: 1996075 - RNA, 19 nt, Human
aagaugcuucucacugcca

SEQ ID NO: 1996076 - RNA, 18 nt, Human
aagauggcugugccucug

SEQ ID NO: 1996077 - RNA, 20 nt, Human
aagauggcugugccucugcc

SEQ ID NO: 1996078 - RNA, 21 nt, Human
aagauggcugugccucugccu

SEQ ID NO: 1996079 - RNA, 23 nt, Human
aagauggcugugccucugccugu

SEQ ID NO: 1996080 - RNA, 14 nt, Human
aagaguaggaagac

SEQ ID NO: 1996081 - RNA, 13 nt, Human
aagaguaggaaga

SEQ ID NO: 1996082 - RNA, 18 nt, Human
aagaucgguuaacaaaua

SEQ ID NO: 1996083 - RNA, 19 nt, Human
aagaucgguuaacaaauaa

SEQ ID NO: 1996084 - RNA, 18 nt, Human
aagaucucagugguuaag

SEQ ID NO: 1996085 - RNA, 20 nt, Human
aagaucgguuaacaaauaac

SEQ ID NO: 1996086 - RNA, 21 nt, Human
aagaucgguuaacaaauaaca

SEQ ID NO: 1996087 - RNA, 20 nt, Human
aagccgcuggggccaguugg

SEQ ID NO: 1996088 - RNA, 23 nt, Human
aagcccuuccaugucgccucugc

SEQ ID NO: 1996089 - RNA, 15 nt, Human
aagcccuuccauguc

SEQ ID NO: 1996090 - RNA, 20 nt, Human
aagcccuuccaugucgccuc

SEQ ID NO: 1996091 - RNA, 15 nt, Human
aagccccauuaacug

SEQ ID NO: 1996092 - RNA, 19 nt, Human
aagcccugagcuuucugcu

SEQ ID NO: 1996093 - RNA, 18 nt, Human
aagcccaguucagcuugg

SEQ ID NO: 1996094 - RNA, 19 nt, Human
aagcccaguucagcuuggg

SEQ ID NO: 1996095 - RNA, 13 nt, Human
aagccaagaggca

SEQ ID NO: 1996096 - RNA, 14 nt, Human
aagcccaggagccc

SEQ ID NO: 1996097 - RNA, 15 nt, Human
aagcccaggagccca

SEQ ID NO: 1996098 - RNA, 16 nt, Human
aagcccaggagcccau

SEQ ID NO: 1996099 - RNA, 13 nt, Human
aagcccaggaggg

SEQ ID NO: 1996100 - RNA, 22 nt, Human
aagcccaggaaaggcuccagga

SEQ ID NO: 1996101 - RNA, 19 nt, Human
aagcccaggaaaggcucca

SEQ ID NO: 1996102 - RNA, 18 nt, Human
aagccaagaggcugcagc

SEQ ID NO: 1996103 - RNA, 22 nt, Human
aagccaagaggcugcagccagg

SEQ ID NO: 1996104 - RNA, 17 nt, Human
aagcccaggaaaggcuc

SEQ ID NO: 1996105 - RNA, 14 nt, Human
aagcccaggaaagg

SEQ ID NO: 1996106 - RNA, 22 nt, Human
aagccaaagcuaggccuggcca

SEQ ID NO: 1996107 - RNA, 14 nt, Human
aagccaaaauuaag

SEQ ID NO: 1996108 - RNA, 17 nt, Human
aagccaaaauuaaggug

SEQ ID NO: 1996109 - RNA, 20 nt, Human
aagccaaaauuaagguguuu

SEQ ID NO: 1996110 - RNA, 22 nt, Human
aagccaaaauuaagguguuuga

SEQ ID NO: 1996111 - RNA, 13 nt, Human
aagcauuucaaag

SEQ ID NO: 1996112 - RNA, 17 nt, Human
aagcauuuuguaauaau

SEQ ID NO: 1996113 - RNA, 14 nt, Human
aagcauuuuguaau

SEQ ID NO: 1996114 - RNA, 16 nt, Human
aagcauuuacuuugug

SEQ ID NO: 1996115 - RNA, 17 nt, Human
aagcaucuaaggacaag

SEQ ID NO: 1996116 - RNA, 13 nt, Human
aagcaucuaagga

SEQ ID NO: 1996117 - RNA, 15 nt, Human
aagcaucuaaggaca

SEQ ID NO: 1996118 - RNA, 20 nt, Human
aagcagugcaugcugucccu

SEQ ID NO: 1996119 - RNA, 13 nt, Human
aagcagugcccag

SEQ ID NO: 1996120 - RNA, 14 nt, Human
aagcagugcccagg

SEQ ID NO: 1996121 - RNA, 15 nt, Human
aagcagugcccaggu

SEQ ID NO: 1996122 - RNA, 16 nt, Human
aagcagugcccaggug

SEQ ID NO: 1996123 - RNA, 18 nt, Human
aagcagugcccagguggc

SEQ ID NO: 1996124 - RNA, 15 nt, Human
aagcagugcaugcug

SEQ ID NO: 1996125 - RNA, 14 nt, Human
aagcagugcaugcu

SEQ ID NO: 1996126 - RNA, 13 nt, Human
aagcauauaaaau

SEQ ID NO: 1996127 - RNA, 18 nt, Human
aagcaguggagcccagga

SEQ ID NO: 1996128 - RNA, 12 nt, Human
aagcaguuucaa

SEQ ID NO: 1996129 - RNA, 13 nt, Human
aagcaguuucaau

SEQ ID NO: 1996130 - RNA, 14 nt, Human
aagcaguuucaaua

SEQ ID NO: 1996131 - RNA, 19 nt, Human
aagcaguuucaauaaaguu

SEQ ID NO: 1996132 - RNA, 20 nt, Human
aagcaguuucaauaaaguuu

SEQ ID NO: 1996133 - RNA, 22 nt, Human
aagcaguuucaauaaaguuuga

SEQ ID NO: 1996134 - RNA, 12 nt, Human
aagcagugcaug

SEQ ID NO: 1996135 - RNA, 16 nt, Human
gugugugggagugugu

SEQ ID NO: 1996136 - RNA, 17 nt, Human
gugugugcagagcugaa

SEQ ID NO: 1996137 - RNA, 15 nt, Human
gugugugaugugaca

SEQ ID NO: 1996138 - RNA, 14 nt, Human
gugugugcagagcu

SEQ ID NO: 1996139 - RNA, 21 nt, Human
gugugugcgccuacaggagug

SEQ ID NO: 1996140 - RNA, 18 nt, Human
aagcuccaagcucccagg

SEQ ID NO: 1996141 - RNA, 17 nt, Human
aagcuccaagcucccag

SEQ ID NO: 1996142 - RNA, 19 nt, Human
aagcucagggccuggcuca

SEQ ID NO: 1996143 - RNA, 18 nt, Human
aagcucagggccuggcuc

SEQ ID NO: 1996144 - RNA, 20 nt, Human
aagcucagggccuggcucag

SEQ ID NO: 1996145 - RNA, 17 nt, Human
aagcucagggccuggcu

SEQ ID NO: 1996146 - RNA, 16 nt, Human
aagcucagggccuggc

SEQ ID NO: 1996147 - RNA, 13 nt, Human
aagcucagggccu

SEQ ID NO: 1996148 - RNA, 12 nt, Human
aagcucagggcc

SEQ ID NO: 1996149 - RNA, 15 nt, Human
guucagcuccagcuc

SEQ ID NO: 1996150 - RNA, 13 nt, Human
guucagcuccagc

SEQ ID NO: 1996151 - RNA, 14 nt, Human
guucaagaucaaaa

SEQ ID NO: 1996152 - RNA, 20 nt, Human
guucaagaucaaaaaggcuu

SEQ ID NO: 1996153 - RNA, 15 nt, Human
aagccucaaaacaaa

SEQ ID NO: 1996154 - RNA, 16 nt, Human
aagccucaaaacaaag

SEQ ID NO: 1996155 - RNA, 18 nt, Human
aagccucaaaacaaaggc

SEQ ID NO: 1996156 - RNA, 17 nt, Human
aagccucaaauuugaac

SEQ ID NO: 1996157 - RNA, 21 nt, Human
aagccucaaauuugaacaugu

SEQ ID NO: 1996158 - RNA, 18 nt, Human
aagccuagauguuuuaua

SEQ ID NO: 1996159 - RNA, 12 nt, Human
aagccuaaagau

SEQ ID NO: 1996160 - RNA, 13 nt, Human
aagccuaaagauu

SEQ ID NO: 1996161 - RNA, 22 nt, Human
aagcuagacgagcaggcuucuu

SEQ ID NO: 1996162 - RNA, 20 nt, Human
aagccugaguuugcuuucaa

SEQ ID NO: 1996163 - RNA, 12 nt, Human
aagcuaggccug

SEQ ID NO: 1996164 - RNA, 21 nt, Human
aagcuauucccucaaaucuga

SEQ ID NO: 1996165 - RNA, 21 nt, Human
aagcuaggaaaagaaaucuau

SEQ ID NO: 1996166 - RNA, 23 nt, Human
aagcuaggaaaagaaaucuauag

SEQ ID NO: 1996167 - RNA, 19 nt, Human
aagcuaggaaaagaaaucu

SEQ ID NO: 1996168 - RNA, 20 nt, Human
aagcuaggaaaagaaaucua

SEQ ID NO: 1996169 - RNA, 12 nt, Human
guuauucuuugc

SEQ ID NO: 1996170 - RNA, 13 nt, Human
guuauucuuugca

SEQ ID NO: 1996171 - RNA, 22 nt, Human
guuauucaacagcaagugugaa

SEQ ID NO: 1996172 - RNA, 15 nt, Human
guuauucuuugcacu

SEQ ID NO: 1996173 - RNA, 16 nt, Human
guuauucuuugcacuu

SEQ ID NO: 1996174 - RNA, 23 nt, Human
guuauuuuuauuuauuuaaauuu

SEQ ID NO: 1996175 - RNA, 19 nt, Human
guuauuuuuauaagaaaac

SEQ ID NO: 1996176 - RNA, 20 nt, Human
guuauuuugauguaaagaug

SEQ ID NO: 1996177 - RNA, 19 nt, Human
guuauugagagagaugugu

SEQ ID NO: 1996178 - RNA, 20 nt, Human
guuauugagagagaugugua

SEQ ID NO: 1996179 - RNA, 21 nt, Human
guuauugagagagauguguaa

SEQ ID NO: 1996180 - RNA, 22 nt, Human
guuauugagagagauguguaau

SEQ ID NO: 1996181 - RNA, 16 nt, Human
guucaaaccugugaag

SEQ ID NO: 1996182 - RNA, 13 nt, Human
guucaaagucaug

SEQ ID NO: 1996183 - RNA, 18 nt, Human
guucaaagucaugauguu

SEQ ID NO: 1996184 - RNA, 19 nt, Human
guucaaagucaugauguuu

SEQ ID NO: 1996185 - RNA, 20 nt, Human
guucaaagucaugauguuuu

SEQ ID NO: 1996186 - RNA, 12 nt, Human
guucaaaugugu

SEQ ID NO: 1996187 - RNA, 18 nt, Human
guucaagcgauucuucug

SEQ ID NO: 1996188 - RNA, 13 nt, Human
guucaagaaauga

SEQ ID NO: 1996189 - RNA, 20 nt, Human
guucaagaaaugaagagcug

SEQ ID NO: 1996190 - RNA, 21 nt, Human
guucaaagauauuuugcuuug

SEQ ID NO: 1996191 - RNA, 22 nt, Human
guucaaagauauuuugcuuugu

SEQ ID NO: 1996192 - RNA, 20 nt, Human
guucaaagauauuuugcuuu

SEQ ID NO: 1996193 - RNA, 13 nt, Human
guuacuuuuccuu

SEQ ID NO: 1996194 - RNA, 20 nt, Human
guuacuuuccaauucuccuu

SEQ ID NO: 1996195 - RNA, 21 nt, Human
guuacuuuccaauucuccuuu

SEQ ID NO: 1996196 - RNA, 14 nt, Human
guuacuuuuccuug

SEQ ID NO: 1996197 - RNA, 17 nt, Human
guuacuuuuccuugcau

SEQ ID NO: 1996198 - RNA, 12 nt, Human
guuaagcaucua

SEQ ID NO: 1996199 - RNA, 12 nt, Human
guuaagagaaau

SEQ ID NO: 1996200 - RNA, 11 nt, Human
guuaagagaaa

SEQ ID NO: 1996201 - RNA, 14 nt, Human
guuaagauuccuaa

SEQ ID NO: 1996202 - RNA, 18 nt, Human
guuaagagaaaugagcuu

SEQ ID NO: 1996203 - RNA, 20 nt, Human
guuaggcauugugggaaggg

SEQ ID NO: 1996204 - RNA, 19 nt, Human
guuaggcauugugggaagg

SEQ ID NO: 1996205 - RNA, 14 nt, Human
guuaggcaguauaa

SEQ ID NO: 1996206 - RNA, 19 nt, Human
guuaggccaaagacaaaua

SEQ ID NO: 1996207 - RNA, 22 nt, Human
guuaggccaaagacaaauagua

SEQ ID NO: 1996208 - RNA, 15 nt, Human
guuagaauguaaggu

SEQ ID NO: 1996209 - RNA, 19 nt, Human
uaaaaaucucaaauuucua

SEQ ID NO: 1996210 - RNA, 20 nt, Human
uaaaaaucucaaauuucuaa

SEQ ID NO: 1996211 - RNA, 21 nt, Human
uaaaaaucucaaauuucuaaa

SEQ ID NO: 1996212 - RNA, 12 nt, Human
uaaaagaauugu

SEQ ID NO: 1996213 - RNA, 22 nt, Human
uaaaacuugauguguuaucucu

SEQ ID NO: 1996214 - RNA, 20 nt, Human
uaaaacuugauguguuaucu

SEQ ID NO: 1996215 - RNA, 15 nt, Human
guuuuucuucucccu

SEQ ID NO: 1996216 - RNA, 16 nt, Human
guuuuucuuaauauau

SEQ ID NO: 1996217 - RNA, 15 nt, Human
uaaaaaguggaaaaa

SEQ ID NO: 1996218 - RNA, 20 nt, Human
guuuuugaaggcagaaagca

SEQ ID NO: 1996219 - RNA, 19 nt, Human
guuuuugaaggcagaaagc

SEQ ID NO: 1996220 - RNA, 19 nt, Human
uaaaaauaaaaaacacugg

SEQ ID NO: 1996221 - RNA, 18 nt, Human
uaaaaauaaaaaacacug

SEQ ID NO: 1996222 - RNA, 19 nt, Human
guuuuugauagcauuguaa

SEQ ID NO: 1996223 - RNA, 14 nt, Human
uaaaaaguguuuaa

SEQ ID NO: 1996224 - RNA, 11 nt, Human
uaaaaauaacc

SEQ ID NO: 1996225 - RNA, 16 nt, Human
uaaaaauaaccuugca

SEQ ID NO: 1996226 - RNA, 13 nt, Human
uaaaaauaacugu

SEQ ID NO: 1996227 - RNA, 17 nt, Human
uaaaaauaacuguaauu

SEQ ID NO: 1996228 - RNA, 15 nt, Human
uaaaaauaacuguaa

SEQ ID NO: 1996229 - RNA, 16 nt, Human
uaaaaauaacuguaau

SEQ ID NO: 1996230 - RNA, 12 nt, Human
uaaaaauaaagc

SEQ ID NO: 1996231 - RNA, 19 nt, Human
uaaaaauaaagcacaaacc

SEQ ID NO: 1996232 - RNA, 21 nt, Human
uaaaaauaaaaaacacuggga

SEQ ID NO: 1996233 - RNA, 17 nt, Human
uaaaaaguguuuaaaug

SEQ ID NO: 1996234 - RNA, 16 nt, Human
uaaaaaucucaaauuu

SEQ ID NO: 1996235 - RNA, 17 nt, Human
uaaaaaucucaaauuuc

SEQ ID NO: 1996236 - RNA, 15 nt, Human
uaaaaaucucaaauu

SEQ ID NO: 1996237 - RNA, 12 nt, Human
uaaaaguucuuu

SEQ ID NO: 1996238 - RNA, 20 nt, Human
uaaaagacagugaaagaaaa

SEQ ID NO: 1996239 - RNA, 22 nt, Human
uaaaauaccagccaguaaaugg

SEQ ID NO: 1996240 - RNA, 15 nt, Human
uaaaauaauuuugua

SEQ ID NO: 1996241 - RNA, 16 nt, Human
uaaaauaauuuuguaa

SEQ ID NO: 1996242 - RNA, 13 nt, Human
uaaaauaauuuug

SEQ ID NO: 1996243 - RNA, 14 nt, Human
uaaaauaauuuugu

SEQ ID NO: 1996244 - RNA, 21 nt, Human
uaaaauaauuuuguaauguau

SEQ ID NO: 1996245 - RNA, 12 nt, Human
uaaaauacugua

SEQ ID NO: 1996246 - RNA, 14 nt, Human
uaaaauacuguaga

SEQ ID NO: 1996247 - RNA, 16 nt, Human
uaaaauacuguagaua

SEQ ID NO: 1996248 - RNA, 17 nt, Human
uaaaauacuguagauaa

SEQ ID NO: 1996249 - RNA, 20 nt, Human
uaaaauacuguagauaauua

SEQ ID NO: 1996250 - RNA, 21 nt, Human
uaaaauacuguagauaauuaa

SEQ ID NO: 1996251 - RNA, 13 nt, Human
uaaaauacuucuu

SEQ ID NO: 1996252 - RNA, 22 nt, Human
uaaaauacuucuuuuuacaaug

SEQ ID NO: 1996253 - RNA, 20 nt, Human
aagugauucuccugccucag

SEQ ID NO: 1996254 - RNA, 21 nt, Human
aagugauucucaugccucagc

SEQ ID NO: 1996255 - RNA, 19 nt, Human
aagugauucuccugccuca

SEQ ID NO: 1996256 - RNA, 15 nt, Human
aagugauucuccugc

SEQ ID NO: 1996257 - RNA, 16 nt, Human
aagugauucuccugcc

SEQ ID NO: 1996258 - RNA, 17 nt, Human
aagugauucuccugccu

SEQ ID NO: 1996259 - RNA, 18 nt, Human
aagugauucuccugccuc

SEQ ID NO: 1996260 - RNA, 16 nt, Human
aagugaggaugaaaaa

SEQ ID NO: 1996261 - RNA, 18 nt, Human
aagugaggaaaucaaagu

SEQ ID NO: 1996262 - RNA, 21 nt, Human
aagugaggaaaucaaagugcu

SEQ ID NO: 1996263 - RNA, 20 nt, Human
aagugauucucaugccucag

SEQ ID NO: 1996264 - RNA, 14 nt, Human
uaaaauauuuauga

SEQ ID NO: 1996265 - RNA, 15 nt, Human
uaaaauauuuaugaa

SEQ ID NO: 1996266 - RNA, 16 nt, Human
uaaaauauuuaugaag

SEQ ID NO: 1996267 - RNA, 17 nt, Human
uaaaauauuuaugaaga

SEQ ID NO: 1996268 - RNA, 18 nt, Human
uaaaauauuuaugaagaa

SEQ ID NO: 1996269 - RNA, 20 nt, Human
uaaaauauuuaugaagaaaa

SEQ ID NO: 1996270 - RNA, 13 nt, Human
uaaaauaugcacu

SEQ ID NO: 1996271 - RNA, 14 nt, Human
uaaaauaugcacua

SEQ ID NO: 1996272 - RNA, 19 nt, Human
uaaaauaugcacuaagucu

SEQ ID NO: 1996273 - RNA, 23 nt, Human
uaaaauaugcacuaagucucuuu

SEQ ID NO: 1996274 - RNA, 13 nt, Human
uaaaauauuccug

SEQ ID NO: 1996275 - RNA, 22 nt, Human
uaaaauauuccugcauuuguga

SEQ ID NO: 1996276 - RNA, 13 nt, Human
aaguacacuguuu

SEQ ID NO: 1996277 - RNA, 18 nt, Human
aaguacacuguuucaaac

SEQ ID NO: 1996278 - RNA, 14 nt, Human
aaguaauauuuauu

SEQ ID NO: 1996279 - RNA, 22 nt, Human
aaguaauauuuauuaaauuuuu

SEQ ID NO: 1996280 - RNA, 22 nt, Human
guuuugcacucuuguuucuccc

SEQ ID NO: 1996281 - RNA, 23 nt, Human
guuuuggauuuggagagaaauau

SEQ ID NO: 1996282 - RNA, 15 nt, Human
guuuugcuuccccuc

SEQ ID NO: 1996283 - RNA, 15 nt, Human
guuucugccgcagcc

SEQ ID NO: 1996284 - RNA, 13 nt, Human
guuuugcacucuu

SEQ ID NO: 1996285 - RNA, 14 nt, Human
guuucugccgcagc

SEQ ID NO: 1996286 - RNA, 16 nt, Human
guuuugccauguuggc

SEQ ID NO: 1996287 - RNA, 20 nt, Human
guuuugccauguuggccagg

SEQ ID NO: 1996288 - RNA, 21 nt, Human
guuuugccauguuggccaggc

SEQ ID NO: 1996289 - RNA, 22 nt, Human
guuuugccauguuggccaggcu

SEQ ID NO: 1996290 - RNA, 23 nt, Human
aaguacacuguuucaaacuuuac

SEQ ID NO: 1996291 - RNA, 23 nt, Human
aaguacacugaauuuuuaugugu

SEQ ID NO: 1996292 - RNA, 19 nt, Human
aaguacacuguuucaaacu

SEQ ID NO: 1996293 - RNA, 20 nt, Human
aaguacacuguuucaaacuu

SEQ ID NO: 1996294 - RNA, 21 nt, Human
aaguacauuuuuugaaaugcu

SEQ ID NO: 1996295 - RNA, 15 nt, Human
aaguacagguacuuu

SEQ ID NO: 1996296 - RNA, 18 nt, Human
aaguacagguacuuuguc

SEQ ID NO: 1996297 - RNA, 16 nt, Human
aaguacauuuuuugaa

SEQ ID NO: 1996298 - RNA, 17 nt, Human
aaguacauuuuuugaaa

SEQ ID NO: 1996299 - RNA, 20 nt, Human
aaguauuuaagccuaaagau

SEQ ID NO: 1996300 - RNA, 21 nt, Human
aaguauuuaagccuaaagauu

SEQ ID NO: 1996301 - RNA, 17 nt, Human
aaguauuaauucucuuu

SEQ ID NO: 1996302 - RNA, 12 nt, Human
aagugaaaacuu

SEQ ID NO: 1996303 - RNA, 20 nt, Human
aagucuuuuaaaaaguauug

SEQ ID NO: 1996304 - RNA, 21 nt, Human
aagugaaaaaggaggaagaga

SEQ ID NO: 1996305 - RNA, 12 nt, Human
aagugaaaauau

SEQ ID NO: 1996306 - RNA, 14 nt, Human
aagugaaaauauag

SEQ ID NO: 1996307 - RNA, 10 nt, Human
aagugaaauu

SEQ ID NO: 1996308 - RNA, 11 nt, Human
aagugaaauuu

SEQ ID NO: 1996309 - RNA, 12 nt, Human
aagugaaauuua

SEQ ID NO: 1996310 - RNA, 15 nt, Human
aagugaaauuuauug

SEQ ID NO: 1996311 - RNA, 20 nt, Human
aagugaaauuuauugaggaa

SEQ ID NO: 1996312 - RNA, 17 nt, Human
aagugaagacaaugacu

SEQ ID NO: 1996313 - RNA, 19 nt, Human
aagugaagacaaugacuua

SEQ ID NO: 1996314 - RNA, 15 nt, Human
guuuuucauaaagca

SEQ ID NO: 1996315 - RNA, 15 nt, Human
aagugagagcugggu

SEQ ID NO: 1996316 - RNA, 12 nt, Human
aagugagagagg

SEQ ID NO: 1996317 - RNA, 14 nt, Human
aagugagagcuggg

SEQ ID NO: 1996318 - RNA, 21 nt, Human
aagucaugcguuuaaucacau

SEQ ID NO: 1996319 - RNA, 21 nt, Human
aagucaugcuccccugugcca

SEQ ID NO: 1996320 - RNA, 15 nt, Human
aagucaugcuccccu

SEQ ID NO: 1996321 - RNA, 19 nt, Human
aagucaugcuccccugugc

SEQ ID NO: 1996322 - RNA, 22 nt, Human
aagucuuauauauuguagauaa

SEQ ID NO: 1996323 - RNA, 16 nt, Human
aagucuuucacauuua

SEQ ID NO: 1996324 - RNA, 17 nt, Human
aagucuuuuaaaaagua

SEQ ID NO: 1996325 - RNA, 19 nt, Human
aagucuuuuaaaaaguauu

SEQ ID NO: 1996326 - RNA, 11 nt, Human
aagucuuugcu

SEQ ID NO: 1996327 - RNA, 12 nt, Human
aagucuuuuaaa

SEQ ID NO: 1996328 - RNA, 16 nt, Human
aagucuuuuaaaaagu

SEQ ID NO: 1996329 - RNA, 17 nt, Human
aagucuugccuauauuu

SEQ ID NO: 1996330 - RNA, 13 nt, Human
aagucuucuauuu

SEQ ID NO: 1996331 - RNA, 17 nt, Human
aagucuucuauuuauuu

SEQ ID NO: 1996332 - RNA, 13 nt, Human
aagucuucaugaa

SEQ ID NO: 1996333 - RNA, 14 nt, Human
aagucuucaugaaa

SEQ ID NO: 1996334 - RNA, 16 nt, Human
aagucuucaugaaaug

SEQ ID NO: 1996335 - RNA, 18 nt, Human
aagucuucaugaaaugcu

SEQ ID NO: 1996336 - RNA, 19 nt, Human
aagucuucaugaaaugcua

SEQ ID NO: 1996337 - RNA, 22 nt, Human
aagucuucaugaaaugcuaugu

SEQ ID NO: 1996338 - RNA, 22 nt, Human
guuucuaugacacaugcaaggu

SEQ ID NO: 1996339 - RNA, 20 nt, Human
aaguaagggaagcagaagga

SEQ ID NO: 1996340 - RNA, 16 nt, Human
aaguaaggaauuuuau

SEQ ID NO: 1996341 - RNA, 13 nt, Human
aaguaagcaaaga

SEQ ID NO: 1996342 - RNA, 18 nt, Human
aagguauuuaauagguuu

SEQ ID NO: 1996343 - RNA, 14 nt, Human
aaggucaccucacu

SEQ ID NO: 1996344 - RNA, 15 nt, Human
aaggucaccucacuc

SEQ ID NO: 1996345 - RNA, 17 nt, Human
aaggucaccucacucag

SEQ ID NO: 1996346 - RNA, 18 nt, Human
aaggucaccucacucagc

SEQ ID NO: 1996347 - RNA, 19 nt, Human
aaggucaccucacucagca

SEQ ID NO: 1996348 - RNA, 22 nt, Human
aaggucaccucacucagcacca

SEQ ID NO: 1996349 - RNA, 12 nt, Human
aaggucauuuuu

SEQ ID NO: 1996350 - RNA, 14 nt, Human
aaggucauuuccau

SEQ ID NO: 1996351 - RNA, 20 nt, Human
aaggucauuuccauguaugc

SEQ ID NO: 1996352 - RNA, 18 nt, Human
guuucugaaagggacgcu

SEQ ID NO: 1996353 - RNA, 13 nt, Human
guuucucuucucc

SEQ ID NO: 1996354 - RNA, 21 nt, Human
guuucucuucuccccuuccau

SEQ ID NO: 1996355 - RNA, 23 nt, Human
guuucuauuuucucugauacuuu

SEQ ID NO: 1996356 - RNA, 14 nt, Human
aaguaagucucaag

SEQ ID NO: 1996357 - RNA, 13 nt, Human
guuucuauuuucu

SEQ ID NO: 1996358 - RNA, 19 nt, Human
guuucuauguguagggcgg

SEQ ID NO: 1996359 - RNA, 20 nt, Human
aagguagaaauaucugaaaa

SEQ ID NO: 1996360 - RNA, 13 nt, Human
aagguagaaugac

SEQ ID NO: 1996361 - RNA, 17 nt, Human
aagguagaaugaccuug

SEQ ID NO: 1996362 - RNA, 19 nt, Human
aagguagaaugaccuugua

SEQ ID NO: 1996363 - RNA, 18 nt, Human
aagguacuuucauauuuu

SEQ ID NO: 1996364 - RNA, 19 nt, Human
aagguacuuucauauuuua

SEQ ID NO: 1996365 - RNA, 22 nt, Human
aagguacuuucauauuuuaaac

SEQ ID NO: 1996366 - RNA, 23 nt, Human
aagggucuccgaaaugcugucuu

SEQ ID NO: 1996367 - RNA, 24 nt, Human
aagggucuccgaaaugcugucuuu

SEQ ID NO: 1996368 - RNA, 22 nt, Human
aaggggcccaaauucuuucagu

SEQ ID NO: 1996369 - RNA, 23 nt, Human
aaggcucugagcaaauguggcuc

SEQ ID NO: 1996370 - RNA, 15 nt, Human
aaggcuccaggagca

SEQ ID NO: 1996371 - RNA, 18 nt, Human
aaggcuccaggagcagcc

SEQ ID NO: 1996372 - RNA, 16 nt, Human
aaggcuccaggagcag

SEQ ID NO: 1996373 - RNA, 14 nt, Human
guuucaaacuuuac

SEQ ID NO: 1996374 - RNA, 16 nt, Human
guuucaaacuuuacua

SEQ ID NO: 1996375 - RNA, 15 nt, Human
guuuauuuuaaaaca

SEQ ID NO: 1996376 - RNA, 16 nt, Human
guuuauuuuaaaacaa

SEQ ID NO: 1996377 - RNA, 13 nt, Human
guuucaaacuuua

SEQ ID NO: 1996378 - RNA, 18 nt, Human
aaggcucgagcaugccug

SEQ ID NO: 1996379 - RNA, 16 nt, Human
aaggcucgagcaugcc

SEQ ID NO: 1996380 - RNA, 22 nt, Human
aaggcuccaggagcagccacau

SEQ ID NO: 1996381 - RNA, 19 nt, Human
aaggcuccaggagcagcca

SEQ ID NO: 1996382 - RNA, 20 nt, Human
aaggcucgagcaugccugga

SEQ ID NO: 1996383 - RNA, 19 nt, Human
aaggcucgagcaugccugg

SEQ ID NO: 1996384 - RNA, 22 nt, Human
aaggcucgagcaugccuggaug

SEQ ID NO: 1996385 - RNA, 15 nt, Human
aaggcuccugccccc

SEQ ID NO: 1996386 - RNA, 17 nt, Human
guugggccaggagccuc

SEQ ID NO: 1996387 - RNA, 15 nt, Human
guugggccaggagcc

SEQ ID NO: 1996388 - RNA, 13 nt, Human
guugggcuggugu

SEQ ID NO: 1996389 - RNA, 15 nt, Human
guugggcugguguca

SEQ ID NO: 1996390 - RNA, 13 nt, Human
guuuacaguguuc

SEQ ID NO: 1996391 - RNA, 15 nt, Human
guuuacaguguuccg

SEQ ID NO: 1996392 - RNA, 13 nt, Human
guuuauugucaaa

SEQ ID NO: 1996393 - RNA, 21 nt, Human
guuuauuggugaguuaggaac

SEQ ID NO: 1996394 - RNA, 20 nt, Human
guuuaaugguaguuuuacag

SEQ ID NO: 1996395 - RNA, 12 nt, Human
guuuaaugguag

SEQ ID NO: 1996396 - RNA, 17 nt, Human
guuuaaugguaguuuua

SEQ ID NO: 1996397 - RNA, 22 nt, Human
aaggaaccaaagcgaauuuuaa

SEQ ID NO: 1996398 - RNA, 23 nt, Human
aaggaaccaaagcgaauuuuaaa

SEQ ID NO: 1996399 - RNA, 17 nt, Human
aaggaacagcaauggug

SEQ ID NO: 1996400 - RNA, 12 nt, Human
aaggaaccuucc

SEQ ID NO: 1996401 - RNA, 13 nt, Human
aaggaaccuuccu

SEQ ID NO: 1996402 - RNA, 21 nt, Human
aaggaaccuuccuuccugcuu

SEQ ID NO: 1996403 - RNA, 23 nt, Human
aaggaaccuuccuuccugcuuga

SEQ ID NO: 1996404 - RNA, 22 nt, Human
aaggaaauaccaguucugggca

SEQ ID NO: 1996405 - RNA, 15 nt, Human
aaggaaagagggagg

SEQ ID NO: 1996406 - RNA, 14 nt, Human
aagcuccaucucca

SEQ ID NO: 1996407 - RNA, 20 nt, Human
aagcuccaucuccacuccag

SEQ ID NO: 1996408 - RNA, 17 nt, Human
aaggaauaccugucccc

SEQ ID NO: 1996409 - RNA, 21 nt, Human
aaggaauaaauugcuccuuga

SEQ ID NO: 1996410 - RNA, 16 nt, Human
aaggaagcacaugccu

SEQ ID NO: 1996411 - RNA, 13 nt, Human
aaggaagcacaug

SEQ ID NO: 1996412 - RNA, 15 nt, Human
aaggaagacuucauc

SEQ ID NO: 1996413 - RNA, 14 nt, Human
aaggaagacuucau

SEQ ID NO: 1996414 - RNA, 11 nt, Human
aaggaagaaau

SEQ ID NO: 1996415 - RNA, 17 nt, Human
aaggaagaaauuaacuu

SEQ ID NO: 1996416 - RNA, 23 nt, Human
aaggaacuaggucaaaaaucugu

SEQ ID NO: 1996417 - RNA, 12 nt, Human
aaggaggccacc

SEQ ID NO: 1996418 - RNA, 14 nt, Human
aaggaggccaccuc

SEQ ID NO: 1996419 - RNA, 15 nt, Human
aaggaggccaccucc

SEQ ID NO: 1996420 - RNA, 14 nt, Human
aaggaggcuccagg

SEQ ID NO: 1996421 - RNA, 16 nt, Human
aaggaggccaccuccu

SEQ ID NO: 1996422 - RNA, 19 nt, Human
aaggaggccaccuccuaaa

SEQ ID NO: 1996423 - RNA, 17 nt, Human
aaggaggcuccaggcag

SEQ ID NO: 1996424 - RNA, 18 nt, Human
aaggaggcuccaggcagc

SEQ ID NO: 1996425 - RNA, 19 nt, Human
aaggaggcuccaggcagca

SEQ ID NO: 1996426 - RNA, 18 nt, Human
aaggaggaagagaaaaaa

SEQ ID NO: 1996427 - RNA, 12 nt, Human
aaggagggugag

SEQ ID NO: 1996428 - RNA, 20 nt, Human
aaggaggggauagagagaga

SEQ ID NO: 1996429 - RNA, 22 nt, Human
aaggagcucacuguggugucug

SEQ ID NO: 1996430 - RNA, 14 nt, Human
aaggagauuuacaa

SEQ ID NO: 1996431 - RNA, 11 nt, Human
aaggagagcua

SEQ ID NO: 1996432 - RNA, 18 nt, Human
aaggaauaccuguccccc

SEQ ID NO: 1996433 - RNA, 20 nt, Human
aaggaauagaucuaugauug

SEQ ID NO: 1996434 - RNA, 23 nt, Human
aaggaguuucuuuagcugacaga

SEQ ID NO: 1996435 - RNA, 15 nt, Human
aaggauacaggcugg

SEQ ID NO: 1996436 - RNA, 12 nt, Human
aaggcaugaagg

SEQ ID NO: 1996437 - RNA, 13 nt, Human
aaggauacaaaag

SEQ ID NO: 1996438 - RNA, 21 nt, Human
aaggauacaaaagcaugugag

SEQ ID NO: 1996439 - RNA, 21 nt, Human
aaggcccacgagcuuguucuu

SEQ ID NO: 1996440 - RNA, 21 nt, Human
aaggcccagagagaagagccc

SEQ ID NO: 1996441 - RNA, 22 nt, Human
aaggcccuaucuguuuacagug

SEQ ID NO: 1996442 - RNA, 23 nt, Human
aaggcccuguuagugcacugauu

SEQ ID NO: 1996443 - RNA, 16 nt, Human
aaggccaaaggaagca

SEQ ID NO: 1996444 - RNA, 15 nt, Human
aaggcauuucccacc

SEQ ID NO: 1996445 - RNA, 23 nt, Human
guugcccaggcaggucuugaacu

SEQ ID NO: 1996446 - RNA, 22 nt, Human
aaggccuaauucuaugccuguc

SEQ ID NO: 1996447 - RNA, 12 nt, Human
guugcccaggcu

SEQ ID NO: 1996448 - RNA, 13 nt, Human
guugcccaggcug

SEQ ID NO: 1996449 - RNA, 23 nt, Human
guugccuauaagccaaaauuaag

SEQ ID NO: 1996450 - RNA, 17 nt, Human
guuggaaaauaucuuug

SEQ ID NO: 1996451 - RNA, 14 nt, Human
guuggaaacacuaa

SEQ ID NO: 1996452 - RNA, 15 nt, Human
guuggaaacacuaaa

SEQ ID NO: 1996453 - RNA, 16 nt, Human
guuggaaacacuaaau

SEQ ID NO: 1996454 - RNA, 18 nt, Human
guuggaaacacuaaaugu

SEQ ID NO: 1996455 - RNA, 19 nt, Human
guuggaaacacuaaauguu

SEQ ID NO: 1996456 - RNA, 20 nt, Human
guuggaaacacuaaauguua

SEQ ID NO: 1996457 - RNA, 22 nt, Human
guuggaaacacuaaauguuaaa

SEQ ID NO: 1996458 - RNA, 15 nt, Human
guuggaagaggaaca

SEQ ID NO: 1996459 - RNA, 23 nt, Human
guuggaaacacuaaauguuaaag

SEQ ID NO: 1996460 - RNA, 18 nt, Human
gucccccuuccauggacu

SEQ ID NO: 1996461 - RNA, 16 nt, Human
gucccccuuccaugga

SEQ ID NO: 1996462 - RNA, 18 nt, Human
gucccccugacaacacuc

SEQ ID NO: 1996463 - RNA, 14 nt, Human
gucccccuuccaug

SEQ ID NO: 1996464 - RNA, 23 nt, Human
gucccuuucgacuugcauuuuug

SEQ ID NO: 1996465 - RNA, 12 nt, Human
aacagaaaugua

SEQ ID NO: 1996466 - RNA, 13 nt, Human
aacagaaauguac

SEQ ID NO: 1996467 - RNA, 14 nt, Human
aacagaaauguaca

SEQ ID NO: 1996468 - RNA, 15 nt, Human
aacagaaauguacag

SEQ ID NO: 1996469 - RNA, 16 nt, Human
guccuacccacccucc

SEQ ID NO: 1996470 - RNA, 15 nt, Human
guccuacccacccuc

SEQ ID NO: 1996471 - RNA, 15 nt, Human
gucccuuucuucucc

SEQ ID NO: 1996472 - RNA, 20 nt, Human
gucccuuucuucucccccau

SEQ ID NO: 1996473 - RNA, 12 nt, Human
guccuacucugu

SEQ ID NO: 1996474 - RNA, 16 nt, Human
aacagggauugauuuu

SEQ ID NO: 1996475 - RNA, 17 nt, Human
aacagggauugauuuua

SEQ ID NO: 1996476 - RNA, 19 nt, Human
aacagggauugauuuuaaa

SEQ ID NO: 1996477 - RNA, 21 nt, Human
aacagggauugauuuuaaaau

SEQ ID NO: 1996478 - RNA, 22 nt, Human
aacagggauugauuuuaaaaug

SEQ ID NO: 1996479 - RNA, 23 nt, Human
aacagggucucuagugcugugaa

SEQ ID NO: 1996480 - RNA, 20 nt, Human
aacagggucucuagugcugu

SEQ ID NO: 1996481 - RNA, 22 nt, Human
aacagggucucuagugcuguga

SEQ ID NO: 1996482 - RNA, 13 nt, Human
aacagggucucua

SEQ ID NO: 1996483 - RNA, 18 nt, Human
aacagggucucuagugcu

SEQ ID NO: 1996484 - RNA, 23 nt, Human
aacagugcaccugggacagggag

SEQ ID NO: 1996485 - RNA, 15 nt, Human
aacagugauuaccag

SEQ ID NO: 1996486 - RNA, 22 nt, Human
aacagugauuaccagggacuga

SEQ ID NO: 1996487 - RNA, 23 nt, Human
aacagaacucgguguccccacca

SEQ ID NO: 1996488 - RNA, 16 nt, Human
aacagauaaauaguuu

SEQ ID NO: 1996489 - RNA, 21 nt, Human
aacacaaauuaugcuaagaau

SEQ ID NO: 1996490 - RNA, 20 nt, Human
gucauuuuguguugaagagc

SEQ ID NO: 1996491 - RNA, 18 nt, Human
gucauuuuguguugaaga

SEQ ID NO: 1996492 - RNA, 17 nt, Human
gucauuuuggucuaagg

SEQ ID NO: 1996493 - RNA, 13 nt, Human
gucauuuucauua

SEQ ID NO: 1996494 - RNA, 19 nt, Human
gucauuuugcagaggcuau

SEQ ID NO: 1996495 - RNA, 19 nt, Human
gucauuuuuuuuaagaaaa

SEQ ID NO: 1996496 - RNA, 21 nt, Human
gucauuuuuuuuaagaaaaag

SEQ ID NO: 1996497 - RNA, 18 nt, Human
guccaagaagcccaggaa

SEQ ID NO: 1996498 - RNA, 17 nt, Human
guccaagaagcccagga

SEQ ID NO: 1996499 - RNA, 20 nt, Human
guccaagaagcccaggaaag

SEQ ID NO: 1996500 - RNA, 16 nt, Human
guccaagaagcccagg

SEQ ID NO: 1996501 - RNA, 15 nt, Human
guccaagaagcccag

SEQ ID NO: 1996502 - RNA, 13 nt, Human
guccaagaagccc

SEQ ID NO: 1996503 - RNA, 21 nt, Human
gucccaccccacacacgccag

SEQ ID NO: 1996504 - RNA, 16 nt, Human
guccauagcuguggug

SEQ ID NO: 1996505 - RNA, 17 nt, Human
guccauaauguucugcu

SEQ ID NO: 1996506 - RNA, 13 nt, Human
guccauagcugug

SEQ ID NO: 1996507 - RNA, 14 nt, Human
guccauagagagca

SEQ ID NO: 1996508 - RNA, 13 nt, Human
guccauagagagc

SEQ ID NO: 1996509 - RNA, 14 nt, Human
gucccaccuuggcu

SEQ ID NO: 1996510 - RNA, 15 nt, Human
gucccaccuuggcug

SEQ ID NO: 1996511 - RNA, 16 nt, Human
gucccaccuuggcugc

SEQ ID NO: 1996512 - RNA, 18 nt, Human
aaauuuugauguuuuaag

SEQ ID NO: 1996513 - RNA, 23 nt, Human
aaauuuugauguuuuaaggaugc

SEQ ID NO: 1996514 - RNA, 18 nt, Human
aaauuuuguaagggagca

SEQ ID NO: 1996515 - RNA, 22 nt, Human
aaauuuuaggcaaguuuucccu

SEQ ID NO: 1996516 - RNA, 13 nt, Human
aaauuuugaaaag

SEQ ID NO: 1996517 - RNA, 14 nt, Human
aaauuuugaaaagu

SEQ ID NO: 1996518 - RNA, 17 nt, Human
aaauuuugaaaaguaau

SEQ ID NO: 1996519 - RNA, 18 nt, Human
aaauuuugaaaaguaaua

SEQ ID NO: 1996520 - RNA, 21 nt, Human
aaauuuugaaaaguaauauuu

SEQ ID NO: 1996521 - RNA, 16 nt, Human
aacaaggcaaggcugu

SEQ ID NO: 1996522 - RNA, 15 nt, Human
aacaaggcaaggcug

SEQ ID NO: 1996523 - RNA, 12 nt, Human
aaauuuuuuugu

SEQ ID NO: 1996524 - RNA, 19 nt, Human
aaauuuuuuuguaugaaaa

SEQ ID NO: 1996525 - RNA, 13 nt, Human
aaauuuuuuugua

SEQ ID NO: 1996526 - RNA, 14 nt, Human
aaauuuuuuuguau

SEQ ID NO: 1996527 - RNA, 17 nt, Human
aaauuuuuuuguaugaa

SEQ ID NO: 1996528 - RNA, 18 nt, Human
aaauuuuuuuguaugaaa

SEQ ID NO: 1996529 - RNA, 20 nt, Human
aaauuuuuuuguaugaaaac

SEQ ID NO: 1996530 - RNA, 20 nt, Human
aacaauucaaagaaucaccu

SEQ ID NO: 1996531 - RNA, 23 nt, Human
aacaauucucccgggacucugca

SEQ ID NO: 1996532 - RNA, 22 nt, Human
aacaauucucccgggacucugc

SEQ ID NO: 1996533 - RNA, 15 nt, Human
aacaauaaagcaaua

SEQ ID NO: 1996534 - RNA, 21 nt, Human
aacaaggcaaggcugucaauu

SEQ ID NO: 1996535 - RNA, 18 nt, Human
aacaaggcaaggcuguca

SEQ ID NO: 1996536 - RNA, 16 nt, Human
aacaagcauauaaaau

SEQ ID NO: 1996537 - RNA, 17 nt, Human
aacaagcauauaaaaug

SEQ ID NO: 1996538 - RNA, 14 nt, Human
aacaaguugagcua

SEQ ID NO: 1996539 - RNA, 17 nt, Human
aacaaguugagcuauga

SEQ ID NO: 1996540 - RNA, 21 nt, Human
aacaaguugagcuaugacuua

SEQ ID NO: 1996541 - RNA, 22 nt, Human
aacaaguugagcuaugacuuaa

SEQ ID NO: 1996542 - RNA, 12 nt, Human
aacaauaaaaga

SEQ ID NO: 1996543 - RNA, 14 nt, Human
gucaggccgggcag

SEQ ID NO: 1996544 - RNA, 15 nt, Human
gucaggccgggcaga

SEQ ID NO: 1996545 - RNA, 16 nt, Human
gucaggccgggcagag

SEQ ID NO: 1996546 - RNA, 17 nt, Human
gucaggccgggcagagc

SEQ ID NO: 1996547 - RNA, 19 nt, Human
gucaggccgggcagagcac

SEQ ID NO: 1996548 - RNA, 22 nt, Human
gucaggccgggcagagcacagc

SEQ ID NO: 1996549 - RNA, 20 nt, Human
gucaggcuaauguuggcaga

SEQ ID NO: 1996550 - RNA, 14 nt, Human
gucaggcucucugg

SEQ ID NO: 1996551 - RNA, 16 nt, Human
gucaggcucucugggc

SEQ ID NO: 1996552 - RNA, 19 nt, Human
gucaggcucucugggcuga

SEQ ID NO: 1996553 - RNA, 20 nt, Human
gucaggcucucugggcugac

SEQ ID NO: 1996554 - RNA, 13 nt, Human
gucagaauagaaa

SEQ ID NO: 1996555 - RNA, 13 nt, Human
gucacagccaggc

SEQ ID NO: 1996556 - RNA, 23 nt, Human
gucagaaguuucugccgcagccc

SEQ ID NO: 1996557 - RNA, 17 nt, Human
gucagaauagaaauuag

SEQ ID NO: 1996558 - RNA, 21 nt, Human
gucacacaguauuacuucugc

SEQ ID NO: 1996559 - RNA, 12 nt, Human
gucacagccagg

SEQ ID NO: 1996560 - RNA, 22 nt, Human
gucacacaguauuacuucugcu

SEQ ID NO: 1996561 - RNA, 17 nt, Human
gucaguuuauguuuugg

SEQ ID NO: 1996562 - RNA, 18 nt, Human
aaauuuguuauaaugaau

SEQ ID NO: 1996563 - RNA, 19 nt, Human
aaauuuguuuaaaguauac

SEQ ID NO: 1996564 - RNA, 16 nt, Human
aaauuuuaagcuagga

SEQ ID NO: 1996565 - RNA, 17 nt, Human
gucaguauguggaagug

SEQ ID NO: 1996566 - RNA, 21 nt, Human
gucaguauguggaaguguggg

SEQ ID NO: 1996567 - RNA, 14 nt, Human
gucaguauccaggc

SEQ ID NO: 1996568 - RNA, 16 nt, Human
gucaguauccaggcuu

SEQ ID NO: 1996569 - RNA, 13 nt, Human
gucaguuguauca

SEQ ID NO: 1996570 - RNA, 16 nt, Human
gucaguuguuauuuau

SEQ ID NO: 1996571 - RNA, 15 nt, Human
gucagugugacugau

SEQ ID NO: 1996572 - RNA, 17 nt, Human
gucaguuguuauuuauu

SEQ ID NO: 1996573 - RNA, 18 nt, Human
gucaguuguuauuuauug

SEQ ID NO: 1996574 - RNA, 21 nt, Human
gucaguuguuauuuauugaaa

SEQ ID NO: 1996575 - RNA, 19 nt, Human
guauaaaagggacugagaa

SEQ ID NO: 1996576 - RNA, 20 nt, Human
guaguugaggaaagcacaga

SEQ ID NO: 1996577 - RNA, 19 nt, Human
guaguugaggaaagcacag

SEQ ID NO: 1996578 - RNA, 18 nt, Human
aaauguaacuauguuuua

SEQ ID NO: 1996579 - RNA, 18 nt, Human
aaauguaacuguuaccau

SEQ ID NO: 1996580 - RNA, 11 nt, Human
aaauguaacug

SEQ ID NO: 1996581 - RNA, 18 nt, Human
aaauguaacugugccagu

SEQ ID NO: 1996582 - RNA, 23 nt, Human
aaauguaacugugccaguucuuu

SEQ ID NO: 1996583 - RNA, 14 nt, Human
aaauguaacuguua

SEQ ID NO: 1996584 - RNA, 18 nt, Human
aaaugguauccagaaugg

SEQ ID NO: 1996585 - RNA, 22 nt, Human
guaacaggaaaauuuuaaaaau

SEQ ID NO: 1996586 - RNA, 12 nt, Human
guaacaggcaga

SEQ ID NO: 1996587 - RNA, 19 nt, Human
aaaugggggugcauuugag

SEQ ID NO: 1996588 - RNA, 14 nt, Human
guaacacaggccac

SEQ ID NO: 1996589 - RNA, 15 nt, Human
guauccaaugaaaua

SEQ ID NO: 1996590 - RNA, 15 nt, Human
guauccagaauggaa

SEQ ID NO: 1996591 - RNA, 19 nt, Human
guaucccaugagccucagc

SEQ ID NO: 1996592 - RNA, 14 nt, Human
guaucaugaagccu

SEQ ID NO: 1996593 - RNA, 22 nt, Human
guaucaggugcugccauccagg

SEQ ID NO: 1996594 - RNA, 12 nt, Human
guaugcuucaua

SEQ ID NO: 1996595 - RNA, 13 nt, Human
guaugcuucauac

SEQ ID NO: 1996596 - RNA, 14 nt, Human
guaugcuucauaca

SEQ ID NO: 1996597 - RNA, 15 nt, Human
guaugcuucauacag

SEQ ID NO: 1996598 - RNA, 21 nt, Human
guaucccaugagccucagcau

SEQ ID NO: 1996599 - RNA, 15 nt, Human
guaugcgugugugug

SEQ ID NO: 1996600 - RNA, 15 nt, Human
guaugguggcugggu

SEQ ID NO: 1996601 - RNA, 16 nt, Human
guaugguggcuggguu

SEQ ID NO: 1996602 - RNA, 21 nt, Human
guaugcuucauacagggaugg

SEQ ID NO: 1996603 - RNA, 14 nt, Human
guaugguggcuggg

SEQ ID NO: 1996604 - RNA, 13 nt, Human
guauauugguuuu

SEQ ID NO: 1996605 - RNA, 19 nt, Human
guauauugcacaauuauaa

SEQ ID NO: 1996606 - RNA, 12 nt, Human
guauaauaggcu

SEQ ID NO: 1996607 - RNA, 15 nt, Human
guauaaguggugugu

SEQ ID NO: 1996608 - RNA, 16 nt, Human
guauauuuuauaucaa

SEQ ID NO: 1996609 - RNA, 19 nt, Human
guauauugguuuuaugaug

SEQ ID NO: 1996610 - RNA, 17 nt, Human
guauauuugauuuauua

SEQ ID NO: 1996611 - RNA, 18 nt, Human
guauauuugauuuauuaa

SEQ ID NO: 1996612 - RNA, 19 nt, Human
guauauuugauuuauuaac

SEQ ID NO: 1996613 - RNA, 20 nt, Human
guauauuugauuuauuaacu

SEQ ID NO: 1996614 - RNA, 23 nt, Human
guauauuugauuuauuaacuuaa

SEQ ID NO: 1996615 - RNA, 16 nt, Human
guaucaggugcugcca

SEQ ID NO: 1996616 - RNA, 18 nt, Human
guaucaggugcugccauc

SEQ ID NO: 1996617 - RNA, 13 nt, Human
guaucaaauacau

SEQ ID NO: 1996618 - RNA, 14 nt, Human
guaucaaauacauu

SEQ ID NO: 1996619 - RNA, 17 nt, Human
gucaacacuaacaugau

SEQ ID NO: 1996620 - RNA, 21 nt, Human
gucaacaaguaugaauaaaga

SEQ ID NO: 1996621 - RNA, 15 nt, Human
gucaaacgugaaaau

SEQ ID NO: 1996622 - RNA, 17 nt, Human
gucaaacgugaaaaugc

SEQ ID NO: 1996623 - RNA, 14 nt, Human
gucaaacgugaaaa

SEQ ID NO: 1996624 - RNA, 19 nt, Human
gucaaacauuaguacuuua

SEQ ID NO: 1996625 - RNA, 11 nt, Human
gucaaacauua

SEQ ID NO: 1996626 - RNA, 17 nt, Human
gucaaacauuaguacuu

SEQ ID NO: 1996627 - RNA, 20 nt, Human
gucaaacaaacucucugaac

SEQ ID NO: 1996628 - RNA, 23 nt, Human
gucaaaaguagaacuuuguauag

SEQ ID NO: 1996629 - RNA, 16 nt, Human
gucaaaaguagaacuu

SEQ ID NO: 1996630 - RNA, 17 nt, Human
gucaaaaguagaacuuu

SEQ ID NO: 1996631 - RNA, 19 nt, Human
guauuuuuaauuaacuuug

SEQ ID NO: 1996632 - RNA, 22 nt, Human
guauuuuguuuuugucuuaaaa

SEQ ID NO: 1996633 - RNA, 21 nt, Human
aaauuuauuuacugcuagucu

SEQ ID NO: 1996634 - RNA, 12 nt, Human
aaauugugaugu

SEQ ID NO: 1996635 - RNA, 16 nt, Human
aaauugucuuaaugga

SEQ ID NO: 1996636 - RNA, 15 nt, Human
aaauugugauguguc

SEQ ID NO: 1996637 - RNA, 12 nt, Human
aaauuuauguga

SEQ ID NO: 1996638 - RNA, 23 nt, Human
aaauuguuguccgguuuacuuua

SEQ ID NO: 1996639 - RNA, 22 nt, Human
aaauuguuguccgguuuacuuu

SEQ ID NO: 1996640 - RNA, 19 nt, Human
aaauuguuacuccauauau

SEQ ID NO: 1996641 - RNA, 15 nt, Human
aaauuuaugugaugg

SEQ ID NO: 1996642 - RNA, 15 nt, Human
aaauuuauugaggaa

SEQ ID NO: 1996643 - RNA, 16 nt, Human
aaauuuauugaggaaa

SEQ ID NO: 1996644 - RNA, 19 nt, Human
aaauuuauugaggaaaaau

SEQ ID NO: 1996645 - RNA, 20 nt, Human
aaauuuauugaggaaaaaua

SEQ ID NO: 1996646 - RNA, 23 nt, Human
aaauuuauugaggaaaaauaugu

SEQ ID NO: 1996647 - RNA, 14 nt, Human
aaauuuauuuacug

SEQ ID NO: 1996648 - RNA, 19 nt, Human
aaauuuauuuacugcuagu

SEQ ID NO: 1996649 - RNA, 20 nt, Human
aaauuguaagcaugcacaaa

SEQ ID NO: 1996650 - RNA, 22 nt, Human
aaauucugauuucuuuucacca

SEQ ID NO: 1996651 - RNA, 18 nt, Human
aaauucugucucuggauu

SEQ ID NO: 1996652 - RNA, 19 nt, Human
aaauuguaagcaugcacaa

SEQ ID NO: 1996653 - RNA, 16 nt, Human
aaauucugucucugga

SEQ ID NO: 1996654 - RNA, 17 nt, Human
aaauucugauuucuuuu

SEQ ID NO: 1996655 - RNA, 20 nt, Human
aaauucugauuucuuuucac

SEQ ID NO: 1996656 - RNA, 12 nt, Human
aaauucugauuu

SEQ ID NO: 1996657 - RNA, 14 nt, Human
aaauucugauuucu

SEQ ID NO: 1996658 - RNA, 16 nt, Human
aaauucugauuucuuu

SEQ ID NO: 1996659 - RNA, 15 nt, Human
aaauguauuacagug

SEQ ID NO: 1996660 - RNA, 23 nt, Human
aaaugucaaaaguagaacuuugu

SEQ ID NO: 1996661 - RNA, 15 nt, Human
aaaugucaaauguga

SEQ ID NO: 1996662 - RNA, 20 nt, Human
aaaugucaaaaguagaacuu

SEQ ID NO: 1996663 - RNA, 11 nt, Human
guauguauaau

SEQ ID NO: 1996664 - RNA, 15 nt, Human
guauguauaauucaa

SEQ ID NO: 1996665 - RNA, 19 nt, Human
aaaugucuaguuguaacac

SEQ ID NO: 1996666 - RNA, 22 nt, Human
aaauguccaguaagaucacugu

SEQ ID NO: 1996667 - RNA, 20 nt, Human
aaaugucaugagauugcugu

SEQ ID NO: 1996668 - RNA, 21 nt, Human
aaauguccaguaagaucacug

SEQ ID NO: 1996669 - RNA, 24 nt, Human
aaaugucuaguuguaacaccauga

SEQ ID NO: 1996670 - RNA, 20 nt, Human
aaaugugagugguugaauau

SEQ ID NO: 1996671 - RNA, 22 nt, Human
aaaugugaauuacuaacuucua

SEQ ID NO: 1996672 - RNA, 23 nt, Human
aaaugugaauuacuaacuucuaa

SEQ ID NO: 1996673 - RNA, 15 nt, Human
aaaugugaauuacua

SEQ ID NO: 1996674 - RNA, 16 nt, Human
aaaugugaauuacuaa

SEQ ID NO: 1996675 - RNA, 13 nt, Human
aaauuaagaagaa

SEQ ID NO: 1996676 - RNA, 14 nt, Human
aaauuaagaagaaa

SEQ ID NO: 1996677 - RNA, 15 nt, Human
aaauuaagaagaaac

SEQ ID NO: 1996678 - RNA, 16 nt, Human
aaauuaagaagaaacu

SEQ ID NO: 1996679 - RNA, 14 nt, Human
aaauuaagaaagga

SEQ ID NO: 1996680 - RNA, 16 nt, Human
aaauguguuuuggucc

SEQ ID NO: 1996681 - RNA, 15 nt, Human
aaauguguuuugguc

SEQ ID NO: 1996682 - RNA, 12 nt, Human
aaaugugugugu

SEQ ID NO: 1996683 - RNA, 22 nt, Human
aaaugugugugaugugacauuu

SEQ ID NO: 1996684 - RNA, 23 nt, Human
aaaugugugugaugugacauuug

SEQ ID NO: 1996685 - RNA, 19 nt, Human
aaaugugugagugcaugua

SEQ ID NO: 1996686 - RNA, 15 nt, Human
aaaugugugugaugu

SEQ ID NO: 1996687 - RNA, 18 nt, Human
aaaugugugugaugugac

SEQ ID NO: 1996688 - RNA, 19 nt, Human
aaaugugugugaugugaca

SEQ ID NO: 1996689 - RNA, 20 nt, Human
aaaugugugugaugugacau

SEQ ID NO: 1996690 - RNA, 20 nt, Human
aaauuagggcucuaauuucc

SEQ ID NO: 1996691 - RNA, 21 nt, Human
aaauuagggcucuaauuuccu

SEQ ID NO: 1996692 - RNA, 18 nt, Human
aaauuagggcucuaauuu

SEQ ID NO: 1996693 - RNA, 19 nt, Human
aaauuagggcucuaauuuc

SEQ ID NO: 1996694 - RNA, 12 nt, Human
aaauuaaggugu

SEQ ID NO: 1996695 - RNA, 17 nt, Human
aaauuaagguguuugaa

SEQ ID NO: 1996696 - RNA, 19 nt, Human
aaauuaagguguuugaaaa

SEQ ID NO: 1996697 - RNA, 21 nt, Human
aaauuaagguguuugaaaaua

SEQ ID NO: 1996698 - RNA, 23 nt, Human
aaauuaagguguuugaaaauagu

SEQ ID NO: 1996699 - RNA, 15 nt, Human
aaauuaguucccauu

SEQ ID NO: 1996700 - RNA, 23 nt, Human
aaauuagggcucuaauuuccuua

SEQ ID NO: 1996701 - RNA, 18 nt, Human
aaauuauaccuguugcuu

SEQ ID NO: 1996702 - RNA, 22 nt, Human
aaauuauguuuuacuguucauu

SEQ ID NO: 1996703 - RNA, 19 nt, Human
aaauuauaauguauucaua

SEQ ID NO: 1996704 - RNA, 23 nt, Human
aaauuauaauguauucauauuug

SEQ ID NO: 1996705 - RNA, 12 nt, Human
aaauuauaaugu

SEQ ID NO: 1996706 - RNA, 14 nt, Human
aaauuauaauguau

SEQ ID NO: 1996707 - RNA, 15 nt, Human
aaauuauaauguauu

SEQ ID NO: 1996708 - RNA, 17 nt, Human
aaauuauaauguauuca

SEQ ID NO: 1996709 - RNA, 18 nt, Human
aacucuccuccagaguca

SEQ ID NO: 1996710 - RNA, 15 nt, Human
aacucuccuccagag

SEQ ID NO: 1996711 - RNA, 16 nt, Human
aacucuccucugcugc

SEQ ID NO: 1996712 - RNA, 17 nt, Human
aacucuccucugcugcu

SEQ ID NO: 1996713 - RNA, 24 nt, Human
aacucuauggucuuauauuuacaa

SEQ ID NO: 1996714 - RNA, 14 nt, Human
aacucuauuuagau

SEQ ID NO: 1996715 - RNA, 22 nt, Human
gugaaccaccacacccagccca

SEQ ID NO: 1996716 - RNA, 23 nt, Human
gugaaccaccacacccagcccac

SEQ ID NO: 1996717 - RNA, 12 nt, Human
aacuccuggccu

SEQ ID NO: 1996718 - RNA, 22 nt, Human
aacucaucuagguaaauuacag

SEQ ID NO: 1996719 - RNA, 20 nt, Human
aacucaucuggaguucucaa

SEQ ID NO: 1996720 - RNA, 20 nt, Human
aacucauugcaucauuuaca

SEQ ID NO: 1996721 - RNA, 17 nt, Human
aacucauuuugcuugug

SEQ ID NO: 1996722 - RNA, 21 nt, Human
aacucgguguccccaccaucu

SEQ ID NO: 1996723 - RNA, 22 nt, Human
aacucgguguccccaccaucug

SEQ ID NO: 1996724 - RNA, 23 nt, Human
aacucgguguccccaccaucugc

SEQ ID NO: 1996725 - RNA, 24 nt, Human
aacucgguguccccaccaucugcu

SEQ ID NO: 1996726 - RNA, 16 nt, Human
aacucgguguccccac

SEQ ID NO: 1996727 - RNA, 17 nt, Human
aacucgguguccccacc

SEQ ID NO: 1996728 - RNA, 18 nt, Human
aacucgguguccccacca

SEQ ID NO: 1996729 - RNA, 19 nt, Human
aacucgguguccccaccau

SEQ ID NO: 1996730 - RNA, 16 nt, Human
aacuaugauuuggaaa

SEQ ID NO: 1996731 - RNA, 21 nt, Human
aacuaugauuuggaaaauaaa

SEQ ID NO: 1996732 - RNA, 13 nt, Human
aacuaucuucauc

SEQ ID NO: 1996733 - RNA, 23 nt, Human
aacuagacucccaagcuggacua

SEQ ID NO: 1996734 - RNA, 20 nt, Human
aacuagacucccaagcugga

SEQ ID NO: 1996735 - RNA, 19 nt, Human
aaccuuggcuuggcccugg

SEQ ID NO: 1996736 - RNA, 20 nt, Human
aacuacuaccuguaaugaca

SEQ ID NO: 1996737 - RNA, 18 nt, Human
aaccuugaaaacuuuaug

SEQ ID NO: 1996738 - RNA, 12 nt, Human
aaccugugucuc

SEQ ID NO: 1996739 - RNA, 11 nt, Human
aaccugucuga

SEQ ID NO: 1996740 - RNA, 14 nt, Human
aaccugucuuuugg

SEQ ID NO: 1996741 - RNA, 16 nt, Human
aaccugucuuuuggga

SEQ ID NO: 1996742 - RNA, 18 nt, Human
aaccugugagcugcacca

SEQ ID NO: 1996743 - RNA, 15 nt, Human
aaccuguccuaagga

SEQ ID NO: 1996744 - RNA, 23 nt, Human
aaccuguccuaaggaaccuuccu

SEQ ID NO: 1996745 - RNA, 16 nt, Human
gucuuuugguuaugaa

SEQ ID NO: 1996746 - RNA, 17 nt, Human
gucuucuauuuauuuau

SEQ ID NO: 1996747 - RNA, 12 nt, Human
gucuucuauuua

SEQ ID NO: 1996748 - RNA, 14 nt, Human
gucuucuauuuauu

SEQ ID NO: 1996749 - RNA, 18 nt, Human
gucuuuggacccugaggc

SEQ ID NO: 1996750 - RNA, 16 nt, Human
gucuuucacauuuaaa

SEQ ID NO: 1996751 - RNA, 20 nt, Human
aaccugagccccaaaaggua

SEQ ID NO: 1996752 - RNA, 13 nt, Human
gucuggcacagcc

SEQ ID NO: 1996753 - RNA, 16 nt, Human
gucuggcacagccugc

SEQ ID NO: 1996754 - RNA, 17 nt, Human
gucuggcacagccugca

SEQ ID NO: 1996755 - RNA, 14 nt, Human
gucuggcccuuccu

SEQ ID NO: 1996756 - RNA, 19 nt, Human
gucugucccaguuaacugu

SEQ ID NO: 1996757 - RNA, 23 nt, Human
aacccaaauguucaucaaugaau

SEQ ID NO: 1996758 - RNA, 19 nt, Human
aaccauuugaaaccccugu

SEQ ID NO: 1996759 - RNA, 19 nt, Human
aaccauuuaucuugaagga

SEQ ID NO: 1996760 - RNA, 13 nt, Human
aaccauuuaucuu

SEQ ID NO: 1996761 - RNA, 15 nt, Human
aaccauuuaucuuga

SEQ ID NO: 1996762 - RNA, 12 nt, Human
aaccauuuaucu

SEQ ID NO: 1996763 - RNA, 23 nt, Human
aaccauuguucugacacgacuuc

SEQ ID NO: 1996764 - RNA, 15 nt, Human
aacccacccuuucua

SEQ ID NO: 1996765 - RNA, 13 nt, Human
aacccaauaguug

SEQ ID NO: 1996766 - RNA, 18 nt, Human
aaccaucauugaaaucuu

SEQ ID NO: 1996767 - RNA, 17 nt, Human
aaccaucauugaaaucu

SEQ ID NO: 1996768 - RNA, 23 nt, Human
aaccauaguuacuguaaaaugca

SEQ ID NO: 1996769 - RNA, 12 nt, Human
aaccaucauuga

SEQ ID NO: 1996770 - RNA, 23 nt, Human
aaccaagguagaaugaccuugua

SEQ ID NO: 1996771 - RNA, 16 nt, Human
aaccauaguuacugua

SEQ ID NO: 1996772 - RNA, 17 nt, Human
aaccauaguuacuguaa

SEQ ID NO: 1996773 - RNA, 18 nt, Human
aaccauaguuacuguaaa

SEQ ID NO: 1996774 - RNA, 20 nt, Human
aaccauaguuacuguaaaau

SEQ ID NO: 1996775 - RNA, 14 nt, Human
aaccaccagaagcc

SEQ ID NO: 1996776 - RNA, 17 nt, Human
aaccaccagaagcccag

SEQ ID NO: 1996777 - RNA, 21 nt, Human
aaccaccacacccagcccacu

SEQ ID NO: 1996778 - RNA, 18 nt, Human
gucuccgaaaugcugucu

SEQ ID NO: 1996779 - RNA, 20 nt, Human
gucuccgaaaugcugucuuu

SEQ ID NO: 1996780 - RNA, 16 nt, Human
gucuccgaaaugcugu

SEQ ID NO: 1996781 - RNA, 20 nt, Human
aaccacauuggagauguuua

SEQ ID NO: 1996782 - RNA, 19 nt, Human
aaccaccacacccagccca

SEQ ID NO: 1996783 - RNA, 15 nt, Human
aaccaagucaaguga

SEQ ID NO: 1996784 - RNA, 20 nt, Human
aaccaagguagaaugaccuu

SEQ ID NO: 1996785 - RNA, 22 nt, Human
aaccaagguagaaugaccuugu

SEQ ID NO: 1996786 - RNA, 13 nt, Human
gucucgaacuccu

SEQ ID NO: 1996787 - RNA, 18 nt, Human
gucucgaacuccugaccu

SEQ ID NO: 1996788 - RNA, 19 nt, Human
gucucgaacuccugaccuu

SEQ ID NO: 1996789 - RNA, 16 nt, Human
aaccaagccguggcuu

SEQ ID NO: 1996790 - RNA, 18 nt, Human
aaccaagccguggcuucc

SEQ ID NO: 1996791 - RNA, 16 nt, Human
aacccgggaggcagag

SEQ ID NO: 1996792 - RNA, 17 nt, Human
aaccccuguaggccuca

SEQ ID NO: 1996793 - RNA, 12 nt, Human
aaccccuuccca

SEQ ID NO: 1996794 - RNA, 18 nt, Human
aaccugagccccaaaagg

SEQ ID NO: 1996795 - RNA, 11 nt, Human
aaccugacccc

SEQ ID NO: 1996796 - RNA, 12 nt, Human
aaccucuaaauu

SEQ ID NO: 1996797 - RNA, 17 nt, Human
aaccucgcuccaacucc

SEQ ID NO: 1996798 - RNA, 10 nt, Human
aacccagcuc

SEQ ID NO: 1996799 - RNA, 17 nt, Human
aaccccauaccuacauu

SEQ ID NO: 1996800 - RNA, 14 nt, Human
aacccagauaaagg

SEQ ID NO: 1996801 - RNA, 17 nt, Human
aaccccccauuucuucc

SEQ ID NO: 1996802 - RNA, 20 nt, Human
aaccccuggcuccaggccag

SEQ ID NO: 1996803 - RNA, 20 nt, Human
aaccccucgcccagucccag

SEQ ID NO: 1996804 - RNA, 23 nt, Human
aaccccucgcccagucccagcag

SEQ ID NO: 1996805 - RNA, 16 nt, Human
aaccccuggaccccag

SEQ ID NO: 1996806 - RNA, 20 nt, Human
aaccccuggaccccagccuc

SEQ ID NO: 1996807 - RNA, 12 nt, Human
aaccccucgccc

SEQ ID NO: 1996808 - RNA, 15 nt, Human
aaccccucgcccagu

SEQ ID NO: 1996809 - RNA, 16 nt, Human
aaccccucgcccaguc

SEQ ID NO: 1996810 - RNA, 13 nt, Human
aacugaaagugaa

SEQ ID NO: 1996811 - RNA, 16 nt, Human
aacucuguuacacuuu

SEQ ID NO: 1996812 - RNA, 23 nt, Human
aacucuguuacacuuuuuggaag

SEQ ID NO: 1996813 - RNA, 22 nt, Human
aacucuguuacacuuuuuggaa

SEQ ID NO: 1996814 - RNA, 23 nt, Human
aacucugagagauuuggggcuaa

SEQ ID NO: 1996815 - RNA, 21 nt, Human
aacucuucaaucucuugcacu

SEQ ID NO: 1996816 - RNA, 21 nt, Human
gugagguggaauuauuuuaaa

SEQ ID NO: 1996817 - RNA, 22 nt, Human
gugagucgaggacagggaggug

SEQ ID NO: 1996818 - RNA, 22 nt, Human
aacucugacaacagacuucuga

SEQ ID NO: 1996819 - RNA, 23 nt, Human
aacucugacaacagacuucugaa

SEQ ID NO: 1996820 - RNA, 20 nt, Human
aacucugacaacagacuucu

SEQ ID NO: 1996821 - RNA, 22 nt, Human
gugaggccagagacacaagccu

SEQ ID NO: 1996822 - RNA, 17 nt, Human
gugaggccagagacaca

SEQ ID NO: 1996823 - RNA, 18 nt, Human
gugaggguaaguauuuuc

SEQ ID NO: 1996824 - RNA, 21 nt, Human
gugaacuuggugccuaauguu

SEQ ID NO: 1996825 - RNA, 14 nt, Human
gugaacuuggaagc

SEQ ID NO: 1996826 - RNA, 21 nt, Human
gugagaugcuagaacucccuu

SEQ ID NO: 1996827 - RNA, 19 nt, Human
gugaacuugggccacugug

SEQ ID NO: 1996828 - RNA, 17 nt, Human
gugaacuugggccacug

SEQ ID NO: 1996829 - RNA, 16 nt, Human
aacugcacaugauuuc

SEQ ID NO: 1996830 - RNA, 17 nt, Human
aacugcacaugauuuca

SEQ ID NO: 1996831 - RNA, 18 nt, Human
aacugcacaugauuucac

SEQ ID NO: 1996832 - RNA, 19 nt, Human
aacugcacaugauuucaca

SEQ ID NO: 1996833 - RNA, 23 nt, Human
aacugcacaugauuucacaaaua

SEQ ID NO: 1996834 - RNA, 20 nt, Human
aacugcacaugauuucacaa

SEQ ID NO: 1996835 - RNA, 21 nt, Human
aacugcacaugauuucacaaa

SEQ ID NO: 1996836 - RNA, 15 nt, Human
aacugcugacuguuu

SEQ ID NO: 1996837 - RNA, 19 nt, Human
aacugcucuugggcaauau

SEQ ID NO: 1996838 - RNA, 20 nt, Human
aacugcucuugggcaauauu

SEQ ID NO: 1996839 - RNA, 22 nt, Human
aacugcucuugggcaauauucu

SEQ ID NO: 1996840 - RNA, 23 nt, Human
aacugcucuugggcaauauucuc

SEQ ID NO: 1996841 - RNA, 21 nt, Human
aacugcugacuguuuucucuu

SEQ ID NO: 1996842 - RNA, 20 nt, Human
aacugcugacuguuuucucu

SEQ ID NO: 1996843 - RNA, 23 nt, Human
aacugcugacuguuuucucuuga

SEQ ID NO: 1996844 - RNA, 18 nt, Human
aacugcuuccuauaauuu

SEQ ID NO: 1996845 - RNA, 22 nt, Human
aacugcuuccuauaauuuugau

SEQ ID NO: 1996846 - RNA, 23 nt, Human
aacugcuuccuauaauuuugaua

SEQ ID NO: 1996847 - RNA, 19 nt, Human
aacugcuuccuuucuugau

SEQ ID NO: 1996848 - RNA, 15 nt, Human
aacugcuuucuuucg

SEQ ID NO: 1996849 - RNA, 21 nt, Human
aacugcuuucuuucguuuguu

SEQ ID NO: 1996850 - RNA, 19 nt, Human
aacuggaaauacuagauuu

SEQ ID NO: 1996851 - RNA, 16 nt, Human
aacuggauuaaacuua

SEQ ID NO: 1996852 - RNA, 11 nt, Human
aacuggcugca

SEQ ID NO: 1996853 - RNA, 15 nt, Human
aacuggauuaaacuu

SEQ ID NO: 1996854 - RNA, 21 nt, Human
aacugggggagggugaaguga

SEQ ID NO: 1996855 - RNA, 22 nt, Human
aacugggggagggugaagugaa

SEQ ID NO: 1996856 - RNA, 16 nt, Human
aacuggguacuugugg

SEQ ID NO: 1996857 - RNA, 21 nt, Human
aacuggguacuuguggacaca

SEQ ID NO: 1996858 - RNA, 19 nt, Human
aacugggcauauuucuaau

SEQ ID NO: 1996859 - RNA, 12 nt, Human
gugcaagagagg

SEQ ID NO: 1996860 - RNA, 15 nt, Human
gugcaagccccugcu

SEQ ID NO: 1996861 - RNA, 22 nt, Human
gugcaaugaccuuucaauagga

SEQ ID NO: 1996862 - RNA, 19 nt, Human
gugauggggcccugccucc

SEQ ID NO: 1996863 - RNA, 14 nt, Human
gugaugguuccccu

SEQ ID NO: 1996864 - RNA, 16 nt, Human
gugaugguuccccugu

SEQ ID NO: 1996865 - RNA, 22 nt, Human
gugaugguuccccuguucacuc

SEQ ID NO: 1996866 - RNA, 21 nt, Human
gugcacacaccagagcccacc

SEQ ID NO: 1996867 - RNA, 22 nt, Human
gugcaugcugucccuuacguga

SEQ ID NO: 1996868 - RNA, 17 nt, Human
gugcacaucuguuuugu

SEQ ID NO: 1996869 - RNA, 13 nt, Human
gugcacaggcaga

SEQ ID NO: 1996870 - RNA, 12 nt, Human
gugcacaggcag

SEQ ID NO: 1996871 - RNA, 12 nt, Human
gugccucugccu

SEQ ID NO: 1996872 - RNA, 16 nt, Human
gugccucugcaguacu

SEQ ID NO: 1996873 - RNA, 13 nt, Human
gugccucuagcug

SEQ ID NO: 1996874 - RNA, 14 nt, Human
gugccucuagcuga

SEQ ID NO: 1996875 - RNA, 15 nt, Human
gugccucuagcugaa

SEQ ID NO: 1996876 - RNA, 16 nt, Human
gugccucuagcugaau

SEQ ID NO: 1996877 - RNA, 23 nt, Human
gugcauuaucuagauacuguauc

SEQ ID NO: 1996878 - RNA, 15 nt, Human
gugccacauuuucuu

SEQ ID NO: 1996879 - RNA, 15 nt, Human
gugcauuaucuagau

SEQ ID NO: 1996880 - RNA, 19 nt, Human
gugcauuaucuagauacug

SEQ ID NO: 1996881 - RNA, 19 nt, Human
gugcauguguguucaugca

SEQ ID NO: 1996882 - RNA, 20 nt, Human
aacugguuauuuaaaaugua

SEQ ID NO: 1996883 - RNA, 15 nt, Human
aacuguaaaauacuu

SEQ ID NO: 1996884 - RNA, 15 nt, Human
aacuguaauuauuug

SEQ ID NO: 1996885 - RNA, 18 nt, Human
aacuguaauuauuugaau

SEQ ID NO: 1996886 - RNA, 20 nt, Human
aacuguaauuauuugaauga

SEQ ID NO: 1996887 - RNA, 14 nt, Human
aacuggugauauau

SEQ ID NO: 1996888 - RNA, 13 nt, Human
aacuguacuuuga

SEQ ID NO: 1996889 - RNA, 20 nt, Human
aacuguacuuugauucacau

SEQ ID NO: 1996890 - RNA, 22 nt, Human
aacuguacuuugauucacaugu

SEQ ID NO: 1996891 - RNA, 15 nt, Human
aacuguacuuugauu

SEQ ID NO: 1996892 - RNA, 17 nt, Human
aacuguacuuugauuca

SEQ ID NO: 1996893 - RNA, 18 nt, Human
aacuguacuuugauucac

SEQ ID NO: 1996894 - RNA, 19 nt, Human
aacuguacuuugauucaca

SEQ ID NO: 1996895 - RNA, 13 nt, Human
aacuuccaauuua

SEQ ID NO: 1996896 - RNA, 16 nt, Human
aacuucaucugucugu

SEQ ID NO: 1996897 - RNA, 12 nt, Human
aacuucaggaaa

SEQ ID NO: 1996898 - RNA, 16 nt, Human
aacuuccccauacaaa

SEQ ID NO: 1996899 - RNA, 23 nt, Human
aacuuccccauacaaauaagcau

SEQ ID NO: 1996900 - RNA, 14 nt, Human
gugaugagaggaaa

SEQ ID NO: 1996901 - RNA, 16 nt, Human
gugaugagaggaaauc

SEQ ID NO: 1996902 - RNA, 18 nt, Human
gugauggggcccugccuc

SEQ ID NO: 1996903 - RNA, 17 nt, Human
gugauggggcccugccu

SEQ ID NO: 1996904 - RNA, 16 nt, Human
gugauggggcccugcc

SEQ ID NO: 1996905 - RNA, 14 nt, Human
gugauggggcccug

SEQ ID NO: 1996906 - RNA, 22 nt, Human
gugaugcgcaugucacggaggg

SEQ ID NO: 1996907 - RNA, 17 nt, Human
gugaugcgcaguugcug

SEQ ID NO: 1996908 - RNA, 15 nt, Human
gugaugcgcaguugc

SEQ ID NO: 1996909 - RNA, 19 nt, Human
gugauggcgaaagagggua

SEQ ID NO: 1996910 - RNA, 13 nt, Human
cacaggaaaccag

SEQ ID NO: 1996911 - RNA, 16 nt, Human
cacaggcccuuccucu

SEQ ID NO: 1996912 - RNA, 17 nt, Human
cacaggcccuuccucuc

SEQ ID NO: 1996913 - RNA, 18 nt, Human
cacaggcccuuccucucc

SEQ ID NO: 1996914 - RNA, 19 nt, Human
cacaggcccuuccucucca

SEQ ID NO: 1996915 - RNA, 22 nt, Human
cacagcugcucaauaaaguaca

SEQ ID NO: 1996916 - RNA, 18 nt, Human
cacagcugcucugugacc

SEQ ID NO: 1996917 - RNA, 12 nt, Human
cacagcugcuca

SEQ ID NO: 1996918 - RNA, 21 nt, Human
cacaggcccuuccucuccacu

SEQ ID NO: 1996919 - RNA, 17 nt, Human
cacagugcaucucagcc

SEQ ID NO: 1996920 - RNA, 18 nt, Human
cacagugcaucucagccc

SEQ ID NO: 1996921 - RNA, 19 nt, Human
cacagugcaucucagccca

SEQ ID NO: 1996922 - RNA, 17 nt, Human
cacaguucaauucucau

SEQ ID NO: 1996923 - RNA, 13 nt, Human
cacaguuauuaca

SEQ ID NO: 1996924 - RNA, 15 nt, Human
cacaguuauuacaua

SEQ ID NO: 1996925 - RNA, 18 nt, Human
caauaggaaaaacugauu

SEQ ID NO: 1996926 - RNA, 18 nt, Human
caauaauaauaccucccu

SEQ ID NO: 1996927 - RNA, 14 nt, Human
caauaccccaugga

SEQ ID NO: 1996928 - RNA, 18 nt, Human
caauaagaacaaauacaa

SEQ ID NO: 1996929 - RNA, 22 nt, Human
caauaaauuuugaaaaguaaua

SEQ ID NO: 1996930 - RNA, 17 nt, Human
caauaggaaaaacugau

SEQ ID NO: 1996931 - RNA, 16 nt, Human
caauaggaaaaacuga

SEQ ID NO: 1996932 - RNA, 15 nt, Human
caauaggaaaaacug

SEQ ID NO: 1996933 - RNA, 18 nt, Human
caauagcauuagaaauaa

SEQ ID NO: 1996934 - RNA, 18 nt, Human
caaggcugggggaagaag

SEQ ID NO: 1996935 - RNA, 20 nt, Human
caaggcuugcugcagauacu

SEQ ID NO: 1996936 - RNA, 15 nt, Human
caaggcuugcugcag

SEQ ID NO: 1996937 - RNA, 16 nt, Human
caaggcuugcugcaga

SEQ ID NO: 1996938 - RNA, 19 nt, Human
caaggguagggugggccuu

SEQ ID NO: 1996939 - RNA, 21 nt, Human
caagggaaaauaaaaaaagaa

SEQ ID NO: 1996940 - RNA, 23 nt, Human
caagggaaaauaaaaaaagaaaa

SEQ ID NO: 1996941 - RNA, 23 nt, Human
caauaaaguuugaucuuccucug

SEQ ID NO: 1996942 - RNA, 11 nt, Human
caauaaauuuu

SEQ ID NO: 1996943 - RNA, 13 nt, Human
caauaaauuuuga

SEQ ID NO: 1996944 - RNA, 14 nt, Human
caauaaauuuugaa

SEQ ID NO: 1996945 - RNA, 15 nt, Human
caauaaauuuugaaa

SEQ ID NO: 1996946 - RNA, 16 nt, Human
caauaaauuuugaaaa

SEQ ID NO: 1996947 - RNA, 17 nt, Human
caauaaauuuugaaaag

SEQ ID NO: 1996948 - RNA, 18 nt, Human
caauaaauuuugaaaagu

SEQ ID NO: 1996949 - RNA, 19 nt, Human
caauaaaguugagcaaaca

SEQ ID NO: 1996950 - RNA, 13 nt, Human
caauaaaguuuga

SEQ ID NO: 1996951 - RNA, 20 nt, Human
caauaaaguuugaucuuccu

SEQ ID NO: 1996952 - RNA, 21 nt, Human
caauaaaguuugaucuuccuc

SEQ ID NO: 1996953 - RNA, 14 nt, Human
caauaaaguuugau

SEQ ID NO: 1996954 - RNA, 18 nt, Human
caauaaaguuugaucuuc

SEQ ID NO: 1996955 - RNA, 15 nt, Human
caagccuggucagcc

SEQ ID NO: 1996956 - RNA, 16 nt, Human
caagccuggucagccc

SEQ ID NO: 1996957 - RNA, 17 nt, Human
caagccuggucagccca

SEQ ID NO: 1996958 - RNA, 18 nt, Human
caagccuggucagcccaa

SEQ ID NO: 1996959 - RNA, 17 nt, Human
caagccuuggcucuacc

SEQ ID NO: 1996960 - RNA, 12 nt, Human
caagccugguca

SEQ ID NO: 1996961 - RNA, 15 nt, Human
caagauaccuuuuuu

SEQ ID NO: 1996962 - RNA, 14 nt, Human
caagaggcugcagc

SEQ ID NO: 1996963 - RNA, 16 nt, Human
caagagucuggggacc

SEQ ID NO: 1996964 - RNA, 14 nt, Human
caagaguggcccca

SEQ ID NO: 1996965 - RNA, 15 nt, Human
caagaguggccccac

SEQ ID NO: 1996966 - RNA, 16 nt, Human
caagaguggccccacc

SEQ ID NO: 1996967 - RNA, 17 nt, Human
caagaguggccccaccu

SEQ ID NO: 1996968 - RNA, 18 nt, Human
caagaguggccccaccug

SEQ ID NO: 1996969 - RNA, 19 nt, Human
caagaguggccccaccugg

SEQ ID NO: 1996970 - RNA, 20 nt, Human
caagaguggccccaccuggc

SEQ ID NO: 1996971 - RNA, 21 nt, Human
caagaguggccccaccuggcc

SEQ ID NO: 1996972 - RNA, 22 nt, Human
caagaguggccccaccuggccc

SEQ ID NO: 1996973 - RNA, 23 nt, Human
caagaguggccccaccuggcccu

SEQ ID NO: 1996974 - RNA, 22 nt, Human
caagcugcacccucaggcaggu

SEQ ID NO: 1996975 - RNA, 17 nt, Human
caagcgauucucuugcc

SEQ ID NO: 1996976 - RNA, 21 nt, Human
caagcuggucccacucagucc

SEQ ID NO: 1996977 - RNA, 15 nt, Human
caagcgauucuucug

SEQ ID NO: 1996978 - RNA, 17 nt, Human
caagcgauucuucugcu

SEQ ID NO: 1996979 - RNA, 21 nt, Human
caagcugcacccucaggcagg

SEQ ID NO: 1996980 - RNA, 18 nt, Human
caagcgauucuucugcuu

SEQ ID NO: 1996981 - RNA, 22 nt, Human
caaggcugcagugagccgagau

SEQ ID NO: 1996982 - RNA, 17 nt, Human
caaggcugcagugagcc

SEQ ID NO: 1996983 - RNA, 20 nt, Human
caaggauccugagccagauu

SEQ ID NO: 1996984 - RNA, 22 nt, Human
caaggauccugagccagauuuc

SEQ ID NO: 1996985 - RNA, 19 nt, Human
caaggauccugagccagau

SEQ ID NO: 1996986 - RNA, 18 nt, Human
caaggauccugagccaga

SEQ ID NO: 1996987 - RNA, 16 nt, Human
caaggagauuuacaac

SEQ ID NO: 1996988 - RNA, 22 nt, Human
caagcuggucccacucagucca

SEQ ID NO: 1996989 - RNA, 23 nt, Human
caagcuggucccacucaguccau

SEQ ID NO: 1996990 - RNA, 18 nt, Human
caaggaaaaaauaacaau

SEQ ID NO: 1996991 - RNA, 20 nt, Human
caaggaaaaaauaacaauga

SEQ ID NO: 1996992 - RNA, 15 nt, Human
caagcuuuuccuaau

SEQ ID NO: 1996993 - RNA, 16 nt, Human
cacagauuugagcuca

SEQ ID NO: 1996994 - RNA, 17 nt, Human
cacagauuugagcucag

SEQ ID NO: 1996995 - RNA, 18 nt, Human
cacagauuugagcucagc

SEQ ID NO: 1996996 - RNA, 22 nt, Human
cacagauuugagcucagcccug

SEQ ID NO: 1996997 - RNA, 14 nt, Human
cacagcugagaggc

SEQ ID NO: 1996998 - RNA, 13 nt, Human
cacagaggcugcc

SEQ ID NO: 1996999 - RNA, 15 nt, Human
cacagaggacacaga

SEQ ID NO: 1997000 - RNA, 19 nt, Human
cacagaggacacagagaag

SEQ ID NO: 1997001 - RNA, 22 nt, Human
cacagaguuguuacauuuuuaa

SEQ ID NO: 1997002 - RNA, 21 nt, Human
cacagaguuguuacauuuuua

SEQ ID NO: 1997003 - RNA, 23 nt, Human
cacagaugggugcuuggaggaag

SEQ ID NO: 1997004 - RNA, 19 nt, Human
cacagagaaaguacuucuc

SEQ ID NO: 1997005 - RNA, 20 nt, Human
cacagagaaaguacuucucc

SEQ ID NO: 1997006 - RNA, 21 nt, Human
cacagagaaaguacuucucca

SEQ ID NO: 1997007 - RNA, 21 nt, Human
cacacucccgagacggcacug

SEQ ID NO: 1997008 - RNA, 12 nt, Human
cacagagaaagu

SEQ ID NO: 1997009 - RNA, 14 nt, Human
cacacuccagcugg

SEQ ID NO: 1997010 - RNA, 20 nt, Human
caauuuuuuaagugaaaaua

SEQ ID NO: 1997011 - RNA, 21 nt, Human
caauuuuuuaagugaaaauau

SEQ ID NO: 1997012 - RNA, 18 nt, Human
caauuuuugguugaauaa

SEQ ID NO: 1997013 - RNA, 19 nt, Human
caauuuuugguugaauaaa

SEQ ID NO: 1997014 - RNA, 14 nt, Human
cacaaacagaggcc

SEQ ID NO: 1997015 - RNA, 15 nt, Human
cacaaacagaggccg

SEQ ID NO: 1997016 - RNA, 18 nt, Human
cacaaagcccuuccaugu

SEQ ID NO: 1997017 - RNA, 13 nt, Human
cacaaacagaggc

SEQ ID NO: 1997018 - RNA, 18 nt, Human
caauucccaccuaugagu

SEQ ID NO: 1997019 - RNA, 22 nt, Human
caauuccaugacaauaugcccu

SEQ ID NO: 1997020 - RNA, 15 nt, Human
caauuacauguuugg

SEQ ID NO: 1997021 - RNA, 18 nt, Human
caauuacaggaaguacug

SEQ ID NO: 1997022 - RNA, 15 nt, Human
caauuacuuuagaaa

SEQ ID NO: 1997023 - RNA, 17 nt, Human
caauuacuuuagaaaau

SEQ ID NO: 1997024 - RNA, 22 nt, Human
caaugugacuuaaugccacuaa

SEQ ID NO: 1997025 - RNA, 22 nt, Human
caauaucuugcuugaacuuaca

SEQ ID NO: 1997026 - RNA, 16 nt, Human
caauaucuugcuugaa

SEQ ID NO: 1997027 - RNA, 19 nt, Human
caauaucuugcuugaacuu

SEQ ID NO: 1997028 - RNA, 22 nt, Human
caaugugaaaagaaaaaugagc

SEQ ID NO: 1997029 - RNA, 21 nt, Human
caauaucuuuuuuuuaauaaa

SEQ ID NO: 1997030 - RNA, 15 nt, Human
caauaucuugcuuga

SEQ ID NO: 1997031 - RNA, 22 nt, Human
caaugugugccgagcccuugcc

SEQ ID NO: 1997032 - RNA, 23 nt, Human
caaugugugccgagcccuugccc

SEQ ID NO: 1997033 - RNA, 15 nt, Human
caauguuaaauuaau

SEQ ID NO: 1997034 - RNA, 17 nt, Human
caauuacaggaaguacu

SEQ ID NO: 1997035 - RNA, 11 nt, Human
caauguuuaca

SEQ ID NO: 1997036 - RNA, 20 nt, Human
caauguuaaauuaauuauaa

SEQ ID NO: 1997037 - RNA, 17 nt, Human
cacacacgcgugcacac

SEQ ID NO: 1997038 - RNA, 22 nt, Human
cacaaucaccgaugcaaacauu

SEQ ID NO: 1997039 - RNA, 12 nt, Human
cacacaaagcag

SEQ ID NO: 1997040 - RNA, 15 nt, Human
cacacaaaaaaagac

SEQ ID NO: 1997041 - RNA, 19 nt, Human
cacacaaaaaaagaccugu

SEQ ID NO: 1997042 - RNA, 11 nt, Human
cacaauuccau

SEQ ID NO: 1997043 - RNA, 22 nt, Human
cacaauugaauuaguuuuuucu

SEQ ID NO: 1997044 - RNA, 13 nt, Human
cacacaaaaaaag

SEQ ID NO: 1997045 - RNA, 20 nt, Human
cacaagaaaugaaagcaggg

SEQ ID NO: 1997046 - RNA, 21 nt, Human
cacaagaaaugaaagcaggga

SEQ ID NO: 1997047 - RNA, 13 nt, Human
cacaaaggagagc

SEQ ID NO: 1997048 - RNA, 18 nt, Human
cacaagaaaugaaagcag

SEQ ID NO: 1997049 - RNA, 13 nt, Human
caacaggcugggc

SEQ ID NO: 1997050 - RNA, 15 nt, Human
caaaccuuuaacuaa

SEQ ID NO: 1997051 - RNA, 12 nt, Human
caaaccuuuccc

SEQ ID NO: 1997052 - RNA, 13 nt, Human
caaaccuuucccc

SEQ ID NO: 1997053 - RNA, 19 nt, Human
caaaccuuucuauaauuuu

SEQ ID NO: 1997054 - RNA, 20 nt, Human
caaaccuuucuauaauuuua

SEQ ID NO: 1997055 - RNA, 13 nt, Human
caaaccugugaag

SEQ ID NO: 1997056 - RNA, 14 nt, Human
caaacucucugaac

SEQ ID NO: 1997057 - RNA, 22 nt, Human
caaaccuuucuauaauuuuaca

SEQ ID NO: 1997058 - RNA, 17 nt, Human
caaacucuugaccucag

SEQ ID NO: 1997059 - RNA, 19 nt, Human
caaacucuugaccucaggu

SEQ ID NO: 1997060 - RNA, 20 nt, Human
caaacucuugaccucaggug

SEQ ID NO: 1997061 - RNA, 21 nt, Human
caaacucuugaccucagguga

SEQ ID NO: 1997062 - RNA, 16 nt, Human
caaacugaaaagcuga

SEQ ID NO: 1997063 - RNA, 22 nt, Human
caaaaugaaacgcaaccaccac

SEQ ID NO: 1997064 - RNA, 11 nt, Human
caaaaugaaac

SEQ ID NO: 1997065 - RNA, 21 nt, Human
caaaaugagcccuguccugcc

SEQ ID NO: 1997066 - RNA, 21 nt, Human
caaacaaaagcugaacacauu

SEQ ID NO: 1997067 - RNA, 16 nt, Human
caaacaagcauauaaa

SEQ ID NO: 1997068 - RNA, 18 nt, Human
caaacaagcauauaaaau

SEQ ID NO: 1997069 - RNA, 20 nt, Human
caaacaagcauauaaaaugg

SEQ ID NO: 1997070 - RNA, 21 nt, Human
caaacacuugugacuuuugcu

SEQ ID NO: 1997071 - RNA, 15 nt, Human
caaacagaggccgcc

SEQ ID NO: 1997072 - RNA, 13 nt, Human
caaacagaggccg

SEQ ID NO: 1997073 - RNA, 21 nt, Human
caaaacgguuuuacugcagcu

SEQ ID NO: 1997074 - RNA, 15 nt, Human
caaaacgguuuuacu

SEQ ID NO: 1997075 - RNA, 18 nt, Human
auuuuauuuuauuaugca

SEQ ID NO: 1997076 - RNA, 22 nt, Human
auuuuauuuugaaauggaaauu

SEQ ID NO: 1997077 - RNA, 23 nt, Human
auuuuauuuugaaauggaaauua

SEQ ID NO: 1997078 - RNA, 16 nt, Human
caaaacucuccucugc

SEQ ID NO: 1997079 - RNA, 15 nt, Human
caaaacucuccucug

SEQ ID NO: 1997080 - RNA, 19 nt, Human
caaaacucuccucugcugc

SEQ ID NO: 1997081 - RNA, 23 nt, Human
caaaacucuccucugcugcuggc

SEQ ID NO: 1997082 - RNA, 12 nt, Human
caaaaguuauua

SEQ ID NO: 1997083 - RNA, 16 nt, Human
caaaaguuauuaaaau

SEQ ID NO: 1997084 - RNA, 18 nt, Human
caaaaguuauuaaaauug

SEQ ID NO: 1997085 - RNA, 22 nt, Human
caaaaguuauuaaaauuguugu

SEQ ID NO: 1997086 - RNA, 14 nt, Human
caaaaguuucucuu

SEQ ID NO: 1997087 - RNA, 18 nt, Human
caaaaguuuguuugcuua

SEQ ID NO: 1997088 - RNA, 16 nt, Human
caaaauaaaacuuuuu

SEQ ID NO: 1997089 - RNA, 20 nt, Human
caaaauaaaacuuuuuaaaa

SEQ ID NO: 1997090 - RNA, 14 nt, Human
caaaauaagaaaag

SEQ ID NO: 1997091 - RNA, 15 nt, Human
caaaauaagaaaaga

SEQ ID NO: 1997092 - RNA, 20 nt, Human
caaaauacauucuuuuugcu

SEQ ID NO: 1997093 - RNA, 23 nt, Human
caaaauacauucuuuuugcucua

SEQ ID NO: 1997094 - RNA, 22 nt, Human
caaaauaagaaaagauguagau

SEQ ID NO: 1997095 - RNA, 13 nt, Human
caaaauaaauugg

SEQ ID NO: 1997096 - RNA, 19 nt, Human
caaaauacaugaugauuuc

SEQ ID NO: 1997097 - RNA, 22 nt, Human
caaaauacaugaugauuucaga

SEQ ID NO: 1997098 - RNA, 11 nt, Human
caaaauacauu

SEQ ID NO: 1997099 - RNA, 16 nt, Human
caaaauaagaaaagau

SEQ ID NO: 1997100 - RNA, 18 nt, Human
caaaauaagaaaagaugu

SEQ ID NO: 1997101 - RNA, 21 nt, Human
caaaaucgaugcagugcuucc

SEQ ID NO: 1997102 - RNA, 23 nt, Human
caaagugcugggauuacaagcgu

SEQ ID NO: 1997103 - RNA, 18 nt, Human
caaagugcugggauuaca

SEQ ID NO: 1997104 - RNA, 21 nt, Human
caaaguuaaacgugaugugcu

SEQ ID NO: 1997105 - RNA, 20 nt, Human
caaaguucccuacuuccugu

SEQ ID NO: 1997106 - RNA, 15 nt, Human
caaagaaauuaugug

SEQ ID NO: 1997107 - RNA, 11 nt, Human
caaagaagaaa

SEQ ID NO: 1997108 - RNA, 13 nt, Human
caaagugcuggga

SEQ ID NO: 1997109 - RNA, 19 nt, Human
caaagugcugggauuacaa

SEQ ID NO: 1997110 - RNA, 18 nt, Human
caaauguucaucaaugaa

SEQ ID NO: 1997111 - RNA, 14 nt, Human
caaauguucaucaa

SEQ ID NO: 1997112 - RNA, 19 nt, Human
caaauggauuccuguuuca

SEQ ID NO: 1997113 - RNA, 18 nt, Human
caaauggaguuggaguuc

SEQ ID NO: 1997114 - RNA, 19 nt, Human
caaauggaguuggaguuca

SEQ ID NO: 1997115 - RNA, 21 nt, Human
caaauggaguuggaguucauu

SEQ ID NO: 1997116 - RNA, 23 nt, Human
caaauggaaaugggcagagcaga

SEQ ID NO: 1997117 - RNA, 23 nt, Human
caaauauauucagccuggcuuca

SEQ ID NO: 1997118 - RNA, 19 nt, Human
caaauaaaguaguaaaaga

SEQ ID NO: 1997119 - RNA, 13 nt, Human
caaauaacaacuu

SEQ ID NO: 1997120 - RNA, 14 nt, Human
caaauaacaacuuu

SEQ ID NO: 1997121 - RNA, 16 nt, Human
caaauaacaacuuuuu

SEQ ID NO: 1997122 - RNA, 19 nt, Human
caaauauuucuagacacuu

SEQ ID NO: 1997123 - RNA, 15 nt, Human
caacagauuggauuu

SEQ ID NO: 1997124 - RNA, 20 nt, Human
caacagauuggauuuuaugu

SEQ ID NO: 1997125 - RNA, 21 nt, Human
caacagauuggauuuuauguu

SEQ ID NO: 1997126 - RNA, 23 nt, Human
caacagauuggauuuuauguuga

SEQ ID NO: 1997127 - RNA, 15 nt, Human
caacacuuuaauggg

SEQ ID NO: 1997128 - RNA, 12 nt, Human
caaauuaauugu

SEQ ID NO: 1997129 - RNA, 16 nt, Human
caaauuaauuguguga

SEQ ID NO: 1997130 - RNA, 19 nt, Human
caaauuaauugugugaacu

SEQ ID NO: 1997131 - RNA, 20 nt, Human
caaauuaauugugugaacuu

SEQ ID NO: 1997132 - RNA, 19 nt, Human
caaauuucucuguuccaua

SEQ ID NO: 1997133 - RNA, 15 nt, Human
caaauuucuaaaucu

SEQ ID NO: 1997134 - RNA, 22 nt, Human
caaauuucuaaaucuccaaaau

SEQ ID NO: 1997135 - RNA, 16 nt, Human
caaccuggucacagga

SEQ ID NO: 1997136 - RNA, 16 nt, Human
caaccuucuguggcuc

SEQ ID NO: 1997137 - RNA, 17 nt, Human
caaccuucuguggcuca

SEQ ID NO: 1997138 - RNA, 19 nt, Human
caaccuucuguggcucaca

SEQ ID NO: 1997139 - RNA, 20 nt, Human
caaccuucuguggcucacag

SEQ ID NO: 1997140 - RNA, 14 nt, Human
caaccuuggcuugg

SEQ ID NO: 1997141 - RNA, 20 nt, Human
caacauacucccaucuguga

SEQ ID NO: 1997142 - RNA, 21 nt, Human
caaccugcucuccucuugcca

SEQ ID NO: 1997143 - RNA, 23 nt, Human
caaccugcucuccucuugccacu

SEQ ID NO: 1997144 - RNA, 18 nt, Human
caaccugcucuccucuug

SEQ ID NO: 1997145 - RNA, 12 nt, Human
caacauauacaa

SEQ ID NO: 1997146 - RNA, 19 nt, Human
caacauacucccaucugug

SEQ ID NO: 1997147 - RNA, 17 nt, Human
caacauacucccaucug

SEQ ID NO: 1997148 - RNA, 12 nt, Human
caacaggcuggg

SEQ ID NO: 1997149 - RNA, 19 nt, Human
caacagccaauauuuaaaa

SEQ ID NO: 1997150 - RNA, 17 nt, Human
caacagccacucagaaa

SEQ ID NO: 1997151 - RNA, 15 nt, Human
caagagagcagcaag

SEQ ID NO: 1997152 - RNA, 21 nt, Human
caagagagcagcaaggucuug

SEQ ID NO: 1997153 - RNA, 15 nt, Human
caagacgcugugcug

SEQ ID NO: 1997154 - RNA, 13 nt, Human
caagacgcugugc

SEQ ID NO: 1997155 - RNA, 23 nt, Human
caagaccuucuccuucaccuuug

SEQ ID NO: 1997156 - RNA, 21 nt, Human
caagaccuucuccuucaccuu

SEQ ID NO: 1997157 - RNA, 17 nt, Human
caagagcuuaacagugu

SEQ ID NO: 1997158 - RNA, 14 nt, Human
caagaggcaaagga

SEQ ID NO: 1997159 - RNA, 17 nt, Human
caagaggcaaaggaauc

SEQ ID NO: 1997160 - RNA, 13 nt, Human
caagaagcccagg

SEQ ID NO: 1997161 - RNA, 14 nt, Human
caagaagcccagga

SEQ ID NO: 1997162 - RNA, 12 nt, Human
caagaaaugaag

SEQ ID NO: 1997163 - RNA, 13 nt, Human
caagaaaugaaga

SEQ ID NO: 1997164 - RNA, 17 nt, Human
caagaaaugaagagcug

SEQ ID NO: 1997165 - RNA, 21 nt, Human
caagaagcaauguuauaaagu

SEQ ID NO: 1997166 - RNA, 17 nt, Human
caagaaaugaaagcagg

SEQ ID NO: 1997167 - RNA, 19 nt, Human
caagaaaugaaagcaggga

SEQ ID NO: 1997168 - RNA, 15 nt, Human
caagaaaugaaagca

SEQ ID NO: 1997169 - RNA, 12 nt, Human
caacuugggaac

SEQ ID NO: 1997170 - RNA, 16 nt, Human
caacuuguaaaugugg

SEQ ID NO: 1997171 - RNA, 19 nt, Human
caacuugccuuugaagagu

SEQ ID NO: 1997172 - RNA, 18 nt, Human
caacuaaaguuguacuuu

SEQ ID NO: 1997173 - RNA, 20 nt, Human
caacuaaaguuguacuuuaa

SEQ ID NO: 1997174 - RNA, 17 nt, Human
caacuugccuuugaaga

SEQ ID NO: 1997175 - RNA, 22 nt, Human
caacuaaaaugugucuugcugu

SEQ ID NO: 1997176 - RNA, 22 nt, Human
caaccuuggcuuggcccuggca

SEQ ID NO: 1997177 - RNA, 15 nt, Human
caaccuuggcuuggc

SEQ ID NO: 1997178 - RNA, 13 nt, Human
uguguuugaagca

SEQ ID NO: 1997179 - RNA, 18 nt, Human
uguguuuuucauaaagca

SEQ ID NO: 1997180 - RNA, 15 nt, Human
uguguuuuucauaaa

SEQ ID NO: 1997181 - RNA, 16 nt, Human
uguguuuauugucaaa

SEQ ID NO: 1997182 - RNA, 19 nt, Human
ugugugugcuuauguauga

SEQ ID NO: 1997183 - RNA, 18 nt, Human
ugugugugaugugacauu

SEQ ID NO: 1997184 - RNA, 13 nt, Human
ugugugugaugug

SEQ ID NO: 1997185 - RNA, 14 nt, Human
ugugugugauguga

SEQ ID NO: 1997186 - RNA, 15 nt, Human
ugugugugaugugac

SEQ ID NO: 1997187 - RNA, 20 nt, Human
ugugugugcuuauguaugag

SEQ ID NO: 1997188 - RNA, 16 nt, Human
ugugugggagugugua

SEQ ID NO: 1997189 - RNA, 20 nt, Human
uguguggagucauuucugau

SEQ ID NO: 1997190 - RNA, 14 nt, Human
uguguggucaacau

SEQ ID NO: 1997191 - RNA, 23 nt, Human
uguguggucaacauuucucaugu

SEQ ID NO: 1997192 - RNA, 17 nt, Human
ugugugugaaaaugugu

SEQ ID NO: 1997193 - RNA, 11 nt, Human
uguguaugugg

SEQ ID NO: 1997194 - RNA, 12 nt, Human
uguguauguggg

SEQ ID NO: 1997195 - RNA, 18 nt, Human
uguguaugcgugugugug

SEQ ID NO: 1997196 - RNA, 22 nt, Human
uguguaugugaguauucucauu

SEQ ID NO: 1997197 - RNA, 22 nt, Human
ugugugaagcuuaagggucaua

SEQ ID NO: 1997198 - RNA, 18 nt, Human
ugugugauauuucagaaa

SEQ ID NO: 1997199 - RNA, 20 nt, Human
ugugugauauuucagaaaua

SEQ ID NO: 1997200 - RNA, 14 nt, Human
ugugugaugugaca

SEQ ID NO: 1997201 - RNA, 15 nt, Human
ugugugaugugacau

SEQ ID NO: 1997202 - RNA, 17 nt, Human
ugugugaugugacauuu

SEQ ID NO: 1997203 - RNA, 19 nt, Human
ugugugaugugacauuugu

SEQ ID NO: 1997204 - RNA, 14 nt, Human
ugugugggagugug

SEQ ID NO: 1997205 - RNA, 15 nt, Human
ugugugggagugugu

SEQ ID NO: 1997206 - RNA, 17 nt, Human
uguguggagucauuucu

SEQ ID NO: 1997207 - RNA, 13 nt, Human
ugugugcucucca

SEQ ID NO: 1997208 - RNA, 15 nt, Human
ugugugcuuauguau

SEQ ID NO: 1997209 - RNA, 17 nt, Human
ugugugcuaaacgugua

SEQ ID NO: 1997210 - RNA, 19 nt, Human
ugugugcacguacacacac

SEQ ID NO: 1997211 - RNA, 17 nt, Human
uguucauaaauaaaguu

SEQ ID NO: 1997212 - RNA, 19 nt, Human
uguucagccacugagggac

SEQ ID NO: 1997213 - RNA, 18 nt, Human
uguucagcguuuugcaag

SEQ ID NO: 1997214 - RNA, 20 nt, Human
uguucagcuccagcucacca

SEQ ID NO: 1997215 - RNA, 18 nt, Human
uguucagccacugaggga

SEQ ID NO: 1997216 - RNA, 21 nt, Human
uguucagcuccagcucaccag

SEQ ID NO: 1997217 - RNA, 22 nt, Human
uguucagcuccagcucaccagc

SEQ ID NO: 1997218 - RNA, 21 nt, Human
uguuaggccaaagacaaauag

SEQ ID NO: 1997219 - RNA, 17 nt, Human
uguuaguaugaggcauu

SEQ ID NO: 1997220 - RNA, 19 nt, Human
uguuaguaugaggcauuug

SEQ ID NO: 1997221 - RNA, 20 nt, Human
uguuaguaugaggcauuugu

SEQ ID NO: 1997222 - RNA, 15 nt, Human
uguucagaaaaaagg

SEQ ID NO: 1997223 - RNA, 12 nt, Human
uguucagaaaaa

SEQ ID NO: 1997224 - RNA, 17 nt, Human
uguuagccccauaauuu

SEQ ID NO: 1997225 - RNA, 19 nt, Human
uguuaggccaaagacaaau

SEQ ID NO: 1997226 - RNA, 14 nt, Human
uguuacuaaguuuu

SEQ ID NO: 1997227 - RNA, 14 nt, Human
uguuacucuuggga

SEQ ID NO: 1997228 - RNA, 17 nt, Human
uguuacucuugggacau

SEQ ID NO: 1997229 - RNA, 18 nt, Human
uguuacucuugggacauc

SEQ ID NO: 1997230 - RNA, 23 nt, Human
uguuaccauuggaaauuucacgu

SEQ ID NO: 1997231 - RNA, 23 nt, Human
uguuaccccaagcgcccuggccc

SEQ ID NO: 1997232 - RNA, 23 nt, Human
uguuaaaaugcaugauugcagaa

SEQ ID NO: 1997233 - RNA, 22 nt, Human
uguuaaaauuauaccuguugcu

SEQ ID NO: 1997234 - RNA, 17 nt, Human
uguuuaagacacuuccg

SEQ ID NO: 1997235 - RNA, 18 nt, Human
uguuuaagacacuuccgu

SEQ ID NO: 1997236 - RNA, 19 nt, Human
uguuuaagacacuuccguc

SEQ ID NO: 1997237 - RNA, 13 nt, Human
uguuuaagcagaa

SEQ ID NO: 1997238 - RNA, 14 nt, Human
uguuuaagcagaau

SEQ ID NO: 1997239 - RNA, 18 nt, Human
uguuuaagcagaauugga

SEQ ID NO: 1997240 - RNA, 19 nt, Human
uguuuaagcagaauuggaa

SEQ ID NO: 1997241 - RNA, 21 nt, Human
uguuuaagugaauugacuuau

SEQ ID NO: 1997242 - RNA, 17 nt, Human
uguuuaauaaagcgaaa

SEQ ID NO: 1997243 - RNA, 12 nt, Human
uguuuacagugu

SEQ ID NO: 1997244 - RNA, 12 nt, Human
uguuuaagagac

SEQ ID NO: 1997245 - RNA, 23 nt, Human
uguuuaaagguuucuauuuucuc

SEQ ID NO: 1997246 - RNA, 13 nt, Human
uguuuaaaauuuc

SEQ ID NO: 1997247 - RNA, 21 nt, Human
uguuuaaaauuucuuagaaaa

SEQ ID NO: 1997248 - RNA, 17 nt, Human
uguuggcugggggccuc

SEQ ID NO: 1997249 - RNA, 15 nt, Human
uguuggccucugcaa

SEQ ID NO: 1997250 - RNA, 19 nt, Human
uguuggcugggggccucag

SEQ ID NO: 1997251 - RNA, 15 nt, Human
uguuggccaaagcca

SEQ ID NO: 1997252 - RNA, 14 nt, Human
uguuggcagccucu

SEQ ID NO: 1997253 - RNA, 23 nt, Human
uguuggcagaugcagcucuuccu

SEQ ID NO: 1997254 - RNA, 15 nt, Human
uguuggccaggcugg

SEQ ID NO: 1997255 - RNA, 16 nt, Human
uguuggccaggcuggu

SEQ ID NO: 1997256 - RNA, 15 nt, Human
uguuggcagaugcag

SEQ ID NO: 1997257 - RNA, 15 nt, Human
uguugauuaaagaug

SEQ ID NO: 1997258 - RNA, 16 nt, Human
uguugauuaaagauga

SEQ ID NO: 1997259 - RNA, 14 nt, Human
uguugauucucucc

SEQ ID NO: 1997260 - RNA, 20 nt, Human
uguugaugcaauccuuacaa

SEQ ID NO: 1997261 - RNA, 21 nt, Human
uguugaugcaauccuuacaaa

SEQ ID NO: 1997262 - RNA, 22 nt, Human
uguugaugcaauccuuacaaau

SEQ ID NO: 1997263 - RNA, 23 nt, Human
uguugaugcaauccuuacaaaug

SEQ ID NO: 1997264 - RNA, 16 nt, Human
uguugaugcuguauuc

SEQ ID NO: 1997265 - RNA, 21 nt, Human
uguugaugggaugauugaaga

SEQ ID NO: 1997266 - RNA, 23 nt, Human
uguugaugggaugauugaagaaa

SEQ ID NO: 1997267 - RNA, 16 nt, Human
uguucucugcccucca

SEQ ID NO: 1997268 - RNA, 15 nt, Human
uguucucugcccucc

SEQ ID NO: 1997269 - RNA, 14 nt, Human
uguucucugcccuc

SEQ ID NO: 1997270 - RNA, 13 nt, Human
uguucucugcccu

SEQ ID NO: 1997271 - RNA, 16 nt, Human
uguucuggcucuucca

SEQ ID NO: 1997272 - RNA, 13 nt, Human
uguucuggcucuu

SEQ ID NO: 1997273 - RNA, 12 nt, Human
uguucuggcucu

SEQ ID NO: 1997274 - RNA, 20 nt, Human
uguucugcuaaauuucaaau

SEQ ID NO: 1997275 - RNA, 13 nt, Human
uguucaugaaaga

SEQ ID NO: 1997276 - RNA, 14 nt, Human
uguucaugaaagau

SEQ ID NO: 1997277 - RNA, 19 nt, Human
uguucaucauccuaagcua

SEQ ID NO: 1997278 - RNA, 16 nt, Human
uguucucucuucucca

SEQ ID NO: 1997279 - RNA, 15 nt, Human
uguucucucuucucc

SEQ ID NO: 1997280 - RNA, 16 nt, Human
uguucuuuugucccag

SEQ ID NO: 1997281 - RNA, 12 nt, Human
uguucuuuucaa

SEQ ID NO: 1997282 - RNA, 23 nt, Human
uguucuuucuggcuaugcauuug

SEQ ID NO: 1997283 - RNA, 20 nt, Human
uguucuggcucuuccaggcu

SEQ ID NO: 1997284 - RNA, 17 nt, Human
uguucuggcucuuccag

SEQ ID NO: 1997285 - RNA, 21 nt, Human
uguucuggcucuuccaggcug

SEQ ID NO: 1997286 - RNA, 15 nt, Human
uguucugcuuuccuc

SEQ ID NO: 1997287 - RNA, 15 nt, Human
uguugacauuuguuu

SEQ ID NO: 1997288 - RNA, 22 nt, Human
uguugaccaggcaccuccccuc

SEQ ID NO: 1997289 - RNA, 21 nt, Human
uguugaccaggcaccuccccu

SEQ ID NO: 1997290 - RNA, 19 nt, Human
uguugacucuaguacugug

SEQ ID NO: 1997291 - RNA, 22 nt, Human
uguugacucuaguacugugaau

SEQ ID NO: 1997292 - RNA, 15 nt, Human
uguugaagccuuugu

SEQ ID NO: 1997293 - RNA, 20 nt, Human
uguugaaaagaguaguacuu

SEQ ID NO: 1997294 - RNA, 20 nt, Human
uguugacaucacuggcaugg

SEQ ID NO: 1997295 - RNA, 23 nt, Human
uuaaagaaaaaaaugucaaaagu

SEQ ID NO: 1997296 - RNA, 17 nt, Human
uuaaagaaacaugguuu

SEQ ID NO: 1997297 - RNA, 16 nt, Human
uuaaaugcccagcccc

SEQ ID NO: 1997298 - RNA, 15 nt, Human
uuaaaugcccagccc

SEQ ID NO: 1997299 - RNA, 14 nt, Human
uuaaaugcccagcc

SEQ ID NO: 1997300 - RNA, 11 nt, Human
uuaaaugcacc

SEQ ID NO: 1997301 - RNA, 22 nt, Human
uuaaaucauacuccuaugcuuu

SEQ ID NO: 1997302 - RNA, 22 nt, Human
uuaaacuuaaucuaaauggaac

SEQ ID NO: 1997303 - RNA, 21 nt, Human
uuaaacuuuagugcuacagaa

SEQ ID NO: 1997304 - RNA, 16 nt, Human
uuaaagaaaaaaaugu

SEQ ID NO: 1997305 - RNA, 14 nt, Human
uuaaaacccaagug

SEQ ID NO: 1997306 - RNA, 16 nt, Human
uuaaaacuacuuagca

SEQ ID NO: 1997307 - RNA, 14 nt, Human
uuaaaacuucaucu

SEQ ID NO: 1997308 - RNA, 20 nt, Human
uuaaaacugcaguuuucaga

SEQ ID NO: 1997309 - RNA, 13 nt, Human
uuaaaauaaacuu

SEQ ID NO: 1997310 - RNA, 16 nt, Human
uuaaaauaaacuuucu

SEQ ID NO: 1997311 - RNA, 12 nt, Human
uguuuuucugcu

SEQ ID NO: 1997312 - RNA, 16 nt, Human
uguuuuuaaguuugca

SEQ ID NO: 1997313 - RNA, 18 nt, Human
uguuuuugaaggcagaaa

SEQ ID NO: 1997314 - RNA, 20 nt, Human
uguuuuugaaggcagaaagc

SEQ ID NO: 1997315 - RNA, 14 nt, Human
uguuuuucugcuuu

SEQ ID NO: 1997316 - RNA, 15 nt, Human
uguuuuucugcuuua

SEQ ID NO: 1997317 - RNA, 18 nt, Human
uguuuuucugcuuuagac

SEQ ID NO: 1997318 - RNA, 19 nt, Human
uguuuuucugcuuuagacu

SEQ ID NO: 1997319 - RNA, 16 nt, Human
uguuuuugaaggcaga

SEQ ID NO: 1997320 - RNA, 14 nt, Human
uguuuuuguauauu

SEQ ID NO: 1997321 - RNA, 21 nt, Human
uguuuuuguauauugguuuua

SEQ ID NO: 1997322 - RNA, 22 nt, Human
uuaaaaaaaaaccugagcccca

SEQ ID NO: 1997323 - RNA, 13 nt, Human
uguuuuuguaaag

SEQ ID NO: 1997324 - RNA, 14 nt, Human
uguuuuuguaaaga

SEQ ID NO: 1997325 - RNA, 16 nt, Human
uguuuuuguaaagaaa

SEQ ID NO: 1997326 - RNA, 17 nt, Human
uguuuuuguaaagaaaa

SEQ ID NO: 1997327 - RNA, 12 nt, Human
uguuuuuguaua

SEQ ID NO: 1997328 - RNA, 13 nt, Human
uguuuuuguauau

SEQ ID NO: 1997329 - RNA, 15 nt, Human
uguuuuuaaaaucuu

SEQ ID NO: 1997330 - RNA, 16 nt, Human
uguuuuuaaaaucuua

SEQ ID NO: 1997331 - RNA, 12 nt, Human
uguuuuuaagau

SEQ ID NO: 1997332 - RNA, 21 nt, Human
uguuuuuaaaaucuuauuaaa

SEQ ID NO: 1997333 - RNA, 17 nt, Human
uguuuuuaaaaucuuau

SEQ ID NO: 1997334 - RNA, 19 nt, Human
uguuuuuaaaaucuuauua

SEQ ID NO: 1997335 - RNA, 22 nt, Human
uguuuuaaggaugcuuguacau

SEQ ID NO: 1997336 - RNA, 23 nt, Human
uguuuuaaggaugcuuguacaua

SEQ ID NO: 1997337 - RNA, 17 nt, Human
uguuuuaagaggcaggg

SEQ ID NO: 1997338 - RNA, 19 nt, Human
uguuuuaacaagaagcaau

SEQ ID NO: 1997339 - RNA, 19 nt, Human
uguuuuaaggaugcuugua

SEQ ID NO: 1997340 - RNA, 11 nt, Human
uguuucugggg

SEQ ID NO: 1997341 - RNA, 16 nt, Human
uguuugugugucaagu

SEQ ID NO: 1997342 - RNA, 14 nt, Human
uguuuguucuuguu

SEQ ID NO: 1997343 - RNA, 16 nt, Human
uguuuguucuuguuuu

SEQ ID NO: 1997344 - RNA, 16 nt, Human
uguuuuaagaggcagg

SEQ ID NO: 1997345 - RNA, 16 nt, Human
uguuuccugcaggcca

SEQ ID NO: 1997346 - RNA, 18 nt, Human
uguuucuggcuuagaaca

SEQ ID NO: 1997347 - RNA, 15 nt, Human
uguuuccuggcacug

SEQ ID NO: 1997348 - RNA, 13 nt, Human
uuacaaccuagaa

SEQ ID NO: 1997349 - RNA, 23 nt, Human
uuacaaauuauaauguauucaua

SEQ ID NO: 1997350 - RNA, 24 nt, Human
uuacaaauuauaauguauucauau

SEQ ID NO: 1997351 - RNA, 14 nt, Human
uuacaacacuuuaa

SEQ ID NO: 1997352 - RNA, 21 nt, Human
uuacaaauuauaauguauuca

SEQ ID NO: 1997353 - RNA, 16 nt, Human
uuacaaccuagaagua

SEQ ID NO: 1997354 - RNA, 19 nt, Human
uuaaugagcaauaucugcu

SEQ ID NO: 1997355 - RNA, 22 nt, Human
uuaauuaaaacacaacaucuuu

SEQ ID NO: 1997356 - RNA, 19 nt, Human
uuacauuuguauuuuucca

SEQ ID NO: 1997357 - RNA, 12 nt, Human
uuacauuuuuaa

SEQ ID NO: 1997358 - RNA, 17 nt, Human
uuacauuuuuaagugcu

SEQ ID NO: 1997359 - RNA, 13 nt, Human
uuacauucaguug

SEQ ID NO: 1997360 - RNA, 20 nt, Human
uuacacuuuaugcacaaaau

SEQ ID NO: 1997361 - RNA, 13 nt, Human
uuacacuuuaugc

SEQ ID NO: 1997362 - RNA, 16 nt, Human
uuacacuuuuuggaag

SEQ ID NO: 1997363 - RNA, 20 nt, Human
uuacacuggcaaugguaguu

SEQ ID NO: 1997364 - RNA, 21 nt, Human
uuacacuggcaaugguaguuu

SEQ ID NO: 1997365 - RNA, 22 nt, Human
uuacacuggcaaugguaguuuc

SEQ ID NO: 1997366 - RNA, 23 nt, Human
uuacacuggcaaugguaguuucu

SEQ ID NO: 1997367 - RNA, 14 nt, Human
uuaauacuguuauu

SEQ ID NO: 1997368 - RNA, 18 nt, Human
uuaauacuguuauucuuu

SEQ ID NO: 1997369 - RNA, 20 nt, Human
uuaauacuguuauucuuugc

SEQ ID NO: 1997370 - RNA, 22 nt, Human
uuaauaauagauugugaauaau

SEQ ID NO: 1997371 - RNA, 20 nt, Human
uuaauaaucaagagccuuaa

SEQ ID NO: 1997372 - RNA, 21 nt, Human
uuaauacuguuauucuuugca

SEQ ID NO: 1997373 - RNA, 23 nt, Human
uuaauacuguuauucuuugcacu

SEQ ID NO: 1997374 - RNA, 15 nt, Human
uuaagcagaauugga

SEQ ID NO: 1997375 - RNA, 17 nt, Human
uuaagcagaauuggaaa

SEQ ID NO: 1997376 - RNA, 15 nt, Human
uuaagcaugacagaa

SEQ ID NO: 1997377 - RNA, 17 nt, Human
uuaagcaugacagaaaa

SEQ ID NO: 1997378 - RNA, 15 nt, Human
uuaagccuaaagauu

SEQ ID NO: 1997379 - RNA, 16 nt, Human
uuaagccuaaagauuu

SEQ ID NO: 1997380 - RNA, 20 nt, Human
uuaagccuaaagauuuugau

SEQ ID NO: 1997381 - RNA, 19 nt, Human
uuaagccucaaauuugaac

SEQ ID NO: 1997382 - RNA, 20 nt, Human
uuaaaugcaaccauuugaaa

SEQ ID NO: 1997383 - RNA, 13 nt, Human
uuaaaugcccagc

SEQ ID NO: 1997384 - RNA, 19 nt, Human
uuaaaugucaaaugugaau

SEQ ID NO: 1997385 - RNA, 20 nt, Human
uuaaaugucaaaugugaauu

SEQ ID NO: 1997386 - RNA, 11 nt, Human
uuaaaugugaa

SEQ ID NO: 1997387 - RNA, 12 nt, Human
uuaaaugugaau

SEQ ID NO: 1997388 - RNA, 16 nt, Human
uuaaaugugaauuacu

SEQ ID NO: 1997389 - RNA, 18 nt, Human
uuaaaugugaauuacuaa

SEQ ID NO: 1997390 - RNA, 13 nt, Human
uuaaauguuaugu

SEQ ID NO: 1997391 - RNA, 14 nt, Human
uuaaauguuaugua

SEQ ID NO: 1997392 - RNA, 16 nt, Human
uuaaauguuauguaua

SEQ ID NO: 1997393 - RNA, 21 nt, Human
uuaaaugugaauuacuaacuu

SEQ ID NO: 1997394 - RNA, 22 nt, Human
uuaaaugugaauuacuaacuuc

SEQ ID NO: 1997395 - RNA, 21 nt, Human
uuaaaugugugagugcaugua

SEQ ID NO: 1997396 - RNA, 12 nt, Human
uuaacuuuuaua

SEQ ID NO: 1997397 - RNA, 13 nt, Human
uuaacuuuuauaa

SEQ ID NO: 1997398 - RNA, 14 nt, Human
uuaacuuuuauaaa

SEQ ID NO: 1997399 - RNA, 12 nt, Human
uuaagaguaaaa

SEQ ID NO: 1997400 - RNA, 14 nt, Human
uuaagauuauaauu

SEQ ID NO: 1997401 - RNA, 15 nt, Human
uuaagauuauaauug

SEQ ID NO: 1997402 - RNA, 16 nt, Human
uuaagauuauaauugu

SEQ ID NO: 1997403 - RNA, 12 nt, Human
uguccuacucug

SEQ ID NO: 1997404 - RNA, 17 nt, Human
uguccuacucuguguca

SEQ ID NO: 1997405 - RNA, 16 nt, Human
uguccccgacccuugc

SEQ ID NO: 1997406 - RNA, 17 nt, Human
uguccccgacccuugcc

SEQ ID NO: 1997407 - RNA, 20 nt, Human
uguccuacccacccuccuuu

SEQ ID NO: 1997408 - RNA, 22 nt, Human
uguccccaccgcagacaggacc

SEQ ID NO: 1997409 - RNA, 19 nt, Human
uguccccaccgcagacagg

SEQ ID NO: 1997410 - RNA, 13 nt, Human
uguccccaccgca

SEQ ID NO: 1997411 - RNA, 18 nt, Human
uguccccaccgcagacag

SEQ ID NO: 1997412 - RNA, 19 nt, Human
ugucauuugagcagggcuc

SEQ ID NO: 1997413 - RNA, 16 nt, Human
ugucauuugagcaggg

SEQ ID NO: 1997414 - RNA, 22 nt, Human
ugucauuucauguccuguguca

SEQ ID NO: 1997415 - RNA, 18 nt, Human
ugucauuucauguccugu

SEQ ID NO: 1997416 - RNA, 16 nt, Human
ugucccaacuuguaaa

SEQ ID NO: 1997417 - RNA, 16 nt, Human
uguccaguaagaucac

SEQ ID NO: 1997418 - RNA, 17 nt, Human
uguccaguaagaucacu

SEQ ID NO: 1997419 - RNA, 19 nt, Human
uguccaguaagaucacugu

SEQ ID NO: 1997420 - RNA, 20 nt, Human
uguccaguaagaucacuguu

SEQ ID NO: 1997421 - RNA, 21 nt, Human
uguccaguaagaucacuguuu

SEQ ID NO: 1997422 - RNA, 22 nt, Human
uguccaguaagaucacuguuua

SEQ ID NO: 1997423 - RNA, 16 nt, Human
ugucaucugagaauga

SEQ ID NO: 1997424 - RNA, 17 nt, Human
ugucaccugcuucucug

SEQ ID NO: 1997425 - RNA, 18 nt, Human
ugucaccugcuucucugc

SEQ ID NO: 1997426 - RNA, 20 nt, Human
ugucaccugcuucucugccc

SEQ ID NO: 1997427 - RNA, 13 nt, Human
ugucaccugaaga

SEQ ID NO: 1997428 - RNA, 20 nt, Human
ugucaugcagaguauuucua

SEQ ID NO: 1997429 - RNA, 19 nt, Human
ugucaucugagaaugaaca

SEQ ID NO: 1997430 - RNA, 18 nt, Human
uguauuguuguaaaaugu

SEQ ID NO: 1997431 - RNA, 20 nt, Human
uguauuuauuuaguauuuau

SEQ ID NO: 1997432 - RNA, 14 nt, Human
uguauuuauucuuu

SEQ ID NO: 1997433 - RNA, 15 nt, Human
uguauuuauucuuuu

SEQ ID NO: 1997434 - RNA, 22 nt, Human
ugucacccuuaggccagcacca

SEQ ID NO: 1997435 - RNA, 20 nt, Human
ugucacccgaucgccagcaa

SEQ ID NO: 1997436 - RNA, 12 nt, Human
ugucacaggcag

SEQ ID NO: 1997437 - RNA, 21 nt, Human
ugucacaggaaggcugucuca

SEQ ID NO: 1997438 - RNA, 15 nt, Human
uguauuuugugaguu

SEQ ID NO: 1997439 - RNA, 17 nt, Human
ugucacacacuuuggcu

SEQ ID NO: 1997440 - RNA, 22 nt, Human
uguauucucuccuguaccucuu

SEQ ID NO: 1997441 - RNA, 13 nt, Human
uguauucuguaaa

SEQ ID NO: 1997442 - RNA, 14 nt, Human
uguauucuguaaaa

SEQ ID NO: 1997443 - RNA, 13 nt, Human
uguauucugucuu

SEQ ID NO: 1997444 - RNA, 16 nt, Human
uguauucugucuucau

SEQ ID NO: 1997445 - RNA, 17 nt, Human
uguauucugucuucauc

SEQ ID NO: 1997446 - RNA, 19 nt, Human
uguauuguccuauuagugu

SEQ ID NO: 1997447 - RNA, 14 nt, Human
uguauuguccuauu

SEQ ID NO: 1997448 - RNA, 22 nt, Human
uguauaaaagggacugagaaau

SEQ ID NO: 1997449 - RNA, 16 nt, Human
uguaugaucugugccu

SEQ ID NO: 1997450 - RNA, 17 nt, Human
uguaugaucugugccuu

SEQ ID NO: 1997451 - RNA, 22 nt, Human
uguaguuugaggaaauuugcag

SEQ ID NO: 1997452 - RNA, 12 nt, Human
uguaguucuuua

SEQ ID NO: 1997453 - RNA, 14 nt, Human
uguaguucuuuaaa

SEQ ID NO: 1997454 - RNA, 15 nt, Human
uguaguucuuuaaac

SEQ ID NO: 1997455 - RNA, 17 nt, Human
uguaguucuuuaaacug

SEQ ID NO: 1997456 - RNA, 16 nt, Human
uguaccgcaaugugac

SEQ ID NO: 1997457 - RNA, 18 nt, Human
uguacagagcccacgccc

SEQ ID NO: 1997458 - RNA, 13 nt, Human
uguacagagccca

SEQ ID NO: 1997459 - RNA, 18 nt, Human
uguacaaugacuuuauug

SEQ ID NO: 1997460 - RNA, 17 nt, Human
uguacagagcccacgcc

SEQ ID NO: 1997461 - RNA, 16 nt, Human
uguacagagcccacgc

SEQ ID NO: 1997462 - RNA, 17 nt, Human
uguaauuaaguacuaug

SEQ ID NO: 1997463 - RNA, 14 nt, Human
uguaauguugugaa

SEQ ID NO: 1997464 - RNA, 15 nt, Human
uguaauguugugaau

SEQ ID NO: 1997465 - RNA, 16 nt, Human
uguacaaggacagccc

SEQ ID NO: 1997466 - RNA, 20 nt, Human
uguacaaggacagccccucc

SEQ ID NO: 1997467 - RNA, 23 nt, Human
uguacaaggacagccccuccucc

SEQ ID NO: 1997468 - RNA, 14 nt, Human
uggucacagccagg

SEQ ID NO: 1997469 - RNA, 23 nt, Human
ugguauuggccauaagcaacaau

SEQ ID NO: 1997470 - RNA, 15 nt, Human
uggucacagccaggc

SEQ ID NO: 1997471 - RNA, 17 nt, Human
uggucacagccaggcgc

SEQ ID NO: 1997472 - RNA, 23 nt, Human
uguaauaaacccuuaacuggcau

SEQ ID NO: 1997473 - RNA, 14 nt, Human
uguaauaaacccuu

SEQ ID NO: 1997474 - RNA, 22 nt, Human
uguaauaaacccuuaacuggca

SEQ ID NO: 1997475 - RNA, 14 nt, Human
uguaaucacagcua

SEQ ID NO: 1997476 - RNA, 14 nt, Human
uguaaucaacaugg

SEQ ID NO: 1997477 - RNA, 14 nt, Human
uguagcauccugga

SEQ ID NO: 1997478 - RNA, 16 nt, Human
uguagcauccuggaau

SEQ ID NO: 1997479 - RNA, 15 nt, Human
uguagauuuauuuca

SEQ ID NO: 1997480 - RNA, 16 nt, Human
uguagauuuauuucau

SEQ ID NO: 1997481 - RNA, 12 nt, Human
uguagauuugau

SEQ ID NO: 1997482 - RNA, 17 nt, Human
uguagcauccuggaaua

SEQ ID NO: 1997483 - RNA, 18 nt, Human
uguagcauccuggaauau

SEQ ID NO: 1997484 - RNA, 20 nt, Human
uguagaucaacucauguuaa

SEQ ID NO: 1997485 - RNA, 19 nt, Human
uguacugcauaugaaagga

SEQ ID NO: 1997486 - RNA, 14 nt, Human
uguaccucugccuc

SEQ ID NO: 1997487 - RNA, 15 nt, Human
uguacgucugacagg

SEQ ID NO: 1997488 - RNA, 22 nt, Human
uguacgacgucagauguuuaaa

SEQ ID NO: 1997489 - RNA, 23 nt, Human
uguacgacgucagauguuuaaaa

SEQ ID NO: 1997490 - RNA, 23 nt, Human
uguagccucaaucgagugagaca

SEQ ID NO: 1997491 - RNA, 18 nt, Human
uguagccccucuccugga

SEQ ID NO: 1997492 - RNA, 20 nt, Human
ugugcauuaucuagauacug

SEQ ID NO: 1997493 - RNA, 21 nt, Human
ugugcauuaucuagauacugu

SEQ ID NO: 1997494 - RNA, 23 nt, Human
ugugcauuaucuagauacuguau

SEQ ID NO: 1997495 - RNA, 17 nt, Human
ugugccuuggugugcug

SEQ ID NO: 1997496 - RNA, 23 nt, Human
ugugcauuuggugguuucagaaa

SEQ ID NO: 1997497 - RNA, 14 nt, Human
ugugcauuaucuag

SEQ ID NO: 1997498 - RNA, 16 nt, Human
ugugcauuaucuagau

SEQ ID NO: 1997499 - RNA, 19 nt, Human
ugugcauuaucuagauacu

SEQ ID NO: 1997500 - RNA, 17 nt, Human
ugugcacaucuguuuug

SEQ ID NO: 1997501 - RNA, 15 nt, Human
ugugcacaucuguuu

SEQ ID NO: 1997502 - RNA, 14 nt, Human
ugugcacguacaca

SEQ ID NO: 1997503 - RNA, 19 nt, Human
uguggaaauuaagaagaaa

SEQ ID NO: 1997504 - RNA, 16 nt, Human
ugugcucaggagcccu

SEQ ID NO: 1997505 - RNA, 15 nt, Human
ugugcucaggagccc

SEQ ID NO: 1997506 - RNA, 17 nt, Human
ugugcucaggagcccug

SEQ ID NO: 1997507 - RNA, 14 nt, Human
ugugcuuguuaacu

SEQ ID NO: 1997508 - RNA, 16 nt, Human
ugugccuuuugccauc

SEQ ID NO: 1997509 - RNA, 14 nt, Human
ugugccuuuuuuau

SEQ ID NO: 1997510 - RNA, 20 nt, Human
ugugccuuuuuuauaucuug

SEQ ID NO: 1997511 - RNA, 14 nt, Human
ugugcgccuacagg

SEQ ID NO: 1997512 - RNA, 19 nt, Human
ugugcgccuacaggaguga

SEQ ID NO: 1997513 - RNA, 14 nt, Human
ugugcucagaauua

SEQ ID NO: 1997514 - RNA, 21 nt, Human
ugugcucagaauuauuaauua

SEQ ID NO: 1997515 - RNA, 19 nt, Human
ugugcgcauaggccugcuu

SEQ ID NO: 1997516 - RNA, 22 nt, Human
ugugcgcauaggccugcuuugu

SEQ ID NO: 1997517 - RNA, 15 nt, Human
uguggaagugugggu

SEQ ID NO: 1997518 - RNA, 18 nt, Human
uguggacacagcucuucu

SEQ ID NO: 1997519 - RNA, 19 nt, Human
uguggacacagcucuucuc

SEQ ID NO: 1997520 - RNA, 14 nt, Human
ugugggagugugua

SEQ ID NO: 1997521 - RNA, 15 nt, Human
ugugggaguguguaa

SEQ ID NO: 1997522 - RNA, 10 nt, Human
uguggcucac

SEQ ID NO: 1997523 - RNA, 12 nt, Human
uguggcuccaca

SEQ ID NO: 1997524 - RNA, 20 nt, Human
uguggcuccacacacacaaa

SEQ ID NO: 1997525 - RNA, 14 nt, Human
uguggccugccagu

SEQ ID NO: 1997526 - RNA, 18 nt, Human
uguggccucuucugagcu

SEQ ID NO: 1997527 - RNA, 16 nt, Human
uguggccucuucugag

SEQ ID NO: 1997528 - RNA, 23 nt, Human
uguggcgcagcauauucaggaag

SEQ ID NO: 1997529 - RNA, 11 nt, Human
uguguaauuua

SEQ ID NO: 1997530 - RNA, 18 nt, Human
uguguaauuuaaaauugu

SEQ ID NO: 1997531 - RNA, 22 nt, Human
ugugggcuaguugggcuuccuc

SEQ ID NO: 1997532 - RNA, 22 nt, Human
ugugggcgugagaccugccccu

SEQ ID NO: 1997533 - RNA, 20 nt, Human
ugugggcgugagaccugccc

SEQ ID NO: 1997534 - RNA, 21 nt, Human
ugugggcgugagaccugcccc

SEQ ID NO: 1997535 - RNA, 15 nt, Human
ugugggcaaaagagu

SEQ ID NO: 1997536 - RNA, 19 nt, Human
uguguaauuuaaaauugug

SEQ ID NO: 1997537 - RNA, 22 nt, Human
uguguaauuuaaaauugugaug

SEQ ID NO: 1997538 - RNA, 23 nt, Human
uguguaauuuaaaauugugaugu

SEQ ID NO: 1997539 - RNA, 12 nt, Human
uguguaauuuuu

SEQ ID NO: 1997540 - RNA, 14 nt, Human
uguguaauuuuucu

SEQ ID NO: 1997541 - RNA, 15 nt, Human
uguguaauuuuucug

SEQ ID NO: 1997542 - RNA, 17 nt, Human
uguguaauuuuucugua

SEQ ID NO: 1997543 - RNA, 19 nt, Human
uguguaauuuuucuguaua

SEQ ID NO: 1997544 - RNA, 16 nt, Human
uguguagggcgggagg

SEQ ID NO: 1997545 - RNA, 12 nt, Human
uguguagggcgg

SEQ ID NO: 1997546 - RNA, 10 nt, Human
ugugacauuu

SEQ ID NO: 1997547 - RNA, 15 nt, Human
ugugacauuugucau

SEQ ID NO: 1997548 - RNA, 18 nt, Human
ugugacauuugucauuuu

SEQ ID NO: 1997549 - RNA, 19 nt, Human
ugugacauuugucauuuuc

SEQ ID NO: 1997550 - RNA, 19 nt, Human
ugugaauuacuaacuucua

SEQ ID NO: 1997551 - RNA, 20 nt, Human
ugugaauuacuaacuucuaa

SEQ ID NO: 1997552 - RNA, 16 nt, Human
ugugaaggaccuucac

SEQ ID NO: 1997553 - RNA, 23 nt, Human
ugugaaggcaggggaauguaugu

SEQ ID NO: 1997554 - RNA, 13 nt, Human
ugugaauuacuaa

SEQ ID NO: 1997555 - RNA, 15 nt, Human
ugugaauuacuaacu

SEQ ID NO: 1997556 - RNA, 16 nt, Human
ugugaauuacuaacuu

SEQ ID NO: 1997557 - RNA, 17 nt, Human
ugugaauuacuaacuuc

SEQ ID NO: 1997558 - RNA, 18 nt, Human
ugugaggaagccgcuggg

SEQ ID NO: 1997559 - RNA, 13 nt, Human
ugugaggaagccg

SEQ ID NO: 1997560 - RNA, 22 nt, Human
ugugacauuugucauuuucauu

SEQ ID NO: 1997561 - RNA, 20 nt, Human
ugugacauuugucauuuuca

SEQ ID NO: 1997562 - RNA, 21 nt, Human
ugugacauuugucauuuucau

SEQ ID NO: 1997563 - RNA, 20 nt, Human
ugugaggaagccgcuggggc

SEQ ID NO: 1997564 - RNA, 12 nt, Human
ugugaggaagcc

SEQ ID NO: 1997565 - RNA, 12 nt, Human
ugugaggcagga

SEQ ID NO: 1997566 - RNA, 14 nt, Human
ugugaggcaggaga

SEQ ID NO: 1997567 - RNA, 15 nt, Human
ugugagucaccaagc

SEQ ID NO: 1997568 - RNA, 17 nt, Human
ugugagucaccaagccc

SEQ ID NO: 1997569 - RNA, 19 nt, Human
ugugagucaccaagcccag

SEQ ID NO: 1997570 - RNA, 21 nt, Human
ugugagucaccaagcccaguu

SEQ ID NO: 1997571 - RNA, 14 nt, Human
ugugagugguugaa

SEQ ID NO: 1997572 - RNA, 16 nt, Human
ugugauauaagugugu

SEQ ID NO: 1997573 - RNA, 15 nt, Human
ugugauauuccccuu

SEQ ID NO: 1997574 - RNA, 12 nt, Human
ugugcacaggca

SEQ ID NO: 1997575 - RNA, 13 nt, Human
ugugcacaggcag

SEQ ID NO: 1997576 - RNA, 14 nt, Human
ugugcacaggcaga

SEQ ID NO: 1997577 - RNA, 16 nt, Human
ugugcacaggcagagc

SEQ ID NO: 1997578 - RNA, 13 nt, Human
ugugauauuucag

SEQ ID NO: 1997579 - RNA, 14 nt, Human
ugugauauuucaga

SEQ ID NO: 1997580 - RNA, 16 nt, Human
ugugauauuucagaaa

SEQ ID NO: 1997581 - RNA, 20 nt, Human
ugugauauuucagaaauaca

SEQ ID NO: 1997582 - RNA, 22 nt, Human
ugugauauuucagaaauacaga

SEQ ID NO: 1997583 - RNA, 14 nt, Human
uguccucagggagc

SEQ ID NO: 1997584 - RNA, 19 nt, Human
uguccucagggagcaggga

SEQ ID NO: 1997585 - RNA, 12 nt, Human
uguccucaggga

SEQ ID NO: 1997586 - RNA, 23 nt, Human
uguccucagggagcagggaaggc

SEQ ID NO: 1997587 - RNA, 14 nt, Human
uguccuccugcugc

SEQ ID NO: 1997588 - RNA, 17 nt, Human
uguccuccugcugccag

SEQ ID NO: 1997589 - RNA, 18 nt, Human
uguccuccugcugccagu

SEQ ID NO: 1997590 - RNA, 19 nt, Human
ugucugaagucacugcaca

SEQ ID NO: 1997591 - RNA, 18 nt, Human
ugucugcuggucacuucu

SEQ ID NO: 1997592 - RNA, 21 nt, Human
ugucugcuggucacuucuucu

SEQ ID NO: 1997593 - RNA, 22 nt, Human
ugucugcuggucacuucuucug

SEQ ID NO: 1997594 - RNA, 23 nt, Human
ugucugcuggucacuucuucugu

SEQ ID NO: 1997595 - RNA, 17 nt, Human
ugucugaagucacugca

SEQ ID NO: 1997596 - RNA, 18 nt, Human
ugucugaagucacugcac

SEQ ID NO: 1997597 - RNA, 16 nt, Human
ugucugaagucacugc

SEQ ID NO: 1997598 - RNA, 17 nt, Human
ugucuggcacagccugc

SEQ ID NO: 1997599 - RNA, 18 nt, Human
ugucuggcacagccugca

SEQ ID NO: 1997600 - RNA, 20 nt, Human
ugucuggcacagccugcacu

SEQ ID NO: 1997601 - RNA, 23 nt, Human
ugucuuuucuugcaugaggcuag

SEQ ID NO: 1997602 - RNA, 17 nt, Human
ugucuuucuugcucccu

SEQ ID NO: 1997603 - RNA, 19 nt, Human
ugucuuuucuuugccaucu

SEQ ID NO: 1997604 - RNA, 20 nt, Human
ugucuuuucuuugccaucuc

SEQ ID NO: 1997605 - RNA, 23 nt, Human
ugugaaaagaaaaaugagccugg

SEQ ID NO: 1997606 - RNA, 22 nt, Human
ugugaagcuuaagggucauaug

SEQ ID NO: 1997607 - RNA, 13 nt, Human
ugugaaggaccuu

SEQ ID NO: 1997608 - RNA, 18 nt, Human
ugugaaggaccuucacuc

SEQ ID NO: 1997609 - RNA, 17 nt, Human
ugugaaaaugugugugu

SEQ ID NO: 1997610 - RNA, 12 nt, Human
ugugaagcugga

SEQ ID NO: 1997611 - RNA, 21 nt, Human
ugugaagcuggaacugcggga

SEQ ID NO: 1997612 - RNA, 16 nt, Human
ugugaaaaugugugug

SEQ ID NO: 1997613 - RNA, 21 nt, Human
ugucuuuucuugcaugaggcu

SEQ ID NO: 1997614 - RNA, 16 nt, Human
ugucuuuggacccuga

SEQ ID NO: 1997615 - RNA, 14 nt, Human
ugucuuuggacccu

SEQ ID NO: 1997616 - RNA, 13 nt, Human
ugucuuucugggg

SEQ ID NO: 1997617 - RNA, 16 nt, Human
ugucugucccaguuaa

SEQ ID NO: 1997618 - RNA, 22 nt, Human
ugcucuccucuugccacugccu

SEQ ID NO: 1997619 - RNA, 17 nt, Human
ugcucuccaagcccagu

SEQ ID NO: 1997620 - RNA, 22 nt, Human
ugcucucaccuugguuccuggg

SEQ ID NO: 1997621 - RNA, 16 nt, Human
ugcucuccucuugcca

SEQ ID NO: 1997622 - RNA, 14 nt, Human
ugcucuccucuugc

SEQ ID NO: 1997623 - RNA, 18 nt, Human
ugcucuccucuugccacu

SEQ ID NO: 1997624 - RNA, 21 nt, Human
ugcucuccucuugccacugcc

SEQ ID NO: 1997625 - RNA, 22 nt, Human
ugcucgccucggaucagcugag

SEQ ID NO: 1997626 - RNA, 18 nt, Human
ugcucucaaaccccugac

SEQ ID NO: 1997627 - RNA, 19 nt, Human
ugcucucaaaccccugacc

SEQ ID NO: 1997628 - RNA, 20 nt, Human
ugcucucaaaccccugaccu

SEQ ID NO: 1997629 - RNA, 21 nt, Human
ugcucucaaaccccugaccuc

SEQ ID NO: 1997630 - RNA, 20 nt, Human
ugcucucaccuugguuccug

SEQ ID NO: 1997631 - RNA, 18 nt, Human
ugcuccuuucuuguuuua

SEQ ID NO: 1997632 - RNA, 17 nt, Human
ugcuccucuccccagca

SEQ ID NO: 1997633 - RNA, 18 nt, Human
ugcuccucuccccagcaa

SEQ ID NO: 1997634 - RNA, 17 nt, Human
ugcucagaccagcucuu

SEQ ID NO: 1997635 - RNA, 16 nt, Human
ugcucagaccagcucu

SEQ ID NO: 1997636 - RNA, 17 nt, Human
ugcucagagcaguguuu

SEQ ID NO: 1997637 - RNA, 15 nt, Human
ugcucacauaucugu

SEQ ID NO: 1997638 - RNA, 16 nt, Human
ugcucacauaucuguc

SEQ ID NO: 1997639 - RNA, 22 nt, Human
ugcucagggaaaagcagcucuc

SEQ ID NO: 1997640 - RNA, 21 nt, Human
ugcucagggaaaagcagcucu

SEQ ID NO: 1997641 - RNA, 15 nt, Human
ugcucacaguuauua

SEQ ID NO: 1997642 - RNA, 15 nt, Human
ugcucagcagugaga

SEQ ID NO: 1997643 - RNA, 17 nt, Human
ugcucagcagugagagc

SEQ ID NO: 1997644 - RNA, 20 nt, Human
ugcucagcagugagagcaga

SEQ ID NO: 1997645 - RNA, 14 nt, Human
ugcuccucucccca

SEQ ID NO: 1997646 - RNA, 19 nt, Human
ugcucagugucuggcugca

SEQ ID NO: 1997647 - RNA, 13 nt, Human
ugcugcuggcugg

SEQ ID NO: 1997648 - RNA, 14 nt, Human
ugcugcuuugauau

SEQ ID NO: 1997649 - RNA, 16 nt, Human
ugcugcuuugauauau

SEQ ID NO: 1997650 - RNA, 19 nt, Human
ugcuggaacucuugacagc

SEQ ID NO: 1997651 - RNA, 12 nt, Human
ugcuggaaagag

SEQ ID NO: 1997652 - RNA, 14 nt, Human
ugcugcuaauucuu

SEQ ID NO: 1997653 - RNA, 18 nt, Human
ugcugcuaauucuuugca

SEQ ID NO: 1997654 - RNA, 21 nt, Human
ugcugcuaauucuuugcaaaa

SEQ ID NO: 1997655 - RNA, 18 nt, Human
ugcugcaguugccaguca

SEQ ID NO: 1997656 - RNA, 23 nt, Human
ugcugcaguugccagucaccccg

SEQ ID NO: 1997657 - RNA, 17 nt, Human
ugcugauggugcaauga

SEQ ID NO: 1997658 - RNA, 15 nt, Human
ugcugauggugcaau

SEQ ID NO: 1997659 - RNA, 13 nt, Human
ugcugauggugca

SEQ ID NO: 1997660 - RNA, 18 nt, Human
ugcugauggugcaaugac

SEQ ID NO: 1997661 - RNA, 18 nt, Human
ugcugauuuuauucuuga

SEQ ID NO: 1997662 - RNA, 19 nt, Human
ugcugauuuuauucuugau

SEQ ID NO: 1997663 - RNA, 13 nt, Human
ugcugauuuuauu

SEQ ID NO: 1997664 - RNA, 16 nt, Human
ugcugauuuuauucuu

SEQ ID NO: 1997665 - RNA, 17 nt, Human
ugcugauuuuauucuug

SEQ ID NO: 1997666 - RNA, 21 nt, Human
ugcugaaggcucgagcaugcc

SEQ ID NO: 1997667 - RNA, 13 nt, Human
ugcugaaggcucg

SEQ ID NO: 1997668 - RNA, 22 nt, Human
ugcugacagacacaggcccggc

SEQ ID NO: 1997669 - RNA, 23 nt, Human
ugcugacagacacaggcccggcu

SEQ ID NO: 1997670 - RNA, 12 nt, Human
ugcugaaggcuc

SEQ ID NO: 1997671 - RNA, 23 nt, Human
ugcugaaggaauaaauugcuccu

SEQ ID NO: 1997672 - RNA, 21 nt, Human
ugcugaacauugcauauaacu

SEQ ID NO: 1997673 - RNA, 14 nt, Human
ugcugaacauugga

SEQ ID NO: 1997674 - RNA, 22 nt, Human
ugcugaacauuggagaaucuca

SEQ ID NO: 1997675 - RNA, 19 nt, Human
ugcugaacauugcauauaa

SEQ ID NO: 1997676 - RNA, 15 nt, Human
ugccucuccgccccu

SEQ ID NO: 1997677 - RNA, 20 nt, Human
ugccucuccgccccugagcc

SEQ ID NO: 1997678 - RNA, 9 nt, Human
ugccucucu

SEQ ID NO: 1997679 - RNA, 21 nt, Human
ugccucuccgccccugagccc

SEQ ID NO: 1997680 - RNA, 22 nt, Human
ugccucuccgccccugagccca

SEQ ID NO: 1997681 - RNA, 13 nt, Human
ugccucuugucuu

SEQ ID NO: 1997682 - RNA, 19 nt, Human
ugccugacagagggaugga

SEQ ID NO: 1997683 - RNA, 15 nt, Human
ugccccuggccuugg

SEQ ID NO: 1997684 - RNA, 19 nt, Human
ugccccuggccuugggauc

SEQ ID NO: 1997685 - RNA, 14 nt, Human
ugccccuggccuug

SEQ ID NO: 1997686 - RNA, 18 nt, Human
ugccccuggcagccccug

SEQ ID NO: 1997687 - RNA, 12 nt, Human
ugccucuagcug

SEQ ID NO: 1997688 - RNA, 13 nt, Human
ugccucuagcuga

SEQ ID NO: 1997689 - RNA, 14 nt, Human
ugccucuagcugaa

SEQ ID NO: 1997690 - RNA, 20 nt, Human
ugccucgaacuggcugcaaa

SEQ ID NO: 1997691 - RNA, 18 nt, Human
ugccucgaacuggcugca

SEQ ID NO: 1997692 - RNA, 19 nt, Human
ugccucgaacuggcugcaa

SEQ ID NO: 1997693 - RNA, 18 nt, Human
ugccugggcagaaggaag

SEQ ID NO: 1997694 - RNA, 21 nt, Human
ugccugggaucccucauccuc

SEQ ID NO: 1997695 - RNA, 22 nt, Human
ugccugaggggcagccugccuu

SEQ ID NO: 1997696 - RNA, 15 nt, Human
ugccuggcggggugg

SEQ ID NO: 1997697 - RNA, 15 nt, Human
ugccugaggggcagc

SEQ ID NO: 1997698 - RNA, 16 nt, Human
ugccugaggggcagcc

SEQ ID NO: 1997699 - RNA, 18 nt, Human
ugccugaggggcagccug

SEQ ID NO: 1997700 - RNA, 14 nt, Human
ugccugguggcagc

SEQ ID NO: 1997701 - RNA, 15 nt, Human
ugccugguggcagcu

SEQ ID NO: 1997702 - RNA, 18 nt, Human
ugccuguaaucacagcua

SEQ ID NO: 1997703 - RNA, 16 nt, Human
ugccugguggcagcug

SEQ ID NO: 1997704 - RNA, 14 nt, Human
ugccugugaacuga

SEQ ID NO: 1997705 - RNA, 22 nt, Human
ugcuaaacguguauguuuuuca

SEQ ID NO: 1997706 - RNA, 23 nt, Human
ugcuaaacguguauguuuuucag

SEQ ID NO: 1997707 - RNA, 15 nt, Human
ugcuaaaugugaaug

SEQ ID NO: 1997708 - RNA, 22 nt, Human
ugcuaagacucaguggggaggg

SEQ ID NO: 1997709 - RNA, 12 nt, Human
ugcuaaauuuca

SEQ ID NO: 1997710 - RNA, 15 nt, Human
ugcuaaauugauguu

SEQ ID NO: 1997711 - RNA, 16 nt, Human
ugcuaaauugauguug

SEQ ID NO: 1997712 - RNA, 17 nt, Human
ugcuaaauugauguuga

SEQ ID NO: 1997713 - RNA, 18 nt, Human
ugcuaaauugauguugau

SEQ ID NO: 1997714 - RNA, 21 nt, Human
ugcuaaauugauguugaugca

SEQ ID NO: 1997715 - RNA, 14 nt, Human
ugcgccuacaggag

SEQ ID NO: 1997716 - RNA, 16 nt, Human
ugcgccuacaggagug

SEQ ID NO: 1997717 - RNA, 22 nt, Human
ugcgccuacaggagugagcacu

SEQ ID NO: 1997718 - RNA, 17 nt, Human
ugcuaaacguguauguu

SEQ ID NO: 1997719 - RNA, 18 nt, Human
ugcuaaacguguauguuu

SEQ ID NO: 1997720 - RNA, 19 nt, Human
ugcuaaacguguauguuuu

SEQ ID NO: 1997721 - RNA, 14 nt, Human
ugcgaucuggguuc

SEQ ID NO: 1997722 - RNA, 14 nt, Human
ugccuugacaaacu

SEQ ID NO: 1997723 - RNA, 21 nt, Human
ugccuugacaaacuucuuuca

SEQ ID NO: 1997724 - RNA, 15 nt, Human
ugcgaucuggguuca

SEQ ID NO: 1997725 - RNA, 19 nt, Human
ugcgaucuggguucacugc

SEQ ID NO: 1997726 - RNA, 20 nt, Human
ugcgaucuggguucacugca

SEQ ID NO: 1997727 - RNA, 21 nt, Human
ugcgaucuggguucacugcaa

SEQ ID NO: 1997728 - RNA, 18 nt, Human
ugccuucgguacccacca

SEQ ID NO: 1997729 - RNA, 19 nt, Human
ugccuucgguacccaccac

SEQ ID NO: 1997730 - RNA, 17 nt, Human
ugccugugaacugaacu

SEQ ID NO: 1997731 - RNA, 18 nt, Human
ugccugugaacugaacuc

SEQ ID NO: 1997732 - RNA, 21 nt, Human
ugccugugaacugaacucuga

SEQ ID NO: 1997733 - RNA, 14 nt, Human
ugcacuuucagacu

SEQ ID NO: 1997734 - RNA, 21 nt, Human
ugcacuuucagacucucucug

SEQ ID NO: 1997735 - RNA, 14 nt, Human
ugcacuuuguucug

SEQ ID NO: 1997736 - RNA, 12 nt, Human
ugcacuuuguuc

SEQ ID NO: 1997737 - RNA, 20 nt, Human
ugcagcaauaaagcagcguu

SEQ ID NO: 1997738 - RNA, 23 nt, Human
ugcagcaauaaagcagcguuucu

SEQ ID NO: 1997739 - RNA, 23 nt, Human
ugcagcacagcugagaggcuguc

SEQ ID NO: 1997740 - RNA, 11 nt, Human
ugcagagcugc

SEQ ID NO: 1997741 - RNA, 19 nt, Human
ugcagaggcuaugggaaga

SEQ ID NO: 1997742 - RNA, 22 nt, Human
ugcagagcagugggccuggcca

SEQ ID NO: 1997743 - RNA, 13 nt, Human
ugcagagcugaag

SEQ ID NO: 1997744 - RNA, 21 nt, Human
ugcagagcaggaaacaugacu

SEQ ID NO: 1997745 - RNA, 17 nt, Human
ugcagagcaguaaggga

SEQ ID NO: 1997746 - RNA, 18 nt, Human
ugcagagcaguaagggaa

SEQ ID NO: 1997747 - RNA, 14 nt, Human
ugcacugacucugg

SEQ ID NO: 1997748 - RNA, 15 nt, Human
ugcacugacucugga

SEQ ID NO: 1997749 - RNA, 16 nt, Human
ugcacugacucuggaa

SEQ ID NO: 1997750 - RNA, 17 nt, Human
ugcacugacucuggaaa

SEQ ID NO: 1997751 - RNA, 12 nt, Human
ugcacugacucu

SEQ ID NO: 1997752 - RNA, 13 nt, Human
ugcacugacucug

SEQ ID NO: 1997753 - RNA, 22 nt, Human
ugcacgcugggcaaugagaauc

SEQ ID NO: 1997754 - RNA, 14 nt, Human
ugcacgcuggggaa

SEQ ID NO: 1997755 - RNA, 15 nt, Human
ugcacgcuggggaag

SEQ ID NO: 1997756 - RNA, 20 nt, Human
ugaguccccuguuuguuucu

SEQ ID NO: 1997757 - RNA, 17 nt, Human
ugcaccgggccacagag

SEQ ID NO: 1997758 - RNA, 22 nt, Human
ugcaccgggccacagagaaagu

SEQ ID NO: 1997759 - RNA, 23 nt, Human
ugcaccggcuggccuggccccuc

SEQ ID NO: 1997760 - RNA, 19 nt, Human
ugaguccccuguuuguuuc

SEQ ID NO: 1997761 - RNA, 14 nt, Human
ugcaccgggccaca

SEQ ID NO: 1997762 - RNA, 15 nt, Human
ugcaccgggccacag

SEQ ID NO: 1997763 - RNA, 14 nt, Human
ugcagcagggcagu

SEQ ID NO: 1997764 - RNA, 17 nt, Human
ugcaggauucucaccag

SEQ ID NO: 1997765 - RNA, 21 nt, Human
ugcaggauucucaccagcugu

SEQ ID NO: 1997766 - RNA, 14 nt, Human
ugcaggcagccagg

SEQ ID NO: 1997767 - RNA, 13 nt, Human
ugcaggcagccag

SEQ ID NO: 1997768 - RNA, 15 nt, Human
ugcaggcagccaggc

SEQ ID NO: 1997769 - RNA, 10 nt, Human
ugcaggcagg

SEQ ID NO: 1997770 - RNA, 15 nt, Human
ugcaggccaggccag

SEQ ID NO: 1997771 - RNA, 12 nt, Human
ugcaggcccacc

SEQ ID NO: 1997772 - RNA, 13 nt, Human
ugcaggcccaccc

SEQ ID NO: 1997773 - RNA, 14 nt, Human
ugcaggcccacccu

SEQ ID NO: 1997774 - RNA, 15 nt, Human
ugcaggcccacccug

SEQ ID NO: 1997775 - RNA, 11 nt, Human
ugcaggcaggc

SEQ ID NO: 1997776 - RNA, 13 nt, Human
ugcaggcaggcug

SEQ ID NO: 1997777 - RNA, 17 nt, Human
ugcaggcccacccugcu

SEQ ID NO: 1997778 - RNA, 16 nt, Human
ugcagugcuuccaagg

SEQ ID NO: 1997779 - RNA, 22 nt, Human
ugcagugguaugaucacggcuc

SEQ ID NO: 1997780 - RNA, 22 nt, Human
ugcaguggcgaaaucccugcuc

SEQ ID NO: 1997781 - RNA, 14 nt, Human
ugcaguugccaguc

SEQ ID NO: 1997782 - RNA, 13 nt, Human
ugcaguugccagu

SEQ ID NO: 1997783 - RNA, 13 nt, Human
ugcauauauauau

SEQ ID NO: 1997784 - RNA, 15 nt, Human
ugcauauauauaugu

SEQ ID NO: 1997785 - RNA, 17 nt, Human
ugcauauauauaugugu

SEQ ID NO: 1997786 - RNA, 22 nt, Human
ugcauauaacuuauauuguaag

SEQ ID NO: 1997787 - RNA, 20 nt, Human
ugcauauaacuuauauugua

SEQ ID NO: 1997788 - RNA, 21 nt, Human
ugcauauaacuuauauuguaa

SEQ ID NO: 1997789 - RNA, 15 nt, Human
ugcaguugccaguca

SEQ ID NO: 1997790 - RNA, 14 nt, Human
ugcccaugcugggc

SEQ ID NO: 1997791 - RNA, 17 nt, Human
ugcccaugcugggcucc

SEQ ID NO: 1997792 - RNA, 17 nt, Human
ugcccagguggcugugg

SEQ ID NO: 1997793 - RNA, 19 nt, Human
ugcccagguggcuguggaa

SEQ ID NO: 1997794 - RNA, 17 nt, Human
ugccccuggcagccccu

SEQ ID NO: 1997795 - RNA, 13 nt, Human
ugccccucccuuc

SEQ ID NO: 1997796 - RNA, 15 nt, Human
ugccccagggcuccc

SEQ ID NO: 1997797 - RNA, 15 nt, Human
ugccccagcuugggc

SEQ ID NO: 1997798 - RNA, 23 nt, Human
ugccccucaacucuccuccagag

SEQ ID NO: 1997799 - RNA, 15 nt, Human
ugcccacucccugca

SEQ ID NO: 1997800 - RNA, 14 nt, Human
ugcccacucccugc

SEQ ID NO: 1997801 - RNA, 16 nt, Human
ugcccacucccugcaa

SEQ ID NO: 1997802 - RNA, 11 nt, Human
ugcccaggcug

SEQ ID NO: 1997803 - RNA, 21 nt, Human
ugcccacucccugcaaccuga

SEQ ID NO: 1997804 - RNA, 18 nt, Human
ugcccaggcuggagugca

SEQ ID NO: 1997805 - RNA, 13 nt, Human
ugcccaggcuggc

SEQ ID NO: 1997806 - RNA, 15 nt, Human
ugcccaggcuggagu

SEQ ID NO: 1997807 - RNA, 20 nt, Human
ugcccaggcuggagugcagu

SEQ ID NO: 1997808 - RNA, 14 nt, Human
ugcccaccuggccu

SEQ ID NO: 1997809 - RNA, 13 nt, Human
ugcccaccuggcc

SEQ ID NO: 1997810 - RNA, 17 nt, Human
ugcccacccuccacucu

SEQ ID NO: 1997811 - RNA, 21 nt, Human
ugccauccagguucagcuugu

SEQ ID NO: 1997812 - RNA, 20 nt, Human
ugccauccagguucagcuug

SEQ ID NO: 1997813 - RNA, 18 nt, Human
ugccaggauggaaugaug

SEQ ID NO: 1997814 - RNA, 14 nt, Human
ugccaggcacaggc

SEQ ID NO: 1997815 - RNA, 15 nt, Human
ugccaggcacaggca

SEQ ID NO: 1997816 - RNA, 16 nt, Human
ugccaggcacaggcag

SEQ ID NO: 1997817 - RNA, 17 nt, Human
ugccaggcacaggcagg

SEQ ID NO: 1997818 - RNA, 18 nt, Human
ugccaggcacaggcaggg

SEQ ID NO: 1997819 - RNA, 19 nt, Human
ugccaggcacaggcagggc

SEQ ID NO: 1997820 - RNA, 20 nt, Human
ugccaggcacaggcagggca

SEQ ID NO: 1997821 - RNA, 21 nt, Human
ugccaggcacaggcagggcag

SEQ ID NO: 1997822 - RNA, 22 nt, Human
ugccaggcacaggcagggcagg

SEQ ID NO: 1997823 - RNA, 21 nt, Human
ugccacuaccccuugauuuuc

SEQ ID NO: 1997824 - RNA, 10 nt, Human
ugccaggcau

SEQ ID NO: 1997825 - RNA, 18 nt, Human
ugccagguuuuuggucug

SEQ ID NO: 1997826 - RNA, 19 nt, Human
ugccagguuuuuggucuga

SEQ ID NO: 1997827 - RNA, 22 nt, Human
ugccagguuuuuggucugaccc

SEQ ID NO: 1997828 - RNA, 15 nt, Human
ugccacccugcugag

SEQ ID NO: 1997829 - RNA, 20 nt, Human
ugccacuaaauugacacuua

SEQ ID NO: 1997830 - RNA, 19 nt, Human
ugccacccuggggagaaag

SEQ ID NO: 1997831 - RNA, 22 nt, Human
ugccacuacggaauaguuggcu

SEQ ID NO: 1997832 - RNA, 20 nt, Human
ugccacccuggggagaaagu

SEQ ID NO: 1997833 - RNA, 20 nt, Human
ugccacuaccccuugauuuu

SEQ ID NO: 1997834 - RNA, 14 nt, Human
ugcaucaagaugug

SEQ ID NO: 1997835 - RNA, 19 nt, Human
ugcaucaagaugugacaug

SEQ ID NO: 1997836 - RNA, 19 nt, Human
ugccaaauauaaauaaaaa

SEQ ID NO: 1997837 - RNA, 22 nt, Human
ugccaaauauaaauaaaaauaa

SEQ ID NO: 1997838 - RNA, 21 nt, Human
ugcauauuuauaaaaauaaaa

SEQ ID NO: 1997839 - RNA, 14 nt, Human
ugcauaucuucauc

SEQ ID NO: 1997840 - RNA, 20 nt, Human
ugcauauuuauaaaaauaaa

SEQ ID NO: 1997841 - RNA, 17 nt, Human
ugccaaauauaaauaaa

SEQ ID NO: 1997842 - RNA, 18 nt, Human
ugccaaauauaaauaaaa

SEQ ID NO: 1997843 - RNA, 14 nt, Human
ugggagauguggaa

SEQ ID NO: 1997844 - RNA, 13 nt, Human
ugggagcaaaaga

SEQ ID NO: 1997845 - RNA, 12 nt, Human
ugggagcugccu

SEQ ID NO: 1997846 - RNA, 13 nt, Human
ugggagcugccug

SEQ ID NO: 1997847 - RNA, 14 nt, Human
ugggagcugccugu

SEQ ID NO: 1997848 - RNA, 22 nt, Human
ugggacaacuguagaggcaguu

SEQ ID NO: 1997849 - RNA, 12 nt, Human
ugggacacccug

SEQ ID NO: 1997850 - RNA, 15 nt, Human
ugggacgcucugcug

SEQ ID NO: 1997851 - RNA, 16 nt, Human
ugggacgcucugcugu

SEQ ID NO: 1997852 - RNA, 13 nt, Human
ugggacacccugu

SEQ ID NO: 1997853 - RNA, 15 nt, Human
ugggcagaggaaagc

SEQ ID NO: 1997854 - RNA, 17 nt, Human
ugggauuacagguguga

SEQ ID NO: 1997855 - RNA, 17 nt, Human
ugggauuauauaucccu

SEQ ID NO: 1997856 - RNA, 13 nt, Human
ugggauccuggag

SEQ ID NO: 1997857 - RNA, 18 nt, Human
ugggauccuccaggugca

SEQ ID NO: 1997858 - RNA, 16 nt, Human
ugggauuacaggugug

SEQ ID NO: 1997859 - RNA, 18 nt, Human
ugggauuacaggcuccug

SEQ ID NO: 1997860 - RNA, 21 nt, Human
ugggagugaggaugucugggc

SEQ ID NO: 1997861 - RNA, 15 nt, Human
ugggauccuccaggu

SEQ ID NO: 1997862 - RNA, 15 nt, Human
ugggagugagcuggu

SEQ ID NO: 1997863 - RNA, 20 nt, Human
ugggaguaguuggagcauug

SEQ ID NO: 1997864 - RNA, 17 nt, Human
ugggagcugccuguuca

SEQ ID NO: 1997865 - RNA, 21 nt, Human
ugggagcugccuguucagcuc

SEQ ID NO: 1997866 - RNA, 22 nt, Human
ugggagcugccuguucagcucc

SEQ ID NO: 1997867 - RNA, 14 nt, Human
ugggaguacaaaag

SEQ ID NO: 1997868 - RNA, 21 nt, Human
uggcugcuucaaggauccuga

SEQ ID NO: 1997869 - RNA, 16 nt, Human
uggcugcuucaaggau

SEQ ID NO: 1997870 - RNA, 21 nt, Human
uggcugggggccucagugcca

SEQ ID NO: 1997871 - RNA, 18 nt, Human
uggcuggaagggguccag

SEQ ID NO: 1997872 - RNA, 13 nt, Human
uggcuggaagggg

SEQ ID NO: 1997873 - RNA, 18 nt, Human
uggcccauguauggccag

SEQ ID NO: 1997874 - RNA, 21 nt, Human
uggcccauguauggccaggaa

SEQ ID NO: 1997875 - RNA, 17 nt, Human
uggcccauguauggcca

SEQ ID NO: 1997876 - RNA, 18 nt, Human
uggccccacaccagcccc

SEQ ID NO: 1997877 - RNA, 12 nt, Human
uggccccaccug

SEQ ID NO: 1997878 - RNA, 13 nt, Human
uggccccaccugg

SEQ ID NO: 1997879 - RNA, 16 nt, Human
uggccccaccuggccc

SEQ ID NO: 1997880 - RNA, 17 nt, Human
uggccccaccuggcccu

SEQ ID NO: 1997881 - RNA, 19 nt, Human
uggccccaccuggcccucu

SEQ ID NO: 1997882 - RNA, 23 nt, Human
uggccccaccuggcccucucuga

SEQ ID NO: 1997883 - RNA, 18 nt, Human
uggcuugaauuaagaaga

SEQ ID NO: 1997884 - RNA, 14 nt, Human
uggcuuuugugcau

SEQ ID NO: 1997885 - RNA, 21 nt, Human
uggcuugaguuuaaauuguaa

SEQ ID NO: 1997886 - RNA, 20 nt, Human
ugggggaucacagccucuga

SEQ ID NO: 1997887 - RNA, 16 nt, Human
ugggggaugggccuga

SEQ ID NO: 1997888 - RNA, 20 nt, Human
uggggauugggccccugcca

SEQ ID NO: 1997889 - RNA, 21 nt, Human
ugggggaucacagccucugaa

SEQ ID NO: 1997890 - RNA, 13 nt, Human
uggggauucagau

SEQ ID NO: 1997891 - RNA, 16 nt, Human
uggggauucagauuuc

SEQ ID NO: 1997892 - RNA, 18 nt, Human
uggggauucagauuucuc

SEQ ID NO: 1997893 - RNA, 20 nt, Human
uggggauucagauuucucuu

SEQ ID NO: 1997894 - RNA, 11 nt, Human
ugggggaugua

SEQ ID NO: 1997895 - RNA, 17 nt, Human
ugggggaugggccugag

SEQ ID NO: 1997896 - RNA, 17 nt, Human
ugggggcucagcaaggc

SEQ ID NO: 1997897 - RNA, 18 nt, Human
ugggggcucagcaaggcc

SEQ ID NO: 1997898 - RNA, 18 nt, Human
ugggggcugggcagagga

SEQ ID NO: 1997899 - RNA, 17 nt, Human
ugggggcugggcagagg

SEQ ID NO: 1997900 - RNA, 18 nt, Human
ugggggucuguguguuua

SEQ ID NO: 1997901 - RNA, 15 nt, Human
ugggggucugugugu

SEQ ID NO: 1997902 - RNA, 19 nt, Human
ugggggcugggcagaggaa

SEQ ID NO: 1997903 - RNA, 23 nt, Human
ugggggcucagcaaggccaccuc

SEQ ID NO: 1997904 - RNA, 12 nt, Human
ugggggugcauu

SEQ ID NO: 1997905 - RNA, 15 nt, Human
ugggggugcauuuga

SEQ ID NO: 1997906 - RNA, 16 nt, Human
ugggcagaggaaagca

SEQ ID NO: 1997907 - RNA, 22 nt, Human
ugggcagaucucccacaugcca

SEQ ID NO: 1997908 - RNA, 22 nt, Human
ugggcuaagugauccucccacc

SEQ ID NO: 1997909 - RNA, 20 nt, Human
ugggcgugagaccugccccu

SEQ ID NO: 1997910 - RNA, 16 nt, Human
ugggcuaguugggcuu

SEQ ID NO: 1997911 - RNA, 23 nt, Human
ugggcuggguucuacccaggugc

SEQ ID NO: 1997912 - RNA, 17 nt, Human
ugggcuggugucaccug

SEQ ID NO: 1997913 - RNA, 15 nt, Human
ugggcuucaguggca

SEQ ID NO: 1997914 - RNA, 17 nt, Human
ugggcuucaguggcagc

SEQ ID NO: 1997915 - RNA, 14 nt, Human
uggguuagacugcc

SEQ ID NO: 1997916 - RNA, 15 nt, Human
uggguuagacugcca

SEQ ID NO: 1997917 - RNA, 16 nt, Human
uggguuagacugccag

SEQ ID NO: 1997918 - RNA, 19 nt, Human
uggguuagacugccagcuc

SEQ ID NO: 1997919 - RNA, 20 nt, Human
uggguuagacugccagcucu

SEQ ID NO: 1997920 - RNA, 16 nt, Human
uggguucuacccaggu

SEQ ID NO: 1997921 - RNA, 15 nt, Human
uggguucuacccagg

SEQ ID NO: 1997922 - RNA, 22 nt, Human
uggguucuacccaggugcuagg

SEQ ID NO: 1997923 - RNA, 14 nt, Human
uggguuaguggaug

SEQ ID NO: 1997924 - RNA, 20 nt, Human
uggguggggggcuucauaca

SEQ ID NO: 1997925 - RNA, 21 nt, Human
uggguggggggcuucauacac

SEQ ID NO: 1997926 - RNA, 18 nt, Human
uggguggggggcuucaua

SEQ ID NO: 1997927 - RNA, 19 nt, Human
ugggguuuaucagaauucu

SEQ ID NO: 1997928 - RNA, 16 nt, Human
uggguaacuagggaag

SEQ ID NO: 1997929 - RNA, 18 nt, Human
uggguuucuaaagcugcc

SEQ ID NO: 1997930 - RNA, 17 nt, Human
uggguuucuaaagcugc

SEQ ID NO: 1997931 - RNA, 21 nt, Human
uggguuucuaaagcugccagc

SEQ ID NO: 1997932 - RNA, 19 nt, Human
uggguuuucuuaaccaucu

SEQ ID NO: 1997933 - RNA, 17 nt, Human
ugguaguuucugugguu

SEQ ID NO: 1997934 - RNA, 15 nt, Human
ugguaguuuuacagu

SEQ ID NO: 1997935 - RNA, 23 nt, Human
ugguauuggcuagagguucaaag

SEQ ID NO: 1997936 - RNA, 18 nt, Human
ugguaugaucacggcuca

SEQ ID NO: 1997937 - RNA, 22 nt, Human
ugguauauccuuuucuguguuu

SEQ ID NO: 1997938 - RNA, 15 nt, Human
ugguaucuaauucuu

SEQ ID NO: 1997939 - RNA, 20 nt, Human
ugguaucuaauucuuuaaug

SEQ ID NO: 1997940 - RNA, 21 nt, Human
ugguaucuaauucuuuaauga

SEQ ID NO: 1997941 - RNA, 19 nt, Human
uggcaacaaacugcacaug

SEQ ID NO: 1997942 - RNA, 23 nt, Human
uggcaaauguaacugugccaguu

SEQ ID NO: 1997943 - RNA, 17 nt, Human
uggcaacaaacugcaca

SEQ ID NO: 1997944 - RNA, 18 nt, Human
uggcaacaaacugcacau

SEQ ID NO: 1997945 - RNA, 13 nt, Human
uggcaacaaacug

SEQ ID NO: 1997946 - RNA, 14 nt, Human
uggcaacaaacugc

SEQ ID NO: 1997947 - RNA, 15 nt, Human
uggcaacaaacugca

SEQ ID NO: 1997948 - RNA, 13 nt, Human
uggauuuuauguu

SEQ ID NO: 1997949 - RNA, 15 nt, Human
uggauuuuauguuga

SEQ ID NO: 1997950 - RNA, 16 nt, Human
uggauuuuauguugac

SEQ ID NO: 1997951 - RNA, 22 nt, Human
uggauuuuauguugacauuugu

SEQ ID NO: 1997952 - RNA, 16 nt, Human
uggauuuggagagaaa

SEQ ID NO: 1997953 - RNA, 17 nt, Human
uggauuuggagagaaau

SEQ ID NO: 1997954 - RNA, 19 nt, Human
uggauuuggagagaaauau

SEQ ID NO: 1997955 - RNA, 20 nt, Human
uggauuuggagagaaauauu

SEQ ID NO: 1997956 - RNA, 21 nt, Human
uggauuuggagagaaauauuu

SEQ ID NO: 1997957 - RNA, 22 nt, Human
uggauuuggagagaaauauuuu

SEQ ID NO: 1997958 - RNA, 18 nt, Human
uggauccuugucaguugu

SEQ ID NO: 1997959 - RNA, 12 nt, Human
uggaucaggaaa

SEQ ID NO: 1997960 - RNA, 20 nt, Human
uggauuuaacagaaauguac

SEQ ID NO: 1997961 - RNA, 24 nt, Human
uggauuuaacagaaauguacagca

SEQ ID NO: 1997962 - RNA, 15 nt, Human
uggaggaccugcccg

SEQ ID NO: 1997963 - RNA, 12 nt, Human
uggagggaaagc

SEQ ID NO: 1997964 - RNA, 12 nt, Human
uggagggccugg

SEQ ID NO: 1997965 - RNA, 13 nt, Human
uggagggccuggg

SEQ ID NO: 1997966 - RNA, 15 nt, Human
uggagggccugggcc

SEQ ID NO: 1997967 - RNA, 17 nt, Human
uggagggccugggccug

SEQ ID NO: 1997968 - RNA, 18 nt, Human
uggagggccugggccugg

SEQ ID NO: 1997969 - RNA, 22 nt, Human
uggagggccugggccuggcucc

SEQ ID NO: 1997970 - RNA, 18 nt, Human
uggaggaaggaaacccag

SEQ ID NO: 1997971 - RNA, 12 nt, Human
uggaggaaggaa

SEQ ID NO: 1997972 - RNA, 20 nt, Human
uggaggaaggaaacccagcu

SEQ ID NO: 1997973 - RNA, 15 nt, Human
uggaggaagaacuga

SEQ ID NO: 1997974 - RNA, 17 nt, Human
uggaggaagaacugaaa

SEQ ID NO: 1997975 - RNA, 20 nt, Human
uggaggaagaacugaaaggc

SEQ ID NO: 1997976 - RNA, 14 nt, Human
uggacucuaaaguc

SEQ ID NO: 1997977 - RNA, 15 nt, Human
uggacuccucugucc

SEQ ID NO: 1997978 - RNA, 18 nt, Human
uggacucagaaacuccau

SEQ ID NO: 1997979 - RNA, 14 nt, Human
uggacuccucuguc

SEQ ID NO: 1997980 - RNA, 15 nt, Human
uggacuccugcacac

SEQ ID NO: 1997981 - RNA, 20 nt, Human
uggccagaugcaccagcccu

SEQ ID NO: 1997982 - RNA, 21 nt, Human
uggccagaugcaccagcccuu

SEQ ID NO: 1997983 - RNA, 17 nt, Human
uggccacuccagacccc

SEQ ID NO: 1997984 - RNA, 20 nt, Human
uggccacuccagaccccugg

SEQ ID NO: 1997985 - RNA, 17 nt, Human
uggcagguaggaauauu

SEQ ID NO: 1997986 - RNA, 20 nt, Human
uggcagguaggaauauuaua

SEQ ID NO: 1997987 - RNA, 14 nt, Human
uggcaggugagcaa

SEQ ID NO: 1997988 - RNA, 23 nt, Human
uggcagguaggaauauuauauuu

SEQ ID NO: 1997989 - RNA, 13 nt, Human
uggcagugggagc

SEQ ID NO: 1997990 - RNA, 22 nt, Human
uggcaccuccucggcuggcugu

SEQ ID NO: 1997991 - RNA, 13 nt, Human
uggcaccugucug

SEQ ID NO: 1997992 - RNA, 14 nt, Human
uggcaccugucugc

SEQ ID NO: 1997993 - RNA, 18 nt, Human
uggcaccugucugcucca

SEQ ID NO: 1997994 - RNA, 19 nt, Human
uggcaccugucugcuccag

SEQ ID NO: 1997995 - RNA, 21 nt, Human
uggcaccugucugcuccagcu

SEQ ID NO: 1997996 - RNA, 23 nt, Human
uggcaccugucugcuccagcucu

SEQ ID NO: 1997997 - RNA, 13 nt, Human
uggcaccuucccc

SEQ ID NO: 1997998 - RNA, 21 nt, Human
uggcacccggccccugcuggu

SEQ ID NO: 1997999 - RNA, 13 nt, Human
uggcagcugcuuu

SEQ ID NO: 1998000 - RNA, 21 nt, Human
uggcaccuucccccuccccca

SEQ ID NO: 1998001 - RNA, 21 nt, Human
uggcaggacacugcagaacag

SEQ ID NO: 1998002 - RNA, 19 nt, Human
uggcaggaguuggaagugu

SEQ ID NO: 1998003 - RNA, 14 nt, Human
ugcuuuaauuuuag

SEQ ID NO: 1998004 - RNA, 15 nt, Human
ugcuuuaauuuuagc

SEQ ID NO: 1998005 - RNA, 17 nt, Human
ugcuuuaauuuuagcaa

SEQ ID NO: 1998006 - RNA, 16 nt, Human
ugcuuuagacuugaaa

SEQ ID NO: 1998007 - RNA, 18 nt, Human
ugcuuuagacuugaaaag

SEQ ID NO: 1998008 - RNA, 14 nt, Human
ugcuuuagacuuga

SEQ ID NO: 1998009 - RNA, 15 nt, Human
ugcuuuagacuugaa

SEQ ID NO: 1998010 - RNA, 22 nt, Human
ugcuuucuuucguuuguuuguu

SEQ ID NO: 1998011 - RNA, 15 nt, Human
ugcuuucuuucguuu

SEQ ID NO: 1998012 - RNA, 20 nt, Human
uggaaaaauagccugccucu

SEQ ID NO: 1998013 - RNA, 17 nt, Human
uggaaaaauagccugcc

SEQ ID NO: 1998014 - RNA, 20 nt, Human
uggaaagaguaggaagacuu

SEQ ID NO: 1998015 - RNA, 14 nt, Human
uggaaagaguacuc

SEQ ID NO: 1998016 - RNA, 17 nt, Human
uggaaacaagucaguca

SEQ ID NO: 1998017 - RNA, 13 nt, Human
uggaaacacuaaa

SEQ ID NO: 1998018 - RNA, 16 nt, Human
uggaaacacuaaaugu

SEQ ID NO: 1998019 - RNA, 17 nt, Human
uggaaacacuaaauguu

SEQ ID NO: 1998020 - RNA, 18 nt, Human
uggaaacacuaaauguua

SEQ ID NO: 1998021 - RNA, 17 nt, Human
uggaaacagcucgacuu

SEQ ID NO: 1998022 - RNA, 19 nt, Human
uggaaacacuaaauguuaa

SEQ ID NO: 1998023 - RNA, 20 nt, Human
uggaaacacuaaauguuaaa

SEQ ID NO: 1998024 - RNA, 22 nt, Human
uggaaacacuaaauguuaaaga

SEQ ID NO: 1998025 - RNA, 23 nt, Human
uggaaacacuaaauguuaaagau

SEQ ID NO: 1998026 - RNA, 21 nt, Human
uggaaagacuuuuccaacccu

SEQ ID NO: 1998027 - RNA, 18 nt, Human
uggaaacagaggaccagc

SEQ ID NO: 1998028 - RNA, 20 nt, Human
uggaaacagaggaccagcac

SEQ ID NO: 1998029 - RNA, 22 nt, Human
uggaaacagcucgacuuuaaaa

SEQ ID NO: 1998030 - RNA, 20 nt, Human
uggaaugaugggucaguugu

SEQ ID NO: 1998031 - RNA, 15 nt, Human
uggaaugagaauuua

SEQ ID NO: 1998032 - RNA, 15 nt, Human
uggaaugcacucaga

SEQ ID NO: 1998033 - RNA, 14 nt, Human
uggaauaucuacuu

SEQ ID NO: 1998034 - RNA, 21 nt, Human
uggacuagagggaccucuccc

SEQ ID NO: 1998035 - RNA, 18 nt, Human
uggacucaccucccccau

SEQ ID NO: 1998036 - RNA, 20 nt, Human
uggacucaccucccccaucu

SEQ ID NO: 1998037 - RNA, 19 nt, Human
uggacaugcacagcuaaca

SEQ ID NO: 1998038 - RNA, 13 nt, Human
uggacaugcacag

SEQ ID NO: 1998039 - RNA, 15 nt, Human
uggaauauauaacca

SEQ ID NO: 1998040 - RNA, 16 nt, Human
uggaauauauaaccag

SEQ ID NO: 1998041 - RNA, 17 nt, Human
uggaauaaggagaauga

SEQ ID NO: 1998042 - RNA, 22 nt, Human
uggaauaauccuaaacauauga

SEQ ID NO: 1998043 - RNA, 19 nt, Human
uggaauaacauguaauuaa

SEQ ID NO: 1998044 - RNA, 15 nt, Human
uggaauaacauguaa

SEQ ID NO: 1998045 - RNA, 14 nt, Human
uggaauaacaugua

SEQ ID NO: 1998046 - RNA, 18 nt, Human
uggaauaaaaauuccaga

SEQ ID NO: 1998047 - RNA, 23 nt, Human
uggaauaaaaauuccagaaugaa

SEQ ID NO: 1998048 - RNA, 15 nt, Human
uccugaggcuccacu

SEQ ID NO: 1998049 - RNA, 21 nt, Human
uccugagccagauuucacucu

SEQ ID NO: 1998050 - RNA, 22 nt, Human
uccucuguccaggcacugcugc

SEQ ID NO: 1998051 - RNA, 19 nt, Human
uccugagccagauuucacu

SEQ ID NO: 1998052 - RNA, 18 nt, Human
uccugagccagauuucac

SEQ ID NO: 1998053 - RNA, 19 nt, Human
uccucuguacagagcccac

SEQ ID NO: 1998054 - RNA, 23 nt, Human
uccucuguacagagcccacgccc

SEQ ID NO: 1998055 - RNA, 17 nt, Human
uccugagccagauuuca

SEQ ID NO: 1998056 - RNA, 17 nt, Human
uccucuguccaggcacu

SEQ ID NO: 1998057 - RNA, 16 nt, Human
uccugaggcuccacuu

SEQ ID NO: 1998058 - RNA, 17 nt, Human
uccugaggcuccacuug

SEQ ID NO: 1998059 - RNA, 12 nt, Human
uccugaggcugg

SEQ ID NO: 1998060 - RNA, 19 nt, Human
uccugaggcugggcucccu

SEQ ID NO: 1998061 - RNA, 17 nt, Human
uccugaggcugggcucc

SEQ ID NO: 1998062 - RNA, 16 nt, Human
uccugaggcugggcuc

SEQ ID NO: 1998063 - RNA, 15 nt, Human
uccugaggcugggcu

SEQ ID NO: 1998064 - RNA, 17 nt, Human
uccucugcugcuggcug

SEQ ID NO: 1998065 - RNA, 14 nt, Human
uccucuauccuggg

SEQ ID NO: 1998066 - RNA, 15 nt, Human
uccucuggccugugu

SEQ ID NO: 1998067 - RNA, 17 nt, Human
uccucugcuuaaaaacu

SEQ ID NO: 1998068 - RNA, 13 nt, Human
uccucuguacaga

SEQ ID NO: 1998069 - RNA, 15 nt, Human
uccucuguacagagc

SEQ ID NO: 1998070 - RNA, 21 nt, Human
uccucuaggaggucucuaaga

SEQ ID NO: 1998071 - RNA, 17 nt, Human
uccucuaggaggucucu

SEQ ID NO: 1998072 - RNA, 21 nt, Human
uccuccuuuucacaguucucu

SEQ ID NO: 1998073 - RNA, 13 nt, Human
uccuccuggacuc

SEQ ID NO: 1998074 - RNA, 14 nt, Human
uccuccugcugcca

SEQ ID NO: 1998075 - RNA, 15 nt, Human
uccuccugcugccag

SEQ ID NO: 1998076 - RNA, 20 nt, Human
uccucaaaacuucagacaua

SEQ ID NO: 1998077 - RNA, 13 nt, Human
uccuccaggugca

SEQ ID NO: 1998078 - RNA, 12 nt, Human
uccuccaggugc

SEQ ID NO: 1998079 - RNA, 22 nt, Human
uccuccaggugcacaagcucca

SEQ ID NO: 1998080 - RNA, 20 nt, Human
uccuccaggugcacaagcuc

SEQ ID NO: 1998081 - RNA, 18 nt, Human
uccuccaggugcacaagc

SEQ ID NO: 1998082 - RNA, 14 nt, Human
uccuccaggugcac

SEQ ID NO: 1998083 - RNA, 12 nt, Human
uccuccucagau

SEQ ID NO: 1998084 - RNA, 18 nt, Human
uccuccugacaccccacu

SEQ ID NO: 1998085 - RNA, 21 nt, Human
uccuccugacaccccacuuag

SEQ ID NO: 1998086 - RNA, 22 nt, Human
uccuccugacaccccacuuagc

SEQ ID NO: 1998087 - RNA, 17 nt, Human
uccuaguuccaccauca

SEQ ID NO: 1998088 - RNA, 14 nt, Human
uccuaguuccacca

SEQ ID NO: 1998089 - RNA, 18 nt, Human
uccuaagcuauucaguaa

SEQ ID NO: 1998090 - RNA, 16 nt, Human
uccuaagcuauucagu

SEQ ID NO: 1998091 - RNA, 21 nt, Human
uccggaacguagucggcacag

SEQ ID NO: 1998092 - RNA, 12 nt, Human
uccuauuucaga

SEQ ID NO: 1998093 - RNA, 15 nt, Human
uccuauuuagacaug

SEQ ID NO: 1998094 - RNA, 13 nt, Human
uccuauuucagaa

SEQ ID NO: 1998095 - RNA, 14 nt, Human
uccuauuucagaag

SEQ ID NO: 1998096 - RNA, 16 nt, Human
uccuauuucagaaguu

SEQ ID NO: 1998097 - RNA, 20 nt, Human
uccuauuucagaaguuuaaa

SEQ ID NO: 1998098 - RNA, 13 nt, Human
uccuaugcuuuag

SEQ ID NO: 1998099 - RNA, 21 nt, Human
uccuaguuccaccaucaagcc

SEQ ID NO: 1998100 - RNA, 22 nt, Human
uccgaaagggacuuggaagcuc

SEQ ID NO: 1998101 - RNA, 14 nt, Human
uccgaaaucagcag

SEQ ID NO: 1998102 - RNA, 17 nt, Human
uccgaaaugcugucuuu

SEQ ID NO: 1998103 - RNA, 20 nt, Human
uccgaaaugcugucuuucuu

SEQ ID NO: 1998104 - RNA, 19 nt, Human
uccgaccuggccugucugu

SEQ ID NO: 1998105 - RNA, 17 nt, Human
ucccuucuuuuucuucu

SEQ ID NO: 1998106 - RNA, 21 nt, Human
uccgaaagggacuuggaagcu

SEQ ID NO: 1998107 - RNA, 18 nt, Human
uccgaaaccaaagaagaa

SEQ ID NO: 1998108 - RNA, 19 nt, Human
uccgaaaccaaagaagaaa

SEQ ID NO: 1998109 - RNA, 21 nt, Human
uccgcuuucuacccagcgagc

SEQ ID NO: 1998110 - RNA, 18 nt, Human
uccgccccugagcccacu

SEQ ID NO: 1998111 - RNA, 19 nt, Human
uccgccccugagcccacug

SEQ ID NO: 1998112 - RNA, 20 nt, Human
uccgccccugagcccacugu

SEQ ID NO: 1998113 - RNA, 21 nt, Human
uccgccccugagcccacugug

SEQ ID NO: 1998114 - RNA, 21 nt, Human
uccgacuugugcacaggcaga

SEQ ID NO: 1998115 - RNA, 14 nt, Human
uccgccccugagcc

SEQ ID NO: 1998116 - RNA, 15 nt, Human
uccgccccugagccc

SEQ ID NO: 1998117 - RNA, 16 nt, Human
uccgccccugagccca

SEQ ID NO: 1998118 - RNA, 17 nt, Human
uccgccccugagcccac

SEQ ID NO: 1998119 - RNA, 16 nt, Human
ucccuucccaccucuc

SEQ ID NO: 1998120 - RNA, 14 nt, Human
ucccuucccaccuc

SEQ ID NO: 1998121 - RNA, 12 nt, Human
ucccuucucuuc

SEQ ID NO: 1998122 - RNA, 14 nt, Human
ucccuucucuucca

SEQ ID NO: 1998123 - RNA, 15 nt, Human
ucccuucucuuccag

SEQ ID NO: 1998124 - RNA, 21 nt, Human
ucccuucucuuccaggcagcc

SEQ ID NO: 1998125 - RNA, 16 nt, Human
ucccuucucuuccagg

SEQ ID NO: 1998126 - RNA, 20 nt, Human
ucccuucucuuccaggcagc

SEQ ID NO: 1998127 - RNA, 21 nt, Human
ucccuucccacuggaggcaug

SEQ ID NO: 1998128 - RNA, 17 nt, Human
ucccuucccaccucucu

SEQ ID NO: 1998129 - RNA, 16 nt, Human
ucccugccccccagcc

SEQ ID NO: 1998130 - RNA, 14 nt, Human
ucccugccccuccc

SEQ ID NO: 1998131 - RNA, 18 nt, Human
ucccugccccucccuuca

SEQ ID NO: 1998132 - RNA, 15 nt, Human
ucccuggcuuccuua

SEQ ID NO: 1998133 - RNA, 16 nt, Human
ucccuggcuuccuuac

SEQ ID NO: 1998134 - RNA, 17 nt, Human
ucccuggcuuccuuacu

SEQ ID NO: 1998135 - RNA, 12 nt, Human
ucccuggcuucc

SEQ ID NO: 1998136 - RNA, 23 nt, Human
ucccucuacugggagccuaccca

SEQ ID NO: 1998137 - RNA, 18 nt, Human
ucccuccgggucuuccua

SEQ ID NO: 1998138 - RNA, 15 nt, Human
ucccucuccagcagg

SEQ ID NO: 1998139 - RNA, 16 nt, Human
ucccucucugcuggac

SEQ ID NO: 1998140 - RNA, 16 nt, Human
ucccugccaauggacu

SEQ ID NO: 1998141 - RNA, 14 nt, Human
ucccugccaaugga

SEQ ID NO: 1998142 - RNA, 13 nt, Human
ucccucuggggcu

SEQ ID NO: 1998143 - RNA, 17 nt, Human
ucccucuggggcuguuc

SEQ ID NO: 1998144 - RNA, 20 nt, Human
ucccugcacuugcagacucu

SEQ ID NO: 1998145 - RNA, 18 nt, Human
ucccucuacugggagccu

SEQ ID NO: 1998146 - RNA, 22 nt, Human
ucccucuacugggagccuaccc

SEQ ID NO: 1998147 - RNA, 13 nt, Human
ucccucccuuggg

SEQ ID NO: 1998148 - RNA, 14 nt, Human
ucccucccuugggg

SEQ ID NO: 1998149 - RNA, 18 nt, Human
ucccucccuuccucuuuc

SEQ ID NO: 1998150 - RNA, 17 nt, Human
ucccuacuuccugugac

SEQ ID NO: 1998151 - RNA, 17 nt, Human
ucccaugagccucagca

SEQ ID NO: 1998152 - RNA, 22 nt, Human
ucccaugagccucagcauccug

SEQ ID NO: 1998153 - RNA, 19 nt, Human
ucccuaccgagucucuucu

SEQ ID NO: 1998154 - RNA, 21 nt, Human
ucccuaccgagucucuucucc

SEQ ID NO: 1998155 - RNA, 22 nt, Human
ucccuaccgagucucuucucca

SEQ ID NO: 1998156 - RNA, 23 nt, Human
ucccuaccgagucucuucuccac

SEQ ID NO: 1998157 - RNA, 23 nt, Human
ucgcccagucccagcagccagcc

SEQ ID NO: 1998158 - RNA, 15 nt, Human
ucggaaaacaugcua

SEQ ID NO: 1998159 - RNA, 18 nt, Human
ucggaaaacaugcuacac

SEQ ID NO: 1998160 - RNA, 14 nt, Human
ucgcccagucugga

SEQ ID NO: 1998161 - RNA, 19 nt, Human
ucgcccagucuggaaugca

SEQ ID NO: 1998162 - RNA, 23 nt, Human
ucgcccagucuggaaugcagugg

SEQ ID NO: 1998163 - RNA, 15 nt, Human
ucggccuccauccug

SEQ ID NO: 1998164 - RNA, 16 nt, Human
ucggccuccauccuga

SEQ ID NO: 1998165 - RNA, 17 nt, Human
ucggccuccauccugag

SEQ ID NO: 1998166 - RNA, 15 nt, Human
ucgcaggccucccug

SEQ ID NO: 1998167 - RNA, 19 nt, Human
ucgcaggccucccugccag

SEQ ID NO: 1998168 - RNA, 20 nt, Human
ucgcaggccucccugccagu

SEQ ID NO: 1998169 - RNA, 22 nt, Human
ucgcauagaaaucaauaauuug

SEQ ID NO: 1998170 - RNA, 23 nt, Human
ucgcaggauucuuccucccuccc

SEQ ID NO: 1998171 - RNA, 21 nt, Human
ucgcaggauucuuccucccuc

SEQ ID NO: 1998172 - RNA, 17 nt, Human
ucgcaggauucuuccuc

SEQ ID NO: 1998173 - RNA, 22 nt, Human
uccuuuucgcaggauucuuccu

SEQ ID NO: 1998174 - RNA, 14 nt, Human
uccuuuucuguguu

SEQ ID NO: 1998175 - RNA, 21 nt, Human
uccuuuguauucugucuucau

SEQ ID NO: 1998176 - RNA, 15 nt, Human
uccuuuguauucugu

SEQ ID NO: 1998177 - RNA, 17 nt, Human
uccuuuguauucugucu

SEQ ID NO: 1998178 - RNA, 18 nt, Human
uccuuuguauucugucuu

SEQ ID NO: 1998179 - RNA, 15 nt, Human
uccuuuucuguguuu

SEQ ID NO: 1998180 - RNA, 23 nt, Human
uccuugaaaacacuguucucugc

SEQ ID NO: 1998181 - RNA, 22 nt, Human
uccuugaaaacacuguucucug

SEQ ID NO: 1998182 - RNA, 17 nt, Human
uccuuaucaaaggacac

SEQ ID NO: 1998183 - RNA, 14 nt, Human
uccuuaucuagcug

SEQ ID NO: 1998184 - RNA, 15 nt, Human
uccuuaucuagcugc

SEQ ID NO: 1998185 - RNA, 14 nt, Human
uccuuaucaaagga

SEQ ID NO: 1998186 - RNA, 15 nt, Human
uccuuaucaaaggac

SEQ ID NO: 1998187 - RNA, 24 nt, Human
uccuuaggguuuucucucuauuuc

SEQ ID NO: 1998188 - RNA, 23 nt, Human
uccugaggggagacagagcaacc

SEQ ID NO: 1998189 - RNA, 19 nt, Human
uccugucaucugagaauga

SEQ ID NO: 1998190 - RNA, 20 nt, Human
uccugaggggagacagagca

SEQ ID NO: 1998191 - RNA, 19 nt, Human
uccugucccucauccauag

SEQ ID NO: 1998192 - RNA, 21 nt, Human
uccuuaccagcagagcaccuu

SEQ ID NO: 1998193 - RNA, 20 nt, Human
uccuuaccagcagagcaccu

SEQ ID NO: 1998194 - RNA, 21 nt, Human
uccuuggugucgggcaugaca

SEQ ID NO: 1998195 - RNA, 18 nt, Human
uccuuggugucgggcaug

SEQ ID NO: 1998196 - RNA, 22 nt, Human
uccuugcugcaaggcucuuccu

SEQ ID NO: 1998197 - RNA, 19 nt, Human
uccuucuuugcccuuuacu

SEQ ID NO: 1998198 - RNA, 13 nt, Human
uccuucuuugccc

SEQ ID NO: 1998199 - RNA, 22 nt, Human
uccuuugugaggaagccgcugg

SEQ ID NO: 1998200 - RNA, 18 nt, Human
uccuuugugaggaagccg

SEQ ID NO: 1998201 - RNA, 17 nt, Human
uccuuugugaggaagcc

SEQ ID NO: 1998202 - RNA, 22 nt, Human
uccuuggugucgggcaugacac

SEQ ID NO: 1998203 - RNA, 17 nt, Human
ucucacuguugcccagg

SEQ ID NO: 1998204 - RNA, 14 nt, Human
ucucagaggcccca

SEQ ID NO: 1998205 - RNA, 14 nt, Human
ucucagauauuugc

SEQ ID NO: 1998206 - RNA, 17 nt, Human
ucucagauauuugcacc

SEQ ID NO: 1998207 - RNA, 14 nt, Human
ucucacuguugccc

SEQ ID NO: 1998208 - RNA, 15 nt, Human
ucucacuguugccca

SEQ ID NO: 1998209 - RNA, 12 nt, Human
ucucaguuuuuc

SEQ ID NO: 1998210 - RNA, 13 nt, Human
ucucaguuuuucu

SEQ ID NO: 1998211 - RNA, 15 nt, Human
ucucaguuuuucuua

SEQ ID NO: 1998212 - RNA, 18 nt, Human
ucucaguuuuucuuaaua

SEQ ID NO: 1998213 - RNA, 21 nt, Human
ucucaguuuuucuuaauauau

SEQ ID NO: 1998214 - RNA, 22 nt, Human
ucucaguuuuucuuaauauaua

SEQ ID NO: 1998215 - RNA, 13 nt, Human
ucucaaauuucua

SEQ ID NO: 1998216 - RNA, 22 nt, Human
ucuaucuuugagcgcccacuag

SEQ ID NO: 1998217 - RNA, 14 nt, Human
ucucaaauuucuaa

SEQ ID NO: 1998218 - RNA, 16 nt, Human
ucucaaauuucuaaau

SEQ ID NO: 1998219 - RNA, 18 nt, Human
ucucaaauuucuaaaucu

SEQ ID NO: 1998220 - RNA, 13 nt, Human
ucucaauuuuugg

SEQ ID NO: 1998221 - RNA, 22 nt, Human
ucucaauuuuugguugaauaaa

SEQ ID NO: 1998222 - RNA, 16 nt, Human
ucucacacaugagcau

SEQ ID NO: 1998223 - RNA, 23 nt, Human
ucucacacaugagcaucaggcca

SEQ ID NO: 1998224 - RNA, 20 nt, Human
ucucacugccaugccagcuu

SEQ ID NO: 1998225 - RNA, 21 nt, Human
ucucacacaugagcaucaggc

SEQ ID NO: 1998226 - RNA, 23 nt, Human
ucucacucugucgcccagucugg

SEQ ID NO: 1998227 - RNA, 18 nt, Human
ucgucgagcuccccccag

SEQ ID NO: 1998228 - RNA, 17 nt, Human
ucuaaugacauucaaua

SEQ ID NO: 1998229 - RNA, 18 nt, Human
ucuaaugacauucaauaa

SEQ ID NO: 1998230 - RNA, 19 nt, Human
ucuaaugacauucaauaaa

SEQ ID NO: 1998231 - RNA, 13 nt, Human
ucuaauucuuuaa

SEQ ID NO: 1998232 - RNA, 21 nt, Human
ucuaauuggcuuuacuauuuu

SEQ ID NO: 1998233 - RNA, 12 nt, Human
ucuacuaaaaau

SEQ ID NO: 1998234 - RNA, 15 nt, Human
ucuacuaaaaauaca

SEQ ID NO: 1998235 - RNA, 19 nt, Human
ucuacuaaaaauacaaaaa

SEQ ID NO: 1998236 - RNA, 14 nt, Human
ucuacuauuuaugu

SEQ ID NO: 1998237 - RNA, 19 nt, Human
ucuaauuuuauuuugugaa

SEQ ID NO: 1998238 - RNA, 15 nt, Human
ucuacucauuuuaau

SEQ ID NO: 1998239 - RNA, 21 nt, Human
ucuacucgaguuacagacaaa

SEQ ID NO: 1998240 - RNA, 20 nt, Human
ucuacucgaguuacagacaa

SEQ ID NO: 1998241 - RNA, 18 nt, Human
ucuacucuagggaaaaac

SEQ ID NO: 1998242 - RNA, 18 nt, Human
ucuaggaggucucuaaga

SEQ ID NO: 1998243 - RNA, 15 nt, Human
ucuagguaaauuaca

SEQ ID NO: 1998244 - RNA, 12 nt, Human
ucuagggaaaaa

SEQ ID NO: 1998245 - RNA, 13 nt, Human
ucuauauuuuaca

SEQ ID NO: 1998246 - RNA, 17 nt, Human
ucccacuucaaaacaaa

SEQ ID NO: 1998247 - RNA, 15 nt, Human
ucccacucuucucau

SEQ ID NO: 1998248 - RNA, 13 nt, Human
ucccacugcccac

SEQ ID NO: 1998249 - RNA, 14 nt, Human
ucccacuccaagcc

SEQ ID NO: 1998250 - RNA, 16 nt, Human
ucccacuccaagccag

SEQ ID NO: 1998251 - RNA, 12 nt, Human
ucccacuccaag

SEQ ID NO: 1998252 - RNA, 18 nt, Human
ucccacuccaagccagca

SEQ ID NO: 1998253 - RNA, 19 nt, Human
ucccacuccaagccagcaa

SEQ ID NO: 1998254 - RNA, 13 nt, Human
ucccacucuucuc

SEQ ID NO: 1998255 - RNA, 18 nt, Human
ucccaggcauuccccagg

SEQ ID NO: 1998256 - RNA, 17 nt, Human
ucccaggcauuccccag

SEQ ID NO: 1998257 - RNA, 16 nt, Human
ucccaggauguacaag

SEQ ID NO: 1998258 - RNA, 15 nt, Human
ucccacuucugccag

SEQ ID NO: 1998259 - RNA, 16 nt, Human
ucccacuucugccaga

SEQ ID NO: 1998260 - RNA, 19 nt, Human
ucccaggcauuccccagga

SEQ ID NO: 1998261 - RNA, 19 nt, Human
ucccaggcugagccucagu

SEQ ID NO: 1998262 - RNA, 16 nt, Human
ucccagggagcaaggg

SEQ ID NO: 1998263 - RNA, 19 nt, Human
ucccagggagcaagggcag

SEQ ID NO: 1998264 - RNA, 21 nt, Human
ucccagggagcaagggcaggg

SEQ ID NO: 1998265 - RNA, 15 nt, Human
ucccaugagccucag

SEQ ID NO: 1998266 - RNA, 16 nt, Human
ucccaugagccucagc

SEQ ID NO: 1998267 - RNA, 18 nt, Human
ucccaccucucucacucc

SEQ ID NO: 1998268 - RNA, 17 nt, Human
ucccaccucucucacuc

SEQ ID NO: 1998269 - RNA, 14 nt, Human
ucccaccucucuca

SEQ ID NO: 1998270 - RNA, 16 nt, Human
ucccaccucagccucc

SEQ ID NO: 1998271 - RNA, 14 nt, Human
ucccaacuugccuu

SEQ ID NO: 1998272 - RNA, 20 nt, Human
ucccaacuugccuuugaaga

SEQ ID NO: 1998273 - RNA, 18 nt, Human
ucccaccucagccucccg

SEQ ID NO: 1998274 - RNA, 20 nt, Human
ucccaccucucucacuccuu

SEQ ID NO: 1998275 - RNA, 19 nt, Human
ucccaccuuggcugcaggg

SEQ ID NO: 1998276 - RNA, 21 nt, Human
ucccaccuuggcugcagggag

SEQ ID NO: 1998277 - RNA, 14 nt, Human
ucccacucagucca

SEQ ID NO: 1998278 - RNA, 17 nt, Human
uccauagagagcaagac

SEQ ID NO: 1998279 - RNA, 15 nt, Human
uccauaauguucugc

SEQ ID NO: 1998280 - RNA, 16 nt, Human
uccauaauguucugcu

SEQ ID NO: 1998281 - RNA, 17 nt, Human
uccauaauguucugcua

SEQ ID NO: 1998282 - RNA, 14 nt, Human
uccauacacacgcu

SEQ ID NO: 1998283 - RNA, 18 nt, Human
uccauacacacgcugccu

SEQ ID NO: 1998284 - RNA, 19 nt, Human
uccauacacacgcugccuu

SEQ ID NO: 1998285 - RNA, 17 nt, Human
uccagggcucaacacug

SEQ ID NO: 1998286 - RNA, 20 nt, Human
uccagggcucaacacuguga

SEQ ID NO: 1998287 - RNA, 14 nt, Human
uccaggggaaccug

SEQ ID NO: 1998288 - RNA, 23 nt, Human
uccauaaucuggacuccucuguc

SEQ ID NO: 1998289 - RNA, 20 nt, Human
uccauagagagcaagacgcu

SEQ ID NO: 1998290 - RNA, 15 nt, Human
uccauagcuguggug

SEQ ID NO: 1998291 - RNA, 19 nt, Human
uccauauaagcccuugauu

SEQ ID NO: 1998292 - RNA, 14 nt, Human
uccauagugacuuu

SEQ ID NO: 1998293 - RNA, 15 nt, Human
uccauagugacuuuu

SEQ ID NO: 1998294 - RNA, 12 nt, Human
uccauauccaua

SEQ ID NO: 1998295 - RNA, 19 nt, Human
uccauauccauagugacuu

SEQ ID NO: 1998296 - RNA, 13 nt, Human
uccauauuagaaa

SEQ ID NO: 1998297 - RNA, 15 nt, Human
uccauauuagaaaac

SEQ ID NO: 1998298 - RNA, 17 nt, Human
uccauauuagaaaacuu

SEQ ID NO: 1998299 - RNA, 18 nt, Human
uccauauuagaaaacuuu

SEQ ID NO: 1998300 - RNA, 14 nt, Human
uccauauuauugug

SEQ ID NO: 1998301 - RNA, 18 nt, Human
ucccaacucaccccagcc

SEQ ID NO: 1998302 - RNA, 17 nt, Human
ucccaacucaccccagc

SEQ ID NO: 1998303 - RNA, 21 nt, Human
ucccaacucaccccagcccca

SEQ ID NO: 1998304 - RNA, 19 nt, Human
ucccaacucaccccagccc

SEQ ID NO: 1998305 - RNA, 14 nt, Human
ucccaacuuguaaa

SEQ ID NO: 1998306 - RNA, 19 nt, Human
uccaugugaaacauguugc

SEQ ID NO: 1998307 - RNA, 18 nt, Human
uccaugugaucucauugu

SEQ ID NO: 1998308 - RNA, 19 nt, Human
uccaugucgccucugcauu

SEQ ID NO: 1998309 - RNA, 17 nt, Human
uccaugucgccucugca

SEQ ID NO: 1998310 - RNA, 18 nt, Human
uccaugucgccucugcau

SEQ ID NO: 1998311 - RNA, 16 nt, Human
uccaugucgccucugc

SEQ ID NO: 1998312 - RNA, 16 nt, Human
uccaagaagcccagga

SEQ ID NO: 1998313 - RNA, 15 nt, Human
uccaagaagcccagg

SEQ ID NO: 1998314 - RNA, 23 nt, Human
ucaugucaaauauuuagauguaa

SEQ ID NO: 1998315 - RNA, 14 nt, Human
uccaagaagcccag

SEQ ID NO: 1998316 - RNA, 13 nt, Human
uccaagagccuga

SEQ ID NO: 1998317 - RNA, 14 nt, Human
uccaagagccugag

SEQ ID NO: 1998318 - RNA, 20 nt, Human
uccaagaccuucuccuucac

SEQ ID NO: 1998319 - RNA, 19 nt, Human
uccaagaagcccaggaaag

SEQ ID NO: 1998320 - RNA, 22 nt, Human
uccaagcaggacauggacaagg

SEQ ID NO: 1998321 - RNA, 14 nt, Human
uccaagcaggacau

SEQ ID NO: 1998322 - RNA, 17 nt, Human
uccaagcaaaugugaau

SEQ ID NO: 1998323 - RNA, 15 nt, Human
uccaagcaaauguga

SEQ ID NO: 1998324 - RNA, 12 nt, Human
uccacacccgcg

SEQ ID NO: 1998325 - RNA, 19 nt, Human
uccacaagagcccaggccu

SEQ ID NO: 1998326 - RNA, 20 nt, Human
uccacaagagcccaggccuc

SEQ ID NO: 1998327 - RNA, 21 nt, Human
uccacaagagcccaggccucc

SEQ ID NO: 1998328 - RNA, 22 nt, Human
uccaagcccaguucagcuuggg

SEQ ID NO: 1998329 - RNA, 15 nt, Human
uccaagccagcggga

SEQ ID NO: 1998330 - RNA, 15 nt, Human
uccaagccagcaagc

SEQ ID NO: 1998331 - RNA, 15 nt, Human
uccagaugccacaau

SEQ ID NO: 1998332 - RNA, 16 nt, Human
uccagagcugcuuccc

SEQ ID NO: 1998333 - RNA, 22 nt, Human
uccagauuuuuuacagcugccu

SEQ ID NO: 1998334 - RNA, 19 nt, Human
uccagcaauucuccugccu

SEQ ID NO: 1998335 - RNA, 20 nt, Human
uccagcaauucuccugccuc

SEQ ID NO: 1998336 - RNA, 18 nt, Human
uccagcaauucuccugcc

SEQ ID NO: 1998337 - RNA, 18 nt, Human
uccaggacccugccaggc

SEQ ID NO: 1998338 - RNA, 19 nt, Human
uccaggacccugccaggca

SEQ ID NO: 1998339 - RNA, 21 nt, Human
uccaggacccugccaggcaca

SEQ ID NO: 1998340 - RNA, 22 nt, Human
uccaggacccugccaggcacag

SEQ ID NO: 1998341 - RNA, 18 nt, Human
uccaggacaggagaugcu

SEQ ID NO: 1998342 - RNA, 19 nt, Human
uccaggacaggagaugcug

SEQ ID NO: 1998343 - RNA, 22 nt, Human
uccaggacaggagaugcugugc

SEQ ID NO: 1998344 - RNA, 14 nt, Human
uccaggacccugcc

SEQ ID NO: 1998345 - RNA, 15 nt, Human
uccaggacccugcca

SEQ ID NO: 1998346 - RNA, 17 nt, Human
uccaggacccugccagg

SEQ ID NO: 1998347 - RNA, 19 nt, Human
uccagcuggguuggaaaac

SEQ ID NO: 1998348 - RNA, 15 nt, Human
uccagcuggccggga

SEQ ID NO: 1998349 - RNA, 21 nt, Human
uccagcuggccgggagccuga

SEQ ID NO: 1998350 - RNA, 22 nt, Human
uccagcuggccgggagccugau

SEQ ID NO: 1998351 - RNA, 14 nt, Human
uccacuuucuagcc

SEQ ID NO: 1998352 - RNA, 17 nt, Human
uccacuuuaucuugaau

SEQ ID NO: 1998353 - RNA, 13 nt, Human
uccagagcugcca

SEQ ID NO: 1998354 - RNA, 15 nt, Human
uccagagcugccagu

SEQ ID NO: 1998355 - RNA, 15 nt, Human
uccagagcugcuucc

SEQ ID NO: 1998356 - RNA, 22 nt, Human
uccagagaguggcuccucccgg

SEQ ID NO: 1998357 - RNA, 19 nt, Human
uccagagaguggcuccucc

SEQ ID NO: 1998358 - RNA, 12 nt, Human
uccagagcauuc

SEQ ID NO: 1998359 - RNA, 20 nt, Human
uccagagcauuccagucagg

SEQ ID NO: 1998360 - RNA, 15 nt, Human
uccacuuuaucuuga

SEQ ID NO: 1998361 - RNA, 21 nt, Human
uccacuuagaaauugcauuuc

SEQ ID NO: 1998362 - RNA, 23 nt, Human
uccacuuagaaauugcauuuccu

SEQ ID NO: 1998363 - RNA, 22 nt, Human
uccacugugccaugugccaggu

SEQ ID NO: 1998364 - RNA, 13 nt, Human
uccacccugcucu

SEQ ID NO: 1998365 - RNA, 14 nt, Human
uccacccugcucuc

SEQ ID NO: 1998366 - RNA, 21 nt, Human
uccacccugcucuccgaccag

SEQ ID NO: 1998367 - RNA, 16 nt, Human
ucaguuaagccuuugg

SEQ ID NO: 1998368 - RNA, 17 nt, Human
ucaguuaagccuuugga

SEQ ID NO: 1998369 - RNA, 15 nt, Human
ucaguguuuggugca

SEQ ID NO: 1998370 - RNA, 12 nt, Human
ucaguguuucau

SEQ ID NO: 1998371 - RNA, 15 nt, Human
ucaguguuucugggg

SEQ ID NO: 1998372 - RNA, 18 nt, Human
ucagugugacugaucucu

SEQ ID NO: 1998373 - RNA, 17 nt, Human
ucagucugauucccaag

SEQ ID NO: 1998374 - RNA, 19 nt, Human
ucagucugauucccaagcu

SEQ ID NO: 1998375 - RNA, 14 nt, Human
ucagguggggcagc

SEQ ID NO: 1998376 - RNA, 18 nt, Human
ucaggugcugccauccag

SEQ ID NO: 1998377 - RNA, 20 nt, Human
ucaggugcugccauccaggu

SEQ ID NO: 1998378 - RNA, 15 nt, Human
ucagguggggcagcu

SEQ ID NO: 1998379 - RNA, 16 nt, Human
ucagguggggcagcuu

SEQ ID NO: 1998380 - RNA, 21 nt, Human
ucagguggggcagcuugaggg

SEQ ID NO: 1998381 - RNA, 17 nt, Human
ucagguggggcagcuug

SEQ ID NO: 1998382 - RNA, 20 nt, Human
ucagguggggucacucuggc

SEQ ID NO: 1998383 - RNA, 17 nt, Human
ucagguggggucacucu

SEQ ID NO: 1998384 - RNA, 21 nt, Human
ucagguggggucacucuggca

SEQ ID NO: 1998385 - RNA, 18 nt, Human
ucaguccaugaagaugua

SEQ ID NO: 1998386 - RNA, 15 nt, Human
ucaguccauagcaga

SEQ ID NO: 1998387 - RNA, 18 nt, Human
ucaguccccgugaaggag

SEQ ID NO: 1998388 - RNA, 23 nt, Human
ucaguccaagggguccccuccag

SEQ ID NO: 1998389 - RNA, 14 nt, Human
ucaguucucuucac

SEQ ID NO: 1998390 - RNA, 17 nt, Human
ucaguucucuucacuca

SEQ ID NO: 1998391 - RNA, 16 nt, Human
ucauacuccuaugcuu

SEQ ID NO: 1998392 - RNA, 17 nt, Human
ucauacuccuaugcuuu

SEQ ID NO: 1998393 - RNA, 20 nt, Human
ucauacuccuaugcuuuagc

SEQ ID NO: 1998394 - RNA, 16 nt, Human
ucauacucgagucuga

SEQ ID NO: 1998395 - RNA, 17 nt, Human
ucauacucgagucugag

SEQ ID NO: 1998396 - RNA, 14 nt, Human
ucauacugaugugu

SEQ ID NO: 1998397 - RNA, 15 nt, Human
ucauacugauguguu

SEQ ID NO: 1998398 - RNA, 14 nt, Human
ucaucauauuauac

SEQ ID NO: 1998399 - RNA, 17 nt, Human
ucaucauauuauacaga

SEQ ID NO: 1998400 - RNA, 14 nt, Human
ucaucuggaguucu

SEQ ID NO: 1998401 - RNA, 20 nt, Human
ucaucuggaguucucaaaga

SEQ ID NO: 1998402 - RNA, 13 nt, Human
ucaugaaagauuc

SEQ ID NO: 1998403 - RNA, 15 nt, Human
ucaugaaagauucaa

SEQ ID NO: 1998404 - RNA, 24 nt, Human
ucauggacuucugccagcauaaua

SEQ ID NO: 1998405 - RNA, 15 nt, Human
ucagcacgauuucug

SEQ ID NO: 1998406 - RNA, 16 nt, Human
ucagcacgauuucugu

SEQ ID NO: 1998407 - RNA, 17 nt, Human
ucagcacgauuucuguu

SEQ ID NO: 1998408 - RNA, 12 nt, Human
ucagcaggcagc

SEQ ID NO: 1998409 - RNA, 13 nt, Human
ucagcaggcagcc

SEQ ID NO: 1998410 - RNA, 17 nt, Human
ucagcagugagagcaga

SEQ ID NO: 1998411 - RNA, 13 nt, Human
ucagcaguugcug

SEQ ID NO: 1998412 - RNA, 15 nt, Human
ucagcaggcagccuu

SEQ ID NO: 1998413 - RNA, 16 nt, Human
ucagcaggcagccuug

SEQ ID NO: 1998414 - RNA, 14 nt, Human
ucagcaguugcugg

SEQ ID NO: 1998415 - RNA, 16 nt, Human
ucagcaguugcuggua

SEQ ID NO: 1998416 - RNA, 17 nt, Human
ucagcaguugcugguaa

SEQ ID NO: 1998417 - RNA, 18 nt, Human
ucagcaguugcugguaaa

SEQ ID NO: 1998418 - RNA, 19 nt, Human
ucagcaguugcugguaaaa

SEQ ID NO: 1998419 - RNA, 20 nt, Human
ucagcaguugcugguaaaau

SEQ ID NO: 1998420 - RNA, 22 nt, Human
ucagcaguugcugguaaaauga

SEQ ID NO: 1998421 - RNA, 23 nt, Human
ucagcaguugcugguaaaaugaa

SEQ ID NO: 1998422 - RNA, 12 nt, Human
ucagccucccaa

SEQ ID NO: 1998423 - RNA, 13 nt, Human
ucagccucccaaa

SEQ ID NO: 1998424 - RNA, 23 nt, Human
ucagcaucugaccucuaccuuca

SEQ ID NO: 1998425 - RNA, 15 nt, Human
ucagcauccuggcac

SEQ ID NO: 1998426 - RNA, 16 nt, Human
ucagcauccuggcacc

SEQ ID NO: 1998427 - RNA, 17 nt, Human
ucagcauccuggcaccc

SEQ ID NO: 1998428 - RNA, 18 nt, Human
ucagcauccuggcacccg

SEQ ID NO: 1998429 - RNA, 13 nt, Human
ucagauauuugca

SEQ ID NO: 1998430 - RNA, 14 nt, Human
ucagauauuugcac

SEQ ID NO: 1998431 - RNA, 15 nt, Human
ucagauauuugcacc

SEQ ID NO: 1998432 - RNA, 20 nt, Human
ucagaucauuaucagccugu

SEQ ID NO: 1998433 - RNA, 21 nt, Human
ucagcacauaggguucccacg

SEQ ID NO: 1998434 - RNA, 24 nt, Human
ucagcacauaggguucccacgaag

SEQ ID NO: 1998435 - RNA, 13 nt, Human
ucagcaccacuca

SEQ ID NO: 1998436 - RNA, 15 nt, Human
ucagcaccacucaag

SEQ ID NO: 1998437 - RNA, 20 nt, Human
ucagcaccacucaagaccaa

SEQ ID NO: 1998438 - RNA, 21 nt, Human
ucagcaccacucaagaccaaa

SEQ ID NO: 1998439 - RNA, 17 nt, Human
ucagauaugauucaaau

SEQ ID NO: 1998440 - RNA, 16 nt, Human
ucagauaugauucaaa

SEQ ID NO: 1998441 - RNA, 18 nt, Human
ucagauaugauucaaaug

SEQ ID NO: 1998442 - RNA, 14 nt, Human
uaucauucuaaaga

SEQ ID NO: 1998443 - RNA, 23 nt, Human
uaucauucuaaagauagaguaaa

SEQ ID NO: 1998444 - RNA, 16 nt, Human
uaucauucuaaagaua

SEQ ID NO: 1998445 - RNA, 17 nt, Human
uaucauucuaaagauag

SEQ ID NO: 1998446 - RNA, 16 nt, Human
ucagccugcuccagcu

SEQ ID NO: 1998447 - RNA, 16 nt, Human
ucagccucccacagug

SEQ ID NO: 1998448 - RNA, 21 nt, Human
ucagccucccacagugcuggg

SEQ ID NO: 1998449 - RNA, 22 nt, Human
ucagccucccaaagugcuggga

SEQ ID NO: 1998450 - RNA, 12 nt, Human
ucagccucccga

SEQ ID NO: 1998451 - RNA, 20 nt, Human
ucagccucccgaauagcugg

SEQ ID NO: 1998452 - RNA, 18 nt, Human
ucagcuccagcucaccag

SEQ ID NO: 1998453 - RNA, 21 nt, Human
ucagcuccagcucaccagccc

SEQ ID NO: 1998454 - RNA, 22 nt, Human
ucagcuccagcucaccagcccc

SEQ ID NO: 1998455 - RNA, 17 nt, Human
ucaggaggcaggaccuu

SEQ ID NO: 1998456 - RNA, 22 nt, Human
ucaggagcuccauacacacgcu

SEQ ID NO: 1998457 - RNA, 18 nt, Human
ucaggaggccaagguggg

SEQ ID NO: 1998458 - RNA, 15 nt, Human
ucagcugcuacuacu

SEQ ID NO: 1998459 - RNA, 12 nt, Human
ucagcugcucag

SEQ ID NO: 1998460 - RNA, 24 nt, Human
ucugagaucaaaacgguuuuacug

SEQ ID NO: 1998461 - RNA, 18 nt, Human
ucugagaggacuuuucuu

SEQ ID NO: 1998462 - RNA, 12 nt, Human
ucugagagcugu

SEQ ID NO: 1998463 - RNA, 23 nt, Human
ucugacccaugcugcccugugag

SEQ ID NO: 1998464 - RNA, 22 nt, Human
ucugacccaugcugcccuguga

SEQ ID NO: 1998465 - RNA, 20 nt, Human
ucugacccaugcugcccugu

SEQ ID NO: 1998466 - RNA, 19 nt, Human
ucugacccaugcugcccug

SEQ ID NO: 1998467 - RNA, 13 nt, Human
ucugcacuccccu

SEQ ID NO: 1998468 - RNA, 13 nt, Human
ucugauuucaggg

SEQ ID NO: 1998469 - RNA, 20 nt, Human
ucugauuucuuuucaccauu

SEQ ID NO: 1998470 - RNA, 16 nt, Human
ucugcaaagcauguuu

SEQ ID NO: 1998471 - RNA, 23 nt, Human
ucugcaaagcauguuuugcaugu

SEQ ID NO: 1998472 - RNA, 22 nt, Human
ucugaggaauccagacccggcu

SEQ ID NO: 1998473 - RNA, 18 nt, Human
ucugaggaauccagaccc

SEQ ID NO: 1998474 - RNA, 21 nt, Human
ucugaggaauccagacccggc

SEQ ID NO: 1998475 - RNA, 14 nt, Human
ucugcccacucccu

SEQ ID NO: 1998476 - RNA, 13 nt, Human
ucugcccacuccc

SEQ ID NO: 1998477 - RNA, 12 nt, Human
ucugccucccau

SEQ ID NO: 1998478 - RNA, 17 nt, Human
ucugcccaccucggccu

SEQ ID NO: 1998479 - RNA, 15 nt, Human
ucugccucccaucac

SEQ ID NO: 1998480 - RNA, 13 nt, Human
ucugccucccauc

SEQ ID NO: 1998481 - RNA, 12 nt, Human
ucugcccacucc

SEQ ID NO: 1998482 - RNA, 22 nt, Human
ucugccauauucuguuggccag

SEQ ID NO: 1998483 - RNA, 23 nt, Human
ucugccauauucuguuggccagu

SEQ ID NO: 1998484 - RNA, 18 nt, Human
ucugccauauucuguugg

SEQ ID NO: 1998485 - RNA, 23 nt, Human
ucugccucugacacacagcucug

SEQ ID NO: 1998486 - RNA, 14 nt, Human
ucugccucugaugu

SEQ ID NO: 1998487 - RNA, 18 nt, Human
ucugccucugauguauuu

SEQ ID NO: 1998488 - RNA, 20 nt, Human
ucugccucugauguauuuug

SEQ ID NO: 1998489 - RNA, 21 nt, Human
ucugccucugacacacagcuc

SEQ ID NO: 1998490 - RNA, 22 nt, Human
ucugccucugacacacagcucu

SEQ ID NO: 1998491 - RNA, 19 nt, Human
ucugccugaagucacacag

SEQ ID NO: 1998492 - RNA, 21 nt, Human
ucugccugaggggcagccugc

SEQ ID NO: 1998493 - RNA, 22 nt, Human
ucugccugaggggcagccugcc

SEQ ID NO: 1998494 - RNA, 23 nt, Human
ucugccugaggggcagccugccu

SEQ ID NO: 1998495 - RNA, 20 nt, Human
ucugccugaagucacacagu

SEQ ID NO: 1998496 - RNA, 21 nt, Human
ucugccucccaucacccgcua

SEQ ID NO: 1998497 - RNA, 20 nt, Human
ucugccucccaucacccgcu

SEQ ID NO: 1998498 - RNA, 17 nt, Human
ucugccucccaucaccc

SEQ ID NO: 1998499 - RNA, 16 nt, Human
ucugccucccaucacc

SEQ ID NO: 1998500 - RNA, 15 nt, Human
ucugccucugacaca

SEQ ID NO: 1998501 - RNA, 18 nt, Human
ucugccucugacacacag

SEQ ID NO: 1998502 - RNA, 15 nt, Human
ucugccuccucuuca

SEQ ID NO: 1998503 - RNA, 15 nt, Human
ucuggcugcagagca

SEQ ID NO: 1998504 - RNA, 22 nt, Human
ucuggagcccacuguacuugcu

SEQ ID NO: 1998505 - RNA, 16 nt, Human
ucuggagcccacugua

SEQ ID NO: 1998506 - RNA, 12 nt, Human
ucuggagcccac

SEQ ID NO: 1998507 - RNA, 16 nt, Human
ucuggugaccuuccaa

SEQ ID NO: 1998508 - RNA, 18 nt, Human
ucuggugaccuuccaaga

SEQ ID NO: 1998509 - RNA, 23 nt, Human
ucuggugaccuuccaagagccug

SEQ ID NO: 1998510 - RNA, 16 nt, Human
ucuggugacuuuccuc

SEQ ID NO: 1998511 - RNA, 13 nt, Human
ucugucuaggaau

SEQ ID NO: 1998512 - RNA, 14 nt, Human
ucugucucagucca

SEQ ID NO: 1998513 - RNA, 12 nt, Human
ucuguccuggga

SEQ ID NO: 1998514 - RNA, 17 nt, Human
ucugucgcccagucugg

SEQ ID NO: 1998515 - RNA, 14 nt, Human
ucuguacagagccc

SEQ ID NO: 1998516 - RNA, 15 nt, Human
ucuguacagagccca

SEQ ID NO: 1998517 - RNA, 13 nt, Human
ucugcugcuggcu

SEQ ID NO: 1998518 - RNA, 11 nt, Human
ucugcugcugg

SEQ ID NO: 1998519 - RNA, 22 nt, Human
ucugcugaugacccccccagcu

SEQ ID NO: 1998520 - RNA, 15 nt, Human
ucugcugcagagcag

SEQ ID NO: 1998521 - RNA, 16 nt, Human
ucugcugcagagcagu

SEQ ID NO: 1998522 - RNA, 22 nt, Human
ucugcugcagagcaguaaggga

SEQ ID NO: 1998523 - RNA, 13 nt, Human
ucugcugaaggaa

SEQ ID NO: 1998524 - RNA, 13 nt, Human
ucugcucuugcau

SEQ ID NO: 1998525 - RNA, 17 nt, Human
ucugccugcccaggccc

SEQ ID NO: 1998526 - RNA, 18 nt, Human
ucugccugcccaggcccc

SEQ ID NO: 1998527 - RNA, 20 nt, Human
ucugccugcccaggccccug

SEQ ID NO: 1998528 - RNA, 23 nt, Human
ucuggaccccaucugugaauaag

SEQ ID NO: 1998529 - RNA, 15 nt, Human
ucuggacuccucugu

SEQ ID NO: 1998530 - RNA, 16 nt, Human
ucuggacuccucuguc

SEQ ID NO: 1998531 - RNA, 18 nt, Human
ucuggacuccucugucca

SEQ ID NO: 1998532 - RNA, 22 nt, Human
ucuggacuccucuguccaggca

SEQ ID NO: 1998533 - RNA, 12 nt, Human
ucuggacucugg

SEQ ID NO: 1998534 - RNA, 14 nt, Human
ucuggacucuggac

SEQ ID NO: 1998535 - RNA, 15 nt, Human
ucuggacucuggacu

SEQ ID NO: 1998536 - RNA, 20 nt, Human
ucuggacuuucucuaauaau

SEQ ID NO: 1998537 - RNA, 22 nt, Human
ucuggacuuucucuaauaauaa

SEQ ID NO: 1998538 - RNA, 15 nt, Human
ucugcugcuggcugg

SEQ ID NO: 1998539 - RNA, 14 nt, Human
ucugcugcuggcug

SEQ ID NO: 1998540 - RNA, 17 nt, Human
ucugcugcuggcugguu

SEQ ID NO: 1998541 - RNA, 14 nt, Human
ucuggaauuugaaa

SEQ ID NO: 1998542 - RNA, 15 nt, Human
ugaaacacuuugcau

SEQ ID NO: 1998543 - RNA, 12 nt, Human
ugaaaauuuuga

SEQ ID NO: 1998544 - RNA, 14 nt, Human
ugaaaauucagugg

SEQ ID NO: 1998545 - RNA, 18 nt, Human
ugaaaauugccuuucugu

SEQ ID NO: 1998546 - RNA, 19 nt, Human
ugaaaauugccuuucugug

SEQ ID NO: 1998547 - RNA, 22 nt, Human
ugaaaauugccuuucuguguuu

SEQ ID NO: 1998548 - RNA, 23 nt, Human
ugaaaauugccuuucuguguuua

SEQ ID NO: 1998549 - RNA, 22 nt, Human
ugaaaagaaaaaugagccuggc

SEQ ID NO: 1998550 - RNA, 20 nt, Human
ugaaaagaaaaaugagccug

SEQ ID NO: 1998551 - RNA, 20 nt, Human
ugaaaauuaggauuucauga

SEQ ID NO: 1998552 - RNA, 19 nt, Human
ugaaaagaaaaaugagccu

SEQ ID NO: 1998553 - RNA, 18 nt, Human
ugaaaaccacauuggaga

SEQ ID NO: 1998554 - RNA, 23 nt, Human
ugaaaacacuguucucugcccuc

SEQ ID NO: 1998555 - RNA, 22 nt, Human
ugaaaacacuguucucugcccu

SEQ ID NO: 1998556 - RNA, 14 nt, Human
ugaaaacagaaauu

SEQ ID NO: 1998557 - RNA, 15 nt, Human
ugaaaacagaaauug

SEQ ID NO: 1998558 - RNA, 17 nt, Human
ugaaaacagaaauuggu

SEQ ID NO: 1998559 - RNA, 18 nt, Human
ugaaaacagaaauuggua

SEQ ID NO: 1998560 - RNA, 21 nt, Human
ugaaaacagaaauugguaccu

SEQ ID NO: 1998561 - RNA, 22 nt, Human
ugaaaacagaaauugguaccuu

SEQ ID NO: 1998562 - RNA, 21 nt, Human
ugaaaacacuguucucugccc

SEQ ID NO: 1998563 - RNA, 20 nt, Human
ugaaaacacuguucucugcc

SEQ ID NO: 1998564 - RNA, 17 nt, Human
ugaaaacacuguucucu

SEQ ID NO: 1998565 - RNA, 19 nt, Human
ucuuuuccaaacacaggca

SEQ ID NO: 1998566 - RNA, 13 nt, Human
ucuuuuccucgcu

SEQ ID NO: 1998567 - RNA, 18 nt, Human
ucuuuuguuuuuugaagu

SEQ ID NO: 1998568 - RNA, 19 nt, Human
ucuuuuguuacucuuggga

SEQ ID NO: 1998569 - RNA, 21 nt, Human
ucuuuuguuuuuugaaguguu

SEQ ID NO: 1998570 - RNA, 21 nt, Human
ugaaaacacauuuuucuuagg

SEQ ID NO: 1998571 - RNA, 14 nt, Human
ucuuugcagacagg

SEQ ID NO: 1998572 - RNA, 17 nt, Human
ucuuugcagacaggcaa

SEQ ID NO: 1998573 - RNA, 18 nt, Human
ucuuugcacuuuuucuua

SEQ ID NO: 1998574 - RNA, 20 nt, Human
ucuuugcacuuuuucuuaau

SEQ ID NO: 1998575 - RNA, 13 nt, Human
ucuuugccaucuc

SEQ ID NO: 1998576 - RNA, 16 nt, Human
ucuuugccaucucugc

SEQ ID NO: 1998577 - RNA, 17 nt, Human
ucuuugccaucucugcu

SEQ ID NO: 1998578 - RNA, 18 nt, Human
ucuuugccaucucugcuc

SEQ ID NO: 1998579 - RNA, 19 nt, Human
ucuuugccaucucugcucc

SEQ ID NO: 1998580 - RNA, 20 nt, Human
ucuuugccaucucugcucca

SEQ ID NO: 1998581 - RNA, 21 nt, Human
ucuuugcccccaaacccccau

SEQ ID NO: 1998582 - RNA, 23 nt, Human
ucuuugagugaagcugggagaac

SEQ ID NO: 1998583 - RNA, 15 nt, Human
ucuuugaauuuucau

SEQ ID NO: 1998584 - RNA, 16 nt, Human
ucuuugaauuuucauu

SEQ ID NO: 1998585 - RNA, 19 nt, Human
ucuuugaauuuucauuuua

SEQ ID NO: 1998586 - RNA, 21 nt, Human
ucuuugaauuuucauuuuaca

SEQ ID NO: 1998587 - RNA, 13 nt, Human
ucuuugcagacag

SEQ ID NO: 1998588 - RNA, 15 nt, Human
ucuuuggacccugag

SEQ ID NO: 1998589 - RNA, 14 nt, Human
ucuuuggacccuga

SEQ ID NO: 1998590 - RNA, 16 nt, Human
ucuuuggacccugagg

SEQ ID NO: 1998591 - RNA, 13 nt, Human
ucuuuggacccug

SEQ ID NO: 1998592 - RNA, 22 nt, Human
ucuuugcccuuuacuugucuuu

SEQ ID NO: 1998593 - RNA, 13 nt, Human
ucuuugcccuuua

SEQ ID NO: 1998594 - RNA, 15 nt, Human
ucuuugcccuuuacu

SEQ ID NO: 1998595 - RNA, 13 nt, Human
ucuuguguguuua

SEQ ID NO: 1998596 - RNA, 23 nt, Human
ucuuuccaaaguacacuguuuca

SEQ ID NO: 1998597 - RNA, 17 nt, Human
ucuuguguauuucaguu

SEQ ID NO: 1998598 - RNA, 12 nt, Human
ucuuucccuccc

SEQ ID NO: 1998599 - RNA, 23 nt, Human
ucuuucccucccuuccucuuucc

SEQ ID NO: 1998600 - RNA, 13 nt, Human
ucuuucccucccu

SEQ ID NO: 1998601 - RNA, 13 nt, Human
ucuuugaauuuuc

SEQ ID NO: 1998602 - RNA, 14 nt, Human
ucuuugaauuuuca

SEQ ID NO: 1998603 - RNA, 21 nt, Human
ucuuauauuuacaacacuuua

SEQ ID NO: 1998604 - RNA, 16 nt, Human
ucuuaucucagauauu

SEQ ID NO: 1998605 - RNA, 22 nt, Human
ucuuauccaacaucaacaucuu

SEQ ID NO: 1998606 - RNA, 20 nt, Human
ucuuaucucagauauuugca

SEQ ID NO: 1998607 - RNA, 21 nt, Human
ucuuaucucagauauuugcac

SEQ ID NO: 1998608 - RNA, 21 nt, Human
ucuucagagacuccugcaggc

SEQ ID NO: 1998609 - RNA, 14 nt, Human
ucuucagaucucua

SEQ ID NO: 1998610 - RNA, 15 nt, Human
ucuucagaucucuaa

SEQ ID NO: 1998611 - RNA, 19 nt, Human
ucuucaguuaagccuuugg

SEQ ID NO: 1998612 - RNA, 20 nt, Human
ucuucaguuaagccuuugga

SEQ ID NO: 1998613 - RNA, 22 nt, Human
ucuucaguuaagccuuuggaaa

SEQ ID NO: 1998614 - RNA, 21 nt, Human
ucuuccaaagcagagagcauu

SEQ ID NO: 1998615 - RNA, 22 nt, Human
ucuucauuaccucagugagaag

SEQ ID NO: 1998616 - RNA, 14 nt, Human
ucuucauguuccca

SEQ ID NO: 1998617 - RNA, 16 nt, Human
ucuucauguucccacu

SEQ ID NO: 1998618 - RNA, 19 nt, Human
ucuucauguucccacuuca

SEQ ID NO: 1998619 - RNA, 11 nt, Human
ucugugugugu

SEQ ID NO: 1998620 - RNA, 13 nt, Human
ucugugugugugu

SEQ ID NO: 1998621 - RNA, 15 nt, Human
ucuuagauguauaua

SEQ ID NO: 1998622 - RNA, 17 nt, Human
ucugugucagguggggc

SEQ ID NO: 1998623 - RNA, 20 nt, Human
ucugugucagguggggcagc

SEQ ID NO: 1998624 - RNA, 23 nt, Human
ucuuagguuggcaaaaaggcagg

SEQ ID NO: 1998625 - RNA, 20 nt, Human
ucuuagguuggcaaaaaggc

SEQ ID NO: 1998626 - RNA, 13 nt, Human
ucuuauaauuuaa

SEQ ID NO: 1998627 - RNA, 14 nt, Human
ucuuauaauuuaaa

SEQ ID NO: 1998628 - RNA, 17 nt, Human
ucuugaacugagcuugg

SEQ ID NO: 1998629 - RNA, 20 nt, Human
ucuugaaauauaggaacuua

SEQ ID NO: 1998630 - RNA, 21 nt, Human
ucuugaaauauaggaacuuaa

SEQ ID NO: 1998631 - RNA, 18 nt, Human
ucuugaacugagcuugga

SEQ ID NO: 1998632 - RNA, 16 nt, Human
ucuugaaggaaaaauu

SEQ ID NO: 1998633 - RNA, 17 nt, Human
ucuugaaggaaaaauuc

SEQ ID NO: 1998634 - RNA, 18 nt, Human
ucuugaaggaaaaauuca

SEQ ID NO: 1998635 - RNA, 19 nt, Human
ucuugaaggaaaaauucaa

SEQ ID NO: 1998636 - RNA, 22 nt, Human
ucuugaaggaaaaauucaauag

SEQ ID NO: 1998637 - RNA, 22 nt, Human
ucuugaagacuuuucuuucagc

SEQ ID NO: 1998638 - RNA, 13 nt, Human
ucuugaagacuuu

SEQ ID NO: 1998639 - RNA, 16 nt, Human
ucuucuuggucucagu

SEQ ID NO: 1998640 - RNA, 17 nt, Human
ucuuccaaccauuuauc

SEQ ID NO: 1998641 - RNA, 19 nt, Human
ucuuccaaccauuuaucuu

SEQ ID NO: 1998642 - RNA, 21 nt, Human
ucuuccaaccauuuaucuuga

SEQ ID NO: 1998643 - RNA, 14 nt, Human
ucuugcucugcuga

SEQ ID NO: 1998644 - RNA, 16 nt, Human
ucuugccacugccucu

SEQ ID NO: 1998645 - RNA, 17 nt, Human
ucuugccacugccucuu

SEQ ID NO: 1998646 - RNA, 19 nt, Human
ucuugccaaauauaaauaa

SEQ ID NO: 1998647 - RNA, 23 nt, Human
ucuugcauggcaaggacugcagg

SEQ ID NO: 1998648 - RNA, 23 nt, Human
ucuugcauuuaaaagacagcuuu

SEQ ID NO: 1998649 - RNA, 14 nt, Human
ucuugcauuucacu

SEQ ID NO: 1998650 - RNA, 15 nt, Human
ucuugcucugcugac

SEQ ID NO: 1998651 - RNA, 23 nt, Human
ucuugcucugcugacagacacag

SEQ ID NO: 1998652 - RNA, 13 nt, Human
ugaggcagguccc

SEQ ID NO: 1998653 - RNA, 20 nt, Human
ugaggcagcacgugcacaaa

SEQ ID NO: 1998654 - RNA, 16 nt, Human
ugaggcugggcucccu

SEQ ID NO: 1998655 - RNA, 15 nt, Human
ugaggcugggcuccc

SEQ ID NO: 1998656 - RNA, 18 nt, Human
ugaggcucugcccuuggu

SEQ ID NO: 1998657 - RNA, 15 nt, Human
ugaggcucugcccuu

SEQ ID NO: 1998658 - RNA, 16 nt, Human
ugaggcucugcccuug

SEQ ID NO: 1998659 - RNA, 21 nt, Human
ugaggugaugaagacagcccg

SEQ ID NO: 1998660 - RNA, 21 nt, Human
ugaggcugggcucccuuccca

SEQ ID NO: 1998661 - RNA, 18 nt, Human
ugaggucagagccugcag

SEQ ID NO: 1998662 - RNA, 19 nt, Human
ugaggucagagccugcagu

SEQ ID NO: 1998663 - RNA, 20 nt, Human
ugagucccaggcugagccuc

SEQ ID NO: 1998664 - RNA, 21 nt, Human
ugagucccaggcugagccuca

SEQ ID NO: 1998665 - RNA, 21 nt, Human
ugaggaggccuugggcucugc

SEQ ID NO: 1998666 - RNA, 23 nt, Human
ugaggaggccuugggcucugcug

SEQ ID NO: 1998667 - RNA, 15 nt, Human
ugagcugcaccaggu

SEQ ID NO: 1998668 - RNA, 23 nt, Human
ugagcuuaagaauuuugagcagg

SEQ ID NO: 1998669 - RNA, 17 nt, Human
ugagcuuacguaguucu

SEQ ID NO: 1998670 - RNA, 18 nt, Human
ugagcuuacguaguucua

SEQ ID NO: 1998671 - RNA, 17 nt, Human
ugaggauuaguuuagaa

SEQ ID NO: 1998672 - RNA, 19 nt, Human
ugaggauuaguuuagaaca

SEQ ID NO: 1998673 - RNA, 20 nt, Human
ugaggauuaguuuagaacag

SEQ ID NO: 1998674 - RNA, 21 nt, Human
ugaggauuaguuuagaacagg

SEQ ID NO: 1998675 - RNA, 22 nt, Human
ugaggaugaaaaaauaacacug

SEQ ID NO: 1998676 - RNA, 19 nt, Human
ugaggaucagaguaaucca

SEQ ID NO: 1998677 - RNA, 17 nt, Human
ugaggaucagaguaauc

SEQ ID NO: 1998678 - RNA, 13 nt, Human
ugaggaucagagu

SEQ ID NO: 1998679 - RNA, 23 nt, Human
ugagccgagaucacgccacugca

SEQ ID NO: 1998680 - RNA, 14 nt, Human
ugagccgcagagaa

SEQ ID NO: 1998681 - RNA, 20 nt, Human
ugagcagggcucagcgggga

SEQ ID NO: 1998682 - RNA, 22 nt, Human
ugagcagggcucagcggggaca

SEQ ID NO: 1998683 - RNA, 23 nt, Human
ugagcagggcucagcggggacag

SEQ ID NO: 1998684 - RNA, 22 nt, Human
ugagccgagaucacgccacugc

SEQ ID NO: 1998685 - RNA, 19 nt, Human
ugagcucaggaguuugaga

SEQ ID NO: 1998686 - RNA, 11 nt, Human
ugagcucagga

SEQ ID NO: 1998687 - RNA, 11 nt, Human
ugagcucagcc

SEQ ID NO: 1998688 - RNA, 12 nt, Human
ugagcucagccc

SEQ ID NO: 1998689 - RNA, 20 nt, Human
ugagcucagcccuggugggc

SEQ ID NO: 1998690 - RNA, 17 nt, Human
ugagcugaaagaggcca

SEQ ID NO: 1998691 - RNA, 14 nt, Human
ugacugggggcaga

SEQ ID NO: 1998692 - RNA, 16 nt, Human
ugacuuuccucuuugg

SEQ ID NO: 1998693 - RNA, 14 nt, Human
ugacuuugaaaaua

SEQ ID NO: 1998694 - RNA, 21 nt, Human
ugacucuuucuauuguuucuu

SEQ ID NO: 1998695 - RNA, 22 nt, Human
ugacucuugaguuguuuuugua

SEQ ID NO: 1998696 - RNA, 23 nt, Human
ugacucuugaguuguuuuuguau

SEQ ID NO: 1998697 - RNA, 14 nt, Human
ugacugaacuguaa

SEQ ID NO: 1998698 - RNA, 13 nt, Human
ugacuacagggcc

SEQ ID NO: 1998699 - RNA, 14 nt, Human
ugacuacagggccg

SEQ ID NO: 1998700 - RNA, 18 nt, Human
ugacucuuccccaggaag

SEQ ID NO: 1998701 - RNA, 14 nt, Human
ugacucuugaguug

SEQ ID NO: 1998702 - RNA, 19 nt, Human
ugacucuugaguuguuuuu

SEQ ID NO: 1998703 - RNA, 21 nt, Human
ugacucuugaguuguuuuugu

SEQ ID NO: 1998704 - RNA, 13 nt, Human
ugaccauucucca

SEQ ID NO: 1998705 - RNA, 14 nt, Human
ugaccauucuccac

SEQ ID NO: 1998706 - RNA, 17 nt, Human
ugacgugucaggaaaac

SEQ ID NO: 1998707 - RNA, 13 nt, Human
ugagacauauuua

SEQ ID NO: 1998708 - RNA, 15 nt, Human
ugagaaauaaaguuu

SEQ ID NO: 1998709 - RNA, 15 nt, Human
ugacuuuuuuucacu

SEQ ID NO: 1998710 - RNA, 18 nt, Human
ugagaaaaccccuuccca

SEQ ID NO: 1998711 - RNA, 16 nt, Human
ugacuuuucaaguauu

SEQ ID NO: 1998712 - RNA, 23 nt, Human
ugacuuuucaaguauuuaagccu

SEQ ID NO: 1998713 - RNA, 22 nt, Human
ugacuuuucuguccgagcuuug

SEQ ID NO: 1998714 - RNA, 13 nt, Human
ugacuuuugcuuu

SEQ ID NO: 1998715 - RNA, 14 nt, Human
ugacuuuugcuuua

SEQ ID NO: 1998716 - RNA, 16 nt, Human
ugacuuuugcuuuaau

SEQ ID NO: 1998717 - RNA, 17 nt, Human
ugacuuuugcuuuaauu

SEQ ID NO: 1998718 - RNA, 21 nt, Human
ugacuuuugcuuuaauuccau

SEQ ID NO: 1998719 - RNA, 12 nt, Human
ugagcagcaccc

SEQ ID NO: 1998720 - RNA, 18 nt, Human
ugagaggggaacagacug

SEQ ID NO: 1998721 - RNA, 14 nt, Human
ugagaggggaacag

SEQ ID NO: 1998722 - RNA, 19 nt, Human
ugagaggcugucuguugua

SEQ ID NO: 1998723 - RNA, 14 nt, Human
ugagaccaaccugg

SEQ ID NO: 1998724 - RNA, 12 nt, Human
ugagaccugccc

SEQ ID NO: 1998725 - RNA, 13 nt, Human
ugagaccugcccc

SEQ ID NO: 1998726 - RNA, 14 nt, Human
ugagaccugccccu

SEQ ID NO: 1998727 - RNA, 15 nt, Human
ugagaccugccccuc

SEQ ID NO: 1998728 - RNA, 22 nt, Human
ugagaccugccccuccucucug

SEQ ID NO: 1998729 - RNA, 20 nt, Human
ugaagagaagggcagggcug

SEQ ID NO: 1998730 - RNA, 22 nt, Human
ugaagagaagggcagggcugag

SEQ ID NO: 1998731 - RNA, 13 nt, Human
ugaagacuccaga

SEQ ID NO: 1998732 - RNA, 14 nt, Human
ugaagacuccagaa

SEQ ID NO: 1998733 - RNA, 15 nt, Human
ugaagacuccagaaa

SEQ ID NO: 1998734 - RNA, 23 nt, Human
ugaagagcaagagagcagcaagg

SEQ ID NO: 1998735 - RNA, 17 nt, Human
ugaagagcuggggagaa

SEQ ID NO: 1998736 - RNA, 18 nt, Human
ugaagagcuggggagaau

SEQ ID NO: 1998737 - RNA, 20 nt, Human
ugaagagguuuuaaagcuuc

SEQ ID NO: 1998738 - RNA, 21 nt, Human
ugaagagguuuuaaagcuucc

SEQ ID NO: 1998739 - RNA, 19 nt, Human
ugaagagguuuuaaagcuu

SEQ ID NO: 1998740 - RNA, 18 nt, Human
ugaagagcuguugauggg

SEQ ID NO: 1998741 - RNA, 17 nt, Human
ugaagaguccucugaau

SEQ ID NO: 1998742 - RNA, 23 nt, Human
ugaagaguccucugaaugaaccu

SEQ ID NO: 1998743 - RNA, 18 nt, Human
ugaaggccccgcccaggc

SEQ ID NO: 1998744 - RNA, 14 nt, Human
ugaaggaaaaauuc

SEQ ID NO: 1998745 - RNA, 16 nt, Human
ugaagcuuuuauguga

SEQ ID NO: 1998746 - RNA, 13 nt, Human
ugaaggaaaaauu

SEQ ID NO: 1998747 - RNA, 21 nt, Human
ugaagcuuuuaugugaaacau

SEQ ID NO: 1998748 - RNA, 16 nt, Human
ugaaggaaccaaagcg

SEQ ID NO: 1998749 - RNA, 20 nt, Human
ugaaggccccgcccaggcuu

SEQ ID NO: 1998750 - RNA, 19 nt, Human
ugaaggccccgcccaggcu

SEQ ID NO: 1998751 - RNA, 16 nt, Human
ugaaacacuuugcaua

SEQ ID NO: 1998752 - RNA, 13 nt, Human
ugaaacagacuug

SEQ ID NO: 1998753 - RNA, 14 nt, Human
ugaaacagacuugu

SEQ ID NO: 1998754 - RNA, 12 nt, Human
ugaaacaugcuu

SEQ ID NO: 1998755 - RNA, 20 nt, Human
ugaaacaugcuuguguuucu

SEQ ID NO: 1998756 - RNA, 24 nt, Human
ugaaacauguugccaaaauggugg

SEQ ID NO: 1998757 - RNA, 13 nt, Human
ugaaacauguuuc

SEQ ID NO: 1998758 - RNA, 18 nt, Human
ugaaacauugcuuuuaaa

SEQ ID NO: 1998759 - RNA, 23 nt, Human
ugaacuggguacuuguggacaca

SEQ ID NO: 1998760 - RNA, 19 nt, Human
ugaacuuacaggugauuaa

SEQ ID NO: 1998761 - RNA, 16 nt, Human
ugaaacauugcuuuua

SEQ ID NO: 1998762 - RNA, 17 nt, Human
ugaaacauugcuuuuaa

SEQ ID NO: 1998763 - RNA, 13 nt, Human
ugaacuguuagaa

SEQ ID NO: 1998764 - RNA, 14 nt, Human
ugaacuguuagaau

SEQ ID NO: 1998765 - RNA, 16 nt, Human
ugaacuguuagaaugu

SEQ ID NO: 1998766 - RNA, 17 nt, Human
ugaacuguuagaaugua

SEQ ID NO: 1998767 - RNA, 19 nt, Human
ugaagacucauucuucugu

SEQ ID NO: 1998768 - RNA, 20 nt, Human
ugaagacucauucuucugua

SEQ ID NO: 1998769 - RNA, 19 nt, Human
ugaacuuccugcuuccuca

SEQ ID NO: 1998770 - RNA, 22 nt, Human
ugaaguuugauaaauaguguua

SEQ ID NO: 1998771 - RNA, 15 nt, Human
ugaaguuugauaaau

SEQ ID NO: 1998772 - RNA, 20 nt, Human
ugaaguuugauaaauagugu

SEQ ID NO: 1998773 - RNA, 14 nt, Human
ugaaguuugauaaa

SEQ ID NO: 1998774 - RNA, 21 nt, Human
ugaaucagaauaaccuucaaa

SEQ ID NO: 1998775 - RNA, 21 nt, Human
ugaaggcuggguucugauccu

SEQ ID NO: 1998776 - RNA, 20 nt, Human
ugaaggcuggguucugaucc

SEQ ID NO: 1998777 - RNA, 12 nt, Human
ugaaucuguaca

SEQ ID NO: 1998778 - RNA, 13 nt, Human
ugaaucuguacag

SEQ ID NO: 1998779 - RNA, 14 nt, Human
ugaaucuguacaga

SEQ ID NO: 1998780 - RNA, 16 nt, Human
ugaaugaaccuucugg

SEQ ID NO: 1998781 - RNA, 15 nt, Human
ugaaugaaccuucug

SEQ ID NO: 1998782 - RNA, 16 nt, Human
ugaaucuuggugucua

SEQ ID NO: 1998783 - RNA, 14 nt, Human
ugaaucuucugaaa

SEQ ID NO: 1998784 - RNA, 22 nt, Human
ugaaucuucugaaaccaaaugu

SEQ ID NO: 1998785 - RNA, 15 nt, Human
ugaaugaauggcuaa

SEQ ID NO: 1998786 - RNA, 20 nt, Human
ugaaugaauggcuaagcaaa

SEQ ID NO: 1998787 - RNA, 23 nt, Human
ugaaugaugauccuaggcauuug

SEQ ID NO: 1998788 - RNA, 14 nt, Human
ugaaugcauaaaau

SEQ ID NO: 1998789 - RNA, 16 nt, Human
ugaccacugcagaaga

SEQ ID NO: 1998790 - RNA, 17 nt, Human
ugaccacugcagaagac

SEQ ID NO: 1998791 - RNA, 18 nt, Human
ugaccacugcagaagaca

SEQ ID NO: 1998792 - RNA, 13 nt, Human
ugacauguuuuau

SEQ ID NO: 1998793 - RNA, 21 nt, Human
ugaccagccuccaugcugccu

SEQ ID NO: 1998794 - RNA, 22 nt, Human
ugaccagccuccaugcugccuc

SEQ ID NO: 1998795 - RNA, 23 nt, Human
ugaccagccuccaugcugccucc

SEQ ID NO: 1998796 - RNA, 15 nt, Human
ugaccaucauuucac

SEQ ID NO: 1998797 - RNA, 18 nt, Human
ugacaugcacucagcucu

SEQ ID NO: 1998798 - RNA, 22 nt, Human
ugacaucucuauuccccacccu

SEQ ID NO: 1998799 - RNA, 19 nt, Human
ugacauguguuggcagccu

SEQ ID NO: 1998800 - RNA, 23 nt, Human
ugacaucaacugcaucaagaugu

SEQ ID NO: 1998801 - RNA, 22 nt, Human
ugacagagccugccccagcgcu

SEQ ID NO: 1998802 - RNA, 23 nt, Human
ugacagagccugccccagcgcug

SEQ ID NO: 1998803 - RNA, 23 nt, Human
ugacagagagagauacucuggga

SEQ ID NO: 1998804 - RNA, 14 nt, Human
ugacagagccugcc

SEQ ID NO: 1998805 - RNA, 16 nt, Human
ugacagagccugcccc

SEQ ID NO: 1998806 - RNA, 20 nt, Human
ugacagagccugccccagcg

SEQ ID NO: 1998807 - RNA, 22 nt, Human
ugacagagcaagugagacccug

SEQ ID NO: 1998808 - RNA, 21 nt, Human
ugacagagagagauacucugg

SEQ ID NO: 1998809 - RNA, 22 nt, Human
ugacagagagagauacucuggg

SEQ ID NO: 1998810 - RNA, 20 nt, Human
ugacagagagagauacucug

SEQ ID NO: 1998811 - RNA, 17 nt, Human
ugacagacacaggcccg

SEQ ID NO: 1998812 - RNA, 18 nt, Human
ugacagacacaggcccgg

SEQ ID NO: 1998813 - RNA, 15 nt, Human
ugacauauuuuugcu

SEQ ID NO: 1998814 - RNA, 16 nt, Human
ugacaucacuggcaug

SEQ ID NO: 1998815 - RNA, 17 nt, Human
ugacaucacuggcaugg

SEQ ID NO: 1998816 - RNA, 14 nt, Human
ugacaucacuggca

SEQ ID NO: 1998817 - RNA, 18 nt, Human
ugacaucacuggcauggu

SEQ ID NO: 1998818 - RNA, 18 nt, Human
ugacauccacaaaugcag

SEQ ID NO: 1998819 - RNA, 23 nt, Human
ugacaacacucauugaccugagg

SEQ ID NO: 1998820 - RNA, 15 nt, Human
ugacaacagacuucu

SEQ ID NO: 1998821 - RNA, 17 nt, Human
ugacaaauguuucuaag

SEQ ID NO: 1998822 - RNA, 19 nt, Human
ugacaaauguuucuaaggu

SEQ ID NO: 1998823 - RNA, 21 nt, Human
ugacaaauguuucuaagguaa

SEQ ID NO: 1998824 - RNA, 18 nt, Human
ugacaacagacuucugaa

SEQ ID NO: 1998825 - RNA, 19 nt, Human
ugacaacagacuucugaaa

SEQ ID NO: 1998826 - RNA, 13 nt, Human
ugacaacacucau

SEQ ID NO: 1998827 - RNA, 14 nt, Human
ugacaaauguuucu

SEQ ID NO: 1998828 - RNA, 15 nt, Human
ugacaaauguuucua

SEQ ID NO: 1998829 - RNA, 16 nt, Human
ugaauuuaaauagcuu

SEQ ID NO: 1998830 - RNA, 20 nt, Human
ugacaaagguaaaucagacu

SEQ ID NO: 1998831 - RNA, 13 nt, Human
ugaauuguaagga

SEQ ID NO: 1998832 - RNA, 21 nt, Human
ugaauuguaaggaaugauuaa

SEQ ID NO: 1998833 - RNA, 14 nt, Human
ugacacacagcucu

SEQ ID NO: 1998834 - RNA, 15 nt, Human
ugacacacagcucug

SEQ ID NO: 1998835 - RNA, 14 nt, Human
ugacagacacaggc

SEQ ID NO: 1998836 - RNA, 16 nt, Human
ugacagacacaggccc

SEQ ID NO: 1998837 - RNA, 13 nt, Human
ugacagacacagg

SEQ ID NO: 1998838 - RNA, 23 nt, Human
ugacaaggauugcuacuguccua

SEQ ID NO: 1998839 - RNA, 17 nt, Human
ugacaaguuuaaaggcu

SEQ ID NO: 1998840 - RNA, 22 nt, Human
uacauggaauaacauguaauua

SEQ ID NO: 1998841 - RNA, 19 nt, Human
uacauggaauaacauguaa

SEQ ID NO: 1998842 - RNA, 18 nt, Human
uacauggaauaacaugua

SEQ ID NO: 1998843 - RNA, 14 nt, Human
uacauggaauaaca

SEQ ID NO: 1998844 - RNA, 19 nt, Human
uacauuuuuaagugcugca

SEQ ID NO: 1998845 - RNA, 22 nt, Human
uacauuuuuaagugcugcauuu

SEQ ID NO: 1998846 - RNA, 21 nt, Human
uacauggcuggagcuagaauu

SEQ ID NO: 1998847 - RNA, 14 nt, Human
uacauuuuuaagug

SEQ ID NO: 1998848 - RNA, 14 nt, Human
uacaugcuuguuga

SEQ ID NO: 1998849 - RNA, 15 nt, Human
uacaugcuuugugaa

SEQ ID NO: 1998850 - RNA, 16 nt, Human
uacaugcuuugugaac

SEQ ID NO: 1998851 - RNA, 16 nt, Human
uacaugccauugaaaa

SEQ ID NO: 1998852 - RNA, 18 nt, Human
uacaugcacacucaugug

SEQ ID NO: 1998853 - RNA, 14 nt, Human
uacaugaaauucaa

SEQ ID NO: 1998854 - RNA, 17 nt, Human
uacauaagauaaaugug

SEQ ID NO: 1998855 - RNA, 16 nt, Human
uacauaagauaaaugu

SEQ ID NO: 1998856 - RNA, 16 nt, Human
uacaugaaaacacauu

SEQ ID NO: 1998857 - RNA, 17 nt, Human
uacaugaaaacacauuu

SEQ ID NO: 1998858 - RNA, 18 nt, Human
uacaugaaaacacauuuu

SEQ ID NO: 1998859 - RNA, 19 nt, Human
uacaugaaaacacauuuuu

SEQ ID NO: 1998860 - RNA, 23 nt, Human
uacaugaaaacacauuuuucuua

SEQ ID NO: 1998861 - RNA, 19 nt, Human
uacaguuuguuaguaugag

SEQ ID NO: 1998862 - RNA, 21 nt, Human
uacaguuuguuaguaugaggc

SEQ ID NO: 1998863 - RNA, 16 nt, Human
uacauaaacaaguccu

SEQ ID NO: 1998864 - RNA, 12 nt, Human
uacauaaacauc

SEQ ID NO: 1998865 - RNA, 13 nt, Human
uacauaaacauca

SEQ ID NO: 1998866 - RNA, 13 nt, Human
uacaggaaguacu

SEQ ID NO: 1998867 - RNA, 18 nt, Human
uacaggaagguagaaaua

SEQ ID NO: 1998868 - RNA, 20 nt, Human
uacagcuugaccgugaggcc

SEQ ID NO: 1998869 - RNA, 14 nt, Human
uacagcugccugca

SEQ ID NO: 1998870 - RNA, 13 nt, Human
uacagcugccugc

SEQ ID NO: 1998871 - RNA, 16 nt, Human
uacagcucccccagcu

SEQ ID NO: 1998872 - RNA, 17 nt, Human
uacagcucccccagcuc

SEQ ID NO: 1998873 - RNA, 18 nt, Human
uacagcucccccagcucc

SEQ ID NO: 1998874 - RNA, 20 nt, Human
uacagcucccccagcucccc

SEQ ID NO: 1998875 - RNA, 14 nt, Human
uacagcucccccag

SEQ ID NO: 1998876 - RNA, 23 nt, Human
uacacugugcugagucugaaggc

SEQ ID NO: 1998877 - RNA, 22 nt, Human
uacacugugcugagucugaagg

SEQ ID NO: 1998878 - RNA, 20 nt, Human
uacacuguuucaaacuuuac

SEQ ID NO: 1998879 - RNA, 16 nt, Human
uacacugccugccuua

SEQ ID NO: 1998880 - RNA, 16 nt, Human
uacacuuacacuuuau

SEQ ID NO: 1998881 - RNA, 22 nt, Human
uacacuguuucaaacuuuacua

SEQ ID NO: 1998882 - RNA, 16 nt, Human
uacagcuaaucagcau

SEQ ID NO: 1998883 - RNA, 18 nt, Human
uacagcuaaucagcauuc

SEQ ID NO: 1998884 - RNA, 21 nt, Human
uacacugagagccuuuuugaa

SEQ ID NO: 1998885 - RNA, 16 nt, Human
uacacuucaguuaucu

SEQ ID NO: 1998886 - RNA, 19 nt, Human
uacaguugaaaaacagcug

SEQ ID NO: 1998887 - RNA, 17 nt, Human
uacaguugaaaaacagc

SEQ ID NO: 1998888 - RNA, 20 nt, Human
uacaguugaaaaacagcuga

SEQ ID NO: 1998889 - RNA, 18 nt, Human
uacaguuuguuaguauga

SEQ ID NO: 1998890 - RNA, 15 nt, Human
uacaggaaguacugg

SEQ ID NO: 1998891 - RNA, 14 nt, Human
uacaggaaguacug

SEQ ID NO: 1998892 - RNA, 22 nt, Human
uacaggaaguacuggagaaaau

SEQ ID NO: 1998893 - RNA, 15 nt, Human
uacaggagugagcac

SEQ ID NO: 1998894 - RNA, 20 nt, Human
uacaggaugaugacuaugga

SEQ ID NO: 1998895 - RNA, 23 nt, Human
uacaguucggugagcuacaaaug

SEQ ID NO: 1998896 - RNA, 13 nt, Human
uacaaaugauugc

SEQ ID NO: 1998897 - RNA, 18 nt, Human
uacaaaugauugcuuuua

SEQ ID NO: 1998898 - RNA, 19 nt, Human
uacaaaugauugcuuuuaa

SEQ ID NO: 1998899 - RNA, 20 nt, Human
uacaaaugauugcuuuuaaa

SEQ ID NO: 1998900 - RNA, 21 nt, Human
uacaaaugauugcuuuuaaaa

SEQ ID NO: 1998901 - RNA, 23 nt, Human
uacaaaugauugcuuuuaaaauu

SEQ ID NO: 1998902 - RNA, 16 nt, Human
uacaaaugcaucuuug

SEQ ID NO: 1998903 - RNA, 17 nt, Human
uacaaaugcaucuuuga

SEQ ID NO: 1998904 - RNA, 18 nt, Human
uacaaaugcaucuuugau

SEQ ID NO: 1998905 - RNA, 18 nt, Human
uacaaaguagaagucuua

SEQ ID NO: 1998906 - RNA, 14 nt, Human
uacaaaguagaagu

SEQ ID NO: 1998907 - RNA, 17 nt, Human
uacaaaggcuguauuca

SEQ ID NO: 1998908 - RNA, 16 nt, Human
uacaaaggcuguauuc

SEQ ID NO: 1998909 - RNA, 14 nt, Human
uacaaacaagcaua

SEQ ID NO: 1998910 - RNA, 15 nt, Human
uacaaacaagcauau

SEQ ID NO: 1998911 - RNA, 17 nt, Human
uacaaacaagcauauaa

SEQ ID NO: 1998912 - RNA, 18 nt, Human
uacaaacaagcauauaaa

SEQ ID NO: 1998913 - RNA, 19 nt, Human
uacaaacaagcauauaaaa

SEQ ID NO: 1998914 - RNA, 20 nt, Human
uacaaacaagcauauaaaau

SEQ ID NO: 1998915 - RNA, 13 nt, Human
uaauuuuguguaa

SEQ ID NO: 1998916 - RNA, 19 nt, Human
uaauuuuguguaagaaaua

SEQ ID NO: 1998917 - RNA, 20 nt, Human
uaauuuuguguaagaaauac

SEQ ID NO: 1998918 - RNA, 19 nt, Human
uaauuuuuaaaugcaguua

SEQ ID NO: 1998919 - RNA, 13 nt, Human
uaauuuuuaaaug

SEQ ID NO: 1998920 - RNA, 15 nt, Human
uaauuuuuaaaugca

SEQ ID NO: 1998921 - RNA, 15 nt, Human
uaauucuaugccugu

SEQ ID NO: 1998922 - RNA, 15 nt, Human
uacaaauuauaaugu

SEQ ID NO: 1998923 - RNA, 16 nt, Human
uacaaauuauaaugua

SEQ ID NO: 1998924 - RNA, 18 nt, Human
uacaaauuauaauguauu

SEQ ID NO: 1998925 - RNA, 22 nt, Human
uacaaauuauaauguauucaua

SEQ ID NO: 1998926 - RNA, 15 nt, Human
uacaaauuuuucugu

SEQ ID NO: 1998927 - RNA, 16 nt, Human
uacaaauuuuucugug

SEQ ID NO: 1998928 - RNA, 23 nt, Human
uacaaaugccuccaaaguauugu

SEQ ID NO: 1998929 - RNA, 19 nt, Human
uacaaaugcaucuuugaug

SEQ ID NO: 1998930 - RNA, 21 nt, Human
uacaaaugcaucuuugaugug

SEQ ID NO: 1998931 - RNA, 16 nt, Human
uacaacaccaaaaaau

SEQ ID NO: 1998932 - RNA, 18 nt, Human
uacaacaccaaaaaauau

SEQ ID NO: 1998933 - RNA, 19 nt, Human
uacaacaccaaaaaauauc

SEQ ID NO: 1998934 - RNA, 18 nt, Human
uacaacacuuuaaugggu

SEQ ID NO: 1998935 - RNA, 17 nt, Human
uacaauuucuuuugguu

SEQ ID NO: 1998936 - RNA, 11 nt, Human
uacacacacac

SEQ ID NO: 1998937 - RNA, 19 nt, Human
uacaauuucuuuugguuca

SEQ ID NO: 1998938 - RNA, 23 nt, Human
uacacacgcugccuucgguaccc

SEQ ID NO: 1998939 - RNA, 15 nt, Human
uacacacugcauguu

SEQ ID NO: 1998940 - RNA, 14 nt, Human
uacacaggacaggg

SEQ ID NO: 1998941 - RNA, 21 nt, Human
uacacaggacagggguuccuu

SEQ ID NO: 1998942 - RNA, 22 nt, Human
uacacaggacagggguuccuuc

SEQ ID NO: 1998943 - RNA, 20 nt, Human
uacacauauaaauugucuua

SEQ ID NO: 1998944 - RNA, 22 nt, Human
uacacaucagccaucaacuaaa

SEQ ID NO: 1998945 - RNA, 16 nt, Human
uacacauguauccuuu

SEQ ID NO: 1998946 - RNA, 20 nt, Human
uacacauguauccuuucaca

SEQ ID NO: 1998947 - RNA, 21 nt, Human
uacacugugcugagucugaag

SEQ ID NO: 1998948 - RNA, 18 nt, Human
uacacugaauuuuuaugu

SEQ ID NO: 1998949 - RNA, 20 nt, Human
uacacugaauuuuuaugugu

SEQ ID NO: 1998950 - RNA, 22 nt, Human
uacacugaauuuuuauguguga

SEQ ID NO: 1998951 - RNA, 23 nt, Human
uacacugaauuuuuaugugugau

SEQ ID NO: 1998952 - RNA, 14 nt, Human
uacuguuacuugau

SEQ ID NO: 1998953 - RNA, 15 nt, Human
uacuguuacuugaua

SEQ ID NO: 1998954 - RNA, 17 nt, Human
uacuguuacuugauaac

SEQ ID NO: 1998955 - RNA, 21 nt, Human
uacugucuucaguaagccgug

SEQ ID NO: 1998956 - RNA, 14 nt, Human
uacugugacuuuau

SEQ ID NO: 1998957 - RNA, 19 nt, Human
uacugcuagucuuaagaac

SEQ ID NO: 1998958 - RNA, 16 nt, Human
uacuguccuacccacc

SEQ ID NO: 1998959 - RNA, 18 nt, Human
uacugcuugaauaaacac

SEQ ID NO: 1998960 - RNA, 12 nt, Human
uacuugaaccau

SEQ ID NO: 1998961 - RNA, 16 nt, Human
uacuugaaccauaaaa

SEQ ID NO: 1998962 - RNA, 17 nt, Human
uacuugaaccauaaaau

SEQ ID NO: 1998963 - RNA, 19 nt, Human
uacuugaaccauaaaaugu

SEQ ID NO: 1998964 - RNA, 20 nt, Human
uacuugaaccauaaaauguc

SEQ ID NO: 1998965 - RNA, 21 nt, Human
uacuugaaccauaaaaugucc

SEQ ID NO: 1998966 - RNA, 17 nt, Human
uacuuaaauguuaugua

SEQ ID NO: 1998967 - RNA, 18 nt, Human
uacuuaaauguuauguau

SEQ ID NO: 1998968 - RNA, 19 nt, Human
uacuuaaauguuauguaua

SEQ ID NO: 1998969 - RNA, 19 nt, Human
uacuguuuaagugaauuga

SEQ ID NO: 1998970 - RNA, 13 nt, Human
uacuguuauucuu

SEQ ID NO: 1998971 - RNA, 14 nt, Human
uacuguuauucuuu

SEQ ID NO: 1998972 - RNA, 15 nt, Human
uacuguuauucuuug

SEQ ID NO: 1998973 - RNA, 16 nt, Human
uacuguuauucuuugc

SEQ ID NO: 1998974 - RNA, 17 nt, Human
uacuguuauucuuugca

SEQ ID NO: 1998975 - RNA, 20 nt, Human
uacuguuauucuuugcacuu

SEQ ID NO: 1998976 - RNA, 16 nt, Human
uacuguucagcuuuua

SEQ ID NO: 1998977 - RNA, 19 nt, Human
uacuugcucuugaugccug

SEQ ID NO: 1998978 - RNA, 18 nt, Human
uacuugcucuugaugccu

SEQ ID NO: 1998979 - RNA, 14 nt, Human
uacuugcucuugau

SEQ ID NO: 1998980 - RNA, 13 nt, Human
uacuugcucuuga

SEQ ID NO: 1998981 - RNA, 20 nt, Human
uacuugcucuugaugccugg

SEQ ID NO: 1998982 - RNA, 13 nt, Human
uacuuguggacac

SEQ ID NO: 1998983 - RNA, 20 nt, Human
uacuaaggauacaggcugga

SEQ ID NO: 1998984 - RNA, 22 nt, Human
uacuaaggauacaggcuggaaa

SEQ ID NO: 1998985 - RNA, 12 nt, Human
uacuaaggauac

SEQ ID NO: 1998986 - RNA, 19 nt, Human
uacuaaggauacaggcugg

SEQ ID NO: 1998987 - RNA, 22 nt, Human
uacuacaguccucccaucucac

SEQ ID NO: 1998988 - RNA, 13 nt, Human
uacuacaguuugu

SEQ ID NO: 1998989 - RNA, 14 nt, Human
uacuacaguuuguu

SEQ ID NO: 1998990 - RNA, 18 nt, Human
uacucgaguuacagacaa

SEQ ID NO: 1998991 - RNA, 22 nt, Human
uacucgaguuacagacaaagcg

SEQ ID NO: 1998992 - RNA, 12 nt, Human
uacuccucccag

SEQ ID NO: 1998993 - RNA, 15 nt, Human
uacuccccuccuuga

SEQ ID NO: 1998994 - RNA, 14 nt, Human
uacugccuauuuua

SEQ ID NO: 1998995 - RNA, 21 nt, Human
uacugccuauuuuaauaaaca

SEQ ID NO: 1998996 - RNA, 14 nt, Human
uacugccuccccca

SEQ ID NO: 1998997 - RNA, 19 nt, Human
uacugcccaggccugccug

SEQ ID NO: 1998998 - RNA, 20 nt, Human
uacugcccaggccugccugu

SEQ ID NO: 1998999 - RNA, 21 nt, Human
uacugcccaggccugccuguu

SEQ ID NO: 1999000 - RNA, 22 nt, Human
uacugcccaggccugccuguuc

SEQ ID NO: 1999001 - RNA, 19 nt, Human
uacugccaaccucgcucca

SEQ ID NO: 1999002 - RNA, 23 nt, Human
uacugccaaccucgcuccaacuc

SEQ ID NO: 1999003 - RNA, 13 nt, Human
uacugccaaccuc

SEQ ID NO: 1999004 - RNA, 16 nt, Human
uacugccaaccucgcu

SEQ ID NO: 1999005 - RNA, 17 nt, Human
uacugcauucuucugau

SEQ ID NO: 1999006 - RNA, 18 nt, Human
uacugcauucuucugauc

SEQ ID NO: 1999007 - RNA, 15 nt, Human
uacugcauuuaggga

SEQ ID NO: 1999008 - RNA, 18 nt, Human
uacugcauuuagggagua

SEQ ID NO: 1999009 - RNA, 14 nt, Human
uacugcauucuucu

SEQ ID NO: 1999010 - RNA, 16 nt, Human
uacucuacccucuuag

SEQ ID NO: 1999011 - RNA, 16 nt, Human
uacugcaaacuauuua

SEQ ID NO: 1999012 - RNA, 23 nt, Human
uacauuuuuaagugcugcauuua

SEQ ID NO: 1999013 - RNA, 20 nt, Human
uacauuuuuagccuguguca

SEQ ID NO: 1999014 - RNA, 13 nt, Human
uacauuuuuugaa

SEQ ID NO: 1999015 - RNA, 15 nt, Human
uacauuuuuugaaau

SEQ ID NO: 1999016 - RNA, 16 nt, Human
uacauuuuuugaaaug

SEQ ID NO: 1999017 - RNA, 22 nt, Human
uacauuuuuugaaaugcugaaa

SEQ ID NO: 1999018 - RNA, 15 nt, Human
uacccacugcucugg

SEQ ID NO: 1999019 - RNA, 20 nt, Human
uaccaaaaaaauuacaguuu

SEQ ID NO: 1999020 - RNA, 22 nt, Human
uaccuaacgaaguauccuucag

SEQ ID NO: 1999021 - RNA, 22 nt, Human
uaccgagucucuucuccacugg

SEQ ID NO: 1999022 - RNA, 17 nt, Human
uaccgagucucuucucc

SEQ ID NO: 1999023 - RNA, 15 nt, Human
uaccgacaagcacag

SEQ ID NO: 1999024 - RNA, 18 nt, Human
uaccgagucucuucucca

SEQ ID NO: 1999025 - RNA, 21 nt, Human
uaccgagucucuucuccacug

SEQ ID NO: 1999026 - RNA, 15 nt, Human
uaccuacauacaauu

SEQ ID NO: 1999027 - RNA, 21 nt, Human
uacgaaaagaggggaagagac

SEQ ID NO: 1999028 - RNA, 18 nt, Human
uacgaaaagaggggaaga

SEQ ID NO: 1999029 - RNA, 13 nt, Human
uaccuuuuuuaua

SEQ ID NO: 1999030 - RNA, 16 nt, Human
uaccuuuuuuauacau

SEQ ID NO: 1999031 - RNA, 17 nt, Human
uaccuuuuuuauacaua

SEQ ID NO: 1999032 - RNA, 15 nt, Human
uaccuuuuuuuuucu

SEQ ID NO: 1999033 - RNA, 19 nt, Human
uaccuuuuuuuuucuuuuu

SEQ ID NO: 1999034 - RNA, 20 nt, Human
uacuaauagacaauuuauua

SEQ ID NO: 1999035 - RNA, 21 nt, Human
uacuaauagacaauuuauuau

SEQ ID NO: 1999036 - RNA, 14 nt, Human
uacuaaggaaucuu

SEQ ID NO: 1999037 - RNA, 13 nt, Human
uaccuuuuuuaga

SEQ ID NO: 1999038 - RNA, 19 nt, Human
uaccuuuuuuagaguugau

SEQ ID NO: 1999039 - RNA, 22 nt, Human
uaccuuuuuuagaguugauacu

SEQ ID NO: 1999040 - RNA, 18 nt, Human
uaccucggugccuuccuc

SEQ ID NO: 1999041 - RNA, 18 nt, Human
uaccucugcauaaauauu

SEQ ID NO: 1999042 - RNA, 21 nt, Human
uaccucuugagccuugaacuu

SEQ ID NO: 1999043 - RNA, 13 nt, Human
uagcauccuggaa

SEQ ID NO: 1999044 - RNA, 15 nt, Human
uagcauccuggaaua

SEQ ID NO: 1999045 - RNA, 16 nt, Human
uagcauccuggaauau

SEQ ID NO: 1999046 - RNA, 18 nt, Human
uagcauccuggaauaucu

SEQ ID NO: 1999047 - RNA, 17 nt, Human
uagcaucacuuaaaaca

SEQ ID NO: 1999048 - RNA, 18 nt, Human
uagcaucacuuaaaacac

SEQ ID NO: 1999049 - RNA, 23 nt, Human
uagcaucacuuaaaacacguuuu

SEQ ID NO: 1999050 - RNA, 22 nt, Human
uagcauauauguguccauuucc

SEQ ID NO: 1999051 - RNA, 14 nt, Human
uagcauaugacaaa

SEQ ID NO: 1999052 - RNA, 18 nt, Human
uagcauaugacaaauguu

SEQ ID NO: 1999053 - RNA, 19 nt, Human
uagcauaugacaaauguuu

SEQ ID NO: 1999054 - RNA, 21 nt, Human
uagcauaugacaaauguuucu

SEQ ID NO: 1999055 - RNA, 22 nt, Human
uagcauaugacaaauguuucua

SEQ ID NO: 1999056 - RNA, 15 nt, Human
uagcaucacuuaaaa

SEQ ID NO: 1999057 - RNA, 16 nt, Human
uagcauacguacacau

SEQ ID NO: 1999058 - RNA, 17 nt, Human
uagcauacguacacauu

SEQ ID NO: 1999059 - RNA, 18 nt, Human
uagcauacguacacauuu

SEQ ID NO: 1999060 - RNA, 19 nt, Human
uagcauacguacacauuuu

SEQ ID NO: 1999061 - RNA, 11 nt, Human
uagcagggaaa

SEQ ID NO: 1999062 - RNA, 20 nt, Human
uagcagcugacuuucaaagu

SEQ ID NO: 1999063 - RNA, 16 nt, Human
uagauuccauuuacug

SEQ ID NO: 1999064 - RNA, 21 nt, Human
uagauuccauuuacugcauuc

SEQ ID NO: 1999065 - RNA, 21 nt, Human
uagauuaguacuggauuauuc

SEQ ID NO: 1999066 - RNA, 22 nt, Human
uagauuaguacuggauuauuca

SEQ ID NO: 1999067 - RNA, 13 nt, Human
uagauuugggaga

SEQ ID NO: 1999068 - RNA, 21 nt, Human
uagauuugccauagaguacac

SEQ ID NO: 1999069 - RNA, 14 nt, Human
uagauuuauuucau

SEQ ID NO: 1999070 - RNA, 15 nt, Human
uagauuuauuucauc

SEQ ID NO: 1999071 - RNA, 16 nt, Human
uagauacuguaucaug

SEQ ID NO: 1999072 - RNA, 15 nt, Human
uagccagugaacaua

SEQ ID NO: 1999073 - RNA, 15 nt, Human
uagcccccucuuccc

SEQ ID NO: 1999074 - RNA, 14 nt, Human
uagcccccucuucc

SEQ ID NO: 1999075 - RNA, 16 nt, Human
uagccccucuccugga

SEQ ID NO: 1999076 - RNA, 23 nt, Human
uagccccucuccccgcaguguuu

SEQ ID NO: 1999077 - RNA, 16 nt, Human
uagccuaggugacaga

SEQ ID NO: 1999078 - RNA, 18 nt, Human
uagccgugucacgggcau

SEQ ID NO: 1999079 - RNA, 14 nt, Human
uagccuaagauaua

SEQ ID NO: 1999080 - RNA, 18 nt, Human
uagccuaagauauacuug

SEQ ID NO: 1999081 - RNA, 19 nt, Human
uagccuaagauauacuugu

SEQ ID NO: 1999082 - RNA, 22 nt, Human
uagccuaagauauacuuguuuu

SEQ ID NO: 1999083 - RNA, 20 nt, Human
uagccugugccucugggacu

SEQ ID NO: 1999084 - RNA, 18 nt, Human
uagccugugccucuggga

SEQ ID NO: 1999085 - RNA, 12 nt, Human
uagcucauucuc

SEQ ID NO: 1999086 - RNA, 15 nt, Human
uagccuggugguuuu

SEQ ID NO: 1999087 - RNA, 20 nt, Human
uagcucaggugucccugcac

SEQ ID NO: 1999088 - RNA, 21 nt, Human
uagcucaggugucccugcacu

SEQ ID NO: 1999089 - RNA, 21 nt, Human
uagcugcagauaaguggccuu

SEQ ID NO: 1999090 - RNA, 17 nt, Human
uagcugacagaaucucu

SEQ ID NO: 1999091 - RNA, 14 nt, Human
uagcucuuuuccua

SEQ ID NO: 1999092 - RNA, 15 nt, Human
uagcugggacuacag

SEQ ID NO: 1999093 - RNA, 17 nt, Human
uagcugggacuacaggc

SEQ ID NO: 1999094 - RNA, 19 nt, Human
uagcugggacuacaggcac

SEQ ID NO: 1999095 - RNA, 13 nt, Human
uagaaucccugug

SEQ ID NO: 1999096 - RNA, 15 nt, Human
uagaaucccuguguu

SEQ ID NO: 1999097 - RNA, 16 nt, Human
uagaaucccuguguua

SEQ ID NO: 1999098 - RNA, 20 nt, Human
uagaaucccuguguuaauuu

SEQ ID NO: 1999099 - RNA, 17 nt, Human
uagaaugaccuuguaau

SEQ ID NO: 1999100 - RNA, 19 nt, Human
uagaaugaccuuguaaugu

SEQ ID NO: 1999101 - RNA, 20 nt, Human
uagaaugaccuuguaaugua

SEQ ID NO: 1999102 - RNA, 21 nt, Human
uagaaugaccuuguaauguaa

SEQ ID NO: 1999103 - RNA, 15 nt, Human
uagaaugaccuugua

SEQ ID NO: 1999104 - RNA, 16 nt, Human
uagaaugaccuuguaa

SEQ ID NO: 1999105 - RNA, 14 nt, Human
uagaauguaguuug

SEQ ID NO: 1999106 - RNA, 12 nt, Human
uagaauguaguu

SEQ ID NO: 1999107 - RNA, 21 nt, Human
uagaauguaguuugaggaaau

SEQ ID NO: 1999108 - RNA, 23 nt, Human
uagaauguaguuugaggaaauuu

SEQ ID NO: 1999109 - RNA, 18 nt, Human
uagaauguuuucaaaugu

SEQ ID NO: 1999110 - RNA, 20 nt, Human
uagaauggugauuuuaaaug

SEQ ID NO: 1999111 - RNA, 21 nt, Human
uagaauggugauuuuaaaugu

SEQ ID NO: 1999112 - RNA, 15 nt, Human
uagaauggugauuuu

SEQ ID NO: 1999113 - RNA, 16 nt, Human
uagaauggugauuuua

SEQ ID NO: 1999114 - RNA, 17 nt, Human
uagaauggugauuuuaa

SEQ ID NO: 1999115 - RNA, 18 nt, Human
uagaauggugauuuuaaa

SEQ ID NO: 1999116 - RNA, 19 nt, Human
uagaauggugauuuuaaau

SEQ ID NO: 1999117 - RNA, 19 nt, Human
uagaauguuuucaaauguu

SEQ ID NO: 1999118 - RNA, 15 nt, Human
uagaauuaacacaug

SEQ ID NO: 1999119 - RNA, 16 nt, Human
uagaauuaacacauga

SEQ ID NO: 1999120 - RNA, 18 nt, Human
uagaauuaacacaugauc

SEQ ID NO: 1999121 - RNA, 23 nt, Human
uagaauuaguggcacuugcuuuu

SEQ ID NO: 1999122 - RNA, 15 nt, Human
uagaauauauuuccu

SEQ ID NO: 1999123 - RNA, 14 nt, Human
uacuuguugccuau

SEQ ID NO: 1999124 - RNA, 17 nt, Human
uacuuguugccuauaag

SEQ ID NO: 1999125 - RNA, 13 nt, Human
uacuuguuguuua

SEQ ID NO: 1999126 - RNA, 17 nt, Human
uacuuguuguuuaaugu

SEQ ID NO: 1999127 - RNA, 14 nt, Human
uacuuguggacaca

SEQ ID NO: 1999128 - RNA, 14 nt, Human
uacuugucuuucug

SEQ ID NO: 1999129 - RNA, 13 nt, Human
uacuuguuucuau

SEQ ID NO: 1999130 - RNA, 15 nt, Human
uacuuguuuuuguaa

SEQ ID NO: 1999131 - RNA, 16 nt, Human
uacuuguuuuuguaaa

SEQ ID NO: 1999132 - RNA, 19 nt, Human
uacuuguuuuuguaaagaa

SEQ ID NO: 1999133 - RNA, 15 nt, Human
uagaagucuucauga

SEQ ID NO: 1999134 - RNA, 18 nt, Human
uagaagucuucaugaaau

SEQ ID NO: 1999135 - RNA, 20 nt, Human
uagaagucuucaugaaaugc

SEQ ID NO: 1999136 - RNA, 21 nt, Human
uagaagucuucaugaaaugcu

SEQ ID NO: 1999137 - RNA, 22 nt, Human
uagaagucuucaugaaaugcua

SEQ ID NO: 1999138 - RNA, 24 nt, Human
uagaagucuucaugaaaugcuaug

SEQ ID NO: 1999139 - RNA, 11 nt, Human
uagagacaggg

SEQ ID NO: 1999140 - RNA, 22 nt, Human
uagagaaggacccggaggggcc

SEQ ID NO: 1999141 - RNA, 13 nt, Human
uagagaaggaccc

SEQ ID NO: 1999142 - RNA, 10 nt, Human
uagacuugaa

SEQ ID NO: 1999143 - RNA, 12 nt, Human
uagacuugaaaa

SEQ ID NO: 1999144 - RNA, 15 nt, Human
uagacuucuguuuuc

SEQ ID NO: 1999145 - RNA, 16 nt, Human
uagacuucuguuuuca

SEQ ID NO: 1999146 - RNA, 17 nt, Human
uagacuucuguuuucaa

SEQ ID NO: 1999147 - RNA, 18 nt, Human
uagacuucuguuuucaau

SEQ ID NO: 1999148 - RNA, 14 nt, Human
uagagguucaaaga

SEQ ID NO: 1999149 - RNA, 15 nt, Human
uagagguucaaagau

SEQ ID NO: 1999150 - RNA, 22 nt, Human
uagagacagagcgacagagcag

SEQ ID NO: 1999151 - RNA, 15 nt, Human
uagagguauaauugu

SEQ ID NO: 1999152 - RNA, 16 nt, Human
uagagguauaauugug

SEQ ID NO: 1999153 - RNA, 17 nt, Human
uagagguauaauugugu

SEQ ID NO: 1999154 - RNA, 21 nt, Human
uagagguauaauugugugaua

SEQ ID NO: 1999155 - RNA, 13 nt, Human
uagacuugaaaag

SEQ ID NO: 1999156 - RNA, 12 nt, Human
uagagugggagc

SEQ ID NO: 1999157 - RNA, 15 nt, Human
uagagucugagggcu

SEQ ID NO: 1999158 - RNA, 21 nt, Human
uagagucugagggcuuguagu

SEQ ID NO: 1999159 - RNA, 13 nt, Human
uagaggugcaugc

SEQ ID NO: 1999160 - RNA, 16 nt, Human
uagaggugcaugccua

SEQ ID NO: 1999161 - RNA, 14 nt, Human
uagaguugauacua

SEQ ID NO: 1999162 - RNA, 17 nt, Human
uagaguugauacuacag

SEQ ID NO: 1999163 - RNA, 20 nt, Human
uagacccacuggacucaccu

SEQ ID NO: 1999164 - RNA, 16 nt, Human
uagaauugaagguuuu

SEQ ID NO: 1999165 - RNA, 17 nt, Human
uagaauugaagguuuuu

SEQ ID NO: 1999166 - RNA, 18 nt, Human
uagaauugaagguuuuug

SEQ ID NO: 1999167 - RNA, 14 nt, Human
uagacuacuguuca

SEQ ID NO: 1999168 - RNA, 21 nt, Human
uagacuucagggagucagcug

SEQ ID NO: 1999169 - RNA, 23 nt, Human
uagacuucagggagucagcuguu

SEQ ID NO: 1999170 - RNA, 24 nt, Human
uagacuucagggagucagcuguuu

SEQ ID NO: 1999171 - RNA, 15 nt, Human
uauaaacuuuaccuu

SEQ ID NO: 1999172 - RNA, 16 nt, Human
uauaaacuuuaccuuu

SEQ ID NO: 1999173 - RNA, 17 nt, Human
uauaaacuuuaccuuuu

SEQ ID NO: 1999174 - RNA, 13 nt, Human
uauaaacuuuacc

SEQ ID NO: 1999175 - RNA, 14 nt, Human
uauaaacuuuaccu

SEQ ID NO: 1999176 - RNA, 18 nt, Human
uauaaaccgaacugaugu

SEQ ID NO: 1999177 - RNA, 12 nt, Human
uauaaacagcuu

SEQ ID NO: 1999178 - RNA, 11 nt, Human
uauaaacuuua

SEQ ID NO: 1999179 - RNA, 22 nt, Human
uauaaacaagaaugaagguuuu

SEQ ID NO: 1999180 - RNA, 13 nt, Human
uaguuugaggaaa

SEQ ID NO: 1999181 - RNA, 14 nt, Human
uaguuugaggaaau

SEQ ID NO: 1999182 - RNA, 19 nt, Human
uaguuugaggaaauuugca

SEQ ID NO: 1999183 - RNA, 20 nt, Human
uaguuugaggaaauuugcag

SEQ ID NO: 1999184 - RNA, 15 nt, Human
uauaaaauuuacugu

SEQ ID NO: 1999185 - RNA, 22 nt, Human
uauaaacaugcuugcauuauau

SEQ ID NO: 1999186 - RNA, 13 nt, Human
uauaaacacuguu

SEQ ID NO: 1999187 - RNA, 18 nt, Human
uauaaacagaagugacug

SEQ ID NO: 1999188 - RNA, 12 nt, Human
uauaaacacugu

SEQ ID NO: 1999189 - RNA, 16 nt, Human
uaguuugauuaaauuc

SEQ ID NO: 1999190 - RNA, 21 nt, Human
uaguuugauuaaauucuugca

SEQ ID NO: 1999191 - RNA, 15 nt, Human
uaguuugauuaaauu

SEQ ID NO: 1999192 - RNA, 20 nt, Human
uaguagggguaccacugaau

SEQ ID NO: 1999193 - RNA, 12 nt, Human
uaguucuuuaaa

SEQ ID NO: 1999194 - RNA, 15 nt, Human
uaguucuuuaaacug

SEQ ID NO: 1999195 - RNA, 20 nt, Human
uaguucuuuaaacugucgug

SEQ ID NO: 1999196 - RNA, 13 nt, Human
uaguugaauacuu

SEQ ID NO: 1999197 - RNA, 15 nt, Human
uaguugaauacuuga

SEQ ID NO: 1999198 - RNA, 16 nt, Human
uaguugaauacuugaa

SEQ ID NO: 1999199 - RNA, 17 nt, Human
uaguugaauacuugaac

SEQ ID NO: 1999200 - RNA, 21 nt, Human
uaguucuguauuugaaagugc

SEQ ID NO: 1999201 - RNA, 11 nt, Human
uaguucuguga

SEQ ID NO: 1999202 - RNA, 17 nt, Human
uaguucuguauuugaaa

SEQ ID NO: 1999203 - RNA, 19 nt, Human
uaguucuguauuugaaagu

SEQ ID NO: 1999204 - RNA, 20 nt, Human
uaguuguuugauucagacag

SEQ ID NO: 1999205 - RNA, 21 nt, Human
uaguugaauacuugaaccaua

SEQ ID NO: 1999206 - RNA, 19 nt, Human
uaguugaauacuugaacca

SEQ ID NO: 1999207 - RNA, 20 nt, Human
uaguugaauacuugaaccau

SEQ ID NO: 1999208 - RNA, 22 nt, Human
uaguuguuugauucagacagcu

SEQ ID NO: 1999209 - RNA, 21 nt, Human
uaguuguuugauucagacagc

SEQ ID NO: 1999210 - RNA, 15 nt, Human
uaguaugaggcauuu

SEQ ID NO: 1999211 - RNA, 16 nt, Human
uaguagggguaccacu

SEQ ID NO: 1999212 - RNA, 17 nt, Human
uaguagggguaccacug

SEQ ID NO: 1999213 - RNA, 16 nt, Human
uaguaugguggcuggg

SEQ ID NO: 1999214 - RNA, 20 nt, Human
uaguggcuuaaaacaacacu

SEQ ID NO: 1999215 - RNA, 18 nt, Human
uaguggccaucauuucug

SEQ ID NO: 1999216 - RNA, 19 nt, Human
uaguggccaucauuucugg

SEQ ID NO: 1999217 - RNA, 15 nt, Human
uaguggcauggagaa

SEQ ID NO: 1999218 - RNA, 20 nt, Human
uagcugcauuugucuggccu

SEQ ID NO: 1999219 - RNA, 22 nt, Human
uagcuggucuuauuuguaaagc

SEQ ID NO: 1999220 - RNA, 12 nt, Human
uagcuguaaggc

SEQ ID NO: 1999221 - RNA, 17 nt, Human
uagcuguaaggcaugaa

SEQ ID NO: 1999222 - RNA, 19 nt, Human
uagcuguaaggcaugaagg

SEQ ID NO: 1999223 - RNA, 11 nt, Human
uagggaaaaac

SEQ ID NO: 1999224 - RNA, 17 nt, Human
uaggucugauauucaaa

SEQ ID NO: 1999225 - RNA, 11 nt, Human
uaggugacaga

SEQ ID NO: 1999226 - RNA, 16 nt, Human
uaggugacagagugag

SEQ ID NO: 1999227 - RNA, 17 nt, Human
uaggugugggggaagca

SEQ ID NO: 1999228 - RNA, 13 nt, Human
uagguguggggga

SEQ ID NO: 1999229 - RNA, 22 nt, Human
uagguuauuuugauguaaagau

SEQ ID NO: 1999230 - RNA, 19 nt, Human
uaggugugacugaauuucu

SEQ ID NO: 1999231 - RNA, 21 nt, Human
uaggugugacugaauuucuuu

SEQ ID NO: 1999232 - RNA, 23 nt, Human
uaggugugacugaauuucuuuug

SEQ ID NO: 1999233 - RNA, 14 nt, Human
uaguaggauaugcc

SEQ ID NO: 1999234 - RNA, 21 nt, Human
uaguaggauaugccugcucuu

SEQ ID NO: 1999235 - RNA, 13 nt, Human
uaguaggcaagau

SEQ ID NO: 1999236 - RNA, 17 nt, Human
uaguaugaggcauuugu

SEQ ID NO: 1999237 - RNA, 18 nt, Human
uaguaugaggcauuuguu

SEQ ID NO: 1999238 - RNA, 20 nt, Human
uauacuuguuuuuguaaaga

SEQ ID NO: 1999239 - RNA, 22 nt, Human
uauacuuguuuuuguaaagaaa

SEQ ID NO: 1999240 - RNA, 22 nt, Human
uauagaaagcaagauguacuau

SEQ ID NO: 1999241 - RNA, 11 nt, Human
uauagaaagug

SEQ ID NO: 1999242 - RNA, 18 nt, Human
uauagaaagcaagaugua

SEQ ID NO: 1999243 - RNA, 18 nt, Human
uauagacaggagaagaaa

SEQ ID NO: 1999244 - RNA, 20 nt, Human
uauagacaggagaagaaaga

SEQ ID NO: 1999245 - RNA, 21 nt, Human
uauagacaggagaagaaagaa

SEQ ID NO: 1999246 - RNA, 23 nt, Human
uauagaagucuucaugaaaugcu

SEQ ID NO: 1999247 - RNA, 21 nt, Human
uauagaagucuucaugaaaug

SEQ ID NO: 1999248 - RNA, 22 nt, Human
uauagaagucuucaugaaaugc

SEQ ID NO: 1999249 - RNA, 14 nt, Human
uauagaagucuuca

SEQ ID NO: 1999250 - RNA, 15 nt, Human
uauagaagucuucau

SEQ ID NO: 1999251 - RNA, 16 nt, Human
uauagaagucuucaug

SEQ ID NO: 1999252 - RNA, 19 nt, Human
uauagaagucuucaugaaa

SEQ ID NO: 1999253 - RNA, 12 nt, Human
uauagaaagugu

SEQ ID NO: 1999254 - RNA, 14 nt, Human
uauagaaaguguuc

SEQ ID NO: 1999255 - RNA, 20 nt, Human
uauagaaaguguucuguuac

SEQ ID NO: 1999256 - RNA, 21 nt, Human
uauagaaaguguucuguuaca

SEQ ID NO: 1999257 - RNA, 22 nt, Human
uauagaaaguguucuguuacaa

SEQ ID NO: 1999258 - RNA, 23 nt, Human
uauagaaaguguucuguuacaaa

SEQ ID NO: 1999259 - RNA, 13 nt, Human
uauagaagaaugc

SEQ ID NO: 1999260 - RNA, 18 nt, Human
uauagaagaaugcaugcu

SEQ ID NO: 1999261 - RNA, 20 nt, Human
uauagaagaaugcaugcuuu

SEQ ID NO: 1999262 - RNA, 13 nt, Human
uauagaagucuuc

SEQ ID NO: 1999263 - RNA, 14 nt, Human
uauagugcaauaua

SEQ ID NO: 1999264 - RNA, 15 nt, Human
uauagugcaauauau

SEQ ID NO: 1999265 - RNA, 22 nt, Human
uauaguauuugaaaacagaaau

SEQ ID NO: 1999266 - RNA, 20 nt, Human
uauagagucauuguaauguu

SEQ ID NO: 1999267 - RNA, 15 nt, Human
uauagagcagaaauu

SEQ ID NO: 1999268 - RNA, 17 nt, Human
uauagagcagaaauucu

SEQ ID NO: 1999269 - RNA, 18 nt, Human
uauagagcagaaauucug

SEQ ID NO: 1999270 - RNA, 19 nt, Human
uauagagcagaaauucugu

SEQ ID NO: 1999271 - RNA, 20 nt, Human
uauagagcagaaauucuguu

SEQ ID NO: 1999272 - RNA, 18 nt, Human
uauagagucauuguaaug

SEQ ID NO: 1999273 - RNA, 11 nt, Human
uauaguauuug

SEQ ID NO: 1999274 - RNA, 13 nt, Human
uauaguauuugaa

SEQ ID NO: 1999275 - RNA, 14 nt, Human
uauaguauuugaaa

SEQ ID NO: 1999276 - RNA, 15 nt, Human
uauaguauuugaaaa

SEQ ID NO: 1999277 - RNA, 17 nt, Human
uauaguauuugaaaaca

SEQ ID NO: 1999278 - RNA, 18 nt, Human
uauaguauuugaaaacag

SEQ ID NO: 1999279 - RNA, 20 nt, Human
uauaguauuugaaaacagaa

SEQ ID NO: 1999280 - RNA, 21 nt, Human
uauaucuuggcagguaggaau

SEQ ID NO: 1999281 - RNA, 20 nt, Human
uauauuuguaaauuuaugug

SEQ ID NO: 1999282 - RNA, 23 nt, Human
uauauuuggaugcagaguucagg

SEQ ID NO: 1999283 - RNA, 16 nt, Human
uauauuugauuuauua

SEQ ID NO: 1999284 - RNA, 17 nt, Human
uauauuugauuuauuaa

SEQ ID NO: 1999285 - RNA, 20 nt, Human
uauauuugauuuauuaacuu

SEQ ID NO: 1999286 - RNA, 22 nt, Human
uauauuugauuuauuaacuuaa

SEQ ID NO: 1999287 - RNA, 13 nt, Human
uauauuugauuua

SEQ ID NO: 1999288 - RNA, 14 nt, Human
uauaugaaaacuaa

SEQ ID NO: 1999289 - RNA, 19 nt, Human
uauaugaacauacaaaugc

SEQ ID NO: 1999290 - RNA, 18 nt, Human
uauauuuuauuuuuagaa

SEQ ID NO: 1999291 - RNA, 13 nt, Human
uauauuuguauua

SEQ ID NO: 1999292 - RNA, 22 nt, Human
uauauuuuauuuuuagaauuuu

SEQ ID NO: 1999293 - RNA, 17 nt, Human
uauauuuuguaugcaag

SEQ ID NO: 1999294 - RNA, 21 nt, Human
uauauuuuguaugcaagcagu

SEQ ID NO: 1999295 - RNA, 15 nt, Human
uauauuuuguaugca

SEQ ID NO: 1999296 - RNA, 16 nt, Human
uauauuuuguaugcaa

SEQ ID NO: 1999297 - RNA, 21 nt, Human
uauauuuuuuguuaaaugauu

SEQ ID NO: 1999298 - RNA, 16 nt, Human
uauauuuuuuucugaa

SEQ ID NO: 1999299 - RNA, 19 nt, Human
uauauuuuuuucugaaauu

SEQ ID NO: 1999300 - RNA, 20 nt, Human
uauauuuuuuucugaaauuu

SEQ ID NO: 1999301 - RNA, 19 nt, Human
uaucaaaaagauaucaaag

SEQ ID NO: 1999302 - RNA, 17 nt, Human
uaucaugacaaagacug

SEQ ID NO: 1999303 - RNA, 14 nt, Human
uaucaaaagaaaga

SEQ ID NO: 1999304 - RNA, 19 nt, Human
uaucaggugcugccaucca

SEQ ID NO: 1999305 - RNA, 20 nt, Human
uaucaaacuacuuuuuaaca

SEQ ID NO: 1999306 - RNA, 20 nt, Human
uaucaggugcugccauccag

SEQ ID NO: 1999307 - RNA, 18 nt, Human
uaucaguuuuauagcuuu

SEQ ID NO: 1999308 - RNA, 22 nt, Human
uaagugccaggauggaaugaug

SEQ ID NO: 1999309 - RNA, 14 nt, Human
uaagugcugcauuu

SEQ ID NO: 1999310 - RNA, 23 nt, Human
uaagugaggaugaaaaaauaaca

SEQ ID NO: 1999311 - RNA, 12 nt, Human
uaagugagagag

SEQ ID NO: 1999312 - RNA, 22 nt, Human
uaagugauugcugguuuuaguu

SEQ ID NO: 1999313 - RNA, 13 nt, Human
uaagugaaauuua

SEQ ID NO: 1999314 - RNA, 14 nt, Human
uaagugaaauuuau

SEQ ID NO: 1999315 - RNA, 19 nt, Human
uaagugaggaaaucaaagu

SEQ ID NO: 1999316 - RNA, 21 nt, Human
uaagugaggaaaucaaagugc

SEQ ID NO: 1999317 - RNA, 13 nt, Human
uaagugaaauaag

SEQ ID NO: 1999318 - RNA, 15 nt, Human
uaagugaaaauauag

SEQ ID NO: 1999319 - RNA, 20 nt, Human
uaagucuugccuauauuuuc

SEQ ID NO: 1999320 - RNA, 11 nt, Human
uaagugaaauu

SEQ ID NO: 1999321 - RNA, 12 nt, Human
uaagugaaauuu

SEQ ID NO: 1999322 - RNA, 17 nt, Human
uaagucuugccuauauu

SEQ ID NO: 1999323 - RNA, 15 nt, Human
uaaguccuacuuuua

SEQ ID NO: 1999324 - RNA, 20 nt, Human
uaaguccuacuuuuaaagaa

SEQ ID NO: 1999325 - RNA, 16 nt, Human
uaagucucaagguagg

SEQ ID NO: 1999326 - RNA, 14 nt, Human
uaagucucuuuuuu

SEQ ID NO: 1999327 - RNA, 17 nt, Human
uaagucucuuuuuuaca

SEQ ID NO: 1999328 - RNA, 18 nt, Human
uaagucucuuuuuuacaa

SEQ ID NO: 1999329 - RNA, 19 nt, Human
uaagucucuuuuuuacaaa

SEQ ID NO: 1999330 - RNA, 20 nt, Human
uaagucucuuuuuuacaaag

SEQ ID NO: 1999331 - RNA, 21 nt, Human
uaagucucuuuuuuacaaagg

SEQ ID NO: 1999332 - RNA, 15 nt, Human
uaagugcugcauuua

SEQ ID NO: 1999333 - RNA, 16 nt, Human
uaagugcugcauuuaa

SEQ ID NO: 1999334 - RNA, 18 nt, Human
uaagugcugcauuuaaaa

SEQ ID NO: 1999335 - RNA, 22 nt, Human
uaagugcugcauuuaaaagaua

SEQ ID NO: 1999336 - RNA, 18 nt, Human
uaagugguuuuaauaaaa

SEQ ID NO: 1999337 - RNA, 16 nt, Human
uaagugguguguguau

SEQ ID NO: 1999338 - RNA, 15 nt, Human
uaaguggugugugua

SEQ ID NO: 1999339 - RNA, 12 nt, Human
uaauaaauaguu

SEQ ID NO: 1999340 - RNA, 15 nt, Human
uaauaaauaguucuu

SEQ ID NO: 1999341 - RNA, 12 nt, Human
uaauaaagcugu

SEQ ID NO: 1999342 - RNA, 23 nt, Human
uaauaagcuaguugaauacuuga

SEQ ID NO: 1999343 - RNA, 12 nt, Human
uaauaagcuagu

SEQ ID NO: 1999344 - RNA, 16 nt, Human
uaauaagcuaguugaa

SEQ ID NO: 1999345 - RNA, 17 nt, Human
uaauaagcuaguugaau

SEQ ID NO: 1999346 - RNA, 20 nt, Human
uaauaagcuaguugaauacu

SEQ ID NO: 1999347 - RNA, 21 nt, Human
uaauaagcuaguugaauacuu

SEQ ID NO: 1999348 - RNA, 18 nt, Human
uaagccucaaauuugaac

SEQ ID NO: 1999349 - RNA, 19 nt, Human
uaagccucaaauuugaaca

SEQ ID NO: 1999350 - RNA, 17 nt, Human
uaagccaugagaauguu

SEQ ID NO: 1999351 - RNA, 20 nt, Human
uaagcggcucaagcccagga

SEQ ID NO: 1999352 - RNA, 15 nt, Human
uaagcguauggcuuu

SEQ ID NO: 1999353 - RNA, 16 nt, Human
uaagcguauggcuuua

SEQ ID NO: 1999354 - RNA, 22 nt, Human
uaagcguauggcuuuauuuuuu

SEQ ID NO: 1999355 - RNA, 19 nt, Human
uaagccauucugacucaua

SEQ ID NO: 1999356 - RNA, 20 nt, Human
uaagccauucugacucauau

SEQ ID NO: 1999357 - RNA, 12 nt, Human
uaagaggcaggg

SEQ ID NO: 1999358 - RNA, 15 nt, Human
uaagaggcagggucu

SEQ ID NO: 1999359 - RNA, 15 nt, Human
uaagggaaaaaucaa

SEQ ID NO: 1999360 - RNA, 20 nt, Human
uaagggaaaaaucaaguauu

SEQ ID NO: 1999361 - RNA, 17 nt, Human
uaagggaacaaguugag

SEQ ID NO: 1999362 - RNA, 23 nt, Human
uaagggaacaaguugagcuauga

SEQ ID NO: 1999363 - RNA, 14 nt, Human
uaaggcaaucaugg

SEQ ID NO: 1999364 - RNA, 16 nt, Human
uaaggauguucuagca

SEQ ID NO: 1999365 - RNA, 13 nt, Human
uaagcuaggaaaa

SEQ ID NO: 1999366 - RNA, 17 nt, Human
uaagcuaggaaaagaaa

SEQ ID NO: 1999367 - RNA, 20 nt, Human
uaagcuaggaaaagaaaucu

SEQ ID NO: 1999368 - RNA, 22 nt, Human
uaagcuaggaaaagaaaucuau

SEQ ID NO: 1999369 - RNA, 16 nt, Human
uaagcuaguugaauac

SEQ ID NO: 1999370 - RNA, 18 nt, Human
uaagcuaguugaauacuu

SEQ ID NO: 1999371 - RNA, 19 nt, Human
uaagcuaguugaauacuug

SEQ ID NO: 1999372 - RNA, 20 nt, Human
uaagcuaguugaauacuuga

SEQ ID NO: 1999373 - RNA, 14 nt, Human
uaagcuauucagua

SEQ ID NO: 1999374 - RNA, 21 nt, Human
uaagcuaguugaauacuugaa

SEQ ID NO: 1999375 - RNA, 22 nt, Human
uaagcuaguugaauacuugaac

SEQ ID NO: 1999376 - RNA, 22 nt, Human
uaagggacugauguuugugcag

SEQ ID NO: 1999377 - RNA, 18 nt, Human
uaaggggaauuaacaauu

SEQ ID NO: 1999378 - RNA, 22 nt, Human
uaaggggaauuaacaauugcca

SEQ ID NO: 1999379 - RNA, 15 nt, Human
uaagggacugauguu

SEQ ID NO: 1999380 - RNA, 16 nt, Human
uaagggacugauguuu

SEQ ID NO: 1999381 - RNA, 17 nt, Human
uaagggacugauguuug

SEQ ID NO: 1999382 - RNA, 18 nt, Human
uaagggacugauguuugu

SEQ ID NO: 1999383 - RNA, 13 nt, Human
uaaggucuguuug

SEQ ID NO: 1999384 - RNA, 20 nt, Human
uaagguauaucauucuaaag

SEQ ID NO: 1999385 - RNA, 21 nt, Human
uaagguauaucauucuaaaga

SEQ ID NO: 1999386 - RNA, 22 nt, Human
uaagguauaucauucuaaagau

SEQ ID NO: 1999387 - RNA, 17 nt, Human
uaaggucagcucagagc

SEQ ID NO: 1999388 - RNA, 17 nt, Human
uaaggguaucuggugac

SEQ ID NO: 1999389 - RNA, 24 nt, Human
uaagggucauauguuugcuuguau

SEQ ID NO: 1999390 - RNA, 18 nt, Human
uaaggucuguuugcuguu

SEQ ID NO: 1999391 - RNA, 19 nt, Human
uaaggucuguuugcuguug

SEQ ID NO: 1999392 - RNA, 22 nt, Human
uaaggucuguuugcuguugcug

SEQ ID NO: 1999393 - RNA, 20 nt, Human
uaagguggguacgggagggu

SEQ ID NO: 1999394 - RNA, 15 nt, Human
uaaggugugcucuga

SEQ ID NO: 1999395 - RNA, 12 nt, Human
uaagguguuuga

SEQ ID NO: 1999396 - RNA, 20 nt, Human
uaaguauuuuccuguuguca

SEQ ID NO: 1999397 - RNA, 21 nt, Human
uaaguauuuuccuguugucaa

SEQ ID NO: 1999398 - RNA, 13 nt, Human
uaaguauuuggaa

SEQ ID NO: 1999399 - RNA, 15 nt, Human
uaagguguuugaaaa

SEQ ID NO: 1999400 - RNA, 16 nt, Human
uaagguguuugaaaau

SEQ ID NO: 1999401 - RNA, 17 nt, Human
uaagguguuugaaaaua

SEQ ID NO: 1999402 - RNA, 18 nt, Human
uaagguguuugaaaauag

SEQ ID NO: 1999403 - RNA, 20 nt, Human
uaagguguuugaaaauaguu

SEQ ID NO: 1999404 - RNA, 21 nt, Human
uaagguguuugaaaauaguuu

SEQ ID NO: 1999405 - RNA, 14 nt, Human
uaaguauuuggaau

SEQ ID NO: 1999406 - RNA, 23 nt, Human
uaagucagaaacuaaaacaaaua

SEQ ID NO: 1999407 - RNA, 20 nt, Human
uaauccucuaggaggucucu

SEQ ID NO: 1999408 - RNA, 12 nt, Human
uaaucuaaaugg

SEQ ID NO: 1999409 - RNA, 13 nt, Human
uaaucuaaaugga

SEQ ID NO: 1999410 - RNA, 20 nt, Human
uaauauuaaggaagacaaug

SEQ ID NO: 1999411 - RNA, 17 nt, Human
uaaucuggacuccucug

SEQ ID NO: 1999412 - RNA, 18 nt, Human
uaaucuggacuccucugu

SEQ ID NO: 1999413 - RNA, 15 nt, Human
uaaucuggacuccuc

SEQ ID NO: 1999414 - RNA, 14 nt, Human
uaaucuacugcauu

SEQ ID NO: 1999415 - RNA, 16 nt, Human
uaaucuacugcauuua

SEQ ID NO: 1999416 - RNA, 19 nt, Human
uaaucuggacuccucuguc

SEQ ID NO: 1999417 - RNA, 20 nt, Human
uaaucuggacuccucugucc

SEQ ID NO: 1999418 - RNA, 21 nt, Human
uaaucuggacuccucugucca

SEQ ID NO: 1999419 - RNA, 22 nt, Human
uaaucuggacuccucuguccag

SEQ ID NO: 1999420 - RNA, 18 nt, Human
uaaucugggccagaauuu

SEQ ID NO: 1999421 - RNA, 23 nt, Human
uaaucugggccagaauuucaaac

SEQ ID NO: 1999422 - RNA, 19 nt, Human
uaauaaucaagagccuuaa

SEQ ID NO: 1999423 - RNA, 20 nt, Human
uaauaaucaagagccuuaaa

SEQ ID NO: 1999424 - RNA, 22 nt, Human
uaauaaucaagagccuuaaaac

SEQ ID NO: 1999425 - RNA, 16 nt, Human
uaauaauccugcaaag

SEQ ID NO: 1999426 - RNA, 23 nt, Human
uaauaaucauuggauucugagag

SEQ ID NO: 1999427 - RNA, 12 nt, Human
uaauaaucaaga

SEQ ID NO: 1999428 - RNA, 14 nt, Human
uaauaaucaagagc

SEQ ID NO: 1999429 - RNA, 16 nt, Human
uaauaucuucauuucu

SEQ ID NO: 1999430 - RNA, 14 nt, Human
uaauaugaaauuuu

SEQ ID NO: 1999431 - RNA, 15 nt, Human
uaauaugcacacauu

SEQ ID NO: 1999432 - RNA, 16 nt, Human
uaauaugcacacauuu

SEQ ID NO: 1999433 - RNA, 17 nt, Human
uaauaugcacacauuuu

SEQ ID NO: 1999434 - RNA, 18 nt, Human
uaauaugcacacauuuuu

SEQ ID NO: 1999435 - RNA, 19 nt, Human
uaauaugcacacauuuuuu

SEQ ID NO: 1999436 - RNA, 15 nt, Human
uaaugcgugcauacc

SEQ ID NO: 1999437 - RNA, 19 nt, Human
uaaugcgugcauaccacuu

SEQ ID NO: 1999438 - RNA, 22 nt, Human
uaaugcgugcauaccacuuuug

SEQ ID NO: 1999439 - RNA, 23 nt, Human
uaaugcgugcauaccacuuuugu

SEQ ID NO: 1999440 - RNA, 17 nt, Human
uaaugcuaaucuuguga

SEQ ID NO: 1999441 - RNA, 22 nt, Human
uaaugcuaaucuugugaaaaua

SEQ ID NO: 1999442 - RNA, 11 nt, Human
uaaugcuuugg

SEQ ID NO: 1999443 - RNA, 16 nt, Human
uaaugcuuugguucug

SEQ ID NO: 1999444 - RNA, 15 nt, Human
uaauggggcggugag

SEQ ID NO: 1999445 - RNA, 13 nt, Human
uaauggaugaaau

SEQ ID NO: 1999446 - RNA, 15 nt, Human
uaauggaugaaauca

SEQ ID NO: 1999447 - RNA, 16 nt, Human
uaauggaugaaaucau

SEQ ID NO: 1999448 - RNA, 17 nt, Human
uaauggaugaaaucaua

SEQ ID NO: 1999449 - RNA, 20 nt, Human
uaauuaaguacuauguauca

SEQ ID NO: 1999450 - RNA, 17 nt, Human
uaauuaaguacuaugua

SEQ ID NO: 1999451 - RNA, 14 nt, Human
uaauuaaguacuau

SEQ ID NO: 1999452 - RNA, 16 nt, Human
uaaugguaguuuuaca

SEQ ID NO: 1999453 - RNA, 13 nt, Human
uaauguugaacaa

SEQ ID NO: 1999454 - RNA, 16 nt, Human
uaauguugaacaaaau

SEQ ID NO: 1999455 - RNA, 17 nt, Human
uaauguugaacaaaaua

SEQ ID NO: 1999456 - RNA, 18 nt, Human
uaauguugugaauaauua

SEQ ID NO: 1999457 - RNA, 19 nt, Human
uaauguugugaauaauuac

SEQ ID NO: 1999458 - RNA, 21 nt, Human
uaauguugugaauaauuacag

SEQ ID NO: 1999459 - RNA, 23 nt, Human
uaauguugugaauaauuacagug

SEQ ID NO: 1999460 - RNA, 13 nt, Human
uaauguugugaau

SEQ ID NO: 1999461 - RNA, 14 nt, Human
uaauguugugaaua

SEQ ID NO: 1999462 - RNA, 16 nt, Human
uaauguugugaauaau

SEQ ID NO: 1999463 - RNA, 17 nt, Human
uaauguugauuucuagu

SEQ ID NO: 1999464 - RNA, 18 nt, Human
uaauguugauuucuaguu

SEQ ID NO: 1999465 - RNA, 18 nt, Human
uaauguugaacaaaauaa

SEQ ID NO: 1999466 - RNA, 22 nt, Human
uaauguugaacaaaauaaauug

SEQ ID NO: 1999467 - RNA, 13 nt, Human
uaauguugauuuc

SEQ ID NO: 1999468 - RNA, 14 nt, Human
uaauguugauuucu

SEQ ID NO: 1999469 - RNA, 24 nt, Human
uaagaaagacuaucuaaauguuga

SEQ ID NO: 1999470 - RNA, 21 nt, Human
uaagaaacauuggaagcaggu

SEQ ID NO: 1999471 - RNA, 12 nt, Human
uaagaaacauug

SEQ ID NO: 1999472 - RNA, 13 nt, Human
uaagaaacauugg

SEQ ID NO: 1999473 - RNA, 15 nt, Human
uaagaaacauuggaa

SEQ ID NO: 1999474 - RNA, 16 nt, Human
uaagaaacauuggaag

SEQ ID NO: 1999475 - RNA, 19 nt, Human
uaagaggaaaguacauuuu

SEQ ID NO: 1999476 - RNA, 21 nt, Human
uaagagcuuccaauuuuccuu

SEQ ID NO: 1999477 - RNA, 15 nt, Human
uaagaggaaaguaca

SEQ ID NO: 1999478 - RNA, 18 nt, Human
uaagaggaaaguacauuu

SEQ ID NO: 1999479 - RNA, 15 nt, Human
uaagaacaccugcau

SEQ ID NO: 1999480 - RNA, 19 nt, Human
uaagaaccuuuugagugcc

SEQ ID NO: 1999481 - RNA, 17 nt, Human
uaagaacaaaagaagca

SEQ ID NO: 1999482 - RNA, 18 nt, Human
uaagaacaaaagcgaccc

SEQ ID NO: 1999483 - RNA, 16 nt, Human
uaagaaaaaggaugca

SEQ ID NO: 1999484 - RNA, 18 nt, Human
uaagaaaaaggaugcaca

SEQ ID NO: 1999485 - RNA, 19 nt, Human
uaagaaaaaggaugcacag

SEQ ID NO: 1999486 - RNA, 23 nt, Human
uaagaaaaaggaugcacagaguu

SEQ ID NO: 1999487 - RNA, 19 nt, Human
uaagaaaaagcaaaaggca

SEQ ID NO: 1999488 - RNA, 16 nt, Human
uaagaaaagauguaga

SEQ ID NO: 1999489 - RNA, 14 nt, Human
uaacuguuaccauu

SEQ ID NO: 1999490 - RNA, 15 nt, Human
uaacuguuaccauug

SEQ ID NO: 1999491 - RNA, 18 nt, Human
uaacuguuaccauuggaa

SEQ ID NO: 1999492 - RNA, 19 nt, Human
uaacuguuaccauuggaaa

SEQ ID NO: 1999493 - RNA, 18 nt, Human
uaacugugccaguucuuu

SEQ ID NO: 1999494 - RNA, 13 nt, Human
uaacugugguguu

SEQ ID NO: 1999495 - RNA, 11 nt, Human
uaacuguuacc

SEQ ID NO: 1999496 - RNA, 13 nt, Human
uaacuguuaccau

SEQ ID NO: 1999497 - RNA, 23 nt, Human
uaacugcucuugggcaauauucu

SEQ ID NO: 1999498 - RNA, 13 nt, Human
uaacccagaaaau

SEQ ID NO: 1999499 - RNA, 16 nt, Human
uaaccagacacaaacu

SEQ ID NO: 1999500 - RNA, 23 nt, Human
uaaccaguguuguggauuuaaca

SEQ ID NO: 1999501 - RNA, 16 nt, Human
uaaccacuucagcuga

SEQ ID NO: 1999502 - RNA, 13 nt, Human
uaaccagaucauu

SEQ ID NO: 1999503 - RNA, 15 nt, Human
uaacauucuauuuca

SEQ ID NO: 1999504 - RNA, 19 nt, Human
uaacauucuauuucaacuu

SEQ ID NO: 1999505 - RNA, 11 nt, Human
uaacagaaaug

SEQ ID NO: 1999506 - RNA, 15 nt, Human
uaacacugugaagag

SEQ ID NO: 1999507 - RNA, 16 nt, Human
uaacacugugaagagc

SEQ ID NO: 1999508 - RNA, 21 nt, Human
uaacuccuaguagggguacca

SEQ ID NO: 1999509 - RNA, 16 nt, Human
uaacuauguugauaaa

SEQ ID NO: 1999510 - RNA, 15 nt, Human
uaacuauguuuaaag

SEQ ID NO: 1999511 - RNA, 16 nt, Human
uaacccagaaaaucug

SEQ ID NO: 1999512 - RNA, 16 nt, Human
uaacugaaauaaaaaa

SEQ ID NO: 1999513 - RNA, 11 nt, Human
uaacugcucuu

SEQ ID NO: 1999514 - RNA, 12 nt, Human
uaacugcucuug

SEQ ID NO: 1999515 - RNA, 15 nt, Human
uaacugcucuugggc

SEQ ID NO: 1999516 - RNA, 16 nt, Human
uaacugcucuugggca

SEQ ID NO: 1999517 - RNA, 19 nt, Human
uaacugcucuugggcaaua

SEQ ID NO: 1999518 - RNA, 17 nt, Human
uaaaugcccagccccuu

SEQ ID NO: 1999519 - RNA, 16 nt, Human
uaaaugcccagccccu

SEQ ID NO: 1999520 - RNA, 15 nt, Human
uaaaugcccagcccc

SEQ ID NO: 1999521 - RNA, 14 nt, Human
uaaaugcccagccc

SEQ ID NO: 1999522 - RNA, 16 nt, Human
uaaauggaaccacucu

SEQ ID NO: 1999523 - RNA, 13 nt, Human
uaaaugcccagcc

SEQ ID NO: 1999524 - RNA, 13 nt, Human
uaaaguuguacuu

SEQ ID NO: 1999525 - RNA, 16 nt, Human
uaaaguuguacuuuaa

SEQ ID NO: 1999526 - RNA, 22 nt, Human
uaaaguuguacuuuaaaaauuu

SEQ ID NO: 1999527 - RNA, 12 nt, Human
uaaaguuucaaa

SEQ ID NO: 1999528 - RNA, 13 nt, Human
uaaaguuucaaaa

SEQ ID NO: 1999529 - RNA, 17 nt, Human
uaaaguuucaaaaaucu

SEQ ID NO: 1999530 - RNA, 18 nt, Human
uaaaguuucaaaaaucug

SEQ ID NO: 1999531 - RNA, 19 nt, Human
uaaaguuucaaaaaucuga

SEQ ID NO: 1999532 - RNA, 20 nt, Human
uaaaguuucaaaaaucugaa

SEQ ID NO: 1999533 - RNA, 16 nt, Human
uaaaguugguaaaccu

SEQ ID NO: 1999534 - RNA, 17 nt, Human
uaaaguugguaaaccuu

SEQ ID NO: 1999535 - RNA, 12 nt, Human
uaaaguuguacu

SEQ ID NO: 1999536 - RNA, 18 nt, Human
uaaaugggggugcauuug

SEQ ID NO: 1999537 - RNA, 19 nt, Human
uaaaugggggugcauuuga

SEQ ID NO: 1999538 - RNA, 14 nt, Human
uaaaugggggugca

SEQ ID NO: 1999539 - RNA, 17 nt, Human
uaaaugggggugcauuu

SEQ ID NO: 1999540 - RNA, 18 nt, Human
uaaauguaguucauacuu

SEQ ID NO: 1999541 - RNA, 17 nt, Human
uaaaugucaaaugugaa

SEQ ID NO: 1999542 - RNA, 20 nt, Human
uaaaugucuaguuguaacac

SEQ ID NO: 1999543 - RNA, 22 nt, Human
uaaaugucucuuuaaugucaca

SEQ ID NO: 1999544 - RNA, 17 nt, Human
uaaauucuugcaaagua

SEQ ID NO: 1999545 - RNA, 18 nt, Human
uaaauucuugcaaaguau

SEQ ID NO: 1999546 - RNA, 22 nt, Human
uaaauucuugcaaaguaucccu

SEQ ID NO: 1999547 - RNA, 11 nt, Human
uaaauucugau

SEQ ID NO: 1999548 - RNA, 12 nt, Human
uaaauucugauu

SEQ ID NO: 1999549 - RNA, 13 nt, Human
uaaauucugauuu

SEQ ID NO: 1999550 - RNA, 14 nt, Human
uaaauucugauuuc

SEQ ID NO: 1999551 - RNA, 15 nt, Human
uaaauucugauuucu

SEQ ID NO: 1999552 - RNA, 16 nt, Human
uaaauucugauuucuu

SEQ ID NO: 1999553 - RNA, 20 nt, Human
uaaauucugauuucuuuuca

SEQ ID NO: 1999554 - RNA, 16 nt, Human
uaaauucuugcaaagu

SEQ ID NO: 1999555 - RNA, 15 nt, Human
uaaauucaaaccuaa

SEQ ID NO: 1999556 - RNA, 11 nt, Human
uaaauuauuuu

SEQ ID NO: 1999557 - RNA, 22 nt, Human
uaaaugugaauuacuaacuucu

SEQ ID NO: 1999558 - RNA, 11 nt, Human
uaaaugugaau

SEQ ID NO: 1999559 - RNA, 13 nt, Human
uaaaugugaauua

SEQ ID NO: 1999560 - RNA, 15 nt, Human
uaaaugugaauuacu

SEQ ID NO: 1999561 - RNA, 14 nt, Human
uaaauuuauuuacu

SEQ ID NO: 1999562 - RNA, 15 nt, Human
uaaauuuauuuacug

SEQ ID NO: 1999563 - RNA, 18 nt, Human
uaaauuuauuuacugcua

SEQ ID NO: 1999564 - RNA, 13 nt, Human
uaaauucuuucau

SEQ ID NO: 1999565 - RNA, 20 nt, Human
uaaauugacacuuaaaaaug

SEQ ID NO: 1999566 - RNA, 13 nt, Human
uaaauuuauguga

SEQ ID NO: 1999567 - RNA, 22 nt, Human
uaaauuuaguauuuuguuucag

SEQ ID NO: 1999568 - RNA, 23 nt, Human
uaaauugacacuuaaaaaugguu

SEQ ID NO: 1999569 - RNA, 18 nt, Human
uaacaccaugauuaacca

SEQ ID NO: 1999570 - RNA, 14 nt, Human
uaacacuacucaaa

SEQ ID NO: 1999571 - RNA, 19 nt, Human
uaacacuacucaaagcaaa

SEQ ID NO: 1999572 - RNA, 16 nt, Human
uaaaccaaaaacugaa

SEQ ID NO: 1999573 - RNA, 17 nt, Human
uaaacugucgugucaua

SEQ ID NO: 1999574 - RNA, 22 nt, Human
uaaacuugguuuuuaaaaaacu

SEQ ID NO: 1999575 - RNA, 14 nt, Human
uaaagaaaaauauu

SEQ ID NO: 1999576 - RNA, 15 nt, Human
uaaagaaaaauauuu

SEQ ID NO: 1999577 - RNA, 17 nt, Human
uaaagaaaaauauuuaa

SEQ ID NO: 1999578 - RNA, 20 nt, Human
uaaagaaaaauauuuaaugu

SEQ ID NO: 1999579 - RNA, 22 nt, Human
uaaagaaaaaaaugucaaaagu

SEQ ID NO: 1999580 - RNA, 14 nt, Human
uaaagaaaaaaaug

SEQ ID NO: 1999581 - RNA, 16 nt, Human
uaaagaaaaaaauguc

SEQ ID NO: 1999582 - RNA, 17 nt, Human
uaaagaaaaaaauguca

SEQ ID NO: 1999583 - RNA, 20 nt, Human
uaaagaaaaaaaugucaaaa

SEQ ID NO: 1999584 - RNA, 21 nt, Human
uaaacaagaccacguuucuaa

SEQ ID NO: 1999585 - RNA, 22 nt, Human
uaaacaagaccacguuucuaaa

SEQ ID NO: 1999586 - RNA, 20 nt, Human
uaaacaagaccacguuucua

SEQ ID NO: 1999587 - RNA, 19 nt, Human
uaaacaagaccacguuucu

SEQ ID NO: 1999588 - RNA, 16 nt, Human
uaaaaucuugaaaaug

SEQ ID NO: 1999589 - RNA, 23 nt, Human
uaaaaucuuauuaaaguuucaaa

SEQ ID NO: 1999590 - RNA, 14 nt, Human
uaaaaucuuauuaa

SEQ ID NO: 1999591 - RNA, 15 nt, Human
uaaaaucuuauuaaa

SEQ ID NO: 1999592 - RNA, 17 nt, Human
uaaaaucuuauuaaagu

SEQ ID NO: 1999593 - RNA, 18 nt, Human
uaaaaucuuauuaaaguu

SEQ ID NO: 1999594 - RNA, 19 nt, Human
uaaaaucuuauuaaaguuu

SEQ ID NO: 1999595 - RNA, 21 nt, Human
uaaaaucuuauuaaaguuuca

SEQ ID NO: 1999596 - RNA, 22 nt, Human
uaaaaucuuauuaaaguuucaa

SEQ ID NO: 1999597 - RNA, 21 nt, Human
uaaaaucauaaguauuuggaa

SEQ ID NO: 1999598 - RNA, 17 nt, Human
uaaacacucuugaaaaa

SEQ ID NO: 1999599 - RNA, 15 nt, Human
uaaacacucuugaaa

SEQ ID NO: 1999600 - RNA, 21 nt, Human
uaaacaucagguuaggcagua

SEQ ID NO: 1999601 - RNA, 19 nt, Human
uaaacaucagguuaggcag

SEQ ID NO: 1999602 - RNA, 20 nt, Human
uaaacaucagguuaggcagu

SEQ ID NO: 1999603 - RNA, 18 nt, Human
uaaacacucuugaaaaau

SEQ ID NO: 1999604 - RNA, 16 nt, Human
uaaacaucagguuagg

SEQ ID NO: 1999605 - RNA, 17 nt, Human
uaaacaucagguuaggc

SEQ ID NO: 1999606 - RNA, 17 nt, Human
uaaaggcuaccuuugua

SEQ ID NO: 1999607 - RNA, 20 nt, Human
uaaaggccucugccucacaa

SEQ ID NO: 1999608 - RNA, 23 nt, Human
uaaaggccucugccucacaacau

SEQ ID NO: 1999609 - RNA, 14 nt, Human
uaaaguguuugaaa

SEQ ID NO: 1999610 - RNA, 21 nt, Human
uaaaggcccuaucuguuuaca

SEQ ID NO: 1999611 - RNA, 15 nt, Human
uaaaggccucugccu

SEQ ID NO: 1999612 - RNA, 15 nt, Human
uaaaggcuaccuuug

SEQ ID NO: 1999613 - RNA, 23 nt, Human
uaaaggaaucuagccagugaaca

SEQ ID NO: 1999614 - RNA, 15 nt, Human
uaaaggcagcuguug

SEQ ID NO: 1999615 - RNA, 20 nt, Human
uaaaggcagcuguugucucu

SEQ ID NO: 1999616 - RNA, 21 nt, Human
uaaaggcagcuguugucucuu

SEQ ID NO: 1999617 - RNA, 20 nt, Human
uaaagccugaguuugcuuuc

SEQ ID NO: 1999618 - RNA, 14 nt, Human
uaaagcugaaaacu

SEQ ID NO: 1999619 - RNA, 12 nt, Human
uaaagaaaacug

SEQ ID NO: 1999620 - RNA, 21 nt, Human
uaaagaaaaauauuuaauguu

SEQ ID NO: 1999621 - RNA, 22 nt, Human
uaaagaaaaauauuuaauguug

SEQ ID NO: 1999622 - RNA, 14 nt, Human
uaaagaaacauggu

SEQ ID NO: 1999623 - RNA, 19 nt, Human
uaaagcaagcucacuugcu

SEQ ID NO: 1999624 - RNA, 21 nt, Human
uaaagcaagcucacuugcuuu

SEQ ID NO: 1999625 - RNA, 16 nt, Human
uaaagcagcguuucua

SEQ ID NO: 1999626 - RNA, 17 nt, Human
uaaagcagcguuucuau

SEQ ID NO: 1999627 - RNA, 19 nt, Human
uaaagcagcguuucuauga

SEQ ID NO: 1999628 - RNA, 18 nt, Human
uaaagcaggcagaacuca

SEQ ID NO: 1999629 - RNA, 11 nt, Human
uaaagccucaa

SEQ ID NO: 1999630 - RNA, 17 nt, Human
uaaaaacaaagaaauua

SEQ ID NO: 1999631 - RNA, 21 nt, Human
uaaaaacaaagaaauuaugug

SEQ ID NO: 1999632 - RNA, 19 nt, Human
guuuuguuuccuuucacug

SEQ ID NO: 1999633 - RNA, 21 nt, Human
guuuuuaaggguuuguggaaa

SEQ ID NO: 1999634 - RNA, 17 nt, Human
guuuuuaaguuugcacu

SEQ ID NO: 1999635 - RNA, 18 nt, Human
uaaaaaugguuuaaaugg

SEQ ID NO: 1999636 - RNA, 19 nt, Human
uaaaaaugguuuaaauggu

SEQ ID NO: 1999637 - RNA, 12 nt, Human
uaaaaagcccaa

SEQ ID NO: 1999638 - RNA, 16 nt, Human
uaaaaagcccaaccuc

SEQ ID NO: 1999639 - RNA, 20 nt, Human
uaaaaagcccaaccucuucc

SEQ ID NO: 1999640 - RNA, 20 nt, Human
uaaaaacagauuuggaaaga

SEQ ID NO: 1999641 - RNA, 22 nt, Human
uaaaaacagauuuggaaagacu

SEQ ID NO: 1999642 - RNA, 22 nt, Human
uaaaaagauaaaaaaacagcuu

SEQ ID NO: 1999643 - RNA, 15 nt, Human
uaaaacaacacucac

SEQ ID NO: 1999644 - RNA, 22 nt, Human
uaaaacaagcacuaaacaaaga

SEQ ID NO: 1999645 - RNA, 15 nt, Human
uaaaaauuuacuaca

SEQ ID NO: 1999646 - RNA, 19 nt, Human
uaaaaauuuacuacaauau

SEQ ID NO: 1999647 - RNA, 18 nt, Human
uaaaaauuagccuaagau

SEQ ID NO: 1999648 - RNA, 14 nt, Human
uaaaaauuccagaa

SEQ ID NO: 1999649 - RNA, 16 nt, Human
uaaaaauuccagaaug

SEQ ID NO: 1999650 - RNA, 19 nt, Human
uaaaaauuccagaaugaag

SEQ ID NO: 1999651 - RNA, 19 nt, Human
uaaaacagaguaaucuugu

SEQ ID NO: 1999652 - RNA, 17 nt, Human
uaaaacagaguaaucuu

SEQ ID NO: 1999653 - RNA, 19 nt, Human
uaaaacacuucauugaaaa

SEQ ID NO: 1999654 - RNA, 19 nt, Human
uaaaacacuuccauaaucu

SEQ ID NO: 1999655 - RNA, 23 nt, Human
uaaaacacaacaucuuuuucuac

SEQ ID NO: 1999656 - RNA, 22 nt, Human
uaaaacacaacaucuuuuucua

SEQ ID NO: 1999657 - RNA, 17 nt, Human
uaaaacacaacaucuuu

SEQ ID NO: 1999658 - RNA, 12 nt, Human
uaaaaggugacc

SEQ ID NO: 1999659 - RNA, 19 nt, Human
uaaaaggugaccaaugaug

SEQ ID NO: 1999660 - RNA, 16 nt, Human
uaaaaucauaaguauu

SEQ ID NO: 1999661 - RNA, 11 nt, Human
uaaaagcacac

SEQ ID NO: 1999662 - RNA, 19 nt, Human
uaaaagcacaaaggaauga

SEQ ID NO: 1999663 - RNA, 18 nt, Human
uaaaagcagcauaaagaa

SEQ ID NO: 1999664 - RNA, 21 nt, Human
uaaaagcagcauaaagaauuu

SEQ ID NO: 1999665 - RNA, 12 nt, Human
uaaaaggagcca

SEQ ID NO: 1999666 - RNA, 21 nt, Human
uaaaagguaugcaaucaaauc

SEQ ID NO: 1999667 - RNA, 15 nt, Human
uaaaacaucauuccu

SEQ ID NO: 1999668 - RNA, 12 nt, Human
uaaaacauuaaa

SEQ ID NO: 1999669 - RNA, 16 nt, Human
uaaaacaucauuccuu

SEQ ID NO: 1999670 - RNA, 17 nt, Human
uaaaacaucauuccuuu

SEQ ID NO: 1999671 - RNA, 20 nt, Human
uaaaacaucauuccuuuuua

SEQ ID NO: 1999672 - RNA, 15 nt, Human
uaaaacauuaaaaua

SEQ ID NO: 1999673 - RNA, 16 nt, Human
uaaaacauuaaaauau

SEQ ID NO: 1999674 - RNA, 19 nt, Human
uaaaacauuaaaauauaau

SEQ ID NO: 1999675 - RNA, 17 nt, Human
uaaaagauaaauauuau

SEQ ID NO: 1999676 - RNA, 14 nt, Human
uaaaagauacaguu

SEQ ID NO: 1999677 - RNA, 17 nt, Human
uaaaagauacaguuacu

SEQ ID NO: 1999678 - RNA, 20 nt, Human
uaaaagauacaguuacucag

SEQ ID NO: 1999679 - RNA, 21 nt, Human
uaaaagauacaguuacucaga

SEQ ID NO: 1999680 - RNA, 15 nt, Human
guuucauccuuccca

SEQ ID NO: 1999681 - RNA, 17 nt, Human
guuucauccuucccacu

SEQ ID NO: 1999682 - RNA, 14 nt, Human
guuucauccuuccc

SEQ ID NO: 1999683 - RNA, 22 nt, Human
guuucauauucaugcaaguauu

SEQ ID NO: 1999684 - RNA, 17 nt, Human
guuuaucuagauguaaa

SEQ ID NO: 1999685 - RNA, 18 nt, Human
guuuaucuagauguaaau

SEQ ID NO: 1999686 - RNA, 22 nt, Human
guuuaucgcccuggcaggcagg

SEQ ID NO: 1999687 - RNA, 15 nt, Human
guuuaucuagaugua

SEQ ID NO: 1999688 - RNA, 21 nt, Human
guuuaucagaaagggcagaag

SEQ ID NO: 1999689 - RNA, 16 nt, Human
guuuaucccuuaagaa

SEQ ID NO: 1999690 - RNA, 17 nt, Human
guuuaucccuuaagaau

SEQ ID NO: 1999691 - RNA, 22 nt, Human
guuuaucccuuaagaaugaguu

SEQ ID NO: 1999692 - RNA, 15 nt, Human
guuuauaucuccuuu

SEQ ID NO: 1999693 - RNA, 19 nt, Human
guuuauaucuccuuuguau

SEQ ID NO: 1999694 - RNA, 19 nt, Human
guuuaggaacuacugagga

SEQ ID NO: 1999695 - RNA, 16 nt, Human
guuuagaauugaaggu

SEQ ID NO: 1999696 - RNA, 17 nt, Human
guuuauaguuaaucuau

SEQ ID NO: 1999697 - RNA, 18 nt, Human
guuuauaguuaaucuaua

SEQ ID NO: 1999698 - RNA, 14 nt, Human
guuguuacauuuuu

SEQ ID NO: 1999699 - RNA, 15 nt, Human
guuguuacauuuuua

SEQ ID NO: 1999700 - RNA, 20 nt, Human
guuguuugauucagacagcu

SEQ ID NO: 1999701 - RNA, 19 nt, Human
guuguucuuggcaauaaau

SEQ ID NO: 1999702 - RNA, 21 nt, Human
guuguucuuggcaauaaauuu

SEQ ID NO: 1999703 - RNA, 16 nt, Human
guuuagaagaagugug

SEQ ID NO: 1999704 - RNA, 15 nt, Human
guuuacucacagcca

SEQ ID NO: 1999705 - RNA, 15 nt, Human
guuuagaacagguuu

SEQ ID NO: 1999706 - RNA, 14 nt, Human
guuuagaauugaag

SEQ ID NO: 1999707 - RNA, 12 nt, Human
guuuagaacagg

SEQ ID NO: 1999708 - RNA, 14 nt, Human
guuuagauaauaca

SEQ ID NO: 1999709 - RNA, 15 nt, Human
guuuagauaauacac

SEQ ID NO: 1999710 - RNA, 22 nt, Human
guuguuugaugcauuaaaagaa

SEQ ID NO: 1999711 - RNA, 14 nt, Human
guugugaauaauua

SEQ ID NO: 1999712 - RNA, 14 nt, Human
guugucucuucucc

SEQ ID NO: 1999713 - RNA, 17 nt, Human
guugucucuucuccuua

SEQ ID NO: 1999714 - RNA, 13 nt, Human
guugugaauaauu

SEQ ID NO: 1999715 - RNA, 19 nt, Human
guugucugcaacucugaag

SEQ ID NO: 1999716 - RNA, 22 nt, Human
guugucugaagucacugcacag

SEQ ID NO: 1999717 - RNA, 19 nt, Human
guugucugaagucacugca

SEQ ID NO: 1999718 - RNA, 12 nt, Human
guugucucuucu

SEQ ID NO: 1999719 - RNA, 14 nt, Human
guugugguuaaucu

SEQ ID NO: 1999720 - RNA, 10 nt, Human
guugugugcc

SEQ ID NO: 1999721 - RNA, 21 nt, Human
guugugugccucuagcugaau

SEQ ID NO: 1999722 - RNA, 22 nt, Human
guuguggauuuaacagaaaugu

SEQ ID NO: 1999723 - RNA, 12 nt, Human
guuguguguggg

SEQ ID NO: 1999724 - RNA, 13 nt, Human
guuguguguggga

SEQ ID NO: 1999725 - RNA, 14 nt, Human
guugugugugggag

SEQ ID NO: 1999726 - RNA, 16 nt, Human
guugugugugggagug

SEQ ID NO: 1999727 - RNA, 22 nt, Human
guugugugugggaguguguaau

SEQ ID NO: 1999728 - RNA, 19 nt, Human
guuguccgguuuacuuuaa

SEQ ID NO: 1999729 - RNA, 12 nt, Human
guugucagcuga

SEQ ID NO: 1999730 - RNA, 22 nt, Human
guugucaagaauagcauuguaa

SEQ ID NO: 1999731 - RNA, 19 nt, Human
guuggcugggggccucagu

SEQ ID NO: 1999732 - RNA, 14 nt, Human
guugucaagaauag

SEQ ID NO: 1999733 - RNA, 18 nt, Human
guugucaagaauagcauu

SEQ ID NO: 1999734 - RNA, 20 nt, Human
guuggccccugcccggcugc

SEQ ID NO: 1999735 - RNA, 13 nt, Human
guuggccucugca

SEQ ID NO: 1999736 - RNA, 13 nt, Human
guuggccccugcc

SEQ ID NO: 1999737 - RNA, 14 nt, Human
guuggccccugccc

SEQ ID NO: 1999738 - RNA, 12 nt, Human
guuggcuggggg

SEQ ID NO: 1999739 - RNA, 20 nt, Human
guuuuccaugaguccccugu

SEQ ID NO: 1999740 - RNA, 19 nt, Human
guuuuccaugaguccccug

SEQ ID NO: 1999741 - RNA, 22 nt, Human
guuuucagcuaggaacaaaucu

SEQ ID NO: 1999742 - RNA, 20 nt, Human
guuuuccagguuuaagcugu

SEQ ID NO: 1999743 - RNA, 20 nt, Human
guuuucccuugaggaaacaa

SEQ ID NO: 1999744 - RNA, 16 nt, Human
guuuucccugaaguua

SEQ ID NO: 1999745 - RNA, 21 nt, Human
guuuuccgcauucuuuguaca

SEQ ID NO: 1999746 - RNA, 15 nt, Human
guuuucccugaaguu

SEQ ID NO: 1999747 - RNA, 13 nt, Human
guuuuccugaaga

SEQ ID NO: 1999748 - RNA, 10 nt, Human
guuuuguugc

SEQ ID NO: 1999749 - RNA, 18 nt, Human
guuuuguugcacugaagu

SEQ ID NO: 1999750 - RNA, 19 nt, Human
guuuuguugcacugaaguu

SEQ ID NO: 1999751 - RNA, 18 nt, Human
guuuuguaaacuuugaaa

SEQ ID NO: 1999752 - RNA, 21 nt, Human
guuuuguaaacuuugaaauau

SEQ ID NO: 1999753 - RNA, 16 nt, Human
guuuugguccacuuuu

SEQ ID NO: 1999754 - RNA, 21 nt, Human
guuuugguccacuuuuccagu

SEQ ID NO: 1999755 - RNA, 16 nt, Human
guuuuguaaacuuuga

SEQ ID NO: 1999756 - RNA, 16 nt, Human
guuuuaaaaugagaaa

SEQ ID NO: 1999757 - RNA, 15 nt, Human
guuuuaaaaugagaa

SEQ ID NO: 1999758 - RNA, 16 nt, Human
guuuuaaaagccuugg

SEQ ID NO: 1999759 - RNA, 14 nt, Human
guuuuaaaauacug

SEQ ID NO: 1999760 - RNA, 16 nt, Human
guuuuaaaauacugua

SEQ ID NO: 1999761 - RNA, 18 nt, Human
guuuuaaaauacuguaga

SEQ ID NO: 1999762 - RNA, 19 nt, Human
guuuuaaaauacuguagau

SEQ ID NO: 1999763 - RNA, 21 nt, Human
guuuuaaaauacuguagauaa

SEQ ID NO: 1999764 - RNA, 14 nt, Human
guuuguuuguuuca

SEQ ID NO: 1999765 - RNA, 23 nt, Human
guuuguuuuuuguuuuucugcuu

SEQ ID NO: 1999766 - RNA, 20 nt, Human
guuuguuucugaaagggacg

SEQ ID NO: 1999767 - RNA, 14 nt, Human
guuuguuccagaau

SEQ ID NO: 1999768 - RNA, 16 nt, Human
guuuguuucuuugaau

SEQ ID NO: 1999769 - RNA, 17 nt, Human
guuuucaaaauaaaaau

SEQ ID NO: 1999770 - RNA, 20 nt, Human
guuuucaaaauuguuacaaa

SEQ ID NO: 1999771 - RNA, 18 nt, Human
guuuucaaccucuagaau

SEQ ID NO: 1999772 - RNA, 19 nt, Human
guuuucaaccucuagaauu

SEQ ID NO: 1999773 - RNA, 23 nt, Human
guuuucaacucuucccugaacuu

SEQ ID NO: 1999774 - RNA, 17 nt, Human
guuuuaaaaugagaaau

SEQ ID NO: 1999775 - RNA, 13 nt, Human
guuuucaaaugga

SEQ ID NO: 1999776 - RNA, 14 nt, Human
guuuucaaauggag

SEQ ID NO: 1999777 - RNA, 16 nt, Human
guuuucaaauggaguu

SEQ ID NO: 1999778 - RNA, 11 nt, Human
guuuucacucu

SEQ ID NO: 1999779 - RNA, 12 nt, Human
guuuucacucuu

SEQ ID NO: 1999780 - RNA, 21 nt, Human
guuugauucagacagcugccu

SEQ ID NO: 1999781 - RNA, 20 nt, Human
guuugauucagacagcugcc

SEQ ID NO: 1999782 - RNA, 16 nt, Human
guuugauucagacagc

SEQ ID NO: 1999783 - RNA, 15 nt, Human
guuugguccuguagg

SEQ ID NO: 1999784 - RNA, 20 nt, Human
guuuguaaauuaacuuuuau

SEQ ID NO: 1999785 - RNA, 18 nt, Human
guuuguuucugaaaggga

SEQ ID NO: 1999786 - RNA, 13 nt, Human
guuugguucaaau

SEQ ID NO: 1999787 - RNA, 22 nt, Human
guuugguucaaauguguuuugg

SEQ ID NO: 1999788 - RNA, 15 nt, Human
guuuguaacaagaaa

SEQ ID NO: 1999789 - RNA, 14 nt, Human
guuuguauguauaa

SEQ ID NO: 1999790 - RNA, 16 nt, Human
guuuguauguauaauu

SEQ ID NO: 1999791 - RNA, 18 nt, Human
guuugagaucagccuggg

SEQ ID NO: 1999792 - RNA, 23 nt, Human
guuugauuaaauucuugcaaagu

SEQ ID NO: 1999793 - RNA, 17 nt, Human
guuugagaucagccugg

SEQ ID NO: 1999794 - RNA, 19 nt, Human
guuucuuuguaaugaaaac

SEQ ID NO: 1999795 - RNA, 13 nt, Human
guuucuuuuugaa

SEQ ID NO: 1999796 - RNA, 16 nt, Human
guuucuuuuugaaucu

SEQ ID NO: 1999797 - RNA, 13 nt, Human
guuugaaaauagu

SEQ ID NO: 1999798 - RNA, 16 nt, Human
guuugaaaauaguuua

SEQ ID NO: 1999799 - RNA, 18 nt, Human
guuucuuuguaaugaaaa

SEQ ID NO: 1999800 - RNA, 11 nt, Human
guuucuuagac

SEQ ID NO: 1999801 - RNA, 22 nt, Human
guuuccuaaaauaucugggugg

SEQ ID NO: 1999802 - RNA, 23 nt, Human
guugccagucaccccggccaccu

SEQ ID NO: 1999803 - RNA, 18 nt, Human
guugccagucaccccggc

SEQ ID NO: 1999804 - RNA, 17 nt, Human
guugccagucaccccgg

SEQ ID NO: 1999805 - RNA, 16 nt, Human
guugccagucaccccg

SEQ ID NO: 1999806 - RNA, 14 nt, Human
guugccagucaccc

SEQ ID NO: 1999807 - RNA, 13 nt, Human
guugccagucacc

SEQ ID NO: 1999808 - RNA, 12 nt, Human
guugcccaggca

SEQ ID NO: 1999809 - RNA, 18 nt, Human
guugcccagccucuuucc

SEQ ID NO: 1999810 - RNA, 20 nt, Human
guugcccagccucuuucccu

SEQ ID NO: 1999811 - RNA, 21 nt, Human
guugcccagccucuuucccuu

SEQ ID NO: 1999812 - RNA, 14 nt, Human
guugcccaggcagg

SEQ ID NO: 1999813 - RNA, 14 nt, Human
guuggaguucauuc

SEQ ID NO: 1999814 - RNA, 20 nt, Human
guuggaguucauucauauua

SEQ ID NO: 1999815 - RNA, 16 nt, Human
guuggaguagaaugua

SEQ ID NO: 1999816 - RNA, 20 nt, Human
guuggaguagaauguaguuu

SEQ ID NO: 1999817 - RNA, 22 nt, Human
guugcccagccucuuucccuuc

SEQ ID NO: 1999818 - RNA, 13 nt, Human
guuggccaggcug

SEQ ID NO: 1999819 - RNA, 14 nt, Human
guuggccaggcugc

SEQ ID NO: 1999820 - RNA, 19 nt, Human
guuggccaggcugcucuca

SEQ ID NO: 1999821 - RNA, 15 nt, Human
guuggccaggcuggu

SEQ ID NO: 1999822 - RNA, 14 nt, Human
guuggccaggcugg

SEQ ID NO: 1999823 - RNA, 17 nt, Human
guuggccaggcuggucu

SEQ ID NO: 1999824 - RNA, 19 nt, Human
guuggccaggcugcucuug

SEQ ID NO: 1999825 - RNA, 18 nt, Human
guuggccaggcuggucuc

SEQ ID NO: 1999826 - RNA, 19 nt, Human
guuggccaggcuggucuca

SEQ ID NO: 1999827 - RNA, 14 nt, Human
guuggccaguguga

SEQ ID NO: 1999828 - RNA, 23 nt, Human
guuggccaaagccaaagcuaggc

SEQ ID NO: 1999829 - RNA, 23 nt, Human
guuggcagaugcagcucuuccug

SEQ ID NO: 1999830 - RNA, 18 nt, Human
guuggcagaugcagcucu

SEQ ID NO: 1999831 - RNA, 18 nt, Human
guuggcaaaaaggcagga

SEQ ID NO: 1999832 - RNA, 13 nt, Human
guuggcaccuucc

SEQ ID NO: 1999833 - RNA, 16 nt, Human
guuggcaccuuccccc

SEQ ID NO: 1999834 - RNA, 18 nt, Human
guuggcaccuucccccuc

SEQ ID NO: 1999835 - RNA, 14 nt, Human
guuggcaaaaaggc

SEQ ID NO: 1999836 - RNA, 20 nt, Human
guugaagucaugcuccccug

SEQ ID NO: 1999837 - RNA, 13 nt, Human
guugaauaugauu

SEQ ID NO: 1999838 - RNA, 13 nt, Human
guugaagccuuug

SEQ ID NO: 1999839 - RNA, 14 nt, Human
guugaagccuuugu

SEQ ID NO: 1999840 - RNA, 16 nt, Human
guugaagucaugcucc

SEQ ID NO: 1999841 - RNA, 19 nt, Human
guugaagucaugcuccccu

SEQ ID NO: 1999842 - RNA, 14 nt, Human
guugauuaaagaug

SEQ ID NO: 1999843 - RNA, 14 nt, Human
guugaacuguuaga

SEQ ID NO: 1999844 - RNA, 17 nt, Human
guugaacuguuagaaug

SEQ ID NO: 1999845 - RNA, 19 nt, Human
guugaacuguuagaaugua

SEQ ID NO: 1999846 - RNA, 19 nt, Human
guugaagaccuaaccaggg

SEQ ID NO: 1999847 - RNA, 18 nt, Human
guugaagagguuuuaaag

SEQ ID NO: 1999848 - RNA, 21 nt, Human
guugaagaccuaaccagggcc

SEQ ID NO: 1999849 - RNA, 18 nt, Human
guugaacaaaauaaauug

SEQ ID NO: 1999850 - RNA, 14 nt, Human
guugaacaaaauaa

SEQ ID NO: 1999851 - RNA, 15 nt, Human
guugaacaaaauaaa

SEQ ID NO: 1999852 - RNA, 17 nt, Human
guugaacaaaauaaauu

SEQ ID NO: 1999853 - RNA, 16 nt, Human
guugaagacagagcua

SEQ ID NO: 1999854 - RNA, 16 nt, Human
guugcacugaaguuug

SEQ ID NO: 1999855 - RNA, 21 nt, Human
guugcacugaaguuugauaaa

SEQ ID NO: 1999856 - RNA, 15 nt, Human
guugcaggaccucag

SEQ ID NO: 1999857 - RNA, 12 nt, Human
guugcacugaag

SEQ ID NO: 1999858 - RNA, 13 nt, Human
guugcacugaagu

SEQ ID NO: 1999859 - RNA, 15 nt, Human
guugcacugaaguuu

SEQ ID NO: 1999860 - RNA, 14 nt, Human
guugcaacuuugua

SEQ ID NO: 1999861 - RNA, 22 nt, Human
guugauuucuaguuauuuauuc

SEQ ID NO: 1999862 - RNA, 16 nt, Human
guugauuucuaguuau

SEQ ID NO: 1999863 - RNA, 13 nt, Human
guugauucucucc

SEQ ID NO: 1999864 - RNA, 14 nt, Human
guugauucucucca

SEQ ID NO: 1999865 - RNA, 16 nt, Human
guugcaacuuuguaua

SEQ ID NO: 1999866 - RNA, 17 nt, Human
guugaaaaacagcugag

SEQ ID NO: 1999867 - RNA, 12 nt, Human
guucuuugugua

SEQ ID NO: 1999868 - RNA, 19 nt, Human
guucuuuucaauauauuug

SEQ ID NO: 1999869 - RNA, 13 nt, Human
guucuuuccaaag

SEQ ID NO: 1999870 - RNA, 14 nt, Human
guucuuuccaaagu

SEQ ID NO: 1999871 - RNA, 18 nt, Human
guucuuuccaaaguacac

SEQ ID NO: 1999872 - RNA, 20 nt, Human
guucuuuccaaaguacacug

SEQ ID NO: 1999873 - RNA, 16 nt, Human
guucuuucuuccucug

SEQ ID NO: 1999874 - RNA, 17 nt, Human
guucuuucuuccucugc

SEQ ID NO: 1999875 - RNA, 18 nt, Human
guucuuucuuccucugcu

SEQ ID NO: 1999876 - RNA, 19 nt, Human
guucuuucuuccucugcug

SEQ ID NO: 1999877 - RNA, 14 nt, Human
guucuuucuuccuc

SEQ ID NO: 1999878 - RNA, 15 nt, Human
guucuuucuuccucu

SEQ ID NO: 1999879 - RNA, 20 nt, Human
guucuuucauuugcuuugga

SEQ ID NO: 1999880 - RNA, 22 nt, Human
guucuuucauuugcuuuggaag

SEQ ID NO: 1999881 - RNA, 20 nt, Human
guucuuuccauaauaaaagg

SEQ ID NO: 1999882 - RNA, 13 nt, Human
guucuuucucuuu

SEQ ID NO: 1999883 - RNA, 20 nt, Human
guucuggcucuuccaggcug

SEQ ID NO: 1999884 - RNA, 16 nt, Human
guucuggcucuuccag

SEQ ID NO: 1999885 - RNA, 12 nt, Human
guucuggcucuu

SEQ ID NO: 1999886 - RNA, 17 nt, Human
guucugcuaaauuucaa

SEQ ID NO: 1999887 - RNA, 19 nt, Human
guucugcuaaauuucaaau

SEQ ID NO: 1999888 - RNA, 23 nt, Human
guucuggcagaguugaagacaga

SEQ ID NO: 1999889 - RNA, 11 nt, Human
guucugggaca

SEQ ID NO: 1999890 - RNA, 12 nt, Human
guucugggacac

SEQ ID NO: 1999891 - RNA, 14 nt, Human
guucugggacacag

SEQ ID NO: 1999892 - RNA, 15 nt, Human
guucugggacacagu

SEQ ID NO: 1999893 - RNA, 16 nt, Human
guucugggacacaguu

SEQ ID NO: 1999894 - RNA, 18 nt, Human
guucuuucacccuuuucu

SEQ ID NO: 1999895 - RNA, 23 nt, Human
guucugggacacaguucaauucu

SEQ ID NO: 1999896 - RNA, 20 nt, Human
guucugccucugauguauuu

SEQ ID NO: 1999897 - RNA, 19 nt, Human
guucugauccuaguuccac

SEQ ID NO: 1999898 - RNA, 15 nt, Human
guucugcacacagca

SEQ ID NO: 1999899 - RNA, 16 nt, Human
guucugcacacagcac

SEQ ID NO: 1999900 - RNA, 15 nt, Human
guuccuucugggcau

SEQ ID NO: 1999901 - RNA, 18 nt, Human
guuccuuccucugagccu

SEQ ID NO: 1999902 - RNA, 19 nt, Human
guuccuuccucugagccuu

SEQ ID NO: 1999903 - RNA, 17 nt, Human
guuccuuccucugagcc

SEQ ID NO: 1999904 - RNA, 20 nt, Human
guuccaccaucaagccacca

SEQ ID NO: 1999905 - RNA, 17 nt, Human
guuccaccaucaagcca

SEQ ID NO: 1999906 - RNA, 14 nt, Human
guuccacagaggac

SEQ ID NO: 1999907 - RNA, 12 nt, Human
guuccacugaga

SEQ ID NO: 1999908 - RNA, 13 nt, Human
guuccacugagac

SEQ ID NO: 1999909 - RNA, 13 nt, Human
guuccagccugcc

SEQ ID NO: 1999910 - RNA, 14 nt, Human
guuccagccugcca

SEQ ID NO: 1999911 - RNA, 14 nt, Human
guuccagcaccaca

SEQ ID NO: 1999912 - RNA, 23 nt, Human
guuccagcaauucuccugccuca

SEQ ID NO: 1999913 - RNA, 20 nt, Human
guuccagcaauucuccugcc

SEQ ID NO: 1999914 - RNA, 21 nt, Human
guuccagcaauucuccugccu

SEQ ID NO: 1999915 - RNA, 14 nt, Human
guuccacugagacc

SEQ ID NO: 1999916 - RNA, 17 nt, Human
guucauucauauuacaa

SEQ ID NO: 1999917 - RNA, 14 nt, Human
guucauucauauua

SEQ ID NO: 1999918 - RNA, 16 nt, Human
guucauucauauuaca

SEQ ID NO: 1999919 - RNA, 17 nt, Human
guuccaaccacugaauc

SEQ ID NO: 1999920 - RNA, 17 nt, Human
guuccaaacaugagguu

SEQ ID NO: 1999921 - RNA, 23 nt, Human
guuccaaacaugagguucucucu

SEQ ID NO: 1999922 - RNA, 18 nt, Human
guuccaagucuuugcuau

SEQ ID NO: 1999923 - RNA, 16 nt, Human
guuccuagccaccgcc

SEQ ID NO: 1999924 - RNA, 16 nt, Human
guuccuacacaggaca

SEQ ID NO: 1999925 - RNA, 17 nt, Human
guuccuacacaggacag

SEQ ID NO: 1999926 - RNA, 15 nt, Human
guuccuacacaggac

SEQ ID NO: 1999927 - RNA, 22 nt, Human
guuccucauuagcauuuugcua

SEQ ID NO: 1999928 - RNA, 23 nt, Human
guuccuagugauggcuuaugaua

SEQ ID NO: 1999929 - RNA, 18 nt, Human
guuccuacacaggacagg

SEQ ID NO: 1999930 - RNA, 15 nt, Human
guuccagccugccac

SEQ ID NO: 1999931 - RNA, 14 nt, Human
guuccuaauccucu

SEQ ID NO: 1999932 - RNA, 17 nt, Human
guuccaggguucucuug

SEQ ID NO: 1999933 - RNA, 15 nt, Human
guuccaguuucagag

SEQ ID NO: 1999934 - RNA, 22 nt, Human
guuccuggggcauccauggggu

SEQ ID NO: 1999935 - RNA, 23 nt, Human
guuccuccccuccuccuggacuc

SEQ ID NO: 1999936 - RNA, 13 nt, Human
guucaucuugaau

SEQ ID NO: 1999937 - RNA, 12 nt, Human
guucaucuugaa

SEQ ID NO: 1999938 - RNA, 12 nt, Human
guucaugaaaga

SEQ ID NO: 1999939 - RNA, 20 nt, Human
guucaucccuucucuuccag

SEQ ID NO: 1999940 - RNA, 18 nt, Human
guucaucuugaauuguaa

SEQ ID NO: 1999941 - RNA, 17 nt, Human
guucagccacugaggga

SEQ ID NO: 1999942 - RNA, 16 nt, Human
guucaucaaugaauga

SEQ ID NO: 1999943 - RNA, 17 nt, Human
guucaucauccuaagcu

SEQ ID NO: 1999944 - RNA, 16 nt, Human
guucaucccuucucuu

SEQ ID NO: 1999945 - RNA, 18 nt, Human
guucaucccuucucuucc

SEQ ID NO: 1999946 - RNA, 19 nt, Human
guucaucccuucucuucca

SEQ ID NO: 1999947 - RNA, 20 nt, Human
guucacuaaacucugaauaa

SEQ ID NO: 1999948 - RNA, 12 nt, Human
guucagaaaaaa

SEQ ID NO: 1999949 - RNA, 21 nt, Human
guucagaaaaaagguucuuug

SEQ ID NO: 1999950 - RNA, 18 nt, Human
guucacucuuggagccug

SEQ ID NO: 1999951 - RNA, 19 nt, Human
guucacucuuggagccugc

SEQ ID NO: 1999952 - RNA, 17 nt, Human
guucacucuuggagccu

SEQ ID NO: 1999953 - RNA, 20 nt, Human
guucacucuuggagccugca

SEQ ID NO: 1999954 - RNA, 24 nt, Human
guucacucuuggagccugcagagc

SEQ ID NO: 1999955 - RNA, 19 nt, Human
guucacugcaaccuccgcc

SEQ ID NO: 1999956 - RNA, 16 nt, Human
guucacggguggccug

SEQ ID NO: 1999957 - RNA, 15 nt, Human
guucacuaaacucug

SEQ ID NO: 1999958 - RNA, 24 nt, Human
guucacucuacuuagcaugucccu

SEQ ID NO: 1999959 - RNA, 16 nt, Human
guucacuaaacucuga

SEQ ID NO: 1999960 - RNA, 18 nt, Human
guucacuaaacucugaau

SEQ ID NO: 1999961 - RNA, 15 nt, Human
guucacaccugcaga

SEQ ID NO: 1999962 - RNA, 19 nt, Human
guuacauaagauaaaugug

SEQ ID NO: 1999963 - RNA, 18 nt, Human
guuacauaagauaaaugu

SEQ ID NO: 1999964 - RNA, 20 nt, Human
guuacaugcagccacuuagg

SEQ ID NO: 1999965 - RNA, 12 nt, Human
guuacagccugg

SEQ ID NO: 1999966 - RNA, 19 nt, Human
guuacagguaccaguucuu

SEQ ID NO: 1999967 - RNA, 17 nt, Human
guuacagacaaagcgug

SEQ ID NO: 1999968 - RNA, 15 nt, Human
guuacagacaaagcg

SEQ ID NO: 1999969 - RNA, 21 nt, Human
guuacauuuuuaagugcugca

SEQ ID NO: 1999970 - RNA, 16 nt, Human
guuacccaaauuaaga

SEQ ID NO: 1999971 - RNA, 14 nt, Human
guuaccauuggaaa

SEQ ID NO: 1999972 - RNA, 16 nt, Human
guuaccauuggaaauu

SEQ ID NO: 1999973 - RNA, 19 nt, Human
guuaccauuggaaauuuca

SEQ ID NO: 1999974 - RNA, 23 nt, Human
guuaccauuuugggguacccacu

SEQ ID NO: 1999975 - RNA, 12 nt, Human
guuaccuuaaau

SEQ ID NO: 1999976 - RNA, 20 nt, Human
guuaccauuggaaauuucac

SEQ ID NO: 1999977 - RNA, 21 nt, Human
guuaccauuggaaauuucacg

SEQ ID NO: 1999978 - RNA, 19 nt, Human
guuaguuucuccaagcagg

SEQ ID NO: 1999979 - RNA, 16 nt, Human
guuaguuucuccaagc

SEQ ID NO: 1999980 - RNA, 22 nt, Human
guuaguuucuccaagcaggaca

SEQ ID NO: 1999981 - RNA, 16 nt, Human
guuaguuccacugaga

SEQ ID NO: 1999982 - RNA, 24 nt, Human
guuaguucaaucuggauucauauu

SEQ ID NO: 1999983 - RNA, 13 nt, Human
guuauaaaggaau

SEQ ID NO: 1999984 - RNA, 15 nt, Human
guuacuaccuccucu

SEQ ID NO: 1999985 - RNA, 22 nt, Human
guuacuaaguuuuuauggcuuu

SEQ ID NO: 1999986 - RNA, 15 nt, Human
guuacucagaauucu

SEQ ID NO: 1999987 - RNA, 20 nt, Human
guuaucauuuuuuccuguuu

SEQ ID NO: 1999988 - RNA, 17 nt, Human
guuaucauuuuuuccug

SEQ ID NO: 1999989 - RNA, 21 nt, Human
guuaugacuccagaauuuccc

SEQ ID NO: 1999990 - RNA, 17 nt, Human
guuauaaugaaugacuu

SEQ ID NO: 1999991 - RNA, 18 nt, Human
guuauagguccuuuagaa

SEQ ID NO: 1999992 - RNA, 15 nt, Human
guuauagugcaauau

SEQ ID NO: 1999993 - RNA, 16 nt, Human
guuauagugcaauaua

SEQ ID NO: 1999994 - RNA, 21 nt, Human
guuauagguccuuuagaaaca

SEQ ID NO: 1999995 - RNA, 17 nt, Human
guuauagugcaauauau

SEQ ID NO: 1999996 - RNA, 21 nt, Human
guuauauuuuucuuaaaaagu

SEQ ID NO: 1999997 - RNA, 23 nt, Human
guuauauuuuucuuaaaaaguaa

SEQ ID NO: 1999998 - RNA, 23 nt, Human
guucaauucucauuugucacaca

SEQ ID NO: 1999999 - RNA, 16 nt, Human
guucaauucucauuug

SEQ ID NO: 2000000 - RNA, 23 nt, Human
guucaaucuggauucauauuuaa

SEQ ID NO: 2000001 - RNA, 23 nt, Human
guuauuauagagcagaaauucug

SEQ ID NO: 2000002 - RNA, 20 nt, Human
guucaagcgauucuucugcu

SEQ ID NO: 2000003 - RNA, 23 nt, Human
guucaagugauucucaugccuca

SEQ ID NO: 2000004 - RNA, 15 nt, Human
guuauguaaauaauu

SEQ ID NO: 2000005 - RNA, 19 nt, Human
guuauuaaaaaucucaaau

SEQ ID NO: 2000006 - RNA, 21 nt, Human
guuauguaaauaauucuuuuu

SEQ ID NO: 2000007 - RNA, 14 nt, Human
guuauguauauggu

SEQ ID NO: 2000008 - RNA, 19 nt, Human
guucaagcgauucuucugc

SEQ ID NO: 2000009 - RNA, 17 nt, Human
guuauuauauuuacaaa

SEQ ID NO: 2000010 - RNA, 11 nt, Human
guuaugugucu

SEQ ID NO: 2000011 - RNA, 12 nt, Human
guuauuaaaauu

SEQ ID NO: 2000012 - RNA, 13 nt, Human
guuauuaaaauug

SEQ ID NO: 2000013 - RNA, 14 nt, Human
guggcucacgccug

SEQ ID NO: 2000014 - RNA, 15 nt, Human
gugcuaauuuugaaa

SEQ ID NO: 2000015 - RNA, 13 nt, Human
gugcuaauuuuga

SEQ ID NO: 2000016 - RNA, 14 nt, Human
guggcugcuucaag

SEQ ID NO: 2000017 - RNA, 12 nt, Human
guggcugcuuca

SEQ ID NO: 2000018 - RNA, 20 nt, Human
guggcucaagucuggcccca

SEQ ID NO: 2000019 - RNA, 21 nt, Human
guggcucaagucuggccccac

SEQ ID NO: 2000020 - RNA, 13 nt, Human
guggcuccucccg

SEQ ID NO: 2000021 - RNA, 20 nt, Human
guggcuccucccggugccca

SEQ ID NO: 2000022 - RNA, 22 nt, Human
guggcugcuucaaggauccuga

SEQ ID NO: 2000023 - RNA, 19 nt, Human
guggcugcuucaaggaucc

SEQ ID NO: 2000024 - RNA, 16 nt, Human
guggcugcuucaagga

SEQ ID NO: 2000025 - RNA, 15 nt, Human
guggcugcuucaagg

SEQ ID NO: 2000026 - RNA, 17 nt, Human
guggcuggaucugugag

SEQ ID NO: 2000027 - RNA, 23 nt, Human
guggcugcuucaaggauccugag

SEQ ID NO: 2000028 - RNA, 19 nt, Human
guggcuggguuggagggug

SEQ ID NO: 2000029 - RNA, 18 nt, Human
guggcuucccgcucagcc

SEQ ID NO: 2000030 - RNA, 19 nt, Human
guggcuucccgcucagccc

SEQ ID NO: 2000031 - RNA, 20 nt, Human
guggcuucccgcucagcccu

SEQ ID NO: 2000032 - RNA, 22 nt, Human
guggcuuaaaacaacacucaca

SEQ ID NO: 2000033 - RNA, 13 nt, Human
gugggccuggcca

SEQ ID NO: 2000034 - RNA, 15 nt, Human
gugggcauucaaaug

SEQ ID NO: 2000035 - RNA, 17 nt, Human
gugggcauucucucucc

SEQ ID NO: 2000036 - RNA, 17 nt, Human
gugggcccaaugcacuu

SEQ ID NO: 2000037 - RNA, 18 nt, Human
gugggcgugagaccugcc

SEQ ID NO: 2000038 - RNA, 21 nt, Human
gugggcgugagaccugccccu

SEQ ID NO: 2000039 - RNA, 22 nt, Human
gugggcgugagaccugccccuc

SEQ ID NO: 2000040 - RNA, 19 nt, Human
gugggccuucagggaguga

SEQ ID NO: 2000041 - RNA, 14 nt, Human
gugggcuccccucu

SEQ ID NO: 2000042 - RNA, 15 nt, Human
gugggcuccccucuu

SEQ ID NO: 2000043 - RNA, 19 nt, Human
gugggcuccccucuuccuc

SEQ ID NO: 2000044 - RNA, 20 nt, Human
gugggcuccccucuuccucu

SEQ ID NO: 2000045 - RNA, 22 nt, Human
gugggcuccccucuuccucuug

SEQ ID NO: 2000046 - RNA, 15 nt, Human
gugggcuaguugggc

SEQ ID NO: 2000047 - RNA, 13 nt, Human
guggggaggggcu

SEQ ID NO: 2000048 - RNA, 18 nt, Human
guggggaccucaggccug

SEQ ID NO: 2000049 - RNA, 15 nt, Human
guggggaccucaggc

SEQ ID NO: 2000050 - RNA, 13 nt, Human
guggggcagcuug

SEQ ID NO: 2000051 - RNA, 17 nt, Human
guggggcagcuugaggg

SEQ ID NO: 2000052 - RNA, 23 nt, Human
guggguuucuaaagcugccagcc

SEQ ID NO: 2000053 - RNA, 15 nt, Human
gugggugugagcagc

SEQ ID NO: 2000054 - RNA, 21 nt, Human
guguaaguauucuuauuuaau

SEQ ID NO: 2000055 - RNA, 17 nt, Human
guguaagacaaaaagcu

SEQ ID NO: 2000056 - RNA, 19 nt, Human
guggugcgaucuggguuca

SEQ ID NO: 2000057 - RNA, 14 nt, Human
guggucuuuuccuc

SEQ ID NO: 2000058 - RNA, 21 nt, Human
guggugagaggcauccaguau

SEQ ID NO: 2000059 - RNA, 14 nt, Human
guggugaccucugc

SEQ ID NO: 2000060 - RNA, 17 nt, Human
guggugaccucugccug

SEQ ID NO: 2000061 - RNA, 18 nt, Human
guggucuccacuggggau

SEQ ID NO: 2000062 - RNA, 18 nt, Human
gugguccuaaucuucuga

SEQ ID NO: 2000063 - RNA, 17 nt, Human
guggucccaccccacac

SEQ ID NO: 2000064 - RNA, 16 nt, Human
guggucccaccccaca

SEQ ID NO: 2000065 - RNA, 15 nt, Human
guggucccaccccac

SEQ ID NO: 2000066 - RNA, 14 nt, Human
guggucccacccca

SEQ ID NO: 2000067 - RNA, 17 nt, Human
gugguagagugugccug

SEQ ID NO: 2000068 - RNA, 19 nt, Human
gugguaugaucacggcuca

SEQ ID NO: 2000069 - RNA, 20 nt, Human
guguaugugaguauucucau

SEQ ID NO: 2000070 - RNA, 11 nt, Human
guguccccacc

SEQ ID NO: 2000071 - RNA, 12 nt, Human
guguccccacca

SEQ ID NO: 2000072 - RNA, 13 nt, Human
guguccccaccau

SEQ ID NO: 2000073 - RNA, 17 nt, Human
guguccccaccaucugc

SEQ ID NO: 2000074 - RNA, 18 nt, Human
guguccccaccaucugcu

SEQ ID NO: 2000075 - RNA, 20 nt, Human
guguccccaccaucugcugu

SEQ ID NO: 2000076 - RNA, 22 nt, Human
guguccccaccaucugcugucu

SEQ ID NO: 2000077 - RNA, 13 nt, Human
gugucccugcacu

SEQ ID NO: 2000078 - RNA, 16 nt, Human
gugucccugcacuugc

SEQ ID NO: 2000079 - RNA, 18 nt, Human
gugucccugcacuugcag

SEQ ID NO: 2000080 - RNA, 12 nt, Human
guguauauuuga

SEQ ID NO: 2000081 - RNA, 13 nt, Human
guguauauuugau

SEQ ID NO: 2000082 - RNA, 14 nt, Human
guguauauuugauu

SEQ ID NO: 2000083 - RNA, 17 nt, Human
guguauauuugauuuau

SEQ ID NO: 2000084 - RNA, 22 nt, Human
guguaauuuaaaauugugaugu

SEQ ID NO: 2000085 - RNA, 23 nt, Human
guguaauuuaaaauugugaugug

SEQ ID NO: 2000086 - RNA, 20 nt, Human
guguaauuuaaaauugugau

SEQ ID NO: 2000087 - RNA, 15 nt, Human
guguaauuuuucugu

SEQ ID NO: 2000088 - RNA, 16 nt, Human
guguaauuuuucugua

SEQ ID NO: 2000089 - RNA, 23 nt, Human
guguacagaauuuuucuucauua

SEQ ID NO: 2000090 - RNA, 17 nt, Human
guguacauggaauaaca

SEQ ID NO: 2000091 - RNA, 15 nt, Human
guguaccauuaaaau

SEQ ID NO: 2000092 - RNA, 22 nt, Human
guguacauggaauaacauguaa

SEQ ID NO: 2000093 - RNA, 17 nt, Human
guuaacaggcaaacauu

SEQ ID NO: 2000094 - RNA, 11 nt, Human
guuaaauguuu

SEQ ID NO: 2000095 - RNA, 13 nt, Human
guuaaauguuuug

SEQ ID NO: 2000096 - RNA, 17 nt, Human
guuaaauguuuuguaaa

SEQ ID NO: 2000097 - RNA, 18 nt, Human
guuaaauguuuuguaaac

SEQ ID NO: 2000098 - RNA, 19 nt, Human
guuaaauguuuuguaaacu

SEQ ID NO: 2000099 - RNA, 22 nt, Human
guuaaauguuuuguaaacuuug

SEQ ID NO: 2000100 - RNA, 23 nt, Human
guuaaauguuuuguaaacuuuga

SEQ ID NO: 2000101 - RNA, 12 nt, Human
guuaacaaauaa

SEQ ID NO: 2000102 - RNA, 17 nt, Human
guuaacaaauaacaacu

SEQ ID NO: 2000103 - RNA, 13 nt, Human
guuacagacaaag

SEQ ID NO: 2000104 - RNA, 17 nt, Human
guuacacuuuuuggaag

SEQ ID NO: 2000105 - RNA, 18 nt, Human
guuacacuuuuuggaagu

SEQ ID NO: 2000106 - RNA, 22 nt, Human
guuacacuuuuuggaagugaaa

SEQ ID NO: 2000107 - RNA, 16 nt, Human
guuacacuaaaaggug

SEQ ID NO: 2000108 - RNA, 15 nt, Human
guuacacuaaaaggu

SEQ ID NO: 2000109 - RNA, 18 nt, Human
guuaacugagugccuuuu

SEQ ID NO: 2000110 - RNA, 22 nt, Human
guuaaaauaccagccaguaaau

SEQ ID NO: 2000111 - RNA, 14 nt, Human
guuaaaauggauuu

SEQ ID NO: 2000112 - RNA, 13 nt, Human
guuaaaauuauac

SEQ ID NO: 2000113 - RNA, 20 nt, Human
guuaaaaacagauuuggaaa

SEQ ID NO: 2000114 - RNA, 16 nt, Human
guuaaagggaagaaaa

SEQ ID NO: 2000115 - RNA, 21 nt, Human
guuaaagggaagaaaacacug

SEQ ID NO: 2000116 - RNA, 18 nt, Human
guuaaaggugaacauugg

SEQ ID NO: 2000117 - RNA, 17 nt, Human
guuaaacucgcucacug

SEQ ID NO: 2000118 - RNA, 16 nt, Human
guuaaagauguagcaa

SEQ ID NO: 2000119 - RNA, 13 nt, Human
guuaaagauguag

SEQ ID NO: 2000120 - RNA, 20 nt, Human
guguuauuuuaaucucagaa

SEQ ID NO: 2000121 - RNA, 15 nt, Human
guguuaugagccagg

SEQ ID NO: 2000122 - RNA, 17 nt, Human
guguuauaugaacauac

SEQ ID NO: 2000123 - RNA, 23 nt, Human
guguuauaugaacauacaaaugc

SEQ ID NO: 2000124 - RNA, 22 nt, Human
guguuauugagagagaugugua

SEQ ID NO: 2000125 - RNA, 24 nt, Human
guguuauugagagagauguguaau

SEQ ID NO: 2000126 - RNA, 14 nt, Human
guguucagaaaaaa

SEQ ID NO: 2000127 - RNA, 23 nt, Human
guguucaguguuagcaguggguc

SEQ ID NO: 2000128 - RNA, 12 nt, Human
guguucucagag

SEQ ID NO: 2000129 - RNA, 13 nt, Human
guguucucagagg

SEQ ID NO: 2000130 - RNA, 18 nt, Human
guguuuuucauaaagcag

SEQ ID NO: 2000131 - RNA, 12 nt, Human
guguuuuggucc

SEQ ID NO: 2000132 - RNA, 18 nt, Human
guguuaugacuccagaau

SEQ ID NO: 2000133 - RNA, 14 nt, Human
guguuauaugaaca

SEQ ID NO: 2000134 - RNA, 12 nt, Human
guguuacuaagu

SEQ ID NO: 2000135 - RNA, 13 nt, Human
guguuacauguau

SEQ ID NO: 2000136 - RNA, 14 nt, Human
guguuacuaaguuu

SEQ ID NO: 2000137 - RNA, 19 nt, Human
guguguuuuaaaaugagaa

SEQ ID NO: 2000138 - RNA, 18 nt, Human
guguguuucauccuuccc

SEQ ID NO: 2000139 - RNA, 16 nt, Human
guguguuuuaaaauga

SEQ ID NO: 2000140 - RNA, 13 nt, Human
guguguuuuaaaa

SEQ ID NO: 2000141 - RNA, 14 nt, Human
guguguuuuucaua

SEQ ID NO: 2000142 - RNA, 13 nt, Human
guguuaauuuaag

SEQ ID NO: 2000143 - RNA, 16 nt, Human
guguuaauuuaaguuu

SEQ ID NO: 2000144 - RNA, 18 nt, Human
guguuaauuuaaguuuug

SEQ ID NO: 2000145 - RNA, 17 nt, Human
gugugggaguguguaau

SEQ ID NO: 2000146 - RNA, 17 nt, Human
guguggagucauuucug

SEQ ID NO: 2000147 - RNA, 21 nt, Human
guguggagucauuucugauuu

SEQ ID NO: 2000148 - RNA, 13 nt, Human
guguggagaagcg

SEQ ID NO: 2000149 - RNA, 20 nt, Human
guguggaaauuaagaagaaa

SEQ ID NO: 2000150 - RNA, 21 nt, Human
guguggagaagcggcuggcag

SEQ ID NO: 2000151 - RNA, 12 nt, Human
guguguugugug

SEQ ID NO: 2000152 - RNA, 14 nt, Human
guguguugugugug

SEQ ID NO: 2000153 - RNA, 17 nt, Human
guguguuguguguggga

SEQ ID NO: 2000154 - RNA, 14 nt, Human
guguguugcuuaug

SEQ ID NO: 2000155 - RNA, 16 nt, Human
guguguuuaugugugu

SEQ ID NO: 2000156 - RNA, 12 nt, Human
guguguuuuaaa

SEQ ID NO: 2000157 - RNA, 14 nt, Human
guguguuuaugugu

SEQ ID NO: 2000158 - RNA, 15 nt, Human
guguguuuaugugug

SEQ ID NO: 2000159 - RNA, 15 nt, Human
guguguuucugaucu

SEQ ID NO: 2000160 - RNA, 17 nt, Human
gugugcucaggagcccu

SEQ ID NO: 2000161 - RNA, 16 nt, Human
gugugcucaggagccc

SEQ ID NO: 2000162 - RNA, 13 nt, Human
gugugcccagcuu

SEQ ID NO: 2000163 - RNA, 18 nt, Human
gugugcccagcuuauaaa

SEQ ID NO: 2000164 - RNA, 11 nt, Human
gugugccucua

SEQ ID NO: 2000165 - RNA, 13 nt, Human
gugugccucuagc

SEQ ID NO: 2000166 - RNA, 14 nt, Human
gugugccucuagcu

SEQ ID NO: 2000167 - RNA, 16 nt, Human
gugugccucuagcuga

SEQ ID NO: 2000168 - RNA, 17 nt, Human
gugugccucuagcugaa

SEQ ID NO: 2000169 - RNA, 23 nt, Human
gugugccucuagcugaauugagc

SEQ ID NO: 2000170 - RNA, 19 nt, Human
gugugcucaggagcccugg

SEQ ID NO: 2000171 - RNA, 18 nt, Human
gugugcucaggagcccug

SEQ ID NO: 2000172 - RNA, 12 nt, Human
gugugcucugau

SEQ ID NO: 2000173 - RNA, 22 nt, Human
gugugcuaaacguguauguuuu

SEQ ID NO: 2000174 - RNA, 19 nt, Human
guguggaaauuaagaagaa

SEQ ID NO: 2000175 - RNA, 15 nt, Human
gugugcucugaucau

SEQ ID NO: 2000176 - RNA, 22 nt, Human
gugugcucugaucauccacugu

SEQ ID NO: 2000177 - RNA, 14 nt, Human
gugucucuuggucc

SEQ ID NO: 2000178 - RNA, 17 nt, Human
gugucucccuucauccu

SEQ ID NO: 2000179 - RNA, 14 nt, Human
guguccggucccug

SEQ ID NO: 2000180 - RNA, 23 nt, Human
gugucccugcacuugcagacucu

SEQ ID NO: 2000181 - RNA, 20 nt, Human
guguccuccugggguucuuu

SEQ ID NO: 2000182 - RNA, 15 nt, Human
gugucgggcaugaca

SEQ ID NO: 2000183 - RNA, 22 nt, Human
gugugauauuucagaaauacag

SEQ ID NO: 2000184 - RNA, 20 nt, Human
gugugagucaccaagcccag

SEQ ID NO: 2000185 - RNA, 15 nt, Human
gugugauauuucaga

SEQ ID NO: 2000186 - RNA, 17 nt, Human
gugugauauuucagaaa

SEQ ID NO: 2000187 - RNA, 17 nt, Human
gugugagugcauguacu

SEQ ID NO: 2000188 - RNA, 21 nt, Human
gugucucuugguccugcugca

SEQ ID NO: 2000189 - RNA, 20 nt, Human
gugucucuugguccugcugc

SEQ ID NO: 2000190 - RNA, 19 nt, Human
gugucucuugguccugcug

SEQ ID NO: 2000191 - RNA, 18 nt, Human
gugucucuugguccugcu

SEQ ID NO: 2000192 - RNA, 22 nt, Human
gugucucuugguccugcugcag

SEQ ID NO: 2000193 - RNA, 14 nt, Human
gugucuggcugcag

SEQ ID NO: 2000194 - RNA, 13 nt, Human
gugucugcccccu

SEQ ID NO: 2000195 - RNA, 23 nt, Human
gugauccacccaccucagccucc

SEQ ID NO: 2000196 - RNA, 24 nt, Human
gugauccacccaccucagccuccc

SEQ ID NO: 2000197 - RNA, 13 nt, Human
gugauuuuuguaa

SEQ ID NO: 2000198 - RNA, 18 nt, Human
gugauuuuuguaauuuuu

SEQ ID NO: 2000199 - RNA, 12 nt, Human
gugauuuucauu

SEQ ID NO: 2000200 - RNA, 13 nt, Human
gugauuuggaucu

SEQ ID NO: 2000201 - RNA, 16 nt, Human
gugauuuuaaaugugu

SEQ ID NO: 2000202 - RNA, 19 nt, Human
gugcaaacccacucagaga

SEQ ID NO: 2000203 - RNA, 12 nt, Human
gugcaaagccac

SEQ ID NO: 2000204 - RNA, 22 nt, Human
gugcacuaauguguaagacaaa

SEQ ID NO: 2000205 - RNA, 21 nt, Human
gugcaaaaggcuugcagaacu

SEQ ID NO: 2000206 - RNA, 18 nt, Human
gugcaaacccacucagag

SEQ ID NO: 2000207 - RNA, 18 nt, Human
gugcagacaaucuucugu

SEQ ID NO: 2000208 - RNA, 22 nt, Human
gugcagaacugcagucacugca

SEQ ID NO: 2000209 - RNA, 23 nt, Human
gugcagaagggagcuggcuccag

SEQ ID NO: 2000210 - RNA, 22 nt, Human
gugcauaccacuuuuguucuug

SEQ ID NO: 2000211 - RNA, 16 nt, Human
gugcaggcccacccug

SEQ ID NO: 2000212 - RNA, 19 nt, Human
gugcaggcccacccugcuu

SEQ ID NO: 2000213 - RNA, 13 nt, Human
gugcaucucagcc

SEQ ID NO: 2000214 - RNA, 14 nt, Human
gugccagcccagag

SEQ ID NO: 2000215 - RNA, 18 nt, Human
gugccagcccagaggccg

SEQ ID NO: 2000216 - RNA, 20 nt, Human
gugcaguggugcgaucuggg

SEQ ID NO: 2000217 - RNA, 23 nt, Human
gugcaguggugcgaucuggguuc

SEQ ID NO: 2000218 - RNA, 15 nt, Human
gugcaggagcgcucc

SEQ ID NO: 2000219 - RNA, 17 nt, Human
gugcaggagcgcucccu

SEQ ID NO: 2000220 - RNA, 11 nt, Human
gugcaggcagg

SEQ ID NO: 2000221 - RNA, 12 nt, Human
gugcaggcaggc

SEQ ID NO: 2000222 - RNA, 18 nt, Human
gugcaggcaggcuggccu

SEQ ID NO: 2000223 - RNA, 12 nt, Human
gugcaggcccac

SEQ ID NO: 2000224 - RNA, 13 nt, Human
gugcaggcccacc

SEQ ID NO: 2000225 - RNA, 14 nt, Human
gugcagcagggcag

SEQ ID NO: 2000226 - RNA, 14 nt, Human
gugcggccuuuggc

SEQ ID NO: 2000227 - RNA, 20 nt, Human
gugcgucaguccaagggguc

SEQ ID NO: 2000228 - RNA, 14 nt, Human
gugcgccuacagga

SEQ ID NO: 2000229 - RNA, 20 nt, Human
gugcuaaacguguauguuuu

SEQ ID NO: 2000230 - RNA, 14 nt, Human
gugcuaaacgugua

SEQ ID NO: 2000231 - RNA, 17 nt, Human
gugcuaaacguguaugu

SEQ ID NO: 2000232 - RNA, 20 nt, Human
gugcccaagaauagaugcug

SEQ ID NO: 2000233 - RNA, 21 nt, Human
gugccaggauggaaugauggg

SEQ ID NO: 2000234 - RNA, 14 nt, Human
gugccaucagugcc

SEQ ID NO: 2000235 - RNA, 14 nt, Human
gugccaugugccag

SEQ ID NO: 2000236 - RNA, 16 nt, Human
gugccaugugccaggu

SEQ ID NO: 2000237 - RNA, 14 nt, Human
gugccuuuugccau

SEQ ID NO: 2000238 - RNA, 21 nt, Human
gugcgaucuggguucacugca

SEQ ID NO: 2000239 - RNA, 15 nt, Human
gugccuucagcucua

SEQ ID NO: 2000240 - RNA, 15 nt, Human
gugcccgccaccaca

SEQ ID NO: 2000241 - RNA, 15 nt, Human
gugaggaugucuggg

SEQ ID NO: 2000242 - RNA, 16 nt, Human
gugagugguugaauau

SEQ ID NO: 2000243 - RNA, 17 nt, Human
gugaggaugaaaaaaua

SEQ ID NO: 2000244 - RNA, 18 nt, Human
gugaggagcuugaaaccc

SEQ ID NO: 2000245 - RNA, 19 nt, Human
gugagccgagaucacgcca

SEQ ID NO: 2000246 - RNA, 15 nt, Human
gugagccacugcacc

SEQ ID NO: 2000247 - RNA, 20 nt, Human
gugagccacugcaccgggcc

SEQ ID NO: 2000248 - RNA, 21 nt, Human
gugacuauggagcugagcagg

SEQ ID NO: 2000249 - RNA, 12 nt, Human
gugacuaggaaa

SEQ ID NO: 2000250 - RNA, 17 nt, Human
gugaguugauagcacag

SEQ ID NO: 2000251 - RNA, 15 nt, Human
gugauacaaugcugu

SEQ ID NO: 2000252 - RNA, 12 nt, Human
gugaguuuguuu

SEQ ID NO: 2000253 - RNA, 13 nt, Human
gugaguuuguuuc

SEQ ID NO: 2000254 - RNA, 15 nt, Human
gugaguuuguuucuu

SEQ ID NO: 2000255 - RNA, 17 nt, Human
gugaguuuguuucuuug

SEQ ID NO: 2000256 - RNA, 22 nt, Human
gugaguuuguuucuuugaauuu

SEQ ID NO: 2000257 - RNA, 12 nt, Human
gugauaaaauca

SEQ ID NO: 2000258 - RNA, 13 nt, Human
gugauaaaaucau

SEQ ID NO: 2000259 - RNA, 17 nt, Human
gugauacaaugcugugc

SEQ ID NO: 2000260 - RNA, 21 nt, Human
gugauaaaaucauaaguauuu

SEQ ID NO: 2000261 - RNA, 12 nt, Human
gugauauucccc

SEQ ID NO: 2000262 - RNA, 13 nt, Human
gugauauucuuug

SEQ ID NO: 2000263 - RNA, 20 nt, Human
gugauauucuuuguuaauuu

SEQ ID NO: 2000264 - RNA, 16 nt, Human
gugauauaaacagcuu

SEQ ID NO: 2000265 - RNA, 19 nt, Human
gugauauaaguguguguuu

SEQ ID NO: 2000266 - RNA, 13 nt, Human
gugaucaaagcca

SEQ ID NO: 2000267 - RNA, 22 nt, Human
gugauauucuuuguuaauuugg

SEQ ID NO: 2000268 - RNA, 23 nt, Human
gugauauucuuuguuaauuugga

SEQ ID NO: 2000269 - RNA, 13 nt, Human
gugauauuucaga

SEQ ID NO: 2000270 - RNA, 17 nt, Human
gugauauuucagaaaua

SEQ ID NO: 2000271 - RNA, 18 nt, Human
gugauauuucagaaauac

SEQ ID NO: 2000272 - RNA, 22 nt, Human
gugauccacccaccucagccuc

SEQ ID NO: 2000273 - RNA, 14 nt, Human
gugaucacuuucug

SEQ ID NO: 2000274 - RNA, 23 nt, Human
gugaucacuuucugaaauucaca

SEQ ID NO: 2000275 - RNA, 12 nt, Human
gugacagaggca

SEQ ID NO: 2000276 - RNA, 13 nt, Human
gugacagaggcag

SEQ ID NO: 2000277 - RNA, 14 nt, Human
gugacagaggcagc

SEQ ID NO: 2000278 - RNA, 12 nt, Human
gugaccucugcc

SEQ ID NO: 2000279 - RNA, 15 nt, Human
gugacagaggcagcc

SEQ ID NO: 2000280 - RNA, 13 nt, Human
gugaccucugccu

SEQ ID NO: 2000281 - RNA, 14 nt, Human
gugaccucugccug

SEQ ID NO: 2000282 - RNA, 13 nt, Human
gugacgguuccua

SEQ ID NO: 2000283 - RNA, 24 nt, Human
gugacgguuccuacacaggacagg

SEQ ID NO: 2000284 - RNA, 21 nt, Human
gugaccuuccaagagccugag

SEQ ID NO: 2000285 - RNA, 22 nt, Human
gugaccuuccaagagccugaga

SEQ ID NO: 2000286 - RNA, 15 nt, Human
gugaccucugccuga

SEQ ID NO: 2000287 - RNA, 21 nt, Human
gugaacaaauuuacagagaca

SEQ ID NO: 2000288 - RNA, 18 nt, Human
gugaaauuuuucauauuu

SEQ ID NO: 2000289 - RNA, 13 nt, Human
gugaaauuuuuca

SEQ ID NO: 2000290 - RNA, 14 nt, Human
gugaaauuuuucau

SEQ ID NO: 2000291 - RNA, 18 nt, Human
gugaaaaaaaaaaugcug

SEQ ID NO: 2000292 - RNA, 18 nt, Human
gugaaaaauguuaggaca

SEQ ID NO: 2000293 - RNA, 21 nt, Human
gucuuuuuuuuuuaagugaaa

SEQ ID NO: 2000294 - RNA, 23 nt, Human
gucuuuuuuuuuuaagugaaauu

SEQ ID NO: 2000295 - RNA, 14 nt, Human
gugaaaaaaaaaau

SEQ ID NO: 2000296 - RNA, 15 nt, Human
gugaaaaaaaaaaug

SEQ ID NO: 2000297 - RNA, 20 nt, Human
gugacaaggauugcuacugu

SEQ ID NO: 2000298 - RNA, 21 nt, Human
gugaaugaugauccuaggcau

SEQ ID NO: 2000299 - RNA, 13 nt, Human
gucugccuggagg

SEQ ID NO: 2000300 - RNA, 15 nt, Human
gucugcccccuccug

SEQ ID NO: 2000301 - RNA, 18 nt, Human
gucugccccaaguuuugu

SEQ ID NO: 2000302 - RNA, 19 nt, Human
gucugccccaaguuuugug

SEQ ID NO: 2000303 - RNA, 22 nt, Human
gucugccccaaguuuugugaaa

SEQ ID NO: 2000304 - RNA, 22 nt, Human
gucugugagaugcuagaacucc

SEQ ID NO: 2000305 - RNA, 23 nt, Human
gucugugagaugcuagaacuccc

SEQ ID NO: 2000306 - RNA, 18 nt, Human
gucugugccauuuuguau

SEQ ID NO: 2000307 - RNA, 15 nt, Human
gucugugagaugcua

SEQ ID NO: 2000308 - RNA, 16 nt, Human
gucugugagaugcuag

SEQ ID NO: 2000309 - RNA, 17 nt, Human
gucugugagaugcuaga

SEQ ID NO: 2000310 - RNA, 21 nt, Human
gucugugagaugcuagaacuc

SEQ ID NO: 2000311 - RNA, 11 nt, Human
gucuguguguu

SEQ ID NO: 2000312 - RNA, 21 nt, Human
gucuguguguuuaugugugug

SEQ ID NO: 2000313 - RNA, 22 nt, Human
gucuguguguuuaugugugugu

SEQ ID NO: 2000314 - RNA, 20 nt, Human
gucuguguuccaaccacuga

SEQ ID NO: 2000315 - RNA, 11 nt, Human
gucugugugug

SEQ ID NO: 2000316 - RNA, 12 nt, Human
gucugugugugu

SEQ ID NO: 2000317 - RNA, 16 nt, Human
gucuguguguguguau

SEQ ID NO: 2000318 - RNA, 20 nt, Human
gucuguguguguguaugugg

SEQ ID NO: 2000319 - RNA, 14 nt, Human
gucuguucuuucca

SEQ ID NO: 2000320 - RNA, 17 nt, Human
gucuguucuuuccaaag

SEQ ID NO: 2000321 - RNA, 13 nt, Human
gucuguugauuaa

SEQ ID NO: 2000322 - RNA, 16 nt, Human
gucuguugauuaaaga

SEQ ID NO: 2000323 - RNA, 19 nt, Human
gucuguugauuaaagauga

SEQ ID NO: 2000324 - RNA, 21 nt, Human
gucuugaacuccuggccucaa

SEQ ID NO: 2000325 - RNA, 18 nt, Human
gucuugaacuccuggccu

SEQ ID NO: 2000326 - RNA, 20 nt, Human
gucuugaacuccuggccuca

SEQ ID NO: 2000327 - RNA, 16 nt, Human
gucuugcaauggcagc

SEQ ID NO: 2000328 - RNA, 17 nt, Human
gucuugcaauggcagcc

SEQ ID NO: 2000329 - RNA, 18 nt, Human
gucuugcaauggcagccu

SEQ ID NO: 2000330 - RNA, 19 nt, Human
gucuugcaauggcagccuu

SEQ ID NO: 2000331 - RNA, 21 nt, Human
gucuuaaaaaguggaaaaaua

SEQ ID NO: 2000332 - RNA, 16 nt, Human
gucuugaacuccuggc

SEQ ID NO: 2000333 - RNA, 17 nt, Human
gucuugaacuccuggcc

SEQ ID NO: 2000334 - RNA, 12 nt, Human
gucuucugcuuu

SEQ ID NO: 2000335 - RNA, 13 nt, Human
gucuucugcuuug

SEQ ID NO: 2000336 - RNA, 14 nt, Human
gucuucugcuuugu

SEQ ID NO: 2000337 - RNA, 22 nt, Human
gucuucugcuuuguugugugcc

SEQ ID NO: 2000338 - RNA, 15 nt, Human
gucuugccuauauuu

SEQ ID NO: 2000339 - RNA, 23 nt, Human
gucuugcaauggcagccuuggca

SEQ ID NO: 2000340 - RNA, 20 nt, Human
gucuugcaauggcagccuug

SEQ ID NO: 2000341 - RNA, 21 nt, Human
gucuugcaauggcagccuugg

SEQ ID NO: 2000342 - RNA, 17 nt, Human
gucuugguuccagccug

SEQ ID NO: 2000343 - RNA, 19 nt, Human
gucuugguuccagccugcc

SEQ ID NO: 2000344 - RNA, 16 nt, Human
gucuuuuuucacuaca

SEQ ID NO: 2000345 - RNA, 16 nt, Human
gucuugguuccagccu

SEQ ID NO: 2000346 - RNA, 16 nt, Human
gucgggcaugacacga

SEQ ID NO: 2000347 - RNA, 11 nt, Human
gucggcuccag

SEQ ID NO: 2000348 - RNA, 12 nt, Human
gucggcuccagu

SEQ ID NO: 2000349 - RNA, 22 nt, Human
gucggcuccaguccccagaacu

SEQ ID NO: 2000350 - RNA, 21 nt, Human
gucggaaaacaugcuacacac

SEQ ID NO: 2000351 - RNA, 19 nt, Human
guccuuaccagcagagcac

SEQ ID NO: 2000352 - RNA, 18 nt, Human
guccuuaccagcagagca

SEQ ID NO: 2000353 - RNA, 21 nt, Human
guccuuaccagcagagcaccu

SEQ ID NO: 2000354 - RNA, 14 nt, Human
gucccugccaaugg

SEQ ID NO: 2000355 - RNA, 11 nt, Human
gucccugccaa

SEQ ID NO: 2000356 - RNA, 15 nt, Human
gucccugccaaugga

SEQ ID NO: 2000357 - RNA, 18 nt, Human
gucucacuauguugccca

SEQ ID NO: 2000358 - RNA, 22 nt, Human
gucucaccauuuccccagggca

SEQ ID NO: 2000359 - RNA, 23 nt, Human
gucucaccauuuccccagggcac

SEQ ID NO: 2000360 - RNA, 18 nt, Human
gucucaccauuuccccag

SEQ ID NO: 2000361 - RNA, 19 nt, Human
gucucaccauuuccccagg

SEQ ID NO: 2000362 - RNA, 20 nt, Human
gucucaccauuuccccaggg

SEQ ID NO: 2000363 - RNA, 21 nt, Human
gucucaccauuuccccagggc

SEQ ID NO: 2000364 - RNA, 11 nt, Human
gucucacucug

SEQ ID NO: 2000365 - RNA, 19 nt, Human
gucucacuauguugcccag

SEQ ID NO: 2000366 - RNA, 15 nt, Human
gucucaccauuuccc

SEQ ID NO: 2000367 - RNA, 18 nt, Human
gucuaagaaacauuggaa

SEQ ID NO: 2000368 - RNA, 19 nt, Human
gucuaagaaacauuggaag

SEQ ID NO: 2000369 - RNA, 15 nt, Human
gucuaaauuuauuau

SEQ ID NO: 2000370 - RNA, 22 nt, Human
gucuaaccacagcuccuuuucc

SEQ ID NO: 2000371 - RNA, 14 nt, Human
gucuaagaaacauu

SEQ ID NO: 2000372 - RNA, 15 nt, Human
gucuaagaaacauug

SEQ ID NO: 2000373 - RNA, 18 nt, Human
gucgucaaagcugaaaug

SEQ ID NO: 2000374 - RNA, 15 nt, Human
gucguaguuacucuc

SEQ ID NO: 2000375 - RNA, 14 nt, Human
gucucuagugcugu

SEQ ID NO: 2000376 - RNA, 16 nt, Human
gucucuagugcuguga

SEQ ID NO: 2000377 - RNA, 17 nt, Human
gucucuagugcugugaa

SEQ ID NO: 2000378 - RNA, 18 nt, Human
gucucuagugcugugaaa

SEQ ID NO: 2000379 - RNA, 15 nt, Human
gucucacucugucgc

SEQ ID NO: 2000380 - RNA, 16 nt, Human
gucucacucugucgcc

SEQ ID NO: 2000381 - RNA, 18 nt, Human
gucucacucugucgccca

SEQ ID NO: 2000382 - RNA, 19 nt, Human
gucucacucugucgcccag

SEQ ID NO: 2000383 - RNA, 22 nt, Human
gucucacucugucgcccagucu

SEQ ID NO: 2000384 - RNA, 17 nt, Human
gucucuggaauuugaaa

SEQ ID NO: 2000385 - RNA, 13 nt, Human
gucucugagcauu

SEQ ID NO: 2000386 - RNA, 21 nt, Human
gucucuggauuauauuaugaa

SEQ ID NO: 2000387 - RNA, 18 nt, Human
gucucuucuccacuggau

SEQ ID NO: 2000388 - RNA, 13 nt, Human
gucucuucuccuu

SEQ ID NO: 2000389 - RNA, 16 nt, Human
gucucugguuccuccc

SEQ ID NO: 2000390 - RNA, 17 nt, Human
gucucugguuccucccc

SEQ ID NO: 2000391 - RNA, 14 nt, Human
gucucuucuccuua

SEQ ID NO: 2000392 - RNA, 19 nt, Human
guauuuuguuuuugucuua

SEQ ID NO: 2000393 - RNA, 15 nt, Human
gucaagugaaaaagg

SEQ ID NO: 2000394 - RNA, 21 nt, Human
gucaauaauuauuugucucag

SEQ ID NO: 2000395 - RNA, 15 nt, Human
gucaaugcagccccc

SEQ ID NO: 2000396 - RNA, 18 nt, Human
gucaaugaacaagcauuc

SEQ ID NO: 2000397 - RNA, 21 nt, Human
guauuuugugaguuuguuucu

SEQ ID NO: 2000398 - RNA, 23 nt, Human
guauuuuaguggacccugaaaug

SEQ ID NO: 2000399 - RNA, 14 nt, Human
guauuuuacuaaua

SEQ ID NO: 2000400 - RNA, 16 nt, Human
guauuaagauuauaau

SEQ ID NO: 2000401 - RNA, 23 nt, Human
guauuaagauuauaauuguugca

SEQ ID NO: 2000402 - RNA, 13 nt, Human
guauuuuaaucac

SEQ ID NO: 2000403 - RNA, 15 nt, Human
guauuaauucucuuu

SEQ ID NO: 2000404 - RNA, 18 nt, Human
gucaccccggccaccugc

SEQ ID NO: 2000405 - RNA, 17 nt, Human
gucaccccggccaccug

SEQ ID NO: 2000406 - RNA, 22 nt, Human
gucaccccggccaccugcggug

SEQ ID NO: 2000407 - RNA, 14 nt, Human
gucacuaccuggcu

SEQ ID NO: 2000408 - RNA, 16 nt, Human
gucacuaccuggcugc

SEQ ID NO: 2000409 - RNA, 17 nt, Human
gucacuaccuggcugcg

SEQ ID NO: 2000410 - RNA, 16 nt, Human
gucacucuggcagcuc

SEQ ID NO: 2000411 - RNA, 14 nt, Human
gucacucuggcagc

SEQ ID NO: 2000412 - RNA, 13 nt, Human
gucacucuggcag

SEQ ID NO: 2000413 - RNA, 12 nt, Human
gucacucuggca

SEQ ID NO: 2000414 - RNA, 19 nt, Human
gucacucuggcagcucaga

SEQ ID NO: 2000415 - RNA, 17 nt, Human
gucacucuggcagcuca

SEQ ID NO: 2000416 - RNA, 22 nt, Human
gucacucuggcagcucagagag

SEQ ID NO: 2000417 - RNA, 15 nt, Human
gucagagccugcagu

SEQ ID NO: 2000418 - RNA, 16 nt, Human
gucagagccugcaguu

SEQ ID NO: 2000419 - RNA, 14 nt, Human
gucagagccugcag

SEQ ID NO: 2000420 - RNA, 18 nt, Human
gucagauguuuaaaacac

SEQ ID NO: 2000421 - RNA, 19 nt, Human
gucagauguuuaaaacacc

SEQ ID NO: 2000422 - RNA, 22 nt, Human
gucagaugcugugcaaauguua

SEQ ID NO: 2000423 - RNA, 13 nt, Human
gucagauguuuaa

SEQ ID NO: 2000424 - RNA, 15 nt, Human
gucagauguuuaaaa

SEQ ID NO: 2000425 - RNA, 17 nt, Human
gucagauguuuaaaaca

SEQ ID NO: 2000426 - RNA, 20 nt, Human
gucccuaauaaagcugugug

SEQ ID NO: 2000427 - RNA, 18 nt, Human
gucccuaauaaagcugug

SEQ ID NO: 2000428 - RNA, 21 nt, Human
gucccuaccgagucucuucuc

SEQ ID NO: 2000429 - RNA, 22 nt, Human
gucccuaccgagucucuucucc

SEQ ID NO: 2000430 - RNA, 23 nt, Human
gucccuaccgagucucuucucca

SEQ ID NO: 2000431 - RNA, 18 nt, Human
gucccugaggcagguccc

SEQ ID NO: 2000432 - RNA, 16 nt, Human
gucccugaagagaagg

SEQ ID NO: 2000433 - RNA, 22 nt, Human
gucccugaggcagguccccaga

SEQ ID NO: 2000434 - RNA, 16 nt, Human
gucccugcacuugcag

SEQ ID NO: 2000435 - RNA, 19 nt, Human
gucccugcacuugcagacu

SEQ ID NO: 2000436 - RNA, 21 nt, Human
gucccugcacuugcagacucu

SEQ ID NO: 2000437 - RNA, 17 nt, Human
guccccaccgcagacag

SEQ ID NO: 2000438 - RNA, 17 nt, Human
guccccaccaucugcug

SEQ ID NO: 2000439 - RNA, 18 nt, Human
guccccaccaucugcugu

SEQ ID NO: 2000440 - RNA, 20 nt, Human
guccccaccaucugcugucu

SEQ ID NO: 2000441 - RNA, 17 nt, Human
gucccuaauaaagcugu

SEQ ID NO: 2000442 - RNA, 16 nt, Human
gucccuaauaaagcug

SEQ ID NO: 2000443 - RNA, 13 nt, Human
guccccaccaucu

SEQ ID NO: 2000444 - RNA, 15 nt, Human
guccccaccaucugc

SEQ ID NO: 2000445 - RNA, 16 nt, Human
guccccaccaucugcu

SEQ ID NO: 2000446 - RNA, 21 nt, Human
gucccaugugagcugcugcca

SEQ ID NO: 2000447 - RNA, 22 nt, Human
gucccaugugagcugcugccau

SEQ ID NO: 2000448 - RNA, 17 nt, Human
gucccaugugagcugcu

SEQ ID NO: 2000449 - RNA, 18 nt, Human
gucccaugugagcugcug

SEQ ID NO: 2000450 - RNA, 20 nt, Human
gucccaugugagcugcugcc

SEQ ID NO: 2000451 - RNA, 20 nt, Human
gucccaccuuggcugcaggg

SEQ ID NO: 2000452 - RNA, 23 nt, Human
gucccaccuuggcugcagggagu

SEQ ID NO: 2000453 - RNA, 15 nt, Human
gucccaggcugagcc

SEQ ID NO: 2000454 - RNA, 16 nt, Human
gucccaggcugagccu

SEQ ID NO: 2000455 - RNA, 17 nt, Human
gucccaggcugagccuc

SEQ ID NO: 2000456 - RNA, 21 nt, Human
gucccaggcugagccucaguc

SEQ ID NO: 2000457 - RNA, 18 nt, Human
gucccaggcugagccuca

SEQ ID NO: 2000458 - RNA, 19 nt, Human
gucccaggcugagccucag

SEQ ID NO: 2000459 - RNA, 23 nt, Human
gucauuguaauguugugaauaau

SEQ ID NO: 2000460 - RNA, 22 nt, Human
gucauugcuucuucugaggccu

SEQ ID NO: 2000461 - RNA, 12 nt, Human
gucauuguaaug

SEQ ID NO: 2000462 - RNA, 13 nt, Human
gucauuguaaugu

SEQ ID NO: 2000463 - RNA, 21 nt, Human
gucauuguaauguugugaaua

SEQ ID NO: 2000464 - RNA, 12 nt, Human
gucauugcuucu

SEQ ID NO: 2000465 - RNA, 13 nt, Human
gucauugcuucuu

SEQ ID NO: 2000466 - RNA, 14 nt, Human
gucauugcuucuuc

SEQ ID NO: 2000467 - RNA, 15 nt, Human
gucauugcuucuucu

SEQ ID NO: 2000468 - RNA, 16 nt, Human
gucauugcuucuucug

SEQ ID NO: 2000469 - RNA, 21 nt, Human
gucauucgcuacuaugauuua

SEQ ID NO: 2000470 - RNA, 21 nt, Human
gucauucagauaugauucaaa

SEQ ID NO: 2000471 - RNA, 17 nt, Human
gucauuauguuaauauu

SEQ ID NO: 2000472 - RNA, 19 nt, Human
gucauuauguuaauauuuc

SEQ ID NO: 2000473 - RNA, 22 nt, Human
gucagcuguuucuagaguuccu

SEQ ID NO: 2000474 - RNA, 21 nt, Human
gucccaccuuggcugcaggga

SEQ ID NO: 2000475 - RNA, 23 nt, Human
guccaguaagaucacuguuuaga

SEQ ID NO: 2000476 - RNA, 22 nt, Human
guccagguggagguggcauccc

SEQ ID NO: 2000477 - RNA, 14 nt, Human
guccaguaagauca

SEQ ID NO: 2000478 - RNA, 18 nt, Human
guccaguaagaucacugu

SEQ ID NO: 2000479 - RNA, 19 nt, Human
guccaguaagaucacuguu

SEQ ID NO: 2000480 - RNA, 20 nt, Human
guccaguaagaucacuguuu

SEQ ID NO: 2000481 - RNA, 21 nt, Human
guccaguaagaucacuguuua

SEQ ID NO: 2000482 - RNA, 23 nt, Human
guccacccaggagccccgaggcc

SEQ ID NO: 2000483 - RNA, 11 nt, Human
guccacccgcc

SEQ ID NO: 2000484 - RNA, 18 nt, Human
guccacccgccccugccc

SEQ ID NO: 2000485 - RNA, 12 nt, Human
guccacccagga

SEQ ID NO: 2000486 - RNA, 13 nt, Human
guccacccaggag

SEQ ID NO: 2000487 - RNA, 16 nt, Human
guccacgugcguguuu

SEQ ID NO: 2000488 - RNA, 23 nt, Human
guccacgugcguguuuucugacu

SEQ ID NO: 2000489 - RNA, 13 nt, Human
guccacuggggug

SEQ ID NO: 2000490 - RNA, 21 nt, Human
guccacugggguggccugacu

SEQ ID NO: 2000491 - RNA, 13 nt, Human
guccagagcugcu

SEQ ID NO: 2000492 - RNA, 16 nt, Human
guccagagcugcuucc

SEQ ID NO: 2000493 - RNA, 17 nt, Human
guccagagcugcuuccc

SEQ ID NO: 2000494 - RNA, 21 nt, Human
guagccaccugaguuccugag

SEQ ID NO: 2000495 - RNA, 21 nt, Human
guagcauuuguguugaagagg

SEQ ID NO: 2000496 - RNA, 19 nt, Human
guagcccccucuucccugg

SEQ ID NO: 2000497 - RNA, 15 nt, Human
guagcccccucuucc

SEQ ID NO: 2000498 - RNA, 23 nt, Human
guagggcgggaggauguucuggg

SEQ ID NO: 2000499 - RNA, 18 nt, Human
guagggcucugacaaagc

SEQ ID NO: 2000500 - RNA, 21 nt, Human
guagggcgggaggauguucug

SEQ ID NO: 2000501 - RNA, 22 nt, Human
guagggcgggaggauguucugg

SEQ ID NO: 2000502 - RNA, 16 nt, Human
guagggcgggaggaug

SEQ ID NO: 2000503 - RNA, 16 nt, Human
guagcauccuggaaua

SEQ ID NO: 2000504 - RNA, 12 nt, Human
guagcacaggcu

SEQ ID NO: 2000505 - RNA, 14 nt, Human
guagcacaggcuga

SEQ ID NO: 2000506 - RNA, 20 nt, Human
guagcacaggcugagugcag

SEQ ID NO: 2000507 - RNA, 23 nt, Human
guagcaaacccugucaaacauua

SEQ ID NO: 2000508 - RNA, 17 nt, Human
guagcaaaugagacagc

SEQ ID NO: 2000509 - RNA, 22 nt, Human
guagauuccauuuacugcauuc

SEQ ID NO: 2000510 - RNA, 12 nt, Human
guagauuuauuu

SEQ ID NO: 2000511 - RNA, 16 nt, Human
guagauuuauuucauc

SEQ ID NO: 2000512 - RNA, 18 nt, Human
guagcaaacccugucaaa

SEQ ID NO: 2000513 - RNA, 20 nt, Human
guagcaaacccugucaaaca

SEQ ID NO: 2000514 - RNA, 21 nt, Human
guagcaaacccugucaaacau

SEQ ID NO: 2000515 - RNA, 19 nt, Human
guagauuuauuucaucaua

SEQ ID NO: 2000516 - RNA, 21 nt, Human
guagauuuauuucaucauauu

SEQ ID NO: 2000517 - RNA, 12 nt, Human
guagauuugauu

SEQ ID NO: 2000518 - RNA, 16 nt, Human
guagauuugauuuuuu

SEQ ID NO: 2000519 - RNA, 21 nt, Human
guagauauccucugcuuaaaa

SEQ ID NO: 2000520 - RNA, 15 nt, Human
guagagugugccuga

SEQ ID NO: 2000521 - RNA, 14 nt, Human
guagucggcacagc

SEQ ID NO: 2000522 - RNA, 19 nt, Human
guagugaagacuccagaaa

SEQ ID NO: 2000523 - RNA, 17 nt, Human
guauaauucacauugua

SEQ ID NO: 2000524 - RNA, 17 nt, Human
guaguguucagaaaaaa

SEQ ID NO: 2000525 - RNA, 22 nt, Human
guauaauucacccaccagacuu

SEQ ID NO: 2000526 - RNA, 12 nt, Human
guauaauugugu

SEQ ID NO: 2000527 - RNA, 14 nt, Human
guauaauuguguga

SEQ ID NO: 2000528 - RNA, 21 nt, Human
guauaauugugugauauuuca

SEQ ID NO: 2000529 - RNA, 23 nt, Human
guauaauugugugauauuucaga

SEQ ID NO: 2000530 - RNA, 14 nt, Human
guagguugggagaa

SEQ ID NO: 2000531 - RNA, 14 nt, Human
guagucaggugccu

SEQ ID NO: 2000532 - RNA, 22 nt, Human
guaguaugauagguuauuuuga

SEQ ID NO: 2000533 - RNA, 16 nt, Human
guaggguuauaauaau

SEQ ID NO: 2000534 - RNA, 17 nt, Human
guagggugggccuucag

SEQ ID NO: 2000535 - RNA, 22 nt, Human
guagggugggccuucagggagu

SEQ ID NO: 2000536 - RNA, 14 nt, Human
guagggugggccuu

SEQ ID NO: 2000537 - RNA, 15 nt, Human
guagggguggcccga

SEQ ID NO: 2000538 - RNA, 18 nt, Human
guagggguaccacugaau

SEQ ID NO: 2000539 - RNA, 13 nt, Human
guaggggaagaau

SEQ ID NO: 2000540 - RNA, 18 nt, Human
guaggggcuuagaggcau

SEQ ID NO: 2000541 - RNA, 14 nt, Human
guauaguuauguaa

SEQ ID NO: 2000542 - RNA, 15 nt, Human
guauaguuauguaaa

SEQ ID NO: 2000543 - RNA, 13 nt, Human
guauaguauuuga

SEQ ID NO: 2000544 - RNA, 14 nt, Human
guauaguauuugaa

SEQ ID NO: 2000545 - RNA, 15 nt, Human
guauaguauuugaaa

SEQ ID NO: 2000546 - RNA, 16 nt, Human
guauaguauuugaaaa

SEQ ID NO: 2000547 - RNA, 17 nt, Human
guauaguauuugaaaac

SEQ ID NO: 2000548 - RNA, 18 nt, Human
guauaguauuugaaaaca

SEQ ID NO: 2000549 - RNA, 21 nt, Human
guauaguauuugaaaacagaa

SEQ ID NO: 2000550 - RNA, 18 nt, Human
guauaguuauguaaauaa

SEQ ID NO: 2000551 - RNA, 17 nt, Human
guauagaagucuucaug

SEQ ID NO: 2000552 - RNA, 18 nt, Human
guauagaagucuucauga

SEQ ID NO: 2000553 - RNA, 21 nt, Human
guauagaagucuucaugaaau

SEQ ID NO: 2000554 - RNA, 23 nt, Human
guauagaagucuucaugaaaugc

SEQ ID NO: 2000555 - RNA, 16 nt, Human
guauagacaggagaag

SEQ ID NO: 2000556 - RNA, 21 nt, Human
guauagacaggagaagaaaga

SEQ ID NO: 2000557 - RNA, 13 nt, Human
guauaucauucua

SEQ ID NO: 2000558 - RNA, 17 nt, Human
guauaucauucuaaaga

SEQ ID NO: 2000559 - RNA, 19 nt, Human
guauaucauucuaaagaua

SEQ ID NO: 2000560 - RNA, 14 nt, Human
guauauccuuuucu

SEQ ID NO: 2000561 - RNA, 20 nt, Human
guauauccuuuucuguguuu

SEQ ID NO: 2000562 - RNA, 22 nt, Human
guauaugucaagccauaauugu

SEQ ID NO: 2000563 - RNA, 15 nt, Human
guauauggugguaau

SEQ ID NO: 2000564 - RNA, 18 nt, Human
guauauggugguaauaag

SEQ ID NO: 2000565 - RNA, 13 nt, Human
guauaugucucag

SEQ ID NO: 2000566 - RNA, 15 nt, Human
guauaugucucaggu

SEQ ID NO: 2000567 - RNA, 21 nt, Human
guauaugucucaggucccugc

SEQ ID NO: 2000568 - RNA, 16 nt, Human
guauauguugggugca

SEQ ID NO: 2000569 - RNA, 22 nt, Human
guauccuuaucuaguguuugau

SEQ ID NO: 2000570 - RNA, 17 nt, Human
guaucguauucaccuuc

SEQ ID NO: 2000571 - RNA, 19 nt, Human
guaucuggugacuuuccuc

SEQ ID NO: 2000572 - RNA, 12 nt, Human
guaucuggugac

SEQ ID NO: 2000573 - RNA, 12 nt, Human
guaucugagcag

SEQ ID NO: 2000574 - RNA, 22 nt, Human
guaugaaagauggcugugccuc

SEQ ID NO: 2000575 - RNA, 23 nt, Human
guaugaaagauggcugugccucu

SEQ ID NO: 2000576 - RNA, 13 nt, Human
guaugaaaacaug

SEQ ID NO: 2000577 - RNA, 17 nt, Human
guaugaaaacauggaac

SEQ ID NO: 2000578 - RNA, 20 nt, Human
guaugaaaacauggaacagu

SEQ ID NO: 2000579 - RNA, 15 nt, Human
guaucugugaacuga

SEQ ID NO: 2000580 - RNA, 13 nt, Human
guaucugucuuuc

SEQ ID NO: 2000581 - RNA, 15 nt, Human
guaucugucuuucca

SEQ ID NO: 2000582 - RNA, 19 nt, Human
guaucugucuuuccacucu

SEQ ID NO: 2000583 - RNA, 20 nt, Human
guaucugucuuuccacucug

SEQ ID NO: 2000584 - RNA, 22 nt, Human
guaucugucuuuccacucugga

SEQ ID NO: 2000585 - RNA, 23 nt, Human
guaucugucuuuccacucuggau

SEQ ID NO: 2000586 - RNA, 12 nt, Human
guaucugugaac

SEQ ID NO: 2000587 - RNA, 13 nt, Human
guaugaggcauuu

SEQ ID NO: 2000588 - RNA, 15 nt, Human
guaugaggcauuugu

SEQ ID NO: 2000589 - RNA, 15 nt, Human
guaugaaucuauuug

SEQ ID NO: 2000590 - RNA, 18 nt, Human
guaugaauaaagacaccu

SEQ ID NO: 2000591 - RNA, 19 nt, Human
guaugaauaaagacaccua

SEQ ID NO: 2000592 - RNA, 21 nt, Human
guaugaucacggcucacugca

SEQ ID NO: 2000593 - RNA, 13 nt, Human
guauguguuuaga

SEQ ID NO: 2000594 - RNA, 17 nt, Human
guaugaggcauuuguuu

SEQ ID NO: 2000595 - RNA, 20 nt, Human
guaugaggcauuuguuugaa

SEQ ID NO: 2000596 - RNA, 20 nt, Human
guaugaucacggcucacugc

SEQ ID NO: 2000597 - RNA, 24 nt, Human
guaugauagguuauuuugauguaa

SEQ ID NO: 2000598 - RNA, 18 nt, Human
guauguuuuucaguucaa

SEQ ID NO: 2000599 - RNA, 20 nt, Human
guauguuuuucaguucaaag

SEQ ID NO: 2000600 - RNA, 21 nt, Human
guauguuuuucaguucaaagu

SEQ ID NO: 2000601 - RNA, 15 nt, Human
guauuaaauuacauu

SEQ ID NO: 2000602 - RNA, 18 nt, Human
guauuaaauuacauuugu

SEQ ID NO: 2000603 - RNA, 21 nt, Human
guauuaaauuacauuuguaau

SEQ ID NO: 2000604 - RNA, 22 nt, Human
guauuaaauuacauuuguaauu

SEQ ID NO: 2000605 - RNA, 17 nt, Human
guauguugaagccuuug

SEQ ID NO: 2000606 - RNA, 18 nt, Human
guauguguuuagaauuga

SEQ ID NO: 2000607 - RNA, 22 nt, Human
guauguguuuagaauugaaggu

SEQ ID NO: 2000608 - RNA, 13 nt, Human
guauguuuuucag

SEQ ID NO: 2000609 - RNA, 14 nt, Human
guauguuuuucagu

SEQ ID NO: 2000610 - RNA, 21 nt, Human
uuuuaaugcuaaucuugugaa

SEQ ID NO: 2000611 - RNA, 19 nt, Human
uuuuaauguaauugauugu

SEQ ID NO: 2000612 - RNA, 21 nt, Human
uuuuaaucucuaacaguggac

SEQ ID NO: 2000613 - RNA, 18 nt, Human
uuuuaaucuacugcauuu

SEQ ID NO: 2000614 - RNA, 16 nt, Human
uuuuaaugauuguuua

SEQ ID NO: 2000615 - RNA, 17 nt, Human
uuuuaaugauuguuuaa

SEQ ID NO: 2000616 - RNA, 16 nt, Human
uuuuaacaagaagcaa

SEQ ID NO: 2000617 - RNA, 14 nt, Human
uuuuaaagaauuuc

SEQ ID NO: 2000618 - RNA, 15 nt, Human
uuuuaaagacuugca

SEQ ID NO: 2000619 - RNA, 11 nt, Human
uuuuaaaugca

SEQ ID NO: 2000620 - RNA, 12 nt, Human
uuuuaaaugcac

SEQ ID NO: 2000621 - RNA, 21 nt, Human
uuuuaaaugcaccuggaauau

SEQ ID NO: 2000622 - RNA, 14 nt, Human
uuuuaaaugcaguu

SEQ ID NO: 2000623 - RNA, 20 nt, Human
uuuuaaaugcaguuacaaau

SEQ ID NO: 2000624 - RNA, 20 nt, Human
uuuuaaaugugugagugcau

SEQ ID NO: 2000625 - RNA, 22 nt, Human
uuuuaaaugugugagugcaugu

SEQ ID NO: 2000626 - RNA, 19 nt, Human
uuuuaaauuauguuuuacu

SEQ ID NO: 2000627 - RNA, 20 nt, Human
uuuuaaaagaugcaauguag

SEQ ID NO: 2000628 - RNA, 13 nt, Human
uuuuaaaagccuu

SEQ ID NO: 2000629 - RNA, 18 nt, Human
uuuuaaaagccuuggccu

SEQ ID NO: 2000630 - RNA, 23 nt, Human
uuuuaaaagccuuggccucagag

SEQ ID NO: 2000631 - RNA, 16 nt, Human
uuuguugaaagaaagu

SEQ ID NO: 2000632 - RNA, 15 nt, Human
uuuguugaacuguua

SEQ ID NO: 2000633 - RNA, 17 nt, Human
uuuuaaagaaugcucuu

SEQ ID NO: 2000634 - RNA, 18 nt, Human
uuuuaaagacuuuuauga

SEQ ID NO: 2000635 - RNA, 12 nt, Human
uuuguaugcaag

SEQ ID NO: 2000636 - RNA, 21 nt, Human
uuuguaugcaagcaguuucaa

SEQ ID NO: 2000637 - RNA, 23 nt, Human
uuuguaugaaaacauggaacagu

SEQ ID NO: 2000638 - RNA, 15 nt, Human
uuuguaugaaaacau

SEQ ID NO: 2000639 - RNA, 23 nt, Human
uuuguaugcaagcaguuucaaua

SEQ ID NO: 2000640 - RNA, 21 nt, Human
uuuguucuggcucuuccaggc

SEQ ID NO: 2000641 - RNA, 14 nt, Human
uuuguaaaaaugua

SEQ ID NO: 2000642 - RNA, 14 nt, Human
uuuguauaguuaug

SEQ ID NO: 2000643 - RNA, 16 nt, Human
uuuguauaguuaugua

SEQ ID NO: 2000644 - RNA, 17 nt, Human
uuuguauaguuauguaa

SEQ ID NO: 2000645 - RNA, 19 nt, Human
uuuguauaguuauguaaau

SEQ ID NO: 2000646 - RNA, 21 nt, Human
uuuguauaguuauguaaauaa

SEQ ID NO: 2000647 - RNA, 22 nt, Human
uuuguauaguuauguaaauaau

SEQ ID NO: 2000648 - RNA, 13 nt, Human
uuuguaugaaaac

SEQ ID NO: 2000649 - RNA, 18 nt, Human
uuuguauauugguuuuau

SEQ ID NO: 2000650 - RNA, 20 nt, Human
uuuguauauugguuuuauga

SEQ ID NO: 2000651 - RNA, 19 nt, Human
uuugcuuuuuaguuuugcu

SEQ ID NO: 2000652 - RNA, 21 nt, Human
uuuggaaaacgauuuaauuua

SEQ ID NO: 2000653 - RNA, 14 nt, Human
uuuggaauuuugug

SEQ ID NO: 2000654 - RNA, 15 nt, Human
uuugcuuugugauuu

SEQ ID NO: 2000655 - RNA, 16 nt, Human
uuugcuuugugauuuu

SEQ ID NO: 2000656 - RNA, 22 nt, Human
uuugaauguaugcuucauacag

SEQ ID NO: 2000657 - RNA, 17 nt, Human
uuugaauguaugcuuca

SEQ ID NO: 2000658 - RNA, 13 nt, Human
uuugaaucuuuaa

SEQ ID NO: 2000659 - RNA, 15 nt, Human
uuugaaucuuuaauu

SEQ ID NO: 2000660 - RNA, 19 nt, Human
uuugaaucuuuaauuaaaa

SEQ ID NO: 2000661 - RNA, 15 nt, Human
uuugcaucugaaaau

SEQ ID NO: 2000662 - RNA, 11 nt, Human
uuugcauaucc

SEQ ID NO: 2000663 - RNA, 12 nt, Human
uuugguuuuguu

SEQ ID NO: 2000664 - RNA, 19 nt, Human
uuugguuuucacauuggaa

SEQ ID NO: 2000665 - RNA, 16 nt, Human
uuugguuugguuuuua

SEQ ID NO: 2000666 - RNA, 18 nt, Human
uuugguuuuaaaauacug

SEQ ID NO: 2000667 - RNA, 22 nt, Human
uuugguuuuaaaauacuguaga

SEQ ID NO: 2000668 - RNA, 23 nt, Human
uuugguuuuaaaauacuguagau

SEQ ID NO: 2000669 - RNA, 18 nt, Human
uuuggauuauucuuucuc

SEQ ID NO: 2000670 - RNA, 21 nt, Human
uuuggaauuuugugcccccau

SEQ ID NO: 2000671 - RNA, 13 nt, Human
uuuggaauuagaa

SEQ ID NO: 2000672 - RNA, 22 nt, Human
uuuggagagaaauauuuuaauu

SEQ ID NO: 2000673 - RNA, 20 nt, Human
uuuggagucagacagaugug

SEQ ID NO: 2000674 - RNA, 15 nt, Human
uuucucugauacaga

SEQ ID NO: 2000675 - RNA, 16 nt, Human
uuucucugauacagaa

SEQ ID NO: 2000676 - RNA, 17 nt, Human
uuucucugauacagaaa

SEQ ID NO: 2000677 - RNA, 18 nt, Human
uuucucugauacagaaaa

SEQ ID NO: 2000678 - RNA, 21 nt, Human
uuucugaaauuuccugggagc

SEQ ID NO: 2000679 - RNA, 19 nt, Human
uuucugaaauuuccuggga

SEQ ID NO: 2000680 - RNA, 17 nt, Human
uuucuagaguuccuacc

SEQ ID NO: 2000681 - RNA, 20 nt, Human
uuucuguucuuucuggcuau

SEQ ID NO: 2000682 - RNA, 20 nt, Human
uuucuaaaggcuaccuuugu

SEQ ID NO: 2000683 - RNA, 21 nt, Human
uuucuaaaggcuaccuuugua

SEQ ID NO: 2000684 - RNA, 14 nt, Human
uuucuaaaguaaaa

SEQ ID NO: 2000685 - RNA, 12 nt, Human
uuucuaaaguaa

SEQ ID NO: 2000686 - RNA, 23 nt, Human
uuucuacucgaguuacagacaaa

SEQ ID NO: 2000687 - RNA, 18 nt, Human
uuucuagacacuuuuucu

SEQ ID NO: 2000688 - RNA, 17 nt, Human
uuucuagaaagaauaaa

SEQ ID NO: 2000689 - RNA, 20 nt, Human
uuuccugauagcauaugaca

SEQ ID NO: 2000690 - RNA, 16 nt, Human
uuuccugaggcugggc

SEQ ID NO: 2000691 - RNA, 12 nt, Human
uuuccugcccug

SEQ ID NO: 2000692 - RNA, 13 nt, Human
uuuccugcccugg

SEQ ID NO: 2000693 - RNA, 14 nt, Human
uuaccacagacaua

SEQ ID NO: 2000694 - RNA, 17 nt, Human
uuaccacagacauacua

SEQ ID NO: 2000695 - RNA, 12 nt, Human
uuucuuaaaaag

SEQ ID NO: 2000696 - RNA, 11 nt, Human
uuucuucaaaa

SEQ ID NO: 2000697 - RNA, 18 nt, Human
uuucuuagggaaggauac

SEQ ID NO: 2000698 - RNA, 23 nt, Human
uuucuuagggaaggauacaaaag

SEQ ID NO: 2000699 - RNA, 12 nt, Human
uuucuucucccu

SEQ ID NO: 2000700 - RNA, 14 nt, Human
uuucuuccucugcu

SEQ ID NO: 2000701 - RNA, 16 nt, Human
uuucuuccucugcuga

SEQ ID NO: 2000702 - RNA, 13 nt, Human
uuucuucucccuc

SEQ ID NO: 2000703 - RNA, 12 nt, Human
uuucuucaaaau

SEQ ID NO: 2000704 - RNA, 22 nt, Human
uuucuucaaaauauaaaaugcc

SEQ ID NO: 2000705 - RNA, 11 nt, Human
uuucuuccucu

SEQ ID NO: 2000706 - RNA, 13 nt, Human
uuucuuccucugc

SEQ ID NO: 2000707 - RNA, 19 nt, Human
uuucuugauaauuuuccuu

SEQ ID NO: 2000708 - RNA, 21 nt, Human
uuucuugauaauuuuccuuua

SEQ ID NO: 2000709 - RNA, 23 nt, Human
uuucuucuucaaaccuuugugug

SEQ ID NO: 2000710 - RNA, 14 nt, Human
uuucuugauaauuu

SEQ ID NO: 2000711 - RNA, 14 nt, Human
uuugaacucuucaa

SEQ ID NO: 2000712 - RNA, 15 nt, Human
uuugaacugauaaag

SEQ ID NO: 2000713 - RNA, 17 nt, Human
uuugaacucuucucauu

SEQ ID NO: 2000714 - RNA, 22 nt, Human
uuugaacucuucucauuacuug

SEQ ID NO: 2000715 - RNA, 17 nt, Human
uuugaacugauaaagau

SEQ ID NO: 2000716 - RNA, 19 nt, Human
uuugaacugauaaagauga

SEQ ID NO: 2000717 - RNA, 22 nt, Human
uuugaagaugccgcauuuggau

SEQ ID NO: 2000718 - RNA, 18 nt, Human
uuugaagagugaaauacc

SEQ ID NO: 2000719 - RNA, 16 nt, Human
uuugaagauucuaugu

SEQ ID NO: 2000720 - RNA, 18 nt, Human
uuugaaucaucaagucuu

SEQ ID NO: 2000721 - RNA, 23 nt, Human
uuuuugaaaucaguaaacacugu

SEQ ID NO: 2000722 - RNA, 17 nt, Human
uuuuugaaaugcugaaa

SEQ ID NO: 2000723 - RNA, 20 nt, Human
uuuuugaaaugcugaaaauu

SEQ ID NO: 2000724 - RNA, 14 nt, Human
uuuuuuguaugaaa

SEQ ID NO: 2000725 - RNA, 13 nt, Human
uuuuuuguaugaa

SEQ ID NO: 2000726 - RNA, 19 nt, Human
uuuuugaacucuucucauu

SEQ ID NO: 2000727 - RNA, 20 nt, Human
uuuuugaacucuucucauua

SEQ ID NO: 2000728 - RNA, 23 nt, Human
uuuuucucugauacagaaaaguu

SEQ ID NO: 2000729 - RNA, 19 nt, Human
uuuuuccuucagugccuua

SEQ ID NO: 2000730 - RNA, 20 nt, Human
uuuuuccuuacauaaacauc

SEQ ID NO: 2000731 - RNA, 11 nt, Human
uuuuuccuuuu

SEQ ID NO: 2000732 - RNA, 11 nt, Human
uuuuuaaaugc

SEQ ID NO: 2000733 - RNA, 15 nt, Human
uuuuuccuuacauaa

SEQ ID NO: 2000734 - RNA, 19 nt, Human
uuuuuccuuacauaaacau

SEQ ID NO: 2000735 - RNA, 22 nt, Human
uuuuuccuaugaccauaaaauu

SEQ ID NO: 2000736 - RNA, 19 nt, Human
uuuuuccugugaacacaua

SEQ ID NO: 2000737 - RNA, 11 nt, Human
uuuuuccuuca

SEQ ID NO: 2000738 - RNA, 13 nt, Human
uuuuuaagugaaa

SEQ ID NO: 2000739 - RNA, 20 nt, Human
uuuuuaagugaaaauauagc

SEQ ID NO: 2000740 - RNA, 15 nt, Human
uuuuuaagugaaauu

SEQ ID NO: 2000741 - RNA, 14 nt, Human
uuuuuaagugaaau

SEQ ID NO: 2000742 - RNA, 18 nt, Human
uuuuuaaagacuuuuaug

SEQ ID NO: 2000743 - RNA, 13 nt, Human
uuuuuaaagacuu

SEQ ID NO: 2000744 - RNA, 12 nt, Human
uuuuuaaagacu

SEQ ID NO: 2000745 - RNA, 12 nt, Human
uuuuuaaaaucu

SEQ ID NO: 2000746 - RNA, 13 nt, Human
uuuuuaaaaucuu

SEQ ID NO: 2000747 - RNA, 14 nt, Human
uuuuuaaaaucuua

SEQ ID NO: 2000748 - RNA, 16 nt, Human
uuuuuaaacaauaaag

SEQ ID NO: 2000749 - RNA, 19 nt, Human
uuuuuaaaaucuuauuaaa

SEQ ID NO: 2000750 - RNA, 15 nt, Human
uuuuuaaaaauaaag

SEQ ID NO: 2000751 - RNA, 13 nt, Human
uuuuuaaaaaacu

SEQ ID NO: 2000752 - RNA, 14 nt, Human
uuuuuaaaaaacuu

SEQ ID NO: 2000753 - RNA, 16 nt, Human
uuuugucauauaagau

SEQ ID NO: 2000754 - RNA, 22 nt, Human
uuuuguauucaauuaaagaaau

SEQ ID NO: 2000755 - RNA, 20 nt, Human
uuuugguugaauaaacuaga

SEQ ID NO: 2000756 - RNA, 22 nt, Human
uuuugguucauuuucagauuca

SEQ ID NO: 2000757 - RNA, 15 nt, Human
uuuugguugaauaaa

SEQ ID NO: 2000758 - RNA, 16 nt, Human
uuuuguaaagauuucu

SEQ ID NO: 2000759 - RNA, 20 nt, Human
uuuuguaaagauuucuguuc

SEQ ID NO: 2000760 - RNA, 17 nt, Human
uuuuguaauaauaaaga

SEQ ID NO: 2000761 - RNA, 19 nt, Human
uuuuguaauaauaaagaau

SEQ ID NO: 2000762 - RNA, 14 nt, Human
uuuuguaaacuuug

SEQ ID NO: 2000763 - RNA, 15 nt, Human
uuuuguaaacuuuga

SEQ ID NO: 2000764 - RNA, 17 nt, Human
uuuuguaaacuuugaaa

SEQ ID NO: 2000765 - RNA, 19 nt, Human
uuuuguaaacuuugaaaua

SEQ ID NO: 2000766 - RNA, 11 nt, Human
uuuuguaaaga

SEQ ID NO: 2000767 - RNA, 16 nt, Human
uuuuguaaagaaaaau

SEQ ID NO: 2000768 - RNA, 17 nt, Human
uuuuguaaagaaaaaua

SEQ ID NO: 2000769 - RNA, 18 nt, Human
uuuuguaaagaaaaauau

SEQ ID NO: 2000770 - RNA, 13 nt, Human
uuuuguaaagauu

SEQ ID NO: 2000771 - RNA, 14 nt, Human
uuuuguaaagauuu

SEQ ID NO: 2000772 - RNA, 19 nt, Human
uuuuguagagccagggucu

SEQ ID NO: 2000773 - RNA, 14 nt, Human
uuuuguauauuggu

SEQ ID NO: 2000774 - RNA, 13 nt, Human
uuuuguaugcaag

SEQ ID NO: 2000775 - RNA, 23 nt, Human
uuuuguaugcaagcaguuucaau

SEQ ID NO: 2000776 - RNA, 20 nt, Human
uuuuggauuuggagagaaau

SEQ ID NO: 2000777 - RNA, 16 nt, Human
uuuuggccaugaaagc

SEQ ID NO: 2000778 - RNA, 20 nt, Human
uuuugacaaggggcaguggu

SEQ ID NO: 2000779 - RNA, 14 nt, Human
uuuugaaucuuuaa

SEQ ID NO: 2000780 - RNA, 16 nt, Human
uuuugaaucuuuaauu

SEQ ID NO: 2000781 - RNA, 20 nt, Human
uuuucuuuuguuuuuugaag

SEQ ID NO: 2000782 - RNA, 14 nt, Human
uuuuggcugcugaa

SEQ ID NO: 2000783 - RNA, 21 nt, Human
uuuugggaaaugcugauuuaa

SEQ ID NO: 2000784 - RNA, 18 nt, Human
uuuugggaaguuaaaggg

SEQ ID NO: 2000785 - RNA, 15 nt, Human
uuuuggucuguguga

SEQ ID NO: 2000786 - RNA, 20 nt, Human
uuuugguccacuuuuccagu

SEQ ID NO: 2000787 - RNA, 21 nt, Human
uuuugguccacuuuuccagua

SEQ ID NO: 2000788 - RNA, 18 nt, Human
uuuuggggugugaccuca

SEQ ID NO: 2000789 - RNA, 18 nt, Human
uuuucuaaaguaaaaaca

SEQ ID NO: 2000790 - RNA, 12 nt, Human
uuuucuaaagua

SEQ ID NO: 2000791 - RNA, 19 nt, Human
uuuuccuuacauaaacauc

SEQ ID NO: 2000792 - RNA, 17 nt, Human
uuuuccuucagauauuu

SEQ ID NO: 2000793 - RNA, 20 nt, Human
uuuucuuugccaucucugcu

SEQ ID NO: 2000794 - RNA, 12 nt, Human
uuuucuuucagu

SEQ ID NO: 2000795 - RNA, 15 nt, Human
uuuucuuuuaauuuu

SEQ ID NO: 2000796 - RNA, 19 nt, Human
uuuuaauuaacuuuggauu

SEQ ID NO: 2000797 - RNA, 24 nt, Human
uuuuaauugaucaguuuucaugug

SEQ ID NO: 2000798 - RNA, 12 nt, Human
uuuuaauuguau

SEQ ID NO: 2000799 - RNA, 13 nt, Human
uuuuaauuguauu

SEQ ID NO: 2000800 - RNA, 14 nt, Human
uuuuaauuguauuu

SEQ ID NO: 2000801 - RNA, 22 nt, Human
uuuuaauuguauuuuuguuguu

SEQ ID NO: 2000802 - RNA, 12 nt, Human
uuuuccuuacau

SEQ ID NO: 2000803 - RNA, 14 nt, Human
uuuuccuuacauaa

SEQ ID NO: 2000804 - RNA, 15 nt, Human
uuuuccuuacauaaa

SEQ ID NO: 2000805 - RNA, 20 nt, Human
uuuuccugggacaucuucug

SEQ ID NO: 2000806 - RNA, 13 nt, Human
uuuuccuguucua

SEQ ID NO: 2000807 - RNA, 24 nt, Human
gcccaccuggccucugcacucccc

SEQ ID NO: 2000808 - RNA, 21 nt, Human
gcccaccuggccucugcacuc

SEQ ID NO: 2000809 - RNA, 20 nt, Human
gcccaccuggccucugcacu

SEQ ID NO: 2000810 - RNA, 17 nt, Human
gcccaccuggccucugc

SEQ ID NO: 2000811 - RNA, 16 nt, Human
gcccaccuggccucug

SEQ ID NO: 2000812 - RNA, 15 nt, Human
gcccaccuggccucu

SEQ ID NO: 2000813 - RNA, 16 nt, Human
gcccaccccauggccg

SEQ ID NO: 2000814 - RNA, 17 nt, Human
gcccagaaugaggcugc

SEQ ID NO: 2000815 - RNA, 13 nt, Human
gcccagaauacug

SEQ ID NO: 2000816 - RNA, 16 nt, Human
gcccagaaugaggcug

SEQ ID NO: 2000817 - RNA, 14 nt, Human
gcccacuucugcca

SEQ ID NO: 2000818 - RNA, 13 nt, Human
gcccaccuuggcu

SEQ ID NO: 2000819 - RNA, 15 nt, Human
gcccaccuuggcuca

SEQ ID NO: 2000820 - RNA, 16 nt, Human
gcccaccuuggcucaa

SEQ ID NO: 2000821 - RNA, 17 nt, Human
gcccaccuuggcucaag

SEQ ID NO: 2000822 - RNA, 20 nt, Human
gcccacauagugaugguucc

SEQ ID NO: 2000823 - RNA, 21 nt, Human
gcccacauccggggccagcuc

SEQ ID NO: 2000824 - RNA, 19 nt, Human
gcccacccaagcaggaggc

SEQ ID NO: 2000825 - RNA, 21 nt, Human
gcccaccaggccccccuguca

SEQ ID NO: 2000826 - RNA, 22 nt, Human
gcccacauccggggccagcucc

SEQ ID NO: 2000827 - RNA, 23 nt, Human
gcccacauccggggccagcuccg

SEQ ID NO: 2000828 - RNA, 24 nt, Human
gccaugcuccuggcccacugcauc

SEQ ID NO: 2000829 - RNA, 15 nt, Human
gccaugggccuccug

SEQ ID NO: 2000830 - RNA, 16 nt, Human
gccaugggccuccugu

SEQ ID NO: 2000831 - RNA, 21 nt, Human
gcccaagaauagaugcugacu

SEQ ID NO: 2000832 - RNA, 22 nt, Human
gcccaagaauagaugcugacug

SEQ ID NO: 2000833 - RNA, 24 nt, Human
gcccaaccugcucuccucuugcca

SEQ ID NO: 2000834 - RNA, 17 nt, Human
gccaggcugggucgccc

SEQ ID NO: 2000835 - RNA, 23 nt, Human
gccaggcugggucgcccuggacu

SEQ ID NO: 2000836 - RNA, 13 nt, Human
gccaggcuggucu

SEQ ID NO: 2000837 - RNA, 23 nt, Human
gccaguaaaugggggugcauuug

SEQ ID NO: 2000838 - RNA, 22 nt, Human
gccaguaacacaggccacccug

SEQ ID NO: 2000839 - RNA, 15 nt, Human
gccaggcuggucuca

SEQ ID NO: 2000840 - RNA, 16 nt, Human
gccagucccugaggca

SEQ ID NO: 2000841 - RNA, 22 nt, Human
gccagucccugaggcagguccc

SEQ ID NO: 2000842 - RNA, 21 nt, Human
gccagucaccccggccaccug

SEQ ID NO: 2000843 - RNA, 12 nt, Human
gccaugaacugu

SEQ ID NO: 2000844 - RNA, 20 nt, Human
gccaugaggaacaaggcaag

SEQ ID NO: 2000845 - RNA, 16 nt, Human
gccaugccaggaaccu

SEQ ID NO: 2000846 - RNA, 18 nt, Human
gccaugccaggaaccugu

SEQ ID NO: 2000847 - RNA, 14 nt, Human
gccaugcuccuggc

SEQ ID NO: 2000848 - RNA, 17 nt, Human
gccaucauguuuacaga

SEQ ID NO: 2000849 - RNA, 21 nt, Human
gccaucauguuuacagaggac

SEQ ID NO: 2000850 - RNA, 14 nt, Human
gccauccagguuca

SEQ ID NO: 2000851 - RNA, 13 nt, Human
gccaucauuucug

SEQ ID NO: 2000852 - RNA, 20 nt, Human
gccaucuggagagcccagag

SEQ ID NO: 2000853 - RNA, 13 nt, Human
gccaucuggagag

SEQ ID NO: 2000854 - RNA, 14 nt, Human
gccaucuggagagc

SEQ ID NO: 2000855 - RNA, 19 nt, Human
gccaucuggagagcccaga

SEQ ID NO: 2000856 - RNA, 24 nt, Human
gccaaggccaaaggaagcacaugc

SEQ ID NO: 2000857 - RNA, 21 nt, Human
gccacuccagaccccuggcuu

SEQ ID NO: 2000858 - RNA, 20 nt, Human
gccacuccagaccccuggcu

SEQ ID NO: 2000859 - RNA, 20 nt, Human
gccaaggccaaaggaagcac

SEQ ID NO: 2000860 - RNA, 20 nt, Human
gccacugcaccgggccacag

SEQ ID NO: 2000861 - RNA, 21 nt, Human
gccacugcaccgggccacaga

SEQ ID NO: 2000862 - RNA, 22 nt, Human
gccacuccagaccccuggcuuu

SEQ ID NO: 2000863 - RNA, 13 nt, Human
gccacuccccagc

SEQ ID NO: 2000864 - RNA, 22 nt, Human
gccagagacacaagccuucggc

SEQ ID NO: 2000865 - RNA, 19 nt, Human
gccacugcaccgggccaca

SEQ ID NO: 2000866 - RNA, 21 nt, Human
gccagagacacaagccuucgg

SEQ ID NO: 2000867 - RNA, 22 nt, Human
gccacugcaccgggccacagag

SEQ ID NO: 2000868 - RNA, 19 nt, Human
gccagauucuuuccugagg

SEQ ID NO: 2000869 - RNA, 22 nt, Human
gccagccgagauagccaaggcc

SEQ ID NO: 2000870 - RNA, 13 nt, Human
gccagauuucacu

SEQ ID NO: 2000871 - RNA, 24 nt, Human
gccagauucuuuccugaggcuggg

SEQ ID NO: 2000872 - RNA, 20 nt, Human
gccagauucuuuccugaggc

SEQ ID NO: 2000873 - RNA, 15 nt, Human
gccagaugcaccagc

SEQ ID NO: 2000874 - RNA, 14 nt, Human
gccagaugcaccag

SEQ ID NO: 2000875 - RNA, 17 nt, Human
gccagagggagugacag

SEQ ID NO: 2000876 - RNA, 21 nt, Human
gccagcucuuccuagcuggag

SEQ ID NO: 2000877 - RNA, 13 nt, Human
gccagcucuuccu

SEQ ID NO: 2000878 - RNA, 17 nt, Human
gccagcucuuccuagcu

SEQ ID NO: 2000879 - RNA, 19 nt, Human
gccagcucuuccuagcugg

SEQ ID NO: 2000880 - RNA, 12 nt, Human
gccagccuggcu

SEQ ID NO: 2000881 - RNA, 13 nt, Human
gccagccuggcug

SEQ ID NO: 2000882 - RNA, 14 nt, Human
gccagccuggcugg

SEQ ID NO: 2000883 - RNA, 17 nt, Human
gccagccuggcugggac

SEQ ID NO: 2000884 - RNA, 14 nt, Human
gccaggaagccagc

SEQ ID NO: 2000885 - RNA, 13 nt, Human
gccaggaagccag

SEQ ID NO: 2000886 - RNA, 12 nt, Human
gccaggaagcca

SEQ ID NO: 2000887 - RNA, 20 nt, Human
gccagcugcuugggcuucau

SEQ ID NO: 2000888 - RNA, 14 nt, Human
gccagcugccuagg

SEQ ID NO: 2000889 - RNA, 18 nt, Human
gccagcugcuugggcuuc

SEQ ID NO: 2000890 - RNA, 17 nt, Human
gccagcugcuugggcuu

SEQ ID NO: 2000891 - RNA, 16 nt, Human
gccaggagccuccugc

SEQ ID NO: 2000892 - RNA, 14 nt, Human
gccaggagccuccu

SEQ ID NO: 2000893 - RNA, 20 nt, Human
gccaggagccuccugcccuu

SEQ ID NO: 2000894 - RNA, 19 nt, Human
gccaggagccuccugcccu

SEQ ID NO: 2000895 - RNA, 22 nt, Human
gccaggcgcuagcacagcuccc

SEQ ID NO: 2000896 - RNA, 17 nt, Human
gccaggaaguagcacag

SEQ ID NO: 2000897 - RNA, 18 nt, Human
gccaggaaguagcacagg

SEQ ID NO: 2000898 - RNA, 19 nt, Human
gccaggaaguagcacaggc

SEQ ID NO: 2000899 - RNA, 20 nt, Human
gccaggaaguagcacaggcu

SEQ ID NO: 2000900 - RNA, 21 nt, Human
gccaggaaguagcacaggcug

SEQ ID NO: 2000901 - RNA, 22 nt, Human
gccaggaaguagcacaggcuga

SEQ ID NO: 2000902 - RNA, 15 nt, Human
gccaggaagccagca

SEQ ID NO: 2000903 - RNA, 20 nt, Human
gcccaggcuggagugcagug

SEQ ID NO: 2000904 - RNA, 19 nt, Human
gcccaggcuggagugcagu

SEQ ID NO: 2000905 - RNA, 12 nt, Human
gcccaggcuggc

SEQ ID NO: 2000906 - RNA, 21 nt, Human
gcccagagaggguggugaccu

SEQ ID NO: 2000907 - RNA, 15 nt, Human
gcccagagagggugg

SEQ ID NO: 2000908 - RNA, 17 nt, Human
gcccagaauacugaugg

SEQ ID NO: 2000909 - RNA, 23 nt, Human
gcccaggccccugccacccuggg

SEQ ID NO: 2000910 - RNA, 13 nt, Human
gcccaggccuccu

SEQ ID NO: 2000911 - RNA, 15 nt, Human
gcccaggcuggagug

SEQ ID NO: 2000912 - RNA, 20 nt, Human
gcccaggcuggagugcaaug

SEQ ID NO: 2000913 - RNA, 20 nt, Human
gcccagggggcuuccugagg

SEQ ID NO: 2000914 - RNA, 21 nt, Human
gcccagggugagguggcaugg

SEQ ID NO: 2000915 - RNA, 22 nt, Human
gccccacucucagaggccccaa

SEQ ID NO: 2000916 - RNA, 16 nt, Human
gccccaccugcagcuc

SEQ ID NO: 2000917 - RNA, 17 nt, Human
gccccaccugcagcucc

SEQ ID NO: 2000918 - RNA, 18 nt, Human
gccccaccugcagcuccc

SEQ ID NO: 2000919 - RNA, 14 nt, Human
gccccaccuggccc

SEQ ID NO: 2000920 - RNA, 15 nt, Human
gccccaccuggcccu

SEQ ID NO: 2000921 - RNA, 18 nt, Human
gccccaccuggcccucuc

SEQ ID NO: 2000922 - RNA, 12 nt, Human
gccccacucuca

SEQ ID NO: 2000923 - RNA, 13 nt, Human
gccccacucucag

SEQ ID NO: 2000924 - RNA, 14 nt, Human
gccccacucucaga

SEQ ID NO: 2000925 - RNA, 16 nt, Human
gccccacucucagagg

SEQ ID NO: 2000926 - RNA, 17 nt, Human
gccccacucucagaggc

SEQ ID NO: 2000927 - RNA, 18 nt, Human
gccccacucucagaggcc

SEQ ID NO: 2000928 - RNA, 19 nt, Human
gccccacucucagaggccc

SEQ ID NO: 2000929 - RNA, 21 nt, Human
gccccacucucagaggcccca

SEQ ID NO: 2000930 - RNA, 13 nt, Human
gccccagugccca

SEQ ID NO: 2000931 - RNA, 14 nt, Human
gccccagugcccac

SEQ ID NO: 2000932 - RNA, 18 nt, Human
gccccaucccaaacccuu

SEQ ID NO: 2000933 - RNA, 19 nt, Human
gccccaguuguauuuauuu

SEQ ID NO: 2000934 - RNA, 21 nt, Human
gccccauaauuuuuuuuuucc

SEQ ID NO: 2000935 - RNA, 12 nt, Human
gccccagugccc

SEQ ID NO: 2000936 - RNA, 22 nt, Human
gccccauccucuguacagagcc

SEQ ID NO: 2000937 - RNA, 14 nt, Human
gccccauccucugu

SEQ ID NO: 2000938 - RNA, 13 nt, Human
gccccauccucug

SEQ ID NO: 2000939 - RNA, 16 nt, Human
gcccccaaacccccau

SEQ ID NO: 2000940 - RNA, 15 nt, Human
gccccauucugccug

SEQ ID NO: 2000941 - RNA, 14 nt, Human
gccccauucugccu

SEQ ID NO: 2000942 - RNA, 13 nt, Human
gccccauuaacug

SEQ ID NO: 2000943 - RNA, 13 nt, Human
gcccccugccugc

SEQ ID NO: 2000944 - RNA, 16 nt, Human
gcccccugccugcccu

SEQ ID NO: 2000945 - RNA, 16 nt, Human
gccccugagaucucug

SEQ ID NO: 2000946 - RNA, 20 nt, Human
gccccugagaucucugcagg

SEQ ID NO: 2000947 - RNA, 17 nt, Human
gccccuguucuggcaga

SEQ ID NO: 2000948 - RNA, 12 nt, Human
gcccgacagccu

SEQ ID NO: 2000949 - RNA, 14 nt, Human
gcccgacagccugg

SEQ ID NO: 2000950 - RNA, 15 nt, Human
gcccgacagccuggc

SEQ ID NO: 2000951 - RNA, 24 nt, Human
gcccgaagcaugaacagugcaccu

SEQ ID NO: 2000952 - RNA, 14 nt, Human
gcccgauccucccc

SEQ ID NO: 2000953 - RNA, 17 nt, Human
gcccgauccuccccugg

SEQ ID NO: 2000954 - RNA, 20 nt, Human
gcccgauccuccccuggacu

SEQ ID NO: 2000955 - RNA, 18 nt, Human
gccccucagggucccugg

SEQ ID NO: 2000956 - RNA, 16 nt, Human
gccccucagggucccu

SEQ ID NO: 2000957 - RNA, 13 nt, Human
gccccucccuccu

SEQ ID NO: 2000958 - RNA, 15 nt, Human
gccccucccuccucu

SEQ ID NO: 2000959 - RNA, 17 nt, Human
gccccucccuccucuga

SEQ ID NO: 2000960 - RNA, 15 nt, Human
gccccucccucucca

SEQ ID NO: 2000961 - RNA, 20 nt, Human
gccccucccucuccagcagg

SEQ ID NO: 2000962 - RNA, 23 nt, Human
gccccucccucuccagcaggccc

SEQ ID NO: 2000963 - RNA, 15 nt, Human
gccccgaggccuucu

SEQ ID NO: 2000964 - RNA, 22 nt, Human
gccccgaaaggucaccucacuc

SEQ ID NO: 2000965 - RNA, 14 nt, Human
gccccucagggucc

SEQ ID NO: 2000966 - RNA, 18 nt, Human
gccccgaggccuucucug

SEQ ID NO: 2000967 - RNA, 14 nt, Human
gcccugcagagggc

SEQ ID NO: 2000968 - RNA, 13 nt, Human
gcccugcagaggg

SEQ ID NO: 2000969 - RNA, 15 nt, Human
gcccugcagagggca

SEQ ID NO: 2000970 - RNA, 17 nt, Human
gcccucuucuucucaag

SEQ ID NO: 2000971 - RNA, 22 nt, Human
gcccuccgaccacuuccagggg

SEQ ID NO: 2000972 - RNA, 14 nt, Human
gcccugagcuuucu

SEQ ID NO: 2000973 - RNA, 19 nt, Human
gcccucugcccacucccug

SEQ ID NO: 2000974 - RNA, 18 nt, Human
gcccucugcccacucccu

SEQ ID NO: 2000975 - RNA, 16 nt, Human
gcccucugcccacucc

SEQ ID NO: 2000976 - RNA, 13 nt, Human
gcccucugcccac

SEQ ID NO: 2000977 - RNA, 21 nt, Human
gcccucccugccccucccuuc

SEQ ID NO: 2000978 - RNA, 23 nt, Human
gcccuccaagaccuucuccuuca

SEQ ID NO: 2000979 - RNA, 22 nt, Human
gcccuccaagaccuucuccuuc

SEQ ID NO: 2000980 - RNA, 15 nt, Human
gcccuccacacccgc

SEQ ID NO: 2000981 - RNA, 21 nt, Human
gcccucccaggcucucaacag

SEQ ID NO: 2000982 - RNA, 12 nt, Human
gcccucccaggc

SEQ ID NO: 2000983 - RNA, 21 nt, Human
gcccuccaucuaaacugcccc

SEQ ID NO: 2000984 - RNA, 20 nt, Human
gcccuccaucuaaacugccc

SEQ ID NO: 2000985 - RNA, 21 nt, Human
gcccuccaagaccuucuccuu

SEQ ID NO: 2000986 - RNA, 19 nt, Human
gcccuccaagaccuucucc

SEQ ID NO: 2000987 - RNA, 13 nt, Human
gcccgcaucagcu

SEQ ID NO: 2000988 - RNA, 15 nt, Human
gcccgcaucagcugc

SEQ ID NO: 2000989 - RNA, 19 nt, Human
gcccgcaucagcugcucag

SEQ ID NO: 2000990 - RNA, 20 nt, Human
gcccgcaucagcugcucaga

SEQ ID NO: 2000991 - RNA, 21 nt, Human
gcccgauccuccccuggacuc

SEQ ID NO: 2000992 - RNA, 13 nt, Human
gccuuuggcuuca

SEQ ID NO: 2000993 - RNA, 23 nt, Human
gcgacaaugcaaaccaucauuga

SEQ ID NO: 2000994 - RNA, 23 nt, Human
gcgaaaaacucaaccaaauggua

SEQ ID NO: 2000995 - RNA, 14 nt, Human
gcgaaagaaaacuc

SEQ ID NO: 2000996 - RNA, 17 nt, Human
gcgaaaucccugcucac

SEQ ID NO: 2000997 - RNA, 15 nt, Human
gccuuggccucagag

SEQ ID NO: 2000998 - RNA, 20 nt, Human
gccuuugaagagugaaauac

SEQ ID NO: 2000999 - RNA, 22 nt, Human
gccuuuggaaacagcucgacuu

SEQ ID NO: 2001000 - RNA, 18 nt, Human
gccuuugcucuggucuau

SEQ ID NO: 2001001 - RNA, 16 nt, Human
gccuuugcagcucaga

SEQ ID NO: 2001002 - RNA, 21 nt, Human
gccuuugcagcucagaaccac

SEQ ID NO: 2001003 - RNA, 20 nt, Human
gccuuauggaacacucugag

SEQ ID NO: 2001004 - RNA, 19 nt, Human
gccuuauggaacacucuga

SEQ ID NO: 2001005 - RNA, 18 nt, Human
gccuuauggaacacucug

SEQ ID NO: 2001006 - RNA, 16 nt, Human
gccuuauggaacacuc

SEQ ID NO: 2001007 - RNA, 12 nt, Human
gccuuccagggg

SEQ ID NO: 2001008 - RNA, 13 nt, Human
gccuuccaccucu

SEQ ID NO: 2001009 - RNA, 13 nt, Human
gccuucagggagu

SEQ ID NO: 2001010 - RNA, 21 nt, Human
gccuucagggagugagggauu

SEQ ID NO: 2001011 - RNA, 13 nt, Human
gccuucaucuccc

SEQ ID NO: 2001012 - RNA, 16 nt, Human
gccuuccagggguggg

SEQ ID NO: 2001013 - RNA, 15 nt, Human
gccuuccaggggugg

SEQ ID NO: 2001014 - RNA, 21 nt, Human
gccuuccaggggugggacacc

SEQ ID NO: 2001015 - RNA, 23 nt, Human
gccuucgauacaccgggccugga

SEQ ID NO: 2001016 - RNA, 18 nt, Human
gccuucgauacaccgggc

SEQ ID NO: 2001017 - RNA, 22 nt, Human
gccuucgauacaccgggccugg

SEQ ID NO: 2001018 - RNA, 20 nt, Human
gccuuacacaaugguuuucu

SEQ ID NO: 2001019 - RNA, 19 nt, Human
gccuuaaaacaucauuccu

SEQ ID NO: 2001020 - RNA, 21 nt, Human
gccuuacacaaugguuuucuu

SEQ ID NO: 2001021 - RNA, 18 nt, Human
gccuuacccucauguucu

SEQ ID NO: 2001022 - RNA, 13 nt, Human
gccuguuuaagag

SEQ ID NO: 2001023 - RNA, 16 nt, Human
gccuuaaaacaucauu

SEQ ID NO: 2001024 - RNA, 12 nt, Human
gccuguuuaaga

SEQ ID NO: 2001025 - RNA, 22 nt, Human
gccuggugaugcgcaguugcug

SEQ ID NO: 2001026 - RNA, 19 nt, Human
gccuuagaagucacacagu

SEQ ID NO: 2001027 - RNA, 17 nt, Human
gccuuagaagucacaca

SEQ ID NO: 2001028 - RNA, 18 nt, Human
gccuuagaagucacacag

SEQ ID NO: 2001029 - RNA, 23 nt, Human
gccuuaucuccaagaccagagau

SEQ ID NO: 2001030 - RNA, 14 nt, Human
gccuuauggaacac

SEQ ID NO: 2001031 - RNA, 10 nt, Human
gccuuaugga

SEQ ID NO: 2001032 - RNA, 15 nt, Human
gccugccacucaggc

SEQ ID NO: 2001033 - RNA, 23 nt, Human
gccugccacucaggcccaaagcc

SEQ ID NO: 2001034 - RNA, 22 nt, Human
gccugggggcugggcagaggaa

SEQ ID NO: 2001035 - RNA, 17 nt, Human
gccuggucgccuuccac

SEQ ID NO: 2001036 - RNA, 17 nt, Human
gccugguccucacacuc

SEQ ID NO: 2001037 - RNA, 14 nt, Human
gccuggggucaggc

SEQ ID NO: 2001038 - RNA, 13 nt, Human
gccugguggcagc

SEQ ID NO: 2001039 - RNA, 18 nt, Human
gccuggucgccuuccacc

SEQ ID NO: 2001040 - RNA, 19 nt, Human
gccugguggcagcugcggu

SEQ ID NO: 2001041 - RNA, 21 nt, Human
gccugguggcagcugcggucc

SEQ ID NO: 2001042 - RNA, 18 nt, Human
gccugguggcagcugcgg

SEQ ID NO: 2001043 - RNA, 14 nt, Human
gccugguggcagcu

SEQ ID NO: 2001044 - RNA, 19 nt, Human
gcuagaacucccuuucaac

SEQ ID NO: 2001045 - RNA, 16 nt, Human
gcuaccuuuguauucu

SEQ ID NO: 2001046 - RNA, 20 nt, Human
gcuaccuuuguauucucucc

SEQ ID NO: 2001047 - RNA, 14 nt, Human
gcuaggaacaaauc

SEQ ID NO: 2001048 - RNA, 16 nt, Human
gcuaggaacacuccuu

SEQ ID NO: 2001049 - RNA, 22 nt, Human
gcuaggaaauccaggguggugg

SEQ ID NO: 2001050 - RNA, 23 nt, Human
gcuauagcuuuagccgugucacg

SEQ ID NO: 2001051 - RNA, 15 nt, Human
gcuaggaacacuccu

SEQ ID NO: 2001052 - RNA, 19 nt, Human
gcuaggaaauccagggugg

SEQ ID NO: 2001053 - RNA, 14 nt, Human
gcuacacaggggaa

SEQ ID NO: 2001054 - RNA, 14 nt, Human
gcuaagaauuuuuu

SEQ ID NO: 2001055 - RNA, 13 nt, Human
gcuacacacugca

SEQ ID NO: 2001056 - RNA, 20 nt, Human
gcuacacacugcauguuugu

SEQ ID NO: 2001057 - RNA, 20 nt, Human
gcuaagagggagggagggcu

SEQ ID NO: 2001058 - RNA, 23 nt, Human
gcuaaacguguauguuuuucagu

SEQ ID NO: 2001059 - RNA, 17 nt, Human
gcuaagaauauuugaau

SEQ ID NO: 2001060 - RNA, 13 nt, Human
gcuaagagggagg

SEQ ID NO: 2001061 - RNA, 20 nt, Human
gcuaaagacugaucucaggg

SEQ ID NO: 2001062 - RNA, 13 nt, Human
gcgggucacagga

SEQ ID NO: 2001063 - RNA, 15 nt, Human
gcgggucacaggagg

SEQ ID NO: 2001064 - RNA, 15 nt, Human
gcggacagccacggc

SEQ ID NO: 2001065 - RNA, 19 nt, Human
gcgcucccuugaccugcug

SEQ ID NO: 2001066 - RNA, 17 nt, Human
gcgggcacaccuccucc

SEQ ID NO: 2001067 - RNA, 19 nt, Human
gcgggcacaccuccuccca

SEQ ID NO: 2001068 - RNA, 22 nt, Human
gcgggcacaccuccucccacug

SEQ ID NO: 2001069 - RNA, 19 nt, Human
gcgggucacaggagggagg

SEQ ID NO: 2001070 - RNA, 20 nt, Human
gcgggucacaggagggaggg

SEQ ID NO: 2001071 - RNA, 18 nt, Human
gcgguuuaucgcccuggc

SEQ ID NO: 2001072 - RNA, 19 nt, Human
gcgucucauacucaccuca

SEQ ID NO: 2001073 - RNA, 11 nt, Human
gcggacagcca

SEQ ID NO: 2001074 - RNA, 13 nt, Human
gcggacagccacg

SEQ ID NO: 2001075 - RNA, 21 nt, Human
gcgcuagcacagcucccuucu

SEQ ID NO: 2001076 - RNA, 13 nt, Human
gcgcuagaggcca

SEQ ID NO: 2001077 - RNA, 18 nt, Human
gcgcuagcacagcucccu

SEQ ID NO: 2001078 - RNA, 21 nt, Human
gcgcggacauccccugcuggc

SEQ ID NO: 2001079 - RNA, 15 nt, Human
gcgcuaacuugcuua

SEQ ID NO: 2001080 - RNA, 20 nt, Human
gcgcuaacuugcuuaaaugu

SEQ ID NO: 2001081 - RNA, 21 nt, Human
gcgcuaacuugcuuaaaugug

SEQ ID NO: 2001082 - RNA, 22 nt, Human
gcgcuaacuugcuuaaauguga

SEQ ID NO: 2001083 - RNA, 15 nt, Human
gcgccuacaggagug

SEQ ID NO: 2001084 - RNA, 22 nt, Human
gcgacagugagacucugucuca

SEQ ID NO: 2001085 - RNA, 12 nt, Human
gcgacagugaga

SEQ ID NO: 2001086 - RNA, 12 nt, Human
gcgacagagcag

SEQ ID NO: 2001087 - RNA, 13 nt, Human
gcgacagagcagu

SEQ ID NO: 2001088 - RNA, 18 nt, Human
gcccuucucuccagcccc

SEQ ID NO: 2001089 - RNA, 17 nt, Human
gcccuucucuccagccc

SEQ ID NO: 2001090 - RNA, 16 nt, Human
gcccuucucuccagcc

SEQ ID NO: 2001091 - RNA, 14 nt, Human
gcccuucucuccag

SEQ ID NO: 2001092 - RNA, 16 nt, Human
gcccugcuuugggcug

SEQ ID NO: 2001093 - RNA, 18 nt, Human
gcccugcuuugggcugcc

SEQ ID NO: 2001094 - RNA, 12 nt, Human
gcccugcuguuu

SEQ ID NO: 2001095 - RNA, 15 nt, Human
gccgaauagcugaug

SEQ ID NO: 2001096 - RNA, 16 nt, Human
gccggcuuucaggagc

SEQ ID NO: 2001097 - RNA, 21 nt, Human
gccgggcgcgguggcucacgc

SEQ ID NO: 2001098 - RNA, 20 nt, Human
gccgggcgugguggugagug

SEQ ID NO: 2001099 - RNA, 21 nt, Human
gccgggcuacccgugagcccu

SEQ ID NO: 2001100 - RNA, 22 nt, Human
gccgagaucacgccacugcacu

SEQ ID NO: 2001101 - RNA, 20 nt, Human
gccgagaucacgccacugca

SEQ ID NO: 2001102 - RNA, 21 nt, Human
gccgagaucacgccacugcac

SEQ ID NO: 2001103 - RNA, 11 nt, Human
gccgcagcccu

SEQ ID NO: 2001104 - RNA, 12 nt, Human
gccgcagcccug

SEQ ID NO: 2001105 - RNA, 13 nt, Human
gccgcagcccugc

SEQ ID NO: 2001106 - RNA, 18 nt, Human
gccucaaccuccugggcu

SEQ ID NO: 2001107 - RNA, 19 nt, Human
gccucaaccuccugggcua

SEQ ID NO: 2001108 - RNA, 22 nt, Human
gccuaugugcaugcagcaucua

SEQ ID NO: 2001109 - RNA, 17 nt, Human
gccucacaguccuuacc

SEQ ID NO: 2001110 - RNA, 13 nt, Human
gccucacaguccu

SEQ ID NO: 2001111 - RNA, 20 nt, Human
gccguguaaccauggaccca

SEQ ID NO: 2001112 - RNA, 21 nt, Human
gccguggcuucccgcucagcc

SEQ ID NO: 2001113 - RNA, 22 nt, Human
gccguggcuucccgcucagccc

SEQ ID NO: 2001114 - RNA, 19 nt, Human
gccguggcuucccgcucag

SEQ ID NO: 2001115 - RNA, 14 nt, Human
gccgugccuucagc

SEQ ID NO: 2001116 - RNA, 15 nt, Human
gccgugccuucagcu

SEQ ID NO: 2001117 - RNA, 17 nt, Human
gccgugccuucagcucu

SEQ ID NO: 2001118 - RNA, 19 nt, Human
gccgugccuucagcucuac

SEQ ID NO: 2001119 - RNA, 17 nt, Human
gccgucuaccugagggg

SEQ ID NO: 2001120 - RNA, 16 nt, Human
gccgucuaccugaggg

SEQ ID NO: 2001121 - RNA, 15 nt, Human
gccgucuaccugagg

SEQ ID NO: 2001122 - RNA, 16 nt, Human
gccggugugggggccc

SEQ ID NO: 2001123 - RNA, 12 nt, Human
gccguacaguuc

SEQ ID NO: 2001124 - RNA, 18 nt, Human
gccucacaguccuuacca

SEQ ID NO: 2001125 - RNA, 21 nt, Human
gccucacaguccuuaccagca

SEQ ID NO: 2001126 - RNA, 15 nt, Human
gccucagcauccugg

SEQ ID NO: 2001127 - RNA, 16 nt, Human
gccucagcauccuggc

SEQ ID NO: 2001128 - RNA, 18 nt, Human
gccucccaaagugcuggg

SEQ ID NO: 2001129 - RNA, 13 nt, Human
gccucccaacuca

SEQ ID NO: 2001130 - RNA, 19 nt, Human
gccucccaaagugcuggga

SEQ ID NO: 2001131 - RNA, 19 nt, Human
gccucccaacucaccccag

SEQ ID NO: 2001132 - RNA, 18 nt, Human
gccucccaacucacccca

SEQ ID NO: 2001133 - RNA, 17 nt, Human
gccucccaacucacccc

SEQ ID NO: 2001134 - RNA, 16 nt, Human
gccucccaacucaccc

SEQ ID NO: 2001135 - RNA, 16 nt, Human
gccucccaucacccgc

SEQ ID NO: 2001136 - RNA, 14 nt, Human
gccucccaucaccc

SEQ ID NO: 2001137 - RNA, 17 nt, Human
gccucccaucacccgcu

SEQ ID NO: 2001138 - RNA, 20 nt, Human
gccucccgaguagcugggac

SEQ ID NO: 2001139 - RNA, 18 nt, Human
gccucccgaguagcuggg

SEQ ID NO: 2001140 - RNA, 19 nt, Human
gccucccgaguagcuggga

SEQ ID NO: 2001141 - RNA, 20 nt, Human
gccuccuacagcccaccugg

SEQ ID NO: 2001142 - RNA, 20 nt, Human
gccuccgucacuaccuggcu

SEQ ID NO: 2001143 - RNA, 21 nt, Human
gccuccgucacuaccuggcug

SEQ ID NO: 2001144 - RNA, 19 nt, Human
gccucucauuccagaggaa

SEQ ID NO: 2001145 - RNA, 16 nt, Human
gccuccgcuucccugg

SEQ ID NO: 2001146 - RNA, 19 nt, Human
gccuccgucacuaccuggc

SEQ ID NO: 2001147 - RNA, 15 nt, Human
gccuccgcuucccug

SEQ ID NO: 2001148 - RNA, 20 nt, Human
gccucucauuccagaggaag

SEQ ID NO: 2001149 - RNA, 14 nt, Human
gccucucucaggcc

SEQ ID NO: 2001150 - RNA, 13 nt, Human
gccucucucaggc

SEQ ID NO: 2001151 - RNA, 16 nt, Human
gccucucucaggccaa

SEQ ID NO: 2001152 - RNA, 17 nt, Human
gccucugacacacagcu

SEQ ID NO: 2001153 - RNA, 18 nt, Human
gccucugacacacagcuc

SEQ ID NO: 2001154 - RNA, 14 nt, Human
gccucugcacuccc

SEQ ID NO: 2001155 - RNA, 19 nt, Human
gccucugacacacagcucu

SEQ ID NO: 2001156 - RNA, 20 nt, Human
gccucugacacacagcucug

SEQ ID NO: 2001157 - RNA, 21 nt, Human
gccucugacacacagcucugu

SEQ ID NO: 2001158 - RNA, 15 nt, Human
gccugcaagggagug

SEQ ID NO: 2001159 - RNA, 13 nt, Human
gccugcaagggag

SEQ ID NO: 2001160 - RNA, 13 nt, Human
gccugaggggcag

SEQ ID NO: 2001161 - RNA, 16 nt, Human
gccugaggggcagccu

SEQ ID NO: 2001162 - RNA, 19 nt, Human
gccugaggggcagccugcc

SEQ ID NO: 2001163 - RNA, 20 nt, Human
gccugaggggcagccugccu

SEQ ID NO: 2001164 - RNA, 17 nt, Human
gccucugcaaaggaaau

SEQ ID NO: 2001165 - RNA, 12 nt, Human
gccucugccucu

SEQ ID NO: 2001166 - RNA, 13 nt, Human
gccucugccucug

SEQ ID NO: 2001167 - RNA, 18 nt, Human
gccucugccucugacaca

SEQ ID NO: 2001168 - RNA, 15 nt, Human
gccugacucccccag

SEQ ID NO: 2001169 - RNA, 14 nt, Human
gccugacuccccca

SEQ ID NO: 2001170 - RNA, 16 nt, Human
gccugacuucugcugg

SEQ ID NO: 2001171 - RNA, 21 nt, Human
gccugacucccccaguccccu

SEQ ID NO: 2001172 - RNA, 23 nt, Human
gccugacucccccaguccccuuc

SEQ ID NO: 2001173 - RNA, 19 nt, Human
gccugacuucugcuggcau

SEQ ID NO: 2001174 - RNA, 22 nt, Human
gcaaugaccuuucaauaggaaa

SEQ ID NO: 2001175 - RNA, 20 nt, Human
gcaaugaccuuucaauagga

SEQ ID NO: 2001176 - RNA, 17 nt, Human
gcaaugaccuuucaaua

SEQ ID NO: 2001177 - RNA, 15 nt, Human
gcaaugaccuuucaa

SEQ ID NO: 2001178 - RNA, 17 nt, Human
gcaaucaaaucugcuuu

SEQ ID NO: 2001179 - RNA, 22 nt, Human
gcaauauucucuguacauauua

SEQ ID NO: 2001180 - RNA, 15 nt, Human
gcaaucaaaucugcu

SEQ ID NO: 2001181 - RNA, 14 nt, Human
gcaaggucauuuuu

SEQ ID NO: 2001182 - RNA, 23 nt, Human
gcaaugaccuuucaauaggaaaa

SEQ ID NO: 2001183 - RNA, 13 nt, Human
gcaaugcuggcug

SEQ ID NO: 2001184 - RNA, 14 nt, Human
gcaaugcuggcugu

SEQ ID NO: 2001185 - RNA, 22 nt, Human
gcaaugcuggcuguuggcuggg

SEQ ID NO: 2001186 - RNA, 23 nt, Human
gcaaugcuggcuguuggcugggg

SEQ ID NO: 2001187 - RNA, 11 nt, Human
gcaaggcuguc

SEQ ID NO: 2001188 - RNA, 16 nt, Human
gcaaggcgcuaacuug

SEQ ID NO: 2001189 - RNA, 18 nt, Human
gcaaggcgcuaacuugcu

SEQ ID NO: 2001190 - RNA, 20 nt, Human
gcaaggccaccucuuccugg

SEQ ID NO: 2001191 - RNA, 22 nt, Human
gcaaggccaccucuuccuggcc

SEQ ID NO: 2001192 - RNA, 13 nt, Human
gcaaggccaccuc

SEQ ID NO: 2001193 - RNA, 14 nt, Human
gcaaggccaccucu

SEQ ID NO: 2001194 - RNA, 14 nt, Human
gcaagguaaaauuu

SEQ ID NO: 2001195 - RNA, 13 nt, Human
gcaaggcugucaa

SEQ ID NO: 2001196 - RNA, 20 nt, Human
gcaaggcgcuaacuugcuua

SEQ ID NO: 2001197 - RNA, 17 nt, Human
gcaagggaggcccagcg

SEQ ID NO: 2001198 - RNA, 16 nt, Human
gcaagggcagggacag

SEQ ID NO: 2001199 - RNA, 21 nt, Human
gcaagggcagggacagggccg

SEQ ID NO: 2001200 - RNA, 19 nt, Human
gcaagggcggccuuuccca

SEQ ID NO: 2001201 - RNA, 21 nt, Human
gcaagggcggccuuucccacu

SEQ ID NO: 2001202 - RNA, 15 nt, Human
gcaagccccugcucc

SEQ ID NO: 2001203 - RNA, 18 nt, Human
gcaaggagauuuacaacu

SEQ ID NO: 2001204 - RNA, 22 nt, Human
gcaagacgcugugcugcccugc

SEQ ID NO: 2001205 - RNA, 21 nt, Human
gcaagacgcugugcugcccug

SEQ ID NO: 2001206 - RNA, 20 nt, Human
gcaagacgcugugcugcccu

SEQ ID NO: 2001207 - RNA, 14 nt, Human
gcaagacgcugugc

SEQ ID NO: 2001208 - RNA, 23 nt, Human
gcaagacgcugugcugcccugcc

SEQ ID NO: 2001209 - RNA, 22 nt, Human
gcaaauccuugugggaaaagaa

SEQ ID NO: 2001210 - RNA, 13 nt, Human
gcaagaaaagagu

SEQ ID NO: 2001211 - RNA, 17 nt, Human
gcaagaauugaagcagg

SEQ ID NO: 2001212 - RNA, 21 nt, Human
gcaaagcccagcuugaaaccu

SEQ ID NO: 2001213 - RNA, 13 nt, Human
gcaaagcccagcu

SEQ ID NO: 2001214 - RNA, 21 nt, Human
gcaaagcaugccaauuucucu

SEQ ID NO: 2001215 - RNA, 20 nt, Human
gcaaagcauguuuugcaugu

SEQ ID NO: 2001216 - RNA, 20 nt, Human
gcaaauccuugugggaaaag

SEQ ID NO: 2001217 - RNA, 16 nt, Human
gcaaauccgaaaucag

SEQ ID NO: 2001218 - RNA, 20 nt, Human
gcaaaguacagguacuuugu

SEQ ID NO: 2001219 - RNA, 19 nt, Human
gcaaaguacagguacuuug

SEQ ID NO: 2001220 - RNA, 16 nt, Human
gcaaaguaucccuacu

SEQ ID NO: 2001221 - RNA, 23 nt, Human
gcaaagggggaggagaagaaaau

SEQ ID NO: 2001222 - RNA, 21 nt, Human
gauuuuugagcccuuguuuca

SEQ ID NO: 2001223 - RNA, 11 nt, Human
gauuuuccauc

SEQ ID NO: 2001224 - RNA, 16 nt, Human
gauuuuccaucuaaaa

SEQ ID NO: 2001225 - RNA, 21 nt, Human
gauuuuccaucuaaaaauaua

SEQ ID NO: 2001226 - RNA, 19 nt, Human
gauuuguuaaugauagcua

SEQ ID NO: 2001227 - RNA, 17 nt, Human
gauuugucacugcuuca

SEQ ID NO: 2001228 - RNA, 13 nt, Human
gauuuuauguuga

SEQ ID NO: 2001229 - RNA, 14 nt, Human
gauuuuauguugac

SEQ ID NO: 2001230 - RNA, 16 nt, Human
gauuuuauguugacau

SEQ ID NO: 2001231 - RNA, 18 nt, Human
gauuuuauguugacauuu

SEQ ID NO: 2001232 - RNA, 20 nt, Human
gauuuuauguugacauuugu

SEQ ID NO: 2001233 - RNA, 13 nt, Human
gauuuuauucuug

SEQ ID NO: 2001234 - RNA, 15 nt, Human
gauuuuauucuugau

SEQ ID NO: 2001235 - RNA, 14 nt, Human
gauuucuguucagc

SEQ ID NO: 2001236 - RNA, 13 nt, Human
gauuugccauaga

SEQ ID NO: 2001237 - RNA, 11 nt, Human
gauuucuguuu

SEQ ID NO: 2001238 - RNA, 19 nt, Human
gauuucuguuuagauaaua

SEQ ID NO: 2001239 - RNA, 23 nt, Human
gauuugcucagugucuggcugca

SEQ ID NO: 2001240 - RNA, 17 nt, Human
gauuugccauagaguac

SEQ ID NO: 2001241 - RNA, 20 nt, Human
gauuuggggcucagaguggg

SEQ ID NO: 2001242 - RNA, 15 nt, Human
gauuugggagaaggg

SEQ ID NO: 2001243 - RNA, 22 nt, Human
gauuuggucaacacuaacauga

SEQ ID NO: 2001244 - RNA, 15 nt, Human
gauuuccguuaaaau

SEQ ID NO: 2001245 - RNA, 18 nt, Human
gauuuccguuaaaauacc

SEQ ID NO: 2001246 - RNA, 13 nt, Human
gauuucucuuuga

SEQ ID NO: 2001247 - RNA, 22 nt, Human
gauuucucuuugaaacaugcuu

SEQ ID NO: 2001248 - RNA, 15 nt, Human
gauugcagaauuguu

SEQ ID NO: 2001249 - RNA, 16 nt, Human
gauugcagaauuguuu

SEQ ID NO: 2001250 - RNA, 19 nt, Human
gauugcagaauuguuuaga

SEQ ID NO: 2001251 - RNA, 13 nt, Human
gauugcagaauug

SEQ ID NO: 2001252 - RNA, 19 nt, Human
gauucauauuuacuucuua

SEQ ID NO: 2001253 - RNA, 18 nt, Human
gauucauauuuacuucuu

SEQ ID NO: 2001254 - RNA, 12 nt, Human
gauucauauuua

SEQ ID NO: 2001255 - RNA, 14 nt, Human
gauucagauuucuc

SEQ ID NO: 2001256 - RNA, 12 nt, Human
gauucagccuuc

SEQ ID NO: 2001257 - RNA, 13 nt, Human
gauucagccuucu

SEQ ID NO: 2001258 - RNA, 15 nt, Human
gauucagccuucuuu

SEQ ID NO: 2001259 - RNA, 21 nt, Human
gauucagccuucuuuuucugg

SEQ ID NO: 2001260 - RNA, 23 nt, Human
gauucagccuucuuuuucuggac

SEQ ID NO: 2001261 - RNA, 17 nt, Human
gauucauauuuacuucu

SEQ ID NO: 2001262 - RNA, 17 nt, Human
gauuccagguggcauca

SEQ ID NO: 2001263 - RNA, 18 nt, Human
gauucccaagcucugcuc

SEQ ID NO: 2001264 - RNA, 19 nt, Human
gauuccagagaguggcucc

SEQ ID NO: 2001265 - RNA, 20 nt, Human
gauuccagagaguggcuccu

SEQ ID NO: 2001266 - RNA, 22 nt, Human
gauuccagagaguggcuccucc

SEQ ID NO: 2001267 - RNA, 15 nt, Human
gauuccagcacaacc

SEQ ID NO: 2001268 - RNA, 20 nt, Human
gauucagauuucucuuugaa

SEQ ID NO: 2001269 - RNA, 15 nt, Human
gauucagcucugcaa

SEQ ID NO: 2001270 - RNA, 13 nt, Human
gauucagcucugc

SEQ ID NO: 2001271 - RNA, 19 nt, Human
gauucagacagcugccugg

SEQ ID NO: 2001272 - RNA, 12 nt, Human
gauggggcuggg

SEQ ID NO: 2001273 - RNA, 23 nt, Human
gauggggcugcaccggcuggccu

SEQ ID NO: 2001274 - RNA, 12 nt, Human
gauucuuuccug

SEQ ID NO: 2001275 - RNA, 18 nt, Human
gauucguggucuuuuccu

SEQ ID NO: 2001276 - RNA, 23 nt, Human
gauucguggucuuuuccucgcuu

SEQ ID NO: 2001277 - RNA, 17 nt, Human
gauuccauuuacugcau

SEQ ID NO: 2001278 - RNA, 21 nt, Human
gauucccaagcucugcuccuc

SEQ ID NO: 2001279 - RNA, 19 nt, Human
gauucccaagcucugcucc

SEQ ID NO: 2001280 - RNA, 20 nt, Human
gauucccaagcucugcuccu

SEQ ID NO: 2001281 - RNA, 17 nt, Human
gauucuuuccugaggcu

SEQ ID NO: 2001282 - RNA, 16 nt, Human
gauucuuuccugaggc

SEQ ID NO: 2001283 - RNA, 18 nt, Human
gauucuuuccugaggcug

SEQ ID NO: 2001284 - RNA, 20 nt, Human
gauugcaacaggcugggcuu

SEQ ID NO: 2001285 - RNA, 23 nt, Human
gauugcaccacugcacuccagcc

SEQ ID NO: 2001286 - RNA, 16 nt, Human
gauugcaccacugcac

SEQ ID NO: 2001287 - RNA, 21 nt, Human
gauugcaacaggcugggcuuc

SEQ ID NO: 2001288 - RNA, 14 nt, Human
gaugaagacagccc

SEQ ID NO: 2001289 - RNA, 15 nt, Human
gaugaaaauauuuaa

SEQ ID NO: 2001290 - RNA, 16 nt, Human
gaugaaaauauuuaaa

SEQ ID NO: 2001291 - RNA, 14 nt, Human
gaugaaaauauuua

SEQ ID NO: 2001292 - RNA, 17 nt, Human
gaugaaaauauuuaaag

SEQ ID NO: 2001293 - RNA, 22 nt, Human
gaucugugccuuuuuuauaucu

SEQ ID NO: 2001294 - RNA, 21 nt, Human
gaucugugaggggcucucuca

SEQ ID NO: 2001295 - RNA, 21 nt, Human
gaucucaggggucuuaccuug

SEQ ID NO: 2001296 - RNA, 18 nt, Human
gaucuuugcagacaggca

SEQ ID NO: 2001297 - RNA, 17 nt, Human
gaucuuugcagacaggc

SEQ ID NO: 2001298 - RNA, 21 nt, Human
gauccugcacugacucuggaa

SEQ ID NO: 2001299 - RNA, 20 nt, Human
gaucgucugguuagaaaaca

SEQ ID NO: 2001300 - RNA, 16 nt, Human
gaucgguuaacaaaua

SEQ ID NO: 2001301 - RNA, 17 nt, Human
gaucgguuaacaaauaa

SEQ ID NO: 2001302 - RNA, 21 nt, Human
gaucuaaaaauaacuguaauu

SEQ ID NO: 2001303 - RNA, 22 nt, Human
gauccugagccagauuucacuc

SEQ ID NO: 2001304 - RNA, 21 nt, Human
gauccugagccagauuucacu

SEQ ID NO: 2001305 - RNA, 18 nt, Human
gauccugcacugacucug

SEQ ID NO: 2001306 - RNA, 16 nt, Human
gaucccucauccucau

SEQ ID NO: 2001307 - RNA, 15 nt, Human
gaucccucauccuca

SEQ ID NO: 2001308 - RNA, 16 nt, Human
gauccccuuccuacca

SEQ ID NO: 2001309 - RNA, 18 nt, Human
gauccccuuccuaccacc

SEQ ID NO: 2001310 - RNA, 21 nt, Human
gauggcuaguaucaaaagaaa

SEQ ID NO: 2001311 - RNA, 13 nt, Human
gauggcugugccu

SEQ ID NO: 2001312 - RNA, 17 nt, Human
gauggcugugccucugc

SEQ ID NO: 2001313 - RNA, 18 nt, Human
gauggcugugccucugcc

SEQ ID NO: 2001314 - RNA, 19 nt, Human
gauggcugugccucugccu

SEQ ID NO: 2001315 - RNA, 22 nt, Human
gauggggcccugccuccuuugu

SEQ ID NO: 2001316 - RNA, 14 nt, Human
gauggggcccugcc

SEQ ID NO: 2001317 - RNA, 13 nt, Human
gauggggcccugc

SEQ ID NO: 2001318 - RNA, 19 nt, Human
gauggcuggaaggggucca

SEQ ID NO: 2001319 - RNA, 16 nt, Human
gauggcuuacaaaaag

SEQ ID NO: 2001320 - RNA, 20 nt, Human
gauggcugugccucugccug

SEQ ID NO: 2001321 - RNA, 20 nt, Human
gauggcaaagaaggagagca

SEQ ID NO: 2001322 - RNA, 22 nt, Human
gauggauuuccagccaaagccu

SEQ ID NO: 2001323 - RNA, 20 nt, Human
gaugccugguggcagcugcg

SEQ ID NO: 2001324 - RNA, 18 nt, Human
gaugccugguggcagcug

SEQ ID NO: 2001325 - RNA, 19 nt, Human
gaugccugguggcagcugc

SEQ ID NO: 2001326 - RNA, 21 nt, Human
gaugccaagaaguuuaaggaa

SEQ ID NO: 2001327 - RNA, 22 nt, Human
gaugccacuaccccuugauuuu

SEQ ID NO: 2001328 - RNA, 12 nt, Human
gaugcagccuca

SEQ ID NO: 2001329 - RNA, 14 nt, Human
gaugcagccucaca

SEQ ID NO: 2001330 - RNA, 19 nt, Human
gaugcagccucacaguccu

SEQ ID NO: 2001331 - RNA, 20 nt, Human
gaugacaugcacucagcucu

SEQ ID NO: 2001332 - RNA, 21 nt, Human
gaugcacagaguuguuacauu

SEQ ID NO: 2001333 - RNA, 22 nt, Human
gaugcacagaguuguuacauuu

SEQ ID NO: 2001334 - RNA, 13 nt, Human
gaugcaccagccc

SEQ ID NO: 2001335 - RNA, 21 nt, Human
gaggaaggaaacccagcucug

SEQ ID NO: 2001336 - RNA, 20 nt, Human
gaggaaggaaacccagcucu

SEQ ID NO: 2001337 - RNA, 19 nt, Human
gaggaaggaaacccagcuc

SEQ ID NO: 2001338 - RNA, 13 nt, Human
gaggaaggaaacc

SEQ ID NO: 2001339 - RNA, 19 nt, Human
gauaaaguugguaaaccuu

SEQ ID NO: 2001340 - RNA, 21 nt, Human
gauaaagauugugugguguuu

SEQ ID NO: 2001341 - RNA, 13 nt, Human
gauaaagauugug

SEQ ID NO: 2001342 - RNA, 16 nt, Human
gauaaagauugugugg

SEQ ID NO: 2001343 - RNA, 20 nt, Human
gauaagcaguuaugugaccu

SEQ ID NO: 2001344 - RNA, 21 nt, Human
gauaaauauugagcagaucua

SEQ ID NO: 2001345 - RNA, 18 nt, Human
gauaagggacugauguuu

SEQ ID NO: 2001346 - RNA, 15 nt, Human
gauaaauauuauauu

SEQ ID NO: 2001347 - RNA, 22 nt, Human
gauaaauauuauauuauauaua

SEQ ID NO: 2001348 - RNA, 17 nt, Human
gauaaauaguguuauug

SEQ ID NO: 2001349 - RNA, 12 nt, Human
gauaaauauuca

SEQ ID NO: 2001350 - RNA, 20 nt, Human
gauaaauauucacacuugaa

SEQ ID NO: 2001351 - RNA, 22 nt, Human
gauaaauaguuuaugauuccac

SEQ ID NO: 2001352 - RNA, 20 nt, Human
gauagcacagacccugcccu

SEQ ID NO: 2001353 - RNA, 22 nt, Human
gauagcacagacccugcccugu

SEQ ID NO: 2001354 - RNA, 21 nt, Human
gauagcacagacccugcccug

SEQ ID NO: 2001355 - RNA, 13 nt, Human
gauagaugugugg

SEQ ID NO: 2001356 - RNA, 18 nt, Human
gauacaggaaaagcugcu

SEQ ID NO: 2001357 - RNA, 19 nt, Human
gauacaggaaaagcugcug

SEQ ID NO: 2001358 - RNA, 14 nt, Human
gauaauacaccacu

SEQ ID NO: 2001359 - RNA, 18 nt, Human
gauaauacaccacuacau

SEQ ID NO: 2001360 - RNA, 21 nt, Human
gauaauacaccacuacauucu

SEQ ID NO: 2001361 - RNA, 22 nt, Human
gauaauacaccacuacauucug

SEQ ID NO: 2001362 - RNA, 11 nt, Human
gauacagaaaa

SEQ ID NO: 2001363 - RNA, 19 nt, Human
gauacaccgggccuggaga

SEQ ID NO: 2001364 - RNA, 23 nt, Human
gauagauaggucagugcaaauac

SEQ ID NO: 2001365 - RNA, 20 nt, Human
gaucauugugaaauuauuca

SEQ ID NO: 2001366 - RNA, 15 nt, Human
gaucauuugaguuca

SEQ ID NO: 2001367 - RNA, 14 nt, Human
gaucauuaucagcc

SEQ ID NO: 2001368 - RNA, 14 nt, Human
gaucauugugaaau

SEQ ID NO: 2001369 - RNA, 20 nt, Human
gauccccaagccuggcaagg

SEQ ID NO: 2001370 - RNA, 17 nt, Human
gaucaguaguuugcauu

SEQ ID NO: 2001371 - RNA, 22 nt, Human
gaucaguaguuugcauuucaga

SEQ ID NO: 2001372 - RNA, 17 nt, Human
gaucauccacugugcca

SEQ ID NO: 2001373 - RNA, 19 nt, Human
gaucauccacugugccaug

SEQ ID NO: 2001374 - RNA, 16 nt, Human
gaucauccacugugcc

SEQ ID NO: 2001375 - RNA, 21 nt, Human
gaucauccacugugccaugug

SEQ ID NO: 2001376 - RNA, 12 nt, Human
gaucaugaauaa

SEQ ID NO: 2001377 - RNA, 12 nt, Human
gaucacggcuca

SEQ ID NO: 2001378 - RNA, 14 nt, Human
gaucagccagaagc

SEQ ID NO: 2001379 - RNA, 15 nt, Human
gaucagccagaagcc

SEQ ID NO: 2001380 - RNA, 15 nt, Human
gaucagccugggcaa

SEQ ID NO: 2001381 - RNA, 12 nt, Human
gaucagccuggg

SEQ ID NO: 2001382 - RNA, 16 nt, Human
gaucaguaguuugcau

SEQ ID NO: 2001383 - RNA, 22 nt, Human
gaucagucugauucccaagcuc

SEQ ID NO: 2001384 - RNA, 16 nt, Human
gaucacgccacugcac

SEQ ID NO: 2001385 - RNA, 18 nt, Human
gaucacgccacugcacua

SEQ ID NO: 2001386 - RNA, 21 nt, Human
gaucaaguuauuuuuaauuug

SEQ ID NO: 2001387 - RNA, 13 nt, Human
gauagugggacca

SEQ ID NO: 2001388 - RNA, 17 nt, Human
gcauuugcugaauacag

SEQ ID NO: 2001389 - RNA, 13 nt, Human
gcauuuguguguu

SEQ ID NO: 2001390 - RNA, 14 nt, Human
gcauuugcugaaua

SEQ ID NO: 2001391 - RNA, 16 nt, Human
gcauuuguguugaaga

SEQ ID NO: 2001392 - RNA, 15 nt, Human
gcauuuguguguuac

SEQ ID NO: 2001393 - RNA, 16 nt, Human
gcauuuguuugaacug

SEQ ID NO: 2001394 - RNA, 13 nt, Human
gcauuugcugaau

SEQ ID NO: 2001395 - RNA, 21 nt, Human
gcauuugaggucuguucuuuc

SEQ ID NO: 2001396 - RNA, 19 nt, Human
gcauucaaauguauuacag

SEQ ID NO: 2001397 - RNA, 14 nt, Human
gcauucuuauucau

SEQ ID NO: 2001398 - RNA, 15 nt, Human
gcauucuuauucauc

SEQ ID NO: 2001399 - RNA, 14 nt, Human
gcauucuucugauc

SEQ ID NO: 2001400 - RNA, 21 nt, Human
gcauucuucugaucacugaaa

SEQ ID NO: 2001401 - RNA, 18 nt, Human
gcauuauauuuguaaauu

SEQ ID NO: 2001402 - RNA, 17 nt, Human
gcauuaucuagauacug

SEQ ID NO: 2001403 - RNA, 20 nt, Human
gcauuauaaucaccagggcc

SEQ ID NO: 2001404 - RNA, 19 nt, Human
gccaaagccuccuccagcc

SEQ ID NO: 2001405 - RNA, 16 nt, Human
gccaaagccuccucca

SEQ ID NO: 2001406 - RNA, 13 nt, Human
gccaaagccaaag

SEQ ID NO: 2001407 - RNA, 20 nt, Human
gccaaagccaaagcuaggcc

SEQ ID NO: 2001408 - RNA, 16 nt, Human
gccaaagcuaggccug

SEQ ID NO: 2001409 - RNA, 22 nt, Human
gccaaagcuaggccuggccaga

SEQ ID NO: 2001410 - RNA, 12 nt, Human
gccaaaggaagc

SEQ ID NO: 2001411 - RNA, 16 nt, Human
gccaaacucaccugcc

SEQ ID NO: 2001412 - RNA, 14 nt, Human
gccaaacucaccug

SEQ ID NO: 2001413 - RNA, 16 nt, Human
gccaaaaaaagacagg

SEQ ID NO: 2001414 - RNA, 18 nt, Human
gcauuuguuugaacugau

SEQ ID NO: 2001415 - RNA, 22 nt, Human
gcauuuguuucuuucucugagg

SEQ ID NO: 2001416 - RNA, 14 nt, Human
gccaaaaaaagaca

SEQ ID NO: 2001417 - RNA, 16 nt, Human
gcauuuuugcaggagc

SEQ ID NO: 2001418 - RNA, 17 nt, Human
gcauuuuugcaggagca

SEQ ID NO: 2001419 - RNA, 20 nt, Human
gcauggcaaggacugcaggg

SEQ ID NO: 2001420 - RNA, 15 nt, Human
gcauguucucugagg

SEQ ID NO: 2001421 - RNA, 21 nt, Human
gcauguucucugaggacacua

SEQ ID NO: 2001422 - RNA, 22 nt, Human
gcauguucucugaggacacuaa

SEQ ID NO: 2001423 - RNA, 18 nt, Human
gcaugcgggcuuccuccu

SEQ ID NO: 2001424 - RNA, 18 nt, Human
gcauggagauagccccac

SEQ ID NO: 2001425 - RNA, 18 nt, Human
gcaugauugcagaauugu

SEQ ID NO: 2001426 - RNA, 20 nt, Human
gcaucugaccucuaccuuca

SEQ ID NO: 2001427 - RNA, 16 nt, Human
gcaucugaaaauugau

SEQ ID NO: 2001428 - RNA, 20 nt, Human
gcaucacuuaaaacacguuu

SEQ ID NO: 2001429 - RNA, 16 nt, Human
gcaucacuuaaaacac

SEQ ID NO: 2001430 - RNA, 21 nt, Human
gcaugaacagcuaauuguacc

SEQ ID NO: 2001431 - RNA, 15 nt, Human
gcaugaacagugcac

SEQ ID NO: 2001432 - RNA, 18 nt, Human
gcaugaaguaauaugcac

SEQ ID NO: 2001433 - RNA, 16 nt, Human
gcaugaaaauuguguu

SEQ ID NO: 2001434 - RNA, 16 nt, Human
gcaugaaaugaacaca

SEQ ID NO: 2001435 - RNA, 18 nt, Human
gcaugaaaugaacacaaa

SEQ ID NO: 2001436 - RNA, 19 nt, Human
gcaugaaaugaacacaaau

SEQ ID NO: 2001437 - RNA, 13 nt, Human
gcaucuuugaugu

SEQ ID NO: 2001438 - RNA, 11 nt, Human
gcaucuuugau

SEQ ID NO: 2001439 - RNA, 15 nt, Human
gcaucuuugaugugu

SEQ ID NO: 2001440 - RNA, 17 nt, Human
gcaucuuugauguguug

SEQ ID NO: 2001441 - RNA, 22 nt, Human
gcaguggugguuuucuguucuu

SEQ ID NO: 2001442 - RNA, 23 nt, Human
gcaguggugguuuucuguucuuu

SEQ ID NO: 2001443 - RNA, 13 nt, Human
gcagugggagcug

SEQ ID NO: 2001444 - RNA, 12 nt, Human
gcagugggagcu

SEQ ID NO: 2001445 - RNA, 14 nt, Human
gcagugggagcugc

SEQ ID NO: 2001446 - RNA, 15 nt, Human
gcagugggagcugcc

SEQ ID NO: 2001447 - RNA, 17 nt, Human
gcaguuauuaacacuaa

SEQ ID NO: 2001448 - RNA, 13 nt, Human
gcaguucaccaug

SEQ ID NO: 2001449 - RNA, 23 nt, Human
gcaguuaugugaccucacgugca

SEQ ID NO: 2001450 - RNA, 13 nt, Human
gcauagaaguaaa

SEQ ID NO: 2001451 - RNA, 20 nt, Human
gcauaugacaaauguuucua

SEQ ID NO: 2001452 - RNA, 18 nt, Human
gcauaugacaaauguuuc

SEQ ID NO: 2001453 - RNA, 19 nt, Human
gcauaugacaaauguuucu

SEQ ID NO: 2001454 - RNA, 14 nt, Human
gcauaugacaaaug

SEQ ID NO: 2001455 - RNA, 15 nt, Human
gcauaugacaaaugu

SEQ ID NO: 2001456 - RNA, 16 nt, Human
gcauaugacaaauguu

SEQ ID NO: 2001457 - RNA, 17 nt, Human
gcauaugacaaauguuu

SEQ ID NO: 2001458 - RNA, 22 nt, Human
gcauaugcuucuuuaaaaaagc

SEQ ID NO: 2001459 - RNA, 19 nt, Human
gcauauuuauaaaaauaaa

SEQ ID NO: 2001460 - RNA, 17 nt, Human
gcauagguuuaauaauu

SEQ ID NO: 2001461 - RNA, 16 nt, Human
gcaguucuuaacccag

SEQ ID NO: 2001462 - RNA, 17 nt, Human
gcauaguaaauguaguu

SEQ ID NO: 2001463 - RNA, 22 nt, Human
gcauauaaaauggcaacaaacu

SEQ ID NO: 2001464 - RNA, 22 nt, Human
gcauagucuacuuguuauaaau

SEQ ID NO: 2001465 - RNA, 15 nt, Human
gcauauaaaauggca

SEQ ID NO: 2001466 - RNA, 14 nt, Human
gcauauccuuuuag

SEQ ID NO: 2001467 - RNA, 19 nt, Human
gcaggggcccugcagcucu

SEQ ID NO: 2001468 - RNA, 20 nt, Human
gcaggggcccugcagcucuc

SEQ ID NO: 2001469 - RNA, 14 nt, Human
gcagggcucagcgg

SEQ ID NO: 2001470 - RNA, 22 nt, Human
gcagggcucagcggggacagcu

SEQ ID NO: 2001471 - RNA, 17 nt, Human
gcagggucucacucugu

SEQ ID NO: 2001472 - RNA, 18 nt, Human
gcagggucucacucuguc

SEQ ID NO: 2001473 - RNA, 16 nt, Human
gcaggcagccaggcca

SEQ ID NO: 2001474 - RNA, 15 nt, Human
gcaggcagccaggcc

SEQ ID NO: 2001475 - RNA, 19 nt, Human
gcagggcucagcggggaca

SEQ ID NO: 2001476 - RNA, 21 nt, Human
gcagggcucagcggggacagc

SEQ ID NO: 2001477 - RNA, 16 nt, Human
gcaguggagcccagga

SEQ ID NO: 2001478 - RNA, 17 nt, Human
gcaguggagcccaggag

SEQ ID NO: 2001479 - RNA, 20 nt, Human
gcaguggcgaaaucccugcu

SEQ ID NO: 2001480 - RNA, 16 nt, Human
gcagugcaugcugucc

SEQ ID NO: 2001481 - RNA, 16 nt, Human
gcagugcaaggaggga

SEQ ID NO: 2001482 - RNA, 14 nt, Human
gcagugcccaggug

SEQ ID NO: 2001483 - RNA, 15 nt, Human
gcagugcccaggugg

SEQ ID NO: 2001484 - RNA, 15 nt, Human
gcagugcaugcuguc

SEQ ID NO: 2001485 - RNA, 23 nt, Human
gcaggugaucugcugcagagcag

SEQ ID NO: 2001486 - RNA, 19 nt, Human
gcagggugucugcccccuc

SEQ ID NO: 2001487 - RNA, 23 nt, Human
gcagggugucugcccccuccuga

SEQ ID NO: 2001488 - RNA, 16 nt, Human
gcagguaggaauauua

SEQ ID NO: 2001489 - RNA, 20 nt, Human
gcagguaggaauauuauauu

SEQ ID NO: 2001490 - RNA, 22 nt, Human
gcagguccaggguuugaguuca

SEQ ID NO: 2001491 - RNA, 19 nt, Human
gcaggucuugaacuccugg

SEQ ID NO: 2001492 - RNA, 20 nt, Human
gcaggucuugaacuccuggc

SEQ ID NO: 2001493 - RNA, 13 nt, Human
gcagguccccaga

SEQ ID NO: 2001494 - RNA, 14 nt, Human
gcagguccccagac

SEQ ID NO: 2001495 - RNA, 13 nt, Human
gcacgugcacaaa

SEQ ID NO: 2001496 - RNA, 20 nt, Human
gcacugcuuccagugaggcu

SEQ ID NO: 2001497 - RNA, 22 nt, Human
gcacugcuuccagugaggcucu

SEQ ID NO: 2001498 - RNA, 12 nt, Human
gcacugcugccc

SEQ ID NO: 2001499 - RNA, 22 nt, Human
gcacugguggcccgacagccug

SEQ ID NO: 2001500 - RNA, 23 nt, Human
gcacugguggcccgacagccugg

SEQ ID NO: 2001501 - RNA, 24 nt, Human
gcacugguggcccgacagccuggc

SEQ ID NO: 2001502 - RNA, 13 nt, Human
gcacugcucucac

SEQ ID NO: 2001503 - RNA, 15 nt, Human
gcacugcucucaccu

SEQ ID NO: 2001504 - RNA, 18 nt, Human
gcacugcuuccagugagg

SEQ ID NO: 2001505 - RNA, 16 nt, Human
gcacugcuuccaguga

SEQ ID NO: 2001506 - RNA, 14 nt, Human
gcacuucaggaggc

SEQ ID NO: 2001507 - RNA, 13 nt, Human
gcagaauuggaaa

SEQ ID NO: 2001508 - RNA, 14 nt, Human
gcagaauuggaaaa

SEQ ID NO: 2001509 - RNA, 19 nt, Human
gcacuucagggcagauuuu

SEQ ID NO: 2001510 - RNA, 15 nt, Human
gcagacaggaccagg

SEQ ID NO: 2001511 - RNA, 13 nt, Human
gcagacaggacca

SEQ ID NO: 2001512 - RNA, 12 nt, Human
gcagacaggacc

SEQ ID NO: 2001513 - RNA, 20 nt, Human
gcagaauuggaaaagacuaa

SEQ ID NO: 2001514 - RNA, 21 nt, Human
gcagaauuguuuagauuuugu

SEQ ID NO: 2001515 - RNA, 23 nt, Human
gcagaauuguuuagauuuugugu

SEQ ID NO: 2001516 - RNA, 15 nt, Human
gcagacaaucuucug

SEQ ID NO: 2001517 - RNA, 23 nt, Human
gcagacaggcaagcaccuccugc

SEQ ID NO: 2001518 - RNA, 18 nt, Human
gcagacaggaccagggau

SEQ ID NO: 2001519 - RNA, 19 nt, Human
gcagacaggcaagcaccuc

SEQ ID NO: 2001520 - RNA, 17 nt, Human
gcaccuuagacaguccc

SEQ ID NO: 2001521 - RNA, 14 nt, Human
gcaccuuagacagu

SEQ ID NO: 2001522 - RNA, 22 nt, Human
gcaccuggaauauauaaccagu

SEQ ID NO: 2001523 - RNA, 18 nt, Human
gcaccuggaauauauaac

SEQ ID NO: 2001524 - RNA, 21 nt, Human
gcaccuggaauauauaaccag

SEQ ID NO: 2001525 - RNA, 15 nt, Human
gcacccucaggcagg

SEQ ID NO: 2001526 - RNA, 23 nt, Human
gcacccguguuuguaaaaaugua

SEQ ID NO: 2001527 - RNA, 12 nt, Human
gcacgauuucug

SEQ ID NO: 2001528 - RNA, 18 nt, Human
gcaccuuagacagucccu

SEQ ID NO: 2001529 - RNA, 19 nt, Human
gcaccuuagacagucccug

SEQ ID NO: 2001530 - RNA, 22 nt, Human
gcaccacugcacuccagccugg

SEQ ID NO: 2001531 - RNA, 21 nt, Human
gcaccacugcacuccagccug

SEQ ID NO: 2001532 - RNA, 15 nt, Human
gcaccagcagccugg

SEQ ID NO: 2001533 - RNA, 12 nt, Human
gcaauggcagcc

SEQ ID NO: 2001534 - RNA, 13 nt, Human
gcaauggcagccu

SEQ ID NO: 2001535 - RNA, 20 nt, Human
gcaccacugcacuccagccu

SEQ ID NO: 2001536 - RNA, 14 nt, Human
gcaauggcagccuu

SEQ ID NO: 2001537 - RNA, 16 nt, Human
gcaccagcagccugga

SEQ ID NO: 2001538 - RNA, 19 nt, Human
gcaccagcccagaagugca

SEQ ID NO: 2001539 - RNA, 19 nt, Human
gcacccggccccugcuggu

SEQ ID NO: 2001540 - RNA, 22 nt, Human
gcacccaccaucaugucuggcu

SEQ ID NO: 2001541 - RNA, 17 nt, Human
gcagcccugcagagggc

SEQ ID NO: 2001542 - RNA, 16 nt, Human
gcagcccugcagaggg

SEQ ID NO: 2001543 - RNA, 15 nt, Human
gcagcccugcagagg

SEQ ID NO: 2001544 - RNA, 14 nt, Human
gcagcccugcagag

SEQ ID NO: 2001545 - RNA, 13 nt, Human
gcagcccugcuuu

SEQ ID NO: 2001546 - RNA, 15 nt, Human
gcagcucaccucucc

SEQ ID NO: 2001547 - RNA, 14 nt, Human
gcagcucaccucuc

SEQ ID NO: 2001548 - RNA, 15 nt, Human
gcagccuuggcaaac

SEQ ID NO: 2001549 - RNA, 14 nt, Human
gcaggcagccaggc

SEQ ID NO: 2001550 - RNA, 13 nt, Human
gcaggcagccagg

SEQ ID NO: 2001551 - RNA, 12 nt, Human
gcaggcagccag

SEQ ID NO: 2001552 - RNA, 9 nt, Human
gcaggcagc

SEQ ID NO: 2001553 - RNA, 21 nt, Human
gcaggagggacagucucacca

SEQ ID NO: 2001554 - RNA, 20 nt, Human
gcaggaggaucacuugaguc

SEQ ID NO: 2001555 - RNA, 20 nt, Human
gcaggaaggcugagaggaga

SEQ ID NO: 2001556 - RNA, 13 nt, Human
gcaggaccagccc

SEQ ID NO: 2001557 - RNA, 14 nt, Human
gcaggacacugcag

SEQ ID NO: 2001558 - RNA, 19 nt, Human
gcaggacacugcagaacag

SEQ ID NO: 2001559 - RNA, 23 nt, Human
gcaggaggaucacuugaguccag

SEQ ID NO: 2001560 - RNA, 20 nt, Human
gcagccccgugggguuccuc

SEQ ID NO: 2001561 - RNA, 21 nt, Human
gcagccccuguucuggcagag

SEQ ID NO: 2001562 - RNA, 20 nt, Human
gcagccccuguucuggcaga

SEQ ID NO: 2001563 - RNA, 13 nt, Human
gcagcccugcaga

SEQ ID NO: 2001564 - RNA, 19 nt, Human
gcagcccgcaucagcugcu

SEQ ID NO: 2001565 - RNA, 22 nt, Human
gcagcccgcaucagcugcucag

SEQ ID NO: 2001566 - RNA, 16 nt, Human
gcagcaauaaagcagc

SEQ ID NO: 2001567 - RNA, 23 nt, Human
gcagcaauaaagcagcguuucua

SEQ ID NO: 2001568 - RNA, 17 nt, Human
gcagccccauucugccu

SEQ ID NO: 2001569 - RNA, 17 nt, Human
gcagauuuuaguuuuau

SEQ ID NO: 2001570 - RNA, 17 nt, Human
gcagcaauaauuucugu

SEQ ID NO: 2001571 - RNA, 18 nt, Human
gcagccccauucugccug

SEQ ID NO: 2001572 - RNA, 19 nt, Human
gcagccccauucugccugc

SEQ ID NO: 2001573 - RNA, 21 nt, Human
gcagccccauucugccugccc

SEQ ID NO: 2001574 - RNA, 24 nt, Human
gcagccccauucugccugcccagg

SEQ ID NO: 2001575 - RNA, 17 nt, Human
gcagauacuacugacca

SEQ ID NO: 2001576 - RNA, 22 nt, Human
gcagauacuacugaccagacaa

SEQ ID NO: 2001577 - RNA, 24 nt, Human
gcagauacuacugaccagacaagc

SEQ ID NO: 2001578 - RNA, 22 nt, Human
gcagauacaggaaaagcugcug

SEQ ID NO: 2001579 - RNA, 21 nt, Human
gcagauucuaggaccuguguc

SEQ ID NO: 2001580 - RNA, 17 nt, Human
gcagacaguuaagagaa

SEQ ID NO: 2001581 - RNA, 20 nt, Human
gcagacagggggccagaaca

SEQ ID NO: 2001582 - RNA, 20 nt, Human
gcagacaugguggggucucc

SEQ ID NO: 2001583 - RNA, 20 nt, Human
gcagaguugaagacagagcu

SEQ ID NO: 2001584 - RNA, 18 nt, Human
gcagauaaacaguaguga

SEQ ID NO: 2001585 - RNA, 21 nt, Human
gcagaguugaagacagagcua

SEQ ID NO: 2001586 - RNA, 16 nt, Human
gacuagacacacaaag

SEQ ID NO: 2001587 - RNA, 19 nt, Human
gacuagacacacaaagcag

SEQ ID NO: 2001588 - RNA, 14 nt, Human
gacuagacacacaa

SEQ ID NO: 2001589 - RNA, 22 nt, Human
gacguguuaugacuccagaauu

SEQ ID NO: 2001590 - RNA, 17 nt, Human
gacuacucccccaggug

SEQ ID NO: 2001591 - RNA, 12 nt, Human
gacuacaggcac

SEQ ID NO: 2001592 - RNA, 14 nt, Human
gacuacuguucagc

SEQ ID NO: 2001593 - RNA, 22 nt, Human
gacucccccaguccccuucccg

SEQ ID NO: 2001594 - RNA, 16 nt, Human
gacuccugcaggcagc

SEQ ID NO: 2001595 - RNA, 15 nt, Human
gacuccugcaggcag

SEQ ID NO: 2001596 - RNA, 14 nt, Human
gacuccugcaggca

SEQ ID NO: 2001597 - RNA, 15 nt, Human
gacucaguggggagg

SEQ ID NO: 2001598 - RNA, 21 nt, Human
gacucauauccccuauuuaac

SEQ ID NO: 2001599 - RNA, 15 nt, Human
gacucagguugucug

SEQ ID NO: 2001600 - RNA, 11 nt, Human
gacuccagaaa

SEQ ID NO: 2001601 - RNA, 22 nt, Human
gacuccagaaaugucccuuucu

SEQ ID NO: 2001602 - RNA, 17 nt, Human
gaccuuuccugaggaag

SEQ ID NO: 2001603 - RNA, 20 nt, Human
gaccuuguaauguaacugcu

SEQ ID NO: 2001604 - RNA, 15 nt, Human
gaccuuguaauguaa

SEQ ID NO: 2001605 - RNA, 16 nt, Human
gaccuuguaauguaac

SEQ ID NO: 2001606 - RNA, 17 nt, Human
gaccuuguaauguaacu

SEQ ID NO: 2001607 - RNA, 18 nt, Human
gaccuuguaauguaacug

SEQ ID NO: 2001608 - RNA, 21 nt, Human
gaccuuucaauaggaaaaacu

SEQ ID NO: 2001609 - RNA, 23 nt, Human
gaccuugaacuggguacuugugg

SEQ ID NO: 2001610 - RNA, 19 nt, Human
gaccugccucggccuccca

SEQ ID NO: 2001611 - RNA, 13 nt, Human
gaccugcugaagu

SEQ ID NO: 2001612 - RNA, 20 nt, Human
gaccugcugaaguccggaac

SEQ ID NO: 2001613 - RNA, 21 nt, Human
gacgucagauguuuaaaacac

SEQ ID NO: 2001614 - RNA, 20 nt, Human
gacguguuaugacuccagaa

SEQ ID NO: 2001615 - RNA, 17 nt, Human
gacguguuaugacucca

SEQ ID NO: 2001616 - RNA, 11 nt, Human
gacgguuccua

SEQ ID NO: 2001617 - RNA, 16 nt, Human
gacgguuccuacacag

SEQ ID NO: 2001618 - RNA, 18 nt, Human
gacgguuccuacacagga

SEQ ID NO: 2001619 - RNA, 19 nt, Human
gacgguuccuacacaggac

SEQ ID NO: 2001620 - RNA, 21 nt, Human
gacgguuccuacacaggacag

SEQ ID NO: 2001621 - RNA, 22 nt, Human
gacgguuccuacacaggacagg

SEQ ID NO: 2001622 - RNA, 16 nt, Human
gacguacaaguaguuc

SEQ ID NO: 2001623 - RNA, 18 nt, Human
gacguacaaguaguucug

SEQ ID NO: 2001624 - RNA, 19 nt, Human
gacguacaaguaguucugu

SEQ ID NO: 2001625 - RNA, 22 nt, Human
gacguacaaguaguucuguauu

SEQ ID NO: 2001626 - RNA, 20 nt, Human
gacgacuguuuucccaacac

SEQ ID NO: 2001627 - RNA, 14 nt, Human
gacgcaccagccca

SEQ ID NO: 2001628 - RNA, 14 nt, Human
gacggagucccacc

SEQ ID NO: 2001629 - RNA, 18 nt, Human
gacggagucccaccuugg

SEQ ID NO: 2001630 - RNA, 23 nt, Human
gacggagucccaccuuggcugca

SEQ ID NO: 2001631 - RNA, 21 nt, Human
gacggagucccaccuuggcug

SEQ ID NO: 2001632 - RNA, 17 nt, Human
gacgggguuucaccaug

SEQ ID NO: 2001633 - RNA, 17 nt, Human
gaccuaaaaauuggugu

SEQ ID NO: 2001634 - RNA, 15 nt, Human
gaccuaaccagggcc

SEQ ID NO: 2001635 - RNA, 18 nt, Human
gaccuaaccagggccaga

SEQ ID NO: 2001636 - RNA, 19 nt, Human
gaccuaaccagggccagaa

SEQ ID NO: 2001637 - RNA, 22 nt, Human
gaccuaaccagggccagaagua

SEQ ID NO: 2001638 - RNA, 16 nt, Human
gaccucaccuaggaag

SEQ ID NO: 2001639 - RNA, 17 nt, Human
gaccucaccuaggaagu

SEQ ID NO: 2001640 - RNA, 15 nt, Human
gaccgugaggccaga

SEQ ID NO: 2001641 - RNA, 19 nt, Human
gaccgugaagauacuuugu

SEQ ID NO: 2001642 - RNA, 14 nt, Human
gaccgugaggccag

SEQ ID NO: 2001643 - RNA, 15 nt, Human
gaccugaggcccuuc

SEQ ID NO: 2001644 - RNA, 13 nt, Human
gaccucaggccug

SEQ ID NO: 2001645 - RNA, 12 nt, Human
gaccucaggccu

SEQ ID NO: 2001646 - RNA, 11 nt, Human
gaccucaggcc

SEQ ID NO: 2001647 - RNA, 21 nt, Human
gaccugaggcccuucucucca

SEQ ID NO: 2001648 - RNA, 18 nt, Human
gaccugaggcccuucucu

SEQ ID NO: 2001649 - RNA, 21 nt, Human
gaccugccccuccucucugcc

SEQ ID NO: 2001650 - RNA, 15 nt, Human
gaccugccucggccu

SEQ ID NO: 2001651 - RNA, 23 nt, Human
gaccugauuucugagcauuuaau

SEQ ID NO: 2001652 - RNA, 11 nt, Human
gacccacugcu

SEQ ID NO: 2001653 - RNA, 12 nt, Human
gacccacugcuu

SEQ ID NO: 2001654 - RNA, 17 nt, Human
gacccaugcugcccugu

SEQ ID NO: 2001655 - RNA, 16 nt, Human
gacccaugcugcccug

SEQ ID NO: 2001656 - RNA, 15 nt, Human
gacccaugcugcccu

SEQ ID NO: 2001657 - RNA, 14 nt, Human
gacccaugcugccc

SEQ ID NO: 2001658 - RNA, 13 nt, Human
gacccagggggag

SEQ ID NO: 2001659 - RNA, 23 nt, Human
gacccugucucaaaaaaagaaaa

SEQ ID NO: 2001660 - RNA, 16 nt, Human
gacccugcccuguggg

SEQ ID NO: 2001661 - RNA, 15 nt, Human
gacccugcccugugg

SEQ ID NO: 2001662 - RNA, 13 nt, Human
gacccugcccugu

SEQ ID NO: 2001663 - RNA, 21 nt, Human
gacccugaggcccagagggcc

SEQ ID NO: 2001664 - RNA, 12 nt, Human
gacccugcccug

SEQ ID NO: 2001665 - RNA, 20 nt, Human
gacccugaggcccagagggc

SEQ ID NO: 2001666 - RNA, 19 nt, Human
gacccugaggcccagaggg

SEQ ID NO: 2001667 - RNA, 18 nt, Human
gacccugaggcccagagg

SEQ ID NO: 2001668 - RNA, 23 nt, Human
gaccccucauagcccucacccug

SEQ ID NO: 2001669 - RNA, 13 nt, Human
gaccccuccaugu

SEQ ID NO: 2001670 - RNA, 22 nt, Human
gaccccucauagcccucacccu

SEQ ID NO: 2001671 - RNA, 16 nt, Human
gaccccaucugugaau

SEQ ID NO: 2001672 - RNA, 19 nt, Human
gaccccaucugugaauaag

SEQ ID NO: 2001673 - RNA, 23 nt, Human
gacaugaaaauagcaauauucuu

SEQ ID NO: 2001674 - RNA, 18 nt, Human
gacauggcuucugaaccu

SEQ ID NO: 2001675 - RNA, 17 nt, Human
gacaugucuuuucuugc

SEQ ID NO: 2001676 - RNA, 12 nt, Human
gacauggugggg

SEQ ID NO: 2001677 - RNA, 21 nt, Human
gacaugucuuuucuugcauga

SEQ ID NO: 2001678 - RNA, 13 nt, Human
gaccaaauggaaa

SEQ ID NO: 2001679 - RNA, 21 nt, Human
gaccaaauggaaacagaggac

SEQ ID NO: 2001680 - RNA, 14 nt, Human
gacaucaacagaua

SEQ ID NO: 2001681 - RNA, 23 nt, Human
gacauacuaaccagcagaaaugc

SEQ ID NO: 2001682 - RNA, 15 nt, Human
gacauacuaaccagc

SEQ ID NO: 2001683 - RNA, 16 nt, Human
gacauacuaaccagca

SEQ ID NO: 2001684 - RNA, 17 nt, Human
gacaggcgaaagaaaac

SEQ ID NO: 2001685 - RNA, 16 nt, Human
gacaggcgaaagaaaa

SEQ ID NO: 2001686 - RNA, 12 nt, Human
gacagcaugaga

SEQ ID NO: 2001687 - RNA, 19 nt, Human
gacagccaacuauggccug

SEQ ID NO: 2001688 - RNA, 13 nt, Human
gacagcugccugg

SEQ ID NO: 2001689 - RNA, 12 nt, Human
gacagcugccug

SEQ ID NO: 2001690 - RNA, 22 nt, Human
gacagccaacuauggccugugg

SEQ ID NO: 2001691 - RNA, 13 nt, Human
gacagccacggcc

SEQ ID NO: 2001692 - RNA, 14 nt, Human
gacagacacaggcc

SEQ ID NO: 2001693 - RNA, 18 nt, Human
gacacgugggcuccccuc

SEQ ID NO: 2001694 - RNA, 19 nt, Human
gacacgugggcuccccucu

SEQ ID NO: 2001695 - RNA, 20 nt, Human
gacacgugggcuccccucuu

SEQ ID NO: 2001696 - RNA, 23 nt, Human
gacacgugggcuccccucuuccu

SEQ ID NO: 2001697 - RNA, 20 nt, Human
gacacuaaccacgcuggacc

SEQ ID NO: 2001698 - RNA, 21 nt, Human
gacacuaaccacgcuggaccu

SEQ ID NO: 2001699 - RNA, 15 nt, Human
gacagacacaggccc

SEQ ID NO: 2001700 - RNA, 16 nt, Human
gacagacacaggcccg

SEQ ID NO: 2001701 - RNA, 19 nt, Human
gacagaucucugcuuugga

SEQ ID NO: 2001702 - RNA, 21 nt, Human
gacagaucucugcuuuggaaa

SEQ ID NO: 2001703 - RNA, 23 nt, Human
gacagaucucugcuuuggaaauc

SEQ ID NO: 2001704 - RNA, 14 nt, Human
gacaggcaaugcug

SEQ ID NO: 2001705 - RNA, 16 nt, Human
gacaggcaaugcuggc

SEQ ID NO: 2001706 - RNA, 17 nt, Human
gacaggagaugcugugc

SEQ ID NO: 2001707 - RNA, 19 nt, Human
gacaggagaugcugugccc

SEQ ID NO: 2001708 - RNA, 22 nt, Human
gacaggagaugcugugccccug

SEQ ID NO: 2001709 - RNA, 17 nt, Human
gacaggcaaugcuggcu

SEQ ID NO: 2001710 - RNA, 18 nt, Human
gacaggcauguucucuga

SEQ ID NO: 2001711 - RNA, 19 nt, Human
gacaggcauguucucugag

SEQ ID NO: 2001712 - RNA, 15 nt, Human
gacagcugccuggga

SEQ ID NO: 2001713 - RNA, 14 nt, Human
gacagcugccuggg

SEQ ID NO: 2001714 - RNA, 17 nt, Human
gacagcuuagaauuauu

SEQ ID NO: 2001715 - RNA, 23 nt, Human
gacagcuuagaauuauuugcacu

SEQ ID NO: 2001716 - RNA, 17 nt, Human
gacaaugacuuacugua

SEQ ID NO: 2001717 - RNA, 20 nt, Human
gacaaugacuuacuguacau

SEQ ID NO: 2001718 - RNA, 12 nt, Human
gacaaugcaaac

SEQ ID NO: 2001719 - RNA, 21 nt, Human
gacaaugacuuacuguacaug

SEQ ID NO: 2001720 - RNA, 18 nt, Human
gacaaugcaaaccaucau

SEQ ID NO: 2001721 - RNA, 16 nt, Human
gacaaugcaaaccauc

SEQ ID NO: 2001722 - RNA, 12 nt, Human
gacaauuuauua

SEQ ID NO: 2001723 - RNA, 13 nt, Human
gacaaucuucugu

SEQ ID NO: 2001724 - RNA, 22 nt, Human
gacacaagccuucggcgccuua

SEQ ID NO: 2001725 - RNA, 13 nt, Human
gacacacaaagca

SEQ ID NO: 2001726 - RNA, 14 nt, Human
gacacacaaagcag

SEQ ID NO: 2001727 - RNA, 13 nt, Human
gacaauuuauuau

SEQ ID NO: 2001728 - RNA, 19 nt, Human
gacaauuuauuauggcaca

SEQ ID NO: 2001729 - RNA, 13 nt, Human
gacacacagcucu

SEQ ID NO: 2001730 - RNA, 15 nt, Human
gacacaggcccggcu

SEQ ID NO: 2001731 - RNA, 17 nt, Human
gacacaggcccggcucc

SEQ ID NO: 2001732 - RNA, 22 nt, Human
gacaagggaaaauaaaaaaaga

SEQ ID NO: 2001733 - RNA, 16 nt, Human
gacaaggugcaggcag

SEQ ID NO: 2001734 - RNA, 17 nt, Human
gacaaggugcaggcagg

SEQ ID NO: 2001735 - RNA, 18 nt, Human
gacaaggugcaggcaggc

SEQ ID NO: 2001736 - RNA, 16 nt, Human
gacaaugacccagugg

SEQ ID NO: 2001737 - RNA, 19 nt, Human
gacaauacuguaugucguc

SEQ ID NO: 2001738 - RNA, 17 nt, Human
gacaauagcauuagaaa

SEQ ID NO: 2001739 - RNA, 16 nt, Human
gaagucuuuguacaga

SEQ ID NO: 2001740 - RNA, 14 nt, Human
gaagucuuuguaca

SEQ ID NO: 2001741 - RNA, 17 nt, Human
gaagucuucaugaaaug

SEQ ID NO: 2001742 - RNA, 18 nt, Human
gaagucuucaugaaaugc

SEQ ID NO: 2001743 - RNA, 13 nt, Human
gaagucuucuauu

SEQ ID NO: 2001744 - RNA, 17 nt, Human
gaagucuucuauuuauu

SEQ ID NO: 2001745 - RNA, 22 nt, Human
gacaaggauugcuacuguccua

SEQ ID NO: 2001746 - RNA, 12 nt, Human
gacaagcacagu

SEQ ID NO: 2001747 - RNA, 15 nt, Human
gacaagcacagucag

SEQ ID NO: 2001748 - RNA, 15 nt, Human
gacacgaauauugcu

SEQ ID NO: 2001749 - RNA, 18 nt, Human
gacaccuugacagggcac

SEQ ID NO: 2001750 - RNA, 20 nt, Human
gacaccuugacagggcacac

SEQ ID NO: 2001751 - RNA, 15 nt, Human
gacaccuugacaggg

SEQ ID NO: 2001752 - RNA, 17 nt, Human
gacaccuugacagggca

SEQ ID NO: 2001753 - RNA, 18 nt, Human
gacacgaauauugcugau

SEQ ID NO: 2001754 - RNA, 17 nt, Human
gacacgaauauugcuga

SEQ ID NO: 2001755 - RNA, 19 nt, Human
gacacgaauauugcugaug

SEQ ID NO: 2001756 - RNA, 15 nt, Human
gacacuaaccacgcu

SEQ ID NO: 2001757 - RNA, 16 nt, Human
gacacuaaccacgcug

SEQ ID NO: 2001758 - RNA, 17 nt, Human
gacacuaaccacgcugg

SEQ ID NO: 2001759 - RNA, 18 nt, Human
gacacuaaccacgcugga

SEQ ID NO: 2001760 - RNA, 23 nt, Human
gacacccugugauggggcccugc

SEQ ID NO: 2001761 - RNA, 22 nt, Human
gacacccugugauggggcccug

SEQ ID NO: 2001762 - RNA, 17 nt, Human
gacaccuacugaguggc

SEQ ID NO: 2001763 - RNA, 17 nt, Human
gacacagugaccauacu

SEQ ID NO: 2001764 - RNA, 22 nt, Human
gacacaggggacacccagaaac

SEQ ID NO: 2001765 - RNA, 18 nt, Human
gacacaggcccggcucca

SEQ ID NO: 2001766 - RNA, 13 nt, Human
gacacccugugau

SEQ ID NO: 2001767 - RNA, 12 nt, Human
gacacccuguga

SEQ ID NO: 2001768 - RNA, 15 nt, Human
gacaccccacuuagc

SEQ ID NO: 2001769 - RNA, 15 nt, Human
gagacagcucugcau

SEQ ID NO: 2001770 - RNA, 18 nt, Human
gagacagcucugcauacu

SEQ ID NO: 2001771 - RNA, 13 nt, Human
gagacagcucugc

SEQ ID NO: 2001772 - RNA, 24 nt, Human
gagacagcccgggcucugccuccc

SEQ ID NO: 2001773 - RNA, 23 nt, Human
gagacagcccgggcucugccucc

SEQ ID NO: 2001774 - RNA, 22 nt, Human
gagacagcccgggcucugccuc

SEQ ID NO: 2001775 - RNA, 21 nt, Human
gagacagcccgggcucugccu

SEQ ID NO: 2001776 - RNA, 20 nt, Human
gagacagcccgggcucugcc

SEQ ID NO: 2001777 - RNA, 19 nt, Human
gagacagcccgggcucugc

SEQ ID NO: 2001778 - RNA, 18 nt, Human
gagacagcccgggcucug

SEQ ID NO: 2001779 - RNA, 17 nt, Human
gagacagcccgggcucu

SEQ ID NO: 2001780 - RNA, 14 nt, Human
gagacagcccgggc

SEQ ID NO: 2001781 - RNA, 22 nt, Human
gagacuccugcaggcagccagg

SEQ ID NO: 2001782 - RNA, 18 nt, Human
gagacucgcgacaaugca

SEQ ID NO: 2001783 - RNA, 16 nt, Human
gagacucgcgacaaug

SEQ ID NO: 2001784 - RNA, 12 nt, Human
gagaccaucccu

SEQ ID NO: 2001785 - RNA, 14 nt, Human
gagacucugucuca

SEQ ID NO: 2001786 - RNA, 22 nt, Human
gagacugucucaagagggcacu

SEQ ID NO: 2001787 - RNA, 17 nt, Human
gagacugcuccugagcc

SEQ ID NO: 2001788 - RNA, 18 nt, Human
gagacugcuccugagccc

SEQ ID NO: 2001789 - RNA, 19 nt, Human
gagacugcuccugagcccc

SEQ ID NO: 2001790 - RNA, 23 nt, Human
gagacugucucaagagggcacug

SEQ ID NO: 2001791 - RNA, 20 nt, Human
gagacuguggagacugcucc

SEQ ID NO: 2001792 - RNA, 21 nt, Human
gagacuguggagacugcuccu

SEQ ID NO: 2001793 - RNA, 13 nt, Human
gagacuuguauga

SEQ ID NO: 2001794 - RNA, 14 nt, Human
gagagaagagcccc

SEQ ID NO: 2001795 - RNA, 15 nt, Human
gagagaagagcccca

SEQ ID NO: 2001796 - RNA, 16 nt, Human
gagagaagagccccac

SEQ ID NO: 2001797 - RNA, 17 nt, Human
gagagaagagaaugcac

SEQ ID NO: 2001798 - RNA, 10 nt, Human
gagacuuuga

SEQ ID NO: 2001799 - RNA, 11 nt, Human
gagacuuugau

SEQ ID NO: 2001800 - RNA, 13 nt, Human
gagacuuugaugu

SEQ ID NO: 2001801 - RNA, 14 nt, Human
gagacuuugauguc

SEQ ID NO: 2001802 - RNA, 15 nt, Human
gagacuuugauguca

SEQ ID NO: 2001803 - RNA, 19 nt, Human
gagacuuugaugucagcag

SEQ ID NO: 2001804 - RNA, 14 nt, Human
gagagauacucugg

SEQ ID NO: 2001805 - RNA, 15 nt, Human
gagagauacucuggg

SEQ ID NO: 2001806 - RNA, 20 nt, Human
gagagaggcuaaaauguuuu

SEQ ID NO: 2001807 - RNA, 18 nt, Human
gagagaggcuaaaauguu

SEQ ID NO: 2001808 - RNA, 19 nt, Human
gagagaggcuaaaauguuu

SEQ ID NO: 2001809 - RNA, 22 nt, Human
gagagcauuauaaucaccaggg

SEQ ID NO: 2001810 - RNA, 19 nt, Human
gagagcccagagucccccc

SEQ ID NO: 2001811 - RNA, 20 nt, Human
gagagcccagagucccccca

SEQ ID NO: 2001812 - RNA, 15 nt, Human
gagagugaacaaauu

SEQ ID NO: 2001813 - RNA, 15 nt, Human
gagagugagguggaa

SEQ ID NO: 2001814 - RNA, 16 nt, Human
gagaguuuagcuguaa

SEQ ID NO: 2001815 - RNA, 19 nt, Human
gagagugaacaaauuuaca

SEQ ID NO: 2001816 - RNA, 17 nt, Human
gagauacagaauuuuau

SEQ ID NO: 2001817 - RNA, 21 nt, Human
gagagggugggagugggccca

SEQ ID NO: 2001818 - RNA, 13 nt, Human
gagaggggaacag

SEQ ID NO: 2001819 - RNA, 18 nt, Human
gagaggggaacagacugg

SEQ ID NO: 2001820 - RNA, 14 nt, Human
gagagccuuccagg

SEQ ID NO: 2001821 - RNA, 13 nt, Human
gagagccuuccag

SEQ ID NO: 2001822 - RNA, 14 nt, Human
gagaaauuuauaaa

SEQ ID NO: 2001823 - RNA, 14 nt, Human
gagaaauauuuuaa

SEQ ID NO: 2001824 - RNA, 17 nt, Human
gagaaauauuuuaauuu

SEQ ID NO: 2001825 - RNA, 17 nt, Human
gagaacagauaaagauu

SEQ ID NO: 2001826 - RNA, 23 nt, Human
gagaaaguacuucuccacccugc

SEQ ID NO: 2001827 - RNA, 18 nt, Human
gacucgcgacaaugcaaa

SEQ ID NO: 2001828 - RNA, 17 nt, Human
gacuccugcaggcagcc

SEQ ID NO: 2001829 - RNA, 19 nt, Human
gacucgcgacaaugcaaac

SEQ ID NO: 2001830 - RNA, 14 nt, Human
gacuuggaagcucc

SEQ ID NO: 2001831 - RNA, 15 nt, Human
gacuuggaagcuccg

SEQ ID NO: 2001832 - RNA, 16 nt, Human
gacuuggaagcuccgc

SEQ ID NO: 2001833 - RNA, 21 nt, Human
gagaaaauggacguguuauga

SEQ ID NO: 2001834 - RNA, 16 nt, Human
gacuuguucuugauag

SEQ ID NO: 2001835 - RNA, 18 nt, Human
gacuugugcacaggcaga

SEQ ID NO: 2001836 - RNA, 17 nt, Human
gacuugugcacaggcag

SEQ ID NO: 2001837 - RNA, 19 nt, Human
gacuugugcacaggcagag

SEQ ID NO: 2001838 - RNA, 20 nt, Human
gagaagauggauaugaccag

SEQ ID NO: 2001839 - RNA, 22 nt, Human
gagaagccagcuuuccucauca

SEQ ID NO: 2001840 - RNA, 21 nt, Human
gagaaugcacaaacagaggcc

SEQ ID NO: 2001841 - RNA, 20 nt, Human
gagaaugcacaaacagaggc

SEQ ID NO: 2001842 - RNA, 22 nt, Human
gagaaugcacaaacagaggccg

SEQ ID NO: 2001843 - RNA, 15 nt, Human
gagacagacuagaag

SEQ ID NO: 2001844 - RNA, 12 nt, Human
gagacagcccgg

SEQ ID NO: 2001845 - RNA, 16 nt, Human
gagacagccaacuaug

SEQ ID NO: 2001846 - RNA, 19 nt, Human
gagacagaguuuucacucu

SEQ ID NO: 2001847 - RNA, 17 nt, Human
gagacagacuagaaguu

SEQ ID NO: 2001848 - RNA, 19 nt, Human
gagacagagcaaccccugg

SEQ ID NO: 2001849 - RNA, 20 nt, Human
gagacagagcgacagagcag

SEQ ID NO: 2001850 - RNA, 17 nt, Human
gagacacaagccuucgg

SEQ ID NO: 2001851 - RNA, 15 nt, Human
gagacacaagccuuc

SEQ ID NO: 2001852 - RNA, 22 nt, Human
gagcuugaaacccguggcgcuu

SEQ ID NO: 2001853 - RNA, 22 nt, Human
gagcuuucugcuaucaaagagg

SEQ ID NO: 2001854 - RNA, 20 nt, Human
gagcuuugaaaauucagugg

SEQ ID NO: 2001855 - RNA, 14 nt, Human
gagcuuuuguagaa

SEQ ID NO: 2001856 - RNA, 23 nt, Human
gagcuuugucuacuucaaaaguu

SEQ ID NO: 2001857 - RNA, 13 nt, Human
gaggaaaaauaug

SEQ ID NO: 2001858 - RNA, 20 nt, Human
gaggaaaaccaagccguggc

SEQ ID NO: 2001859 - RNA, 21 nt, Human
gaggaaaaccaagccguggcu

SEQ ID NO: 2001860 - RNA, 23 nt, Human
gaggaaaaccaagccguggcuuc

SEQ ID NO: 2001861 - RNA, 14 nt, Human
gaggaaaaauaugu

SEQ ID NO: 2001862 - RNA, 17 nt, Human
gaggaaaaauaugugaa

SEQ ID NO: 2001863 - RNA, 18 nt, Human
gaggaaacaacagcuuua

SEQ ID NO: 2001864 - RNA, 17 nt, Human
gaggaaagcaaaggaga

SEQ ID NO: 2001865 - RNA, 16 nt, Human
gaggaaagcaaaggag

SEQ ID NO: 2001866 - RNA, 18 nt, Human
gaggaagccgcuggggcc

SEQ ID NO: 2001867 - RNA, 17 nt, Human
gaggaagccgcuggggc

SEQ ID NO: 2001868 - RNA, 14 nt, Human
gaggaagccgcugg

SEQ ID NO: 2001869 - RNA, 13 nt, Human
gaggaagccgcug

SEQ ID NO: 2001870 - RNA, 17 nt, Human
gaggaagagaaaaaaua

SEQ ID NO: 2001871 - RNA, 16 nt, Human
gaggaacaaggcaagg

SEQ ID NO: 2001872 - RNA, 14 nt, Human
gaggaacaaggcaa

SEQ ID NO: 2001873 - RNA, 16 nt, Human
gaggaaauccuaccuu

SEQ ID NO: 2001874 - RNA, 20 nt, Human
gaggaaaguacauuuuuuga

SEQ ID NO: 2001875 - RNA, 12 nt, Human
gaggaaaucaaa

SEQ ID NO: 2001876 - RNA, 20 nt, Human
gaggaaaucaaagugcuauu

SEQ ID NO: 2001877 - RNA, 19 nt, Human
gaggaaagcacagaggccu

SEQ ID NO: 2001878 - RNA, 20 nt, Human
gaggaaagcacagaggccuc

SEQ ID NO: 2001879 - RNA, 22 nt, Human
gaggaaagcacagaggccuccu

SEQ ID NO: 2001880 - RNA, 15 nt, Human
gagcugaguggggga

SEQ ID NO: 2001881 - RNA, 23 nt, Human
gagcucgcggcgaggacgacuuc

SEQ ID NO: 2001882 - RNA, 19 nt, Human
gagcucccacuucugccag

SEQ ID NO: 2001883 - RNA, 20 nt, Human
gagcucccacuucugccaga

SEQ ID NO: 2001884 - RNA, 18 nt, Human
gagcuccauacacacgcu

SEQ ID NO: 2001885 - RNA, 20 nt, Human
gagcuccauacacacgcugc

SEQ ID NO: 2001886 - RNA, 21 nt, Human
gagcuccauacacacgcugcc

SEQ ID NO: 2001887 - RNA, 22 nt, Human
gagcuccauacacacgcugccu

SEQ ID NO: 2001888 - RNA, 23 nt, Human
gagcuccauacacacgcugccuu

SEQ ID NO: 2001889 - RNA, 13 nt, Human
gagcuaugacuua

SEQ ID NO: 2001890 - RNA, 13 nt, Human
gagcuaggcaggg

SEQ ID NO: 2001891 - RNA, 19 nt, Human
gagcucacuguggugucug

SEQ ID NO: 2001892 - RNA, 16 nt, Human
gagcuauuuuaaacca

SEQ ID NO: 2001893 - RNA, 15 nt, Human
gagccugcaguuauu

SEQ ID NO: 2001894 - RNA, 17 nt, Human
gagccugccccagcgcu

SEQ ID NO: 2001895 - RNA, 18 nt, Human
gagccugccccagcgcug

SEQ ID NO: 2001896 - RNA, 19 nt, Human
gagccugacagccagaacu

SEQ ID NO: 2001897 - RNA, 13 nt, Human
gagccugcccagc

SEQ ID NO: 2001898 - RNA, 13 nt, Human
gagccugccccag

SEQ ID NO: 2001899 - RNA, 17 nt, Human
gagcuagcagcagggag

SEQ ID NO: 2001900 - RNA, 15 nt, Human
gagcuagcagcaggg

SEQ ID NO: 2001901 - RNA, 12 nt, Human
gagccaggaggg

SEQ ID NO: 2001902 - RNA, 13 nt, Human
gagccagauuuca

SEQ ID NO: 2001903 - RNA, 13 nt, Human
gagcccaccuugg

SEQ ID NO: 2001904 - RNA, 15 nt, Human
gagcccaccuuggcu

SEQ ID NO: 2001905 - RNA, 17 nt, Human
gagcccaccuuggcuca

SEQ ID NO: 2001906 - RNA, 18 nt, Human
gagccacugcaccgggcc

SEQ ID NO: 2001907 - RNA, 19 nt, Human
gagccacugcaccgggcca

SEQ ID NO: 2001908 - RNA, 13 nt, Human
gagccacugcacc

SEQ ID NO: 2001909 - RNA, 19 nt, Human
gagccagauuucacucucc

SEQ ID NO: 2001910 - RNA, 18 nt, Human
gagccagauuucacucuc

SEQ ID NO: 2001911 - RNA, 15 nt, Human
gagccagauuucacu

SEQ ID NO: 2001912 - RNA, 20 nt, Human
gagccacugcaccgggccac

SEQ ID NO: 2001913 - RNA, 21 nt, Human
gagcagagaccaucccugaag

SEQ ID NO: 2001914 - RNA, 19 nt, Human
gagcagagaccaucccuga

SEQ ID NO: 2001915 - RNA, 23 nt, Human
gagcagagaccaucccugaaggc

SEQ ID NO: 2001916 - RNA, 21 nt, Human
gagcagccacauuccugaugc

SEQ ID NO: 2001917 - RNA, 22 nt, Human
gagcagccacauuccugaugcu

SEQ ID NO: 2001918 - RNA, 19 nt, Human
gagauagccaaggccaaag

SEQ ID NO: 2001919 - RNA, 21 nt, Human
gagauaggaaggucauuucca

SEQ ID NO: 2001920 - RNA, 22 nt, Human
gagauaggaaggucauuuccau

SEQ ID NO: 2001921 - RNA, 16 nt, Human
gagcagagaccauccc

SEQ ID NO: 2001922 - RNA, 18 nt, Human
gagcagagaccaucccug

SEQ ID NO: 2001923 - RNA, 17 nt, Human
gagcagagaccaucccu

SEQ ID NO: 2001924 - RNA, 21 nt, Human
gagauagccaaggccaaagga

SEQ ID NO: 2001925 - RNA, 20 nt, Human
gagauagccaaggccaaagg

SEQ ID NO: 2001926 - RNA, 13 nt, Human
gagccuccugccc

SEQ ID NO: 2001927 - RNA, 12 nt, Human
gagccugcaguu

SEQ ID NO: 2001928 - RNA, 15 nt, Human
gagccugacagccag

SEQ ID NO: 2001929 - RNA, 16 nt, Human
gagccugacagccaga

SEQ ID NO: 2001930 - RNA, 15 nt, Human
gagccuacccacccc

SEQ ID NO: 2001931 - RNA, 17 nt, Human
gagccuacccaccccca

SEQ ID NO: 2001932 - RNA, 15 nt, Human
gagccuaaaaauaaa

SEQ ID NO: 2001933 - RNA, 17 nt, Human
gagccuaaaaauaaagc

SEQ ID NO: 2001934 - RNA, 19 nt, Human
gagccuaaaaauaaagcac

SEQ ID NO: 2001935 - RNA, 13 nt, Human
gagccucagcauc

SEQ ID NO: 2001936 - RNA, 17 nt, Human
gagccucagcauccugg

SEQ ID NO: 2001937 - RNA, 19 nt, Human
gagccucagucucccuccc

SEQ ID NO: 2001938 - RNA, 18 nt, Human
gagccucagucucccucc

SEQ ID NO: 2001939 - RNA, 14 nt, Human
gagccucagcaucc

SEQ ID NO: 2001940 - RNA, 15 nt, Human
gagccucagcauccu

SEQ ID NO: 2001941 - RNA, 18 nt, Human
gagcccacgcccccacug

SEQ ID NO: 2001942 - RNA, 21 nt, Human
gagcccacuguacuugcucuu

SEQ ID NO: 2001943 - RNA, 18 nt, Human
gagcccacuguacuugcu

SEQ ID NO: 2001944 - RNA, 18 nt, Human
gagcccuugcccaugcug

SEQ ID NO: 2001945 - RNA, 19 nt, Human
gagccgagaucacgccacu

SEQ ID NO: 2001946 - RNA, 20 nt, Human
gagccgagaucacgccacug

SEQ ID NO: 2001947 - RNA, 21 nt, Human
gagccgagaucacgccacugc

SEQ ID NO: 2001948 - RNA, 22 nt, Human
gagccgagaucacgccacugca

SEQ ID NO: 2001949 - RNA, 13 nt, Human
gagccgcagagaa

SEQ ID NO: 2001950 - RNA, 20 nt, Human
gagccgggcaaacuggccgc

SEQ ID NO: 2001951 - RNA, 13 nt, Human
gaaagcagaacag

SEQ ID NO: 2001952 - RNA, 14 nt, Human
gaaagcagaacagu

SEQ ID NO: 2001953 - RNA, 23 nt, Human
gaaagauggcugugccucugccu

SEQ ID NO: 2001954 - RNA, 16 nt, Human
gaaagaucaaaagguu

SEQ ID NO: 2001955 - RNA, 22 nt, Human
gaaagauggcugugccucugcc

SEQ ID NO: 2001956 - RNA, 13 nt, Human
gaaagagauuuaa

SEQ ID NO: 2001957 - RNA, 16 nt, Human
gaaagagauuuaaacu

SEQ ID NO: 2001958 - RNA, 16 nt, Human
gaaacugacuugcugu

SEQ ID NO: 2001959 - RNA, 14 nt, Human
gaaaaauguuagga

SEQ ID NO: 2001960 - RNA, 20 nt, Human
gaaaaauucaauaguaauau

SEQ ID NO: 2001961 - RNA, 22 nt, Human
gaaaaauucaauaguaauauaa

SEQ ID NO: 2001962 - RNA, 16 nt, Human
gaaaaauguuaggaca

SEQ ID NO: 2001963 - RNA, 17 nt, Human
gaaaaauuauugagcca

SEQ ID NO: 2001964 - RNA, 23 nt, Human
gaaaaagaacuuccccauacaaa

SEQ ID NO: 2001965 - RNA, 16 nt, Human
gaaaaagcaaaaggca

SEQ ID NO: 2001966 - RNA, 16 nt, Human
gaaaaaugagccuggc

SEQ ID NO: 2001967 - RNA, 20 nt, Human
gaaacuaggugcauauuuau

SEQ ID NO: 2001968 - RNA, 19 nt, Human
gaaacuaggugcauauuua

SEQ ID NO: 2001969 - RNA, 16 nt, Human
gaaaggaccugcaaac

SEQ ID NO: 2001970 - RNA, 20 nt, Human
gaaagcuuuguugaaagaaa

SEQ ID NO: 2001971 - RNA, 21 nt, Human
gaaagcuuuguugaaagaaag

SEQ ID NO: 2001972 - RNA, 22 nt, Human
gaaaggaguuucuuuagcugac

SEQ ID NO: 2001973 - RNA, 21 nt, Human
gaaagcuugcccuggugccuc

SEQ ID NO: 2001974 - RNA, 16 nt, Human
gaaaggaaagaggcuc

SEQ ID NO: 2001975 - RNA, 11 nt, Human
gaaaggaaaga

SEQ ID NO: 2001976 - RNA, 20 nt, Human
gaaagcacagaggccuccug

SEQ ID NO: 2001977 - RNA, 14 nt, Human
gaaaguguucuguu

SEQ ID NO: 2001978 - RNA, 15 nt, Human
gaaaguguucuguua

SEQ ID NO: 2001979 - RNA, 16 nt, Human
gaaaguguucuguuac

SEQ ID NO: 2001980 - RNA, 17 nt, Human
gaaaguguucuguuaca

SEQ ID NO: 2001981 - RNA, 18 nt, Human
gaaaguguucuguuacaa

SEQ ID NO: 2001982 - RNA, 19 nt, Human
gaaaguguucuguuacaaa

SEQ ID NO: 2001983 - RNA, 21 nt, Human
gaaaguguucuguuacaaaau

SEQ ID NO: 2001984 - RNA, 16 nt, Human
gaaaguuuacaggaaa

SEQ ID NO: 2001985 - RNA, 14 nt, Human
gaaaguuuacagga

SEQ ID NO: 2001986 - RNA, 14 nt, Human
gaaauaaaaagagu

SEQ ID NO: 2001987 - RNA, 16 nt, Human
gaaagugaaaguccag

SEQ ID NO: 2001988 - RNA, 15 nt, Human
gaaagugccuuugca

SEQ ID NO: 2001989 - RNA, 18 nt, Human
gaaagugccuuugcagcu

SEQ ID NO: 2001990 - RNA, 20 nt, Human
gaaagugccuuugcagcuca

SEQ ID NO: 2001991 - RNA, 23 nt, Human
gaaagugccuuugcagcucagaa

SEQ ID NO: 2001992 - RNA, 13 nt, Human
gaaaguguucugu

SEQ ID NO: 2001993 - RNA, 19 nt, Human
gaaaugggcagagcagaga

SEQ ID NO: 2001994 - RNA, 17 nt, Human
gaaaugggcagagcaga

SEQ ID NO: 2001995 - RNA, 17 nt, Human
gaaauguacagcaagga

SEQ ID NO: 2001996 - RNA, 14 nt, Human
gaaaugcugauuua

SEQ ID NO: 2001997 - RNA, 22 nt, Human
gaaaugcugauuuaaacuucuu

SEQ ID NO: 2001998 - RNA, 16 nt, Human
gaaaugugugugaugu

SEQ ID NO: 2001999 - RNA, 18 nt, Human
gaaaugugugugauguga

SEQ ID NO: 2002000 - RNA, 19 nt, Human
gaaaugugugugaugugac

SEQ ID NO: 2002001 - RNA, 20 nt, Human
gaaaugugugugaugugaca

SEQ ID NO: 2002002 - RNA, 21 nt, Human
gaaaugugugugaugugacau

SEQ ID NO: 2002003 - RNA, 23 nt, Human
gaaaugugugugaugugacauuu

SEQ ID NO: 2002004 - RNA, 20 nt, Human
gaaaugucccuuucuucucc

SEQ ID NO: 2002005 - RNA, 13 nt, Human
gaaauguguguga

SEQ ID NO: 2002006 - RNA, 17 nt, Human
gaaaugucccuuucuuc

SEQ ID NO: 2002007 - RNA, 18 nt, Human
gaaaugucccuuucuucu

SEQ ID NO: 2002008 - RNA, 15 nt, Human
gaaaugucccuuucu

SEQ ID NO: 2002009 - RNA, 16 nt, Human
gaaaugucccuuucuu

SEQ ID NO: 2002010 - RNA, 11 nt, Human
gaaaugagcug

SEQ ID NO: 2002011 - RNA, 18 nt, Human
gaaaugaggucagagccu

SEQ ID NO: 2002012 - RNA, 15 nt, Human
gaaaugggcagagca

SEQ ID NO: 2002013 - RNA, 16 nt, Human
gaaaugggcagagcag

SEQ ID NO: 2002014 - RNA, 17 nt, Human
gaaaugcuaugucauuu

SEQ ID NO: 2002015 - RNA, 18 nt, Human
gaaaugcuaugucauuuc

SEQ ID NO: 2002016 - RNA, 19 nt, Human
gaaaugcuaugucauuuca

SEQ ID NO: 2002017 - RNA, 20 nt, Human
gaaaugcuaugucauuucau

SEQ ID NO: 2002018 - RNA, 21 nt, Human
gaaaugcuaugucauuucaug

SEQ ID NO: 2002019 - RNA, 22 nt, Human
gaaaugcuaugucauuucaugu

SEQ ID NO: 2002020 - RNA, 14 nt, Human
gaaaugcugaaaau

SEQ ID NO: 2002021 - RNA, 14 nt, Human
gaaaugcugaccca

SEQ ID NO: 2002022 - RNA, 22 nt, Human
gaaaugcugacccaugggcagg

SEQ ID NO: 2002023 - RNA, 23 nt, Human
gaaauauauggucuaauguuuaa

SEQ ID NO: 2002024 - RNA, 20 nt, Human
gaaauauauggucuaauguu

SEQ ID NO: 2002025 - RNA, 22 nt, Human
gaaauauauggucuaauguuua

SEQ ID NO: 2002026 - RNA, 24 nt, Human
gaaauauauggucuaauguuuaag

SEQ ID NO: 2002027 - RNA, 14 nt, Human
gaaauaaacgucuu

SEQ ID NO: 2002028 - RNA, 16 nt, Human
gaaauaaacgucuuaa

SEQ ID NO: 2002029 - RNA, 17 nt, Human
gaaauaaacgucuuaaa

SEQ ID NO: 2002030 - RNA, 18 nt, Human
gaaauaaacgucuuaaau

SEQ ID NO: 2002031 - RNA, 21 nt, Human
gaaauaaacgucuuaaauauu

SEQ ID NO: 2002032 - RNA, 12 nt, Human
gaaauaaaagcu

SEQ ID NO: 2002033 - RNA, 17 nt, Human
gaaauauaggaacuuaa

SEQ ID NO: 2002034 - RNA, 19 nt, Human
gaaauaucugaaaauguau

SEQ ID NO: 2002035 - RNA, 18 nt, Human
gaaauaucugaaaaugua

SEQ ID NO: 2002036 - RNA, 20 nt, Human
gaaauaucugaaaauguaug

SEQ ID NO: 2002037 - RNA, 23 nt, Human
gaaauuaguacuccccuccuuga

SEQ ID NO: 2002038 - RNA, 21 nt, Human
gaaauuuccugggagcuuuug

SEQ ID NO: 2002039 - RNA, 16 nt, Human
gaacacuccuucacag

SEQ ID NO: 2002040 - RNA, 15 nt, Human
gaacacuccuucaca

SEQ ID NO: 2002041 - RNA, 17 nt, Human
gaacacuccuucacaga

SEQ ID NO: 2002042 - RNA, 20 nt, Human
gaacagacuggaagcacagc

SEQ ID NO: 2002043 - RNA, 19 nt, Human
gaacagacuggaagcacag

SEQ ID NO: 2002044 - RNA, 20 nt, Human
gaacaguuguguuugaagca

SEQ ID NO: 2002045 - RNA, 16 nt, Human
gaacagguucacguga

SEQ ID NO: 2002046 - RNA, 21 nt, Human
gaacagguuuuuuuguuuguu

SEQ ID NO: 2002047 - RNA, 17 nt, Human
gaacaggauauucucac

SEQ ID NO: 2002048 - RNA, 22 nt, Human
gaacagcuguugacucuaguac

SEQ ID NO: 2002049 - RNA, 12 nt, Human
gaacagcuguug

SEQ ID NO: 2002050 - RNA, 17 nt, Human
gaacagcuguugacucu

SEQ ID NO: 2002051 - RNA, 22 nt, Human
gaacagacuggaagcacagcuu

SEQ ID NO: 2002052 - RNA, 22 nt, Human
gaacaguuguguuugaagcaca

SEQ ID NO: 2002053 - RNA, 20 nt, Human
gaaccaaagcgaauuuuaaa

SEQ ID NO: 2002054 - RNA, 23 nt, Human
gaaccaaagcgaauuuuaaaaga

SEQ ID NO: 2002055 - RNA, 18 nt, Human
gaagucuuagauguauau

SEQ ID NO: 2002056 - RNA, 15 nt, Human
gaagucuucaugaaa

SEQ ID NO: 2002057 - RNA, 16 nt, Human
gaagucacauuccuga

SEQ ID NO: 2002058 - RNA, 20 nt, Human
gaagucacauuccugaacag

SEQ ID NO: 2002059 - RNA, 21 nt, Human
gaagucacauuccugaacagg

SEQ ID NO: 2002060 - RNA, 15 nt, Human
gaagucacugcacag

SEQ ID NO: 2002061 - RNA, 21 nt, Human
gaaggugaggagcuugaaacc

SEQ ID NO: 2002062 - RNA, 18 nt, Human
gaaguaacuggugauaua

SEQ ID NO: 2002063 - RNA, 19 nt, Human
gaaguaauaugcacacauu

SEQ ID NO: 2002064 - RNA, 20 nt, Human
gaaguaauaugcacacauuu

SEQ ID NO: 2002065 - RNA, 21 nt, Human
gaaguaauaugcacacauuuu

SEQ ID NO: 2002066 - RNA, 19 nt, Human
gaaguaacuggugauauau

SEQ ID NO: 2002067 - RNA, 13 nt, Human
gaagucacacagu

SEQ ID NO: 2002068 - RNA, 15 nt, Human
gaagggggcugggac

SEQ ID NO: 2002069 - RNA, 18 nt, Human
gaagguauuaagauuaua

SEQ ID NO: 2002070 - RNA, 14 nt, Human
gaaggucauuucca

SEQ ID NO: 2002071 - RNA, 15 nt, Human
gaaggucauuuccau

SEQ ID NO: 2002072 - RNA, 13 nt, Human
gaagggggcuggg

SEQ ID NO: 2002073 - RNA, 20 nt, Human
gaaggcagggagggccuggg

SEQ ID NO: 2002074 - RNA, 22 nt, Human
gaaggcagggagggccugggcc

SEQ ID NO: 2002075 - RNA, 23 nt, Human
gaaggcagggagggccugggccc

SEQ ID NO: 2002076 - RNA, 13 nt, Human
gaaggauuugugu

SEQ ID NO: 2002077 - RNA, 18 nt, Human
gaaggcagggagggccug

SEQ ID NO: 2002078 - RNA, 16 nt, Human
gaaggaugccaagaag

SEQ ID NO: 2002079 - RNA, 18 nt, Human
gaaggaggcuccaggcag

SEQ ID NO: 2002080 - RNA, 17 nt, Human
gaaggaggccaccuccu

SEQ ID NO: 2002081 - RNA, 19 nt, Human
gaaggaggcuccaggcagc

SEQ ID NO: 2002082 - RNA, 20 nt, Human
gaaggaggcuccaggcagca

SEQ ID NO: 2002083 - RNA, 12 nt, Human
gaaggaggccac

SEQ ID NO: 2002084 - RNA, 15 nt, Human
gaaggaggccaccuc

SEQ ID NO: 2002085 - RNA, 16 nt, Human
gaaggaggccaccucc

SEQ ID NO: 2002086 - RNA, 14 nt, Human
gaagccgcuggggc

SEQ ID NO: 2002087 - RNA, 20 nt, Human
gaagccgcuggggccaguug

SEQ ID NO: 2002088 - RNA, 18 nt, Human
gaagccgcuggggccagu

SEQ ID NO: 2002089 - RNA, 21 nt, Human
gaagccgcuggggccaguugg

SEQ ID NO: 2002090 - RNA, 20 nt, Human
gaaggaaacccagcucuggu

SEQ ID NO: 2002091 - RNA, 19 nt, Human
gaaggaaacccagcucugg

SEQ ID NO: 2002092 - RNA, 15 nt, Human
gaagccugcuccuuc

SEQ ID NO: 2002093 - RNA, 19 nt, Human
gaaggacauugcggacagc

SEQ ID NO: 2002094 - RNA, 22 nt, Human
gaaggaauaaauugcuccuuga

SEQ ID NO: 2002095 - RNA, 20 nt, Human
gaaggacauugcggacagcc

SEQ ID NO: 2002096 - RNA, 21 nt, Human
gaaggacauugcggacagcca

SEQ ID NO: 2002097 - RNA, 22 nt, Human
gaaggacccggaggggccuggc

SEQ ID NO: 2002098 - RNA, 23 nt, Human
gaaggaaccaaagcgaauuuuaa

SEQ ID NO: 2002099 - RNA, 19 nt, Human
gaaggaagacuucaucccu

SEQ ID NO: 2002100 - RNA, 22 nt, Human
gaaggaaacccagcucuggucc

SEQ ID NO: 2002101 - RNA, 21 nt, Human
gaaggaaacccagcucugguc

SEQ ID NO: 2002102 - RNA, 15 nt, Human
gaaggaacguccccu

SEQ ID NO: 2002103 - RNA, 22 nt, Human
gaagcuucuggugaccuuccaa

SEQ ID NO: 2002104 - RNA, 16 nt, Human
gaagaguccucugaau

SEQ ID NO: 2002105 - RNA, 14 nt, Human
gaagaguccucuga

SEQ ID NO: 2002106 - RNA, 17 nt, Human
gaagagcuuagaaacug

SEQ ID NO: 2002107 - RNA, 15 nt, Human
gaagagcuggggaga

SEQ ID NO: 2002108 - RNA, 20 nt, Human
gaagagcuguugaugggaug

SEQ ID NO: 2002109 - RNA, 14 nt, Human
gaagagcuuagaaa

SEQ ID NO: 2002110 - RNA, 19 nt, Human
gaagacuucaucccucugg

SEQ ID NO: 2002111 - RNA, 17 nt, Human
gaagacuucaucccucu

SEQ ID NO: 2002112 - RNA, 12 nt, Human
gaagagccuugc

SEQ ID NO: 2002113 - RNA, 12 nt, Human
gaagaauaauuu

SEQ ID NO: 2002114 - RNA, 23 nt, Human
gaagagccccacucucagaggcc

SEQ ID NO: 2002115 - RNA, 13 nt, Human
gaagaaguguguc

SEQ ID NO: 2002116 - RNA, 16 nt, Human
gaagacuucaucccuc

SEQ ID NO: 2002117 - RNA, 15 nt, Human
gaagacuucaucccu

SEQ ID NO: 2002118 - RNA, 17 nt, Human
gaagauguagaggagaa

SEQ ID NO: 2002119 - RNA, 18 nt, Human
gaagauggauaugaccag

SEQ ID NO: 2002120 - RNA, 22 nt, Human
gaagauugagauguguucacaa

SEQ ID NO: 2002121 - RNA, 17 nt, Human
gaagauugagauguguu

SEQ ID NO: 2002122 - RNA, 13 nt, Human
gaagauuguuuau

SEQ ID NO: 2002123 - RNA, 16 nt, Human
gaagauuguuuaucua

SEQ ID NO: 2002124 - RNA, 23 nt, Human
gaagauuguuuaucuagauguaa

SEQ ID NO: 2002125 - RNA, 14 nt, Human
gaagaguauggauu

SEQ ID NO: 2002126 - RNA, 13 nt, Human
gaagagugaaaua

SEQ ID NO: 2002127 - RNA, 14 nt, Human
gaagagugaaauac

SEQ ID NO: 2002128 - RNA, 16 nt, Human
gaagagugaaauacca

SEQ ID NO: 2002129 - RNA, 22 nt, Human
gaagaguggcagcuauaggaaa

SEQ ID NO: 2002130 - RNA, 17 nt, Human
gaagaucuuugggcaua

SEQ ID NO: 2002131 - RNA, 17 nt, Human
gaacuuggcgcugcccc

SEQ ID NO: 2002132 - RNA, 16 nt, Human
gaacuugaagccugcu

SEQ ID NO: 2002133 - RNA, 18 nt, Human
gaacuugaagccugcucc

SEQ ID NO: 2002134 - RNA, 19 nt, Human
gaacuugaagccugcuccu

SEQ ID NO: 2002135 - RNA, 14 nt, Human
gaacuuaaauaaug

SEQ ID NO: 2002136 - RNA, 14 nt, Human
gaacuguuguauaa

SEQ ID NO: 2002137 - RNA, 15 nt, Human
gaacuguuguauaaa

SEQ ID NO: 2002138 - RNA, 16 nt, Human
gaacuguuguauaaau

SEQ ID NO: 2002139 - RNA, 20 nt, Human
gaacuguuguauaaauuuau

SEQ ID NO: 2002140 - RNA, 17 nt, Human
gaacuuaaauaauguga

SEQ ID NO: 2002141 - RNA, 15 nt, Human
gaacuguuagaaugu

SEQ ID NO: 2002142 - RNA, 16 nt, Human
gaacucccuuucaaca

SEQ ID NO: 2002143 - RNA, 15 nt, Human
gaacuccuaaaucaa

SEQ ID NO: 2002144 - RNA, 13 nt, Human
gaacuguuguaua

SEQ ID NO: 2002145 - RNA, 16 nt, Human
gaacuccuaaaucaag

SEQ ID NO: 2002146 - RNA, 13 nt, Human
gaacuccugaccu

SEQ ID NO: 2002147 - RNA, 20 nt, Human
gaaccacaucuugcucugcu

SEQ ID NO: 2002148 - RNA, 18 nt, Human
gaaccacaucuugcucug

SEQ ID NO: 2002149 - RNA, 15 nt, Human
gaacuuguuuucugg

SEQ ID NO: 2002150 - RNA, 12 nt, Human
gaacuugguucc

SEQ ID NO: 2002151 - RNA, 14 nt, Human
gaacuuguuuaaua

SEQ ID NO: 2002152 - RNA, 17 nt, Human
gaacuuuccaggaaggc

SEQ ID NO: 2002153 - RNA, 17 nt, Human
gaacuugggccacugug

SEQ ID NO: 2002154 - RNA, 18 nt, Human
gaacuuggcgcugccccu

SEQ ID NO: 2002155 - RNA, 19 nt, Human
gaacuuggugccuaauguu

SEQ ID NO: 2002156 - RNA, 21 nt, Human
gaacuugaagccugcuccuuc

SEQ ID NO: 2002157 - RNA, 22 nt, Human
gaacuugaagccugcuccuucc

SEQ ID NO: 2002158 - RNA, 22 nt, Human
gaacuuguaaaggaauuuaaaa

SEQ ID NO: 2002159 - RNA, 20 nt, Human
gaagaaagaacuaucuucau

SEQ ID NO: 2002160 - RNA, 16 nt, Human
gaacuuugaccucugc

SEQ ID NO: 2002161 - RNA, 22 nt, Human
gaacuuugaccucugcagcaau

SEQ ID NO: 2002162 - RNA, 21 nt, Human
gaagaaauguaguuuacauuu

SEQ ID NO: 2002163 - RNA, 19 nt, Human
cuuggagccugcagagcug

SEQ ID NO: 2002164 - RNA, 20 nt, Human
cuuggagccugcagagcugc

SEQ ID NO: 2002165 - RNA, 14 nt, Human
cuuggagcucugag

SEQ ID NO: 2002166 - RNA, 21 nt, Human
cuuggaugaguuuugggaagu

SEQ ID NO: 2002167 - RNA, 15 nt, Human
cuuggagccugcaga

SEQ ID NO: 2002168 - RNA, 16 nt, Human
cuuggagccugcagag

SEQ ID NO: 2002169 - RNA, 17 nt, Human
cuuggagccugcagagc

SEQ ID NO: 2002170 - RNA, 18 nt, Human
cuuggagccugcagagcu

SEQ ID NO: 2002171 - RNA, 13 nt, Human
cuuggagccugca

SEQ ID NO: 2002172 - RNA, 19 nt, Human
cuuggacauuuuaugucuu

SEQ ID NO: 2002173 - RNA, 14 nt, Human
cuuggauugucccc

SEQ ID NO: 2002174 - RNA, 13 nt, Human
cuuggauuguccc

SEQ ID NO: 2002175 - RNA, 23 nt, Human
cuuggcucaaguccucuuuucug

SEQ ID NO: 2002176 - RNA, 12 nt, Human
cuuggcugcagg

SEQ ID NO: 2002177 - RNA, 13 nt, Human
cuuggcugcaggg

SEQ ID NO: 2002178 - RNA, 15 nt, Human
cuugcuuuuaaaauc

SEQ ID NO: 2002179 - RNA, 16 nt, Human
cuuggacauuuuaugu

SEQ ID NO: 2002180 - RNA, 17 nt, Human
cuuggacauuuuauguc

SEQ ID NO: 2002181 - RNA, 18 nt, Human
cuuggacauuuuaugucu

SEQ ID NO: 2002182 - RNA, 13 nt, Human
cuugcuugcuuuu

SEQ ID NO: 2002183 - RNA, 18 nt, Human
cuugcauuuaaaagacag

SEQ ID NO: 2002184 - RNA, 22 nt, Human
cuugcauuucacuugaguggag

SEQ ID NO: 2002185 - RNA, 16 nt, Human
cuugcauuuuagcuaa

SEQ ID NO: 2002186 - RNA, 20 nt, Human
cuugcauuuuagcuaauuua

SEQ ID NO: 2002187 - RNA, 12 nt, Human
cuugcauuuuug

SEQ ID NO: 2002188 - RNA, 17 nt, Human
cuugccaaauauaaaua

SEQ ID NO: 2002189 - RNA, 13 nt, Human
cuugcauuuuugc

SEQ ID NO: 2002190 - RNA, 14 nt, Human
cuugcauuuuugca

SEQ ID NO: 2002191 - RNA, 20 nt, Human
cuugcauuuuugcaggagca

SEQ ID NO: 2002192 - RNA, 21 nt, Human
cuugcauuuuugcaggagcag

SEQ ID NO: 2002193 - RNA, 10 nt, Human
cuugcugccu

SEQ ID NO: 2002194 - RNA, 11 nt, Human
cuugcugccuc

SEQ ID NO: 2002195 - RNA, 13 nt, Human
cuugcugccucgg

SEQ ID NO: 2002196 - RNA, 19 nt, Human
cuuggggaccagagcugcc

SEQ ID NO: 2002197 - RNA, 18 nt, Human
cuuggggaccagagcugc

SEQ ID NO: 2002198 - RNA, 17 nt, Human
cuuggggaccagagcug

SEQ ID NO: 2002199 - RNA, 16 nt, Human
cuuggggaccagagcu

SEQ ID NO: 2002200 - RNA, 22 nt, Human
cuuggcucucaaugcuguuugg

SEQ ID NO: 2002201 - RNA, 13 nt, Human
cuuggcucugagg

SEQ ID NO: 2002202 - RNA, 17 nt, Human
cuuggcuugccauuuuu

SEQ ID NO: 2002203 - RNA, 16 nt, Human
cuuggcuuggcccugg

SEQ ID NO: 2002204 - RNA, 20 nt, Human
cuugguuuguaaauuaacuu

SEQ ID NO: 2002205 - RNA, 18 nt, Human
cuuggcuuggcccuggca

SEQ ID NO: 2002206 - RNA, 18 nt, Human
cuuguaaaggaauuuaaa

SEQ ID NO: 2002207 - RNA, 18 nt, Human
cuuguaaaaauuaaaagu

SEQ ID NO: 2002208 - RNA, 18 nt, Human
cuuguauuauguguguuu

SEQ ID NO: 2002209 - RNA, 16 nt, Human
cuuguauuuuuuaaug

SEQ ID NO: 2002210 - RNA, 17 nt, Human
cuuguggacacagcucu

SEQ ID NO: 2002211 - RNA, 18 nt, Human
cuuguggacacagcucuu

SEQ ID NO: 2002212 - RNA, 16 nt, Human
cuugucauagccagug

SEQ ID NO: 2002213 - RNA, 13 nt, Human
cuuguauuaugug

SEQ ID NO: 2002214 - RNA, 21 nt, Human
cuuguaugaaagauggcugug

SEQ ID NO: 2002215 - RNA, 14 nt, Human
cuuguaacuaaaau

SEQ ID NO: 2002216 - RNA, 16 nt, Human
cuuguaacuaaaauaa

SEQ ID NO: 2002217 - RNA, 17 nt, Human
cuuguaacuaaaauaau

SEQ ID NO: 2002218 - RNA, 22 nt, Human
cuuguaacuaaaauaauuuugu

SEQ ID NO: 2002219 - RNA, 19 nt, Human
cuugaaauauaggaacuua

SEQ ID NO: 2002220 - RNA, 13 nt, Human
cuucuuuuucugg

SEQ ID NO: 2002221 - RNA, 14 nt, Human
cuucuuuuucugga

SEQ ID NO: 2002222 - RNA, 15 nt, Human
cuucuuuuucuggac

SEQ ID NO: 2002223 - RNA, 16 nt, Human
cuucuuuuucuggacu

SEQ ID NO: 2002224 - RNA, 19 nt, Human
cuucuuuuucuggacucug

SEQ ID NO: 2002225 - RNA, 21 nt, Human
cuucuuuuucuggacucugga

SEQ ID NO: 2002226 - RNA, 22 nt, Human
cuucuuuuucuggacucuggac

SEQ ID NO: 2002227 - RNA, 12 nt, Human
cuucuuugcccu

SEQ ID NO: 2002228 - RNA, 13 nt, Human
cuucuuucccuuc

SEQ ID NO: 2002229 - RNA, 14 nt, Human
cuucuuucccuucc

SEQ ID NO: 2002230 - RNA, 16 nt, Human
cuucuuucccuuccuc

SEQ ID NO: 2002231 - RNA, 18 nt, Human
cuucuuucccuuccucca

SEQ ID NO: 2002232 - RNA, 19 nt, Human
cuucuuucccuuccuccau

SEQ ID NO: 2002233 - RNA, 23 nt, Human
cuucuuucccuuccuccauccuc

SEQ ID NO: 2002234 - RNA, 19 nt, Human
cuugaacuccuggccucaa

SEQ ID NO: 2002235 - RNA, 17 nt, Human
cuugaacugagcuugga

SEQ ID NO: 2002236 - RNA, 19 nt, Human
cuugaacugagcuuggaag

SEQ ID NO: 2002237 - RNA, 16 nt, Human
cuugaacuggguacuu

SEQ ID NO: 2002238 - RNA, 15 nt, Human
cuugaacuuugaccu

SEQ ID NO: 2002239 - RNA, 18 nt, Human
cuugaacuggguacuugu

SEQ ID NO: 2002240 - RNA, 20 nt, Human
cuugaacuggguacuugugg

SEQ ID NO: 2002241 - RNA, 14 nt, Human
cuugaacccgggag

SEQ ID NO: 2002242 - RNA, 19 nt, Human
cuugaacccgggaggcaga

SEQ ID NO: 2002243 - RNA, 20 nt, Human
cuugaacccgggaggcagag

SEQ ID NO: 2002244 - RNA, 14 nt, Human
cuugaacuccuggc

SEQ ID NO: 2002245 - RNA, 15 nt, Human
cuugaacuccuggcc

SEQ ID NO: 2002246 - RNA, 17 nt, Human
cuugaacuccuggccuc

SEQ ID NO: 2002247 - RNA, 18 nt, Human
cuugaacuccuggccuca

SEQ ID NO: 2002248 - RNA, 17 nt, Human
cuugaguucccagaugg

SEQ ID NO: 2002249 - RNA, 22 nt, Human
cuugaguaaaauacucuuuuua

SEQ ID NO: 2002250 - RNA, 22 nt, Human
cuugcaaaguaucccuacugua

SEQ ID NO: 2002251 - RNA, 17 nt, Human
cuugcacucucuuggcu

SEQ ID NO: 2002252 - RNA, 17 nt, Human
cuugcacucuucuacca

SEQ ID NO: 2002253 - RNA, 18 nt, Human
cuugcacucucuuggcug

SEQ ID NO: 2002254 - RNA, 12 nt, Human
cuugcagaacuu

SEQ ID NO: 2002255 - RNA, 14 nt, Human
cuugcaauggcagc

SEQ ID NO: 2002256 - RNA, 22 nt, Human
cuugcaagggcggccuuuccca

SEQ ID NO: 2002257 - RNA, 20 nt, Human
cuugcauacaaacaagcaua

SEQ ID NO: 2002258 - RNA, 21 nt, Human
cuugcauacaaacaagcauau

SEQ ID NO: 2002259 - RNA, 21 nt, Human
cuugcauaguaaauguaguuc

SEQ ID NO: 2002260 - RNA, 21 nt, Human
cuugcaugguuuagaaagcuu

SEQ ID NO: 2002261 - RNA, 21 nt, Human
cuugcaugaggcuaguguggu

SEQ ID NO: 2002262 - RNA, 18 nt, Human
cuugcagacucuacagag

SEQ ID NO: 2002263 - RNA, 12 nt, Human
cuugcagaagcu

SEQ ID NO: 2002264 - RNA, 13 nt, Human
cuugcagaagcug

SEQ ID NO: 2002265 - RNA, 14 nt, Human
cuugcauacaaaca

SEQ ID NO: 2002266 - RNA, 15 nt, Human
cuugcauacaaacaa

SEQ ID NO: 2002267 - RNA, 21 nt, Human
cuugaguaaaauacucuuuuu

SEQ ID NO: 2002268 - RNA, 20 nt, Human
cuugagccuugaacuuugac

SEQ ID NO: 2002269 - RNA, 22 nt, Human
cuugagccuugaacuuugaccu

SEQ ID NO: 2002270 - RNA, 13 nt, Human
cuugagcucagga

SEQ ID NO: 2002271 - RNA, 21 nt, Human
cuugaccauucuccaccugcc

SEQ ID NO: 2002272 - RNA, 14 nt, Human
cuugagagggugga

SEQ ID NO: 2002273 - RNA, 20 nt, Human
cuugaccauucuccaccugc

SEQ ID NO: 2002274 - RNA, 17 nt, Human
cuugaccauucuccacc

SEQ ID NO: 2002275 - RNA, 19 nt, Human
cuugagccuugaacuuuga

SEQ ID NO: 2002276 - RNA, 16 nt, Human
cuuuuuuauacauaaa

SEQ ID NO: 2002277 - RNA, 17 nt, Human
cuuuuuuauacauaaac

SEQ ID NO: 2002278 - RNA, 15 nt, Human
cuuuuuuauacauaa

SEQ ID NO: 2002279 - RNA, 21 nt, Human
cuuuuuagaugugcugcuuug

SEQ ID NO: 2002280 - RNA, 16 nt, Human
gaaaaagaaaaaauau

SEQ ID NO: 2002281 - RNA, 11 nt, Human
gaaaaagaaaa

SEQ ID NO: 2002282 - RNA, 17 nt, Human
cuuuuuuauuaaucacu

SEQ ID NO: 2002283 - RNA, 19 nt, Human
cuuuuuuauuaaucacugu

SEQ ID NO: 2002284 - RNA, 20 nt, Human
cuuuuuuauuaaucacugug

SEQ ID NO: 2002285 - RNA, 21 nt, Human
cuuuuuuauuaaucacugugu

SEQ ID NO: 2002286 - RNA, 19 nt, Human
cuuuuuuaucaugugaaau

SEQ ID NO: 2002287 - RNA, 15 nt, Human
cuuuuuuauaucuug

SEQ ID NO: 2002288 - RNA, 13 nt, Human
cuuuuuuauuaau

SEQ ID NO: 2002289 - RNA, 14 nt, Human
cuuuuuuauuaauc

SEQ ID NO: 2002290 - RNA, 15 nt, Human
cuuuuuuauuaauca

SEQ ID NO: 2002291 - RNA, 18 nt, Human
cuuuuuuauacauaaaca

SEQ ID NO: 2002292 - RNA, 14 nt, Human
cuuuuuuauaucuu

SEQ ID NO: 2002293 - RNA, 22 nt, Human
cuuuuuaauauugauaugcuua

SEQ ID NO: 2002294 - RNA, 15 nt, Human
cuuuuuaaccucugu

SEQ ID NO: 2002295 - RNA, 16 nt, Human
cuuuuuaaccucuguu

SEQ ID NO: 2002296 - RNA, 13 nt, Human
cuuuucuuuucuu

SEQ ID NO: 2002297 - RNA, 16 nt, Human
cuuuucuuucuaccaa

SEQ ID NO: 2002298 - RNA, 17 nt, Human
cuuuucuuugccaucuc

SEQ ID NO: 2002299 - RNA, 21 nt, Human
cuuuucuuugccaucucugcu

SEQ ID NO: 2002300 - RNA, 22 nt, Human
cuuuucuuugccaucucugcuc

SEQ ID NO: 2002301 - RNA, 17 nt, Human
cuuuucuuucagccaag

SEQ ID NO: 2002302 - RNA, 22 nt, Human
cuuuucuaaacuaggcuccuuc

SEQ ID NO: 2002303 - RNA, 23 nt, Human
cuuuucuaaacuaggcuccuuca

SEQ ID NO: 2002304 - RNA, 14 nt, Human
cuuuuaaaaaguau

SEQ ID NO: 2002305 - RNA, 15 nt, Human
cuuuuaaaaaguauu

SEQ ID NO: 2002306 - RNA, 16 nt, Human
cuuuuaaaaaguauug

SEQ ID NO: 2002307 - RNA, 19 nt, Human
cuuuuaaaaaguauugcca

SEQ ID NO: 2002308 - RNA, 18 nt, Human
cuuuuaaaacacuuccau

SEQ ID NO: 2002309 - RNA, 21 nt, Human
cuuuuaaaaaguauugccaaa

SEQ ID NO: 2002310 - RNA, 23 nt, Human
cuuuuaaaaaguauugccaaaca

SEQ ID NO: 2002311 - RNA, 14 nt, Human
cuuuuaaaacuacu

SEQ ID NO: 2002312 - RNA, 19 nt, Human
cuuuuaaaacuacuuagca

SEQ ID NO: 2002313 - RNA, 15 nt, Human
cuuuuaaagaauuuc

SEQ ID NO: 2002314 - RNA, 18 nt, Human
cuuuuaaagaauuucuuu

SEQ ID NO: 2002315 - RNA, 21 nt, Human
cuuuucgcaggauucuuccuc

SEQ ID NO: 2002316 - RNA, 20 nt, Human
cuuuucgcaggauucuuccu

SEQ ID NO: 2002317 - RNA, 20 nt, Human
cuuuuccuugcauacaaaca

SEQ ID NO: 2002318 - RNA, 15 nt, Human
cuuuuccuugcauac

SEQ ID NO: 2002319 - RNA, 14 nt, Human
cuuuucccuucuuu

SEQ ID NO: 2002320 - RNA, 14 nt, Human
cuuuuccagagcau

SEQ ID NO: 2002321 - RNA, 21 nt, Human
cuuuuccagagcauuccaguc

SEQ ID NO: 2002322 - RNA, 14 nt, Human
cuuuuccaguauuu

SEQ ID NO: 2002323 - RNA, 16 nt, Human
cuuuucacugcuggcu

SEQ ID NO: 2002324 - RNA, 17 nt, Human
cuuuuccaauaugugau

SEQ ID NO: 2002325 - RNA, 19 nt, Human
cuuuuccaauaugugauuu

SEQ ID NO: 2002326 - RNA, 18 nt, Human
cuuuuccaguauuuuagu

SEQ ID NO: 2002327 - RNA, 19 nt, Human
cuuuuccucgcuucuuuca

SEQ ID NO: 2002328 - RNA, 20 nt, Human
cuuuuccucgcuucuuucaa

SEQ ID NO: 2002329 - RNA, 16 nt, Human
cuuuuccucgcuucuu

SEQ ID NO: 2002330 - RNA, 17 nt, Human
cuuuuccucgcuucuuu

SEQ ID NO: 2002331 - RNA, 18 nt, Human
cuuuuccucgcuucuuuc

SEQ ID NO: 2002332 - RNA, 23 nt, Human
cuuuuccaacccucaucaccaac

SEQ ID NO: 2002333 - RNA, 13 nt, Human
cuuuuccaacccu

SEQ ID NO: 2002334 - RNA, 22 nt, Human
cuuuucauuuaggugaggaagc

SEQ ID NO: 2002335 - RNA, 12 nt, Human
cuuuucacugcu

SEQ ID NO: 2002336 - RNA, 18 nt, Human
cuuuucacccuucuacuc

SEQ ID NO: 2002337 - RNA, 15 nt, Human
cuuuucaccauucgu

SEQ ID NO: 2002338 - RNA, 14 nt, Human
cuuuucacccuucu

SEQ ID NO: 2002339 - RNA, 16 nt, Human
cuuuucacccuucuac

SEQ ID NO: 2002340 - RNA, 17 nt, Human
cuuuucacccuucuacu

SEQ ID NO: 2002341 - RNA, 22 nt, Human
cuuuccuacuugcacucuucua

SEQ ID NO: 2002342 - RNA, 21 nt, Human
cuuuccgguguuuaagacauu

SEQ ID NO: 2002343 - RNA, 15 nt, Human
cuuuccccaugucuc

SEQ ID NO: 2002344 - RNA, 20 nt, Human
cuuuccccaugucucgacuc

SEQ ID NO: 2002345 - RNA, 21 nt, Human
cuuuccccaugucucgacuca

SEQ ID NO: 2002346 - RNA, 23 nt, Human
cuuuccaaagccaaugugaacag

SEQ ID NO: 2002347 - RNA, 18 nt, Human
cuuuccacuccuccuagc

SEQ ID NO: 2002348 - RNA, 21 nt, Human
cuuuccacuccuccuagccac

SEQ ID NO: 2002349 - RNA, 12 nt, Human
cuuuccacucug

SEQ ID NO: 2002350 - RNA, 13 nt, Human
cuuuccacucugg

SEQ ID NO: 2002351 - RNA, 14 nt, Human
cuuuccacucugga

SEQ ID NO: 2002352 - RNA, 15 nt, Human
cuuuccacucuggau

SEQ ID NO: 2002353 - RNA, 23 nt, Human
cuuuccacucuggauucagccuu

SEQ ID NO: 2002354 - RNA, 14 nt, Human
cuuuccaggaaggc

SEQ ID NO: 2002355 - RNA, 16 nt, Human
cuuuccaaaugcccag

SEQ ID NO: 2002356 - RNA, 22 nt, Human
cuuuccaaaguacacuguuuca

SEQ ID NO: 2002357 - RNA, 16 nt, Human
cuuuccaaaguacacu

SEQ ID NO: 2002358 - RNA, 19 nt, Human
cuuuauuuuguguuuagga

SEQ ID NO: 2002359 - RNA, 21 nt, Human
cuuguggacacagcucuucuc

SEQ ID NO: 2002360 - RNA, 17 nt, Human
cuuuauuuuuuugaacu

SEQ ID NO: 2002361 - RNA, 20 nt, Human
cuuuauuuuuuugaacucuu

SEQ ID NO: 2002362 - RNA, 16 nt, Human
cuuucaagaacuuguu

SEQ ID NO: 2002363 - RNA, 17 nt, Human
cuuucaagaacuuguuu

SEQ ID NO: 2002364 - RNA, 14 nt, Human
cuuucaacucauug

SEQ ID NO: 2002365 - RNA, 13 nt, Human
cuuucaagaacuu

SEQ ID NO: 2002366 - RNA, 15 nt, Human
cuuucaagaacuugu

SEQ ID NO: 2002367 - RNA, 19 nt, Human
cuuucaagggcuuuccugu

SEQ ID NO: 2002368 - RNA, 23 nt, Human
cuuuggaaagaguaggaagacuu

SEQ ID NO: 2002369 - RNA, 21 nt, Human
cuuugcccuuuacuugucuuu

SEQ ID NO: 2002370 - RNA, 19 nt, Human
cuuuggaaaguagaaaagc

SEQ ID NO: 2002371 - RNA, 19 nt, Human
cuuuggaaagaguaggaag

SEQ ID NO: 2002372 - RNA, 23 nt, Human
cuuugcccccaaacccccauucu

SEQ ID NO: 2002373 - RNA, 22 nt, Human
cuuugcacuuuuucuuaaucau

SEQ ID NO: 2002374 - RNA, 17 nt, Human
cuuugcacuuuuucuua

SEQ ID NO: 2002375 - RNA, 12 nt, Human
cuuugccaucuc

SEQ ID NO: 2002376 - RNA, 14 nt, Human
cuuugccaucucug

SEQ ID NO: 2002377 - RNA, 18 nt, Human
cuuugccaucucugcucc

SEQ ID NO: 2002378 - RNA, 19 nt, Human
cuuugccaucucugcucca

SEQ ID NO: 2002379 - RNA, 15 nt, Human
cuuugccaugugcuu

SEQ ID NO: 2002380 - RNA, 14 nt, Human
cuuugcagacaggc

SEQ ID NO: 2002381 - RNA, 15 nt, Human
cuuugcagacaggca

SEQ ID NO: 2002382 - RNA, 11 nt, Human
cuuugaauuuu

SEQ ID NO: 2002383 - RNA, 13 nt, Human
cuuugaauuuuca

SEQ ID NO: 2002384 - RNA, 14 nt, Human
cuuugaauuuucau

SEQ ID NO: 2002385 - RNA, 15 nt, Human
cuuugaauuuucauu

SEQ ID NO: 2002386 - RNA, 18 nt, Human
cuuugaauuuucauuuua

SEQ ID NO: 2002387 - RNA, 19 nt, Human
cuuugaauuuucauuuuac

SEQ ID NO: 2002388 - RNA, 21 nt, Human
cuuuccugaggcugggcuccc

SEQ ID NO: 2002389 - RNA, 20 nt, Human
cuuuccugaggcugggcucc

SEQ ID NO: 2002390 - RNA, 16 nt, Human
cuuuccugaggcuggg

SEQ ID NO: 2002391 - RNA, 17 nt, Human
cuuuccugaggcugggc

SEQ ID NO: 2002392 - RNA, 21 nt, Human
cuuucuuaauauuuuuacaug

SEQ ID NO: 2002393 - RNA, 23 nt, Human
cuuucuuaauauuuuuacaugca

SEQ ID NO: 2002394 - RNA, 15 nt, Human
cuuucuucaaaauau

SEQ ID NO: 2002395 - RNA, 16 nt, Human
cuuucuuucuuucuuu

SEQ ID NO: 2002396 - RNA, 23 nt, Human
cuuugaaauauauggucuaaugu

SEQ ID NO: 2002397 - RNA, 18 nt, Human
cuuugaagagugaaauac

SEQ ID NO: 2002398 - RNA, 21 nt, Human
cugcacuccccugcugggugu

SEQ ID NO: 2002399 - RNA, 18 nt, Human
cugcacuccccugcuggg

SEQ ID NO: 2002400 - RNA, 13 nt, Human
cugcagagggcac

SEQ ID NO: 2002401 - RNA, 15 nt, Human
cugcagcaauaaagc

SEQ ID NO: 2002402 - RNA, 16 nt, Human
cugcagcaauaaagca

SEQ ID NO: 2002403 - RNA, 10 nt, Human
cugcagaggg

SEQ ID NO: 2002404 - RNA, 20 nt, Human
cugcacuccccugcugggug

SEQ ID NO: 2002405 - RNA, 19 nt, Human
cugcacuccccugcugggu

SEQ ID NO: 2002406 - RNA, 13 nt, Human
cugcacuccccug

SEQ ID NO: 2002407 - RNA, 14 nt, Human
cugcacuccccugc

SEQ ID NO: 2002408 - RNA, 20 nt, Human
cugcacuccagccuggguga

SEQ ID NO: 2002409 - RNA, 18 nt, Human
cugcaccgggccacagag

SEQ ID NO: 2002410 - RNA, 20 nt, Human
cugcaccgggccacagagaa

SEQ ID NO: 2002411 - RNA, 14 nt, Human
cugcaccggcuggc

SEQ ID NO: 2002412 - RNA, 16 nt, Human
cugaggcccugcccaa

SEQ ID NO: 2002413 - RNA, 23 nt, Human
cugaggcccuucucuccagcccc

SEQ ID NO: 2002414 - RNA, 22 nt, Human
cugaggcccuucucuccagccc

SEQ ID NO: 2002415 - RNA, 16 nt, Human
cugcaccggcuggccu

SEQ ID NO: 2002416 - RNA, 15 nt, Human
cugcaccggcuggcc

SEQ ID NO: 2002417 - RNA, 14 nt, Human
cugcaccgggccac

SEQ ID NO: 2002418 - RNA, 15 nt, Human
cugcaccgggccaca

SEQ ID NO: 2002419 - RNA, 17 nt, Human
cugcagcaauaaagcag

SEQ ID NO: 2002420 - RNA, 18 nt, Human
cugcaggucccuaauaaa

SEQ ID NO: 2002421 - RNA, 17 nt, Human
cugcaggucccuaauaa

SEQ ID NO: 2002422 - RNA, 16 nt, Human
cugcaggucccuaaua

SEQ ID NO: 2002423 - RNA, 15 nt, Human
cugcaggucccuaau

SEQ ID NO: 2002424 - RNA, 14 nt, Human
cugcaggucccuaa

SEQ ID NO: 2002425 - RNA, 13 nt, Human
cugcaggucccua

SEQ ID NO: 2002426 - RNA, 12 nt, Human
cugcaggucccu

SEQ ID NO: 2002427 - RNA, 11 nt, Human
cugcagguccc

SEQ ID NO: 2002428 - RNA, 23 nt, Human
cugcaggucccuaauaaagcugu

SEQ ID NO: 2002429 - RNA, 22 nt, Human
cugcaggucccuaauaaagcug

SEQ ID NO: 2002430 - RNA, 21 nt, Human
cugcaggucccuaauaaagcu

SEQ ID NO: 2002431 - RNA, 20 nt, Human
cugcaggucccuaauaaagc

SEQ ID NO: 2002432 - RNA, 19 nt, Human
cugcaggucccuaauaaag

SEQ ID NO: 2002433 - RNA, 15 nt, Human
cugcaguuccccugg

SEQ ID NO: 2002434 - RNA, 17 nt, Human
cugcaguuccccuggaa

SEQ ID NO: 2002435 - RNA, 20 nt, Human
cugcaguuccccuggaagca

SEQ ID NO: 2002436 - RNA, 16 nt, Human
cugcaguugccaguca

SEQ ID NO: 2002437 - RNA, 13 nt, Human
cugcaguugccag

SEQ ID NO: 2002438 - RNA, 21 nt, Human
cugcaguuccccuggaagcag

SEQ ID NO: 2002439 - RNA, 20 nt, Human
cugcccggcaggguccuaga

SEQ ID NO: 2002440 - RNA, 13 nt, Human
cugcccggcaggg

SEQ ID NO: 2002441 - RNA, 19 nt, Human
cugccccuggcagccccug

SEQ ID NO: 2002442 - RNA, 18 nt, Human
cugccccuggcagccccu

SEQ ID NO: 2002443 - RNA, 22 nt, Human
cugcccuaaugcgcaggcuggc

SEQ ID NO: 2002444 - RNA, 20 nt, Human
cugcccuaaugcgcaggcug

SEQ ID NO: 2002445 - RNA, 21 nt, Human
cugcccuaaugcgcaggcugg

SEQ ID NO: 2002446 - RNA, 20 nt, Human
cugcccggugggggggcaga

SEQ ID NO: 2002447 - RNA, 21 nt, Human
cugcccggugggggggcagag

SEQ ID NO: 2002448 - RNA, 23 nt, Human
cugcccggugggggggcagagcc

SEQ ID NO: 2002449 - RNA, 15 nt, Human
cugccauuucugaga

SEQ ID NO: 2002450 - RNA, 12 nt, Human
cugcccaccugg

SEQ ID NO: 2002451 - RNA, 14 nt, Human
cugcccaggccccu

SEQ ID NO: 2002452 - RNA, 15 nt, Human
cugcccaggccccug

SEQ ID NO: 2002453 - RNA, 15 nt, Human
cugccccaaguuuug

SEQ ID NO: 2002454 - RNA, 17 nt, Human
cugcccaggccugccug

SEQ ID NO: 2002455 - RNA, 16 nt, Human
cugcccaggccccugc

SEQ ID NO: 2002456 - RNA, 18 nt, Human
cugcccaggccccugcca

SEQ ID NO: 2002457 - RNA, 19 nt, Human
cugcccaggccccugccac

SEQ ID NO: 2002458 - RNA, 20 nt, Human
cugcccaggccccugccacc

SEQ ID NO: 2002459 - RNA, 22 nt, Human
cugccaggaagccagcaggcuc

SEQ ID NO: 2002460 - RNA, 15 nt, Human
cugccauccucccaa

SEQ ID NO: 2002461 - RNA, 21 nt, Human
cugccauccagguucagcuug

SEQ ID NO: 2002462 - RNA, 21 nt, Human
cugccagcucuuccuagcugg

SEQ ID NO: 2002463 - RNA, 17 nt, Human
cugccagcucuuccuag

SEQ ID NO: 2002464 - RNA, 19 nt, Human
cugccagcucuuccuagcu

SEQ ID NO: 2002465 - RNA, 12 nt, Human
cugccagcucuu

SEQ ID NO: 2002466 - RNA, 14 nt, Human
cugccagcucuucc

SEQ ID NO: 2002467 - RNA, 15 nt, Human
cugccagcucuuccu

SEQ ID NO: 2002468 - RNA, 21 nt, Human
cugccaggaagccagcaggcu

SEQ ID NO: 2002469 - RNA, 20 nt, Human
cugccaggaagccagcaggc

SEQ ID NO: 2002470 - RNA, 14 nt, Human
cugccaggaagcca

SEQ ID NO: 2002471 - RNA, 13 nt, Human
cugccaggaagcc

SEQ ID NO: 2002472 - RNA, 14 nt, Human
cugcauaucuucau

SEQ ID NO: 2002473 - RNA, 20 nt, Human
cugcaucaagaugugacaug

SEQ ID NO: 2002474 - RNA, 22 nt, Human
cugcauaauucugaaguuauau

SEQ ID NO: 2002475 - RNA, 23 nt, Human
cugcauaauucugaaguuauauu

SEQ ID NO: 2002476 - RNA, 15 nt, Human
cugcauaugaaagga

SEQ ID NO: 2002477 - RNA, 17 nt, Human
cugccagacccccugga

SEQ ID NO: 2002478 - RNA, 19 nt, Human
cugccagacccccuggaga

SEQ ID NO: 2002479 - RNA, 12 nt, Human
cugccaccuccc

SEQ ID NO: 2002480 - RNA, 13 nt, Human
cugccaccucccc

SEQ ID NO: 2002481 - RNA, 17 nt, Human
cugccaccuccccuugc

SEQ ID NO: 2002482 - RNA, 18 nt, Human
cugccaccuccccuugcc

SEQ ID NO: 2002483 - RNA, 19 nt, Human
cugccaccuccccuugcca

SEQ ID NO: 2002484 - RNA, 20 nt, Human
cugccaccuccccuugccag

SEQ ID NO: 2002485 - RNA, 22 nt, Human
cugccaccuccccuugccagcu

SEQ ID NO: 2002486 - RNA, 12 nt, Human
cugccacccugg

SEQ ID NO: 2002487 - RNA, 14 nt, Human
cugccacccugggg

SEQ ID NO: 2002488 - RNA, 21 nt, Human
cugccacccuggggagaaagu

SEQ ID NO: 2002489 - RNA, 10 nt, Human
cugccaccuc

SEQ ID NO: 2002490 - RNA, 11 nt, Human
cugccaccucc

SEQ ID NO: 2002491 - RNA, 20 nt, Human
cugcuugcuugcuuuuuaau

SEQ ID NO: 2002492 - RNA, 22 nt, Human
cugcuugaggcaacucaucuua

SEQ ID NO: 2002493 - RNA, 20 nt, Human
cugcuugaguucccagaugg

SEQ ID NO: 2002494 - RNA, 18 nt, Human
cugcuugggcuucauccu

SEQ ID NO: 2002495 - RNA, 17 nt, Human
cugcuugggcuucaucc

SEQ ID NO: 2002496 - RNA, 15 nt, Human
cugcuugggcuucau

SEQ ID NO: 2002497 - RNA, 13 nt, Human
cugcuugggcuuc

SEQ ID NO: 2002498 - RNA, 19 nt, Human
cugcuugugaaaggaaaga

SEQ ID NO: 2002499 - RNA, 19 nt, Human
cugcuugggcuucauccuc

SEQ ID NO: 2002500 - RNA, 15 nt, Human
cugcuuggcccaggg

SEQ ID NO: 2002501 - RNA, 14 nt, Human
cugcuuggcccagg

SEQ ID NO: 2002502 - RNA, 23 nt, Human
cugcuuggcccagggggcuuccu

SEQ ID NO: 2002503 - RNA, 16 nt, Human
cugcuuggcccagggg

SEQ ID NO: 2002504 - RNA, 18 nt, Human
cugcuuggcccagggggc

SEQ ID NO: 2002505 - RNA, 19 nt, Human
cugcuuuugucuaugggac

SEQ ID NO: 2002506 - RNA, 17 nt, Human
cugcuuuuggucugugu

SEQ ID NO: 2002507 - RNA, 16 nt, Human
cugcuuugggcugccc

SEQ ID NO: 2002508 - RNA, 13 nt, Human
cugcuuuggaaau

SEQ ID NO: 2002509 - RNA, 15 nt, Human
cugcuuuuggucugu

SEQ ID NO: 2002510 - RNA, 17 nt, Human
cugcuuugggcugcccu

SEQ ID NO: 2002511 - RNA, 14 nt, Human
cugcuuuagacuug

SEQ ID NO: 2002512 - RNA, 16 nt, Human
cugcuuuagacuugaa

SEQ ID NO: 2002513 - RNA, 17 nt, Human
cugcuuuagacuugaaa

SEQ ID NO: 2002514 - RNA, 19 nt, Human
cugcuuuagacuugaaaag

SEQ ID NO: 2002515 - RNA, 20 nt, Human
cugcuuuagacuugaaaaga

SEQ ID NO: 2002516 - RNA, 23 nt, Human
cugcuggugggcuugucauagcc

SEQ ID NO: 2002517 - RNA, 16 nt, Human
cugcugucauugcuuc

SEQ ID NO: 2002518 - RNA, 18 nt, Human
cugcugucauugcuucuu

SEQ ID NO: 2002519 - RNA, 19 nt, Human
cugcugucauugcuucuuc

SEQ ID NO: 2002520 - RNA, 20 nt, Human
cugcugucauugcuucuucu

SEQ ID NO: 2002521 - RNA, 22 nt, Human
cugcugucauugcuucuucuga

SEQ ID NO: 2002522 - RNA, 17 nt, Human
cugcuuccuuucuugau

SEQ ID NO: 2002523 - RNA, 16 nt, Human
cugcuuccuuucuuga

SEQ ID NO: 2002524 - RNA, 22 nt, Human
cugcuugaauaaacaccacugg

SEQ ID NO: 2002525 - RNA, 19 nt, Human
cugcuucucugcccagcuu

SEQ ID NO: 2002526 - RNA, 21 nt, Human
cugcuugaggcaacucaucuu

SEQ ID NO: 2002527 - RNA, 20 nt, Human
cugcuugaggcaacucaucu

SEQ ID NO: 2002528 - RNA, 13 nt, Human
cugcuugaggcaa

SEQ ID NO: 2002529 - RNA, 17 nt, Human
cugcuggguguggcgca

SEQ ID NO: 2002530 - RNA, 18 nt, Human
cugcuggucacuucuucu

SEQ ID NO: 2002531 - RNA, 19 nt, Human
cugcuggucacuucuucug

SEQ ID NO: 2002532 - RNA, 20 nt, Human
cugcuggucacuucuucugu

SEQ ID NO: 2002533 - RNA, 17 nt, Human
cugcuggucagcacucc

SEQ ID NO: 2002534 - RNA, 17 nt, Human
cugcuggucacuucuuc

SEQ ID NO: 2002535 - RNA, 15 nt, Human
cugcuggguguggcg

SEQ ID NO: 2002536 - RNA, 14 nt, Human
cugcuggguguggc

SEQ ID NO: 2002537 - RNA, 14 nt, Human
cugcugcuggcugg

SEQ ID NO: 2002538 - RNA, 13 nt, Human
cugcuggcugccu

SEQ ID NO: 2002539 - RNA, 14 nt, Human
cugcuggcugccuu

SEQ ID NO: 2002540 - RNA, 15 nt, Human
cugcuggcugccuua

SEQ ID NO: 2002541 - RNA, 20 nt, Human
cugcugggcuccacuuggcu

SEQ ID NO: 2002542 - RNA, 13 nt, Human
cugcugcuggcug

SEQ ID NO: 2002543 - RNA, 12 nt, Human
cugcugcuggcu

SEQ ID NO: 2002544 - RNA, 13 nt, Human
cugcugcaguugc

SEQ ID NO: 2002545 - RNA, 10 nt, Human
cugcugcagu

SEQ ID NO: 2002546 - RNA, 14 nt, Human
cugcugcaguugcc

SEQ ID NO: 2002547 - RNA, 15 nt, Human
cugcugcaguugcca

SEQ ID NO: 2002548 - RNA, 23 nt, Human
cugcugccugcuuuuuauggccu

SEQ ID NO: 2002549 - RNA, 14 nt, Human
cugcugccugcuuu

SEQ ID NO: 2002550 - RNA, 16 nt, Human
cugcugccucaggaau

SEQ ID NO: 2002551 - RNA, 15 nt, Human
cugcucugugcccac

SEQ ID NO: 2002552 - RNA, 12 nt, Human
cugcucugguua

SEQ ID NO: 2002553 - RNA, 16 nt, Human
cugcucuugaacuccu

SEQ ID NO: 2002554 - RNA, 18 nt, Human
cugcucuugaacuccuga

SEQ ID NO: 2002555 - RNA, 19 nt, Human
cugcucuugaacuccugac

SEQ ID NO: 2002556 - RNA, 11 nt, Human
cugcucuugca

SEQ ID NO: 2002557 - RNA, 20 nt, Human
cugcucugaugaagaggagu

SEQ ID NO: 2002558 - RNA, 13 nt, Human
cugcucugcccca

SEQ ID NO: 2002559 - RNA, 15 nt, Human
cugcucugccccagc

SEQ ID NO: 2002560 - RNA, 17 nt, Human
cugcucugccccagcuu

SEQ ID NO: 2002561 - RNA, 22 nt, Human
cugcucugccccagcuugggca

SEQ ID NO: 2002562 - RNA, 11 nt, Human
cugcucugcuc

SEQ ID NO: 2002563 - RNA, 12 nt, Human
cugcucugcucg

SEQ ID NO: 2002564 - RNA, 15 nt, Human
cugcucugcucgccu

SEQ ID NO: 2002565 - RNA, 11 nt, Human
cugcucugcug

SEQ ID NO: 2002566 - RNA, 12 nt, Human
cugcucugcuga

SEQ ID NO: 2002567 - RNA, 23 nt, Human
cugcggugcuaucucccccagcc

SEQ ID NO: 2002568 - RNA, 22 nt, Human
cugcggugcuaucucccccagc

SEQ ID NO: 2002569 - RNA, 21 nt, Human
cugcggugcuaucucccccag

SEQ ID NO: 2002570 - RNA, 20 nt, Human
cugcggugcuaucuccccca

SEQ ID NO: 2002571 - RNA, 23 nt, Human
cugcuccucuccccagcaaguga

SEQ ID NO: 2002572 - RNA, 14 nt, Human
cugcucccccuuuu

SEQ ID NO: 2002573 - RNA, 15 nt, Human
cugcuccugagcccc

SEQ ID NO: 2002574 - RNA, 13 nt, Human
cugcuccugagcc

SEQ ID NO: 2002575 - RNA, 14 nt, Human
cugcuccugagccc

SEQ ID NO: 2002576 - RNA, 12 nt, Human
cugcuccugagc

SEQ ID NO: 2002577 - RNA, 19 nt, Human
cugcuccucuccccagcaa

SEQ ID NO: 2002578 - RNA, 20 nt, Human
cugcuccucuccccagcaag

SEQ ID NO: 2002579 - RNA, 15 nt, Human
cugcucuccgaccag

SEQ ID NO: 2002580 - RNA, 20 nt, Human
cugcucucaaaccccugacc

SEQ ID NO: 2002581 - RNA, 23 nt, Human
cugcucucaaaccccugaccuca

SEQ ID NO: 2002582 - RNA, 22 nt, Human
cugcucucaccuugguuccugg

SEQ ID NO: 2002583 - RNA, 22 nt, Human
cugccugcuuuuuauggccugu

SEQ ID NO: 2002584 - RNA, 19 nt, Human
cugcggugcuaucuccccc

SEQ ID NO: 2002585 - RNA, 18 nt, Human
cugcggugcuaucucccc

SEQ ID NO: 2002586 - RNA, 23 nt, Human
cugcgguccacccaggagccccg

SEQ ID NO: 2002587 - RNA, 22 nt, Human
cugcgggucacaggagggaggg

SEQ ID NO: 2002588 - RNA, 23 nt, Human
cugcgggucacaggagggagggg

SEQ ID NO: 2002589 - RNA, 15 nt, Human
cugcgggucacagga

SEQ ID NO: 2002590 - RNA, 21 nt, Human
cugcgggucacaggagggagg

SEQ ID NO: 2002591 - RNA, 19 nt, Human
cugcggggcgggcacaccu

SEQ ID NO: 2002592 - RNA, 22 nt, Human
cugcggggcgggcacaccuccu

SEQ ID NO: 2002593 - RNA, 17 nt, Human
cugcccugcccaccugg

SEQ ID NO: 2002594 - RNA, 20 nt, Human
cugcccugcccaccuggccu

SEQ ID NO: 2002595 - RNA, 21 nt, Human
cugcccugcccaccuggccuc

SEQ ID NO: 2002596 - RNA, 18 nt, Human
cugccugaagucacacag

SEQ ID NO: 2002597 - RNA, 16 nt, Human
cugccugaagucacac

SEQ ID NO: 2002598 - RNA, 17 nt, Human
cugccugcccuuugucc

SEQ ID NO: 2002599 - RNA, 23 nt, Human
cugccugcccuuuguccuccugc

SEQ ID NO: 2002600 - RNA, 17 nt, Human
cugccugccuuaaguga

SEQ ID NO: 2002601 - RNA, 18 nt, Human
cugccugccuuaagugag

SEQ ID NO: 2002602 - RNA, 20 nt, Human
cugccugccuuaagugagga

SEQ ID NO: 2002603 - RNA, 22 nt, Human
cugccugccuuaagugaggaaa

SEQ ID NO: 2002604 - RNA, 19 nt, Human
cugccugaagucacacagu

SEQ ID NO: 2002605 - RNA, 20 nt, Human
cugccugcaguacuuuaccu

SEQ ID NO: 2002606 - RNA, 21 nt, Human
cugccugcaguacuuuaccuc

SEQ ID NO: 2002607 - RNA, 14 nt, Human
cugucccccugaca

SEQ ID NO: 2002608 - RNA, 13 nt, Human
cugucccccugac

SEQ ID NO: 2002609 - RNA, 16 nt, Human
cuguccuacucugugu

SEQ ID NO: 2002610 - RNA, 17 nt, Human
cuguccuacucuguguc

SEQ ID NO: 2002611 - RNA, 18 nt, Human
cuguccuacucuguguca

SEQ ID NO: 2002612 - RNA, 20 nt, Human
cuguccuacucugugucagg

SEQ ID NO: 2002613 - RNA, 22 nt, Human
cugucucaaaaaaagaaaaaga

SEQ ID NO: 2002614 - RNA, 15 nt, Human
cuguccuauuauauu

SEQ ID NO: 2002615 - RNA, 21 nt, Human
cuguccuauuauauucauucu

SEQ ID NO: 2002616 - RNA, 21 nt, Human
cuguccuacucugugucaggu

SEQ ID NO: 2002617 - RNA, 18 nt, Human
cugucucaagagggcacu

SEQ ID NO: 2002618 - RNA, 19 nt, Human
cugucucaagagggcacug

SEQ ID NO: 2002619 - RNA, 20 nt, Human
cugucucaagagggcacugg

SEQ ID NO: 2002620 - RNA, 21 nt, Human
cugucucaagagggcacuggu

SEQ ID NO: 2002621 - RNA, 18 nt, Human
cugucucuacuaaaaaua

SEQ ID NO: 2002622 - RNA, 22 nt, Human
cugucccagugccgagaaggaa

SEQ ID NO: 2002623 - RNA, 21 nt, Human
cuguccauuuuuauucagggg

SEQ ID NO: 2002624 - RNA, 17 nt, Human
cuguccauuuuuauuca

SEQ ID NO: 2002625 - RNA, 20 nt, Human
cuguccaggcacugcugccc

SEQ ID NO: 2002626 - RNA, 21 nt, Human
cuguccaggcacugcugccca

SEQ ID NO: 2002627 - RNA, 22 nt, Human
cuguccaggcacugcugcccag

SEQ ID NO: 2002628 - RNA, 18 nt, Human
cuguccaggcacugcugc

SEQ ID NO: 2002629 - RNA, 19 nt, Human
cuguccaggcacugcugcc

SEQ ID NO: 2002630 - RNA, 22 nt, Human
cuguccacccgccccugccccu

SEQ ID NO: 2002631 - RNA, 15 nt, Human
cuguccaagcagauu

SEQ ID NO: 2002632 - RNA, 14 nt, Human
cuguaccucugccu

SEQ ID NO: 2002633 - RNA, 22 nt, Human
cuguaccucuugagccuugaac

SEQ ID NO: 2002634 - RNA, 14 nt, Human
cuguaucccaugag

SEQ ID NO: 2002635 - RNA, 15 nt, Human
cuguaucccaugagc

SEQ ID NO: 2002636 - RNA, 19 nt, Human
cuguauagcucuuuuccua

SEQ ID NO: 2002637 - RNA, 13 nt, Human
cuguauuugaaag

SEQ ID NO: 2002638 - RNA, 14 nt, Human
cuguauuugaaagu

SEQ ID NO: 2002639 - RNA, 16 nt, Human
cuguauuugaaagugc

SEQ ID NO: 2002640 - RNA, 17 nt, Human
cuguauuugaaagugcc

SEQ ID NO: 2002641 - RNA, 19 nt, Human
cuguauuugaaagugccuu

SEQ ID NO: 2002642 - RNA, 20 nt, Human
cuguauuugaaagugccuuu

SEQ ID NO: 2002643 - RNA, 21 nt, Human
cuguauuugaaagugccuuug

SEQ ID NO: 2002644 - RNA, 19 nt, Human
cuguaucccaugagccuca

SEQ ID NO: 2002645 - RNA, 18 nt, Human
cuguaucccaugagccuc

SEQ ID NO: 2002646 - RNA, 18 nt, Human
cuguaaggcaaucauggu

SEQ ID NO: 2002647 - RNA, 19 nt, Human
cugguucaagcgauucucu

SEQ ID NO: 2002648 - RNA, 17 nt, Human
cugguuauuuaaaaugu

SEQ ID NO: 2002649 - RNA, 20 nt, Human
cugguucaggguuggccccu

SEQ ID NO: 2002650 - RNA, 23 nt, Human
cugguuaauauuuauaggucacu

SEQ ID NO: 2002651 - RNA, 12 nt, Human
cugguggcagcu

SEQ ID NO: 2002652 - RNA, 16 nt, Human
cuggucucgaacuccu

SEQ ID NO: 2002653 - RNA, 14 nt, Human
cugguggcagcuca

SEQ ID NO: 2002654 - RNA, 13 nt, Human
cugguggcagcuc

SEQ ID NO: 2002655 - RNA, 16 nt, Human
cugguggcagcucacc

SEQ ID NO: 2002656 - RNA, 23 nt, Human
cuguacagagcccacgcccccac

SEQ ID NO: 2002657 - RNA, 21 nt, Human
cuguacagagccguaaaaacu

SEQ ID NO: 2002658 - RNA, 22 nt, Human
cuguacagagccguaaaaacug

SEQ ID NO: 2002659 - RNA, 21 nt, Human
cuguaauuugugauacaaugc

SEQ ID NO: 2002660 - RNA, 22 nt, Human
cuguaauuugugauacaaugcu

SEQ ID NO: 2002661 - RNA, 18 nt, Human
cuguaauuugugauacaa

SEQ ID NO: 2002662 - RNA, 17 nt, Human
cuguaauuugugauaca

SEQ ID NO: 2002663 - RNA, 16 nt, Human
cuguaaggcaugaagg

SEQ ID NO: 2002664 - RNA, 17 nt, Human
cuguaaggcaugaagga

SEQ ID NO: 2002665 - RNA, 21 nt, Human
cuguaccucuugagccuugaa

SEQ ID NO: 2002666 - RNA, 15 nt, Human
cuguacaugggacua

SEQ ID NO: 2002667 - RNA, 22 nt, Human
cuguacaugaaaacacauuuuu

SEQ ID NO: 2002668 - RNA, 23 nt, Human
cuguacaugaaaacacauuuuuc

SEQ ID NO: 2002669 - RNA, 22 nt, Human
cugggucgcccuggacugugug

SEQ ID NO: 2002670 - RNA, 18 nt, Human
cugggucgcccuggacug

SEQ ID NO: 2002671 - RNA, 17 nt, Human
cugggucgcccuggacu

SEQ ID NO: 2002672 - RNA, 15 nt, Human
cuggguuggagggug

SEQ ID NO: 2002673 - RNA, 22 nt, Human
cugggcucccuucccaccucuc

SEQ ID NO: 2002674 - RNA, 21 nt, Human
cugggcucccuucccaccucu

SEQ ID NO: 2002675 - RNA, 20 nt, Human
cugggcucccuucccaccuc

SEQ ID NO: 2002676 - RNA, 19 nt, Human
cugggcucccuucccaccu

SEQ ID NO: 2002677 - RNA, 19 nt, Human
cuggguacuuguggacaca

SEQ ID NO: 2002678 - RNA, 18 nt, Human
cuggguacuuguggacac

SEQ ID NO: 2002679 - RNA, 16 nt, Human
cuggguacuuguggac

SEQ ID NO: 2002680 - RNA, 14 nt, Human
cuggguacuugugg

SEQ ID NO: 2002681 - RNA, 23 nt, Human
cuggucucaaacucuugaccuca

SEQ ID NO: 2002682 - RNA, 14 nt, Human
cuggucccacucag

SEQ ID NO: 2002683 - RNA, 17 nt, Human
cugguccaucugguuuu

SEQ ID NO: 2002684 - RNA, 13 nt, Human
cuggucccacuca

SEQ ID NO: 2002685 - RNA, 21 nt, Human
cugguccauagagagcaagac

SEQ ID NO: 2002686 - RNA, 12 nt, Human
cuggucagccca

SEQ ID NO: 2002687 - RNA, 13 nt, Human
cuggucagcccaa

SEQ ID NO: 2002688 - RNA, 16 nt, Human
cuggucacuucuucug

SEQ ID NO: 2002689 - RNA, 17 nt, Human
cuggucacuucuucugu

SEQ ID NO: 2002690 - RNA, 19 nt, Human
cuggucacaggacucugcc

SEQ ID NO: 2002691 - RNA, 20 nt, Human
cuggucacaggacucugccu

SEQ ID NO: 2002692 - RNA, 21 nt, Human
cuggucacaggacucugccuc

SEQ ID NO: 2002693 - RNA, 22 nt, Human
cuggucacaggacucugccucc

SEQ ID NO: 2002694 - RNA, 23 nt, Human
cuggucacaggacucugccuccu

SEQ ID NO: 2002695 - RNA, 15 nt, Human
cuggucacuucuucu

SEQ ID NO: 2002696 - RNA, 20 nt, Human
cugggagagccuuccagggg

SEQ ID NO: 2002697 - RNA, 19 nt, Human
cugggagagccuuccaggg

SEQ ID NO: 2002698 - RNA, 21 nt, Human
cugggagagccuuccaggggu

SEQ ID NO: 2002699 - RNA, 18 nt, Human
cugggagagccuuccagg

SEQ ID NO: 2002700 - RNA, 17 nt, Human
cugggagagccuuccag

SEQ ID NO: 2002701 - RNA, 16 nt, Human
cugggaaacagaggcu

SEQ ID NO: 2002702 - RNA, 15 nt, Human
cugggaaacagaggc

SEQ ID NO: 2002703 - RNA, 11 nt, Human
cugggaaacag

SEQ ID NO: 2002704 - RNA, 23 nt, Human
cuggcuuuucacugcuggcugcc

SEQ ID NO: 2002705 - RNA, 22 nt, Human
cuggcuuucaacuguuucuaga

SEQ ID NO: 2002706 - RNA, 18 nt, Human
cuggcuguuggcuggggg

SEQ ID NO: 2002707 - RNA, 20 nt, Human
cuggcugguuagagguuccc

SEQ ID NO: 2002708 - RNA, 16 nt, Human
cuggcuguuggcuggg

SEQ ID NO: 2002709 - RNA, 17 nt, Human
cuggcuguuggcugggg

SEQ ID NO: 2002710 - RNA, 14 nt, Human
cuggcuguccaccc

SEQ ID NO: 2002711 - RNA, 18 nt, Human
cugggaugauuggagggg

SEQ ID NO: 2002712 - RNA, 20 nt, Human
cugggaucacauguggacuu

SEQ ID NO: 2002713 - RNA, 20 nt, Human
cugggaucccucauccucau

SEQ ID NO: 2002714 - RNA, 20 nt, Human
cugggauuacaggugugaac

SEQ ID NO: 2002715 - RNA, 16 nt, Human
cugggauuacaggugu

SEQ ID NO: 2002716 - RNA, 18 nt, Human
cugggauuacagguguga

SEQ ID NO: 2002717 - RNA, 20 nt, Human
cugggaugggaggagaggac

SEQ ID NO: 2002718 - RNA, 17 nt, Human
cugggauuacaggugug

SEQ ID NO: 2002719 - RNA, 15 nt, Human
cugggccccaguugu

SEQ ID NO: 2002720 - RNA, 19 nt, Human
cugggccccaguuguauuu

SEQ ID NO: 2002721 - RNA, 21 nt, Human
cugggaggucaaggcugcagu

SEQ ID NO: 2002722 - RNA, 19 nt, Human
cugggaggucaaggcugca

SEQ ID NO: 2002723 - RNA, 17 nt, Human
cugggaggcucuggagc

SEQ ID NO: 2002724 - RNA, 21 nt, Human
cugggaggcucuggagcccac

SEQ ID NO: 2002725 - RNA, 20 nt, Human
cugggaggcucuggagccca

SEQ ID NO: 2002726 - RNA, 18 nt, Human
cugggaggcucuggagcc

SEQ ID NO: 2002727 - RNA, 19 nt, Human
cugggagccuacccacccc

SEQ ID NO: 2002728 - RNA, 22 nt, Human
cugggagccuacccacccccag

SEQ ID NO: 2002729 - RNA, 16 nt, Human
cugggagccuacccac

SEQ ID NO: 2002730 - RNA, 16 nt, Human
cuggccuucggccucc

SEQ ID NO: 2002731 - RNA, 17 nt, Human
cuggccuucggccucca

SEQ ID NO: 2002732 - RNA, 18 nt, Human
cuggccuucggccuccau

SEQ ID NO: 2002733 - RNA, 21 nt, Human
cuggccuucggccuccauccu

SEQ ID NO: 2002734 - RNA, 15 nt, Human
cuggccuucggccuc

SEQ ID NO: 2002735 - RNA, 17 nt, Human
cuggccuggccccucag

SEQ ID NO: 2002736 - RNA, 16 nt, Human
cuggccuggccccuca

SEQ ID NO: 2002737 - RNA, 16 nt, Human
cuggccugagcuggga

SEQ ID NO: 2002738 - RNA, 14 nt, Human
cuggccucugcacu

SEQ ID NO: 2002739 - RNA, 13 nt, Human
cuggccucugcac

SEQ ID NO: 2002740 - RNA, 18 nt, Human
cuggccugagcugggaug

SEQ ID NO: 2002741 - RNA, 15 nt, Human
cuggccugagcuggg

SEQ ID NO: 2002742 - RNA, 14 nt, Human
cuggccuggccccu

SEQ ID NO: 2002743 - RNA, 14 nt, Human
cuggccucccacag

SEQ ID NO: 2002744 - RNA, 20 nt, Human
cuggccucucacugccuccc

SEQ ID NO: 2002745 - RNA, 13 nt, Human
cuggccucccaca

SEQ ID NO: 2002746 - RNA, 12 nt, Human
cuggccucugca

SEQ ID NO: 2002747 - RNA, 13 nt, Human
cuggcccccacau

SEQ ID NO: 2002748 - RNA, 23 nt, Human
cuggccucaagugauucuccugc

SEQ ID NO: 2002749 - RNA, 14 nt, Human
cuggcccccacaug

SEQ ID NO: 2002750 - RNA, 15 nt, Human
cuggcccccacaugg

SEQ ID NO: 2002751 - RNA, 14 nt, Human
cuggcaagaaugug

SEQ ID NO: 2002752 - RNA, 17 nt, Human
cuggcaagaaaagaguu

SEQ ID NO: 2002753 - RNA, 23 nt, Human
cuggcaagaaaagaguuaaggca

SEQ ID NO: 2002754 - RNA, 21 nt, Human
cuggaaucauuguccagagcu

SEQ ID NO: 2002755 - RNA, 18 nt, Human
cuggaauauauaaccagu

SEQ ID NO: 2002756 - RNA, 20 nt, Human
cuggaagugcuaauuuugaa

SEQ ID NO: 2002757 - RNA, 16 nt, Human
cuggcacccggccccu

SEQ ID NO: 2002758 - RNA, 17 nt, Human
cuggcacccggccccug

SEQ ID NO: 2002759 - RNA, 18 nt, Human
cuggcacccggccccugc

SEQ ID NO: 2002760 - RNA, 15 nt, Human
cuggcacagggcagu

SEQ ID NO: 2002761 - RNA, 16 nt, Human
cuggcacagggcagug

SEQ ID NO: 2002762 - RNA, 22 nt, Human
cuggcaugggaaugaaugucag

SEQ ID NO: 2002763 - RNA, 19 nt, Human
cuggcaugggaaugaaugu

SEQ ID NO: 2002764 - RNA, 18 nt, Human
cuggcaugggaaugaaug

SEQ ID NO: 2002765 - RNA, 16 nt, Human
cuggcaugggaaugaa

SEQ ID NO: 2002766 - RNA, 16 nt, Human
cuggcacuauaaugua

SEQ ID NO: 2002767 - RNA, 15 nt, Human
cuggcacuauaaugu

SEQ ID NO: 2002768 - RNA, 22 nt, Human
cuggcacuauaauguaagcucu

SEQ ID NO: 2002769 - RNA, 19 nt, Human
cuggcacuaccaaaggaca

SEQ ID NO: 2002770 - RNA, 21 nt, Human
cuggcauggugguugggaccc

SEQ ID NO: 2002771 - RNA, 24 nt, Human
cuggcaugggaaugaaugucagug

SEQ ID NO: 2002772 - RNA, 13 nt, Human
cucucuccucccu

SEQ ID NO: 2002773 - RNA, 17 nt, Human
cucucuccccugcucca

SEQ ID NO: 2002774 - RNA, 16 nt, Human
cucucugaaccccucc

SEQ ID NO: 2002775 - RNA, 21 nt, Human
cucugccugaagucacacagu

SEQ ID NO: 2002776 - RNA, 22 nt, Human
cucugccugaagucacacagug

SEQ ID NO: 2002777 - RNA, 17 nt, Human
cucucugaaggaggcca

SEQ ID NO: 2002778 - RNA, 22 nt, Human
cucugcugugggcacaggucag

SEQ ID NO: 2002779 - RNA, 11 nt, Human
cucugcugugg

SEQ ID NO: 2002780 - RNA, 15 nt, Human
cucuggacaggcaug

SEQ ID NO: 2002781 - RNA, 12 nt, Human
cucuggccuucg

SEQ ID NO: 2002782 - RNA, 16 nt, Human
cucuggcagcucagag

SEQ ID NO: 2002783 - RNA, 15 nt, Human
cucuggcagcucaga

SEQ ID NO: 2002784 - RNA, 19 nt, Human
cucuggccuucggccucca

SEQ ID NO: 2002785 - RNA, 15 nt, Human
cucuggcuccagcug

SEQ ID NO: 2002786 - RNA, 16 nt, Human
cucuggcuccagcugg

SEQ ID NO: 2002787 - RNA, 19 nt, Human
cucuggagcccacuguacu

SEQ ID NO: 2002788 - RNA, 16 nt, Human
cucuggacaggcaugu

SEQ ID NO: 2002789 - RNA, 22 nt, Human
cucuggacaggcauguucucug

SEQ ID NO: 2002790 - RNA, 14 nt, Human
cucuggcagcucag

SEQ ID NO: 2002791 - RNA, 12 nt, Human
cucuggcagcuc

SEQ ID NO: 2002792 - RNA, 19 nt, Human
cucugugucagguggggca

SEQ ID NO: 2002793 - RNA, 22 nt, Human
cucuguuacacuuuuuggaagu

SEQ ID NO: 2002794 - RNA, 15 nt, Human
cucugugucaggugg

SEQ ID NO: 2002795 - RNA, 15 nt, Human
cucuuagaaaaacca

SEQ ID NO: 2002796 - RNA, 13 nt, Human
cucuuagaaaaac

SEQ ID NO: 2002797 - RNA, 15 nt, Human
cucuuccaggcuggg

SEQ ID NO: 2002798 - RNA, 14 nt, Human
cucuuccaggcugg

SEQ ID NO: 2002799 - RNA, 13 nt, Human
cucuuccaggcug

SEQ ID NO: 2002800 - RNA, 16 nt, Human
cucuuccaaccauuua

SEQ ID NO: 2002801 - RNA, 22 nt, Human
cucugugcccacccuccacucu

SEQ ID NO: 2002802 - RNA, 22 nt, Human
cucuggcuccagcuggccggga

SEQ ID NO: 2002803 - RNA, 15 nt, Human
cucuggcucuacaca

SEQ ID NO: 2002804 - RNA, 19 nt, Human
cugaaagcccugagcuuuc

SEQ ID NO: 2002805 - RNA, 18 nt, Human
cugaaagcccugagcuuu

SEQ ID NO: 2002806 - RNA, 17 nt, Human
cugaaagcccugagcuu

SEQ ID NO: 2002807 - RNA, 16 nt, Human
cugaaagcccugagcu

SEQ ID NO: 2002808 - RNA, 21 nt, Human
cugaaauaaacgucuuaaaua

SEQ ID NO: 2002809 - RNA, 20 nt, Human
cugaaagccuuagggaagcu

SEQ ID NO: 2002810 - RNA, 23 nt, Human
cugaaagcccugagcuuucugcu

SEQ ID NO: 2002811 - RNA, 14 nt, Human
cugaaauauaaagu

SEQ ID NO: 2002812 - RNA, 22 nt, Human
cugaaauagacccacaagaggc

SEQ ID NO: 2002813 - RNA, 19 nt, Human
cugaaaggcaguagucauu

SEQ ID NO: 2002814 - RNA, 17 nt, Human
cucuuucccuuccaguu

SEQ ID NO: 2002815 - RNA, 23 nt, Human
cucuuucccuuccaguuuauucc

SEQ ID NO: 2002816 - RNA, 13 nt, Human
cucuuucccuucc

SEQ ID NO: 2002817 - RNA, 11 nt, Human
cucuuugaaac

SEQ ID NO: 2002818 - RNA, 15 nt, Human
cugaaagcccugagc

SEQ ID NO: 2002819 - RNA, 13 nt, Human
cugaaauuuccug

SEQ ID NO: 2002820 - RNA, 20 nt, Human
cugaaauugaaaaguuauuu

SEQ ID NO: 2002821 - RNA, 21 nt, Human
cugaaauugaaaaguuauuuc

SEQ ID NO: 2002822 - RNA, 23 nt, Human
cugaaauuuccugggagcuuuug

SEQ ID NO: 2002823 - RNA, 14 nt, Human
cugaaauugaaaag

SEQ ID NO: 2002824 - RNA, 15 nt, Human
cugaaauugaaaagu

SEQ ID NO: 2002825 - RNA, 16 nt, Human
cugaaauuuccuggga

SEQ ID NO: 2002826 - RNA, 22 nt, Human
cugaacagaugaccccugccca

SEQ ID NO: 2002827 - RNA, 22 nt, Human
cugaacacugaagucaguucuc

SEQ ID NO: 2002828 - RNA, 24 nt, Human
cugaacagaugaccccugcccaga

SEQ ID NO: 2002829 - RNA, 19 nt, Human
cugaagaauugaaaaacca

SEQ ID NO: 2002830 - RNA, 16 nt, Human
cugaacucugacaaca

SEQ ID NO: 2002831 - RNA, 17 nt, Human
cugaacucugacaacag

SEQ ID NO: 2002832 - RNA, 23 nt, Human
cugaacguuugguucaaaugugu

SEQ ID NO: 2002833 - RNA, 18 nt, Human
cugaacguuugguucaaa

SEQ ID NO: 2002834 - RNA, 22 nt, Human
cucuugaaauauaggaacuuaa

SEQ ID NO: 2002835 - RNA, 21 nt, Human
cucuuggguucaagcgauucu

SEQ ID NO: 2002836 - RNA, 19 nt, Human
cucuuggguucaagcgauu

SEQ ID NO: 2002837 - RNA, 15 nt, Human
cucuugaacuccuga

SEQ ID NO: 2002838 - RNA, 14 nt, Human
cucuuccuagcugg

SEQ ID NO: 2002839 - RNA, 20 nt, Human
cucuucccugaacuuccugc

SEQ ID NO: 2002840 - RNA, 15 nt, Human
cucuuccaggcagcc

SEQ ID NO: 2002841 - RNA, 22 nt, Human
cucuucccugaacuuccugcuu

SEQ ID NO: 2002842 - RNA, 13 nt, Human
cucuuccaggcag

SEQ ID NO: 2002843 - RNA, 14 nt, Human
cucuuccaggcagc

SEQ ID NO: 2002844 - RNA, 23 nt, Human
cucuucccugaacuuccugcuuc

SEQ ID NO: 2002845 - RNA, 21 nt, Human
cucuucccugguaagaaaaag

SEQ ID NO: 2002846 - RNA, 18 nt, Human
cucuuccuccugacaccc

SEQ ID NO: 2002847 - RNA, 21 nt, Human
cucuuccuccugacaccccac

SEQ ID NO: 2002848 - RNA, 12 nt, Human
cucuucuguguu

SEQ ID NO: 2002849 - RNA, 11 nt, Human
cucuuccucca

SEQ ID NO: 2002850 - RNA, 19 nt, Human
cucuuccuccaaggacaga

SEQ ID NO: 2002851 - RNA, 14 nt, Human
cucuuccuccugac

SEQ ID NO: 2002852 - RNA, 16 nt, Human
cucuuccuccugacac

SEQ ID NO: 2002853 - RNA, 14 nt, Human
cucuucuucucaag

SEQ ID NO: 2002854 - RNA, 13 nt, Human
cucuucuguguuu

SEQ ID NO: 2002855 - RNA, 13 nt, Human
cucuucuuagccu

SEQ ID NO: 2002856 - RNA, 17 nt, Human
cucuugguccugcugca

SEQ ID NO: 2002857 - RNA, 16 nt, Human
cucuugguccugcugc

SEQ ID NO: 2002858 - RNA, 15 nt, Human
cucuugguccugcug

SEQ ID NO: 2002859 - RNA, 13 nt, Human
cucuugguccugc

SEQ ID NO: 2002860 - RNA, 18 nt, Human
cucuuuaaugucacaggc

SEQ ID NO: 2002861 - RNA, 17 nt, Human
cucuuuaacuuguaaua

SEQ ID NO: 2002862 - RNA, 19 nt, Human
cucuuuaacuuguaauaaa

SEQ ID NO: 2002863 - RNA, 16 nt, Human
cucuuguucuuacuuu

SEQ ID NO: 2002864 - RNA, 19 nt, Human
cucuuguucuuacuuuccu

SEQ ID NO: 2002865 - RNA, 20 nt, Human
cucuuguucuuacuuuccug

SEQ ID NO: 2002866 - RNA, 13 nt, Human
cucuuguuucucc

SEQ ID NO: 2002867 - RNA, 20 nt, Human
cucuuuaaugucacaggcag

SEQ ID NO: 2002868 - RNA, 21 nt, Human
cucuuuaaugucacaggcagg

SEQ ID NO: 2002869 - RNA, 22 nt, Human
cucuuuaaugucacaggcaggu

SEQ ID NO: 2002870 - RNA, 23 nt, Human
cucuuuaaugucacaggcagguc

SEQ ID NO: 2002871 - RNA, 17 nt, Human
cucuuucccucccuucc

SEQ ID NO: 2002872 - RNA, 13 nt, Human
cucuuucccuccc

SEQ ID NO: 2002873 - RNA, 20 nt, Human
cugaggcccuucucuccagc

SEQ ID NO: 2002874 - RNA, 19 nt, Human
cugaggcccuucucuccag

SEQ ID NO: 2002875 - RNA, 18 nt, Human
cugaggcccuucucucca

SEQ ID NO: 2002876 - RNA, 15 nt, Human
cugaggcccuucucu

SEQ ID NO: 2002877 - RNA, 14 nt, Human
cugaggcccuucuc

SEQ ID NO: 2002878 - RNA, 23 nt, Human
cugaggcccagagggccugcaag

SEQ ID NO: 2002879 - RNA, 21 nt, Human
cugaggcccagagggccugca

SEQ ID NO: 2002880 - RNA, 19 nt, Human
cugaggcccagagggccug

SEQ ID NO: 2002881 - RNA, 18 nt, Human
cugaggcccagagggccu

SEQ ID NO: 2002882 - RNA, 17 nt, Human
cugaggcccagagggcc

SEQ ID NO: 2002883 - RNA, 16 nt, Human
cugaggcccagagggc

SEQ ID NO: 2002884 - RNA, 15 nt, Human
cugaggcccagaggg

SEQ ID NO: 2002885 - RNA, 14 nt, Human
cugaggcccagagg

SEQ ID NO: 2002886 - RNA, 13 nt, Human
cugaggcccagag

SEQ ID NO: 2002887 - RNA, 12 nt, Human
cugaggcccaga

SEQ ID NO: 2002888 - RNA, 14 nt, Human
cugaggcagguccc

SEQ ID NO: 2002889 - RNA, 17 nt, Human
cugaggcagguccccag

SEQ ID NO: 2002890 - RNA, 18 nt, Human
cugaggcagguccccaga

SEQ ID NO: 2002891 - RNA, 19 nt, Human
cugaggcagguccccagac

SEQ ID NO: 2002892 - RNA, 17 nt, Human
cugaggcaguuugagga

SEQ ID NO: 2002893 - RNA, 17 nt, Human
cugaggaucagaguaau

SEQ ID NO: 2002894 - RNA, 19 nt, Human
cugaggaucagaguaaucc

SEQ ID NO: 2002895 - RNA, 21 nt, Human
cugaggauauggacacuggug

SEQ ID NO: 2002896 - RNA, 21 nt, Human
cugagccagauuucacucucc

SEQ ID NO: 2002897 - RNA, 20 nt, Human
cugagccagauuucacucuc

SEQ ID NO: 2002898 - RNA, 19 nt, Human
cugagccagauuucacucu

SEQ ID NO: 2002899 - RNA, 18 nt, Human
cugagccagauuucacuc

SEQ ID NO: 2002900 - RNA, 17 nt, Human
cugagccagauuucacu

SEQ ID NO: 2002901 - RNA, 18 nt, Human
cugagacagcccgggcuc

SEQ ID NO: 2002902 - RNA, 17 nt, Human
cugagacagcccgggcu

SEQ ID NO: 2002903 - RNA, 16 nt, Human
cugagacagcccgggc

SEQ ID NO: 2002904 - RNA, 15 nt, Human
cugagccagauuuca

SEQ ID NO: 2002905 - RNA, 16 nt, Human
cugagccucagucucc

SEQ ID NO: 2002906 - RNA, 21 nt, Human
cugagccucagucucccuccc

SEQ ID NO: 2002907 - RNA, 16 nt, Human
cugagccgcagagaag

SEQ ID NO: 2002908 - RNA, 14 nt, Human
cugagccgcagaga

SEQ ID NO: 2002909 - RNA, 15 nt, Human
cugagccgcagagaa

SEQ ID NO: 2002910 - RNA, 22 nt, Human
cugagccucagucucccucccu

SEQ ID NO: 2002911 - RNA, 16 nt, Human
cugagcgacagugaga

SEQ ID NO: 2002912 - RNA, 20 nt, Human
cugagcgacagugagacucu

SEQ ID NO: 2002913 - RNA, 13 nt, Human
cugagccuucuga

SEQ ID NO: 2002914 - RNA, 14 nt, Human
cugagccuucugag

SEQ ID NO: 2002915 - RNA, 15 nt, Human
cugagccuucugagc

SEQ ID NO: 2002916 - RNA, 17 nt, Human
cugagccuucugagcug

SEQ ID NO: 2002917 - RNA, 15 nt, Human
cugacccaugcugcc

SEQ ID NO: 2002918 - RNA, 14 nt, Human
cugacccaugcugc

SEQ ID NO: 2002919 - RNA, 16 nt, Human
cugacccaugcugccc

SEQ ID NO: 2002920 - RNA, 13 nt, Human
cugacccaugcug

SEQ ID NO: 2002921 - RNA, 13 nt, Human
cugacccacugcu

SEQ ID NO: 2002922 - RNA, 14 nt, Human
cugacccacugcuu

SEQ ID NO: 2002923 - RNA, 12 nt, Human
cugacccacugc

SEQ ID NO: 2002924 - RNA, 22 nt, Human
cugacauuguuggccaaagcca

SEQ ID NO: 2002925 - RNA, 16 nt, Human
cugacagccagaacuc

SEQ ID NO: 2002926 - RNA, 14 nt, Human
cugacagccagaac

SEQ ID NO: 2002927 - RNA, 15 nt, Human
cugacagccagaacu

SEQ ID NO: 2002928 - RNA, 22 nt, Human
cugaagauuguuuaucuagaug

SEQ ID NO: 2002929 - RNA, 18 nt, Human
cugaagaguccucugaau

SEQ ID NO: 2002930 - RNA, 16 nt, Human
cugaagaguccucuga

SEQ ID NO: 2002931 - RNA, 15 nt, Human
cugaagaguccucug

SEQ ID NO: 2002932 - RNA, 14 nt, Human
cugaagaguccucu

SEQ ID NO: 2002933 - RNA, 19 nt, Human
cugaagacucauucuucug

SEQ ID NO: 2002934 - RNA, 14 nt, Human
cugaagauuguuua

SEQ ID NO: 2002935 - RNA, 15 nt, Human
cugaagauuguuuau

SEQ ID NO: 2002936 - RNA, 16 nt, Human
cugaagauuguuuauc

SEQ ID NO: 2002937 - RNA, 21 nt, Human
cugacauuguuggccaaagcc

SEQ ID NO: 2002938 - RNA, 21 nt, Human
cugacaggcaaugcuggcugu

SEQ ID NO: 2002939 - RNA, 18 nt, Human
cugacuguuuucucuuga

SEQ ID NO: 2002940 - RNA, 12 nt, Human
cugacuuagaau

SEQ ID NO: 2002941 - RNA, 22 nt, Human
cugacuuagaaucccuguguua

SEQ ID NO: 2002942 - RNA, 16 nt, Human
cugacuguuuucucuu

SEQ ID NO: 2002943 - RNA, 14 nt, Human
cugacucuucccca

SEQ ID NO: 2002944 - RNA, 17 nt, Human
cugagaaugaacaaaga

SEQ ID NO: 2002945 - RNA, 18 nt, Human
cugagaaugaacaaagac

SEQ ID NO: 2002946 - RNA, 15 nt, Human
cugagacagcccggg

SEQ ID NO: 2002947 - RNA, 14 nt, Human
cugagacagcccgg

SEQ ID NO: 2002948 - RNA, 14 nt, Human
cugagaaauuuaua

SEQ ID NO: 2002949 - RNA, 11 nt, Human
cugagaaauuu

SEQ ID NO: 2002950 - RNA, 13 nt, Human
cuccccugcuggg

SEQ ID NO: 2002951 - RNA, 17 nt, Human
cucccgaauagcuggga

SEQ ID NO: 2002952 - RNA, 16 nt, Human
cucccgaauagcuggg

SEQ ID NO: 2002953 - RNA, 15 nt, Human
cucccgaguagcugg

SEQ ID NO: 2002954 - RNA, 18 nt, Human
cucccgaauagcugggac

SEQ ID NO: 2002955 - RNA, 16 nt, Human
cucccgaguagcuggg

SEQ ID NO: 2002956 - RNA, 17 nt, Human
cucccgaguagcuggga

SEQ ID NO: 2002957 - RNA, 19 nt, Human
cucccgaauagcugggacu

SEQ ID NO: 2002958 - RNA, 18 nt, Human
cucccgaguagcugggac

SEQ ID NO: 2002959 - RNA, 15 nt, Human
cucccgcuccgggcu

SEQ ID NO: 2002960 - RNA, 17 nt, Human
cucccgcuccgggcucc

SEQ ID NO: 2002961 - RNA, 15 nt, Human
cucccggcccugccu

SEQ ID NO: 2002962 - RNA, 16 nt, Human
cucccggcccugccug

SEQ ID NO: 2002963 - RNA, 17 nt, Human
cucccggcccugccugc

SEQ ID NO: 2002964 - RNA, 18 nt, Human
cucccggcccugccugcu

SEQ ID NO: 2002965 - RNA, 20 nt, Human
cucccggcuaugggggcacu

SEQ ID NO: 2002966 - RNA, 15 nt, Human
cucccgggacucugc

SEQ ID NO: 2002967 - RNA, 16 nt, Human
cucccuacuuucuuag

SEQ ID NO: 2002968 - RNA, 20 nt, Human
cuccccagcaagugagagcu

SEQ ID NO: 2002969 - RNA, 12 nt, Human
cuccccugcugg

SEQ ID NO: 2002970 - RNA, 12 nt, Human
cuccccagcaag

SEQ ID NO: 2002971 - RNA, 23 nt, Human
cuccccaaggcccccugccugcc

SEQ ID NO: 2002972 - RNA, 17 nt, Human
cuccccaaggcccccug

SEQ ID NO: 2002973 - RNA, 21 nt, Human
cuccccaaggcccccugccug

SEQ ID NO: 2002974 - RNA, 22 nt, Human
cuccccaaggcccccugccugc

SEQ ID NO: 2002975 - RNA, 20 nt, Human
cucccaucuuuuguuacucu

SEQ ID NO: 2002976 - RNA, 17 nt, Human
cucccaaagugcuggga

SEQ ID NO: 2002977 - RNA, 13 nt, Human
cuccaugugggcu

SEQ ID NO: 2002978 - RNA, 13 nt, Human
cuccaugucucug

SEQ ID NO: 2002979 - RNA, 22 nt, Human
cuccaugucucugagcauuaga

SEQ ID NO: 2002980 - RNA, 16 nt, Human
cuccaucuccacucca

SEQ ID NO: 2002981 - RNA, 17 nt, Human
cuccauccuccuccuuc

SEQ ID NO: 2002982 - RNA, 19 nt, Human
cuccauccuccuccuuccu

SEQ ID NO: 2002983 - RNA, 11 nt, Human
cuccauccuga

SEQ ID NO: 2002984 - RNA, 16 nt, Human
cuccauccugaggcuc

SEQ ID NO: 2002985 - RNA, 18 nt, Human
cuccauccugaggcucca

SEQ ID NO: 2002986 - RNA, 14 nt, Human
cuccaucuccacuc

SEQ ID NO: 2002987 - RNA, 18 nt, Human
cucacuauguugcccagg

SEQ ID NO: 2002988 - RNA, 16 nt, Human
cuccauccuccuccuu

SEQ ID NO: 2002989 - RNA, 22 nt, Human
cucccaacucaccccagcccca

SEQ ID NO: 2002990 - RNA, 16 nt, Human
cucccaacucacccca

SEQ ID NO: 2002991 - RNA, 17 nt, Human
cucccaacucaccccag

SEQ ID NO: 2002992 - RNA, 22 nt, Human
cucccaaagugcugggauuaca

SEQ ID NO: 2002993 - RNA, 18 nt, Human
cucccaaagugcugggau

SEQ ID NO: 2002994 - RNA, 23 nt, Human
cucccaucugugaaaggaaagag

SEQ ID NO: 2002995 - RNA, 18 nt, Human
cucccaucugugaaagga

SEQ ID NO: 2002996 - RNA, 15 nt, Human
cucccaucugugaaa

SEQ ID NO: 2002997 - RNA, 14 nt, Human
cucccaucugugaa

SEQ ID NO: 2002998 - RNA, 11 nt, Human
cucccaucugu

SEQ ID NO: 2002999 - RNA, 21 nt, Human
cucccaucucacacaugagca

SEQ ID NO: 2003000 - RNA, 15 nt, Human
cuccugccucagccu

SEQ ID NO: 2003001 - RNA, 19 nt, Human
cuccugcguguucucagag

SEQ ID NO: 2003002 - RNA, 16 nt, Human
cuccugugugugcgcc

SEQ ID NO: 2003003 - RNA, 19 nt, Human
cuccugugugugcgccuac

SEQ ID NO: 2003004 - RNA, 15 nt, Human
cuccuguggccugcc

SEQ ID NO: 2003005 - RNA, 17 nt, Human
cuccuguggccugccag

SEQ ID NO: 2003006 - RNA, 18 nt, Human
cuccuguggccugccagu

SEQ ID NO: 2003007 - RNA, 20 nt, Human
cuccuguggccugccaguca

SEQ ID NO: 2003008 - RNA, 18 nt, Human
cuccugucuucugcuuug

SEQ ID NO: 2003009 - RNA, 13 nt, Human
cuccugucuucug

SEQ ID NO: 2003010 - RNA, 14 nt, Human
cuccugucuucugc

SEQ ID NO: 2003011 - RNA, 16 nt, Human
cuccugucuucugcuu

SEQ ID NO: 2003012 - RNA, 17 nt, Human
cuccugucuucugcuuu

SEQ ID NO: 2003013 - RNA, 22 nt, Human
cuccugaguugaagucaugcuc

SEQ ID NO: 2003014 - RNA, 14 nt, Human
cuccugauuuuucu

SEQ ID NO: 2003015 - RNA, 17 nt, Human
cuccugcaggcagccag

SEQ ID NO: 2003016 - RNA, 16 nt, Human
cuccugcaggcagcca

SEQ ID NO: 2003017 - RNA, 11 nt, Human
cuccugcaggc

SEQ ID NO: 2003018 - RNA, 20 nt, Human
cuccugcaggcagccaggcc

SEQ ID NO: 2003019 - RNA, 18 nt, Human
cuccugcaggcagccagg

SEQ ID NO: 2003020 - RNA, 11 nt, Human
cuccugcccuu

SEQ ID NO: 2003021 - RNA, 13 nt, Human
cuccugccucagc

SEQ ID NO: 2003022 - RNA, 14 nt, Human
cuccugccucagcc

SEQ ID NO: 2003023 - RNA, 15 nt, Human
cuccgaccagacacc

SEQ ID NO: 2003024 - RNA, 15 nt, Human
cuccgaaaugcuguc

SEQ ID NO: 2003025 - RNA, 16 nt, Human
cuccgaaaugcugucu

SEQ ID NO: 2003026 - RNA, 17 nt, Human
cuccgaaaugcugucuu

SEQ ID NO: 2003027 - RNA, 18 nt, Human
cuccgaaaugcugucuuu

SEQ ID NO: 2003028 - RNA, 13 nt, Human
cucccucauucca

SEQ ID NO: 2003029 - RNA, 17 nt, Human
cuccgccccugagccca

SEQ ID NO: 2003030 - RNA, 18 nt, Human
cuccgccccugagcccac

SEQ ID NO: 2003031 - RNA, 19 nt, Human
cuccgccccugagcccacu

SEQ ID NO: 2003032 - RNA, 20 nt, Human
cuccgccccugagcccacug

SEQ ID NO: 2003033 - RNA, 14 nt, Human
cuccgccccugagc

SEQ ID NO: 2003034 - RNA, 15 nt, Human
cuccgccccugagcc

SEQ ID NO: 2003035 - RNA, 16 nt, Human
cuccgccccugagccc

SEQ ID NO: 2003036 - RNA, 22 nt, Human
cuccuccagccgccaugcuccu

SEQ ID NO: 2003037 - RNA, 22 nt, Human
cuccucuccccagcaagugaga

SEQ ID NO: 2003038 - RNA, 14 nt, Human
cuccucccggugcc

SEQ ID NO: 2003039 - RNA, 15 nt, Human
cuccucccggugccc

SEQ ID NO: 2003040 - RNA, 17 nt, Human
cuccucccggugcccaa

SEQ ID NO: 2003041 - RNA, 14 nt, Human
cuccucccucccag

SEQ ID NO: 2003042 - RNA, 13 nt, Human
cuccuccuuccua

SEQ ID NO: 2003043 - RNA, 14 nt, Human
cuccuccuuccuag

SEQ ID NO: 2003044 - RNA, 15 nt, Human
cuccuccuuccuagu

SEQ ID NO: 2003045 - RNA, 13 nt, Human
cucuacaaaaagc

SEQ ID NO: 2003046 - RNA, 18 nt, Human
cucuaagauguuauauuu

SEQ ID NO: 2003047 - RNA, 19 nt, Human
cucuaagauguuauauuuu

SEQ ID NO: 2003048 - RNA, 23 nt, Human
cucuaagauguuauauuuuucuu

SEQ ID NO: 2003049 - RNA, 12 nt, Human
cucuaagauguu

SEQ ID NO: 2003050 - RNA, 15 nt, Human
cucuaagauguuaua

SEQ ID NO: 2003051 - RNA, 17 nt, Human
cucuaagauguuauauu

SEQ ID NO: 2003052 - RNA, 14 nt, Human
cucggaucagcuga

SEQ ID NO: 2003053 - RNA, 13 nt, Human
cucuacagaggcc

SEQ ID NO: 2003054 - RNA, 11 nt, Human
cucuaauuucc

SEQ ID NO: 2003055 - RNA, 19 nt, Human
cucuacagaggccaugggc

SEQ ID NO: 2003056 - RNA, 21 nt, Human
cucuacagcuaaucagcauuc

SEQ ID NO: 2003057 - RNA, 14 nt, Human
cucuacagaggcca

SEQ ID NO: 2003058 - RNA, 16 nt, Human
cucuacagaggccaug

SEQ ID NO: 2003059 - RNA, 11 nt, Human
cucgcuucuuu

SEQ ID NO: 2003060 - RNA, 14 nt, Human
cucggcucacugca

SEQ ID NO: 2003061 - RNA, 15 nt, Human
cucggaguucuucuu

SEQ ID NO: 2003062 - RNA, 17 nt, Human
cucggcucacugcaucc

SEQ ID NO: 2003063 - RNA, 18 nt, Human
cucggcucacugcauccu

SEQ ID NO: 2003064 - RNA, 16 nt, Human
cucggaguucuucuug

SEQ ID NO: 2003065 - RNA, 19 nt, Human
cuccuucacagaugggugc

SEQ ID NO: 2003066 - RNA, 13 nt, Human
cuccuucaccuuu

SEQ ID NO: 2003067 - RNA, 17 nt, Human
cuccuucacagaugggu

SEQ ID NO: 2003068 - RNA, 16 nt, Human
cuccuucacagauggg

SEQ ID NO: 2003069 - RNA, 20 nt, Human
cuccugugugugcgccuaca

SEQ ID NO: 2003070 - RNA, 23 nt, Human
cuccuucaacaaggcuugcugca

SEQ ID NO: 2003071 - RNA, 14 nt, Human
cucuagcccugccc

SEQ ID NO: 2003072 - RNA, 16 nt, Human
cucuagcccugcccgg

SEQ ID NO: 2003073 - RNA, 13 nt, Human
cucuagcugaauu

SEQ ID NO: 2003074 - RNA, 15 nt, Human
cucuagcugaauuga

SEQ ID NO: 2003075 - RNA, 11 nt, Human
cucuagcugaa

SEQ ID NO: 2003076 - RNA, 12 nt, Human
cucuagcugaau

SEQ ID NO: 2003077 - RNA, 21 nt, Human
cucuagaguagagguauaauu

SEQ ID NO: 2003078 - RNA, 23 nt, Human
cucuagaguagagguauaauugu

SEQ ID NO: 2003079 - RNA, 18 nt, Human
cucuagagaaguggacug

SEQ ID NO: 2003080 - RNA, 23 nt, Human
cucuagagaaguggacuggagga

SEQ ID NO: 2003081 - RNA, 22 nt, Human
cucuagaaaggggauuacaguu

SEQ ID NO: 2003082 - RNA, 15 nt, Human
cucuagaauuuuaag

SEQ ID NO: 2003083 - RNA, 20 nt, Human
cucuagaauuuuaagccuuu

SEQ ID NO: 2003084 - RNA, 23 nt, Human
cucuagggaaaaaccagcgugug

SEQ ID NO: 2003085 - RNA, 18 nt, Human
cucuagggaccagaacca

SEQ ID NO: 2003086 - RNA, 14 nt, Human
cucuaguacuguga

SEQ ID NO: 2003087 - RNA, 16 nt, Human
cucuaguacugugaau

SEQ ID NO: 2003088 - RNA, 12 nt, Human
cucuagggucca

SEQ ID NO: 2003089 - RNA, 18 nt, Human
cucuacugggagccuacc

SEQ ID NO: 2003090 - RNA, 21 nt, Human
cucuacugggagccuacccac

SEQ ID NO: 2003091 - RNA, 16 nt, Human
cucuacuuagcauguc

SEQ ID NO: 2003092 - RNA, 17 nt, Human
cucuacuuagcaugucc

SEQ ID NO: 2003093 - RNA, 19 nt, Human
cucuacuuagcaugucccu

SEQ ID NO: 2003094 - RNA, 20 nt, Human
cucuacuuagcaugucccua

SEQ ID NO: 2003095 - RNA, 20 nt, Human
cucuaccauccccuguagag

SEQ ID NO: 2003096 - RNA, 13 nt, Human
cucuacccuggca

SEQ ID NO: 2003097 - RNA, 18 nt, Human
cucuccagccccuggaug

SEQ ID NO: 2003098 - RNA, 17 nt, Human
cucuccagccccuggau

SEQ ID NO: 2003099 - RNA, 16 nt, Human
cucuccagccccugga

SEQ ID NO: 2003100 - RNA, 15 nt, Human
cucuccagccccugg

SEQ ID NO: 2003101 - RNA, 14 nt, Human
cucuccagccccug

SEQ ID NO: 2003102 - RNA, 12 nt, Human
cucuccacugcc

SEQ ID NO: 2003103 - RNA, 14 nt, Human
cucuccacugccuu

SEQ ID NO: 2003104 - RNA, 11 nt, Human
cucuccacugc

SEQ ID NO: 2003105 - RNA, 14 nt, Human
cucucauuugugug

SEQ ID NO: 2003106 - RNA, 16 nt, Human
cucucaugcugccccu

SEQ ID NO: 2003107 - RNA, 19 nt, Human
cucucaugcugccccugcc

SEQ ID NO: 2003108 - RNA, 21 nt, Human
cucucaugcugccccugccuu

SEQ ID NO: 2003109 - RNA, 22 nt, Human
cucucaugcugccccugccuug

SEQ ID NO: 2003110 - RNA, 21 nt, Human
cucucaggccagcugcuuggg

SEQ ID NO: 2003111 - RNA, 19 nt, Human
cucucaggccagcugcuug

SEQ ID NO: 2003112 - RNA, 18 nt, Human
cucucaggccagcugcuu

SEQ ID NO: 2003113 - RNA, 17 nt, Human
cucucaggccagcugcu

SEQ ID NO: 2003114 - RNA, 15 nt, Human
cucucaggccagcug

SEQ ID NO: 2003115 - RNA, 13 nt, Human
cucucaggccagc

SEQ ID NO: 2003116 - RNA, 23 nt, Human
cucucaggccaaacucaccugcc

SEQ ID NO: 2003117 - RNA, 22 nt, Human
cucucaggccaaacucaccugc

SEQ ID NO: 2003118 - RNA, 21 nt, Human
cucucaggccaaacucaccug

SEQ ID NO: 2003119 - RNA, 20 nt, Human
cucucaggccaaacucaccu

SEQ ID NO: 2003120 - RNA, 12 nt, Human
cucucaggccaa

SEQ ID NO: 2003121 - RNA, 12 nt, Human
cucuagugcugu

SEQ ID NO: 2003122 - RNA, 13 nt, Human
cucuagugcugug

SEQ ID NO: 2003123 - RNA, 14 nt, Human
cucuagugcuguga

SEQ ID NO: 2003124 - RNA, 15 nt, Human
cucuagugcugugaa

SEQ ID NO: 2003125 - RNA, 16 nt, Human
cucuagugcugugaaa

SEQ ID NO: 2003126 - RNA, 17 nt, Human
cucuagugcugugaaaa

SEQ ID NO: 2003127 - RNA, 15 nt, Human
cucuaguuugauuaa

SEQ ID NO: 2003128 - RNA, 18 nt, Human
cucuagugcugugaaaaa

SEQ ID NO: 2003129 - RNA, 19 nt, Human
cucuagugcugugaaaaaa

SEQ ID NO: 2003130 - RNA, 20 nt, Human
cucuagugcugugaaaaaaa

SEQ ID NO: 2003131 - RNA, 19 nt, Human
cucuaguuugauuaaauuc

SEQ ID NO: 2003132 - RNA, 20 nt, Human
cucuaguuugauuaaauucu

SEQ ID NO: 2003133 - RNA, 21 nt, Human
cucuaguuugauuaaauucuu

SEQ ID NO: 2003134 - RNA, 14 nt, Human
cucuccuuccugug

SEQ ID NO: 2003135 - RNA, 14 nt, Human
cucucuacuggucc

SEQ ID NO: 2003136 - RNA, 12 nt, Human
cucucucacucc

SEQ ID NO: 2003137 - RNA, 21 nt, Human
cucucuauuucccccuuucuu

SEQ ID NO: 2003138 - RNA, 22 nt, Human
cucucuauuucccccuuucuuc

SEQ ID NO: 2003139 - RNA, 21 nt, Human
cucucucaauuuuugguugaa

SEQ ID NO: 2003140 - RNA, 13 nt, Human
cucucucaggcca

SEQ ID NO: 2003141 - RNA, 18 nt, Human
cucuccucugcugcuggc

SEQ ID NO: 2003142 - RNA, 15 nt, Human
cucuccucugcugcu

SEQ ID NO: 2003143 - RNA, 14 nt, Human
cucuccucugcugc

SEQ ID NO: 2003144 - RNA, 13 nt, Human
cucuccucugcug

SEQ ID NO: 2003145 - RNA, 14 nt, Human
cucuccucuugcca

SEQ ID NO: 2003146 - RNA, 15 nt, Human
cucuccucuugccac

SEQ ID NO: 2003147 - RNA, 16 nt, Human
cucuccucuugccacu

SEQ ID NO: 2003148 - RNA, 17 nt, Human
cucuccucuugccacug

SEQ ID NO: 2003149 - RNA, 19 nt, Human
cucuccucuugccacugcc

SEQ ID NO: 2003150 - RNA, 22 nt, Human
cucuccucuugccacugccucu

SEQ ID NO: 2003151 - RNA, 14 nt, Human
cucuccccagcaag

SEQ ID NO: 2003152 - RNA, 22 nt, Human
cucuccccagcaagugagagcu

SEQ ID NO: 2003153 - RNA, 12 nt, Human
cucuccucugcu

SEQ ID NO: 2003154 - RNA, 24 nt, Human
cucuccccagcaagugagagcugg

SEQ ID NO: 2003155 - RNA, 19 nt, Human
cucuccagccccuggaugc

SEQ ID NO: 2003156 - RNA, 15 nt, Human
cucuccacugccuuc

SEQ ID NO: 2003157 - RNA, 13 nt, Human
cggaagagccuug

SEQ ID NO: 2003158 - RNA, 14 nt, Human
cggaauaguuggcu

SEQ ID NO: 2003159 - RNA, 17 nt, Human
cggccaccugcggugcu

SEQ ID NO: 2003160 - RNA, 16 nt, Human
cggccaccugcggugc

SEQ ID NO: 2003161 - RNA, 15 nt, Human
cggccaccugcggug

SEQ ID NO: 2003162 - RNA, 11 nt, Human
cggccaccugc

SEQ ID NO: 2003163 - RNA, 13 nt, Human
cggcauuuguuuc

SEQ ID NO: 2003164 - RNA, 13 nt, Human
cggccccugcugg

SEQ ID NO: 2003165 - RNA, 18 nt, Human
cggccccugcugguucag

SEQ ID NO: 2003166 - RNA, 19 nt, Human
cggccccugcugguucagg

SEQ ID NO: 2003167 - RNA, 24 nt, Human
cggccaggccagagggagugacag

SEQ ID NO: 2003168 - RNA, 15 nt, Human
cggcuggacuuggag

SEQ ID NO: 2003169 - RNA, 11 nt, Human
cggcugcccuu

SEQ ID NO: 2003170 - RNA, 12 nt, Human
cggcugcccuuu

SEQ ID NO: 2003171 - RNA, 12 nt, Human
cggccucagagu

SEQ ID NO: 2003172 - RNA, 12 nt, Human
cggccuccaucc

SEQ ID NO: 2003173 - RNA, 14 nt, Human
cggccuccauccug

SEQ ID NO: 2003174 - RNA, 23 nt, Human
cggggacagcuccuucuguccua

SEQ ID NO: 2003175 - RNA, 15 nt, Human
cgggggcagagaggg

SEQ ID NO: 2003176 - RNA, 23 nt, Human
cgggggcaggggaggccaucugg

SEQ ID NO: 2003177 - RNA, 11 nt, Human
cgggacucugc

SEQ ID NO: 2003178 - RNA, 19 nt, Human
cgggacguggcaccuccuc

SEQ ID NO: 2003179 - RNA, 19 nt, Human
cggcuggccuggccccuca

SEQ ID NO: 2003180 - RNA, 22 nt, Human
cggcuggccuggccccucaggg

SEQ ID NO: 2003181 - RNA, 23 nt, Human
cggcuggccuggccccucagggu

SEQ ID NO: 2003182 - RNA, 20 nt, Human
cgggaggucgaggcaggagg

SEQ ID NO: 2003183 - RNA, 18 nt, Human
cgggaggucgaggcagga

SEQ ID NO: 2003184 - RNA, 17 nt, Human
cgggauuaguacacacu

SEQ ID NO: 2003185 - RNA, 22 nt, Human
cgggaugggagccgggcaaacu

SEQ ID NO: 2003186 - RNA, 15 nt, Human
cgggcacaccuccuc

SEQ ID NO: 2003187 - RNA, 22 nt, Human
cggggacagcuccuucuguccu

SEQ ID NO: 2003188 - RNA, 12 nt, Human
cgggcagagcac

SEQ ID NO: 2003189 - RNA, 14 nt, Human
cgggcacucagaag

SEQ ID NO: 2003190 - RNA, 22 nt, Human
cgggcacucagaagacacugau

SEQ ID NO: 2003191 - RNA, 20 nt, Human
cggugagaggggaacagacu

SEQ ID NO: 2003192 - RNA, 21 nt, Human
cggugagaggggaacagacug

SEQ ID NO: 2003193 - RNA, 17 nt, Human
cggugagcuacaaaugc

SEQ ID NO: 2003194 - RNA, 19 nt, Human
cggugaccucuagcccugc

SEQ ID NO: 2003195 - RNA, 20 nt, Human
cgguccccacuuuauugcca

SEQ ID NO: 2003196 - RNA, 23 nt, Human
cggucgggggggacccuccaagg

SEQ ID NO: 2003197 - RNA, 22 nt, Human
cggucucggaucaggcucccag

SEQ ID NO: 2003198 - RNA, 23 nt, Human
cggucucggaucaggcucccagg

SEQ ID NO: 2003199 - RNA, 22 nt, Human
cgggugcagacaaucuucuguu

SEQ ID NO: 2003200 - RNA, 14 nt, Human
cgggugcagcaucu

SEQ ID NO: 2003201 - RNA, 17 nt, Human
cggguuauaaugaauga

SEQ ID NO: 2003202 - RNA, 22 nt, Human
cgggucaucuguaccucugccu

SEQ ID NO: 2003203 - RNA, 16 nt, Human
cgggucuuccuacucu

SEQ ID NO: 2003204 - RNA, 12 nt, Human
cgggucuuccua

SEQ ID NO: 2003205 - RNA, 15 nt, Human
cgggucaucuguacc

SEQ ID NO: 2003206 - RNA, 19 nt, Human
cgggucacaggagggaggg

SEQ ID NO: 2003207 - RNA, 11 nt, Human
cgggucacagg

SEQ ID NO: 2003208 - RNA, 14 nt, Human
cgguccacccagga

SEQ ID NO: 2003209 - RNA, 15 nt, Human
cgguccacccaggag

SEQ ID NO: 2003210 - RNA, 16 nt, Human
cgguccacccaggagc

SEQ ID NO: 2003211 - RNA, 20 nt, Human
cgguccacccaggagccccg

SEQ ID NO: 2003212 - RNA, 14 nt, Human
cgguaccaaugcag

SEQ ID NO: 2003213 - RNA, 19 nt, Human
cgguaccaaugcagaacuc

SEQ ID NO: 2003214 - RNA, 13 nt, Human
cgguacccaccac

SEQ ID NO: 2003215 - RNA, 18 nt, Human
cgcucucuggccuucggc

SEQ ID NO: 2003216 - RNA, 22 nt, Human
cgcugucagccauuccuguucc

SEQ ID NO: 2003217 - RNA, 17 nt, Human
cgcugugcugcccugcc

SEQ ID NO: 2003218 - RNA, 16 nt, Human
cgcugugcugcccugc

SEQ ID NO: 2003219 - RNA, 15 nt, Human
cgcugugcugcccug

SEQ ID NO: 2003220 - RNA, 18 nt, Human
cgcugugcugcccugccc

SEQ ID NO: 2003221 - RNA, 15 nt, Human
cggaaaacaugcuac

SEQ ID NO: 2003222 - RNA, 20 nt, Human
cggaaaacaugcuacacacu

SEQ ID NO: 2003223 - RNA, 14 nt, Human
cgcucucuggccuu

SEQ ID NO: 2003224 - RNA, 15 nt, Human
cgcucucuggccuuc

SEQ ID NO: 2003225 - RNA, 16 nt, Human
cgcucauucagcaucu

SEQ ID NO: 2003226 - RNA, 18 nt, Human
cgcucauucagcaucuga

SEQ ID NO: 2003227 - RNA, 14 nt, Human
cgcuccaacuccaa

SEQ ID NO: 2003228 - RNA, 15 nt, Human
cgcuccaacuccaac

SEQ ID NO: 2003229 - RNA, 16 nt, Human
cgcuacccgggaaggg

SEQ ID NO: 2003230 - RNA, 22 nt, Human
cgcuacauuuccgccacauccc

SEQ ID NO: 2003231 - RNA, 16 nt, Human
cgcucagcccucccug

SEQ ID NO: 2003232 - RNA, 21 nt, Human
cgcucagcccucccugccccu

SEQ ID NO: 2003233 - RNA, 12 nt, Human
cgcucagcccuc

SEQ ID NO: 2003234 - RNA, 22 nt, Human
cgcuaagagggagggagggcuc

SEQ ID NO: 2003235 - RNA, 20 nt, Human
cgcgccccgaaaggucaccu

SEQ ID NO: 2003236 - RNA, 17 nt, Human
cgcggacauccccugcu

SEQ ID NO: 2003237 - RNA, 20 nt, Human
ccucugcccacucccugcaa

SEQ ID NO: 2003238 - RNA, 19 nt, Human
ccucugcccacucccugca

SEQ ID NO: 2003239 - RNA, 17 nt, Human
ccucugcccacucccug

SEQ ID NO: 2003240 - RNA, 22 nt, Human
cgccagauucuuuccugaggcu

SEQ ID NO: 2003241 - RNA, 16 nt, Human
cgccaucccagcccca

SEQ ID NO: 2003242 - RNA, 14 nt, Human
cgccaucccagccc

SEQ ID NO: 2003243 - RNA, 16 nt, Human
cgccaggacuuggccu

SEQ ID NO: 2003244 - RNA, 23 nt, Human
cgccaggggaaaaucagccugcu

SEQ ID NO: 2003245 - RNA, 16 nt, Human
cgcccuggacugugug

SEQ ID NO: 2003246 - RNA, 14 nt, Human
cgcccuggcaggca

SEQ ID NO: 2003247 - RNA, 16 nt, Human
cgcccuggcaggcagg

SEQ ID NO: 2003248 - RNA, 14 nt, Human
cgcccuggccccca

SEQ ID NO: 2003249 - RNA, 15 nt, Human
cgcccuggcccccac

SEQ ID NO: 2003250 - RNA, 17 nt, Human
cgcccuggcccccacau

SEQ ID NO: 2003251 - RNA, 14 nt, Human
cgccccugagccca

SEQ ID NO: 2003252 - RNA, 15 nt, Human
cgccccugagcccac

SEQ ID NO: 2003253 - RNA, 18 nt, Human
cgccccugagcccacugu

SEQ ID NO: 2003254 - RNA, 13 nt, Human
cgcccacuucccu

SEQ ID NO: 2003255 - RNA, 12 nt, Human
cgcccacuuccc

SEQ ID NO: 2003256 - RNA, 22 nt, Human
cgcccagagacccaagcugccu

SEQ ID NO: 2003257 - RNA, 14 nt, Human
cgcccagucccagc

SEQ ID NO: 2003258 - RNA, 15 nt, Human
cgcccagucccagca

SEQ ID NO: 2003259 - RNA, 17 nt, Human
cgcccagucccagcagc

SEQ ID NO: 2003260 - RNA, 18 nt, Human
cgcccagucccagcagcc

SEQ ID NO: 2003261 - RNA, 22 nt, Human
cgcccaggcuuagucacugaga

SEQ ID NO: 2003262 - RNA, 12 nt, Human
cgccccugagcc

SEQ ID NO: 2003263 - RNA, 13 nt, Human
cgccccugagccc

SEQ ID NO: 2003264 - RNA, 12 nt, Human
cgcccagucugg

SEQ ID NO: 2003265 - RNA, 18 nt, Human
cgccccgaaaggucaccu

SEQ ID NO: 2003266 - RNA, 21 nt, Human
cgcccagucccagcagccagc

SEQ ID NO: 2003267 - RNA, 14 nt, Human
cuaaaaauuggugu

SEQ ID NO: 2003268 - RNA, 11 nt, Human
cuaaaaauaua

SEQ ID NO: 2003269 - RNA, 21 nt, Human
cuaaaaauauacauguuuaug

SEQ ID NO: 2003270 - RNA, 23 nt, Human
cuaaaaauauacauguuuaugua

SEQ ID NO: 2003271 - RNA, 22 nt, Human
cuaaaacuguacuuugauucac

SEQ ID NO: 2003272 - RNA, 18 nt, Human
cuaaaacuguacuuugau

SEQ ID NO: 2003273 - RNA, 20 nt, Human
cuaaaacuguacuuugauuc

SEQ ID NO: 2003274 - RNA, 13 nt, Human
cuaaaacuguacu

SEQ ID NO: 2003275 - RNA, 16 nt, Human
cuaaaacuguacuuug

SEQ ID NO: 2003276 - RNA, 17 nt, Human
cuaaaacuguacuuuga

SEQ ID NO: 2003277 - RNA, 13 nt, Human
cuaaaauguuuuc

SEQ ID NO: 2003278 - RNA, 14 nt, Human
cuaaaauguuuuca

SEQ ID NO: 2003279 - RNA, 15 nt, Human
cuaaaauguuuucag

SEQ ID NO: 2003280 - RNA, 17 nt, Human
cuaaaauguuuucagcu

SEQ ID NO: 2003281 - RNA, 15 nt, Human
cuaaaauuuuuuccu

SEQ ID NO: 2003282 - RNA, 16 nt, Human
cuaaauguugaaagau

SEQ ID NO: 2003283 - RNA, 13 nt, Human
cuaaauguuaaag

SEQ ID NO: 2003284 - RNA, 23 nt, Human
cuaaauugacacuuaaaaauggu

SEQ ID NO: 2003285 - RNA, 14 nt, Human
cuaaauguuaaaga

SEQ ID NO: 2003286 - RNA, 15 nt, Human
cuaaauguuaaagau

SEQ ID NO: 2003287 - RNA, 16 nt, Human
cuaaauguuaaagaug

SEQ ID NO: 2003288 - RNA, 17 nt, Human
cuaaauguuaaagaugu

SEQ ID NO: 2003289 - RNA, 19 nt, Human
cuaaauguuaaagauguag

SEQ ID NO: 2003290 - RNA, 23 nt, Human
cuaaauguuaaagauguagcaaa

SEQ ID NO: 2003291 - RNA, 18 nt, Human
cuaaauuuauuauuuaaa

SEQ ID NO: 2003292 - RNA, 17 nt, Human
cuaaauugauguugaug

SEQ ID NO: 2003293 - RNA, 14 nt, Human
cuaaauugauguug

SEQ ID NO: 2003294 - RNA, 15 nt, Human
cuaaauugauguuga

SEQ ID NO: 2003295 - RNA, 16 nt, Human
cuaaauugauguugau

SEQ ID NO: 2003296 - RNA, 15 nt, Human
cuaacaccagacaga

SEQ ID NO: 2003297 - RNA, 15 nt, Human
cuaacaugauuuggg

SEQ ID NO: 2003298 - RNA, 17 nt, Human
cuaacauggaaguacua

SEQ ID NO: 2003299 - RNA, 15 nt, Human
cuaacauggaaguac

SEQ ID NO: 2003300 - RNA, 18 nt, Human
cuaaauggaaccacucua

SEQ ID NO: 2003301 - RNA, 16 nt, Human
cuaaauggaaccacuc

SEQ ID NO: 2003302 - RNA, 17 nt, Human
cuaaauggaaccacucu

SEQ ID NO: 2003303 - RNA, 20 nt, Human
cuaaaucuccaaaauaaaac

SEQ ID NO: 2003304 - RNA, 15 nt, Human
cuaaauggaaccacu

SEQ ID NO: 2003305 - RNA, 14 nt, Human
cuaaacguguaugu

SEQ ID NO: 2003306 - RNA, 17 nt, Human
cuaaacguguauguuuu

SEQ ID NO: 2003307 - RNA, 18 nt, Human
cuaaacguguauguuuuu

SEQ ID NO: 2003308 - RNA, 19 nt, Human
cuaaacguguauguuuuuc

SEQ ID NO: 2003309 - RNA, 20 nt, Human
cuaaacguguauguuuuuca

SEQ ID NO: 2003310 - RNA, 21 nt, Human
cuaaacguguauguuuuucag

SEQ ID NO: 2003311 - RNA, 20 nt, Human
cuaaauauauuuuaagacga

SEQ ID NO: 2003312 - RNA, 18 nt, Human
cuaaauauauuuuaagac

SEQ ID NO: 2003313 - RNA, 22 nt, Human
cuaaacguguauguuuuucagu

SEQ ID NO: 2003314 - RNA, 22 nt, Human
cggugcuaucucccccagcccc

SEQ ID NO: 2003315 - RNA, 21 nt, Human
cggugcuaucucccccagccc

SEQ ID NO: 2003316 - RNA, 20 nt, Human
cggugcuaucucccccagcc

SEQ ID NO: 2003317 - RNA, 18 nt, Human
cggugcuaucucccccag

SEQ ID NO: 2003318 - RNA, 16 nt, Human
cgucuaccugaggggc

SEQ ID NO: 2003319 - RNA, 16 nt, Human
cgucucauacucaccu

SEQ ID NO: 2003320 - RNA, 16 nt, Human
cgugcacacaccagag

SEQ ID NO: 2003321 - RNA, 11 nt, Human
cgucuuuccca

SEQ ID NO: 2003322 - RNA, 18 nt, Human
cgucuuucccaaaggcau

SEQ ID NO: 2003323 - RNA, 20 nt, Human
cgucugacaggcaaugcugg

SEQ ID NO: 2003324 - RNA, 21 nt, Human
cgucugacaggcaaugcuggc

SEQ ID NO: 2003325 - RNA, 22 nt, Human
cgucugacaggcaaugcuggcu

SEQ ID NO: 2003326 - RNA, 23 nt, Human
cgugcauaccacuuuuguucuug

SEQ ID NO: 2003327 - RNA, 21 nt, Human
cgugcaguggugcgaucuggg

SEQ ID NO: 2003328 - RNA, 22 nt, Human
cgugcaguggugcgaucugggu

SEQ ID NO: 2003329 - RNA, 18 nt, Human
cgugcacacaccagagcc

SEQ ID NO: 2003330 - RNA, 19 nt, Human
cgugcacacaccagagccc

SEQ ID NO: 2003331 - RNA, 18 nt, Human
cguugcugacuuagaauc

SEQ ID NO: 2003332 - RNA, 19 nt, Human
cguugaaguugacucugcu

SEQ ID NO: 2003333 - RNA, 20 nt, Human
cguggcuucccgcucagccc

SEQ ID NO: 2003334 - RNA, 21 nt, Human
cguggcuucccgcucagcccu

SEQ ID NO: 2003335 - RNA, 15 nt, Human
cgugggcuccccucu

SEQ ID NO: 2003336 - RNA, 16 nt, Human
cgugggcuccccucuu

SEQ ID NO: 2003337 - RNA, 19 nt, Human
cgugggcuccccucuuccu

SEQ ID NO: 2003338 - RNA, 20 nt, Human
cgugggcuccccucuuccuc

SEQ ID NO: 2003339 - RNA, 18 nt, Human
cguggcuucccgcucagc

SEQ ID NO: 2003340 - RNA, 19 nt, Human
cguggcuucccgcucagcc

SEQ ID NO: 2003341 - RNA, 14 nt, Human
cguggcaccuccuc

SEQ ID NO: 2003342 - RNA, 15 nt, Human
cguggcaccuccucg

SEQ ID NO: 2003343 - RNA, 19 nt, Human
cgugcguguuuucugacug

SEQ ID NO: 2003344 - RNA, 17 nt, Human
cguggagaaucacaggc

SEQ ID NO: 2003345 - RNA, 18 nt, Human
cguggagaaucacaggcu

SEQ ID NO: 2003346 - RNA, 20 nt, Human
cguggagaaucacaggcugg

SEQ ID NO: 2003347 - RNA, 23 nt, Human
cguggagaaucacaggcugggcu

SEQ ID NO: 2003348 - RNA, 11 nt, Human
cuaugcauuug

SEQ ID NO: 2003349 - RNA, 12 nt, Human
cuaugcauuuga

SEQ ID NO: 2003350 - RNA, 16 nt, Human
cuaugacuuaacauag

SEQ ID NO: 2003351 - RNA, 21 nt, Human
cuaugcauuugaaaauuuuga

SEQ ID NO: 2003352 - RNA, 13 nt, Human
cucaccccagccc

SEQ ID NO: 2003353 - RNA, 12 nt, Human
cucaccccagcc

SEQ ID NO: 2003354 - RNA, 14 nt, Human
cucaccccagcccc

SEQ ID NO: 2003355 - RNA, 17 nt, Human
cucaccccuugccauaa

SEQ ID NO: 2003356 - RNA, 13 nt, Human
cucacuaggcuuc

SEQ ID NO: 2003357 - RNA, 16 nt, Human
cucacuaggcuucugg

SEQ ID NO: 2003358 - RNA, 16 nt, Human
cucacuauguugccca

SEQ ID NO: 2003359 - RNA, 17 nt, Human
cucacuauguugcccag

SEQ ID NO: 2003360 - RNA, 20 nt, Human
cucacuaggcuucugguuga

SEQ ID NO: 2003361 - RNA, 20 nt, Human
cucacuaucccggcugcccu

SEQ ID NO: 2003362 - RNA, 21 nt, Human
cucacuaucccggcugcccuu

SEQ ID NO: 2003363 - RNA, 18 nt, Human
cucaagugauucuccugc

SEQ ID NO: 2003364 - RNA, 19 nt, Human
cucaagugauucuccugcc

SEQ ID NO: 2003365 - RNA, 20 nt, Human
cucaagugauucuccugccu

SEQ ID NO: 2003366 - RNA, 13 nt, Human
cucacaguuauua

SEQ ID NO: 2003367 - RNA, 16 nt, Human
cucacaguuauuacau

SEQ ID NO: 2003368 - RNA, 20 nt, Human
cucaccagccccagugccca

SEQ ID NO: 2003369 - RNA, 21 nt, Human
cucaccagccccagugcccac

SEQ ID NO: 2003370 - RNA, 17 nt, Human
cucacaucuuuuucacu

SEQ ID NO: 2003371 - RNA, 19 nt, Human
cucaccagccccagugccc

SEQ ID NO: 2003372 - RNA, 13 nt, Human
cucacauuuauau

SEQ ID NO: 2003373 - RNA, 14 nt, Human
cuaugcauuugaaa

SEQ ID NO: 2003374 - RNA, 13 nt, Human
cuauuuucucuga

SEQ ID NO: 2003375 - RNA, 16 nt, Human
cuauuuucucugauac

SEQ ID NO: 2003376 - RNA, 17 nt, Human
cuauuuucucugauacu

SEQ ID NO: 2003377 - RNA, 22 nt, Human
cuauuuucucugauacuuuuuu

SEQ ID NO: 2003378 - RNA, 22 nt, Human
cuauuuuaauaaacacucuuga

SEQ ID NO: 2003379 - RNA, 18 nt, Human
cuauuuuaauaaacacuc

SEQ ID NO: 2003380 - RNA, 15 nt, Human
cucaacuaaauccaa

SEQ ID NO: 2003381 - RNA, 21 nt, Human
cucaacucuccuccagaguca

SEQ ID NO: 2003382 - RNA, 20 nt, Human
cucaacucuccuccagaguc

SEQ ID NO: 2003383 - RNA, 18 nt, Human
cucaaauuguaauuaaua

SEQ ID NO: 2003384 - RNA, 13 nt, Human
cucaaauuucuaa

SEQ ID NO: 2003385 - RNA, 19 nt, Human
cucaacucuccuccagagu

SEQ ID NO: 2003386 - RNA, 16 nt, Human
cucaacuaaauccaaa

SEQ ID NO: 2003387 - RNA, 19 nt, Human
cucaagagggcacuggugg

SEQ ID NO: 2003388 - RNA, 21 nt, Human
cucaagagggcacugguggcc

SEQ ID NO: 2003389 - RNA, 17 nt, Human
cucaagagggcacuggu

SEQ ID NO: 2003390 - RNA, 14 nt, Human
cuaguuccaccauc

SEQ ID NO: 2003391 - RNA, 14 nt, Human
cuaugacacaugca

SEQ ID NO: 2003392 - RNA, 13 nt, Human
cuaucuuggagag

SEQ ID NO: 2003393 - RNA, 21 nt, Human
cuaucuuggagagcuggggac

SEQ ID NO: 2003394 - RNA, 20 nt, Human
cuaucuuaucucagauauuu

SEQ ID NO: 2003395 - RNA, 20 nt, Human
cuaucuguuuacaguguucc

SEQ ID NO: 2003396 - RNA, 17 nt, Human
cuaucuguuuacagugu

SEQ ID NO: 2003397 - RNA, 21 nt, Human
cuaucuguuuacaguguuccg

SEQ ID NO: 2003398 - RNA, 20 nt, Human
cuaucaaguauuauaccuuu

SEQ ID NO: 2003399 - RNA, 22 nt, Human
cuauauuuuuuguuaaaugauu

SEQ ID NO: 2003400 - RNA, 13 nt, Human
cuauauuuuccug

SEQ ID NO: 2003401 - RNA, 14 nt, Human
cuauauuuuccuga

SEQ ID NO: 2003402 - RNA, 22 nt, Human
cuauauuguuuucaguguacau

SEQ ID NO: 2003403 - RNA, 20 nt, Human
cuauauuuuuuguuaaauga

SEQ ID NO: 2003404 - RNA, 23 nt, Human
cuauauuguuuucaguguacaug

SEQ ID NO: 2003405 - RNA, 17 nt, Human
cuauaucuauaaacacu

SEQ ID NO: 2003406 - RNA, 18 nt, Human
cuauaucuauaaacacug

SEQ ID NO: 2003407 - RNA, 19 nt, Human
cuauaucuauaaacacugu

SEQ ID NO: 2003408 - RNA, 18 nt, Human
cuaguguucuuucucuuu

SEQ ID NO: 2003409 - RNA, 15 nt, Human
cuaguguuugauugu

SEQ ID NO: 2003410 - RNA, 12 nt, Human
cuaguuauuuau

SEQ ID NO: 2003411 - RNA, 13 nt, Human
cuaguuauuuauu

SEQ ID NO: 2003412 - RNA, 16 nt, Human
cuaguuauuuauucug

SEQ ID NO: 2003413 - RNA, 19 nt, Human
cuaguuauuuauucuggga

SEQ ID NO: 2003414 - RNA, 20 nt, Human
cuaguuauuuauucugggaa

SEQ ID NO: 2003415 - RNA, 16 nt, Human
cuaguucaucccuucu

SEQ ID NO: 2003416 - RNA, 17 nt, Human
cuaguucaucccuucuc

SEQ ID NO: 2003417 - RNA, 18 nt, Human
cuaguucaucccuucucu

SEQ ID NO: 2003418 - RNA, 19 nt, Human
cuaguucaucccuucucuu

SEQ ID NO: 2003419 - RNA, 20 nt, Human
cuaguucaucccuucucuuc

SEQ ID NO: 2003420 - RNA, 23 nt, Human
cuaguucaucccuucucuuccag

SEQ ID NO: 2003421 - RNA, 23 nt, Human
cuagugugguguuuccuggcacu

SEQ ID NO: 2003422 - RNA, 22 nt, Human
cuagugugguguuuccuggcac

SEQ ID NO: 2003423 - RNA, 21 nt, Human
cuagugugguguuuccuggca

SEQ ID NO: 2003424 - RNA, 19 nt, Human
cuagugugguguuuccugg

SEQ ID NO: 2003425 - RNA, 13 nt, Human
cuagucuuaagaa

SEQ ID NO: 2003426 - RNA, 14 nt, Human
cuagugcagcugaa

SEQ ID NO: 2003427 - RNA, 16 nt, Human
cuagugcagcugaaau

SEQ ID NO: 2003428 - RNA, 17 nt, Human
cuagugcagcugaaauu

SEQ ID NO: 2003429 - RNA, 19 nt, Human
cuagugcagcugaaauuga

SEQ ID NO: 2003430 - RNA, 20 nt, Human
cuagucaacaguacccuggu

SEQ ID NO: 2003431 - RNA, 21 nt, Human
cuagucaacaguacccugguu

SEQ ID NO: 2003432 - RNA, 15 nt, Human
cuaguaucaaaagaa

SEQ ID NO: 2003433 - RNA, 17 nt, Human
cuaguaucaaaagaaag

SEQ ID NO: 2003434 - RNA, 23 nt, Human
cuaguaucaaaagaaagaaaauc

SEQ ID NO: 2003435 - RNA, 21 nt, Human
cuaggcauuugcugaauacag

SEQ ID NO: 2003436 - RNA, 17 nt, Human
cuaggcagggugucugc

SEQ ID NO: 2003437 - RNA, 18 nt, Human
cuaggcagggugucugcc

SEQ ID NO: 2003438 - RNA, 19 nt, Human
cuaggcagggugucugccc

SEQ ID NO: 2003439 - RNA, 20 nt, Human
cuaguagggguaccacugaa

SEQ ID NO: 2003440 - RNA, 21 nt, Human
cuaguagggguaccacugaau

SEQ ID NO: 2003441 - RNA, 14 nt, Human
cuaguacugugaau

SEQ ID NO: 2003442 - RNA, 15 nt, Human
cuaggaacacuccuu

SEQ ID NO: 2003443 - RNA, 13 nt, Human
cuaggaacacucc

SEQ ID NO: 2003444 - RNA, 14 nt, Human
cuaggaacaaaucu

SEQ ID NO: 2003445 - RNA, 16 nt, Human
cuaggaacaaaucuuc

SEQ ID NO: 2003446 - RNA, 21 nt, Human
cuaggaagacuuuggaaagag

SEQ ID NO: 2003447 - RNA, 13 nt, Human
cuagcacuuccuu

SEQ ID NO: 2003448 - RNA, 14 nt, Human
cuagcacuuccuug

SEQ ID NO: 2003449 - RNA, 16 nt, Human
cuaggaaauccagggu

SEQ ID NO: 2003450 - RNA, 17 nt, Human
cuaggaaauccagggug

SEQ ID NO: 2003451 - RNA, 22 nt, Human
cuaggaccccuccaugugggcu

SEQ ID NO: 2003452 - RNA, 22 nt, Human
cuaggaaggcacuucugccuga

SEQ ID NO: 2003453 - RNA, 14 nt, Human
cuaggaauauagau

SEQ ID NO: 2003454 - RNA, 17 nt, Human
cuaggaauauagauuaa

SEQ ID NO: 2003455 - RNA, 22 nt, Human
cuaggacugaauuaugaaacuu

SEQ ID NO: 2003456 - RNA, 17 nt, Human
cuaggaggucucuaaga

SEQ ID NO: 2003457 - RNA, 19 nt, Human
cuaggauucacaccccacc

SEQ ID NO: 2003458 - RNA, 20 nt, Human
cuaggauucacaccccaccu

SEQ ID NO: 2003459 - RNA, 21 nt, Human
cuaggauucacaccccaccug

SEQ ID NO: 2003460 - RNA, 22 nt, Human
cuaggauucacaccccaccugc

SEQ ID NO: 2003461 - RNA, 23 nt, Human
cuaggauucacaccccaccugcg

SEQ ID NO: 2003462 - RNA, 15 nt, Human
cuaaggugugcucug

SEQ ID NO: 2003463 - RNA, 14 nt, Human
cuaaggcugaacuu

SEQ ID NO: 2003464 - RNA, 19 nt, Human
cuaaggauuagucccuggc

SEQ ID NO: 2003465 - RNA, 21 nt, Human
cuaagcuauucaguaauaacu

SEQ ID NO: 2003466 - RNA, 19 nt, Human
cuaagcuauucaguaauaa

SEQ ID NO: 2003467 - RNA, 14 nt, Human
cuaagcauuuaaaa

SEQ ID NO: 2003468 - RNA, 15 nt, Human
cuaagcaaaauguga

SEQ ID NO: 2003469 - RNA, 18 nt, Human
cuaagcaaaaugugauau

SEQ ID NO: 2003470 - RNA, 14 nt, Human
cuaagcaaaaugug

SEQ ID NO: 2003471 - RNA, 17 nt, Human
cuaaccagcagaaaugc

SEQ ID NO: 2003472 - RNA, 16 nt, Human
cuaaccagcagaaaug

SEQ ID NO: 2003473 - RNA, 17 nt, Human
cuaaccacgcuggaccu

SEQ ID NO: 2003474 - RNA, 17 nt, Human
cuacagaggccaugggc

SEQ ID NO: 2003475 - RNA, 17 nt, Human
cuacccacccuccuuuc

SEQ ID NO: 2003476 - RNA, 22 nt, Human
cuacccacccuccuuucaccac

SEQ ID NO: 2003477 - RNA, 16 nt, Human
cuaccccuugauuuuc

SEQ ID NO: 2003478 - RNA, 24 nt, Human
cuaccccucccggcccugccugcu

SEQ ID NO: 2003479 - RNA, 21 nt, Human
cuaccccucccggcccugccu

SEQ ID NO: 2003480 - RNA, 12 nt, Human
cuacccaggugc

SEQ ID NO: 2003481 - RNA, 20 nt, Human
cuacccagcgagcccuggug

SEQ ID NO: 2003482 - RNA, 19 nt, Human
cuacccagcgagcccuggu

SEQ ID NO: 2003483 - RNA, 16 nt, Human
cuacacuccagugaga

SEQ ID NO: 2003484 - RNA, 21 nt, Human
cuacacacugcauguuuguga

SEQ ID NO: 2003485 - RNA, 17 nt, Human
cuacacuccagugagac

SEQ ID NO: 2003486 - RNA, 18 nt, Human
cuacacugugcugagucu

SEQ ID NO: 2003487 - RNA, 13 nt, Human
cuacacacugcau

SEQ ID NO: 2003488 - RNA, 15 nt, Human
cuacacacugcaugu

SEQ ID NO: 2003489 - RNA, 17 nt, Human
cuacagaaaagaaacuc

SEQ ID NO: 2003490 - RNA, 18 nt, Human
cuacagaaaagaaacucu

SEQ ID NO: 2003491 - RNA, 15 nt, Human
cuacagaggccaugg

SEQ ID NO: 2003492 - RNA, 19 nt, Human
cuaaucagcauucucacuc

SEQ ID NO: 2003493 - RNA, 17 nt, Human
cuaaucagcauucucac

SEQ ID NO: 2003494 - RNA, 16 nt, Human
cuaauccucuuuuucu

SEQ ID NO: 2003495 - RNA, 13 nt, Human
cuaauaaagcugu

SEQ ID NO: 2003496 - RNA, 21 nt, Human
cuaauaaaauuuaaaagucuu

SEQ ID NO: 2003497 - RNA, 12 nt, Human
cuaauaaagcug

SEQ ID NO: 2003498 - RNA, 16 nt, Human
cuaaggugugcucuga

SEQ ID NO: 2003499 - RNA, 14 nt, Human
cuaauguacugcau

SEQ ID NO: 2003500 - RNA, 16 nt, Human
cuaauguacugcauau

SEQ ID NO: 2003501 - RNA, 19 nt, Human
cuaaugaaugcauaaaaug

SEQ ID NO: 2003502 - RNA, 22 nt, Human
cuaaugaaugcauaaaauguua

SEQ ID NO: 2003503 - RNA, 15 nt, Human
cuaaugacauucaau

SEQ ID NO: 2003504 - RNA, 14 nt, Human
cuaaucuugugaaa

SEQ ID NO: 2003505 - RNA, 16 nt, Human
cuaaucuugugaaaau

SEQ ID NO: 2003506 - RNA, 19 nt, Human
cuaaucuugugaaaauaau

SEQ ID NO: 2003507 - RNA, 21 nt, Human
cuaaucuugugaaaauaauug

SEQ ID NO: 2003508 - RNA, 22 nt, Human
cuaauguuggcagaugcagcuc

SEQ ID NO: 2003509 - RNA, 16 nt, Human
cuaauguuuaagcaga

SEQ ID NO: 2003510 - RNA, 17 nt, Human
cuaauguuuaagcagaa

SEQ ID NO: 2003511 - RNA, 18 nt, Human
cuaauguuuaagcagaau

SEQ ID NO: 2003512 - RNA, 20 nt, Human
cuaauguuuaagcagaauug

SEQ ID NO: 2003513 - RNA, 22 nt, Human
cuaauguuuaagcagaauugga

SEQ ID NO: 2003514 - RNA, 14 nt, Human
cuacaauauguaca

SEQ ID NO: 2003515 - RNA, 21 nt, Human
cuacaauauguacauuucuaa

SEQ ID NO: 2003516 - RNA, 22 nt, Human
cuacaauauguacauuucuaag

SEQ ID NO: 2003517 - RNA, 15 nt, Human
cuacaagacacagug

SEQ ID NO: 2003518 - RNA, 13 nt, Human
cuaauuaauuuca

SEQ ID NO: 2003519 - RNA, 21 nt, Human
cuacuguaauuugugauacaa

SEQ ID NO: 2003520 - RNA, 15 nt, Human
cuacuugggaggcug

SEQ ID NO: 2003521 - RNA, 18 nt, Human
cuacuugggaggcugaga

SEQ ID NO: 2003522 - RNA, 19 nt, Human
cuacuugggaggcugagau

SEQ ID NO: 2003523 - RNA, 22 nt, Human
cuacuuauuguagcauccugga

SEQ ID NO: 2003524 - RNA, 22 nt, Human
cuacuguucagcuuuuauuccu

SEQ ID NO: 2003525 - RNA, 20 nt, Human
cuacuuccugugacuucagc

SEQ ID NO: 2003526 - RNA, 14 nt, Human
cuacuuccccuucc

SEQ ID NO: 2003527 - RNA, 15 nt, Human
cuacuuccccuuccu

SEQ ID NO: 2003528 - RNA, 20 nt, Human
cuacuuccccuuccuaauuc

SEQ ID NO: 2003529 - RNA, 14 nt, Human
cuacugaggugcua

SEQ ID NO: 2003530 - RNA, 19 nt, Human
cuacucuucucucugcucu

SEQ ID NO: 2003531 - RNA, 17 nt, Human
cuacucuucucucugcu

SEQ ID NO: 2003532 - RNA, 18 nt, Human
cuacucuucucucugcuc

SEQ ID NO: 2003533 - RNA, 11 nt, Human
cuacucuucuc

SEQ ID NO: 2003534 - RNA, 14 nt, Human
cuacucuucucucu

SEQ ID NO: 2003535 - RNA, 18 nt, Human
cuacugaccagacaagcu

SEQ ID NO: 2003536 - RNA, 20 nt, Human
cuacugaggauauggacacu

SEQ ID NO: 2003537 - RNA, 17 nt, Human
cuacuguaauuugugau

SEQ ID NO: 2003538 - RNA, 16 nt, Human
cuacuguaauuuguga

SEQ ID NO: 2003539 - RNA, 21 nt, Human
cuacuguaaggcaaucauggu

SEQ ID NO: 2003540 - RNA, 21 nt, Human
cuacccgggaagggggcuggg

SEQ ID NO: 2003541 - RNA, 20 nt, Human
cuacccgggaagggggcugg

SEQ ID NO: 2003542 - RNA, 15 nt, Human
cuacccgggaagggg

SEQ ID NO: 2003543 - RNA, 14 nt, Human
cuacccgggaaggg

SEQ ID NO: 2003544 - RNA, 16 nt, Human
cuacucugugucaggu

SEQ ID NO: 2003545 - RNA, 21 nt, Human
cuacucugugucagguggggc

SEQ ID NO: 2003546 - RNA, 14 nt, Human
cuagauguaaauuu

SEQ ID NO: 2003547 - RNA, 17 nt, Human
cuagcacuuugggaggc

SEQ ID NO: 2003548 - RNA, 14 nt, Human
cuagcacagcuccc

SEQ ID NO: 2003549 - RNA, 16 nt, Human
cuagcacagcucccuu

SEQ ID NO: 2003550 - RNA, 17 nt, Human
cuagcacagcucccuuc

SEQ ID NO: 2003551 - RNA, 14 nt, Human
cuagauuugggaga

SEQ ID NO: 2003552 - RNA, 21 nt, Human
cuagagggaccucucccaggg

SEQ ID NO: 2003553 - RNA, 20 nt, Human
cuagagggaccucucccagg

SEQ ID NO: 2003554 - RNA, 19 nt, Human
cuagagggaccucucccag

SEQ ID NO: 2003555 - RNA, 18 nt, Human
cuagagggaccucuccca

SEQ ID NO: 2003556 - RNA, 21 nt, Human
cuagagugaacuugggccacu

SEQ ID NO: 2003557 - RNA, 17 nt, Human
cuagagugaacuugggc

SEQ ID NO: 2003558 - RNA, 21 nt, Human
cuagacgagcaggcuucuucc

SEQ ID NO: 2003559 - RNA, 21 nt, Human
cuagacccacuggacucaccu

SEQ ID NO: 2003560 - RNA, 20 nt, Human
cuagacgagcaggcuucuuc

SEQ ID NO: 2003561 - RNA, 18 nt, Human
cuagacucccaagcugga

SEQ ID NO: 2003562 - RNA, 12 nt, Human
ccguuauuaaaa

SEQ ID NO: 2003563 - RNA, 22 nt, Human
ccuagguauaauucacauugua

SEQ ID NO: 2003564 - RNA, 13 nt, Human
ccuaggugacaga

SEQ ID NO: 2003565 - RNA, 21 nt, Human
ccuagaaauuccccacccuga

SEQ ID NO: 2003566 - RNA, 16 nt, Human
ccuacuuccccuuccu

SEQ ID NO: 2003567 - RNA, 13 nt, Human
ccuacuuccccuu

SEQ ID NO: 2003568 - RNA, 19 nt, Human
ccuacuguaauuugugaua

SEQ ID NO: 2003569 - RNA, 18 nt, Human
ccuacccacccuccuuuc

SEQ ID NO: 2003570 - RNA, 13 nt, Human
ccuacccacccuc

SEQ ID NO: 2003571 - RNA, 18 nt, Human
ccuacaugcuuugugaac

SEQ ID NO: 2003572 - RNA, 17 nt, Human
ccuacaugcuuugugaa

SEQ ID NO: 2003573 - RNA, 21 nt, Human
ccuaacaacauuguagccuca

SEQ ID NO: 2003574 - RNA, 22 nt, Human
ccuaacaacauuguagccucaa

SEQ ID NO: 2003575 - RNA, 15 nt, Human
ccuacagcccaccug

SEQ ID NO: 2003576 - RNA, 19 nt, Human
ccuacagcuugaccgugag

SEQ ID NO: 2003577 - RNA, 22 nt, Human
ccuacaguugaaaaacagcuga

SEQ ID NO: 2003578 - RNA, 16 nt, Human
ccuaaaauucagugga

SEQ ID NO: 2003579 - RNA, 18 nt, Human
ccguguuugucucuucug

SEQ ID NO: 2003580 - RNA, 14 nt, Human
ccguguuugucucu

SEQ ID NO: 2003581 - RNA, 19 nt, Human
ccguguuugucucuucugg

SEQ ID NO: 2003582 - RNA, 16 nt, Human
ccuaaaccaaaaacug

SEQ ID NO: 2003583 - RNA, 13 nt, Human
ccuaaacauauga

SEQ ID NO: 2003584 - RNA, 13 nt, Human
cccuggugguuca

SEQ ID NO: 2003585 - RNA, 13 nt, Human
cccuguucacucu

SEQ ID NO: 2003586 - RNA, 14 nt, Human
cccuguucacucua

SEQ ID NO: 2003587 - RNA, 22 nt, Human
cccuguucacucuacuuagcau

SEQ ID NO: 2003588 - RNA, 12 nt, Human
cccuucccaccu

SEQ ID NO: 2003589 - RNA, 11 nt, Human
cccuucauuug

SEQ ID NO: 2003590 - RNA, 13 nt, Human
cccuucccaccuc

SEQ ID NO: 2003591 - RNA, 13 nt, Human
cccuuccuaauuc

SEQ ID NO: 2003592 - RNA, 14 nt, Human
cccuuccuaauucc

SEQ ID NO: 2003593 - RNA, 19 nt, Human
cccuuccuaauuccacagc

SEQ ID NO: 2003594 - RNA, 20 nt, Human
cccuuccuaauuccacagcu

SEQ ID NO: 2003595 - RNA, 14 nt, Human
cccuucccagggca

SEQ ID NO: 2003596 - RNA, 17 nt, Human
cccuuggauuguccccg

SEQ ID NO: 2003597 - RNA, 12 nt, Human
cccuugaccugc

SEQ ID NO: 2003598 - RNA, 14 nt, Human
cccuuggacauuuu

SEQ ID NO: 2003599 - RNA, 15 nt, Human
cccuugaccugcuga

SEQ ID NO: 2003600 - RNA, 15 nt, Human
cccuuggacauuuua

SEQ ID NO: 2003601 - RNA, 11 nt, Human
cccuucuuuuu

SEQ ID NO: 2003602 - RNA, 21 nt, Human
cccuuccuaauuccacagcug

SEQ ID NO: 2003603 - RNA, 19 nt, Human
cccuucuuuuucuucuuuu

SEQ ID NO: 2003604 - RNA, 23 nt, Human
cccuugguuaggcauugugggaa

SEQ ID NO: 2003605 - RNA, 22 nt, Human
cccuugguuaggcauuguggga

SEQ ID NO: 2003606 - RNA, 23 nt, Human
cccuuuacuugucuuucuggggu

SEQ ID NO: 2003607 - RNA, 17 nt, Human
cccuuuagcuguguuau

SEQ ID NO: 2003608 - RNA, 12 nt, Human
cccuuguuccag

SEQ ID NO: 2003609 - RNA, 22 nt, Human
cccuuguggucccaccccacac

SEQ ID NO: 2003610 - RNA, 17 nt, Human
ccgggaagggggcuggg

SEQ ID NO: 2003611 - RNA, 17 nt, Human
ccggcaauaaaagccca

SEQ ID NO: 2003612 - RNA, 18 nt, Human
ccggcaauaaaagcccag

SEQ ID NO: 2003613 - RNA, 16 nt, Human
ccggcaauaaaagccc

SEQ ID NO: 2003614 - RNA, 17 nt, Human
ccggaggggccuggcag

SEQ ID NO: 2003615 - RNA, 21 nt, Human
ccggaggggccuggcagccgu

SEQ ID NO: 2003616 - RNA, 16 nt, Human
ccgggagccugaucac

SEQ ID NO: 2003617 - RNA, 23 nt, Human
ccgggagccugaucaccugcccu

SEQ ID NO: 2003618 - RNA, 14 nt, Human
ccgggaagcaaaug

SEQ ID NO: 2003619 - RNA, 21 nt, Human
ccgggacguggcaccuccucg

SEQ ID NO: 2003620 - RNA, 12 nt, Human
ccgggacucugc

SEQ ID NO: 2003621 - RNA, 18 nt, Human
ccggugaccucuagcccu

SEQ ID NO: 2003622 - RNA, 21 nt, Human
ccggucgggggggacccucca

SEQ ID NO: 2003623 - RNA, 21 nt, Human
ccgugcuuuuaaggaaaggca

SEQ ID NO: 2003624 - RNA, 21 nt, Human
ccggugggggggcagagcccu

SEQ ID NO: 2003625 - RNA, 17 nt, Human
ccggugugggggccccg

SEQ ID NO: 2003626 - RNA, 16 nt, Human
ccggugggggggcaga

SEQ ID NO: 2003627 - RNA, 17 nt, Human
ccggugggggggcagag

SEQ ID NO: 2003628 - RNA, 22 nt, Human
ccucaggugagaagcagaggaa

SEQ ID NO: 2003629 - RNA, 17 nt, Human
ccuauuagagaagagau

SEQ ID NO: 2003630 - RNA, 11 nt, Human
ccuauuagugu

SEQ ID NO: 2003631 - RNA, 15 nt, Human
ccuauuaguguuaua

SEQ ID NO: 2003632 - RNA, 16 nt, Human
ccuauuaguguuauau

SEQ ID NO: 2003633 - RNA, 19 nt, Human
ccuauuaguguuauaugaa

SEQ ID NO: 2003634 - RNA, 22 nt, Human
ccuaucuguuuacaguguuccg

SEQ ID NO: 2003635 - RNA, 16 nt, Human
ccuauuagagaagaga

SEQ ID NO: 2003636 - RNA, 14 nt, Human
ccucacacucaccc

SEQ ID NO: 2003637 - RNA, 23 nt, Human
ccucacaguccuuaccagcagag

SEQ ID NO: 2003638 - RNA, 24 nt, Human
ccucacaguccuuaccagcagagc

SEQ ID NO: 2003639 - RNA, 15 nt, Human
ccuaggugacagagu

SEQ ID NO: 2003640 - RNA, 23 nt, Human
ccuagguagcccccucuucccug

SEQ ID NO: 2003641 - RNA, 13 nt, Human
ccuaggucuauuu

SEQ ID NO: 2003642 - RNA, 16 nt, Human
ccuagguagcccccuc

SEQ ID NO: 2003643 - RNA, 20 nt, Human
ccuagguagcccccucuucc

SEQ ID NO: 2003644 - RNA, 21 nt, Human
ccuagguagcccccucuuccc

SEQ ID NO: 2003645 - RNA, 23 nt, Human
ccucaggccugggggcugggcag

SEQ ID NO: 2003646 - RNA, 17 nt, Human
ccucagggagcagggaa

SEQ ID NO: 2003647 - RNA, 19 nt, Human
ccucagggagcagggaagg

SEQ ID NO: 2003648 - RNA, 20 nt, Human
ccucagggagcagggaaggc

SEQ ID NO: 2003649 - RNA, 22 nt, Human
ccucagggucccugguggcagc

SEQ ID NO: 2003650 - RNA, 21 nt, Human
ccucagggagcagggaaggcc

SEQ ID NO: 2003651 - RNA, 22 nt, Human
ccucagggagcagggaaggccu

SEQ ID NO: 2003652 - RNA, 23 nt, Human
ccucagggagcagggaaggccug

SEQ ID NO: 2003653 - RNA, 20 nt, Human
ccucagggucccugguggca

SEQ ID NO: 2003654 - RNA, 17 nt, Human
ccucagggucccuggug

SEQ ID NO: 2003655 - RNA, 16 nt, Human
ccucagggucccuggu

SEQ ID NO: 2003656 - RNA, 21 nt, Human
ccucagagugcaagccccugc

SEQ ID NO: 2003657 - RNA, 14 nt, Human
ccucagagugcaag

SEQ ID NO: 2003658 - RNA, 16 nt, Human
ccucagaucuucugug

SEQ ID NO: 2003659 - RNA, 23 nt, Human
ccucacccggugaccucuagccc

SEQ ID NO: 2003660 - RNA, 14 nt, Human
ccucacccuggggc

SEQ ID NO: 2003661 - RNA, 17 nt, Human
ccucacucagcaccacu

SEQ ID NO: 2003662 - RNA, 18 nt, Human
ccucacucagcaccacuc

SEQ ID NO: 2003663 - RNA, 13 nt, Human
ccucacucucagg

SEQ ID NO: 2003664 - RNA, 14 nt, Human
ccucacucucagga

SEQ ID NO: 2003665 - RNA, 16 nt, Human
ccucagagccaccccu

SEQ ID NO: 2003666 - RNA, 12 nt, Human
ccuccuccagcc

SEQ ID NO: 2003667 - RNA, 11 nt, Human
ccuccucagau

SEQ ID NO: 2003668 - RNA, 13 nt, Human
ccucccucuuucc

SEQ ID NO: 2003669 - RNA, 13 nt, Human
ccucccucuccag

SEQ ID NO: 2003670 - RNA, 18 nt, Human
ccucccucuccagcaggc

SEQ ID NO: 2003671 - RNA, 17 nt, Human
ccucccgaguagcuggg

SEQ ID NO: 2003672 - RNA, 18 nt, Human
ccucccgaguagcuggga

SEQ ID NO: 2003673 - RNA, 21 nt, Human
ccucccgaauagcugggacua

SEQ ID NO: 2003674 - RNA, 19 nt, Human
ccucccgaauagcugggac

SEQ ID NO: 2003675 - RNA, 20 nt, Human
ccucccgaauagcugggacu

SEQ ID NO: 2003676 - RNA, 15 nt, Human
ccucccaacucaccc

SEQ ID NO: 2003677 - RNA, 18 nt, Human
ccucccgaauagcuggga

SEQ ID NO: 2003678 - RNA, 15 nt, Human
ccuccccuccuccug

SEQ ID NO: 2003679 - RNA, 18 nt, Human
ccuccauccuccuccuuc

SEQ ID NO: 2003680 - RNA, 19 nt, Human
ccuccauccuccuccuucc

SEQ ID NO: 2003681 - RNA, 20 nt, Human
ccuccauccuccuccuuccu

SEQ ID NO: 2003682 - RNA, 21 nt, Human
ccuccauccuccuccuuccua

SEQ ID NO: 2003683 - RNA, 12 nt, Human
ccuccaggugca

SEQ ID NO: 2003684 - RNA, 11 nt, Human
ccuccaggugc

SEQ ID NO: 2003685 - RNA, 17 nt, Human
ccuccaggugcacaagc

SEQ ID NO: 2003686 - RNA, 12 nt, Human
ccuccauguggg

SEQ ID NO: 2003687 - RNA, 15 nt, Human
ccuccaugugggcua

SEQ ID NO: 2003688 - RNA, 14 nt, Human
ccucccaacucacc

SEQ ID NO: 2003689 - RNA, 17 nt, Human
ccucccaaagugcuggg

SEQ ID NO: 2003690 - RNA, 12 nt, Human
ccuccauccuga

SEQ ID NO: 2003691 - RNA, 13 nt, Human
ccuccauccugag

SEQ ID NO: 2003692 - RNA, 19 nt, Human
ccuccaugcugccuccaga

SEQ ID NO: 2003693 - RNA, 16 nt, Human
ccuccaugcugccucc

SEQ ID NO: 2003694 - RNA, 13 nt, Human
ccuccacucuccu

SEQ ID NO: 2003695 - RNA, 12 nt, Human
ccuccagaacuc

SEQ ID NO: 2003696 - RNA, 17 nt, Human
ccuccagaacucuuccu

SEQ ID NO: 2003697 - RNA, 18 nt, Human
ccuccagaacucuuccuc

SEQ ID NO: 2003698 - RNA, 20 nt, Human
ccuccagaacucuuccucca

SEQ ID NO: 2003699 - RNA, 20 nt, Human
ccucaggugagaagcagagg

SEQ ID NO: 2003700 - RNA, 18 nt, Human
ccucaggugagaagcaga

SEQ ID NO: 2003701 - RNA, 17 nt, Human
ccucaggugagaagcag

SEQ ID NO: 2003702 - RNA, 17 nt, Human
ccucugauguauuuugu

SEQ ID NO: 2003703 - RNA, 17 nt, Human
ccucugcacuccccugc

SEQ ID NO: 2003704 - RNA, 16 nt, Human
ccucugcacuccccug

SEQ ID NO: 2003705 - RNA, 13 nt, Human
ccucugaggcuga

SEQ ID NO: 2003706 - RNA, 11 nt, Human
ccucugagccu

SEQ ID NO: 2003707 - RNA, 12 nt, Human
ccucugagccuu

SEQ ID NO: 2003708 - RNA, 18 nt, Human
ccucugcacuccccugcu

SEQ ID NO: 2003709 - RNA, 23 nt, Human
ccucugcacuccccugcugggug

SEQ ID NO: 2003710 - RNA, 14 nt, Human
ccucugcagcaaua

SEQ ID NO: 2003711 - RNA, 18 nt, Human
ccucugcagcaauaaagc

SEQ ID NO: 2003712 - RNA, 16 nt, Human
ccucugcccacucccu

SEQ ID NO: 2003713 - RNA, 13 nt, Human
ccucugcccacuc

SEQ ID NO: 2003714 - RNA, 19 nt, Human
ccucugcagcaauaaagca

SEQ ID NO: 2003715 - RNA, 21 nt, Human
ccucugauguauuuugugagu

SEQ ID NO: 2003716 - RNA, 21 nt, Human
ccucugacacacagcucuguc

SEQ ID NO: 2003717 - RNA, 13 nt, Human
ccucugagaggcg

SEQ ID NO: 2003718 - RNA, 18 nt, Human
ccucuccucauguucugc

SEQ ID NO: 2003719 - RNA, 15 nt, Human
ccucuccgccccuga

SEQ ID NO: 2003720 - RNA, 18 nt, Human
ccucuccgccccugagcc

SEQ ID NO: 2003721 - RNA, 19 nt, Human
ccucuccgccccugagccc

SEQ ID NO: 2003722 - RNA, 20 nt, Human
ccucuccgccccugagccca

SEQ ID NO: 2003723 - RNA, 13 nt, Human
ccucugacacaca

SEQ ID NO: 2003724 - RNA, 22 nt, Human
ccucuccgccccugagcccacu

SEQ ID NO: 2003725 - RNA, 20 nt, Human
ccucugaaugaaccuucugg

SEQ ID NO: 2003726 - RNA, 15 nt, Human
ccucugacacacagc

SEQ ID NO: 2003727 - RNA, 14 nt, Human
ccucugacacacag

SEQ ID NO: 2003728 - RNA, 19 nt, Human
ccucugacacacagcucug

SEQ ID NO: 2003729 - RNA, 20 nt, Human
ccucugacacacagcucugu

SEQ ID NO: 2003730 - RNA, 22 nt, Human
ccucucccuuggauuguccccg

SEQ ID NO: 2003731 - RNA, 13 nt, Human
ccucucccuugga

SEQ ID NO: 2003732 - RNA, 20 nt, Human
ccucuccccagcaagugaga

SEQ ID NO: 2003733 - RNA, 14 nt, Human
ccucuacugggagc

SEQ ID NO: 2003734 - RNA, 22 nt, Human
ccucuccagcaggcccauggga

SEQ ID NO: 2003735 - RNA, 11 nt, Human
ccucucccagg

SEQ ID NO: 2003736 - RNA, 15 nt, Human
ccucuccccagcaag

SEQ ID NO: 2003737 - RNA, 21 nt, Human
ccuccuccagccgccaugcuc

SEQ ID NO: 2003738 - RNA, 13 nt, Human
ccuccuccuuccu

SEQ ID NO: 2003739 - RNA, 14 nt, Human
ccuccuccuuccua

SEQ ID NO: 2003740 - RNA, 15 nt, Human
ccuccuccuuccuag

SEQ ID NO: 2003741 - RNA, 17 nt, Human
ccuccucggcuggcugu

SEQ ID NO: 2003742 - RNA, 21 nt, Human
ccuccucggcuggcuguccac

SEQ ID NO: 2003743 - RNA, 16 nt, Human
ccuccucucugcccua

SEQ ID NO: 2003744 - RNA, 13 nt, Human
ccuccucucugcc

SEQ ID NO: 2003745 - RNA, 15 nt, Human
ccuccucucugcccu

SEQ ID NO: 2003746 - RNA, 14 nt, Human
ccucgucuuuccca

SEQ ID NO: 2003747 - RNA, 19 nt, Human
cccucagggucccuggugg

SEQ ID NO: 2003748 - RNA, 18 nt, Human
cccucagggucccuggug

SEQ ID NO: 2003749 - RNA, 17 nt, Human
cccucagggucccuggu

SEQ ID NO: 2003750 - RNA, 16 nt, Human
cccucagggucccugg

SEQ ID NO: 2003751 - RNA, 15 nt, Human
cccucagggucccug

SEQ ID NO: 2003752 - RNA, 14 nt, Human
cccuaauaaagcug

SEQ ID NO: 2003753 - RNA, 13 nt, Human
cccuaauaaagcu

SEQ ID NO: 2003754 - RNA, 12 nt, Human
cccuaauaaagc

SEQ ID NO: 2003755 - RNA, 18 nt, Human
cccuaauaaagcugugug

SEQ ID NO: 2003756 - RNA, 15 nt, Human
cccuaauaaagcugu

SEQ ID NO: 2003757 - RNA, 14 nt, Human
cccuaaaagcacac

SEQ ID NO: 2003758 - RNA, 17 nt, Human
cccuaaaguguauuuuu

SEQ ID NO: 2003759 - RNA, 22 nt, Human
cccuaaaguguauuuuuuuacu

SEQ ID NO: 2003760 - RNA, 13 nt, Human
cccuaaagccuca

SEQ ID NO: 2003761 - RNA, 13 nt, Human
cccgugaccuggu

SEQ ID NO: 2003762 - RNA, 15 nt, Human
cccgugaccugguca

SEQ ID NO: 2003763 - RNA, 16 nt, Human
cccgugaccuggucag

SEQ ID NO: 2003764 - RNA, 16 nt, Human
cccggcaggguccuag

SEQ ID NO: 2003765 - RNA, 17 nt, Human
cccggaggggccuggca

SEQ ID NO: 2003766 - RNA, 18 nt, Human
cccggaggggccuggcag

SEQ ID NO: 2003767 - RNA, 22 nt, Human
cccucauccucauacccacccc

SEQ ID NO: 2003768 - RNA, 19 nt, Human
cccucauuggcucuugaac

SEQ ID NO: 2003769 - RNA, 21 nt, Human
cccuccaagaccuucuccuuc

SEQ ID NO: 2003770 - RNA, 22 nt, Human
cccucauuccaccuucccaugc

SEQ ID NO: 2003771 - RNA, 23 nt, Human
cccucauuaaaauauugaaaucu

SEQ ID NO: 2003772 - RNA, 20 nt, Human
cccucagucuggcccuuccu

SEQ ID NO: 2003773 - RNA, 21 nt, Human
cccucagggucccugguggca

SEQ ID NO: 2003774 - RNA, 13 nt, Human
cccucauagcccu

SEQ ID NO: 2003775 - RNA, 15 nt, Human
cccucauagcccuca

SEQ ID NO: 2003776 - RNA, 20 nt, Human
cccucauccucauacccacc

SEQ ID NO: 2003777 - RNA, 17 nt, Human
cccucauccucauaccc

SEQ ID NO: 2003778 - RNA, 22 nt, Human
cccucaucaccaacgucugugc

SEQ ID NO: 2003779 - RNA, 19 nt, Human
cccucauagcccucacccu

SEQ ID NO: 2003780 - RNA, 23 nt, Human
cccucccucuacugggagccuac

SEQ ID NO: 2003781 - RNA, 13 nt, Human
cccucccucuuuc

SEQ ID NO: 2003782 - RNA, 21 nt, Human
cccuccgaccacuuccagggg

SEQ ID NO: 2003783 - RNA, 14 nt, Human
cccucccucuccag

SEQ ID NO: 2003784 - RNA, 14 nt, Human
cccucccuucaacc

SEQ ID NO: 2003785 - RNA, 19 nt, Human
cccuccaucuaaacugccc

SEQ ID NO: 2003786 - RNA, 17 nt, Human
cccuccaugugggcuag

SEQ ID NO: 2003787 - RNA, 12 nt, Human
cccuccaggagu

SEQ ID NO: 2003788 - RNA, 16 nt, Human
cccuccaaggccaggc

SEQ ID NO: 2003789 - RNA, 10 nt, Human
cccuccaagg

SEQ ID NO: 2003790 - RNA, 14 nt, Human
ccccuuaccacugc

SEQ ID NO: 2003791 - RNA, 20 nt, Human
ccccuguucuggcagaguug

SEQ ID NO: 2003792 - RNA, 20 nt, Human
ccccuuccuaauuccacagc

SEQ ID NO: 2003793 - RNA, 21 nt, Human
ccccuuccuaauuccacagcu

SEQ ID NO: 2003794 - RNA, 22 nt, Human
ccccuuccuaauuccacagcug

SEQ ID NO: 2003795 - RNA, 14 nt, Human
ccccuuccuaccac

SEQ ID NO: 2003796 - RNA, 12 nt, Human
ccccuucccccu

SEQ ID NO: 2003797 - RNA, 18 nt, Human
ccccuucccgugaccugg

SEQ ID NO: 2003798 - RNA, 23 nt, Human
ccccuggugguucacucuuggag

SEQ ID NO: 2003799 - RNA, 15 nt, Human
ccccuguaggccuca

SEQ ID NO: 2003800 - RNA, 22 nt, Human
ccccuguccccgcacugggcuu

SEQ ID NO: 2003801 - RNA, 23 nt, Human
ccccuggcuuuucacugcuggcu

SEQ ID NO: 2003802 - RNA, 20 nt, Human
cccgaggccuucucugaagg

SEQ ID NO: 2003803 - RNA, 15 nt, Human
cccgaggccuucucu

SEQ ID NO: 2003804 - RNA, 19 nt, Human
cccgauccuccccuggacu

SEQ ID NO: 2003805 - RNA, 15 nt, Human
cccgaucgccagcaa

SEQ ID NO: 2003806 - RNA, 16 nt, Human
cccgcaagcaccaucc

SEQ ID NO: 2003807 - RNA, 22 nt, Human
cccgcuaagagggagggagggc

SEQ ID NO: 2003808 - RNA, 19 nt, Human
cccgcucagcccucccugc

SEQ ID NO: 2003809 - RNA, 23 nt, Human
cccgcucagcccucccugccccu

SEQ ID NO: 2003810 - RNA, 22 nt, Human
ccccaggugguuauggagaggg

SEQ ID NO: 2003811 - RNA, 14 nt, Human
ccccuggcagcccc

SEQ ID NO: 2003812 - RNA, 12 nt, Human
ccccuggcagcc

SEQ ID NO: 2003813 - RNA, 15 nt, Human
ccccuggcagccccu

SEQ ID NO: 2003814 - RNA, 12 nt, Human
ccccaggaggcc

SEQ ID NO: 2003815 - RNA, 12 nt, Human
ccccagggcacg

SEQ ID NO: 2003816 - RNA, 23 nt, Human
ccccacaggagguggucugggac

SEQ ID NO: 2003817 - RNA, 16 nt, Human
ccccagccccauccca

SEQ ID NO: 2003818 - RNA, 15 nt, Human
ccccagccccauccu

SEQ ID NO: 2003819 - RNA, 22 nt, Human
ccccagcuggggccaggcuggg

SEQ ID NO: 2003820 - RNA, 21 nt, Human
ccccagcuggggccaggcugg

SEQ ID NO: 2003821 - RNA, 13 nt, Human
ccccagccugcua

SEQ ID NO: 2003822 - RNA, 14 nt, Human
cccugguggcagcu

SEQ ID NO: 2003823 - RNA, 23 nt, Human
cccugccuccuuugugaggaagc

SEQ ID NO: 2003824 - RNA, 16 nt, Human
cccugccuccuuugug

SEQ ID NO: 2003825 - RNA, 18 nt, Human
cccugccucucugcaggu

SEQ ID NO: 2003826 - RNA, 11 nt, Human
cccugccucuc

SEQ ID NO: 2003827 - RNA, 20 nt, Human
cccugccaucauguuuacag

SEQ ID NO: 2003828 - RNA, 22 nt, Human
cccugccaggcacaggcagggc

SEQ ID NO: 2003829 - RNA, 23 nt, Human
cccugccaggcacaggcagggca

SEQ ID NO: 2003830 - RNA, 18 nt, Human
cccugccaggcacaggca

SEQ ID NO: 2003831 - RNA, 19 nt, Human
cccugccaggcacaggcag

SEQ ID NO: 2003832 - RNA, 20 nt, Human
cccugccaggcacaggcagg

SEQ ID NO: 2003833 - RNA, 21 nt, Human
cccugccaggcacaggcaggg

SEQ ID NO: 2003834 - RNA, 14 nt, Human
cccugccuccuuug

SEQ ID NO: 2003835 - RNA, 17 nt, Human
cccugccacccugggga

SEQ ID NO: 2003836 - RNA, 18 nt, Human
cccugccacccuggggag

SEQ ID NO: 2003837 - RNA, 13 nt, Human
cccugccaggcac

SEQ ID NO: 2003838 - RNA, 14 nt, Human
cccugccaggcaca

SEQ ID NO: 2003839 - RNA, 15 nt, Human
cccugccaggcacag

SEQ ID NO: 2003840 - RNA, 17 nt, Human
cccugccaggcacaggc

SEQ ID NO: 2003841 - RNA, 12 nt, Human
cccugccacccu

SEQ ID NO: 2003842 - RNA, 14 nt, Human
cccugccacccugg

SEQ ID NO: 2003843 - RNA, 15 nt, Human
cccugccacccuggg

SEQ ID NO: 2003844 - RNA, 20 nt, Human
cccugauguguccucaggga

SEQ ID NO: 2003845 - RNA, 15 nt, Human
cccugaucccuucca

SEQ ID NO: 2003846 - RNA, 16 nt, Human
cccugaucccuuccac

SEQ ID NO: 2003847 - RNA, 23 nt, Human
cccugaucccuuccaccugcucu

SEQ ID NO: 2003848 - RNA, 17 nt, Human
cccucuacugggagccu

SEQ ID NO: 2003849 - RNA, 20 nt, Human
cccucuacugggagccuacc

SEQ ID NO: 2003850 - RNA, 18 nt, Human
cccugcagagggcacaga

SEQ ID NO: 2003851 - RNA, 20 nt, Human
cccugcagagggcacagaaa

SEQ ID NO: 2003852 - RNA, 12 nt, Human
cccugcagaggg

SEQ ID NO: 2003853 - RNA, 16 nt, Human
cccugcaaccugauug

SEQ ID NO: 2003854 - RNA, 22 nt, Human
cccugcaaccugauugugucuc

SEQ ID NO: 2003855 - RNA, 22 nt, Human
cccugccucucugcaggucccu

SEQ ID NO: 2003856 - RNA, 21 nt, Human
cccugccucucugcagguccc

SEQ ID NO: 2003857 - RNA, 16 nt, Human
cccugccucucugcag

SEQ ID NO: 2003858 - RNA, 13 nt, Human
cccugccugcccu

SEQ ID NO: 2003859 - RNA, 23 nt, Human
cccugccugcccugucaggaggc

SEQ ID NO: 2003860 - RNA, 13 nt, Human
cccugcugguuca

SEQ ID NO: 2003861 - RNA, 19 nt, Human
cccugcugguucaggguug

SEQ ID NO: 2003862 - RNA, 20 nt, Human
cccugcugguucaggguugg

SEQ ID NO: 2003863 - RNA, 23 nt, Human
cccugcuuugggcugcccuggug

SEQ ID NO: 2003864 - RNA, 19 nt, Human
cccugcugucauugcuucu

SEQ ID NO: 2003865 - RNA, 22 nt, Human
cccugcuuugggcugcccuggu

SEQ ID NO: 2003866 - RNA, 21 nt, Human
cccuggaagcagugcccaggu

SEQ ID NO: 2003867 - RNA, 17 nt, Human
cccuggaagcagugccc

SEQ ID NO: 2003868 - RNA, 18 nt, Human
cccuggaagcagugccca

SEQ ID NO: 2003869 - RNA, 21 nt, Human
cccuggacugugugcucagga

SEQ ID NO: 2003870 - RNA, 15 nt, Human
cccuggaagcagugc

SEQ ID NO: 2003871 - RNA, 16 nt, Human
cccuggaagcagugcc

SEQ ID NO: 2003872 - RNA, 22 nt, Human
cccugguggcagugggagcugc

SEQ ID NO: 2003873 - RNA, 20 nt, Human
cccuggguuagacugccagc

SEQ ID NO: 2003874 - RNA, 21 nt, Human
cccuggguuagacugccagcu

SEQ ID NO: 2003875 - RNA, 22 nt, Human
cccuggguuagacugccagcuc

SEQ ID NO: 2003876 - RNA, 17 nt, Human
cccuggugcugccacac

SEQ ID NO: 2003877 - RNA, 21 nt, Human
cccuggugcugccacacuuca

SEQ ID NO: 2003878 - RNA, 16 nt, Human
cccuggguuagacugc

SEQ ID NO: 2003879 - RNA, 18 nt, Human
cccuggguuagacugcca

SEQ ID NO: 2003880 - RNA, 19 nt, Human
cccuggguuagacugccag

SEQ ID NO: 2003881 - RNA, 18 nt, Human
cccugggaggcucuggag

SEQ ID NO: 2003882 - RNA, 17 nt, Human
cccugggaggcucugga

SEQ ID NO: 2003883 - RNA, 16 nt, Human
cccugggaggcucugg

SEQ ID NO: 2003884 - RNA, 15 nt, Human
cccugggaggcucug

SEQ ID NO: 2003885 - RNA, 13 nt, Human
cccagguuucuau

SEQ ID NO: 2003886 - RNA, 18 nt, Human
cccaggcauuccccagga

SEQ ID NO: 2003887 - RNA, 16 nt, Human
cccaggagcccauuug

SEQ ID NO: 2003888 - RNA, 22 nt, Human
cccaggagcccauuuggagggc

SEQ ID NO: 2003889 - RNA, 17 nt, Human
cccaggcauuccccagg

SEQ ID NO: 2003890 - RNA, 19 nt, Human
cccagggugggaagggcua

SEQ ID NO: 2003891 - RNA, 16 nt, Human
cccaggaggccagccu

SEQ ID NO: 2003892 - RNA, 15 nt, Human
cccaggaggccagcc

SEQ ID NO: 2003893 - RNA, 15 nt, Human
cccaggcauucccca

SEQ ID NO: 2003894 - RNA, 23 nt, Human
cccaggcaggucuugaacuccug

SEQ ID NO: 2003895 - RNA, 14 nt, Human
cccaguuagcucuc

SEQ ID NO: 2003896 - RNA, 20 nt, Human
cccagugguuccuaauccuc

SEQ ID NO: 2003897 - RNA, 15 nt, Human
cccagugccgagaag

SEQ ID NO: 2003898 - RNA, 21 nt, Human
cccagugcccacaggaucagu

SEQ ID NO: 2003899 - RNA, 10 nt, Human
cccagucugg

SEQ ID NO: 2003900 - RNA, 18 nt, Human
cccagucuggaaugcagu

SEQ ID NO: 2003901 - RNA, 19 nt, Human
cccagucuggaaugcagug

SEQ ID NO: 2003902 - RNA, 13 nt, Human
cccaucucacaca

SEQ ID NO: 2003903 - RNA, 18 nt, Human
cccaucucacacaugagc

SEQ ID NO: 2003904 - RNA, 13 nt, Human
cccaucugugaau

SEQ ID NO: 2003905 - RNA, 16 nt, Human
cccaucugugaauaag

SEQ ID NO: 2003906 - RNA, 20 nt, Human
cccaucugugaaaggaaaga

SEQ ID NO: 2003907 - RNA, 13 nt, Human
cccaugcugcccu

SEQ ID NO: 2003908 - RNA, 12 nt, Human
cccaugcugccc

SEQ ID NO: 2003909 - RNA, 14 nt, Human
cccaugcugcccug

SEQ ID NO: 2003910 - RNA, 15 nt, Human
cccaugagccucagc

SEQ ID NO: 2003911 - RNA, 16 nt, Human
cccaugagccucagca

SEQ ID NO: 2003912 - RNA, 20 nt, Human
cccaugagccucagcauccu

SEQ ID NO: 2003913 - RNA, 19 nt, Human
cccauguauggccaggaag

SEQ ID NO: 2003914 - RNA, 20 nt, Human
cccauguauggccaggaagu

SEQ ID NO: 2003915 - RNA, 16 nt, Human
cccaugucucgacuca

SEQ ID NO: 2003916 - RNA, 17 nt, Human
cccaugucucgacucau

SEQ ID NO: 2003917 - RNA, 14 nt, Human
cccaugugagcugc

SEQ ID NO: 2003918 - RNA, 16 nt, Human
cccaugugagcugcug

SEQ ID NO: 2003919 - RNA, 18 nt, Human
cccaugugagcugcugcc

SEQ ID NO: 2003920 - RNA, 22 nt, Human
cccaugugagcugcugccauga

SEQ ID NO: 2003921 - RNA, 19 nt, Human
cccauguggagucagccuc

SEQ ID NO: 2003922 - RNA, 21 nt, Human
ccccaaauggaaaugggcaga

SEQ ID NO: 2003923 - RNA, 20 nt, Human
ccaugugagcugcugccaug

SEQ ID NO: 2003924 - RNA, 21 nt, Human
ccaugugagcugcugccauga

SEQ ID NO: 2003925 - RNA, 22 nt, Human
ccaugugagcugcugccaugaa

SEQ ID NO: 2003926 - RNA, 13 nt, Human
ccauguuggccag

SEQ ID NO: 2003927 - RNA, 14 nt, Human
ccauguuggccagg

SEQ ID NO: 2003928 - RNA, 22 nt, Human
ccauggagugggucuggaggac

SEQ ID NO: 2003929 - RNA, 23 nt, Human
ccauggcacucuauguucuaaga

SEQ ID NO: 2003930 - RNA, 13 nt, Human
ccaugugccaggu

SEQ ID NO: 2003931 - RNA, 19 nt, Human
ccaugugagcugcugccau

SEQ ID NO: 2003932 - RNA, 18 nt, Human
ccaugcuccuggcccacu

SEQ ID NO: 2003933 - RNA, 15 nt, Human
ccaugcuccuggccc

SEQ ID NO: 2003934 - RNA, 15 nt, Human
ccaugcugcccugug

SEQ ID NO: 2003935 - RNA, 17 nt, Human
ccaugcugcccugugag

SEQ ID NO: 2003936 - RNA, 16 nt, Human
ccaugcugcccuguga

SEQ ID NO: 2003937 - RNA, 14 nt, Human
ccaugcugccucca

SEQ ID NO: 2003938 - RNA, 23 nt, Human
ccaucuuuuuaaccucuguucag

SEQ ID NO: 2003939 - RNA, 14 nt, Human
ccaugaaagaaaac

SEQ ID NO: 2003940 - RNA, 22 nt, Human
ccaugaacugucaagugugugu

SEQ ID NO: 2003941 - RNA, 13 nt, Human
ccaugcuccuggc

SEQ ID NO: 2003942 - RNA, 12 nt, Human
ccauguggacuu

SEQ ID NO: 2003943 - RNA, 18 nt, Human
ccauguuggccaggcugg

SEQ ID NO: 2003944 - RNA, 15 nt, Human
ccauguuggccaggc

SEQ ID NO: 2003945 - RNA, 19 nt, Human
ccauguuggccaggcuggu

SEQ ID NO: 2003946 - RNA, 21 nt, Human
ccauguuggccaggcuggucu

SEQ ID NO: 2003947 - RNA, 15 nt, Human
cccaccuggccucug

SEQ ID NO: 2003948 - RNA, 12 nt, Human
cccaccuggccu

SEQ ID NO: 2003949 - RNA, 12 nt, Human
cccaccugcgcu

SEQ ID NO: 2003950 - RNA, 16 nt, Human
cccaccuuggcugcag

SEQ ID NO: 2003951 - RNA, 17 nt, Human
cccaccuuggcugcagg

SEQ ID NO: 2003952 - RNA, 19 nt, Human
cccaccuuggcugcaggga

SEQ ID NO: 2003953 - RNA, 20 nt, Human
cccaccuuggcugcagggag

SEQ ID NO: 2003954 - RNA, 14 nt, Human
cccacgcccccacu

SEQ ID NO: 2003955 - RNA, 13 nt, Human
cccacgcccccac

SEQ ID NO: 2003956 - RNA, 12 nt, Human
cccaccuggccc

SEQ ID NO: 2003957 - RNA, 13 nt, Human
cccaccuggcccu

SEQ ID NO: 2003958 - RNA, 18 nt, Human
cccaccuggcccucucug

SEQ ID NO: 2003959 - RNA, 15 nt, Human
cccacgcccccacug

SEQ ID NO: 2003960 - RNA, 17 nt, Human
cccagacccuggaggaa

SEQ ID NO: 2003961 - RNA, 20 nt, Human
cccagacgccugauauugaa

SEQ ID NO: 2003962 - RNA, 19 nt, Human
cccagagagaagagcccca

SEQ ID NO: 2003963 - RNA, 21 nt, Human
cccagagagaagagccccacu

SEQ ID NO: 2003964 - RNA, 22 nt, Human
cccagagagaagagccccacuc

SEQ ID NO: 2003965 - RNA, 18 nt, Human
cccaggaggccagccuug

SEQ ID NO: 2003966 - RNA, 16 nt, Human
cccaggaccccugagu

SEQ ID NO: 2003967 - RNA, 13 nt, Human
cccaggagccccg

SEQ ID NO: 2003968 - RNA, 14 nt, Human
cccaggagccccga

SEQ ID NO: 2003969 - RNA, 14 nt, Human
cccaggaggccagc

SEQ ID NO: 2003970 - RNA, 12 nt, Human
cccaggagccca

SEQ ID NO: 2003971 - RNA, 13 nt, Human
cccaggagcccau

SEQ ID NO: 2003972 - RNA, 21 nt, Human
cccagcuaugguucucucgca

SEQ ID NO: 2003973 - RNA, 14 nt, Human
cccagcgagcccug

SEQ ID NO: 2003974 - RNA, 23 nt, Human
cccagccugggauaggggcagag

SEQ ID NO: 2003975 - RNA, 18 nt, Human
cccagcucugguccauag

SEQ ID NO: 2003976 - RNA, 16 nt, Human
cccagcucugguccau

SEQ ID NO: 2003977 - RNA, 15 nt, Human
cccagcucuggucca

SEQ ID NO: 2003978 - RNA, 14 nt, Human
cccagcucuggucc

SEQ ID NO: 2003979 - RNA, 13 nt, Human
cccagcucugguc

SEQ ID NO: 2003980 - RNA, 12 nt, Human
cccagcucuggu

SEQ ID NO: 2003981 - RNA, 15 nt, Human
cccagccccauccuc

SEQ ID NO: 2003982 - RNA, 14 nt, Human
cccagccccauccu

SEQ ID NO: 2003983 - RNA, 14 nt, Human
cccagccccauccc

SEQ ID NO: 2003984 - RNA, 13 nt, Human
cccagccccaucc

SEQ ID NO: 2003985 - RNA, 19 nt, Human
cccagccccauccucugua

SEQ ID NO: 2003986 - RNA, 18 nt, Human
cccagccccauccucugu

SEQ ID NO: 2003987 - RNA, 13 nt, Human
cccagccucuuuc

SEQ ID NO: 2003988 - RNA, 18 nt, Human
cccagccuccaagcucca

SEQ ID NO: 2003989 - RNA, 20 nt, Human
cccagccuccaagcuccauc

SEQ ID NO: 2003990 - RNA, 23 nt, Human
cccagcccuccuuaucaaaggac

SEQ ID NO: 2003991 - RNA, 12 nt, Human
cccagccccauc

SEQ ID NO: 2003992 - RNA, 11 nt, Human
cccagccccau

SEQ ID NO: 2003993 - RNA, 17 nt, Human
cccagccccaaugaaca

SEQ ID NO: 2003994 - RNA, 20 nt, Human
cccagaggccgagagcuaug

SEQ ID NO: 2003995 - RNA, 13 nt, Human
cccagccccaaug

SEQ ID NO: 2003996 - RNA, 16 nt, Human
cccagaggcuggguga

SEQ ID NO: 2003997 - RNA, 15 nt, Human
ccauauuuuuuuccu

SEQ ID NO: 2003998 - RNA, 16 nt, Human
ccauauuuuuuuccuu

SEQ ID NO: 2003999 - RNA, 17 nt, Human
ccauauuuuuuuccuua

SEQ ID NO: 2004000 - RNA, 22 nt, Human
ccauauuuuuuuccuuacauaa

SEQ ID NO: 2004001 - RNA, 12 nt, Human
ccaucacccgcu

SEQ ID NO: 2004002 - RNA, 22 nt, Human
ccaucaacuaaaguuguacuuu

SEQ ID NO: 2004003 - RNA, 23 nt, Human
ccauagagagcaagacgcugugc

SEQ ID NO: 2004004 - RNA, 21 nt, Human
ccaguggggccugaggcuccu

SEQ ID NO: 2004005 - RNA, 16 nt, Human
ccauagaguacacugc

SEQ ID NO: 2004006 - RNA, 19 nt, Human
ccauagaguacacugccug

SEQ ID NO: 2004007 - RNA, 20 nt, Human
ccauagaguacacugccugc

SEQ ID NO: 2004008 - RNA, 22 nt, Human
ccauagaguacacugccugccu

SEQ ID NO: 2004009 - RNA, 19 nt, Human
ccauauuaccacagacaua

SEQ ID NO: 2004010 - RNA, 15 nt, Human
ccauauucuguuggc

SEQ ID NO: 2004011 - RNA, 18 nt, Human
ccauauucuguuggccag

SEQ ID NO: 2004012 - RNA, 19 nt, Human
ccauauuagaaaacuuugu

SEQ ID NO: 2004013 - RNA, 20 nt, Human
ccauauuagaaaacuuuguu

SEQ ID NO: 2004014 - RNA, 22 nt, Human
ccauauuagaaaacuuuguuag

SEQ ID NO: 2004015 - RNA, 16 nt, Human
ccaucgcugucaucuc

SEQ ID NO: 2004016 - RNA, 22 nt, Human
ccaucuuuuguuacucuuggga

SEQ ID NO: 2004017 - RNA, 20 nt, Human
ccaucuuuuuaaccucuguu

SEQ ID NO: 2004018 - RNA, 16 nt, Human
ccauccugaggcucca

SEQ ID NO: 2004019 - RNA, 15 nt, Human
ccauccugaggcucc

SEQ ID NO: 2004020 - RNA, 21 nt, Human
ccauccucuguacagagccca

SEQ ID NO: 2004021 - RNA, 22 nt, Human
ccaucauguuuacagaggacag

SEQ ID NO: 2004022 - RNA, 20 nt, Human
ccaucauguuuacagaggac

SEQ ID NO: 2004023 - RNA, 14 nt, Human
ccaucaugucuggc

SEQ ID NO: 2004024 - RNA, 16 nt, Human
ccaucaugucuggcua

SEQ ID NO: 2004025 - RNA, 18 nt, Human
ccaggccuuaucuccaag

SEQ ID NO: 2004026 - RNA, 12 nt, Human
ccaggccugccu

SEQ ID NO: 2004027 - RNA, 19 nt, Human
ccagggacagauccagcag

SEQ ID NO: 2004028 - RNA, 23 nt, Human
ccagggacagaggggguggccuc

SEQ ID NO: 2004029 - RNA, 22 nt, Human
ccaguggauucuuguuuugcuu

SEQ ID NO: 2004030 - RNA, 19 nt, Human
ccaguggaugccacagccc

SEQ ID NO: 2004031 - RNA, 21 nt, Human
ccaguggaugccacagcccag

SEQ ID NO: 2004032 - RNA, 13 nt, Human
ccaguggcagggc

SEQ ID NO: 2004033 - RNA, 14 nt, Human
ccaguggcagggca

SEQ ID NO: 2004034 - RNA, 13 nt, Human
ccaggagcagcca

SEQ ID NO: 2004035 - RNA, 12 nt, Human
ccaggagcagcc

SEQ ID NO: 2004036 - RNA, 22 nt, Human
ccaggacccugccaggcacagg

SEQ ID NO: 2004037 - RNA, 23 nt, Human
ccaggacccugccaggcacaggc

SEQ ID NO: 2004038 - RNA, 13 nt, Human
ccaggacccugcc

SEQ ID NO: 2004039 - RNA, 14 nt, Human
ccaggacccugcca

SEQ ID NO: 2004040 - RNA, 15 nt, Human
ccaggacccugccag

SEQ ID NO: 2004041 - RNA, 16 nt, Human
ccaggacccugccagg

SEQ ID NO: 2004042 - RNA, 17 nt, Human
ccaggacccugccaggc

SEQ ID NO: 2004043 - RNA, 18 nt, Human
ccaggacccugccaggca

SEQ ID NO: 2004044 - RNA, 19 nt, Human
ccaggacccugccaggcac

SEQ ID NO: 2004045 - RNA, 20 nt, Human
ccaggacccugccaggcaca

SEQ ID NO: 2004046 - RNA, 21 nt, Human
ccaggacccugccaggcacag

SEQ ID NO: 2004047 - RNA, 19 nt, Human
ccaggaagccagcaggcuc

SEQ ID NO: 2004048 - RNA, 17 nt, Human
ccaggaagccagcaggc

SEQ ID NO: 2004049 - RNA, 15 nt, Human
ccaggaagccagcag

SEQ ID NO: 2004050 - RNA, 14 nt, Human
ccaggaagccagca

SEQ ID NO: 2004051 - RNA, 22 nt, Human
ccagcugugcucuggacaggca

SEQ ID NO: 2004052 - RNA, 23 nt, Human
ccagcugugcucuggacaggcau

SEQ ID NO: 2004053 - RNA, 14 nt, Human
ccaggagcagccac

SEQ ID NO: 2004054 - RNA, 14 nt, Human
ccaggccagaggga

SEQ ID NO: 2004055 - RNA, 21 nt, Human
ccaggccagagggagugacag

SEQ ID NO: 2004056 - RNA, 21 nt, Human
ccaggccccugccacccuggg

SEQ ID NO: 2004057 - RNA, 23 nt, Human
ccaggccccugccacccugggga

SEQ ID NO: 2004058 - RNA, 19 nt, Human
ccaggccccugccacccug

SEQ ID NO: 2004059 - RNA, 19 nt, Human
ccaggccuccuacagcuug

SEQ ID NO: 2004060 - RNA, 18 nt, Human
ccaggccuccuacagcuu

SEQ ID NO: 2004061 - RNA, 13 nt, Human
ccaggccuccuac

SEQ ID NO: 2004062 - RNA, 18 nt, Human
ccaggccuacuccugucu

SEQ ID NO: 2004063 - RNA, 21 nt, Human
ccaggccuacuccugucuucu

SEQ ID NO: 2004064 - RNA, 23 nt, Human
ccaggccuacuccugucuucugc

SEQ ID NO: 2004065 - RNA, 19 nt, Human
ccaggcccucugcccacuc

SEQ ID NO: 2004066 - RNA, 18 nt, Human
ccaggcccucugcccacu

SEQ ID NO: 2004067 - RNA, 17 nt, Human
ccaggcccucugcccac

SEQ ID NO: 2004068 - RNA, 16 nt, Human
ccaggcccucugccca

SEQ ID NO: 2004069 - RNA, 15 nt, Human
ccagcugcuugggcu

SEQ ID NO: 2004070 - RNA, 13 nt, Human
ccagcugcuuggg

SEQ ID NO: 2004071 - RNA, 20 nt, Human
ccagcugcaccccuuccugg

SEQ ID NO: 2004072 - RNA, 21 nt, Human
ccagcugcaccccuuccuggg

SEQ ID NO: 2004073 - RNA, 22 nt, Human
ccagcugcaccccuuccugggc

SEQ ID NO: 2004074 - RNA, 23 nt, Human
ccagcugcaccccuuccugggca

SEQ ID NO: 2004075 - RNA, 18 nt, Human
ccagcugcuugggcuuca

SEQ ID NO: 2004076 - RNA, 16 nt, Human
ccagcugcuugggcuu

SEQ ID NO: 2004077 - RNA, 12 nt, Human
ccagcuggccgg

SEQ ID NO: 2004078 - RNA, 14 nt, Human
ccagcuggccggga

SEQ ID NO: 2004079 - RNA, 20 nt, Human
ccagcuggccgggagccuga

SEQ ID NO: 2004080 - RNA, 16 nt, Human
ccagcuggguuggaaa

SEQ ID NO: 2004081 - RNA, 17 nt, Human
ccagcuggguuggaaaa

SEQ ID NO: 2004082 - RNA, 18 nt, Human
ccagcugugcucuggaca

SEQ ID NO: 2004083 - RNA, 20 nt, Human
ccagcugugcucuggacagg

SEQ ID NO: 2004084 - RNA, 21 nt, Human
ccagcugugcucuggacaggc

SEQ ID NO: 2004085 - RNA, 16 nt, Human
ccagcucuuccuagcu

SEQ ID NO: 2004086 - RNA, 20 nt, Human
ccagcucuuccuagcuggag

SEQ ID NO: 2004087 - RNA, 13 nt, Human
ccagcugcacccc

SEQ ID NO: 2004088 - RNA, 14 nt, Human
ccagcugcaccccu

SEQ ID NO: 2004089 - RNA, 17 nt, Human
ccagcugcaccccuucc

SEQ ID NO: 2004090 - RNA, 19 nt, Human
ccagcugcaccccuuccug

SEQ ID NO: 2004091 - RNA, 13 nt, Human
ccagccucuuucc

SEQ ID NO: 2004092 - RNA, 14 nt, Human
ccagccucuuuccc

SEQ ID NO: 2004093 - RNA, 15 nt, Human
ccagccucuuucccu

SEQ ID NO: 2004094 - RNA, 14 nt, Human
ccacacacacaaaa

SEQ ID NO: 2004095 - RNA, 19 nt, Human
ccagccucguuggaagagg

SEQ ID NO: 2004096 - RNA, 22 nt, Human
ccagccucguuggaagaggaac

SEQ ID NO: 2004097 - RNA, 14 nt, Human
ccaaagaugcagcc

SEQ ID NO: 2004098 - RNA, 13 nt, Human
ccaaagaugcagc

SEQ ID NO: 2004099 - RNA, 22 nt, Human
ccaaauucuuucaguggcuacc

SEQ ID NO: 2004100 - RNA, 15 nt, Human
ccaaauucuuucagu

SEQ ID NO: 2004101 - RNA, 14 nt, Human
ccaaauugucaccu

SEQ ID NO: 2004102 - RNA, 21 nt, Human
ccaaauugucaccugcuucuc

SEQ ID NO: 2004103 - RNA, 22 nt, Human
ccaaauugucaccugcuucucu

SEQ ID NO: 2004104 - RNA, 14 nt, Human
ccaacauacuccca

SEQ ID NO: 2004105 - RNA, 16 nt, Human
ccaacaucaacaucuu

SEQ ID NO: 2004106 - RNA, 13 nt, Human
ccaacauccacuc

SEQ ID NO: 2004107 - RNA, 14 nt, Human
ccaacauccacucu

SEQ ID NO: 2004108 - RNA, 15 nt, Human
ccaacauccacucuc

SEQ ID NO: 2004109 - RNA, 17 nt, Human
ccaacauccacucucuc

SEQ ID NO: 2004110 - RNA, 15 nt, Human
ccaacccucaucacc

SEQ ID NO: 2004111 - RNA, 13 nt, Human
ccaacccucauca

SEQ ID NO: 2004112 - RNA, 18 nt, Human
ccaacccuggcacccagg

SEQ ID NO: 2004113 - RNA, 14 nt, Human
ccaaccucgcucca

SEQ ID NO: 2004114 - RNA, 13 nt, Human
ccaaccucuuccu

SEQ ID NO: 2004115 - RNA, 14 nt, Human
ccaaccucuuccuc

SEQ ID NO: 2004116 - RNA, 15 nt, Human
ccaaccucuuccucc

SEQ ID NO: 2004117 - RNA, 17 nt, Human
ccaaccucuuccuccug

SEQ ID NO: 2004118 - RNA, 15 nt, Human
ccaagaccuucuccu

SEQ ID NO: 2004119 - RNA, 12 nt, Human
ccaagagccuga

SEQ ID NO: 2004120 - RNA, 22 nt, Human
ccaagagcaaggaagguaaaaa

SEQ ID NO: 2004121 - RNA, 20 nt, Human
ccaagagcaaggaagguaaa

SEQ ID NO: 2004122 - RNA, 19 nt, Human
ccacaagagcccaggccuc

SEQ ID NO: 2004123 - RNA, 18 nt, Human
ccacaagagcccaggccu

SEQ ID NO: 2004124 - RNA, 17 nt, Human
ccacaagagcccaggcc

SEQ ID NO: 2004125 - RNA, 16 nt, Human
ccacaagagcccaggc

SEQ ID NO: 2004126 - RNA, 21 nt, Human
ccacaagagcccaggccuccu

SEQ ID NO: 2004127 - RNA, 20 nt, Human
ccacaagagcccaggccucc

SEQ ID NO: 2004128 - RNA, 15 nt, Human
ccacaaucaccgaug

SEQ ID NO: 2004129 - RNA, 21 nt, Human
ccacacaacauccaaguggcc

SEQ ID NO: 2004130 - RNA, 15 nt, Human
ccacacaagugcagu

SEQ ID NO: 2004131 - RNA, 12 nt, Human
ccacacacacaa

SEQ ID NO: 2004132 - RNA, 13 nt, Human
ccacacacacaaa

SEQ ID NO: 2004133 - RNA, 20 nt, Human
ccacaagggugcccaccucu

SEQ ID NO: 2004134 - RNA, 13 nt, Human
ccacaaggaagaa

SEQ ID NO: 2004135 - RNA, 16 nt, Human
ccacaaggaagaaauu

SEQ ID NO: 2004136 - RNA, 20 nt, Human
ccacaaguuaaauaaaucau

SEQ ID NO: 2004137 - RNA, 15 nt, Human
ccacaaguuaaauaa

SEQ ID NO: 2004138 - RNA, 18 nt, Human
ccaaggcuagaaccaccu

SEQ ID NO: 2004139 - RNA, 14 nt, Human
ccaagcuccaucuc

SEQ ID NO: 2004140 - RNA, 17 nt, Human
ccaaggcccccugccug

SEQ ID NO: 2004141 - RNA, 19 nt, Human
ccaaggcccccugccugcc

SEQ ID NO: 2004142 - RNA, 20 nt, Human
ccaaggcccccugccugccc

SEQ ID NO: 2004143 - RNA, 21 nt, Human
ccaaggcccccugccugcccu

SEQ ID NO: 2004144 - RNA, 13 nt, Human
ccaagcucccagg

SEQ ID NO: 2004145 - RNA, 12 nt, Human
ccaagcucccag

SEQ ID NO: 2004146 - RNA, 23 nt, Human
ccaagccguggcuucccgcucag

SEQ ID NO: 2004147 - RNA, 13 nt, Human
ccaagcaggaggc

SEQ ID NO: 2004148 - RNA, 14 nt, Human
ccaagcaggaggcu

SEQ ID NO: 2004149 - RNA, 14 nt, Human
ccaagcaggacaug

SEQ ID NO: 2004150 - RNA, 14 nt, Human
ccaagccguggcuu

SEQ ID NO: 2004151 - RNA, 15 nt, Human
ccaagccguggcuuc

SEQ ID NO: 2004152 - RNA, 16 nt, Human
ccaagccguggcuucc

SEQ ID NO: 2004153 - RNA, 17 nt, Human
ccaagccguggcuuccc

SEQ ID NO: 2004154 - RNA, 21 nt, Human
ccaagccguggcuucccgcuc

SEQ ID NO: 2004155 - RNA, 12 nt, Human
ccaagaggcugc

SEQ ID NO: 2004156 - RNA, 13 nt, Human
ccaagaggcugca

SEQ ID NO: 2004157 - RNA, 16 nt, Human
ccaagagccugagagu

SEQ ID NO: 2004158 - RNA, 23 nt, Human
ccaagcagagguugggaggccau

SEQ ID NO: 2004159 - RNA, 20 nt, Human
ccaauauucauagcagcuua

SEQ ID NO: 2004160 - RNA, 16 nt, Human
ccaaguggcucccaca

SEQ ID NO: 2004161 - RNA, 13 nt, Human
ccaaguggcuccc

SEQ ID NO: 2004162 - RNA, 23 nt, Human
ccaaguggagccugacagccaga

SEQ ID NO: 2004163 - RNA, 18 nt, Human
ccaaguggagccugacag

SEQ ID NO: 2004164 - RNA, 22 nt, Human
ccaaguggagccugacagccag

SEQ ID NO: 2004165 - RNA, 19 nt, Human
ccaaggcugauuaaaccaa

SEQ ID NO: 2004166 - RNA, 16 nt, Human
ccaaggcucugagcaa

SEQ ID NO: 2004167 - RNA, 14 nt, Human
ccaaggcuggggga

SEQ ID NO: 2004168 - RNA, 14 nt, Human
ccaagguucugggu

SEQ ID NO: 2004169 - RNA, 10 nt, Human
ccaauuucuc

SEQ ID NO: 2004170 - RNA, 21 nt, Human
ccaauuuuaacuuagagcuuu

SEQ ID NO: 2004171 - RNA, 12 nt, Human
ccaauuuuccuu

SEQ ID NO: 2004172 - RNA, 23 nt, Human
ccaauuuuuuaagugaaaauaua

SEQ ID NO: 2004173 - RNA, 12 nt, Human
ccaauauuuaaa

SEQ ID NO: 2004174 - RNA, 16 nt, Human
ccacaagaaaugaaag

SEQ ID NO: 2004175 - RNA, 22 nt, Human
ccacaagaaaugaaagcaggga

SEQ ID NO: 2004176 - RNA, 13 nt, Human
ccacaagagccca

SEQ ID NO: 2004177 - RNA, 16 nt, Human
ccacaagacccuugug

SEQ ID NO: 2004178 - RNA, 18 nt, Human
ccacaaaggagagcuagc

SEQ ID NO: 2004179 - RNA, 13 nt, Human
ccacaacacacag

SEQ ID NO: 2004180 - RNA, 19 nt, Human
cauugaaaucuuuuugcuu

SEQ ID NO: 2004181 - RNA, 22 nt, Human
cauugaaaauuauuaaucagaa

SEQ ID NO: 2004182 - RNA, 22 nt, Human
cauugaccugaggcccuucucu

SEQ ID NO: 2004183 - RNA, 13 nt, Human
cauugaccugagg

SEQ ID NO: 2004184 - RNA, 16 nt, Human
cauuuccguaauucuu

SEQ ID NO: 2004185 - RNA, 14 nt, Human
cauuuccccagggc

SEQ ID NO: 2004186 - RNA, 15 nt, Human
cauuuccccagggca

SEQ ID NO: 2004187 - RNA, 16 nt, Human
cauuuccccagggcac

SEQ ID NO: 2004188 - RNA, 17 nt, Human
cauuuccccagggcacg

SEQ ID NO: 2004189 - RNA, 16 nt, Human
cauuucucauguugaa

SEQ ID NO: 2004190 - RNA, 17 nt, Human
cauuucucauguugaaa

SEQ ID NO: 2004191 - RNA, 19 nt, Human
cauuuccguaauucuuauu

SEQ ID NO: 2004192 - RNA, 22 nt, Human
cauuuccguaauucuuauucca

SEQ ID NO: 2004193 - RNA, 19 nt, Human
cauuucugauacuuucugu

SEQ ID NO: 2004194 - RNA, 11 nt, Human
cauuucugauu

SEQ ID NO: 2004195 - RNA, 21 nt, Human
cauuucuuccacaagagccca

SEQ ID NO: 2004196 - RNA, 21 nt, Human
cauuuaaaagauacaguuacu

SEQ ID NO: 2004197 - RNA, 21 nt, Human
cauugcaugccgggugcagca

SEQ ID NO: 2004198 - RNA, 16 nt, Human
cauugcauauaacuua

SEQ ID NO: 2004199 - RNA, 22 nt, Human
cauugauuugauuuuuauuauu

SEQ ID NO: 2004200 - RNA, 14 nt, Human
cauugcaacaaaau

SEQ ID NO: 2004201 - RNA, 15 nt, Human
cauugcaacaaaaua

SEQ ID NO: 2004202 - RNA, 21 nt, Human
cauugcaacaaaauacauucu

SEQ ID NO: 2004203 - RNA, 18 nt, Human
cauugagaccgugaagau

SEQ ID NO: 2004204 - RNA, 13 nt, Human
cauugauuugauu

SEQ ID NO: 2004205 - RNA, 16 nt, Human
cauugauuugauuuuu

SEQ ID NO: 2004206 - RNA, 10 nt, Human
cauuuagaau

SEQ ID NO: 2004207 - RNA, 12 nt, Human
cauuuagaaugg

SEQ ID NO: 2004208 - RNA, 19 nt, Human
cauuuagaauggugauuuu

SEQ ID NO: 2004209 - RNA, 18 nt, Human
cauuucccaacacaaaga

SEQ ID NO: 2004210 - RNA, 17 nt, Human
cauuuccauguaugcau

SEQ ID NO: 2004211 - RNA, 20 nt, Human
cauuuagaauggugauuuua

SEQ ID NO: 2004212 - RNA, 21 nt, Human
cauuuagaauggugauuuuaa

SEQ ID NO: 2004213 - RNA, 12 nt, Human
cauuuccaugua

SEQ ID NO: 2004214 - RNA, 14 nt, Human
cauuuccauguaug

SEQ ID NO: 2004215 - RNA, 15 nt, Human
cauuuccauguaugc

SEQ ID NO: 2004216 - RNA, 16 nt, Human
cauuuccauguaugca

SEQ ID NO: 2004217 - RNA, 17 nt, Human
cauuuacuuuguguuca

SEQ ID NO: 2004218 - RNA, 21 nt, Human
cauuuacuuuguguucaccuu

SEQ ID NO: 2004219 - RNA, 23 nt, Human
cauuucuuccacaagagcccagg

SEQ ID NO: 2004220 - RNA, 18 nt, Human
cauuugaggucuguucuu

SEQ ID NO: 2004221 - RNA, 19 nt, Human
cauuugaggucuguucuuu

SEQ ID NO: 2004222 - RNA, 17 nt, Human
cauuugaggucuguucu

SEQ ID NO: 2004223 - RNA, 16 nt, Human
cauuugagcagggcuc

SEQ ID NO: 2004224 - RNA, 14 nt, Human
cauuugagcagggc

SEQ ID NO: 2004225 - RNA, 12 nt, Human
cauuucugauuu

SEQ ID NO: 2004226 - RNA, 18 nt, Human
cauuucugccuuuuguuc

SEQ ID NO: 2004227 - RNA, 24 nt, Human
cauuucugccuuuuguucauuuca

SEQ ID NO: 2004228 - RNA, 14 nt, Human
ccaaagaaugaauu

SEQ ID NO: 2004229 - RNA, 13 nt, Human
ccaaagacaaaua

SEQ ID NO: 2004230 - RNA, 14 nt, Human
ccaaagacaaauag

SEQ ID NO: 2004231 - RNA, 15 nt, Human
ccaaagacaaauagu

SEQ ID NO: 2004232 - RNA, 16 nt, Human
ccaaagacaaauagua

SEQ ID NO: 2004233 - RNA, 18 nt, Human
ccaaaauaaaacuuuuua

SEQ ID NO: 2004234 - RNA, 21 nt, Human
ccaaaauaaaacuuuuuaaaa

SEQ ID NO: 2004235 - RNA, 20 nt, Human
cauuuuuaguagagacaggg

SEQ ID NO: 2004236 - RNA, 14 nt, Human
ccaaaaguuauuaa

SEQ ID NO: 2004237 - RNA, 20 nt, Human
cauuuuuauaccuguuuaaa

SEQ ID NO: 2004238 - RNA, 21 nt, Human
cauuuuuauaccuguuuaaau

SEQ ID NO: 2004239 - RNA, 22 nt, Human
cauuuuuaucaggauuuccucu

SEQ ID NO: 2004240 - RNA, 18 nt, Human
ccaaaauaagaaaagaug

SEQ ID NO: 2004241 - RNA, 14 nt, Human
ccaaaauaagaaaa

SEQ ID NO: 2004242 - RNA, 16 nt, Human
ccaaaauaagaaaaga

SEQ ID NO: 2004243 - RNA, 17 nt, Human
ccaaaauaagaaaagau

SEQ ID NO: 2004244 - RNA, 22 nt, Human
cauuuuggugucuuucucuuuu

SEQ ID NO: 2004245 - RNA, 19 nt, Human
cauuuuggcgcucgaaguu

SEQ ID NO: 2004246 - RNA, 23 nt, Human
cauuuugggguacccacugcucu

SEQ ID NO: 2004247 - RNA, 15 nt, Human
cauuuuuaagugcug

SEQ ID NO: 2004248 - RNA, 20 nt, Human
cauuuuuaagugcugcauuu

SEQ ID NO: 2004249 - RNA, 19 nt, Human
cauuuuuaguagagacagg

SEQ ID NO: 2004250 - RNA, 18 nt, Human
cauuuuuaguagagacag

SEQ ID NO: 2004251 - RNA, 24 nt, Human
cauuuugcuaaaugugaaugauga

SEQ ID NO: 2004252 - RNA, 12 nt, Human
cauuuugcuuua

SEQ ID NO: 2004253 - RNA, 13 nt, Human
cauuuugcuuuaa

SEQ ID NO: 2004254 - RNA, 14 nt, Human
cauuuugcuuuaau

SEQ ID NO: 2004255 - RNA, 18 nt, Human
cauuuugcuuuaauuuua

SEQ ID NO: 2004256 - RNA, 21 nt, Human
cauuuugcuaaaugugaauga

SEQ ID NO: 2004257 - RNA, 18 nt, Human
cauuuugcuaaaugugaa

SEQ ID NO: 2004258 - RNA, 12 nt, Human
cauuuuggcgcu

SEQ ID NO: 2004259 - RNA, 20 nt, Human
cauuuugggguacccacugc

SEQ ID NO: 2004260 - RNA, 21 nt, Human
cauuuugggguacccacugcu

SEQ ID NO: 2004261 - RNA, 22 nt, Human
cauuuugggguacccacugcuc

SEQ ID NO: 2004262 - RNA, 19 nt, Human
cauuuuauuuuauuaugca

SEQ ID NO: 2004263 - RNA, 21 nt, Human
cauuuuauuuuauuaugcaug

SEQ ID NO: 2004264 - RNA, 16 nt, Human
cauuuucuuaauccag

SEQ ID NO: 2004265 - RNA, 22 nt, Human
cauuugaggucuguucuuucca

SEQ ID NO: 2004266 - RNA, 18 nt, Human
cauguuuuucuucucccu

SEQ ID NO: 2004267 - RNA, 15 nt, Human
cauguuuuguuuacg

SEQ ID NO: 2004268 - RNA, 21 nt, Human
cauuaaagccugaguuugcuu

SEQ ID NO: 2004269 - RNA, 21 nt, Human
cauuaccucagugagaagcca

SEQ ID NO: 2004270 - RNA, 22 nt, Human
cauuaccucagugagaagccag

SEQ ID NO: 2004271 - RNA, 13 nt, Human
cauuaauguugau

SEQ ID NO: 2004272 - RNA, 14 nt, Human
cauuaauguugauu

SEQ ID NO: 2004273 - RNA, 16 nt, Human
cauuaauguugauuuc

SEQ ID NO: 2004274 - RNA, 17 nt, Human
cauuaauguugauuucu

SEQ ID NO: 2004275 - RNA, 20 nt, Human
cauuaauguugauuucuagu

SEQ ID NO: 2004276 - RNA, 17 nt, Human
cauuagcaguuugcuuu

SEQ ID NO: 2004277 - RNA, 18 nt, Human
cauuagcaaaaaaaguug

SEQ ID NO: 2004278 - RNA, 19 nt, Human
cauuagcaaaaaaaguugu

SEQ ID NO: 2004279 - RNA, 20 nt, Human
cauuagcaaaaaaaguugua

SEQ ID NO: 2004280 - RNA, 22 nt, Human
cauuagcaaaaaaaguuguaug

SEQ ID NO: 2004281 - RNA, 16 nt, Human
cauuagcaaaaaaagu

SEQ ID NO: 2004282 - RNA, 17 nt, Human
cauuagcaaaaaaaguu

SEQ ID NO: 2004283 - RNA, 15 nt, Human
cauuaccucuuugga

SEQ ID NO: 2004284 - RNA, 17 nt, Human
cauuaccucuuuggaaa

SEQ ID NO: 2004285 - RNA, 23 nt, Human
cauuaccucuuuggaaaaggaag

SEQ ID NO: 2004286 - RNA, 15 nt, Human
cauguuuugcaugua

SEQ ID NO: 2004287 - RNA, 16 nt, Human
cauguuuugcauguaa

SEQ ID NO: 2004288 - RNA, 22 nt, Human
cauguuuucaaauggaguugga

SEQ ID NO: 2004289 - RNA, 13 nt, Human
cauguuuucaaau

SEQ ID NO: 2004290 - RNA, 16 nt, Human
cauguuuucaaaugga

SEQ ID NO: 2004291 - RNA, 20 nt, Human
cauguuuucaaauggaguug

SEQ ID NO: 2004292 - RNA, 23 nt, Human
cauguuugauguaucugagcagg

SEQ ID NO: 2004293 - RNA, 22 nt, Human
cauguuucuuuguaaugaaaac

SEQ ID NO: 2004294 - RNA, 15 nt, Human
cauguuugugauuga

SEQ ID NO: 2004295 - RNA, 14 nt, Human
cauguuuauguaaa

SEQ ID NO: 2004296 - RNA, 21 nt, Human
cauguuucuuuguaaugaaaa

SEQ ID NO: 2004297 - RNA, 20 nt, Human
cauguuucuuuguaaugaaa

SEQ ID NO: 2004298 - RNA, 15 nt, Human
cauguggagucagcc

SEQ ID NO: 2004299 - RNA, 18 nt, Human
cauguggagucagccucg

SEQ ID NO: 2004300 - RNA, 20 nt, Human
cauguggcuugaauuaagaa

SEQ ID NO: 2004301 - RNA, 23 nt, Human
caugugggccacacaagugcagu

SEQ ID NO: 2004302 - RNA, 22 nt, Human
cauguggggagguuaaucuagg

SEQ ID NO: 2004303 - RNA, 21 nt, Human
caugugccagguuuuuggucu

SEQ ID NO: 2004304 - RNA, 15 nt, Human
caugugcuucugcca

SEQ ID NO: 2004305 - RNA, 15 nt, Human
caugugcacaugcac

SEQ ID NO: 2004306 - RNA, 14 nt, Human
cauguaacaauguu

SEQ ID NO: 2004307 - RNA, 20 nt, Human
cauggugacuuuugaaaaga

SEQ ID NO: 2004308 - RNA, 16 nt, Human
cauggucggaaaacau

SEQ ID NO: 2004309 - RNA, 23 nt, Human
caugucuuuucuugcaugaggcu

SEQ ID NO: 2004310 - RNA, 21 nt, Human
caugucuuuucuugcaugagg

SEQ ID NO: 2004311 - RNA, 19 nt, Human
caugucuuuucuugcauga

SEQ ID NO: 2004312 - RNA, 14 nt, Human
caugucuuuucuug

SEQ ID NO: 2004313 - RNA, 17 nt, Human
caugugaaaucauucau

SEQ ID NO: 2004314 - RNA, 16 nt, Human
caugugaaaucauuca

SEQ ID NO: 2004315 - RNA, 15 nt, Human
caugugaaaucauuc

SEQ ID NO: 2004316 - RNA, 21 nt, Human
cauguaauuaaguacuaugua

SEQ ID NO: 2004317 - RNA, 18 nt, Human
cauguaauuaaguacuau

SEQ ID NO: 2004318 - RNA, 14 nt, Human
cauguaauuugugu

SEQ ID NO: 2004319 - RNA, 18 nt, Human
cauguaauuuguguaaau

SEQ ID NO: 2004320 - RNA, 18 nt, Human
caugucgccucugcauuc

SEQ ID NO: 2004321 - RNA, 20 nt, Human
caugucgccucugcauucag

SEQ ID NO: 2004322 - RNA, 15 nt, Human
cauguccugugucag

SEQ ID NO: 2004323 - RNA, 18 nt, Human
cauguccugugucaguuu

SEQ ID NO: 2004324 - RNA, 19 nt, Human
cauguccugugucaguuua

SEQ ID NO: 2004325 - RNA, 20 nt, Human
cauguccugugucaguuuau

SEQ ID NO: 2004326 - RNA, 14 nt, Human
caugucgccucugc

SEQ ID NO: 2004327 - RNA, 15 nt, Human
caugucgccucugca

SEQ ID NO: 2004328 - RNA, 13 nt, Human
caugccccugaac

SEQ ID NO: 2004329 - RNA, 13 nt, Human
caugccaggggcc

SEQ ID NO: 2004330 - RNA, 14 nt, Human
caugccaggggccu

SEQ ID NO: 2004331 - RNA, 19 nt, Human
caugccaggaaccuguccu

SEQ ID NO: 2004332 - RNA, 13 nt, Human
caugccaggaacc

SEQ ID NO: 2004333 - RNA, 20 nt, Human
caugccagcuuaucucaggg

SEQ ID NO: 2004334 - RNA, 19 nt, Human
caugccagcuuaucucagg

SEQ ID NO: 2004335 - RNA, 13 nt, Human
caugccuggaugg

SEQ ID NO: 2004336 - RNA, 19 nt, Human
caugccucucucaggccaa

SEQ ID NO: 2004337 - RNA, 18 nt, Human
caugccucucucaggcca

SEQ ID NO: 2004338 - RNA, 17 nt, Human
caugccucucucaggcc

SEQ ID NO: 2004339 - RNA, 16 nt, Human
caugccucucucaggc

SEQ ID NO: 2004340 - RNA, 15 nt, Human
caugccgggugcagc

SEQ ID NO: 2004341 - RNA, 15 nt, Human
caugccucucucagg

SEQ ID NO: 2004342 - RNA, 14 nt, Human
caugccucucucag

SEQ ID NO: 2004343 - RNA, 21 nt, Human
cauggagauagccccacagga

SEQ ID NO: 2004344 - RNA, 17 nt, Human
cauggagguuugaagau

SEQ ID NO: 2004345 - RNA, 13 nt, Human
cauggacuuuguu

SEQ ID NO: 2004346 - RNA, 11 nt, Human
cauggacuuug

SEQ ID NO: 2004347 - RNA, 16 nt, Human
cauggaguauauguca

SEQ ID NO: 2004348 - RNA, 18 nt, Human
caugggaaugaaugucag

SEQ ID NO: 2004349 - RNA, 14 nt, Human
caugguccauucuc

SEQ ID NO: 2004350 - RNA, 15 nt, Human
cauggggucucucac

SEQ ID NO: 2004351 - RNA, 16 nt, Human
cauggggucucucaca

SEQ ID NO: 2004352 - RNA, 19 nt, Human
cauggggucucucacagac

SEQ ID NO: 2004353 - RNA, 23 nt, Human
cauggggucucucacagacagga

SEQ ID NO: 2004354 - RNA, 19 nt, Human
cauggggcugauuguauuu

SEQ ID NO: 2004355 - RNA, 16 nt, Human
caugggccuccugugu

SEQ ID NO: 2004356 - RNA, 17 nt, Human
caugggccuccugugug

SEQ ID NO: 2004357 - RNA, 17 nt, Human
caugggacagggaggac

SEQ ID NO: 2004358 - RNA, 22 nt, Human
caugggaaugaaugucagugug

SEQ ID NO: 2004359 - RNA, 15 nt, Human
caugggccuccugug

SEQ ID NO: 2004360 - RNA, 22 nt, Human
cauggaaguacuauaauuuacc

SEQ ID NO: 2004361 - RNA, 20 nt, Human
cauggaaguacuauaauuua

SEQ ID NO: 2004362 - RNA, 18 nt, Human
cauggacaugaucuucuu

SEQ ID NO: 2004363 - RNA, 16 nt, Human
cauggaauaacaugua

SEQ ID NO: 2004364 - RNA, 20 nt, Human
caugcuguucaugaaagauu

SEQ ID NO: 2004365 - RNA, 19 nt, Human
caugcugucuggcacagcc

SEQ ID NO: 2004366 - RNA, 20 nt, Human
caugcugucuggcacagccu

SEQ ID NO: 2004367 - RNA, 21 nt, Human
caugcugucuggcacagccug

SEQ ID NO: 2004368 - RNA, 23 nt, Human
caugcugucuggcacagccugca

SEQ ID NO: 2004369 - RNA, 12 nt, Human
caugcugucugg

SEQ ID NO: 2004370 - RNA, 17 nt, Human
caugcugucuggcacag

SEQ ID NO: 2004371 - RNA, 18 nt, Human
caugcugucuggcacagc

SEQ ID NO: 2004372 - RNA, 22 nt, Human
caugcugucccuuacgugaguc

SEQ ID NO: 2004373 - RNA, 21 nt, Human
caugccuggauggggcugcac

SEQ ID NO: 2004374 - RNA, 18 nt, Human
caugccuggauggggcug

SEQ ID NO: 2004375 - RNA, 23 nt, Human
caugccuggauggggcugcaccg

SEQ ID NO: 2004376 - RNA, 12 nt, Human
caguggcagcug

SEQ ID NO: 2004377 - RNA, 21 nt, Human
caguggagugcaaaaggcuug

SEQ ID NO: 2004378 - RNA, 19 nt, Human
caguggagugcaaaaggcu

SEQ ID NO: 2004379 - RNA, 13 nt, Human
caguggagcccag

SEQ ID NO: 2004380 - RNA, 16 nt, Human
caguggagcccaggag

SEQ ID NO: 2004381 - RNA, 17 nt, Human
caguggagcccaggagu

SEQ ID NO: 2004382 - RNA, 13 nt, Human
caguggcagcugc

SEQ ID NO: 2004383 - RNA, 14 nt, Human
caguggcagcugcu

SEQ ID NO: 2004384 - RNA, 15 nt, Human
caguggcagcugcuu

SEQ ID NO: 2004385 - RNA, 16 nt, Human
caguggcagcugcuuu

SEQ ID NO: 2004386 - RNA, 12 nt, Human
caguggcagggc

SEQ ID NO: 2004387 - RNA, 13 nt, Human
caguggcagggca

SEQ ID NO: 2004388 - RNA, 14 nt, Human
caguggcagggcac

SEQ ID NO: 2004389 - RNA, 15 nt, Human
caguggcagggcaca

SEQ ID NO: 2004390 - RNA, 16 nt, Human
caguggcagggcacag

SEQ ID NO: 2004391 - RNA, 17 nt, Human
caguggcagggcacagg

SEQ ID NO: 2004392 - RNA, 19 nt, Human
caguggcagggcacagggc

SEQ ID NO: 2004393 - RNA, 20 nt, Human
caguggcagggcacagggcc

SEQ ID NO: 2004394 - RNA, 20 nt, Human
caguggcgaaaucccugcuc

SEQ ID NO: 2004395 - RNA, 21 nt, Human
caguggcgaaaucccugcuca

SEQ ID NO: 2004396 - RNA, 22 nt, Human
caguggcgaaaucccugcucac

SEQ ID NO: 2004397 - RNA, 23 nt, Human
caguggcgaaaucccugcucacu

SEQ ID NO: 2004398 - RNA, 23 nt, Human
caguggcugaguagcucugccuu

SEQ ID NO: 2004399 - RNA, 19 nt, Human
caguggcgaaaucccugcu

SEQ ID NO: 2004400 - RNA, 16 nt, Human
caguggcuggaucugu

SEQ ID NO: 2004401 - RNA, 18 nt, Human
caguggcuggaucuguga

SEQ ID NO: 2004402 - RNA, 20 nt, Human
caguggcuggaucugugagg

SEQ ID NO: 2004403 - RNA, 22 nt, Human
cagugguuccuaauccucuagg

SEQ ID NO: 2004404 - RNA, 11 nt, Human
cagugguuaag

SEQ ID NO: 2004405 - RNA, 11 nt, Human
cagugggaacu

SEQ ID NO: 2004406 - RNA, 12 nt, Human
cagugugauuuu

SEQ ID NO: 2004407 - RNA, 17 nt, Human
cagugugagggaaagag

SEQ ID NO: 2004408 - RNA, 19 nt, Human
cagugugagggaaagagcu

SEQ ID NO: 2004409 - RNA, 17 nt, Human
caguguguggucaacau

SEQ ID NO: 2004410 - RNA, 21 nt, Human
caguguguggucaacauuucu

SEQ ID NO: 2004411 - RNA, 19 nt, Human
caguguggccucuucugag

SEQ ID NO: 2004412 - RNA, 17 nt, Human
cagugucuggcugcaga

SEQ ID NO: 2004413 - RNA, 19 nt, Human
cagugucuggcugcagagc

SEQ ID NO: 2004414 - RNA, 12 nt, Human
cagugugacuga

SEQ ID NO: 2004415 - RNA, 14 nt, Human
cagugugacaagga

SEQ ID NO: 2004416 - RNA, 20 nt, Human
caguguccauggacucagaa

SEQ ID NO: 2004417 - RNA, 22 nt, Human
caguguccauggacucagaaac

SEQ ID NO: 2004418 - RNA, 14 nt, Human
cagugucaaugcag

SEQ ID NO: 2004419 - RNA, 23 nt, Human
caguguacauggaauaacaugua

SEQ ID NO: 2004420 - RNA, 20 nt, Human
caguguacauggaauaacau

SEQ ID NO: 2004421 - RNA, 15 nt, Human
caguguaccauuaaa

SEQ ID NO: 2004422 - RNA, 17 nt, Human
caguguaccauuaaaau

SEQ ID NO: 2004423 - RNA, 18 nt, Human
caguguaccauuaaaaua

SEQ ID NO: 2004424 - RNA, 21 nt, Human
caguguaccauuaaaauaugc

SEQ ID NO: 2004425 - RNA, 22 nt, Human
caguguaccauuaaaauaugca

SEQ ID NO: 2004426 - RNA, 16 nt, Human
caguguacauggaaua

SEQ ID NO: 2004427 - RNA, 19 nt, Human
caguugaaaaacagcugag

SEQ ID NO: 2004428 - RNA, 18 nt, Human
caguugaaaaacagcuga

SEQ ID NO: 2004429 - RNA, 12 nt, Human
caguugaaaaac

SEQ ID NO: 2004430 - RNA, 16 nt, Human
caguucucuucacuca

SEQ ID NO: 2004431 - RNA, 22 nt, Human
caguucucuccuucuucccccc

SEQ ID NO: 2004432 - RNA, 15 nt, Human
caguucucuccuucu

SEQ ID NO: 2004433 - RNA, 14 nt, Human
caguucucuccuuc

SEQ ID NO: 2004434 - RNA, 13 nt, Human
caguucucuccuu

SEQ ID NO: 2004435 - RNA, 22 nt, Human
caguucggugagcuacaaaugc

SEQ ID NO: 2004436 - RNA, 14 nt, Human
caguuacucagaau

SEQ ID NO: 2004437 - RNA, 17 nt, Human
caguuccccuggaagca

SEQ ID NO: 2004438 - RNA, 21 nt, Human
caguuccccuggaagcagugc

SEQ ID NO: 2004439 - RNA, 14 nt, Human
caguuaagagaaau

SEQ ID NO: 2004440 - RNA, 13 nt, Human
caguuaagagaaa

SEQ ID NO: 2004441 - RNA, 14 nt, Human
caguuaagccuuug

SEQ ID NO: 2004442 - RNA, 15 nt, Human
caguuaagccuuugg

SEQ ID NO: 2004443 - RNA, 17 nt, Human
caguuaagccuuuggaa

SEQ ID NO: 2004444 - RNA, 20 nt, Human
caguuaagccuuuggaaaca

SEQ ID NO: 2004445 - RNA, 14 nt, Human
caguuacaaauuau

SEQ ID NO: 2004446 - RNA, 18 nt, Human
caguuacaaauuauaaug

SEQ ID NO: 2004447 - RNA, 19 nt, Human
caguuacaaauuauaaugu

SEQ ID NO: 2004448 - RNA, 22 nt, Human
caguuacaaauuauaauguauu

SEQ ID NO: 2004449 - RNA, 18 nt, Human
caguguuccgugguuaaa

SEQ ID NO: 2004450 - RNA, 19 nt, Human
caguguuguggauuuaaca

SEQ ID NO: 2004451 - RNA, 20 nt, Human
caguguuguggauuuaacag

SEQ ID NO: 2004452 - RNA, 22 nt, Human
caguguuguggauuuaacagaa

SEQ ID NO: 2004453 - RNA, 14 nt, Human
caguguuucugggg

SEQ ID NO: 2004454 - RNA, 13 nt, Human
caguguuuggugc

SEQ ID NO: 2004455 - RNA, 13 nt, Human
caguguuugugug

SEQ ID NO: 2004456 - RNA, 21 nt, Human
caguguuuugaccuuugauac

SEQ ID NO: 2004457 - RNA, 21 nt, Human
caguucuuuaagaagaucuuu

SEQ ID NO: 2004458 - RNA, 20 nt, Human
caguugagaggacacucccg

SEQ ID NO: 2004459 - RNA, 19 nt, Human
caguugagaggacacuccc

SEQ ID NO: 2004460 - RNA, 22 nt, Human
caguuggucccccuuccaugga

SEQ ID NO: 2004461 - RNA, 21 nt, Human
caguuggucccccuuccaugg

SEQ ID NO: 2004462 - RNA, 20 nt, Human
caguuggucccccuuccaug

SEQ ID NO: 2004463 - RNA, 19 nt, Human
caguuggucccccuuccau

SEQ ID NO: 2004464 - RNA, 18 nt, Human
caguuggucccccuucca

SEQ ID NO: 2004465 - RNA, 18 nt, Human
caguuggguggaugccug

SEQ ID NO: 2004466 - RNA, 19 nt, Human
caguuggguggaugccugg

SEQ ID NO: 2004467 - RNA, 23 nt, Human
caguugccagucaccccggccac

SEQ ID NO: 2004468 - RNA, 14 nt, Human
caguugcccagccu

SEQ ID NO: 2004469 - RNA, 16 nt, Human
caguugcccagccucu

SEQ ID NO: 2004470 - RNA, 17 nt, Human
caguugcccagccucuu

SEQ ID NO: 2004471 - RNA, 18 nt, Human
caguugcccagccucuuu

SEQ ID NO: 2004472 - RNA, 19 nt, Human
caguugcccagccucuuuc

SEQ ID NO: 2004473 - RNA, 21 nt, Human
caguugcccagccucuuuccc

SEQ ID NO: 2004474 - RNA, 14 nt, Human
caguugcugguaaa

SEQ ID NO: 2004475 - RNA, 13 nt, Human
caguugcugguaa

SEQ ID NO: 2004476 - RNA, 17 nt, Human
caguugcugguaaaaug

SEQ ID NO: 2004477 - RNA, 18 nt, Human
caguugcugguaaaauga

SEQ ID NO: 2004478 - RNA, 19 nt, Human
caguugcugguaaaaugaa

SEQ ID NO: 2004479 - RNA, 20 nt, Human
caguugcugguaaaaugaag

SEQ ID NO: 2004480 - RNA, 16 nt, Human
caguuggguggaugcc

SEQ ID NO: 2004481 - RNA, 21 nt, Human
caguugcugguaaaaugaaga

SEQ ID NO: 2004482 - RNA, 22 nt, Human
caguugcugguaaaaugaagaa

SEQ ID NO: 2004483 - RNA, 23 nt, Human
caguugcugguaaaaugaagaau

SEQ ID NO: 2004484 - RNA, 22 nt, Human
caguugcugucagucuugaccu

SEQ ID NO: 2004485 - RNA, 22 nt, Human
caguuguaacauucuauuucaa

SEQ ID NO: 2004486 - RNA, 17 nt, Human
caguuguuagugugucu

SEQ ID NO: 2004487 - RNA, 21 nt, Human
caguuguuaaguccuuggcuu

SEQ ID NO: 2004488 - RNA, 23 nt, Human
caguuuuucauaagauauuuuau

SEQ ID NO: 2004489 - RNA, 21 nt, Human
caguuuuucauaagauauuuu

SEQ ID NO: 2004490 - RNA, 13 nt, Human
caguuuuucuuaa

SEQ ID NO: 2004491 - RNA, 13 nt, Human
caguuuuuguguu

SEQ ID NO: 2004492 - RNA, 15 nt, Human
caguuuuucuuaaua

SEQ ID NO: 2004493 - RNA, 16 nt, Human
caguuuuucuuaauau

SEQ ID NO: 2004494 - RNA, 19 nt, Human
caguuuuucuuaauauaua

SEQ ID NO: 2004495 - RNA, 21 nt, Human
cauaaaaauuagccaagugug

SEQ ID NO: 2004496 - RNA, 19 nt, Human
cauaaaauaaggagcauau

SEQ ID NO: 2004497 - RNA, 22 nt, Human
cauaaaauguccaguaagauca

SEQ ID NO: 2004498 - RNA, 22 nt, Human
cauaaacaagaccacguuucua

SEQ ID NO: 2004499 - RNA, 11 nt, Human
cauaaacauca

SEQ ID NO: 2004500 - RNA, 22 nt, Human
cauaaacaucagguuaggcagu

SEQ ID NO: 2004501 - RNA, 20 nt, Human
cauaaacaagaccacguuuc

SEQ ID NO: 2004502 - RNA, 21 nt, Human
cauaaacaagaccacguuucu

SEQ ID NO: 2004503 - RNA, 16 nt, Human
cauaaagcaggcagaa

SEQ ID NO: 2004504 - RNA, 14 nt, Human
cauaaagcaggcag

SEQ ID NO: 2004505 - RNA, 13 nt, Human
cauaaagaauuug

SEQ ID NO: 2004506 - RNA, 22 nt, Human
cauaaagaauuugucacaggaa

SEQ ID NO: 2004507 - RNA, 16 nt, Human
cauaaaucuuccaaag

SEQ ID NO: 2004508 - RNA, 19 nt, Human
cauaaauuuaguauuuugu

SEQ ID NO: 2004509 - RNA, 20 nt, Human
cauaaauuuaguauuuuguu

SEQ ID NO: 2004510 - RNA, 16 nt, Human
cauaaccuagccuuag

SEQ ID NO: 2004511 - RNA, 18 nt, Human
cauaaucacaacccuuca

SEQ ID NO: 2004512 - RNA, 15 nt, Human
cauaauacuugcuuu

SEQ ID NO: 2004513 - RNA, 18 nt, Human
cauaauaauccugcaaag

SEQ ID NO: 2004514 - RNA, 15 nt, Human
cauaauacugaacca

SEQ ID NO: 2004515 - RNA, 16 nt, Human
cauaauacugaaccac

SEQ ID NO: 2004516 - RNA, 17 nt, Human
cauaauacugaaccacu

SEQ ID NO: 2004517 - RNA, 18 nt, Human
cauaauacugaaccacuu

SEQ ID NO: 2004518 - RNA, 13 nt, Human
cauaccacuuuug

SEQ ID NO: 2004519 - RNA, 14 nt, Human
cauaccacuuuugu

SEQ ID NO: 2004520 - RNA, 15 nt, Human
cauaccacuuuuguu

SEQ ID NO: 2004521 - RNA, 18 nt, Human
cauaccacuuuuguucuu

SEQ ID NO: 2004522 - RNA, 12 nt, Human
cauacccacccc

SEQ ID NO: 2004523 - RNA, 11 nt, Human
cauacccaccc

SEQ ID NO: 2004524 - RNA, 19 nt, Human
cauaccacuuuuguucuug

SEQ ID NO: 2004525 - RNA, 20 nt, Human
cauaccaacucaacuuuuuu

SEQ ID NO: 2004526 - RNA, 14 nt, Human
cauaagauaaaugu

SEQ ID NO: 2004527 - RNA, 15 nt, Human
cauaagauauuuuau

SEQ ID NO: 2004528 - RNA, 15 nt, Human
cauaagcaacaauuu

SEQ ID NO: 2004529 - RNA, 17 nt, Human
cauaagcaacaauuuuc

SEQ ID NO: 2004530 - RNA, 21 nt, Human
cauaagcaacaauuuucagau

SEQ ID NO: 2004531 - RNA, 18 nt, Human
cauaaggucagcucagag

SEQ ID NO: 2004532 - RNA, 16 nt, Human
cauaagcuuuuucucu

SEQ ID NO: 2004533 - RNA, 17 nt, Human
cauaaguauuuggaauu

SEQ ID NO: 2004534 - RNA, 18 nt, Human
cauaauaaaaggcuuuga

SEQ ID NO: 2004535 - RNA, 22 nt, Human
cauaaguauuuggaauuagaac

SEQ ID NO: 2004536 - RNA, 15 nt, Human
cauaccuggcccugu

SEQ ID NO: 2004537 - RNA, 21 nt, Human
cauacccacccccacccaagg

SEQ ID NO: 2004538 - RNA, 18 nt, Human
cauacccacccccaccca

SEQ ID NO: 2004539 - RNA, 17 nt, Human
cauacccacccccaccc

SEQ ID NO: 2004540 - RNA, 14 nt, Human
cauacccaccccca

SEQ ID NO: 2004541 - RNA, 17 nt, Human
cauacguacacauuuua

SEQ ID NO: 2004542 - RNA, 18 nt, Human
cauacguacacauuuuau

SEQ ID NO: 2004543 - RNA, 14 nt, Human
cauacuaaccagca

SEQ ID NO: 2004544 - RNA, 21 nt, Human
cauacuaaccagcagaaaugc

SEQ ID NO: 2004545 - RNA, 15 nt, Human
cauacguacacauuu

SEQ ID NO: 2004546 - RNA, 16 nt, Human
cauacguacacauuuu

SEQ ID NO: 2004547 - RNA, 13 nt, Human
cauacguacacau

SEQ ID NO: 2004548 - RNA, 14 nt, Human
cauacguaaaaauc

SEQ ID NO: 2004549 - RNA, 15 nt, Human
cauacguaaaaaucu

SEQ ID NO: 2004550 - RNA, 17 nt, Human
cauaccuuggccagcaa

SEQ ID NO: 2004551 - RNA, 20 nt, Human
cauacuaauuauacccccug

SEQ ID NO: 2004552 - RNA, 16 nt, Human
cauacgugugcaugug

SEQ ID NO: 2004553 - RNA, 21 nt, Human
caucccugaaggccccgccca

SEQ ID NO: 2004554 - RNA, 19 nt, Human
caucccugaaggccccgcc

SEQ ID NO: 2004555 - RNA, 18 nt, Human
caucccugaaggccccgc

SEQ ID NO: 2004556 - RNA, 17 nt, Human
caucccugaaggccccg

SEQ ID NO: 2004557 - RNA, 22 nt, Human
caucccugaaggccccgcccag

SEQ ID NO: 2004558 - RNA, 17 nt, Human
cauccggggccagcucc

SEQ ID NO: 2004559 - RNA, 18 nt, Human
cauccggggccagcuccg

SEQ ID NO: 2004560 - RNA, 14 nt, Human
cauccuaacuccau

SEQ ID NO: 2004561 - RNA, 21 nt, Human
cauccuaacuccaugucucug

SEQ ID NO: 2004562 - RNA, 12 nt, Human
caucauuucugg

SEQ ID NO: 2004563 - RNA, 21 nt, Human
caucauugaaaucuuuuugcu

SEQ ID NO: 2004564 - RNA, 20 nt, Human
caucauugaaaucuuuuugc

SEQ ID NO: 2004565 - RNA, 15 nt, Human
caucauugaaaucuu

SEQ ID NO: 2004566 - RNA, 14 nt, Human
caucauugaaaucu

SEQ ID NO: 2004567 - RNA, 15 nt, Human
caucaccaacgucug

SEQ ID NO: 2004568 - RNA, 13 nt, Human
caucauugaaauc

SEQ ID NO: 2004569 - RNA, 20 nt, Human
cauccaccguccccucccag

SEQ ID NO: 2004570 - RNA, 14 nt, Human
cauccacagucucc

SEQ ID NO: 2004571 - RNA, 17 nt, Human
cauccaccguccccucc

SEQ ID NO: 2004572 - RNA, 23 nt, Human
cauccacaaaugcaguuuuagaa

SEQ ID NO: 2004573 - RNA, 14 nt, Human
cauccaaguggccu

SEQ ID NO: 2004574 - RNA, 19 nt, Human
caucccucuggggcuguuc

SEQ ID NO: 2004575 - RNA, 13 nt, Human
caucccugaaggc

SEQ ID NO: 2004576 - RNA, 11 nt, Human
caucccugaag

SEQ ID NO: 2004577 - RNA, 15 nt, Human
cauccagguucagcu

SEQ ID NO: 2004578 - RNA, 22 nt, Human
caucuuccaaggguacuaagga

SEQ ID NO: 2004579 - RNA, 16 nt, Human
caucucuuguuuaaau

SEQ ID NO: 2004580 - RNA, 14 nt, Human
caucugagaaugaa

SEQ ID NO: 2004581 - RNA, 16 nt, Human
caucugagaaugaaca

SEQ ID NO: 2004582 - RNA, 20 nt, Human
caucugagagaggcuaaaau

SEQ ID NO: 2004583 - RNA, 22 nt, Human
caucugagagaggcuaaaaugu

SEQ ID NO: 2004584 - RNA, 23 nt, Human
caucugagagaggcuaaaauguu

SEQ ID NO: 2004585 - RNA, 14 nt, Human
caucugauuccagc

SEQ ID NO: 2004586 - RNA, 14 nt, Human
caucuccacuccag

SEQ ID NO: 2004587 - RNA, 22 nt, Human
caucucuucuggguuccuuccu

SEQ ID NO: 2004588 - RNA, 15 nt, Human
caucuugacagagcc

SEQ ID NO: 2004589 - RNA, 20 nt, Human
caucuugacagagccugccc

SEQ ID NO: 2004590 - RNA, 22 nt, Human
caucuugacagagccugcccca

SEQ ID NO: 2004591 - RNA, 13 nt, Human
caucuugcucugc

SEQ ID NO: 2004592 - RNA, 14 nt, Human
caucuugcucugcu

SEQ ID NO: 2004593 - RNA, 20 nt, Human
caucuugcucugcugacaga

SEQ ID NO: 2004594 - RNA, 16 nt, Human
cauccucauacccacc

SEQ ID NO: 2004595 - RNA, 15 nt, Human
cauccucauacccac

SEQ ID NO: 2004596 - RNA, 16 nt, Human
cauccuacaagacaca

SEQ ID NO: 2004597 - RNA, 19 nt, Human
cauccuccucagaucuucu

SEQ ID NO: 2004598 - RNA, 18 nt, Human
cauccuccucagaucuuc

SEQ ID NO: 2004599 - RNA, 16 nt, Human
cauccuccucagaucu

SEQ ID NO: 2004600 - RNA, 15 nt, Human
cauccuccucagauc

SEQ ID NO: 2004601 - RNA, 12 nt, Human
cauccuccucag

SEQ ID NO: 2004602 - RNA, 11 nt, Human
cauccuccuca

SEQ ID NO: 2004603 - RNA, 20 nt, Human
cauccuccgccucccggguu

SEQ ID NO: 2004604 - RNA, 13 nt, Human
cauccuccagggc

SEQ ID NO: 2004605 - RNA, 22 nt, Human
cauccucauacccacccccacc

SEQ ID NO: 2004606 - RNA, 21 nt, Human
cauccucauacccacccccac

SEQ ID NO: 2004607 - RNA, 18 nt, Human
cauccucauacccacccc

SEQ ID NO: 2004608 - RNA, 17 nt, Human
cauccucauacccaccc

SEQ ID NO: 2004609 - RNA, 13 nt, Human
cauccucccaagg

SEQ ID NO: 2004610 - RNA, 18 nt, Human
cauccucuguacagagcc

SEQ ID NO: 2004611 - RNA, 15 nt, Human
cauccucuguacaga

SEQ ID NO: 2004612 - RNA, 20 nt, Human
cauccuccuccgauuucuaa

SEQ ID NO: 2004613 - RNA, 15 nt, Human
cauccuccuccuucc

SEQ ID NO: 2004614 - RNA, 16 nt, Human
cauccuccuccuuccu

SEQ ID NO: 2004615 - RNA, 17 nt, Human
cauccuccuccuuccua

SEQ ID NO: 2004616 - RNA, 19 nt, Human
cauccucuguacagagccc

SEQ ID NO: 2004617 - RNA, 21 nt, Human
cauccucuguacagagcccac

SEQ ID NO: 2004618 - RNA, 18 nt, Human
cauccuccuccuuccuag

SEQ ID NO: 2004619 - RNA, 18 nt, Human
caucuagguaaauuacag

SEQ ID NO: 2004620 - RNA, 17 nt, Human
caucuagguaaauuaca

SEQ ID NO: 2004621 - RNA, 18 nt, Human
caucuaggggagccuuga

SEQ ID NO: 2004622 - RNA, 12 nt, Human
caucuaggauuu

SEQ ID NO: 2004623 - RNA, 15 nt, Human
caucuacccuccgau

SEQ ID NO: 2004624 - RNA, 23 nt, Human
caucuaauuuuauuuugugaagu

SEQ ID NO: 2004625 - RNA, 19 nt, Human
caucuaggggagccuugau

SEQ ID NO: 2004626 - RNA, 20 nt, Human
caucuaggggagccuugauu

SEQ ID NO: 2004627 - RNA, 17 nt, Human
caucucacacaugagca

SEQ ID NO: 2004628 - RNA, 16 nt, Human
caucucacacaugagc

SEQ ID NO: 2004629 - RNA, 20 nt, Human
caucucacacaugagcauca

SEQ ID NO: 2004630 - RNA, 13 nt, Human
caucucacagcua

SEQ ID NO: 2004631 - RNA, 13 nt, Human
caucucagcccac

SEQ ID NO: 2004632 - RNA, 18 nt, Human
cauacuucaugaaauccu

SEQ ID NO: 2004633 - RNA, 20 nt, Human
cauagaaacugucuagcacu

SEQ ID NO: 2004634 - RNA, 23 nt, Human
cauagaaaguaaauaaaaggacu

SEQ ID NO: 2004635 - RNA, 23 nt, Human
cauagagagcaagacgcugugcu

SEQ ID NO: 2004636 - RNA, 21 nt, Human
cauagagagcaagacgcugug

SEQ ID NO: 2004637 - RNA, 19 nt, Human
cauagagagcaagacgcug

SEQ ID NO: 2004638 - RNA, 20 nt, Human
cauagaauaaaauuuuuaau

SEQ ID NO: 2004639 - RNA, 22 nt, Human
cauagaauugcaaucuauaaua

SEQ ID NO: 2004640 - RNA, 20 nt, Human
cauagaauugcaaucuauaa

SEQ ID NO: 2004641 - RNA, 14 nt, Human
cauagaauaaaauu

SEQ ID NO: 2004642 - RNA, 20 nt, Human
cauacucccaucugugaaag

SEQ ID NO: 2004643 - RNA, 18 nt, Human
cauacucccaucugugaa

SEQ ID NO: 2004644 - RNA, 15 nt, Human
cauacucccaucugu

SEQ ID NO: 2004645 - RNA, 16 nt, Human
cauacucccaucugug

SEQ ID NO: 2004646 - RNA, 14 nt, Human
cauacucaugcaug

SEQ ID NO: 2004647 - RNA, 17 nt, Human
cauacuccuaugcuuua

SEQ ID NO: 2004648 - RNA, 18 nt, Human
cauacuccuaugcuuuag

SEQ ID NO: 2004649 - RNA, 15 nt, Human
cauacucgagucuga

SEQ ID NO: 2004650 - RNA, 16 nt, Human
cauacucgagucugag

SEQ ID NO: 2004651 - RNA, 17 nt, Human
cauacucgagucugagg

SEQ ID NO: 2004652 - RNA, 18 nt, Human
cauacucgagucugaggc

SEQ ID NO: 2004653 - RNA, 19 nt, Human
cauacucgagucugaggcc

SEQ ID NO: 2004654 - RNA, 11 nt, Human
cauacucugcu

SEQ ID NO: 2004655 - RNA, 18 nt, Human
cauaguaugguggcuggg

SEQ ID NO: 2004656 - RNA, 19 nt, Human
cauaguaugguggcugggu

SEQ ID NO: 2004657 - RNA, 20 nt, Human
cauaguaugguggcuggguu

SEQ ID NO: 2004658 - RNA, 22 nt, Human
cauagugaugguuccccuguuc

SEQ ID NO: 2004659 - RNA, 14 nt, Human
cauagaguacacug

SEQ ID NO: 2004660 - RNA, 15 nt, Human
cauagaguacacugc

SEQ ID NO: 2004661 - RNA, 17 nt, Human
cauagaguacacugccu

SEQ ID NO: 2004662 - RNA, 18 nt, Human
cauagaguacacugccug

SEQ ID NO: 2004663 - RNA, 19 nt, Human
cauagaguacacugccugc

SEQ ID NO: 2004664 - RNA, 22 nt, Human
cauaguucuagugcagcugaaa

SEQ ID NO: 2004665 - RNA, 21 nt, Human
cauaguuacuguaaaaugcaa

SEQ ID NO: 2004666 - RNA, 17 nt, Human
cauaguuacuguaaaau

SEQ ID NO: 2004667 - RNA, 19 nt, Human
cauaguuacuguaaaaugc

SEQ ID NO: 2004668 - RNA, 22 nt, Human
cauaguggcuuaaaacaacacu

SEQ ID NO: 2004669 - RNA, 20 nt, Human
cauaguuaaagaagacauuu

SEQ ID NO: 2004670 - RNA, 13 nt, Human
cauaguuacugua

SEQ ID NO: 2004671 - RNA, 15 nt, Human
cauaguuacuguaaa

SEQ ID NO: 2004672 - RNA, 17 nt, Human
cauauaaaauggcaaca

SEQ ID NO: 2004673 - RNA, 18 nt, Human
cauauaaaauggcaacaa

SEQ ID NO: 2004674 - RNA, 19 nt, Human
cauaguuuuauuuauauuu

SEQ ID NO: 2004675 - RNA, 15 nt, Human
cauaguuuuauuuau

SEQ ID NO: 2004676 - RNA, 16 nt, Human
cauaguuuuauuuaua

SEQ ID NO: 2004677 - RNA, 21 nt, Human
cauauaaaauggcaacaaacu

SEQ ID NO: 2004678 - RNA, 18 nt, Human
cauauccauagugacuuu

SEQ ID NO: 2004679 - RNA, 19 nt, Human
cauauccauagugacuuuu

SEQ ID NO: 2004680 - RNA, 18 nt, Human
cauauccccuauuuaaca

SEQ ID NO: 2004681 - RNA, 21 nt, Human
cauaugauguacauguacuga

SEQ ID NO: 2004682 - RNA, 17 nt, Human
cauaugauguacaugua

SEQ ID NO: 2004683 - RNA, 15 nt, Human
cauaugauguacaug

SEQ ID NO: 2004684 - RNA, 23 nt, Human
cauauauauguuuuaagaggcag

SEQ ID NO: 2004685 - RNA, 13 nt, Human
cauauauauaugu

SEQ ID NO: 2004686 - RNA, 14 nt, Human
cauauauauaugug

SEQ ID NO: 2004687 - RNA, 15 nt, Human
cauauauauaugugu

SEQ ID NO: 2004688 - RNA, 22 nt, Human
cauauauauguuuuaagaggca

SEQ ID NO: 2004689 - RNA, 17 nt, Human
cauauauauaugugugu

SEQ ID NO: 2004690 - RNA, 18 nt, Human
cauauacaacaccaaaaa

SEQ ID NO: 2004691 - RNA, 20 nt, Human
cauauacaacaccaaaaaau

SEQ ID NO: 2004692 - RNA, 22 nt, Human
cauauacaacaccaaaaaauau

SEQ ID NO: 2004693 - RNA, 23 nt, Human
cauauacaacaccaaaaaauauc

SEQ ID NO: 2004694 - RNA, 12 nt, Human
cauauuuucaug

SEQ ID NO: 2004695 - RNA, 13 nt, Human
cauauuuuuacaa

SEQ ID NO: 2004696 - RNA, 14 nt, Human
cauauuuuucaaaa

SEQ ID NO: 2004697 - RNA, 15 nt, Human
cauauuuuuuuccuu

SEQ ID NO: 2004698 - RNA, 18 nt, Human
cauauuuuuuuccuuaca

SEQ ID NO: 2004699 - RNA, 22 nt, Human
cauauuuuuuuccuuacauaaa

SEQ ID NO: 2004700 - RNA, 18 nt, Human
caucaaugaaugaaugaa

SEQ ID NO: 2004701 - RNA, 14 nt, Human
caucaagaugugac

SEQ ID NO: 2004702 - RNA, 22 nt, Human
caucaagucuuucacauuuaaa

SEQ ID NO: 2004703 - RNA, 21 nt, Human
caucaagaggugggagggccc

SEQ ID NO: 2004704 - RNA, 18 nt, Human
cauauuuuaaacagagga

SEQ ID NO: 2004705 - RNA, 24 nt, Human
cauauuucuaauuggcuuuacuau

SEQ ID NO: 2004706 - RNA, 16 nt, Human
cauauuuuaauuucaa

SEQ ID NO: 2004707 - RNA, 14 nt, Human
cauauuuuaauuuc

SEQ ID NO: 2004708 - RNA, 15 nt, Human
cauauuuuaauuuca

SEQ ID NO: 2004709 - RNA, 23 nt, Human
cauauuuuaauuucaagcuuauu

SEQ ID NO: 2004710 - RNA, 17 nt, Human
cauauuuauaaaaauaa

SEQ ID NO: 2004711 - RNA, 17 nt, Human
cauauuuacuucuuaua

SEQ ID NO: 2004712 - RNA, 16 nt, Human
cauauuuacuucuuau

SEQ ID NO: 2004713 - RNA, 20 nt, Human
cauauuuacuucuuauacau

SEQ ID NO: 2004714 - RNA, 12 nt, Human
cauauuuauaaa

SEQ ID NO: 2004715 - RNA, 14 nt, Human
cauauuuacuucuu

SEQ ID NO: 2004716 - RNA, 13 nt, Human
cauaugccugggc

SEQ ID NO: 2004717 - RNA, 14 nt, Human
agggacugagaaau

SEQ ID NO: 2004718 - RNA, 13 nt, Human
agggacugagaaa

SEQ ID NO: 2004719 - RNA, 15 nt, Human
agggacugagaaauu

SEQ ID NO: 2004720 - RNA, 17 nt, Human
agggacugagaaauuua

SEQ ID NO: 2004721 - RNA, 15 nt, Human
agggaugcauggaga

SEQ ID NO: 2004722 - RNA, 14 nt, Human
agggaugguguuca

SEQ ID NO: 2004723 - RNA, 16 nt, Human
agggauggaggaagaa

SEQ ID NO: 2004724 - RNA, 22 nt, Human
agggauuccuaaucacucagag

SEQ ID NO: 2004725 - RNA, 21 nt, Human
agggcuaggaauauagauuaa

SEQ ID NO: 2004726 - RNA, 14 nt, Human
agggcucaacacug

SEQ ID NO: 2004727 - RNA, 15 nt, Human
agggcuaggaauaua

SEQ ID NO: 2004728 - RNA, 16 nt, Human
agggcuaggaauauag

SEQ ID NO: 2004729 - RNA, 18 nt, Human
agggccuggcucaggugg

SEQ ID NO: 2004730 - RNA, 13 nt, Human
agggccugggccu

SEQ ID NO: 2004731 - RNA, 16 nt, Human
agggccugggccuggc

SEQ ID NO: 2004732 - RNA, 17 nt, Human
agggccugggccuggcu

SEQ ID NO: 2004733 - RNA, 19 nt, Human
agggccugggccuggcucc

SEQ ID NO: 2004734 - RNA, 20 nt, Human
agggccugggccuggcuccc

SEQ ID NO: 2004735 - RNA, 21 nt, Human
agggccugggccuggcucccu

SEQ ID NO: 2004736 - RNA, 22 nt, Human
agggauuuggggcucagagugg

SEQ ID NO: 2004737 - RNA, 17 nt, Human
agggauugauuuuaaaa

SEQ ID NO: 2004738 - RNA, 19 nt, Human
agggauugauuuuaaaaug

SEQ ID NO: 2004739 - RNA, 14 nt, Human
agggauugauuuua

SEQ ID NO: 2004740 - RNA, 14 nt, Human
agggccuggcucag

SEQ ID NO: 2004741 - RNA, 13 nt, Human
agggccuggcuca

SEQ ID NO: 2004742 - RNA, 20 nt, Human
aggcccucugcccacucccu

SEQ ID NO: 2004743 - RNA, 19 nt, Human
aggcccucugcccacuccc

SEQ ID NO: 2004744 - RNA, 19 nt, Human
aggccagggagcaguggcu

SEQ ID NO: 2004745 - RNA, 22 nt, Human
aggcucuggagcccacuguacu

SEQ ID NO: 2004746 - RNA, 13 nt, Human
aggcugaggacuu

SEQ ID NO: 2004747 - RNA, 11 nt, Human
aggcugaggac

SEQ ID NO: 2004748 - RNA, 13 nt, Human
aggcucuucuccu

SEQ ID NO: 2004749 - RNA, 11 nt, Human
aggcugagccu

SEQ ID NO: 2004750 - RNA, 13 nt, Human
aggcugagccuca

SEQ ID NO: 2004751 - RNA, 19 nt, Human
aggcuguugaauggaauuu

SEQ ID NO: 2004752 - RNA, 13 nt, Human
agggacagucuca

SEQ ID NO: 2004753 - RNA, 16 nt, Human
agggacagucucacca

SEQ ID NO: 2004754 - RNA, 12 nt, Human
aggcugucaauu

SEQ ID NO: 2004755 - RNA, 19 nt, Human
aggcugucaauuacaggaa

SEQ ID NO: 2004756 - RNA, 24 nt, Human
aggcuguaucccaugagccucagc

SEQ ID NO: 2004757 - RNA, 16 nt, Human
aggcuguauucagcaa

SEQ ID NO: 2004758 - RNA, 19 nt, Human
aggcugcagugagccgaga

SEQ ID NO: 2004759 - RNA, 17 nt, Human
aggcugcagugagccga

SEQ ID NO: 2004760 - RNA, 23 nt, Human
aggcuguaucccaugagccucag

SEQ ID NO: 2004761 - RNA, 14 nt, Human
aggcagaaagcaaa

SEQ ID NO: 2004762 - RNA, 16 nt, Human
aggcagaaagcaaaau

SEQ ID NO: 2004763 - RNA, 19 nt, Human
aggcagaaagcaaaauuau

SEQ ID NO: 2004764 - RNA, 16 nt, Human
aggcacuucugccuga

SEQ ID NO: 2004765 - RNA, 15 nt, Human
aggcacuucugccug

SEQ ID NO: 2004766 - RNA, 16 nt, Human
aggcagccaggccaca

SEQ ID NO: 2004767 - RNA, 15 nt, Human
aggcagccaggccac

SEQ ID NO: 2004768 - RNA, 14 nt, Human
aggcagccaggcca

SEQ ID NO: 2004769 - RNA, 22 nt, Human
aggcagaacucaucuagguaaa

SEQ ID NO: 2004770 - RNA, 20 nt, Human
aggcagagguugcagugagc

SEQ ID NO: 2004771 - RNA, 13 nt, Human
aggcagauacagg

SEQ ID NO: 2004772 - RNA, 17 nt, Human
aggcaucgcaauguaag

SEQ ID NO: 2004773 - RNA, 11 nt, Human
aggcaugaagg

SEQ ID NO: 2004774 - RNA, 24 nt, Human
aggcaugugaugagaggaaaucac

SEQ ID NO: 2004775 - RNA, 23 nt, Human
aggcaugugaugagaggaaauca

SEQ ID NO: 2004776 - RNA, 12 nt, Human
aggcauguucuc

SEQ ID NO: 2004777 - RNA, 23 nt, Human
aggcauuccccaggaggccagcc

SEQ ID NO: 2004778 - RNA, 22 nt, Human
aggcauuccccaggaggccagc

SEQ ID NO: 2004779 - RNA, 12 nt, Human
aggccagcugcu

SEQ ID NO: 2004780 - RNA, 21 nt, Human
aggcauuccccaggaggccag

SEQ ID NO: 2004781 - RNA, 20 nt, Human
aggcauguucucugaggaca

SEQ ID NO: 2004782 - RNA, 22 nt, Human
aggcauguucucugaggacacu

SEQ ID NO: 2004783 - RNA, 23 nt, Human
aggccaggcccucugcccacucc

SEQ ID NO: 2004784 - RNA, 19 nt, Human
aggccaggcccucugccca

SEQ ID NO: 2004785 - RNA, 18 nt, Human
aggccaggcccucugccc

SEQ ID NO: 2004786 - RNA, 17 nt, Human
aggccaggcccucugcc

SEQ ID NO: 2004787 - RNA, 16 nt, Human
aggccaggcccucugc

SEQ ID NO: 2004788 - RNA, 16 nt, Human
aggccagcugcuuggg

SEQ ID NO: 2004789 - RNA, 14 nt, Human
aggccagcugcuug

SEQ ID NO: 2004790 - RNA, 13 nt, Human
aggccagcugcuu

SEQ ID NO: 2004791 - RNA, 14 nt, Human
aggccaugggccuc

SEQ ID NO: 2004792 - RNA, 16 nt, Human
aggccaugggccuccu

SEQ ID NO: 2004793 - RNA, 17 nt, Human
aggcccucugcccacuc

SEQ ID NO: 2004794 - RNA, 17 nt, Human
aggccaugggccuccug

SEQ ID NO: 2004795 - RNA, 19 nt, Human
aggccagggggccaguccc

SEQ ID NO: 2004796 - RNA, 23 nt, Human
aggccagggggccagucccugag

SEQ ID NO: 2004797 - RNA, 16 nt, Human
aggaugugcugcagug

SEQ ID NO: 2004798 - RNA, 13 nt, Human
aggaugucugggc

SEQ ID NO: 2004799 - RNA, 16 nt, Human
aggaugggcuucugug

SEQ ID NO: 2004800 - RNA, 17 nt, Human
aggaugggcuucugugc

SEQ ID NO: 2004801 - RNA, 14 nt, Human
aggaggucucuaag

SEQ ID NO: 2004802 - RNA, 13 nt, Human
aggaaguagagga

SEQ ID NO: 2004803 - RNA, 19 nt, Human
aggaaguacuggagaaaau

SEQ ID NO: 2004804 - RNA, 16 nt, Human
aggagagcccuucauu

SEQ ID NO: 2004805 - RNA, 15 nt, Human
aggaggucucuaaga

SEQ ID NO: 2004806 - RNA, 12 nt, Human
aggagugagcac

SEQ ID NO: 2004807 - RNA, 19 nt, Human
aggagguuggagggaaagc

SEQ ID NO: 2004808 - RNA, 13 nt, Human
aggaguaaaagag

SEQ ID NO: 2004809 - RNA, 14 nt, Human
aggagugagcacua

SEQ ID NO: 2004810 - RNA, 21 nt, Human
aggagugaaacaucauagaaa

SEQ ID NO: 2004811 - RNA, 20 nt, Human
aggagugcguggcccaccag

SEQ ID NO: 2004812 - RNA, 21 nt, Human
aggagugaucgucagaugugu

SEQ ID NO: 2004813 - RNA, 22 nt, Human
aggagugcguggcccaccaggc

SEQ ID NO: 2004814 - RNA, 23 nt, Human
aggaguucgaguuacagccuggg

SEQ ID NO: 2004815 - RNA, 18 nt, Human
aggaguuucguuuucaaa

SEQ ID NO: 2004816 - RNA, 19 nt, Human
agcuaagguuuagauaaau

SEQ ID NO: 2004817 - RNA, 13 nt, Human
agcuaaugggaca

SEQ ID NO: 2004818 - RNA, 14 nt, Human
agcuaaugggacac

SEQ ID NO: 2004819 - RNA, 15 nt, Human
agcuaaugggacacu

SEQ ID NO: 2004820 - RNA, 12 nt, Human
agcuacaaaugc

SEQ ID NO: 2004821 - RNA, 13 nt, Human
agcucaccagccc

SEQ ID NO: 2004822 - RNA, 14 nt, Human
agcucaccagcccc

SEQ ID NO: 2004823 - RNA, 15 nt, Human
agcucaccagcccca

SEQ ID NO: 2004824 - RNA, 21 nt, Human
agcucaccagccccagugccc

SEQ ID NO: 2004825 - RNA, 17 nt, Human
agcuacaacuaauaaca

SEQ ID NO: 2004826 - RNA, 13 nt, Human
agcuacaaaugca

SEQ ID NO: 2004827 - RNA, 13 nt, Human
agcgaauuuuaaa

SEQ ID NO: 2004828 - RNA, 15 nt, Human
agcgaauuuuaaaag

SEQ ID NO: 2004829 - RNA, 16 nt, Human
agcgaauuuuaaaaga

SEQ ID NO: 2004830 - RNA, 13 nt, Human
agcgacagugaga

SEQ ID NO: 2004831 - RNA, 15 nt, Human
agcgacagugagacu

SEQ ID NO: 2004832 - RNA, 17 nt, Human
agcgauucuucugcuuc

SEQ ID NO: 2004833 - RNA, 19 nt, Human
agcgauucuucugcuucag

SEQ ID NO: 2004834 - RNA, 17 nt, Human
agcgacaacagauugga

SEQ ID NO: 2004835 - RNA, 13 nt, Human
agcgacagagcag

SEQ ID NO: 2004836 - RNA, 15 nt, Human
agcgauucuucugcu

SEQ ID NO: 2004837 - RNA, 20 nt, Human
agcuaacauggaaguacuau

SEQ ID NO: 2004838 - RNA, 19 nt, Human
agcuaacauggaaguacua

SEQ ID NO: 2004839 - RNA, 19 nt, Human
agcgauucucuugccucag

SEQ ID NO: 2004840 - RNA, 13 nt, Human
agccuuucauuuu

SEQ ID NO: 2004841 - RNA, 16 nt, Human
agccuuucauuuugcu

SEQ ID NO: 2004842 - RNA, 22 nt, Human
agccugggauaggggcagagga

SEQ ID NO: 2004843 - RNA, 15 nt, Human
agccuuucuuuucuu

SEQ ID NO: 2004844 - RNA, 17 nt, Human
agccuuucauuuugcuu

SEQ ID NO: 2004845 - RNA, 18 nt, Human
agccuuucauuuugcuuu

SEQ ID NO: 2004846 - RNA, 19 nt, Human
agccuuucauuuugcuuua

SEQ ID NO: 2004847 - RNA, 20 nt, Human
agccuuucauuuugcuuuaa

SEQ ID NO: 2004848 - RNA, 21 nt, Human
agccuuucauuuugcuuuaau

SEQ ID NO: 2004849 - RNA, 23 nt, Human
agccuuucauuuugcuuuaauuu

SEQ ID NO: 2004850 - RNA, 13 nt, Human
agcgaacugacau

SEQ ID NO: 2004851 - RNA, 14 nt, Human
agccuuuuugaaag

SEQ ID NO: 2004852 - RNA, 19 nt, Human
agccuuucuuuucuuucuu

SEQ ID NO: 2004853 - RNA, 16 nt, Human
agccuuuuucuaggcc

SEQ ID NO: 2004854 - RNA, 18 nt, Human
agccugggcaaugugaua

SEQ ID NO: 2004855 - RNA, 20 nt, Human
agccugggauaggggcagag

SEQ ID NO: 2004856 - RNA, 17 nt, Human
agccugcugccugcuuu

SEQ ID NO: 2004857 - RNA, 17 nt, Human
agccugcuccuucccuu

SEQ ID NO: 2004858 - RNA, 14 nt, Human
agccuggacccugu

SEQ ID NO: 2004859 - RNA, 18 nt, Human
agccuggaaaccugucug

SEQ ID NO: 2004860 - RNA, 19 nt, Human
agccuggaaaccugucuga

SEQ ID NO: 2004861 - RNA, 20 nt, Human
agccuggcacagggcagugg

SEQ ID NO: 2004862 - RNA, 17 nt, Human
agccuggcacagggcag

SEQ ID NO: 2004863 - RNA, 18 nt, Human
agccuggcacagggcagu

SEQ ID NO: 2004864 - RNA, 22 nt, Human
agcucaccagccccagugccca

SEQ ID NO: 2004865 - RNA, 23 nt, Human
agcucaccagccccagugcccac

SEQ ID NO: 2004866 - RNA, 16 nt, Human
agcucuuggcuccacu

SEQ ID NO: 2004867 - RNA, 21 nt, Human
agcugacuuuucuguccgagc

SEQ ID NO: 2004868 - RNA, 15 nt, Human
agcugacuuuucugu

SEQ ID NO: 2004869 - RNA, 19 nt, Human
agcugacuuucaaagugga

SEQ ID NO: 2004870 - RNA, 16 nt, Human
agcugguugagguuuc

SEQ ID NO: 2004871 - RNA, 20 nt, Human
agcuggguuggaaaacagua

SEQ ID NO: 2004872 - RNA, 16 nt, Human
agcuggguuggaaaac

SEQ ID NO: 2004873 - RNA, 14 nt, Human
agcuggguuggaaa

SEQ ID NO: 2004874 - RNA, 15 nt, Human
agcuggucccacuca

SEQ ID NO: 2004875 - RNA, 16 nt, Human
agcugucaaggcucag

SEQ ID NO: 2004876 - RNA, 16 nt, Human
aggaagaaauuaacuu

SEQ ID NO: 2004877 - RNA, 19 nt, Human
aggaagaacugaaaggcuu

SEQ ID NO: 2004878 - RNA, 14 nt, Human
aggaagguagaaau

SEQ ID NO: 2004879 - RNA, 15 nt, Human
aggaaguacuggaga

SEQ ID NO: 2004880 - RNA, 11 nt, Human
aggaaguacug

SEQ ID NO: 2004881 - RNA, 14 nt, Human
aggaaggucauuuc

SEQ ID NO: 2004882 - RNA, 16 nt, Human
aggaaggucauuucca

SEQ ID NO: 2004883 - RNA, 18 nt, Human
aggaaggucauuuccaug

SEQ ID NO: 2004884 - RNA, 12 nt, Human
aggaacacuccu

SEQ ID NO: 2004885 - RNA, 12 nt, Human
aggaaaaauuca

SEQ ID NO: 2004886 - RNA, 20 nt, Human
aggaaaaccaagccguggcu

SEQ ID NO: 2004887 - RNA, 21 nt, Human
aggaaaaccaagccguggcuu

SEQ ID NO: 2004888 - RNA, 22 nt, Human
aggaaaaccaagccguggcuuc

SEQ ID NO: 2004889 - RNA, 23 nt, Human
aggaaaaccaagccguggcuucc

SEQ ID NO: 2004890 - RNA, 11 nt, Human
aggaagaaauu

SEQ ID NO: 2004891 - RNA, 23 nt, Human
aggaacuuaaauaaugugaaacu

SEQ ID NO: 2004892 - RNA, 15 nt, Human
aggaacacuccuuca

SEQ ID NO: 2004893 - RNA, 21 nt, Human
agcuuuguuuguugucagcug

SEQ ID NO: 2004894 - RNA, 22 nt, Human
agcuuuguuuguugucagcuga

SEQ ID NO: 2004895 - RNA, 13 nt, Human
agcuuuguuuguu

SEQ ID NO: 2004896 - RNA, 15 nt, Human
agcuuuguuuguucu

SEQ ID NO: 2004897 - RNA, 18 nt, Human
agcuuuguuuagucuuua

SEQ ID NO: 2004898 - RNA, 20 nt, Human
agcuuuguuuagucuuuaua

SEQ ID NO: 2004899 - RNA, 19 nt, Human
agcuuuuuucucugauaca

SEQ ID NO: 2004900 - RNA, 16 nt, Human
agcuuuguuuguucuu

SEQ ID NO: 2004901 - RNA, 17 nt, Human
agcuuuguuuguucuug

SEQ ID NO: 2004902 - RNA, 20 nt, Human
agcuuuuuucucugauacag

SEQ ID NO: 2004903 - RNA, 22 nt, Human
agcuuuuuucucugauacagaa

SEQ ID NO: 2004904 - RNA, 22 nt, Human
agcuuuuuuuuuuuaauuuugu

SEQ ID NO: 2004905 - RNA, 23 nt, Human
agcuuuuuucucugauacagaaa

SEQ ID NO: 2004906 - RNA, 16 nt, Human
aggaaaaaauugcuuu

SEQ ID NO: 2004907 - RNA, 19 nt, Human
aggaaaaccaagccguggc

SEQ ID NO: 2004908 - RNA, 18 nt, Human
aggaaaaaauaacaauga

SEQ ID NO: 2004909 - RNA, 16 nt, Human
agacucuuuggacacu

SEQ ID NO: 2004910 - RNA, 14 nt, Human
agagaaauauuuua

SEQ ID NO: 2004911 - RNA, 15 nt, Human
agagaaauauuuuaa

SEQ ID NO: 2004912 - RNA, 18 nt, Human
agagaaauauuuuaauuu

SEQ ID NO: 2004913 - RNA, 23 nt, Human
agagaaauauuuuaauuuuuaaa

SEQ ID NO: 2004914 - RNA, 12 nt, Human
agagaaaugaaa

SEQ ID NO: 2004915 - RNA, 22 nt, Human
agagaaguggacuggaggagcu

SEQ ID NO: 2004916 - RNA, 18 nt, Human
agagaagugacgguuccu

SEQ ID NO: 2004917 - RNA, 19 nt, Human
agagaagugacgguuccua

SEQ ID NO: 2004918 - RNA, 13 nt, Human
agagaaagaaauu

SEQ ID NO: 2004919 - RNA, 15 nt, Human
agagcccagaguccc

SEQ ID NO: 2004920 - RNA, 18 nt, Human
agagcccagagucccccc

SEQ ID NO: 2004921 - RNA, 22 nt, Human
agagcccagaguccccccacuc

SEQ ID NO: 2004922 - RNA, 12 nt, Human
agagccugcccc

SEQ ID NO: 2004923 - RNA, 13 nt, Human
agagccugcccca

SEQ ID NO: 2004924 - RNA, 16 nt, Human
agagccugccccagcg

SEQ ID NO: 2004925 - RNA, 17 nt, Human
agagccugccccagcgc

SEQ ID NO: 2004926 - RNA, 19 nt, Human
agagccugccccagcgcug

SEQ ID NO: 2004927 - RNA, 23 nt, Human
agagagcaagacgcugugcugcc

SEQ ID NO: 2004928 - RNA, 14 nt, Human
agagagauguguaa

SEQ ID NO: 2004929 - RNA, 18 nt, Human
agagagauguguaauuuu

SEQ ID NO: 2004930 - RNA, 19 nt, Human
agagagauguguaauuuuu

SEQ ID NO: 2004931 - RNA, 19 nt, Human
agagagcaagacgcugugc

SEQ ID NO: 2004932 - RNA, 11 nt, Human
agagagcaaga

SEQ ID NO: 2004933 - RNA, 18 nt, Human
agagcccacgcccccacu

SEQ ID NO: 2004934 - RNA, 20 nt, Human
agacgcugugcugcccugcc

SEQ ID NO: 2004935 - RNA, 19 nt, Human
agacgcugugcugcccugc

SEQ ID NO: 2004936 - RNA, 18 nt, Human
agacgcugugcugcccug

SEQ ID NO: 2004937 - RNA, 15 nt, Human
agacgacagccccug

SEQ ID NO: 2004938 - RNA, 17 nt, Human
agacgcugugcugcccu

SEQ ID NO: 2004939 - RNA, 15 nt, Human
agacuaucuaaaugu

SEQ ID NO: 2004940 - RNA, 23 nt, Human
agacagcccgggcucugccuccc

SEQ ID NO: 2004941 - RNA, 22 nt, Human
agacagcccgggcucugccucc

SEQ ID NO: 2004942 - RNA, 14 nt, Human
agacaauuuauuau

SEQ ID NO: 2004943 - RNA, 21 nt, Human
agacagcccgggcucugccuc

SEQ ID NO: 2004944 - RNA, 13 nt, Human
agacagcccucca

SEQ ID NO: 2004945 - RNA, 23 nt, Human
agaccaucccugaaggccccgcc

SEQ ID NO: 2004946 - RNA, 14 nt, Human
agaccacguuucua

SEQ ID NO: 2004947 - RNA, 14 nt, Human
agacgaacauguag

SEQ ID NO: 2004948 - RNA, 18 nt, Human
agacgaaacauuuguucu

SEQ ID NO: 2004949 - RNA, 20 nt, Human
agacaaugugaaaagaaaaa

SEQ ID NO: 2004950 - RNA, 18 nt, Human
agacaagcuguugaccag

SEQ ID NO: 2004951 - RNA, 22 nt, Human
agacaagcuguugaccaggcac

SEQ ID NO: 2004952 - RNA, 19 nt, Human
agacaaggaaaaaauaaca

SEQ ID NO: 2004953 - RNA, 14 nt, Human
agaauuuuuuauuu

SEQ ID NO: 2004954 - RNA, 15 nt, Human
agaauuuugagcagg

SEQ ID NO: 2004955 - RNA, 14 nt, Human
agaauuuugugaaa

SEQ ID NO: 2004956 - RNA, 22 nt, Human
agaauuuugugaaacagacuug

SEQ ID NO: 2004957 - RNA, 18 nt, Human
agaacaacauauacaaca

SEQ ID NO: 2004958 - RNA, 13 nt, Human
agaacacugccaa

SEQ ID NO: 2004959 - RNA, 18 nt, Human
agaaccaaaaagaggcua

SEQ ID NO: 2004960 - RNA, 17 nt, Human
agaaccaaaaagaggcu

SEQ ID NO: 2004961 - RNA, 17 nt, Human
agaacaucccuccuggg

SEQ ID NO: 2004962 - RNA, 13 nt, Human
agaacaucccucc

SEQ ID NO: 2004963 - RNA, 22 nt, Human
agaacagugauuaccagggacu

SEQ ID NO: 2004964 - RNA, 17 nt, Human
agaacagguuuuuuugu

SEQ ID NO: 2004965 - RNA, 18 nt, Human
agaacagguuuuuuuguu

SEQ ID NO: 2004966 - RNA, 21 nt, Human
agaacagguuuuuuuguuugu

SEQ ID NO: 2004967 - RNA, 12 nt, Human
agaacagcuguu

SEQ ID NO: 2004968 - RNA, 15 nt, Human
agaacagcuguugac

SEQ ID NO: 2004969 - RNA, 16 nt, Human
agaacagauaaagauu

SEQ ID NO: 2004970 - RNA, 12 nt, Human
agaaugaggcug

SEQ ID NO: 2004971 - RNA, 13 nt, Human
agaaugaggcugc

SEQ ID NO: 2004972 - RNA, 14 nt, Human
agaaugaggcugcu

SEQ ID NO: 2004973 - RNA, 20 nt, Human
agaaugaggcugcuuuccaa

SEQ ID NO: 2004974 - RNA, 23 nt, Human
agaaugcacaaacagaggccgcc

SEQ ID NO: 2004975 - RNA, 15 nt, Human
agaaugaguuucuua

SEQ ID NO: 2004976 - RNA, 14 nt, Human
agaaugaguuucuu

SEQ ID NO: 2004977 - RNA, 18 nt, Human
agaaugcucuuuacuuca

SEQ ID NO: 2004978 - RNA, 23 nt, Human
agaaugcaugcuuuccauauuuu

SEQ ID NO: 2004979 - RNA, 13 nt, Human
agaaugaugguuu

SEQ ID NO: 2004980 - RNA, 21 nt, Human
agaaugaugguuuccaauuuc

SEQ ID NO: 2004981 - RNA, 18 nt, Human
agaaugcaccauacucau

SEQ ID NO: 2004982 - RNA, 16 nt, Human
agaaugcaugcuuucc

SEQ ID NO: 2004983 - RNA, 18 nt, Human
agaaugcaugcuuuccau

SEQ ID NO: 2004984 - RNA, 16 nt, Human
agaaugaaagggccca

SEQ ID NO: 2004985 - RNA, 17 nt, Human
agaaucucaaauaacua

SEQ ID NO: 2004986 - RNA, 18 nt, Human
agaaucucaacaugucuc

SEQ ID NO: 2004987 - RNA, 12 nt, Human
agaagagcccca

SEQ ID NO: 2004988 - RNA, 13 nt, Human
agaagagccccac

SEQ ID NO: 2004989 - RNA, 23 nt, Human
agaagagaaugcacaaacagagg

SEQ ID NO: 2004990 - RNA, 15 nt, Human
agaagagaaugcaca

SEQ ID NO: 2004991 - RNA, 14 nt, Human
agaagagccccacu

SEQ ID NO: 2004992 - RNA, 17 nt, Human
agaagagccccacucuc

SEQ ID NO: 2004993 - RNA, 20 nt, Human
agaagagccccacucucaga

SEQ ID NO: 2004994 - RNA, 22 nt, Human
agaagagccccacucucagagg

SEQ ID NO: 2004995 - RNA, 21 nt, Human
agaaccaaaaagaggcuaugu

SEQ ID NO: 2004996 - RNA, 17 nt, Human
agaaccaggcaacuugg

SEQ ID NO: 2004997 - RNA, 17 nt, Human
agaaccagucuuucaac

SEQ ID NO: 2004998 - RNA, 19 nt, Human
agaaccagucuuucaacuc

SEQ ID NO: 2004999 - RNA, 20 nt, Human
agaaccaggcaacuugggaa

SEQ ID NO: 2005000 - RNA, 22 nt, Human
agaaccagucuuucaacucauu

SEQ ID NO: 2005001 - RNA, 19 nt, Human
agaagucuuagauguauau

SEQ ID NO: 2005002 - RNA, 17 nt, Human
agaagucuuagauguau

SEQ ID NO: 2005003 - RNA, 18 nt, Human
agaagucuucuauuuauu

SEQ ID NO: 2005004 - RNA, 13 nt, Human
agaagucuucaug

SEQ ID NO: 2005005 - RNA, 16 nt, Human
agaagucuucaugaaa

SEQ ID NO: 2005006 - RNA, 18 nt, Human
agaagucuucaugaaaug

SEQ ID NO: 2005007 - RNA, 19 nt, Human
agaagucuucaugaaaugc

SEQ ID NO: 2005008 - RNA, 14 nt, Human
agaagucacacagu

SEQ ID NO: 2005009 - RNA, 13 nt, Human
agaaguccagagu

SEQ ID NO: 2005010 - RNA, 15 nt, Human
agaagucaacauccu

SEQ ID NO: 2005011 - RNA, 13 nt, Human
agaagaucuuugg

SEQ ID NO: 2005012 - RNA, 15 nt, Human
agaagaucuuugggc

SEQ ID NO: 2005013 - RNA, 18 nt, Human
agaagggagcuggcucca

SEQ ID NO: 2005014 - RNA, 20 nt, Human
agaaggggacugccaccucc

SEQ ID NO: 2005015 - RNA, 15 nt, Human
agaaggggacugcca

SEQ ID NO: 2005016 - RNA, 16 nt, Human
agaaggggacugccac

SEQ ID NO: 2005017 - RNA, 19 nt, Human
agaaggggacugccaccuc

SEQ ID NO: 2005018 - RNA, 21 nt, Human
agcacagacccugcccugugg

SEQ ID NO: 2005019 - RNA, 18 nt, Human
agcacagaggccuccugu

SEQ ID NO: 2005020 - RNA, 17 nt, Human
agcaauucuccugccuc

SEQ ID NO: 2005021 - RNA, 18 nt, Human
agcaauucuccugccuca

SEQ ID NO: 2005022 - RNA, 19 nt, Human
agcaauucuccugccucag

SEQ ID NO: 2005023 - RNA, 20 nt, Human
agcaauucuccugccucagc

SEQ ID NO: 2005024 - RNA, 15 nt, Human
agcaauucuccugcc

SEQ ID NO: 2005025 - RNA, 14 nt, Human
agcagugggccugg

SEQ ID NO: 2005026 - RNA, 17 nt, Human
agcagugcaugcugucc

SEQ ID NO: 2005027 - RNA, 23 nt, Human
agcagugauauucuuuguuaauu

SEQ ID NO: 2005028 - RNA, 16 nt, Human
agcaguggagcccagg

SEQ ID NO: 2005029 - RNA, 18 nt, Human
agcaguggagcccaggag

SEQ ID NO: 2005030 - RNA, 19 nt, Human
agcagcguuucuaugacac

SEQ ID NO: 2005031 - RNA, 18 nt, Human
agcagcguuucuaugaca

SEQ ID NO: 2005032 - RNA, 20 nt, Human
agcagccuggacccugugga

SEQ ID NO: 2005033 - RNA, 16 nt, Human
agcagugcaugcuguc

SEQ ID NO: 2005034 - RNA, 13 nt, Human
agcagugcaugcu

SEQ ID NO: 2005035 - RNA, 16 nt, Human
agcagccuggacccug

SEQ ID NO: 2005036 - RNA, 14 nt, Human
agccaagaggcugc

SEQ ID NO: 2005037 - RNA, 15 nt, Human
agccaagaggcugca

SEQ ID NO: 2005038 - RNA, 22 nt, Human
agccagauuucacucuccuugg

SEQ ID NO: 2005039 - RNA, 20 nt, Human
agccagauuucacucuccuu

SEQ ID NO: 2005040 - RNA, 17 nt, Human
agccagauuucacucuc

SEQ ID NO: 2005041 - RNA, 14 nt, Human
agccagauuucacu

SEQ ID NO: 2005042 - RNA, 13 nt, Human
agcaucucccagu

SEQ ID NO: 2005043 - RNA, 17 nt, Human
agcaucuggaagagcua

SEQ ID NO: 2005044 - RNA, 17 nt, Human
agccaacuauggccugu

SEQ ID NO: 2005045 - RNA, 19 nt, Human
agcccacgcccccacuggu

SEQ ID NO: 2005046 - RNA, 18 nt, Human
agcccacgcccccacugg

SEQ ID NO: 2005047 - RNA, 17 nt, Human
agcccacgcccccacug

SEQ ID NO: 2005048 - RNA, 23 nt, Human
agcccaccccucaacaccucugc

SEQ ID NO: 2005049 - RNA, 13 nt, Human
agcccaccuuggc

SEQ ID NO: 2005050 - RNA, 17 nt, Human
agcccaaaccaccagaa

SEQ ID NO: 2005051 - RNA, 19 nt, Human
agcccaaaccaccagaagc

SEQ ID NO: 2005052 - RNA, 20 nt, Human
agcccaaaccaccagaagcc

SEQ ID NO: 2005053 - RNA, 22 nt, Human
agcccaaaccaccagaagccca

SEQ ID NO: 2005054 - RNA, 23 nt, Human
agccagcaggcucucaggccagc

SEQ ID NO: 2005055 - RNA, 21 nt, Human
agccagcaggcucucaggcca

SEQ ID NO: 2005056 - RNA, 22 nt, Human
agccagcaggcucucaggccag

SEQ ID NO: 2005057 - RNA, 16 nt, Human
agcaucuaugugagac

SEQ ID NO: 2005058 - RNA, 14 nt, Human
agauaugauucaaa

SEQ ID NO: 2005059 - RNA, 15 nt, Human
agauaugauucaaau

SEQ ID NO: 2005060 - RNA, 16 nt, Human
agauaugauucaaaug

SEQ ID NO: 2005061 - RNA, 15 nt, Human
agauauacuuguuuu

SEQ ID NO: 2005062 - RNA, 20 nt, Human
agauauacuuguuuuuguaa

SEQ ID NO: 2005063 - RNA, 21 nt, Human
agauauacuuguuuuuguaaa

SEQ ID NO: 2005064 - RNA, 23 nt, Human
agauauacuuguuuuuguaaaga

SEQ ID NO: 2005065 - RNA, 19 nt, Human
agagugggguagguuggga

SEQ ID NO: 2005066 - RNA, 15 nt, Human
agaguggcuccuccc

SEQ ID NO: 2005067 - RNA, 12 nt, Human
agaguggcuccu

SEQ ID NO: 2005068 - RNA, 13 nt, Human
agaguggcuccuc

SEQ ID NO: 2005069 - RNA, 14 nt, Human
agaguggcuccucc

SEQ ID NO: 2005070 - RNA, 20 nt, Human
agagggucugaggaauccag

SEQ ID NO: 2005071 - RNA, 21 nt, Human
agaggguaauaaccagacaca

SEQ ID NO: 2005072 - RNA, 19 nt, Human
agagggugauaauagaaga

SEQ ID NO: 2005073 - RNA, 19 nt, Human
agagggugaguccuccaga

SEQ ID NO: 2005074 - RNA, 20 nt, Human
agagggugaguccuccagaa

SEQ ID NO: 2005075 - RNA, 21 nt, Human
agagggugaguccuccagaac

SEQ ID NO: 2005076 - RNA, 23 nt, Human
agaggggguggccucccaacuca

SEQ ID NO: 2005077 - RNA, 13 nt, Human
agaguugaagaca

SEQ ID NO: 2005078 - RNA, 11 nt, Human
agaguguaaaa

SEQ ID NO: 2005079 - RNA, 21 nt, Human
agauagagagugaguacaugc

SEQ ID NO: 2005080 - RNA, 15 nt, Human
agaguugaagacaga

SEQ ID NO: 2005081 - RNA, 14 nt, Human
agaguugaagacag

SEQ ID NO: 2005082 - RNA, 20 nt, Human
agauaggaaggucauuucca

SEQ ID NO: 2005083 - RNA, 21 nt, Human
agauaggaaggucauuuccau

SEQ ID NO: 2005084 - RNA, 19 nt, Human
agauagccccacaggaggu

SEQ ID NO: 2005085 - RNA, 13 nt, Human
agauagaguaaaa

SEQ ID NO: 2005086 - RNA, 20 nt, Human
agauagccaaggccaaagga

SEQ ID NO: 2005087 - RNA, 20 nt, Human
agauagauaggucagugcaa

SEQ ID NO: 2005088 - RNA, 16 nt, Human
agauucuuuccugagg

SEQ ID NO: 2005089 - RNA, 15 nt, Human
agauucuuuccugag

SEQ ID NO: 2005090 - RNA, 18 nt, Human
agauucuuuccugaggcu

SEQ ID NO: 2005091 - RNA, 21 nt, Human
agauucuauguuaauauuuua

SEQ ID NO: 2005092 - RNA, 17 nt, Human
agauugagauguguuca

SEQ ID NO: 2005093 - RNA, 16 nt, Human
agauugcaacaggcug

SEQ ID NO: 2005094 - RNA, 16 nt, Human
agauugcaccacugca

SEQ ID NO: 2005095 - RNA, 17 nt, Human
agauugcaacaggcugg

SEQ ID NO: 2005096 - RNA, 19 nt, Human
agauugcaacaggcugggc

SEQ ID NO: 2005097 - RNA, 15 nt, Human
agcaaaaugcaugua

SEQ ID NO: 2005098 - RNA, 20 nt, Human
agcaaaaugcauguaaucaa

SEQ ID NO: 2005099 - RNA, 19 nt, Human
agcaaauucuguuuuucua

SEQ ID NO: 2005100 - RNA, 20 nt, Human
agcaaagcaugccaauuucu

SEQ ID NO: 2005101 - RNA, 18 nt, Human
agcaaacugguuauuuaa

SEQ ID NO: 2005102 - RNA, 19 nt, Human
agcaaacuuguugaauuua

SEQ ID NO: 2005103 - RNA, 11 nt, Human
agaugaauguc

SEQ ID NO: 2005104 - RNA, 18 nt, Human
agaugacaucugucuagg

SEQ ID NO: 2005105 - RNA, 15 nt, Human
agaugaaugucaguu

SEQ ID NO: 2005106 - RNA, 21 nt, Human
agauggcugugccucugccug

SEQ ID NO: 2005107 - RNA, 22 nt, Human
agauggcugugccucugccugu

SEQ ID NO: 2005108 - RNA, 15 nt, Human
agaugggggccucuu

SEQ ID NO: 2005109 - RNA, 18 nt, Human
agaugggggccucuuuca

SEQ ID NO: 2005110 - RNA, 17 nt, Human
agauggcugugccucug

SEQ ID NO: 2005111 - RNA, 18 nt, Human
agauggcugugccucugc

SEQ ID NO: 2005112 - RNA, 19 nt, Human
agauggcugugccucugcc

SEQ ID NO: 2005113 - RNA, 20 nt, Human
agauggcugugccucugccu

SEQ ID NO: 2005114 - RNA, 14 nt, Human
agauucuuuccuga

SEQ ID NO: 2005115 - RNA, 18 nt, Human
agauucuauguuaauauu

SEQ ID NO: 2005116 - RNA, 20 nt, Human
agauucuaggaccugugucc

SEQ ID NO: 2005117 - RNA, 22 nt, Human
agaugggugcuuggaggaagga

SEQ ID NO: 2005118 - RNA, 20 nt, Human
agaugggugcuuggaggaag

SEQ ID NO: 2005119 - RNA, 18 nt, Human
agaucucugcuuuggaaa

SEQ ID NO: 2005120 - RNA, 23 nt, Human
agaucucugcuuuggaaaucaca

SEQ ID NO: 2005121 - RNA, 22 nt, Human
aguuguuagugugucuuagugu

SEQ ID NO: 2005122 - RNA, 17 nt, Human
aguuguuagugugucuu

SEQ ID NO: 2005123 - RNA, 15 nt, Human
aguugaagucaugcu

SEQ ID NO: 2005124 - RNA, 17 nt, Human
aguugaagucaugcucc

SEQ ID NO: 2005125 - RNA, 14 nt, Human
aguugaauacuuga

SEQ ID NO: 2005126 - RNA, 19 nt, Human
aguugaauacuugaaccau

SEQ ID NO: 2005127 - RNA, 15 nt, Human
aguugaauacuugaa

SEQ ID NO: 2005128 - RNA, 16 nt, Human
aguugaauacuugaac

SEQ ID NO: 2005129 - RNA, 17 nt, Human
aguugaauacuugaacc

SEQ ID NO: 2005130 - RNA, 18 nt, Human
aguugaauacuugaacca

SEQ ID NO: 2005131 - RNA, 20 nt, Human
aguuguuagauuaagaaaua

SEQ ID NO: 2005132 - RNA, 17 nt, Human
aguuguuauuuauugaa

SEQ ID NO: 2005133 - RNA, 12 nt, Human
aguggccccacc

SEQ ID NO: 2005134 - RNA, 21 nt, Human
aguggcccaacaggggcucca

SEQ ID NO: 2005135 - RNA, 13 nt, Human
aguggccccaccu

SEQ ID NO: 2005136 - RNA, 16 nt, Human
aguggccaucauuucu

SEQ ID NO: 2005137 - RNA, 17 nt, Human
aguggccaucauuucug

SEQ ID NO: 2005138 - RNA, 15 nt, Human
aguggcccaacaggg

SEQ ID NO: 2005139 - RNA, 12 nt, Human
aguguuugcugc

SEQ ID NO: 2005140 - RNA, 14 nt, Human
aguggccccaccug

SEQ ID NO: 2005141 - RNA, 16 nt, Human
aguggccccaccuggc

SEQ ID NO: 2005142 - RNA, 18 nt, Human
aguggccccaccuggccc

SEQ ID NO: 2005143 - RNA, 19 nt, Human
aguggccccaccuggcccu

SEQ ID NO: 2005144 - RNA, 19 nt, Human
agugcuauuacgaaguuca

SEQ ID NO: 2005145 - RNA, 23 nt, Human
agugcuauuacgaaguucaagau

SEQ ID NO: 2005146 - RNA, 18 nt, Human
aguuaacaggcaaacauu

SEQ ID NO: 2005147 - RNA, 19 nt, Human
aguuaacaggcaaacauuu

SEQ ID NO: 2005148 - RNA, 18 nt, Human
aguugaaaaacagcugag

SEQ ID NO: 2005149 - RNA, 17 nt, Human
aguugaagacagagcua

SEQ ID NO: 2005150 - RNA, 16 nt, Human
aguugaagacagagcu

SEQ ID NO: 2005151 - RNA, 17 nt, Human
aguugaaaaacagcuga

SEQ ID NO: 2005152 - RNA, 13 nt, Human
aguuccacugaga

SEQ ID NO: 2005153 - RNA, 17 nt, Human
aguuccaaucaguagcu

SEQ ID NO: 2005154 - RNA, 16 nt, Human
aguucaucccuucucu

SEQ ID NO: 2005155 - RNA, 19 nt, Human
aguucaucccuucucuucc

SEQ ID NO: 2005156 - RNA, 15 nt, Human
aguuccacugagacc

SEQ ID NO: 2005157 - RNA, 21 nt, Human
aguuacaaauuauaauguauu

SEQ ID NO: 2005158 - RNA, 22 nt, Human
aguuacaaauuauaauguauuc

SEQ ID NO: 2005159 - RNA, 23 nt, Human
aguuacaaauuauaauguauuca

SEQ ID NO: 2005160 - RNA, 14 nt, Human
aguucauacccugu

SEQ ID NO: 2005161 - RNA, 21 nt, Human
aguuccaccaucaagccacca

SEQ ID NO: 2005162 - RNA, 18 nt, Human
aguuccaccaucaagcca

SEQ ID NO: 2005163 - RNA, 13 nt, Human
aguucaucccuuc

SEQ ID NO: 2005164 - RNA, 15 nt, Human
aguucaucccuucuc

SEQ ID NO: 2005165 - RNA, 20 nt, Human
aguuugccccguucuguuug

SEQ ID NO: 2005166 - RNA, 17 nt, Human
auaaaaaaaagaaaaaa

SEQ ID NO: 2005167 - RNA, 18 nt, Human
auaaaaaaaagaaaaaag

SEQ ID NO: 2005168 - RNA, 14 nt, Human
auaaaaaaugacaa

SEQ ID NO: 2005169 - RNA, 15 nt, Human
auaaaaaaacagcuu

SEQ ID NO: 2005170 - RNA, 12 nt, Human
auaaaaaaagaa

SEQ ID NO: 2005171 - RNA, 16 nt, Human
auaaaaaaagaaaaaa

SEQ ID NO: 2005172 - RNA, 19 nt, Human
auaaaacagaguaaucuug

SEQ ID NO: 2005173 - RNA, 21 nt, Human
auaaaacagaguaaucuuguu

SEQ ID NO: 2005174 - RNA, 16 nt, Human
auaaaacagaguaauc

SEQ ID NO: 2005175 - RNA, 16 nt, Human
auaaaagacagugaaa

SEQ ID NO: 2005176 - RNA, 15 nt, Human
auaaaagacagugaa

SEQ ID NO: 2005177 - RNA, 11 nt, Human
aguuugcaguu

SEQ ID NO: 2005178 - RNA, 15 nt, Human
aguuugcauuucaga

SEQ ID NO: 2005179 - RNA, 16 nt, Human
aguuugcauuucagaa

SEQ ID NO: 2005180 - RNA, 17 nt, Human
aguuugcauuucagaaa

SEQ ID NO: 2005181 - RNA, 23 nt, Human
aguuugcauuucagaaagccuuu

SEQ ID NO: 2005182 - RNA, 14 nt, Human
aguuugauuaaauu

SEQ ID NO: 2005183 - RNA, 22 nt, Human
aguuugaucuuccucugcuaaa

SEQ ID NO: 2005184 - RNA, 23 nt, Human
aguuugaucuuccucugcuaaau

SEQ ID NO: 2005185 - RNA, 14 nt, Human
aguuugaucuuccu

SEQ ID NO: 2005186 - RNA, 16 nt, Human
aguuugaucuuccucu

SEQ ID NO: 2005187 - RNA, 21 nt, Human
aguuugaucuuccucugcuaa

SEQ ID NO: 2005188 - RNA, 14 nt, Human
aguuugaggaaauu

SEQ ID NO: 2005189 - RNA, 18 nt, Human
aguuugaggaaauuugca

SEQ ID NO: 2005190 - RNA, 19 nt, Human
aguuugaggaaauuugcag

SEQ ID NO: 2005191 - RNA, 20 nt, Human
aguuugaggaaauuugcagc

SEQ ID NO: 2005192 - RNA, 17 nt, Human
aguuugaggauuaguuu

SEQ ID NO: 2005193 - RNA, 18 nt, Human
aguuugaggauuaguuua

SEQ ID NO: 2005194 - RNA, 16 nt, Human
aguuugauaaauagug

SEQ ID NO: 2005195 - RNA, 18 nt, Human
aguuugauaaauaguguu

SEQ ID NO: 2005196 - RNA, 19 nt, Human
aguuugauaaauaguguua

SEQ ID NO: 2005197 - RNA, 20 nt, Human
aguuucugucguuaaaaaca

SEQ ID NO: 2005198 - RNA, 22 nt, Human
aguuucugucguuaaaaacaga

SEQ ID NO: 2005199 - RNA, 23 nt, Human
aguuucugucguuaaaaacagau

SEQ ID NO: 2005200 - RNA, 13 nt, Human
aguuucugugguu

SEQ ID NO: 2005201 - RNA, 17 nt, Human
aguuucugugguuggcu

SEQ ID NO: 2005202 - RNA, 21 nt, Human
aguuucugugguuggcuggga

SEQ ID NO: 2005203 - RNA, 23 nt, Human
aguuucugugguuggcugggaaa

SEQ ID NO: 2005204 - RNA, 17 nt, Human
auacaccacuacauucu

SEQ ID NO: 2005205 - RNA, 14 nt, Human
auacaccgggccug

SEQ ID NO: 2005206 - RNA, 18 nt, Human
auacaccgggccuggaga

SEQ ID NO: 2005207 - RNA, 21 nt, Human
auacaccucaacuaaauccaa

SEQ ID NO: 2005208 - RNA, 13 nt, Human
auagaaaaacaaa

SEQ ID NO: 2005209 - RNA, 14 nt, Human
auacuuaaauguua

SEQ ID NO: 2005210 - RNA, 14 nt, Human
auacuuuuuugaaa

SEQ ID NO: 2005211 - RNA, 17 nt, Human
auacuuuuuugaaauca

SEQ ID NO: 2005212 - RNA, 20 nt, Human
auacuugaaccauaaaaugu

SEQ ID NO: 2005213 - RNA, 22 nt, Human
auacuugaaccauaaaaugucc

SEQ ID NO: 2005214 - RNA, 12 nt, Human
auacuuaaaugu

SEQ ID NO: 2005215 - RNA, 12 nt, Human
auacuugaacca

SEQ ID NO: 2005216 - RNA, 13 nt, Human
auacuugaaccau

SEQ ID NO: 2005217 - RNA, 16 nt, Human
auacuugaaccauaaa

SEQ ID NO: 2005218 - RNA, 17 nt, Human
auacuugaaccauaaaa

SEQ ID NO: 2005219 - RNA, 18 nt, Human
auacuugaaccauaaaau

SEQ ID NO: 2005220 - RNA, 19 nt, Human
auacuugaaaauuaacaug

SEQ ID NO: 2005221 - RNA, 21 nt, Human
auacuguuuuucgucauucca

SEQ ID NO: 2005222 - RNA, 20 nt, Human
auacuguuauucuuugcacu

SEQ ID NO: 2005223 - RNA, 22 nt, Human
auacuguuauucuuugcacuuu

SEQ ID NO: 2005224 - RNA, 15 nt, Human
auacuguuauucuuu

SEQ ID NO: 2005225 - RNA, 16 nt, Human
auacuguuauucuuug

SEQ ID NO: 2005226 - RNA, 18 nt, Human
auacuguuauucuuugca

SEQ ID NO: 2005227 - RNA, 21 nt, Human
auaaagaugagugagcaugcc

SEQ ID NO: 2005228 - RNA, 16 nt, Human
auaaagacccaggggg

SEQ ID NO: 2005229 - RNA, 21 nt, Human
auaagcuaacaccagacagac

SEQ ID NO: 2005230 - RNA, 14 nt, Human
auaagcuaguugaa

SEQ ID NO: 2005231 - RNA, 15 nt, Human
auaagcuaguugaau

SEQ ID NO: 2005232 - RNA, 22 nt, Human
auaagcuaguugaauacuugaa

SEQ ID NO: 2005233 - RNA, 23 nt, Human
auaagcuaguugaauacuugaac

SEQ ID NO: 2005234 - RNA, 17 nt, Human
auaagcuaguugaauac

SEQ ID NO: 2005235 - RNA, 18 nt, Human
auaagcuaguugaauacu

SEQ ID NO: 2005236 - RNA, 20 nt, Human
auaagcuaguugaauacuug

SEQ ID NO: 2005237 - RNA, 21 nt, Human
auaagcuaguugaauacuuga

SEQ ID NO: 2005238 - RNA, 15 nt, Human
auacaccacuacauu

SEQ ID NO: 2005239 - RNA, 12 nt, Human
auaauguuaaca

SEQ ID NO: 2005240 - RNA, 14 nt, Human
auaauguucugcua

SEQ ID NO: 2005241 - RNA, 22 nt, Human
auaauguucugcuaaauuucaa

SEQ ID NO: 2005242 - RNA, 23 nt, Human
auacaaugcugugcccuaaagug

SEQ ID NO: 2005243 - RNA, 12 nt, Human
auaauguuguca

SEQ ID NO: 2005244 - RNA, 19 nt, Human
auaaguggccuugacacau

SEQ ID NO: 2005245 - RNA, 21 nt, Human
auaaguggccuugacacauua

SEQ ID NO: 2005246 - RNA, 19 nt, Human
aggggccagacccugccca

SEQ ID NO: 2005247 - RNA, 15 nt, Human
aguacuggagaaaau

SEQ ID NO: 2005248 - RNA, 19 nt, Human
aguacugagcagugauauu

SEQ ID NO: 2005249 - RNA, 23 nt, Human
aguacugagcagugauauucuuu

SEQ ID NO: 2005250 - RNA, 19 nt, Human
aguaccuggguccccagcc

SEQ ID NO: 2005251 - RNA, 21 nt, Human
aguaccuggguccccagcccu

SEQ ID NO: 2005252 - RNA, 22 nt, Human
aguaccuggguccccagcccuu

SEQ ID NO: 2005253 - RNA, 20 nt, Human
aguaccuuaucaaaguagca

SEQ ID NO: 2005254 - RNA, 22 nt, Human
aguauauugauccagaaagaaa

SEQ ID NO: 2005255 - RNA, 16 nt, Human
aguauauuauaauaga

SEQ ID NO: 2005256 - RNA, 20 nt, Human
aguacuucuccacccugcuc

SEQ ID NO: 2005257 - RNA, 19 nt, Human
aguacuucuccacccugcu

SEQ ID NO: 2005258 - RNA, 21 nt, Human
aguacuucuccacccugcucu

SEQ ID NO: 2005259 - RNA, 22 nt, Human
aguacuucuccacccugcucuc

SEQ ID NO: 2005260 - RNA, 15 nt, Human
aguauaucucaguuu

SEQ ID NO: 2005261 - RNA, 17 nt, Human
aguaacuuacuuaggug

SEQ ID NO: 2005262 - RNA, 14 nt, Human
aguaacuugggagu

SEQ ID NO: 2005263 - RNA, 18 nt, Human
aguaacuugggagugugg

SEQ ID NO: 2005264 - RNA, 18 nt, Human
aguaacuggugauauauc

SEQ ID NO: 2005265 - RNA, 19 nt, Human
aguaaaugggggugcauuu

SEQ ID NO: 2005266 - RNA, 20 nt, Human
aguaaaugggggugcauuug

SEQ ID NO: 2005267 - RNA, 21 nt, Human
aguaaaugggggugcauuuga

SEQ ID NO: 2005268 - RNA, 15 nt, Human
aguaaauguaguuca

SEQ ID NO: 2005269 - RNA, 19 nt, Human
aguaaauguaguucauacu

SEQ ID NO: 2005270 - RNA, 12 nt, Human
aguaaauguagu

SEQ ID NO: 2005271 - RNA, 14 nt, Human
aguaaauguaguuc

SEQ ID NO: 2005272 - RNA, 16 nt, Human
aguaaaggcaaacuua

SEQ ID NO: 2005273 - RNA, 12 nt, Human
aguaaacacugu

SEQ ID NO: 2005274 - RNA, 13 nt, Human
aguaaacacugug

SEQ ID NO: 2005275 - RNA, 16 nt, Human
aguaaacacuguguau

SEQ ID NO: 2005276 - RNA, 15 nt, Human
aguaaaccugucuga

SEQ ID NO: 2005277 - RNA, 16 nt, Human
agugacagaggcagcc

SEQ ID NO: 2005278 - RNA, 19 nt, Human
agugacagaggcagcccca

SEQ ID NO: 2005279 - RNA, 14 nt, Human
agugacagaggcag

SEQ ID NO: 2005280 - RNA, 19 nt, Human
agugauccucccaccucag

SEQ ID NO: 2005281 - RNA, 20 nt, Human
agugauccucccaccucagc

SEQ ID NO: 2005282 - RNA, 22 nt, Human
agugauccucccaccucagccu

SEQ ID NO: 2005283 - RNA, 23 nt, Human
agugauccucccaccucagccuc

SEQ ID NO: 2005284 - RNA, 20 nt, Human
agugauggguuaguggaugg

SEQ ID NO: 2005285 - RNA, 13 nt, Human
agugauuaccagg

SEQ ID NO: 2005286 - RNA, 17 nt, Human
agugccuuugcagcuca

SEQ ID NO: 2005287 - RNA, 13 nt, Human
agugcguggccca

SEQ ID NO: 2005288 - RNA, 18 nt, Human
agugccuuugcagcucag

SEQ ID NO: 2005289 - RNA, 20 nt, Human
agugccuuugcagcucagaa

SEQ ID NO: 2005290 - RNA, 21 nt, Human
agugccuuugcagcucagaac

SEQ ID NO: 2005291 - RNA, 14 nt, Human
agugcuacugaaag

SEQ ID NO: 2005292 - RNA, 17 nt, Human
agugcguggcccaccag

SEQ ID NO: 2005293 - RNA, 22 nt, Human
agugccuuauggaacacucuga

SEQ ID NO: 2005294 - RNA, 21 nt, Human
agugccuuauggaacacucug

SEQ ID NO: 2005295 - RNA, 20 nt, Human
agugccuuauggaacacucu

SEQ ID NO: 2005296 - RNA, 19 nt, Human
agugccuuauggaacacuc

SEQ ID NO: 2005297 - RNA, 18 nt, Human
agugauucuccugccuca

SEQ ID NO: 2005298 - RNA, 19 nt, Human
agugauucuccugccucag

SEQ ID NO: 2005299 - RNA, 20 nt, Human
agugauucuccugccucagc

SEQ ID NO: 2005300 - RNA, 18 nt, Human
agugccuuauggaacacu

SEQ ID NO: 2005301 - RNA, 13 nt, Human
aguaucaugaagc

SEQ ID NO: 2005302 - RNA, 21 nt, Human
agucugauucccaagcucugc

SEQ ID NO: 2005303 - RNA, 22 nt, Human
agucugauucccaagcucugcu

SEQ ID NO: 2005304 - RNA, 12 nt, Human
agucugcauaua

SEQ ID NO: 2005305 - RNA, 17 nt, Human
aguccuuugagcuccug

SEQ ID NO: 2005306 - RNA, 16 nt, Human
agucgaggacagggag

SEQ ID NO: 2005307 - RNA, 18 nt, Human
agucuggcccuuccuuuu

SEQ ID NO: 2005308 - RNA, 17 nt, Human
agucuggggaccagcuu

SEQ ID NO: 2005309 - RNA, 18 nt, Human
aguccuuaccagcagagc

SEQ ID NO: 2005310 - RNA, 16 nt, Human
aguccuuaccagcaga

SEQ ID NO: 2005311 - RNA, 14 nt, Human
aguccucuuuucug

SEQ ID NO: 2005312 - RNA, 14 nt, Human
aguccucugaauga

SEQ ID NO: 2005313 - RNA, 12 nt, Human
aguccucugaau

SEQ ID NO: 2005314 - RNA, 15 nt, Human
agucauuugugaauu

SEQ ID NO: 2005315 - RNA, 13 nt, Human
agucauuuucaag

SEQ ID NO: 2005316 - RNA, 15 nt, Human
agucauuuucaagac

SEQ ID NO: 2005317 - RNA, 16 nt, Human
agucauuuuguguuga

SEQ ID NO: 2005318 - RNA, 21 nt, Human
agucauuuuguguugaagagc

SEQ ID NO: 2005319 - RNA, 15 nt, Human
agucauuucugauuu

SEQ ID NO: 2005320 - RNA, 13 nt, Human
agucauuucugau

SEQ ID NO: 2005321 - RNA, 14 nt, Human
agucauuucugauu

SEQ ID NO: 2005322 - RNA, 12 nt, Human
agucauuguaau

SEQ ID NO: 2005323 - RNA, 15 nt, Human
agucauuguaauguu

SEQ ID NO: 2005324 - RNA, 16 nt, Human
agucauuguaauguug

SEQ ID NO: 2005325 - RNA, 17 nt, Human
agucauuguaauguugu

SEQ ID NO: 2005326 - RNA, 20 nt, Human
agucauuguaauguugugaa

SEQ ID NO: 2005327 - RNA, 23 nt, Human
aucuaggaagacuuuggaaagag

SEQ ID NO: 2005328 - RNA, 11 nt, Human
aucuaggauuu

SEQ ID NO: 2005329 - RNA, 19 nt, Human
aucuaggauuuuaagggaa

SEQ ID NO: 2005330 - RNA, 22 nt, Human
augaggcugcuuuccaaagcca

SEQ ID NO: 2005331 - RNA, 21 nt, Human
augagcuuugucuacuucaaa

SEQ ID NO: 2005332 - RNA, 18 nt, Human
augaccuuucaauaggaa

SEQ ID NO: 2005333 - RNA, 18 nt, Human
augaccuuguaauguaac

SEQ ID NO: 2005334 - RNA, 19 nt, Human
augaccuuguaauguaacu

SEQ ID NO: 2005335 - RNA, 20 nt, Human
augaccuuguaauguaacug

SEQ ID NO: 2005336 - RNA, 15 nt, Human
augaccuuucaauag

SEQ ID NO: 2005337 - RNA, 13 nt, Human
augaccuuucaau

SEQ ID NO: 2005338 - RNA, 12 nt, Human
augagccuggca

SEQ ID NO: 2005339 - RNA, 11 nt, Human
augagccuggc

SEQ ID NO: 2005340 - RNA, 21 nt, Human
augagccucagcauccuggca

SEQ ID NO: 2005341 - RNA, 19 nt, Human
augagccucagcauccugg

SEQ ID NO: 2005342 - RNA, 13 nt, Human
augaaacuuggau

SEQ ID NO: 2005343 - RNA, 16 nt, Human
augaaacuuuuggaag

SEQ ID NO: 2005344 - RNA, 12 nt, Human
augaaagacugu

SEQ ID NO: 2005345 - RNA, 23 nt, Human
augaagcauuuacuuuguguuca

SEQ ID NO: 2005346 - RNA, 18 nt, Human
augaaagaaaacuuuuau

SEQ ID NO: 2005347 - RNA, 13 nt, Human
augaaguacucau

SEQ ID NO: 2005348 - RNA, 23 nt, Human
augaaguaauaugcacacauuuu

SEQ ID NO: 2005349 - RNA, 14 nt, Human
augaaguaauaugc

SEQ ID NO: 2005350 - RNA, 21 nt, Human
augaaguaauaugcacacauu

SEQ ID NO: 2005351 - RNA, 23 nt, Human
augaaguuuuuuuuauacaggau

SEQ ID NO: 2005352 - RNA, 17 nt, Human
augaauaaagacaccua

SEQ ID NO: 2005353 - RNA, 12 nt, Human
augaauacuuug

SEQ ID NO: 2005354 - RNA, 17 nt, Human
augaauacgagcaagcu

SEQ ID NO: 2005355 - RNA, 19 nt, Human
augcauguaaucaacaugg

SEQ ID NO: 2005356 - RNA, 13 nt, Human
augcauguaauca

SEQ ID NO: 2005357 - RNA, 11 nt, Human
augccuggugg

SEQ ID NO: 2005358 - RNA, 12 nt, Human
augccugguggc

SEQ ID NO: 2005359 - RNA, 13 nt, Human
augccugguggca

SEQ ID NO: 2005360 - RNA, 14 nt, Human
augccugguggcag

SEQ ID NO: 2005361 - RNA, 19 nt, Human
augccugguggcagcugcg

SEQ ID NO: 2005362 - RNA, 18 nt, Human
augccugguggcagcugc

SEQ ID NO: 2005363 - RNA, 21 nt, Human
augccugguggcagcugcggu

SEQ ID NO: 2005364 - RNA, 24 nt, Human
augcauauuauuuuauguugcaua

SEQ ID NO: 2005365 - RNA, 20 nt, Human
augcauauuauuuuauguug

SEQ ID NO: 2005366 - RNA, 19 nt, Human
augcauaauaauccugcaa

SEQ ID NO: 2005367 - RNA, 21 nt, Human
augcauaauaauccugcaaag

SEQ ID NO: 2005368 - RNA, 23 nt, Human
augcauaauaauccugcaaagua

SEQ ID NO: 2005369 - RNA, 19 nt, Human
augcucugcauguuacaua

SEQ ID NO: 2005370 - RNA, 18 nt, Human
augcucugcauguuacau

SEQ ID NO: 2005371 - RNA, 22 nt, Human
augcuucuucagagacuccugc

SEQ ID NO: 2005372 - RNA, 21 nt, Human
augcuuuaggauguacaguua

SEQ ID NO: 2005373 - RNA, 20 nt, Human
augcuucuucagagacuccu

SEQ ID NO: 2005374 - RNA, 17 nt, Human
augcuucuucagagacu

SEQ ID NO: 2005375 - RNA, 14 nt, Human
augcuucuucagag

SEQ ID NO: 2005376 - RNA, 23 nt, Human
auggagauagccccacaggaggu

SEQ ID NO: 2005377 - RNA, 23 nt, Human
augcuuuccauauuuuuuuccuu

SEQ ID NO: 2005378 - RNA, 15 nt, Human
augcuuuccauauuu

SEQ ID NO: 2005379 - RNA, 16 nt, Human
augcuuuccauauuuu

SEQ ID NO: 2005380 - RNA, 22 nt, Human
augcuuuccauauuuuuuuccu

SEQ ID NO: 2005381 - RNA, 16 nt, Human
augcuuugaucccuuc

SEQ ID NO: 2005382 - RNA, 18 nt, Human
augggaaaguauucucuu

SEQ ID NO: 2005383 - RNA, 22 nt, Human
augggaaaguauucucuuuuca

SEQ ID NO: 2005384 - RNA, 15 nt, Human
augggacagggagga

SEQ ID NO: 2005385 - RNA, 20 nt, Human
auggaguuaaacuuuagugc

SEQ ID NO: 2005386 - RNA, 18 nt, Human
auggaguuggaguucauu

SEQ ID NO: 2005387 - RNA, 23 nt, Human
auggaguuggaguucauucauau

SEQ ID NO: 2005388 - RNA, 18 nt, Human
auggcuuuauuuuuuuga

SEQ ID NO: 2005389 - RNA, 23 nt, Human
auggcuuuauuuuuuugaacucu

SEQ ID NO: 2005390 - RNA, 22 nt, Human
aucuaggaagacuuuggaaaga

SEQ ID NO: 2005391 - RNA, 14 nt, Human
aucgaccugccucg

SEQ ID NO: 2005392 - RNA, 17 nt, Human
aucgacuuguucuugau

SEQ ID NO: 2005393 - RNA, 20 nt, Human
auccaggccccucccucucc

SEQ ID NO: 2005394 - RNA, 21 nt, Human
auccaggccccucccucucca

SEQ ID NO: 2005395 - RNA, 12 nt, Human
auccaggccacu

SEQ ID NO: 2005396 - RNA, 19 nt, Human
auccaggccacucuuagcc

SEQ ID NO: 2005397 - RNA, 14 nt, Human
auccaggccccucc

SEQ ID NO: 2005398 - RNA, 21 nt, Human
auccagcccugaguuccuagc

SEQ ID NO: 2005399 - RNA, 21 nt, Human
auccacugugccaugugccag

SEQ ID NO: 2005400 - RNA, 23 nt, Human
auccacuuuaucuugaauaaugu

SEQ ID NO: 2005401 - RNA, 23 nt, Human
auccacucucucuuguucuuacu

SEQ ID NO: 2005402 - RNA, 19 nt, Human
aucauggagguuugaagau

SEQ ID NO: 2005403 - RNA, 20 nt, Human
aucaugacaaagacugagua

SEQ ID NO: 2005404 - RNA, 15 nt, Human
aucauccuaagcuau

SEQ ID NO: 2005405 - RNA, 13 nt, Human
aucaaauacauuu

SEQ ID NO: 2005406 - RNA, 14 nt, Human
aucaaauacauuua

SEQ ID NO: 2005407 - RNA, 17 nt, Human
aucaaauaauaccuuag

SEQ ID NO: 2005408 - RNA, 20 nt, Human
aucaaauaauaccuuagaag

SEQ ID NO: 2005409 - RNA, 11 nt, Human
aucaaagugcu

SEQ ID NO: 2005410 - RNA, 16 nt, Human
aucaaaguagcaaaug

SEQ ID NO: 2005411 - RNA, 14 nt, Human
auagcacagacccu

SEQ ID NO: 2005412 - RNA, 19 nt, Human
aucaaagagguuuuaaaaa

SEQ ID NO: 2005413 - RNA, 12 nt, Human
aucaaaggacac

SEQ ID NO: 2005414 - RNA, 20 nt, Human
aucaaaagguuaauaaagua

SEQ ID NO: 2005415 - RNA, 24 nt, Human
aucaaaagguuaauaaaguaauua

SEQ ID NO: 2005416 - RNA, 14 nt, Human
auauuuuuuucuga

SEQ ID NO: 2005417 - RNA, 18 nt, Human
auauuuuuuuccuuacau

SEQ ID NO: 2005418 - RNA, 19 nt, Human
auauuuuuuuccuuacaua

SEQ ID NO: 2005419 - RNA, 21 nt, Human
auauuuuuuuccuuacauaaa

SEQ ID NO: 2005420 - RNA, 22 nt, Human
auauuuuuuuccuuacauaaac

SEQ ID NO: 2005421 - RNA, 14 nt, Human
auauuuuuuuccuu

SEQ ID NO: 2005422 - RNA, 15 nt, Human
auauuuuuuuccuua

SEQ ID NO: 2005423 - RNA, 17 nt, Human
auauuuuuuuccuuaca

SEQ ID NO: 2005424 - RNA, 16 nt, Human
auauuuuuuucugaaa

SEQ ID NO: 2005425 - RNA, 18 nt, Human
auauuuuuuucugaaauu

SEQ ID NO: 2005426 - RNA, 18 nt, Human
auauuuuuuucuuuucuu

SEQ ID NO: 2005427 - RNA, 19 nt, Human
auauuuuuuucugaaauuu

SEQ ID NO: 2005428 - RNA, 12 nt, Human
aucaaaaaggcu

SEQ ID NO: 2005429 - RNA, 13 nt, Human
aucaaaaaggcuu

SEQ ID NO: 2005430 - RNA, 16 nt, Human
aucaaaaaggcuuaua

SEQ ID NO: 2005431 - RNA, 17 nt, Human
aucaaaaaggcuuauaa

SEQ ID NO: 2005432 - RNA, 21 nt, Human
aucaaaaaggcuuauaaaaca

SEQ ID NO: 2005433 - RNA, 14 nt, Human
aucaaaagaaagaa

SEQ ID NO: 2005434 - RNA, 23 nt, Human
aucaaaaaggcuuauaaaacaga

SEQ ID NO: 2005435 - RNA, 14 nt, Human
acaaacagaugcuc

SEQ ID NO: 2005436 - RNA, 14 nt, Human
acaaacaagcauau

SEQ ID NO: 2005437 - RNA, 15 nt, Human
acaaacugcuuccuu

SEQ ID NO: 2005438 - RNA, 21 nt, Human
acaaacugcuuccuuucuuga

SEQ ID NO: 2005439 - RNA, 21 nt, Human
acaaacugcacaugauuucac

SEQ ID NO: 2005440 - RNA, 23 nt, Human
acaaacugcacaugauuucacaa

SEQ ID NO: 2005441 - RNA, 14 nt, Human
acaaacugcacaug

SEQ ID NO: 2005442 - RNA, 16 nt, Human
acaaacugcacaugau

SEQ ID NO: 2005443 - RNA, 19 nt, Human
acaaacugcacaugauuuc

SEQ ID NO: 2005444 - RNA, 20 nt, Human
acaaacugcacaugauuuca

SEQ ID NO: 2005445 - RNA, 22 nt, Human
acaaacucucugaaccccuccc

SEQ ID NO: 2005446 - RNA, 15 nt, Human
acaaacucucugaac

SEQ ID NO: 2005447 - RNA, 13 nt, Human
acaacccccagcu

SEQ ID NO: 2005448 - RNA, 14 nt, Human
acaacccccagcuc

SEQ ID NO: 2005449 - RNA, 19 nt, Human
acaaggcaaggcugucaau

SEQ ID NO: 2005450 - RNA, 17 nt, Human
acaaggcaaggcuguca

SEQ ID NO: 2005451 - RNA, 16 nt, Human
acaaggcaaggcuguc

SEQ ID NO: 2005452 - RNA, 15 nt, Human
acaaguuaaauaaau

SEQ ID NO: 2005453 - RNA, 15 nt, Human
acaaggugcaggcag

SEQ ID NO: 2005454 - RNA, 16 nt, Human
acaaggugcaggcagg

SEQ ID NO: 2005455 - RNA, 14 nt, Human
acacagcauuucaa

SEQ ID NO: 2005456 - RNA, 14 nt, Human
acacagcucuucuc

SEQ ID NO: 2005457 - RNA, 16 nt, Human
acacagcucuucucca

SEQ ID NO: 2005458 - RNA, 18 nt, Human
acacagcucuucuccagg

SEQ ID NO: 2005459 - RNA, 18 nt, Human
acaccagagcccaccuug

SEQ ID NO: 2005460 - RNA, 23 nt, Human
acaccagagcccaccuuggcuca

SEQ ID NO: 2005461 - RNA, 15 nt, Human
acaccaauauucaua

SEQ ID NO: 2005462 - RNA, 13 nt, Human
acaccagagccca

SEQ ID NO: 2005463 - RNA, 16 nt, Human
acacgugggcuccccu

SEQ ID NO: 2005464 - RNA, 18 nt, Human
acacgugggcuccccucu

SEQ ID NO: 2005465 - RNA, 19 nt, Human
acacgugggcuccccucuu

SEQ ID NO: 2005466 - RNA, 20 nt, Human
acacgugggcuccccucuuc

SEQ ID NO: 2005467 - RNA, 21 nt, Human
acacgugggcuccccucuucc

SEQ ID NO: 2005468 - RNA, 23 nt, Human
acacgugggcuccccucuuccuc

SEQ ID NO: 2005469 - RNA, 17 nt, Human
acacguuuuaaggacug

SEQ ID NO: 2005470 - RNA, 22 nt, Human
acacguuuuaaggacugacuga

SEQ ID NO: 2005471 - RNA, 15 nt, Human
acacguuggaguaua

SEQ ID NO: 2005472 - RNA, 14 nt, Human
acacguuuuaagga

SEQ ID NO: 2005473 - RNA, 15 nt, Human
acacguuuuaaggac

SEQ ID NO: 2005474 - RNA, 16 nt, Human
acacguuuuaaggacu

SEQ ID NO: 2005475 - RNA, 14 nt, Human
acaccaaucuuacu

SEQ ID NO: 2005476 - RNA, 18 nt, Human
acaccaaucuuacuuugu

SEQ ID NO: 2005477 - RNA, 12 nt, Human
aauuuccuggga

SEQ ID NO: 2005478 - RNA, 15 nt, Human
aauuuccugggagcu

SEQ ID NO: 2005479 - RNA, 17 nt, Human
aauuuccccuaaucuuu

SEQ ID NO: 2005480 - RNA, 18 nt, Human
aauuuccccuaaucuuuu

SEQ ID NO: 2005481 - RNA, 17 nt, Human
aauuucccaaagcagug

SEQ ID NO: 2005482 - RNA, 15 nt, Human
aauuucccaaagcag

SEQ ID NO: 2005483 - RNA, 11 nt, Human
aauuguaauag

SEQ ID NO: 2005484 - RNA, 17 nt, Human
aauuguaauuaauaaua

SEQ ID NO: 2005485 - RNA, 11 nt, Human
aauuauauucc

SEQ ID NO: 2005486 - RNA, 23 nt, Human
aauuauauuccucuugcauuuca

SEQ ID NO: 2005487 - RNA, 21 nt, Human
aauuauagugucaugcagagu

SEQ ID NO: 2005488 - RNA, 19 nt, Human
aauuauacccccugcaaag

SEQ ID NO: 2005489 - RNA, 16 nt, Human
aauuauaauguauuca

SEQ ID NO: 2005490 - RNA, 18 nt, Human
aauuauaauguauucaua

SEQ ID NO: 2005491 - RNA, 22 nt, Human
aauuauaauguauucauauuug

SEQ ID NO: 2005492 - RNA, 16 nt, Human
aauuaugcuaagaauu

SEQ ID NO: 2005493 - RNA, 21 nt, Human
aauuauggcccagggggcuaa

SEQ ID NO: 2005494 - RNA, 18 nt, Human
aauuaugcuaagaauuuu

SEQ ID NO: 2005495 - RNA, 22 nt, Human
aauuaugcuaagaauuuuuuau

SEQ ID NO: 2005496 - RNA, 17 nt, Human
aauuaugguaaaauuuu

SEQ ID NO: 2005497 - RNA, 18 nt, Human
aauuaugguaaaauuuug

SEQ ID NO: 2005498 - RNA, 12 nt, Human
aauuaugaaacu

SEQ ID NO: 2005499 - RNA, 13 nt, Human
aauuaugaaacuu

SEQ ID NO: 2005500 - RNA, 15 nt, Human
aauuaugaaacuuuu

SEQ ID NO: 2005501 - RNA, 18 nt, Human
aauuaugaaacuuuugga

SEQ ID NO: 2005502 - RNA, 19 nt, Human
aauuaugaguuauuuuuau

SEQ ID NO: 2005503 - RNA, 22 nt, Human
aauuguaaggaaugauuaauua

SEQ ID NO: 2005504 - RNA, 13 nt, Human
aauucuuaaauau

SEQ ID NO: 2005505 - RNA, 22 nt, Human
aauuggaguuggaguagaaugu

SEQ ID NO: 2005506 - RNA, 18 nt, Human
aauucuguuuuucuaggc

SEQ ID NO: 2005507 - RNA, 14 nt, Human
aauucuguuuuucu

SEQ ID NO: 2005508 - RNA, 11 nt, Human
aauucugauuu

SEQ ID NO: 2005509 - RNA, 13 nt, Human
aauucugauuucu

SEQ ID NO: 2005510 - RNA, 14 nt, Human
aauucugauuucuu

SEQ ID NO: 2005511 - RNA, 15 nt, Human
aauucugauuucuuu

SEQ ID NO: 2005512 - RNA, 16 nt, Human
aauucugauuucuuuu

SEQ ID NO: 2005513 - RNA, 22 nt, Human
aauucugauuucuuuucaccau

SEQ ID NO: 2005514 - RNA, 17 nt, Human
aauucuguuuuuaaaaa

SEQ ID NO: 2005515 - RNA, 18 nt, Human
aauucuguuuuuaaaaau

SEQ ID NO: 2005516 - RNA, 20 nt, Human
aauucuguuuuuaaaaauua

SEQ ID NO: 2005517 - RNA, 15 nt, Human
aauucucuuauccaa

SEQ ID NO: 2005518 - RNA, 23 nt, Human
aauucucuuccaaccauuuaucu

SEQ ID NO: 2005519 - RNA, 14 nt, Human
aauucugaaguuau

SEQ ID NO: 2005520 - RNA, 15 nt, Human
aauucugaaguuaua

SEQ ID NO: 2005521 - RNA, 18 nt, Human
aauucugaaguuauauuu

SEQ ID NO: 2005522 - RNA, 19 nt, Human
aauucugaaguuauauuuc

SEQ ID NO: 2005523 - RNA, 21 nt, Human
aauucugaaguuauauuuccu

SEQ ID NO: 2005524 - RNA, 15 nt, Human
aauucucuaguuuga

SEQ ID NO: 2005525 - RNA, 17 nt, Human
aauucucuaguuugauu

SEQ ID NO: 2005526 - RNA, 21 nt, Human
aauucucauuugucacacacu

SEQ ID NO: 2005527 - RNA, 14 nt, Human
aauucuccugccuc

SEQ ID NO: 2005528 - RNA, 19 nt, Human
aauucucccgggacucugc

SEQ ID NO: 2005529 - RNA, 15 nt, Human
aauucuccugccuca

SEQ ID NO: 2005530 - RNA, 16 nt, Human
aauucuccugccucag

SEQ ID NO: 2005531 - RNA, 11 nt, Human
aauucuccuuu

SEQ ID NO: 2005532 - RNA, 13 nt, Human
aauucuaugccug

SEQ ID NO: 2005533 - RNA, 15 nt, Human
aauucuaugccuguc

SEQ ID NO: 2005534 - RNA, 19 nt, Human
aauucucagaaucucaaau

SEQ ID NO: 2005535 - RNA, 14 nt, Human
aauucuacuuugag

SEQ ID NO: 2005536 - RNA, 22 nt, Human
aauucuagcuuugagcuuaaga

SEQ ID NO: 2005537 - RNA, 16 nt, Human
accagagcugccaccu

SEQ ID NO: 2005538 - RNA, 14 nt, Human
accagagcugccac

SEQ ID NO: 2005539 - RNA, 12 nt, Human
accagagcugcc

SEQ ID NO: 2005540 - RNA, 23 nt, Human
accacgucuauuucaucagaaca

SEQ ID NO: 2005541 - RNA, 13 nt, Human
accagagcugcca

SEQ ID NO: 2005542 - RNA, 20 nt, Human
accacguugggacagggagg

SEQ ID NO: 2005543 - RNA, 18 nt, Human
accaagccuggucagccc

SEQ ID NO: 2005544 - RNA, 15 nt, Human
accaccagaagccca

SEQ ID NO: 2005545 - RNA, 16 nt, Human
accaccagaagcccag

SEQ ID NO: 2005546 - RNA, 17 nt, Human
accaccagaagcccaga

SEQ ID NO: 2005547 - RNA, 21 nt, Human
accaacgucugugccauuuug

SEQ ID NO: 2005548 - RNA, 14 nt, Human
accaagccguggcu

SEQ ID NO: 2005549 - RNA, 15 nt, Human
accaagccguggcuu

SEQ ID NO: 2005550 - RNA, 16 nt, Human
accaagccguggcuuc

SEQ ID NO: 2005551 - RNA, 17 nt, Human
accaagccguggcuucc

SEQ ID NO: 2005552 - RNA, 18 nt, Human
accaagccguggcuuccc

SEQ ID NO: 2005553 - RNA, 13 nt, Human
accacguuucuaa

SEQ ID NO: 2005554 - RNA, 14 nt, Human
accacguuucuaaa

SEQ ID NO: 2005555 - RNA, 18 nt, Human
accacgcuggaccuugaa

SEQ ID NO: 2005556 - RNA, 14 nt, Human
accacgcuggaccu

SEQ ID NO: 2005557 - RNA, 16 nt, Human
accacgcuggaccuug

SEQ ID NO: 2005558 - RNA, 17 nt, Human
accaacgucugugccau

SEQ ID NO: 2005559 - RNA, 14 nt, Human
accaacgucugugc

SEQ ID NO: 2005560 - RNA, 19 nt, Human
acauguuuuucuucucccu

SEQ ID NO: 2005561 - RNA, 16 nt, Human
acauguuuucaaaugg

SEQ ID NO: 2005562 - RNA, 17 nt, Human
acauguuuucaaaugga

SEQ ID NO: 2005563 - RNA, 18 nt, Human
acauguggcuugaauuaa

SEQ ID NO: 2005564 - RNA, 20 nt, Human
acauguggcuugaauuaaga

SEQ ID NO: 2005565 - RNA, 11 nt, Human
acauguuuuca

SEQ ID NO: 2005566 - RNA, 12 nt, Human
acauguuuucaa

SEQ ID NO: 2005567 - RNA, 13 nt, Human
acauguuuucaaa

SEQ ID NO: 2005568 - RNA, 14 nt, Human
acauguuuucaaau

SEQ ID NO: 2005569 - RNA, 15 nt, Human
acauguuuucaaaug

SEQ ID NO: 2005570 - RNA, 17 nt, Human
acauguguuggcagccu

SEQ ID NO: 2005571 - RNA, 20 nt, Human
acauaaauuuaguauuuugu

SEQ ID NO: 2005572 - RNA, 15 nt, Human
acauaagauaaaugu

SEQ ID NO: 2005573 - RNA, 20 nt, Human
acauaaguauuuaauucaug

SEQ ID NO: 2005574 - RNA, 22 nt, Human
acaucauuccuuuuuauuuaua

SEQ ID NO: 2005575 - RNA, 16 nt, Human
acaucauuccuuuuua

SEQ ID NO: 2005576 - RNA, 17 nt, Human
acaucauuccuuuuuau

SEQ ID NO: 2005577 - RNA, 21 nt, Human
acaucauuccuuuuuauuuau

SEQ ID NO: 2005578 - RNA, 20 nt, Human
acauacaggaagguagaaau

SEQ ID NO: 2005579 - RNA, 16 nt, Human
acauacaauuccaaac

SEQ ID NO: 2005580 - RNA, 17 nt, Human
acauaauacugaaccac

SEQ ID NO: 2005581 - RNA, 18 nt, Human
acauaauacugaaccacu

SEQ ID NO: 2005582 - RNA, 14 nt, Human
acauaauacugaac

SEQ ID NO: 2005583 - RNA, 16 nt, Human
acauaauacugaacca

SEQ ID NO: 2005584 - RNA, 18 nt, Human
acauccccccgccaaaag

SEQ ID NO: 2005585 - RNA, 12 nt, Human
acauccccugcu

SEQ ID NO: 2005586 - RNA, 15 nt, Human
acaucccucucugcu

SEQ ID NO: 2005587 - RNA, 16 nt, Human
acaucccucucugcug

SEQ ID NO: 2005588 - RNA, 17 nt, Human
acaugcacucagcucuu

SEQ ID NO: 2005589 - RNA, 18 nt, Human
acaugcacucagcucuug

SEQ ID NO: 2005590 - RNA, 13 nt, Human
acaugcacgugug

SEQ ID NO: 2005591 - RNA, 20 nt, Human
acaugccucucucaggccaa

SEQ ID NO: 2005592 - RNA, 23 nt, Human
acaugcagccacuuaggacaaau

SEQ ID NO: 2005593 - RNA, 19 nt, Human
acagcucuucuccaggcug

SEQ ID NO: 2005594 - RNA, 20 nt, Human
acagcucuucuccaggcugu

SEQ ID NO: 2005595 - RNA, 15 nt, Human
acaggcaaugcuggc

SEQ ID NO: 2005596 - RNA, 16 nt, Human
acaggcaaugcuggcu

SEQ ID NO: 2005597 - RNA, 14 nt, Human
acaggcacccacca

SEQ ID NO: 2005598 - RNA, 17 nt, Human
acaggcaaugcuggcug

SEQ ID NO: 2005599 - RNA, 17 nt, Human
acaguggagugcaaaag

SEQ ID NO: 2005600 - RNA, 19 nt, Human
acaguggagugcaaaaggc

SEQ ID NO: 2005601 - RNA, 15 nt, Human
acagugcuacugaaa

SEQ ID NO: 2005602 - RNA, 17 nt, Human
acagugcuacugaaagg

SEQ ID NO: 2005603 - RNA, 19 nt, Human
acagugauuaccagggacu

SEQ ID NO: 2005604 - RNA, 13 nt, Human
acagugcaucuca

SEQ ID NO: 2005605 - RNA, 15 nt, Human
acagugcaucucagc

SEQ ID NO: 2005606 - RNA, 17 nt, Human
acagugcaucucagccc

SEQ ID NO: 2005607 - RNA, 18 nt, Human
acagugcaucucagccca

SEQ ID NO: 2005608 - RNA, 23 nt, Human
acaggcacccaccaucaugucug

SEQ ID NO: 2005609 - RNA, 23 nt, Human
acagugaucaaguuauuuuuaau

SEQ ID NO: 2005610 - RNA, 20 nt, Human
acuaauguguaagacaaaaa

SEQ ID NO: 2005611 - RNA, 18 nt, Human
acuaauggggcggugaga

SEQ ID NO: 2005612 - RNA, 19 nt, Human
acguggagaaucacaggcu

SEQ ID NO: 2005613 - RNA, 21 nt, Human
acguggagaaucacaggcugg

SEQ ID NO: 2005614 - RNA, 22 nt, Human
acguggagaaucacaggcuggg

SEQ ID NO: 2005615 - RNA, 19 nt, Human
acgcugugcugcccugccc

SEQ ID NO: 2005616 - RNA, 22 nt, Human
acgcugugcugcccugcccacc

SEQ ID NO: 2005617 - RNA, 15 nt, Human
acgcaccagcccaga

SEQ ID NO: 2005618 - RNA, 12 nt, Human
acgcagcccugc

SEQ ID NO: 2005619 - RNA, 22 nt, Human
acgcagcccugcuuugggcugc

SEQ ID NO: 2005620 - RNA, 23 nt, Human
acgcagcccugcuuugggcugcc

SEQ ID NO: 2005621 - RNA, 17 nt, Human
acgugaagauaccauaa

SEQ ID NO: 2005622 - RNA, 13 nt, Human
acgucuuaaauau

SEQ ID NO: 2005623 - RNA, 14 nt, Human
acgucuuaaauauu

SEQ ID NO: 2005624 - RNA, 13 nt, Human
acgucugugccau

SEQ ID NO: 2005625 - RNA, 12 nt, Human
acgucugugcca

SEQ ID NO: 2005626 - RNA, 19 nt, Human
acggacacucaaaagcugg

SEQ ID NO: 2005627 - RNA, 17 nt, Human
acggacacucaaaagcu

SEQ ID NO: 2005628 - RNA, 19 nt, Human
acggaauaguuggcuagga

SEQ ID NO: 2005629 - RNA, 20 nt, Human
acgauuucuguuuagauaau

SEQ ID NO: 2005630 - RNA, 23 nt, Human
acgauuucuguuuagauaauaca

SEQ ID NO: 2005631 - RNA, 19 nt, Human
acgauuucuguuuagauaa

SEQ ID NO: 2005632 - RNA, 12 nt, Human
accucugccuga

SEQ ID NO: 2005633 - RNA, 20 nt, Human
accucugccugaagucacac

SEQ ID NO: 2005634 - RNA, 23 nt, Human
accucugccugaagucacacagu

SEQ ID NO: 2005635 - RNA, 20 nt, Human
accugccccucaacucuccu

SEQ ID NO: 2005636 - RNA, 15 nt, Human
accugccccucaacu

SEQ ID NO: 2005637 - RNA, 12 nt, Human
accugccccuca

SEQ ID NO: 2005638 - RNA, 23 nt, Human
accugccaggaagccagcaggcu

SEQ ID NO: 2005639 - RNA, 22 nt, Human
accugccaggaagccagcaggc

SEQ ID NO: 2005640 - RNA, 21 nt, Human
accugccaggaagccagcagg

SEQ ID NO: 2005641 - RNA, 23 nt, Human
accugugagcugcaccagguaga

SEQ ID NO: 2005642 - RNA, 14 nt, Human
acccugguugugug

SEQ ID NO: 2005643 - RNA, 18 nt, Human
acccuguauaucagggua

SEQ ID NO: 2005644 - RNA, 15 nt, Human
acccugucaaacauu

SEQ ID NO: 2005645 - RNA, 16 nt, Human
acccugucaaacauua

SEQ ID NO: 2005646 - RNA, 21 nt, Human
acccugucucuacuaaaaaua

SEQ ID NO: 2005647 - RNA, 18 nt, Human
acccugucaaacauuagu

SEQ ID NO: 2005648 - RNA, 16 nt, Human
acccugugauggggcc

SEQ ID NO: 2005649 - RNA, 16 nt, Human
acccuggggagaaagu

SEQ ID NO: 2005650 - RNA, 16 nt, Human
acccucaggcaggugg

SEQ ID NO: 2005651 - RNA, 15 nt, Human
acccucaggcaggug

SEQ ID NO: 2005652 - RNA, 13 nt, Human
acccucaucacca

SEQ ID NO: 2005653 - RNA, 14 nt, Human
acccucaggcaggu

SEQ ID NO: 2005654 - RNA, 13 nt, Human
acccucaggcagg

SEQ ID NO: 2005655 - RNA, 18 nt, Human
acccucagagccaccccu

SEQ ID NO: 2005656 - RNA, 23 nt, Human
acccucaucaccaacgucugugc

SEQ ID NO: 2005657 - RNA, 23 nt, Human
acccuggcacuauaauguaagcu

SEQ ID NO: 2005658 - RNA, 18 nt, Human
acccuggcacccagggug

SEQ ID NO: 2005659 - RNA, 22 nt, Human
acccuggcaaagcagcaacaca

SEQ ID NO: 2005660 - RNA, 19 nt, Human
acccuauugcugcuugagg

SEQ ID NO: 2005661 - RNA, 14 nt, Human
acccuauugcugcu

SEQ ID NO: 2005662 - RNA, 11 nt, Human
acccucagagc

SEQ ID NO: 2005663 - RNA, 13 nt, Human
acccuauugcugc

SEQ ID NO: 2005664 - RNA, 15 nt, Human
acccuauaucuauaa

SEQ ID NO: 2005665 - RNA, 18 nt, Human
accgugaggccagagaca

SEQ ID NO: 2005666 - RNA, 23 nt, Human
accgggcugggagcucugcagag

SEQ ID NO: 2005667 - RNA, 21 nt, Human
accgggcugggagcucugcag

SEQ ID NO: 2005668 - RNA, 23 nt, Human
accgugaggccagagacacaagc

SEQ ID NO: 2005669 - RNA, 19 nt, Human
accgugccuggccacgccc

SEQ ID NO: 2005670 - RNA, 12 nt, Human
accucagccucc

SEQ ID NO: 2005671 - RNA, 11 nt, Human
accucagccuc

SEQ ID NO: 2005672 - RNA, 21 nt, Human
acccugugauggggcccugcc

SEQ ID NO: 2005673 - RNA, 20 nt, Human
acccugugauggggcccugc

SEQ ID NO: 2005674 - RNA, 19 nt, Human
acccugugauggggcccug

SEQ ID NO: 2005675 - RNA, 17 nt, Human
acccugugauggggccc

SEQ ID NO: 2005676 - RNA, 12 nt, Human
accgggcacuca

SEQ ID NO: 2005677 - RNA, 14 nt, Human
accgggcacucaga

SEQ ID NO: 2005678 - RNA, 20 nt, Human
accgggccacagagaaagua

SEQ ID NO: 2005679 - RNA, 16 nt, Human
accgggcacucagaag

SEQ ID NO: 2005680 - RNA, 11 nt, Human
accucaggccu

SEQ ID NO: 2005681 - RNA, 20 nt, Human
accucaggugauccacccac

SEQ ID NO: 2005682 - RNA, 21 nt, Human
accucaggugauccacccacc

SEQ ID NO: 2005683 - RNA, 13 nt, Human
acuuggucuguga

SEQ ID NO: 2005684 - RNA, 18 nt, Human
acuuggucacagccaggc

SEQ ID NO: 2005685 - RNA, 23 nt, Human
acuugggggcucagcaaggccac

SEQ ID NO: 2005686 - RNA, 21 nt, Human
acuuggguccaggccuacucc

SEQ ID NO: 2005687 - RNA, 23 nt, Human
acuuggggggcugaggugggagg

SEQ ID NO: 2005688 - RNA, 22 nt, Human
acuugaaaagagacaggcaggu

SEQ ID NO: 2005689 - RNA, 18 nt, Human
acuuggggcacagggaga

SEQ ID NO: 2005690 - RNA, 15 nt, Human
acuugggggcucagc

SEQ ID NO: 2005691 - RNA, 16 nt, Human
acuugggggcucagca

SEQ ID NO: 2005692 - RNA, 17 nt, Human
acuugggggcucagcaa

SEQ ID NO: 2005693 - RNA, 20 nt, Human
acuugggggcucagcaaggc

SEQ ID NO: 2005694 - RNA, 21 nt, Human
acuugggggcucagcaaggcc

SEQ ID NO: 2005695 - RNA, 22 nt, Human
acuugggggcucagcaaggcca

SEQ ID NO: 2005696 - RNA, 14 nt, Human
acuugaaaauuaac

SEQ ID NO: 2005697 - RNA, 15 nt, Human
acuugaaaagagaca

SEQ ID NO: 2005698 - RNA, 17 nt, Human
acuugaaaagagacagg

SEQ ID NO: 2005699 - RNA, 20 nt, Human
acuugaaaagagacaggcag

SEQ ID NO: 2005700 - RNA, 21 nt, Human
acuugaaaagagacaggcagg

SEQ ID NO: 2005701 - RNA, 12 nt, Human
acuugaaaauua

SEQ ID NO: 2005702 - RNA, 11 nt, Human
acuugaaaaga

SEQ ID NO: 2005703 - RNA, 22 nt, Human
acuucuuggcuuggugaggaaa

SEQ ID NO: 2005704 - RNA, 21 nt, Human
acuucagacauagaauuaaca

SEQ ID NO: 2005705 - RNA, 12 nt, Human
acuuguagauuu

SEQ ID NO: 2005706 - RNA, 13 nt, Human
acuuguagauuug

SEQ ID NO: 2005707 - RNA, 20 nt, Human
acuuggucacagccaggcgc

SEQ ID NO: 2005708 - RNA, 14 nt, Human
acuuguagauuuga

SEQ ID NO: 2005709 - RNA, 15 nt, Human
acuuguagauuugau

SEQ ID NO: 2005710 - RNA, 16 nt, Human
acuuguagauuugauu

SEQ ID NO: 2005711 - RNA, 17 nt, Human
acuuguagauuugauuu

SEQ ID NO: 2005712 - RNA, 18 nt, Human
acuuguagauuugauuuu

SEQ ID NO: 2005713 - RNA, 18 nt, Human
acuuguauauucuauuuu

SEQ ID NO: 2005714 - RNA, 19 nt, Human
acuuguauauucuauuuua

SEQ ID NO: 2005715 - RNA, 20 nt, Human
acuuguauauucuauuuuac

SEQ ID NO: 2005716 - RNA, 22 nt, Human
acuuguauauucuauuuuacaa

SEQ ID NO: 2005717 - RNA, 22 nt, Human
acuuaaaaaugguuuaaauggu

SEQ ID NO: 2005718 - RNA, 12 nt, Human
acuuaaaacacg

SEQ ID NO: 2005719 - RNA, 14 nt, Human
acuuaaaacacguu

SEQ ID NO: 2005720 - RNA, 18 nt, Human
acuuaaaacacguuuuaa

SEQ ID NO: 2005721 - RNA, 15 nt, Human
acuucaaaaguuugu

SEQ ID NO: 2005722 - RNA, 15 nt, Human
acuguuucaaacuuu

SEQ ID NO: 2005723 - RNA, 18 nt, Human
acuguuucaaacuuuacu

SEQ ID NO: 2005724 - RNA, 19 nt, Human
acuguuucaaacuuuacua

SEQ ID NO: 2005725 - RNA, 16 nt, Human
acugucuuuuuucuaa

SEQ ID NO: 2005726 - RNA, 17 nt, Human
acuguaaaauacuucuu

SEQ ID NO: 2005727 - RNA, 13 nt, Human
acuggugauauau

SEQ ID NO: 2005728 - RNA, 15 nt, Human
acuggugauauaucu

SEQ ID NO: 2005729 - RNA, 12 nt, Human
acuguaaaaugc

SEQ ID NO: 2005730 - RNA, 13 nt, Human
acuguaaaaugca

SEQ ID NO: 2005731 - RNA, 15 nt, Human
acuguaaaaugcaaa

SEQ ID NO: 2005732 - RNA, 16 nt, Human
acuguaaaaugcaaaa

SEQ ID NO: 2005733 - RNA, 19 nt, Human
acuguaaaaugcaaaaaau

SEQ ID NO: 2005734 - RNA, 21 nt, Human
acuguaaaaugcaaaaaaucu

SEQ ID NO: 2005735 - RNA, 24 nt, Human
acuguaaaaugcaaaaaaucuuaa

SEQ ID NO: 2005736 - RNA, 16 nt, Human
acugugaagagaacca

SEQ ID NO: 2005737 - RNA, 23 nt, Human
acugucuuuuuucuaaaguaaaa

SEQ ID NO: 2005738 - RNA, 22 nt, Human
acugucuuuuuucuaaaguaaa

SEQ ID NO: 2005739 - RNA, 17 nt, Human
acugugccaugugccag

SEQ ID NO: 2005740 - RNA, 18 nt, Human
acugugccaugugccagg

SEQ ID NO: 2005741 - RNA, 19 nt, Human
acugcccaggccugccugu

SEQ ID NO: 2005742 - RNA, 14 nt, Human
acugccaugccagc

SEQ ID NO: 2005743 - RNA, 12 nt, Human
acuggaacucuc

SEQ ID NO: 2005744 - RNA, 15 nt, Human
acuggaggagcuggg

SEQ ID NO: 2005745 - RNA, 15 nt, Human
acugccuauuuuaau

SEQ ID NO: 2005746 - RNA, 17 nt, Human
acuguaaaauaauaacu

SEQ ID NO: 2005747 - RNA, 12 nt, Human
acugguggcccg

SEQ ID NO: 2005748 - RNA, 15 nt, Human
acucccaucagccca

SEQ ID NO: 2005749 - RNA, 22 nt, Human
acucccaucugugaaaggaaag

SEQ ID NO: 2005750 - RNA, 20 nt, Human
acucccagcaucgcacucug

SEQ ID NO: 2005751 - RNA, 15 nt, Human
acucccaagcuggac

SEQ ID NO: 2005752 - RNA, 21 nt, Human
acucccaagacccgagcuggg

SEQ ID NO: 2005753 - RNA, 18 nt, Human
acucccugccccccagcc

SEQ ID NO: 2005754 - RNA, 14 nt, Human
acucccuuucaaca

SEQ ID NO: 2005755 - RNA, 15 nt, Human
acucuacagaggcca

SEQ ID NO: 2005756 - RNA, 16 nt, Human
acucuacaugcuuguu

SEQ ID NO: 2005757 - RNA, 23 nt, Human
acugaauuucuuuugccguuauu

SEQ ID NO: 2005758 - RNA, 15 nt, Human
acugaauuuuuaugu

SEQ ID NO: 2005759 - RNA, 16 nt, Human
acugaauuuuuaugug

SEQ ID NO: 2005760 - RNA, 19 nt, Human
acugaauuuuuauguguga

SEQ ID NO: 2005761 - RNA, 17 nt, Human
acugacauuguuggcca

SEQ ID NO: 2005762 - RNA, 18 nt, Human
acugacauuguuggccaa

SEQ ID NO: 2005763 - RNA, 13 nt, Human
acugaauuaugaa

SEQ ID NO: 2005764 - RNA, 14 nt, Human
acugaauuaugaaa

SEQ ID NO: 2005765 - RNA, 15 nt, Human
acugaauuaugaaac

SEQ ID NO: 2005766 - RNA, 20 nt, Human
acugaauuaugaaacuuuug

SEQ ID NO: 2005767 - RNA, 12 nt, Human
acugaauuccaa

SEQ ID NO: 2005768 - RNA, 21 nt, Human
acugaauuccaaacaugguuu

SEQ ID NO: 2005769 - RNA, 12 nt, Human
acugaauuucuu

SEQ ID NO: 2005770 - RNA, 18 nt, Human
acugauguuugugcagua

SEQ ID NO: 2005771 - RNA, 16 nt, Human
acugauguuugugcag

SEQ ID NO: 2005772 - RNA, 20 nt, Human
acugauuuuguacauaaaca

SEQ ID NO: 2005773 - RNA, 16 nt, Human
acugauuuuuuuuucc

SEQ ID NO: 2005774 - RNA, 20 nt, Human
acugauuuuuuuuuccuuca

SEQ ID NO: 2005775 - RNA, 19 nt, Human
acugauuuuuuuuuccuuc

SEQ ID NO: 2005776 - RNA, 18 nt, Human
acugauuuuuuuuuccuu

SEQ ID NO: 2005777 - RNA, 17 nt, Human
acugauuuuuuuuuccu

SEQ ID NO: 2005778 - RNA, 14 nt, Human
acugauuacugccu

SEQ ID NO: 2005779 - RNA, 19 nt, Human
acugauguguugugccuua

SEQ ID NO: 2005780 - RNA, 23 nt, Human
acugaucucaggggucuuaccuu

SEQ ID NO: 2005781 - RNA, 23 nt, Human
acugaugggcaacccccagccug

SEQ ID NO: 2005782 - RNA, 16 nt, Human
acugauccagcccuga

SEQ ID NO: 2005783 - RNA, 17 nt, Human
acugauccagcccugag

SEQ ID NO: 2005784 - RNA, 15 nt, Human
aagaguccucugaau

SEQ ID NO: 2005785 - RNA, 13 nt, Human
aagagaaaaaaua

SEQ ID NO: 2005786 - RNA, 19 nt, Human
aagacuuuucuuucagcca

SEQ ID NO: 2005787 - RNA, 12 nt, Human
aagacuuuucuu

SEQ ID NO: 2005788 - RNA, 21 nt, Human
aagacuuuuccaacccucauc

SEQ ID NO: 2005789 - RNA, 15 nt, Human
aagaccacguuucua

SEQ ID NO: 2005790 - RNA, 17 nt, Human
aagaccacguuucuaaa

SEQ ID NO: 2005791 - RNA, 23 nt, Human
aagacagauacuccuccaagguu

SEQ ID NO: 2005792 - RNA, 11 nt, Human
aagagaaaaga

SEQ ID NO: 2005793 - RNA, 12 nt, Human
aagagaaaagaa

SEQ ID NO: 2005794 - RNA, 13 nt, Human
aagagaaaagaaa

SEQ ID NO: 2005795 - RNA, 17 nt, Human
aagacuuuuccaacccu

SEQ ID NO: 2005796 - RNA, 16 nt, Human
aagagaaaagaaaaaa

SEQ ID NO: 2005797 - RNA, 14 nt, Human
aagagaaaagaaaa

SEQ ID NO: 2005798 - RNA, 15 nt, Human
aagagaaaagaaaaa

SEQ ID NO: 2005799 - RNA, 12 nt, Human
aagaacuuguuu

SEQ ID NO: 2005800 - RNA, 14 nt, Human
aagaacuuguuuaa

SEQ ID NO: 2005801 - RNA, 15 nt, Human
aagaacuuguuuaau

SEQ ID NO: 2005802 - RNA, 18 nt, Human
aagaacuuguuuaauaaa

SEQ ID NO: 2005803 - RNA, 12 nt, Human
aagaacugcuuu

SEQ ID NO: 2005804 - RNA, 16 nt, Human
aagaacuaucuucauc

SEQ ID NO: 2005805 - RNA, 14 nt, Human
aagaacuaucuuca

SEQ ID NO: 2005806 - RNA, 17 nt, Human
aacgcccacuucccugg

SEQ ID NO: 2005807 - RNA, 12 nt, Human
aacgcagcccug

SEQ ID NO: 2005808 - RNA, 16 nt, Human
aacgcagcccugcuuu

SEQ ID NO: 2005809 - RNA, 17 nt, Human
aagaaccuaacauuuau

SEQ ID NO: 2005810 - RNA, 14 nt, Human
aagaacuagcauaa

SEQ ID NO: 2005811 - RNA, 23 nt, Human
aagacacaggggacacccagaaa

SEQ ID NO: 2005812 - RNA, 20 nt, Human
aagacaaugugaaaagaaaa

SEQ ID NO: 2005813 - RNA, 19 nt, Human
aagacaaugugaaaagaaa

SEQ ID NO: 2005814 - RNA, 22 nt, Human
aagacaaugacuuacuguacau

SEQ ID NO: 2005815 - RNA, 19 nt, Human
aagaacuuccccauacaaa

SEQ ID NO: 2005816 - RNA, 14 nt, Human
aagacaacauugua

SEQ ID NO: 2005817 - RNA, 17 nt, Human
aagacaacauuguaaga

SEQ ID NO: 2005818 - RNA, 21 nt, Human
aagacaaggaaaaaauaacaa

SEQ ID NO: 2005819 - RNA, 18 nt, Human
aagaagaaauaguucugu

SEQ ID NO: 2005820 - RNA, 19 nt, Human
aagcugcacccucaggcag

SEQ ID NO: 2005821 - RNA, 13 nt, Human
aagcugcacccuc

SEQ ID NO: 2005822 - RNA, 15 nt, Human
aaggcaaggcuguca

SEQ ID NO: 2005823 - RNA, 16 nt, Human
aaggcaaggcugucaa

SEQ ID NO: 2005824 - RNA, 19 nt, Human
aaggcagggagggccuggg

SEQ ID NO: 2005825 - RNA, 22 nt, Human
aaggcagggagggccugggccc

SEQ ID NO: 2005826 - RNA, 18 nt, Human
aaggcaggggaauguaug

SEQ ID NO: 2005827 - RNA, 20 nt, Human
aaggcaggggaauguaugug

SEQ ID NO: 2005828 - RNA, 13 nt, Human
aaggcaaggcugu

SEQ ID NO: 2005829 - RNA, 13 nt, Human
aagauaaguugga

SEQ ID NO: 2005830 - RNA, 15 nt, Human
aagauaaguuggaaa

SEQ ID NO: 2005831 - RNA, 16 nt, Human
aagauaaguuggaaac

SEQ ID NO: 2005832 - RNA, 17 nt, Human
aagauaaguuggaaaca

SEQ ID NO: 2005833 - RNA, 14 nt, Human
aagauaaaugugcu

SEQ ID NO: 2005834 - RNA, 21 nt, Human
aagauaauauuaaggaagaca

SEQ ID NO: 2005835 - RNA, 19 nt, Human
aagauaauauuaaggaaga

SEQ ID NO: 2005836 - RNA, 17 nt, Human
aagauacaguuacucag

SEQ ID NO: 2005837 - RNA, 19 nt, Human
aagauaaguuggaaacacu

SEQ ID NO: 2005838 - RNA, 20 nt, Human
aagauaaguuggaaacacua

SEQ ID NO: 2005839 - RNA, 22 nt, Human
aagauaaguuggaaacacuaaa

SEQ ID NO: 2005840 - RNA, 20 nt, Human
aagccagggcccgggaagca

SEQ ID NO: 2005841 - RNA, 21 nt, Human
aagccagguuccacagaggac

SEQ ID NO: 2005842 - RNA, 23 nt, Human
aagccagguuccacagaggacac

SEQ ID NO: 2005843 - RNA, 13 nt, Human
aagcuacuuauug

SEQ ID NO: 2005844 - RNA, 16 nt, Human
aagcgugagccacugc

SEQ ID NO: 2005845 - RNA, 13 nt, Human
aagcguauggcuu

SEQ ID NO: 2005846 - RNA, 15 nt, Human
aagcguauggcuuua

SEQ ID NO: 2005847 - RNA, 15 nt, Human
aagcgugagccacug

SEQ ID NO: 2005848 - RNA, 14 nt, Human
aagcggcuggcagc

SEQ ID NO: 2005849 - RNA, 21 nt, Human
aagcggcccuaagggaguguc

SEQ ID NO: 2005850 - RNA, 22 nt, Human
aagcggcucaagcccaggaggg

SEQ ID NO: 2005851 - RNA, 14 nt, Human
aagcgaaaaacuca

SEQ ID NO: 2005852 - RNA, 18 nt, Human
aagccuuuguugaacugu

SEQ ID NO: 2005853 - RNA, 10 nt, Human
aagccuuugu

SEQ ID NO: 2005854 - RNA, 17 nt, Human
aagccuuucauuuugcu

SEQ ID NO: 2005855 - RNA, 14 nt, Human
aagccuuuguugaa

SEQ ID NO: 2005856 - RNA, 15 nt, Human
aagccuuucauuuug

SEQ ID NO: 2005857 - RNA, 16 nt, Human
aauaaacacucuugaa

SEQ ID NO: 2005858 - RNA, 11 nt, Human
aauaaacacuc

SEQ ID NO: 2005859 - RNA, 23 nt, Human
aaguuuaaggaauaugggagaaa

SEQ ID NO: 2005860 - RNA, 19 nt, Human
aauaaacacucuugaaaaa

SEQ ID NO: 2005861 - RNA, 12 nt, Human
aauaaacuuucu

SEQ ID NO: 2005862 - RNA, 15 nt, Human
aaguuggaaacacua

SEQ ID NO: 2005863 - RNA, 19 nt, Human
aaguuggaaacacuaaaug

SEQ ID NO: 2005864 - RNA, 20 nt, Human
aaguuggaaacacuaaaugu

SEQ ID NO: 2005865 - RNA, 21 nt, Human
aaguuggaaacacuaaauguu

SEQ ID NO: 2005866 - RNA, 22 nt, Human
aaguuggaaacacuaaauguua

SEQ ID NO: 2005867 - RNA, 23 nt, Human
aaguuggaaacacuaaauguuaa

SEQ ID NO: 2005868 - RNA, 15 nt, Human
aaguuguacuuuaaa

SEQ ID NO: 2005869 - RNA, 18 nt, Human
aaguuguacuuuaaaaau

SEQ ID NO: 2005870 - RNA, 20 nt, Human
aaguuguacuuuaaaaauuu

SEQ ID NO: 2005871 - RNA, 21 nt, Human
aaguuguacuuuaaaaauuua

SEQ ID NO: 2005872 - RNA, 21 nt, Human
aaguuguacuccaauggcuga

SEQ ID NO: 2005873 - RNA, 12 nt, Human
aaguuguacuuu

SEQ ID NO: 2005874 - RNA, 14 nt, Human
aaguuguacuuuaa

SEQ ID NO: 2005875 - RNA, 19 nt, Human
aaguuuaaauauuaagcau

SEQ ID NO: 2005876 - RNA, 14 nt, Human
aaguuuaaggaaua

SEQ ID NO: 2005877 - RNA, 15 nt, Human
aaguuuaaggaauau

SEQ ID NO: 2005878 - RNA, 22 nt, Human
aagugcugcauuuaaaagauac

SEQ ID NO: 2005879 - RNA, 23 nt, Human
aaguggccuccgucacuaccugg

SEQ ID NO: 2005880 - RNA, 13 nt, Human
aaguggcaaagcu

SEQ ID NO: 2005881 - RNA, 19 nt, Human
aaguggcaaagcuguucuu

SEQ ID NO: 2005882 - RNA, 14 nt, Human
aaguggacuggagg

SEQ ID NO: 2005883 - RNA, 22 nt, Human
aaguggcaaagcuguucuuccu

SEQ ID NO: 2005884 - RNA, 23 nt, Human
aaguggcaaagcuguucuuccug

SEQ ID NO: 2005885 - RNA, 13 nt, Human
aaguggcaccugu

SEQ ID NO: 2005886 - RNA, 17 nt, Human
aaguggcaccugucugc

SEQ ID NO: 2005887 - RNA, 18 nt, Human
aaguggcaccugucugcu

SEQ ID NO: 2005888 - RNA, 21 nt, Human
aaguggcaccugucugcucca

SEQ ID NO: 2005889 - RNA, 12 nt, Human
aagugcugggau

SEQ ID NO: 2005890 - RNA, 19 nt, Human
aauaauguuaacauggaca

SEQ ID NO: 2005891 - RNA, 14 nt, Human
aauaaagcagcguu

SEQ ID NO: 2005892 - RNA, 17 nt, Human
aauaaugugaaacugga

SEQ ID NO: 2005893 - RNA, 22 nt, Human
aauaaugugaaacuggauuaaa

SEQ ID NO: 2005894 - RNA, 16 nt, Human
aauaaagcaauaagaa

SEQ ID NO: 2005895 - RNA, 21 nt, Human
aaucaccgaaaacguggcugc

SEQ ID NO: 2005896 - RNA, 22 nt, Human
aaucaaugcuauaacuauguug

SEQ ID NO: 2005897 - RNA, 23 nt, Human
aaucaccgaaaacguggcugcuu

SEQ ID NO: 2005898 - RNA, 19 nt, Human
aaucaccuaauuaauuuca

SEQ ID NO: 2005899 - RNA, 20 nt, Human
aaucaccuaauuaauuucag

SEQ ID NO: 2005900 - RNA, 19 nt, Human
aaucaccgaugcaaacauu

SEQ ID NO: 2005901 - RNA, 23 nt, Human
aaucaaguuggcuucuaaucaaa

SEQ ID NO: 2005902 - RNA, 13 nt, Human
aaucaaagugcua

SEQ ID NO: 2005903 - RNA, 17 nt, Human
aaucaauaacagccgcu

SEQ ID NO: 2005904 - RNA, 23 nt, Human
aaucaauaacagccgcuccagag

SEQ ID NO: 2005905 - RNA, 21 nt, Human
aauauuaagcaugacagaaaa

SEQ ID NO: 2005906 - RNA, 22 nt, Human
aauauuaagcaugacagaaaau

SEQ ID NO: 2005907 - RNA, 13 nt, Human
aauauuaagcaug

SEQ ID NO: 2005908 - RNA, 13 nt, Human
aauauuaagaaag

SEQ ID NO: 2005909 - RNA, 12 nt, Human
aauaugugauuu

SEQ ID NO: 2005910 - RNA, 19 nt, Human
aauaugugauuuuuuuucc

SEQ ID NO: 2005911 - RNA, 23 nt, Human
aauauguggaguucaucuugaau

SEQ ID NO: 2005912 - RNA, 11 nt, Human
aauaugugaag

SEQ ID NO: 2005913 - RNA, 19 nt, Human
aauaugugaaggaccuuca

SEQ ID NO: 2005914 - RNA, 21 nt, Human
aauaugugaaggaccuucacu

SEQ ID NO: 2005915 - RNA, 13 nt, Human
aauauauagcauu

SEQ ID NO: 2005916 - RNA, 14 nt, Human
aauauauagcauuu

SEQ ID NO: 2005917 - RNA, 18 nt, Human
aaucugaauuggaaugca

SEQ ID NO: 2005918 - RNA, 23 nt, Human
aaucugaggaauggacauuucua

SEQ ID NO: 2005919 - RNA, 17 nt, Human
aaucugaagauuguuua

SEQ ID NO: 2005920 - RNA, 18 nt, Human
aaucugaagauuguuuau

SEQ ID NO: 2005921 - RNA, 21 nt, Human
aaucugaagauuguuuaucua

SEQ ID NO: 2005922 - RNA, 14 nt, Human
aaucugaagauugu

SEQ ID NO: 2005923 - RNA, 15 nt, Human
aaucugaagauuguu

SEQ ID NO: 2005924 - RNA, 20 nt, Human
aaugaaagacuguacaaagu

SEQ ID NO: 2005925 - RNA, 18 nt, Human
aaugaaagacuguacaaa

SEQ ID NO: 2005926 - RNA, 20 nt, Human
aaugaagauacugaaauaaa

SEQ ID NO: 2005927 - RNA, 21 nt, Human
aaugaaagacuguacaaagua

SEQ ID NO: 2005928 - RNA, 14 nt, Human
aaugaagcaaugcu

SEQ ID NO: 2005929 - RNA, 16 nt, Human
aaucugagggagcuga

SEQ ID NO: 2005930 - RNA, 20 nt, Human
aaugaugccaugaggaacaa

SEQ ID NO: 2005931 - RNA, 20 nt, Human
aaugauguauguugaagccu

SEQ ID NO: 2005932 - RNA, 20 nt, Human
aaugaauacuuuauaaagga

SEQ ID NO: 2005933 - RNA, 18 nt, Human
aaccuuuuuauuucaaac

SEQ ID NO: 2005934 - RNA, 23 nt, Human
aaccuuuugagugccuuacacaa

SEQ ID NO: 2005935 - RNA, 16 nt, Human
aaccuuuugagugccu

SEQ ID NO: 2005936 - RNA, 18 nt, Human
aaccuuuguuugcaucug

SEQ ID NO: 2005937 - RNA, 20 nt, Human
aacauggcuacuugcuuuga

SEQ ID NO: 2005938 - RNA, 23 nt, Human
aacauggccuuugcuugaaagaa

SEQ ID NO: 2005939 - RNA, 19 nt, Human
aacccucagagccaccccu

SEQ ID NO: 2005940 - RNA, 12 nt, Human
aacccucagagc

SEQ ID NO: 2005941 - RNA, 19 nt, Human
aaccguguuugucucuucu

SEQ ID NO: 2005942 - RNA, 20 nt, Human
aaccguguuugucucuucug

SEQ ID NO: 2005943 - RNA, 21 nt, Human
aaccguguuugucucuucugg

SEQ ID NO: 2005944 - RNA, 23 nt, Human
aaauucuucuccacuuucuagcc

SEQ ID NO: 2005945 - RNA, 15 nt, Human
aaauucuugcaaagu

SEQ ID NO: 2005946 - RNA, 18 nt, Human
aaauucuugcaaaguauc

SEQ ID NO: 2005947 - RNA, 22 nt, Human
aaauucuguuuuuaaaaauuag

SEQ ID NO: 2005948 - RNA, 19 nt, Human
aacagcccuauuucuugau

SEQ ID NO: 2005949 - RNA, 11 nt, Human
aacaggcagau

SEQ ID NO: 2005950 - RNA, 22 nt, Human
aacaggcaaacauuuucucuua

SEQ ID NO: 2005951 - RNA, 15 nt, Human
aacagccgcuccaga

SEQ ID NO: 2005952 - RNA, 16 nt, Human
aacaggcccuccuccc

SEQ ID NO: 2005953 - RNA, 22 nt, Human
aacauggccuuugcuugaaaga

SEQ ID NO: 2005954 - RNA, 14 nt, Human
aaaggaugcacaga

SEQ ID NO: 2005955 - RNA, 20 nt, Human
aaaggaugcccaaagaugca

SEQ ID NO: 2005956 - RNA, 17 nt, Human
aaauauuuaauguugaa

SEQ ID NO: 2005957 - RNA, 12 nt, Human
aaauauuguuaa

SEQ ID NO: 2005958 - RNA, 13 nt, Human
aaauauuuaugaa

SEQ ID NO: 2005959 - RNA, 15 nt, Human
aaauauuuaugaaga

SEQ ID NO: 2005960 - RNA, 16 nt, Human
aaauauuuaugaagaa

SEQ ID NO: 2005961 - RNA, 22 nt, Human
aaauauuuaugaagaaaauacu

SEQ ID NO: 2005962 - RNA, 22 nt, Human
aaauauuuagauguaauuuugu

SEQ ID NO: 2005963 - RNA, 21 nt, Human
aaauauuuaauguugaacaaa

SEQ ID NO: 2005964 - RNA, 21 nt, Human
aaauauuuuuuuuucuuucag

SEQ ID NO: 2005965 - RNA, 14 nt, Human
aaaucuuuuugcuu

SEQ ID NO: 2005966 - RNA, 13 nt, Human
aaaucuuuuugcu

SEQ ID NO: 2005967 - RNA, 19 nt, Human
aaaucuccaaaauaaaacu

SEQ ID NO: 2005968 - RNA, 14 nt, Human
aaaucucaucccua

SEQ ID NO: 2005969 - RNA, 14 nt, Human
aaauggaguuggag

SEQ ID NO: 2005970 - RNA, 22 nt, Human
aaauggaguuggaguucauuca

SEQ ID NO: 2005971 - RNA, 19 nt, Human
aaaugcuguaacuuucuga

SEQ ID NO: 2005972 - RNA, 22 nt, Human
aaaugcugucuuucuugcuccc

SEQ ID NO: 2005973 - RNA, 23 nt, Human
aaaugcugucuuucuugcucccu

SEQ ID NO: 2005974 - RNA, 14 nt, Human
aaaugaaaaaauau

SEQ ID NO: 2005975 - RNA, 23 nt, Human
aaaucuuuuccaggaaaaagaac

SEQ ID NO: 2005976 - RNA, 11 nt, Human
aaauguuuuca

SEQ ID NO: 2005977 - RNA, 14 nt, Human
aaauguuuucagcu

SEQ ID NO: 2005978 - RNA, 15 nt, Human
aaauguuuucagcua

SEQ ID NO: 2005979 - RNA, 18 nt, Human
aaauguuuucagcuagga

SEQ ID NO: 2005980 - RNA, 22 nt, Human
aaauguuuucauauuuuucaaa

SEQ ID NO: 2005981 - RNA, 23 nt, Human
aaauguuuuguaaacuuugaaau

SEQ ID NO: 2005982 - RNA, 13 nt, Human
aaauguuuuguaa

SEQ ID NO: 2005983 - RNA, 14 nt, Human
aaauguuuuguaaa

SEQ ID NO: 2005984 - RNA, 16 nt, Human
aaauguuuuguaaacu

SEQ ID NO: 2005985 - RNA, 19 nt, Human
aaauguuuuguaaacuuug

SEQ ID NO: 2005986 - RNA, 20 nt, Human
aaauguuuuguaaacuuuga

SEQ ID NO: 2005987 - RNA, 21 nt, Human
aaauguuuuguaaacuuugaa

SEQ ID NO: 2005988 - RNA, 22 nt, Human
aaauguuuuguaaacuuugaaa

SEQ ID NO: 2005989 - RNA, 12 nt, Human
aaauucuguuuu

SEQ ID NO: 2005990 - RNA, 15 nt, Human
aaauucuguuuuuaa

SEQ ID NO: 2005991 - RNA, 17 nt, Human
aaauucuguuuuuaaaa

SEQ ID NO: 2005992 - RNA, 19 nt, Human
aaauucuguuuuuaaaaau

SEQ ID NO: 2005993 - RNA, 17 nt, Human
aaauguucaucaaugaa

SEQ ID NO: 2005994 - RNA, 13 nt, Human
aaauguucaucaa

SEQ ID NO: 2005995 - RNA, 23 nt, Human
aaauggaguuggaguucauucau

SEQ ID NO: 2005996 - RNA, 15 nt, Human
aaauggcaacaaacu

SEQ ID NO: 2005997 - RNA, 18 nt, Human
aaauggcaacaaacugca

SEQ ID NO: 2005998 - RNA, 20 nt, Human
aaauggcaacaaacugcaca

SEQ ID NO: 2005999 - RNA, 17 nt, Human
aaauggcaaguuuucca

SEQ ID NO: 2006000 - RNA, 19 nt, Human
aaagaaaaaaaugucaaaa

SEQ ID NO: 2006001 - RNA, 18 nt, Human
aaagaaaaaagagaaaag

SEQ ID NO: 2006002 - RNA, 10 nt, Human
aaagaaaaaa

SEQ ID NO: 2006003 - RNA, 22 nt, Human
aaagaaaaaaaaaaagaaagaa

SEQ ID NO: 2006004 - RNA, 16 nt, Human
aaagaaaaaaaaagaa

SEQ ID NO: 2006005 - RNA, 15 nt, Human
aaagaaaaaaauguc

SEQ ID NO: 2006006 - RNA, 16 nt, Human
aaagaaaaaaauguca

SEQ ID NO: 2006007 - RNA, 16 nt, Human
aaagcauguuuugcau

SEQ ID NO: 2006008 - RNA, 17 nt, Human
aaagcauguuuugcaug

SEQ ID NO: 2006009 - RNA, 15 nt, Human
aaaaucucaaauuuc

SEQ ID NO: 2006010 - RNA, 16 nt, Human
aaaaucucaaauuucu

SEQ ID NO: 2006011 - RNA, 18 nt, Human
aaaaucucaaauuucuaa

SEQ ID NO: 2006012 - RNA, 12 nt, Human
aaacugcacaug

SEQ ID NO: 2006013 - RNA, 9 nt, Human
aaagaaaaa

SEQ ID NO: 2006014 - RNA, 11 nt, Human
aaagaaaaaaa

SEQ ID NO: 2006015 - RNA, 14 nt, Human
aaacugcacaugau

SEQ ID NO: 2006016 - RNA, 17 nt, Human
aaacugcacaugauuuc

SEQ ID NO: 2006017 - RNA, 18 nt, Human
aaacugcacaugauuuca

SEQ ID NO: 2006018 - RNA, 20 nt, Human
aaacugcacaugauuucaca

SEQ ID NO: 2006019 - RNA, 21 nt, Human
aaacugcacaugauuucacaa

SEQ ID NO: 2006020 - RNA, 22 nt, Human
aaacugcacaugauuucacaaa

SEQ ID NO: 2006021 - RNA, 23 nt, Human
aaacugauuuuuuuuuccuucag

SEQ ID NO: 2006022 - RNA, 22 nt, Human
aaacugauuuuuuuuuccuuca

SEQ ID NO: 2006023 - RNA, 23 nt, Human
aaacucuuaaaacccaagugccu

SEQ ID NO: 2006024 - RNA, 12 nt, Human
aaacucuuaaaa

SEQ ID NO: 2006025 - RNA, 22 nt, Human
aaacucuguuacacuuuuugga

SEQ ID NO: 2006026 - RNA, 18 nt, Human
aaacucuguuacacuuuu

SEQ ID NO: 2006027 - RNA, 16 nt, Human
aaaccgccaaggcugg

SEQ ID NO: 2006028 - RNA, 15 nt, Human
aaaccgccaaggcug

SEQ ID NO: 2006029 - RNA, 16 nt, Human
aaacccagcucugguc

SEQ ID NO: 2006030 - RNA, 12 nt, Human
aaacccagcucu

SEQ ID NO: 2006031 - RNA, 22 nt, Human
aaaccgaacugauguaaguaaa

SEQ ID NO: 2006032 - RNA, 17 nt, Human
aaacccacccuuucuac

SEQ ID NO: 2006033 - RNA, 13 nt, Human
aaaagucacaguu

SEQ ID NO: 2006034 - RNA, 19 nt, Human
aaaagucuuuuaaaaagua

SEQ ID NO: 2006035 - RNA, 14 nt, Human
aaaagucuuuuaaa

SEQ ID NO: 2006036 - RNA, 18 nt, Human
aaaagucuuuuaaaaagu

SEQ ID NO: 2006037 - RNA, 19 nt, Human
aaaagucuuaggugaacaa

SEQ ID NO: 2006038 - RNA, 18 nt, Human
aaaaguugaauuuuacau

SEQ ID NO: 2006039 - RNA, 15 nt, Human
aaaaguuguaugauc

SEQ ID NO: 2006040 - RNA, 16 nt, Human
aaaaguuguaugaucu

SEQ ID NO: 2006041 - RNA, 18 nt, Human
aaaaguuguaugaucugu

SEQ ID NO: 2006042 - RNA, 14 nt, Human
aaaauaaaacuuuu

SEQ ID NO: 2006043 - RNA, 21 nt, Human
aaaaucagccugcuccagcug

SEQ ID NO: 2006044 - RNA, 17 nt, Human
aaaaucagccugcucca

SEQ ID NO: 2006045 - RNA, 13 nt, Human
aaaaucagccugc

SEQ ID NO: 2006046 - RNA, 16 nt, Human
aaaauaaaacuuuuua

SEQ ID NO: 2006047 - RNA, 14 nt, Human
aaaagauaaauauu

SEQ ID NO: 2006048 - RNA, 21 nt, Human
aaaagauaaaaaaacagcuuu

SEQ ID NO: 2006049 - RNA, 19 nt, Human
aaaagaguguaaaauauuu

SEQ ID NO: 2006050 - RNA, 15 nt, Human
aaaagaguuaaggca

SEQ ID NO: 2006051 - RNA, 16 nt, Human
aaaagagaugaugaaa

SEQ ID NO: 2006052 - RNA, 19 nt, Human
aaaagagaugaugaaaaua

SEQ ID NO: 2006053 - RNA, 19 nt, Human
aaaagacgcaccagcccag

SEQ ID NO: 2006054 - RNA, 17 nt, Human
aaaagacuaagaucggu

SEQ ID NO: 2006055 - RNA, 13 nt, Human
aaaagagaaaaga

SEQ ID NO: 2006056 - RNA, 14 nt, Human
aaaagagaaaagaa

SEQ ID NO: 2006057 - RNA, 16 nt, Human
aaaagagaaaagaaaa

SEQ ID NO: 2006058 - RNA, 17 nt, Human
aaaagauaaauauuaua

SEQ ID NO: 2006059 - RNA, 17 nt, Human
aaaagauaccuuaaaau

SEQ ID NO: 2006060 - RNA, 21 nt, Human
aaaagauaccuuaaaauuuga

SEQ ID NO: 2006061 - RNA, 22 nt, Human
aaaagauaccuuaaaauuugaa

SEQ ID NO: 2006062 - RNA, 22 nt, Human
aaaagaaaucuauagaaagugu

SEQ ID NO: 2006063 - RNA, 12 nt, Human
aaaagaaaucua

SEQ ID NO: 2006064 - RNA, 10 nt, Human
aaaagaaaga

SEQ ID NO: 2006065 - RNA, 20 nt, Human
aaaagaaacucuauggucuu

SEQ ID NO: 2006066 - RNA, 11 nt, Human
aaaagaaagaa

SEQ ID NO: 2006067 - RNA, 12 nt, Human
aaaagaacuucc

SEQ ID NO: 2006068 - RNA, 17 nt, Human
aaaagaaagaaaaucag

SEQ ID NO: 2006069 - RNA, 15 nt, Human
aaaacaggcaaauuc

SEQ ID NO: 2006070 - RNA, 15 nt, Human
aaaagaaaauaaaaa

SEQ ID NO: 2006071 - RNA, 16 nt, Human
aaaagaaaagucaagg

SEQ ID NO: 2006072 - RNA, 14 nt, Human
aaaagaaaauaaaa

SEQ ID NO: 2006073 - RNA, 14 nt, Human
aaaagaaaaacugu

SEQ ID NO: 2006074 - RNA, 12 nt, Human
aaaagaaaacaa

SEQ ID NO: 2006075 - RNA, 22 nt, Human
aaaagaaaaaaaaagaaaaaag

SEQ ID NO: 2006076 - RNA, 11 nt, Human
aaaagaaaaac

SEQ ID NO: 2006077 - RNA, 13 nt, Human
aaaagacagggcu

SEQ ID NO: 2006078 - RNA, 20 nt, Human
aaaagacaaggaaaaaauaa

SEQ ID NO: 2006079 - RNA, 22 nt, Human
aaaacagccauaggcccuuuca

SEQ ID NO: 2006080 - RNA, 18 nt, Human
aaaacagaguaaucuugu

SEQ ID NO: 2006081 - RNA, 19 nt, Human
aaaacagaguaaucuuguu

SEQ ID NO: 2006082 - RNA, 22 nt, Human
aaaacagaguaaucuuguuggu

SEQ ID NO: 2006083 - RNA, 11 nt, Human
aaaacuuuguu

SEQ ID NO: 2006084 - RNA, 17 nt, Human
aaaacuuuguuaggcca

SEQ ID NO: 2006085 - RNA, 19 nt, Human
aaaacuuuguuaggccaaa

SEQ ID NO: 2006086 - RNA, 9 nt, Human
aaaagaaaa

SEQ ID NO: 2006087 - RNA, 11 nt, Human
aaaagaaaaaa

SEQ ID NO: 2006088 - RNA, 12 nt, Human
aaaagaaaaaaa

SEQ ID NO: 2006089 - RNA, 11 nt, Human
aaaagaaaaag

SEQ ID NO: 2006090 - RNA, 16 nt, Human
aaaagaaaaaaaaaga

SEQ ID NO: 2006091 - RNA, 17 nt, Human
aaaagaaaaaaaaagaa

SEQ ID NO: 2006092 - RNA, 18 nt, Human
aaaagaaaaaaaaagaaa

SEQ ID NO: 2006093 - RNA, 19 nt, Human
aaaagaaaaaaaaagaaaa

SEQ ID NO: 2006094 - RNA, 13 nt, Human
aaaacagaaauug

SEQ ID NO: 2006095 - RNA, 15 nt, Human
aaaacagaaauuggu

SEQ ID NO: 2006096 - RNA, 16 nt, Human
aaaacagaaauuggua

SEQ ID NO: 2006097 - RNA, 19 nt, Human
aaaacacuguucucugccc

SEQ ID NO: 2006098 - RNA, 15 nt, Human
aaaacaccuucuaua

SEQ ID NO: 2006099 - RNA, 17 nt, Human
aaaacacauuuuucuua

SEQ ID NO: 2006100 - RNA, 14 nt, Human
aaaacaccagcuuu

SEQ ID NO: 2006101 - RNA, 17 nt, Human
cucucugggcugacugg

SEQ ID NO: 2006102 - RNA, 21 nt, Human
cucucugggcugacugggcca

SEQ ID NO: 2006103 - RNA, 14 nt, Human
cucucuggccuucg

SEQ ID NO: 2006104 - RNA, 16 nt, Human
cucucuggccuucggc

SEQ ID NO: 2006105 - RNA, 13 nt, Human
cucucuggccuuc

SEQ ID NO: 2006106 - RNA, 16 nt, Human
cucuccuccagaguca

SEQ ID NO: 2006107 - RNA, 12 nt, Human
cucuccuccaga

SEQ ID NO: 2006108 - RNA, 15 nt, Human
cucuccuccagaguc

SEQ ID NO: 2006109 - RNA, 13 nt, Human
cucuccuccagag

SEQ ID NO: 2006110 - RNA, 21 nt, Human
cucuccccucagagugcaagc

SEQ ID NO: 2006111 - RNA, 22 nt, Human
cucuccccgcaguguuugugug

SEQ ID NO: 2006112 - RNA, 19 nt, Human
cucuauguucuaagaagug

SEQ ID NO: 2006113 - RNA, 22 nt, Human
cucuauggucuuauauuuacaa

SEQ ID NO: 2006114 - RNA, 16 nt, Human
cucgguguggagaagc

SEQ ID NO: 2006115 - RNA, 23 nt, Human
cucgguguggagaagcggcuggc

SEQ ID NO: 2006116 - RNA, 13 nt, Human
cucggugucccca

SEQ ID NO: 2006117 - RNA, 15 nt, Human
cucgguguccccacc

SEQ ID NO: 2006118 - RNA, 16 nt, Human
cucgguguccccacca

SEQ ID NO: 2006119 - RNA, 20 nt, Human
cucgguguccccaccaucug

SEQ ID NO: 2006120 - RNA, 17 nt, Human
cucgguguggagaagcg

SEQ ID NO: 2006121 - RNA, 21 nt, Human
cucgguguccccaccaucugc

SEQ ID NO: 2006122 - RNA, 22 nt, Human
cucgguguccccaccaucugcu

SEQ ID NO: 2006123 - RNA, 23 nt, Human
cucgguguccccaccaucugcug

SEQ ID NO: 2006124 - RNA, 13 nt, Human
cucgucuuuccca

SEQ ID NO: 2006125 - RNA, 17 nt, Human
cuccuuuguauucuguc

SEQ ID NO: 2006126 - RNA, 18 nt, Human
cuccuuuguauucugucu

SEQ ID NO: 2006127 - RNA, 19 nt, Human
cuccuuuguauucugucuu

SEQ ID NO: 2006128 - RNA, 18 nt, Human
cuccuuugugaggaagcc

SEQ ID NO: 2006129 - RNA, 17 nt, Human
cuccuuugugaggaagc

SEQ ID NO: 2006130 - RNA, 20 nt, Human
cuccuuucacaaccuucugu

SEQ ID NO: 2006131 - RNA, 13 nt, Human
cucuguacagagc

SEQ ID NO: 2006132 - RNA, 18 nt, Human
cucugcuggacguccagg

SEQ ID NO: 2006133 - RNA, 15 nt, Human
cucuguacagagccc

SEQ ID NO: 2006134 - RNA, 14 nt, Human
cucuguacagagcc

SEQ ID NO: 2006135 - RNA, 15 nt, Human
cucugcugcuggcug

SEQ ID NO: 2006136 - RNA, 14 nt, Human
cucugcugcuggcu

SEQ ID NO: 2006137 - RNA, 16 nt, Human
cucugcugcuggcugg

SEQ ID NO: 2006138 - RNA, 16 nt, Human
cucuguacagagccca

SEQ ID NO: 2006139 - RNA, 21 nt, Human
cucugcugacagacacaggcc

SEQ ID NO: 2006140 - RNA, 22 nt, Human
cucugcugacagacacaggccc

SEQ ID NO: 2006141 - RNA, 20 nt, Human
cucugcugacagacacaggc

SEQ ID NO: 2006142 - RNA, 11 nt, Human
cucugcucuga

SEQ ID NO: 2006143 - RNA, 13 nt, Human
cucugcugcuggc

SEQ ID NO: 2006144 - RNA, 21 nt, Human
cucugcugaugacccccccag

SEQ ID NO: 2006145 - RNA, 23 nt, Human
cucugcugacagacacaggcccg

SEQ ID NO: 2006146 - RNA, 20 nt, Human
cucugcaggaaauggcugug

SEQ ID NO: 2006147 - RNA, 17 nt, Human
cucugcacuccccugcu

SEQ ID NO: 2006148 - RNA, 21 nt, Human
cucugcuccucuccccagcaa

SEQ ID NO: 2006149 - RNA, 13 nt, Human
cucugcagguccc

SEQ ID NO: 2006150 - RNA, 21 nt, Human
cucugcacaagcugcacccuc

SEQ ID NO: 2006151 - RNA, 20 nt, Human
cucugcacaagcugcacccu

SEQ ID NO: 2006152 - RNA, 16 nt, Human
cucugcacuccccugc

SEQ ID NO: 2006153 - RNA, 15 nt, Human
cucugcacuccccug

SEQ ID NO: 2006154 - RNA, 23 nt, Human
cuccgcuuucuacccagcgagcc

SEQ ID NO: 2006155 - RNA, 13 nt, Human
cuccuaccuggua

SEQ ID NO: 2006156 - RNA, 12 nt, Human
cuccuacugagg

SEQ ID NO: 2006157 - RNA, 14 nt, Human
cuccuuguguuacu

SEQ ID NO: 2006158 - RNA, 13 nt, Human
cuccuuucacaac

SEQ ID NO: 2006159 - RNA, 15 nt, Human
cuccuuucaccacau

SEQ ID NO: 2006160 - RNA, 16 nt, Human
cuccuuucacaaccuu

SEQ ID NO: 2006161 - RNA, 17 nt, Human
cuccuuucacaaccuuc

SEQ ID NO: 2006162 - RNA, 16 nt, Human
cuccuguaccucuuga

SEQ ID NO: 2006163 - RNA, 14 nt, Human
cuccucugcugcug

SEQ ID NO: 2006164 - RNA, 13 nt, Human
cuccucugcugcu

SEQ ID NO: 2006165 - RNA, 15 nt, Human
cuccucugcugcugg

SEQ ID NO: 2006166 - RNA, 12 nt, Human
cuccucugucca

SEQ ID NO: 2006167 - RNA, 15 nt, Human
cuccucuguccaggc

SEQ ID NO: 2006168 - RNA, 18 nt, Human
cuccugggcuaagugauc

SEQ ID NO: 2006169 - RNA, 19 nt, Human
cuccuggccucaagugauu

SEQ ID NO: 2006170 - RNA, 19 nt, Human
cuccuggcccacugcaucg

SEQ ID NO: 2006171 - RNA, 18 nt, Human
cuccucuugccacugccu

SEQ ID NO: 2006172 - RNA, 12 nt, Human
cuccucuugcca

SEQ ID NO: 2006173 - RNA, 15 nt, Human
cuccucuugccacug

SEQ ID NO: 2006174 - RNA, 16 nt, Human
cuccucuugccacugc

SEQ ID NO: 2006175 - RNA, 12 nt, Human
cucccacugccc

SEQ ID NO: 2006176 - RNA, 15 nt, Human
cucccacugcccacu

SEQ ID NO: 2006177 - RNA, 17 nt, Human
cucccacugcccacugg

SEQ ID NO: 2006178 - RNA, 15 nt, Human
cucccacuucugcca

SEQ ID NO: 2006179 - RNA, 16 nt, Human
cucccacuucugccag

SEQ ID NO: 2006180 - RNA, 17 nt, Human
cucccacuucugccaga

SEQ ID NO: 2006181 - RNA, 15 nt, Human
cucccacaggcccuu

SEQ ID NO: 2006182 - RNA, 14 nt, Human
cucccacaggcccu

SEQ ID NO: 2006183 - RNA, 16 nt, Human
cucccacaggcccuuc

SEQ ID NO: 2006184 - RNA, 20 nt, Human
cucccacaggcccuuccucu

SEQ ID NO: 2006185 - RNA, 21 nt, Human
cucccacaggcccuuccucuc

SEQ ID NO: 2006186 - RNA, 23 nt, Human
cuccaggugcacaagcuccaagc

SEQ ID NO: 2006187 - RNA, 15 nt, Human
cuccaggcuccuuua

SEQ ID NO: 2006188 - RNA, 23 nt, Human
cuccaggcuccuuuagcgcccag

SEQ ID NO: 2006189 - RNA, 20 nt, Human
cuccaggcuguaucccauga

SEQ ID NO: 2006190 - RNA, 20 nt, Human
cucccucuacugggagccua

SEQ ID NO: 2006191 - RNA, 16 nt, Human
cucccucccagcucca

SEQ ID NO: 2006192 - RNA, 20 nt, Human
cucccucuuucccucccuuc

SEQ ID NO: 2006193 - RNA, 16 nt, Human
cucccucuccagcagg

SEQ ID NO: 2006194 - RNA, 21 nt, Human
cucccucuccagcaggcccau

SEQ ID NO: 2006195 - RNA, 20 nt, Human
cucccugaaguaagcaaaga

SEQ ID NO: 2006196 - RNA, 13 nt, Human
cucccucuacugg

SEQ ID NO: 2006197 - RNA, 19 nt, Human
cucccucuacugggagccu

SEQ ID NO: 2006198 - RNA, 14 nt, Human
cucccucccagcuc

SEQ ID NO: 2006199 - RNA, 11 nt, Human
cucccucccag

SEQ ID NO: 2006200 - RNA, 16 nt, Human
cuccccuaaagccuca

SEQ ID NO: 2006201 - RNA, 23 nt, Human
cuccccuaaagccucaaaacaaa

SEQ ID NO: 2006202 - RNA, 18 nt, Human
cucccaggagccugccca

SEQ ID NO: 2006203 - RNA, 21 nt, Human
cucccaggagccugcccagcc

SEQ ID NO: 2006204 - RNA, 19 nt, Human
cucccaggagccugcccag

SEQ ID NO: 2006205 - RNA, 20 nt, Human
cucccaggagccugcccagc

SEQ ID NO: 2006206 - RNA, 23 nt, Human
cucaggugucccugcacuugcag

SEQ ID NO: 2006207 - RNA, 22 nt, Human
cucagguugucugaagucacug

SEQ ID NO: 2006208 - RNA, 23 nt, Human
cucaugauagaaggcuaugggga

SEQ ID NO: 2006209 - RNA, 22 nt, Human
cucagucuggcccuuccuuuuc

SEQ ID NO: 2006210 - RNA, 16 nt, Human
cucagugagcuggaga

SEQ ID NO: 2006211 - RNA, 20 nt, Human
cucagucuggcccuuccuuu

SEQ ID NO: 2006212 - RNA, 16 nt, Human
cucaguccaugaagau

SEQ ID NO: 2006213 - RNA, 14 nt, Human
cucagguugucuga

SEQ ID NO: 2006214 - RNA, 15 nt, Human
cucaguccauagcag

SEQ ID NO: 2006215 - RNA, 17 nt, Human
cucaguccauagcagag

SEQ ID NO: 2006216 - RNA, 22 nt, Human
cucagggaaaagcagcucuccc

SEQ ID NO: 2006217 - RNA, 20 nt, Human
cucagggaaaagcagcucuc

SEQ ID NO: 2006218 - RNA, 17 nt, Human
cucagggaaaagcagcu

SEQ ID NO: 2006219 - RNA, 23 nt, Human
cucagggaaaagcagcucucccc

SEQ ID NO: 2006220 - RNA, 13 nt, Human
cucagggaaagca

SEQ ID NO: 2006221 - RNA, 22 nt, Human
cucaggcauggaugaauaaaug

SEQ ID NO: 2006222 - RNA, 20 nt, Human
cucaggccaaacucaccugc

SEQ ID NO: 2006223 - RNA, 19 nt, Human
cucaggccaaacucaccug

SEQ ID NO: 2006224 - RNA, 21 nt, Human
cucaggccaaacucaccugcc

SEQ ID NO: 2006225 - RNA, 23 nt, Human
cucaggccgaaggaggagucagg

SEQ ID NO: 2006226 - RNA, 18 nt, Human
cucaggccagcugcuugg

SEQ ID NO: 2006227 - RNA, 17 nt, Human
cucaggccagcugcuug

SEQ ID NO: 2006228 - RNA, 16 nt, Human
cucaggccagcugcuu

SEQ ID NO: 2006229 - RNA, 20 nt, Human
cucaggccugacucucagca

SEQ ID NO: 2006230 - RNA, 11 nt, Human
cucaggccugg

SEQ ID NO: 2006231 - RNA, 22 nt, Human
cucaggccugggggcugggcag

SEQ ID NO: 2006232 - RNA, 17 nt, Human
cucaccuuucccaucuu

SEQ ID NO: 2006233 - RNA, 18 nt, Human
cucacgagucauccagaa

SEQ ID NO: 2006234 - RNA, 17 nt, Human
cucacgcuccuuucuga

SEQ ID NO: 2006235 - RNA, 15 nt, Human
cucacgcauucucug

SEQ ID NO: 2006236 - RNA, 13 nt, Human
cucagaagacacu

SEQ ID NO: 2006237 - RNA, 14 nt, Human
cucagaaccacagc

SEQ ID NO: 2006238 - RNA, 15 nt, Human
cucagaagacacuga

SEQ ID NO: 2006239 - RNA, 17 nt, Human
cucagaagacacugaug

SEQ ID NO: 2006240 - RNA, 20 nt, Human
cucagaagacacugaugggc

SEQ ID NO: 2006241 - RNA, 22 nt, Human
cucagaagacacugaugggcaa

SEQ ID NO: 2006242 - RNA, 19 nt, Human
cucagccucccgaauagcu

SEQ ID NO: 2006243 - RNA, 21 nt, Human
cucagccucccgaauagcugg

SEQ ID NO: 2006244 - RNA, 22 nt, Human
cucagccucccgaauagcuggg

SEQ ID NO: 2006245 - RNA, 13 nt, Human
cucagacuguaua

SEQ ID NO: 2006246 - RNA, 15 nt, Human
cucagaccagcucuu

SEQ ID NO: 2006247 - RNA, 14 nt, Human
cucagaccagcucu

SEQ ID NO: 2006248 - RNA, 16 nt, Human
cucagaccagcucuuc

SEQ ID NO: 2006249 - RNA, 23 nt, Human
cucagaagacacugaugggcaac

SEQ ID NO: 2006250 - RNA, 17 nt, Human
cuauccuacuuccccuu

SEQ ID NO: 2006251 - RNA, 23 nt, Human
cuaucaguuuuauagcuuuauuu

SEQ ID NO: 2006252 - RNA, 14 nt, Human
cuaucucccccagc

SEQ ID NO: 2006253 - RNA, 13 nt, Human
cuaucucccccag

SEQ ID NO: 2006254 - RNA, 14 nt, Human
cuaugugagaccau

SEQ ID NO: 2006255 - RNA, 17 nt, Human
cuauccugggcuuuugu

SEQ ID NO: 2006256 - RNA, 18 nt, Human
cuauguugcccaggcagg

SEQ ID NO: 2006257 - RNA, 19 nt, Human
cuauguugcccaggcaggu

SEQ ID NO: 2006258 - RNA, 21 nt, Human
cuauguugcccaggcaggucu

SEQ ID NO: 2006259 - RNA, 22 nt, Human
cuauguugcccaggcaggucuu

SEQ ID NO: 2006260 - RNA, 17 nt, Human
cuaugugagcacaaagg

SEQ ID NO: 2006261 - RNA, 14 nt, Human
cuauguuaauauuu

SEQ ID NO: 2006262 - RNA, 15 nt, Human
cuauguuaauauuuu

SEQ ID NO: 2006263 - RNA, 17 nt, Human
cuauguuaauauuuuag

SEQ ID NO: 2006264 - RNA, 18 nt, Human
cuauguucuaagaaguga

SEQ ID NO: 2006265 - RNA, 14 nt, Human
cuauguugcccagg

SEQ ID NO: 2006266 - RNA, 21 nt, Human
cuauguuaauauuuuaggugu

SEQ ID NO: 2006267 - RNA, 18 nt, Human
cucaaguuuaugucucag

SEQ ID NO: 2006268 - RNA, 21 nt, Human
cucaagugauucuccugccuc

SEQ ID NO: 2006269 - RNA, 23 nt, Human
cucaauuauuuugcauuuuuucu

SEQ ID NO: 2006270 - RNA, 21 nt, Human
cucaaugugugccgagcccuu

SEQ ID NO: 2006271 - RNA, 14 nt, Human
ccuugcauaauggu

SEQ ID NO: 2006272 - RNA, 15 nt, Human
ccuugcauacaaaca

SEQ ID NO: 2006273 - RNA, 21 nt, Human
ccuugcauuuuagcuaauuua

SEQ ID NO: 2006274 - RNA, 13 nt, Human
ccuugcacuuuca

SEQ ID NO: 2006275 - RNA, 17 nt, Human
ccuugcacacaucaucu

SEQ ID NO: 2006276 - RNA, 24 nt, Human
ccuugcacacaucaucuguaagcu

SEQ ID NO: 2006277 - RNA, 13 nt, Human
ccuugccagcugc

SEQ ID NO: 2006278 - RNA, 14 nt, Human
ccuugccagcugcu

SEQ ID NO: 2006279 - RNA, 15 nt, Human
ccuugccagcugcug

SEQ ID NO: 2006280 - RNA, 19 nt, Human
ccuugccagcugcugagcc

SEQ ID NO: 2006281 - RNA, 20 nt, Human
ccuugccagcugcugagccg

SEQ ID NO: 2006282 - RNA, 22 nt, Human
ccuugccagcugcugagccgca

SEQ ID NO: 2006283 - RNA, 23 nt, Human
ccuugccagcugcugagccgcag

SEQ ID NO: 2006284 - RNA, 24 nt, Human
ccuugccagcugcugagccgcaga

SEQ ID NO: 2006285 - RNA, 19 nt, Human
ccuugccaggucccuuuca

SEQ ID NO: 2006286 - RNA, 12 nt, Human
ccuugccagucu

SEQ ID NO: 2006287 - RNA, 18 nt, Human
ccuugcuaccacggccuc

SEQ ID NO: 2006288 - RNA, 23 nt, Human
ccuugcuaccacggccuccuuuc

SEQ ID NO: 2006289 - RNA, 15 nt, Human
ccuuuaguuauaaag

SEQ ID NO: 2006290 - RNA, 20 nt, Human
ccuuuaucuaccaacuuuca

SEQ ID NO: 2006291 - RNA, 17 nt, Human
ccuuucaauaggaaaaa

SEQ ID NO: 2006292 - RNA, 18 nt, Human
ccuuucaauaggaaaaac

SEQ ID NO: 2006293 - RNA, 14 nt, Human
ccuuuauucuggca

SEQ ID NO: 2006294 - RNA, 15 nt, Human
ccuuucaauaggaaa

SEQ ID NO: 2006295 - RNA, 17 nt, Human
ccuuccccuuccuucuu

SEQ ID NO: 2006296 - RNA, 14 nt, Human
ccuuccccuuccuu

SEQ ID NO: 2006297 - RNA, 15 nt, Human
ccuuccccuuccuuc

SEQ ID NO: 2006298 - RNA, 16 nt, Human
ccuuccccuuccuucu

SEQ ID NO: 2006299 - RNA, 13 nt, Human
ccuuccccuuccu

SEQ ID NO: 2006300 - RNA, 19 nt, Human
ccuucccccuccaauccca

SEQ ID NO: 2006301 - RNA, 22 nt, Human
ccuucccccucccccagccacu

SEQ ID NO: 2006302 - RNA, 19 nt, Human
ccuuccuaauuccacagcu

SEQ ID NO: 2006303 - RNA, 20 nt, Human
ccuuccuaauuccacagcug

SEQ ID NO: 2006304 - RNA, 18 nt, Human
ccuuccuaauuccacagc

SEQ ID NO: 2006305 - RNA, 12 nt, Human
ccuucccuugcu

SEQ ID NO: 2006306 - RNA, 20 nt, Human
ccuucucuccagccccugga

SEQ ID NO: 2006307 - RNA, 16 nt, Human
ccuuccucuccacugc

SEQ ID NO: 2006308 - RNA, 17 nt, Human
ccuuccucuccacugcc

SEQ ID NO: 2006309 - RNA, 14 nt, Human
ccuuccucuccacu

SEQ ID NO: 2006310 - RNA, 15 nt, Human
ccuuccucuccacug

SEQ ID NO: 2006311 - RNA, 21 nt, Human
ccuuccuaauuccacagcugc

SEQ ID NO: 2006312 - RNA, 14 nt, Human
ccuuccuaccaccc

SEQ ID NO: 2006313 - RNA, 21 nt, Human
ccuuccuaguucaucccuucu

SEQ ID NO: 2006314 - RNA, 21 nt, Human
ccuuccuccauccuccuccuu

SEQ ID NO: 2006315 - RNA, 23 nt, Human
ccuuccuccauccuccuccuucc

SEQ ID NO: 2006316 - RNA, 23 nt, Human
ccuucucuccagccccuggaugc

SEQ ID NO: 2006317 - RNA, 21 nt, Human
ccuucucuccagccccuggau

SEQ ID NO: 2006318 - RNA, 20 nt, Human
ccuuccucuccacugccuuc

SEQ ID NO: 2006319 - RNA, 20 nt, Human
ccuucucucucaauuuuugg

SEQ ID NO: 2006320 - RNA, 14 nt, Human
ccuucucugaagga

SEQ ID NO: 2006321 - RNA, 16 nt, Human
ccuucucugaaggaca

SEQ ID NO: 2006322 - RNA, 22 nt, Human
ccuucuguccuacucuguguca

SEQ ID NO: 2006323 - RNA, 12 nt, Human
ccuucucuucca

SEQ ID NO: 2006324 - RNA, 17 nt, Human
ccuucucuucacaguca

SEQ ID NO: 2006325 - RNA, 20 nt, Human
ccuucuguccuacucugugu

SEQ ID NO: 2006326 - RNA, 21 nt, Human
ccuucuguccuacucuguguc

SEQ ID NO: 2006327 - RNA, 13 nt, Human
ccuguucagcucc

SEQ ID NO: 2006328 - RNA, 21 nt, Human
ccuguucacucuacuuagcau

SEQ ID NO: 2006329 - RNA, 16 nt, Human
ccuuagcaaauucugu

SEQ ID NO: 2006330 - RNA, 19 nt, Human
ccuuagcagggaaacagcu

SEQ ID NO: 2006331 - RNA, 20 nt, Human
ccuuagcagggaaacagcua

SEQ ID NO: 2006332 - RNA, 20 nt, Human
ccuguugggccaggagccuc

SEQ ID NO: 2006333 - RNA, 19 nt, Human
ccuguugggccaggagccu

SEQ ID NO: 2006334 - RNA, 18 nt, Human
ccuguugggccaggagcc

SEQ ID NO: 2006335 - RNA, 17 nt, Human
ccuguugggccaggagc

SEQ ID NO: 2006336 - RNA, 16 nt, Human
ccuguugggccaggag

SEQ ID NO: 2006337 - RNA, 18 nt, Human
ccuguucccaugagauga

SEQ ID NO: 2006338 - RNA, 12 nt, Human
ccuguucccauu

SEQ ID NO: 2006339 - RNA, 17 nt, Human
ccuguucuggcagaguu

SEQ ID NO: 2006340 - RNA, 12 nt, Human
ccuguucuggca

SEQ ID NO: 2006341 - RNA, 16 nt, Human
ccuguucugcuuuccu

SEQ ID NO: 2006342 - RNA, 23 nt, Human
ccuguucagcuccagcucaccag

SEQ ID NO: 2006343 - RNA, 20 nt, Human
ccuguucagcuccagcucac

SEQ ID NO: 2006344 - RNA, 21 nt, Human
ccuguucagcuccagcucacc

SEQ ID NO: 2006345 - RNA, 14 nt, Human
ccuguucagcucca

SEQ ID NO: 2006346 - RNA, 15 nt, Human
ccuguucagcuccag

SEQ ID NO: 2006347 - RNA, 16 nt, Human
ccuguucagcuccagc

SEQ ID NO: 2006348 - RNA, 19 nt, Human
ccuguucagcuccagcuca

SEQ ID NO: 2006349 - RNA, 19 nt, Human
ccuucccaccucucucacu

SEQ ID NO: 2006350 - RNA, 14 nt, Human
ccuucccaccucuc

SEQ ID NO: 2006351 - RNA, 12 nt, Human
ccuucccaccuc

SEQ ID NO: 2006352 - RNA, 15 nt, Human
ccuucccaugcccug

SEQ ID NO: 2006353 - RNA, 18 nt, Human
ccuucccacucuucucau

SEQ ID NO: 2006354 - RNA, 22 nt, Human
ccuucccacucugucgagccug

SEQ ID NO: 2006355 - RNA, 18 nt, Human
ccuuauggaacacucuga

SEQ ID NO: 2006356 - RNA, 17 nt, Human
ccuuauggaacacucug

SEQ ID NO: 2006357 - RNA, 16 nt, Human
ccuuauggaacacucu

SEQ ID NO: 2006358 - RNA, 14 nt, Human
ccuuauggaacacu

SEQ ID NO: 2006359 - RNA, 20 nt, Human
ccuuauggaacacucugaga

SEQ ID NO: 2006360 - RNA, 19 nt, Human
ccuuauggaacacucugag

SEQ ID NO: 2006361 - RNA, 22 nt, Human
ccuuauggaacacucugagacu

SEQ ID NO: 2006362 - RNA, 22 nt, Human
ccuuaucuccaagaccagagau

SEQ ID NO: 2006363 - RNA, 16 nt, Human
ccuuaucuccaagacc

SEQ ID NO: 2006364 - RNA, 19 nt, Human
ccuuaucuaguguuugauu

SEQ ID NO: 2006365 - RNA, 15 nt, Human
ccuuaucuagcugca

SEQ ID NO: 2006366 - RNA, 12 nt, Human
ccuuauggaaca

SEQ ID NO: 2006367 - RNA, 14 nt, Human
ccuuaucaaaggac

SEQ ID NO: 2006368 - RNA, 18 nt, Human
ccuuaucaaaggacacca

SEQ ID NO: 2006369 - RNA, 14 nt, Human
ccuuaucauaaauu

SEQ ID NO: 2006370 - RNA, 16 nt, Human
ccuuaucauaaauuca

SEQ ID NO: 2006371 - RNA, 18 nt, Human
ccuuagggaagcuggccu

SEQ ID NO: 2006372 - RNA, 20 nt, Human
ccuuaggugauccacucgcc

SEQ ID NO: 2006373 - RNA, 14 nt, Human
ccuuagcuucuggc

SEQ ID NO: 2006374 - RNA, 13 nt, Human
ccuuaucaaagga

SEQ ID NO: 2006375 - RNA, 20 nt, Human
ccuuagggaagcuggccuga

SEQ ID NO: 2006376 - RNA, 21 nt, Human
ccuuagggaagcuggccugag

SEQ ID NO: 2006377 - RNA, 16 nt, Human
ccuuaggguuuucucu

SEQ ID NO: 2006378 - RNA, 17 nt, Human
cuaagaauuuuuuauuu

SEQ ID NO: 2006379 - RNA, 14 nt, Human
cuaaguuuuuaugg

SEQ ID NO: 2006380 - RNA, 20 nt, Human
cuaaguuuuaggguacaugu

SEQ ID NO: 2006381 - RNA, 21 nt, Human
cuaaguuuuaggguacaugug

SEQ ID NO: 2006382 - RNA, 17 nt, Human
cuaagucucuuuuuuac

SEQ ID NO: 2006383 - RNA, 18 nt, Human
cuaagucucuuuuuuaca

SEQ ID NO: 2006384 - RNA, 20 nt, Human
cuaagucucuuuuuuacaaa

SEQ ID NO: 2006385 - RNA, 19 nt, Human
cuaaguugaguauauuaua

SEQ ID NO: 2006386 - RNA, 21 nt, Human
cuaaguugaguauauuauaau

SEQ ID NO: 2006387 - RNA, 22 nt, Human
cuaaguugaguauauuauaaua

SEQ ID NO: 2006388 - RNA, 19 nt, Human
cuacaaaaagcauaaaaau

SEQ ID NO: 2006389 - RNA, 20 nt, Human
cuaauaaaauuuaaaagucu

SEQ ID NO: 2006390 - RNA, 18 nt, Human
cuaaguaaaucucuucug

SEQ ID NO: 2006391 - RNA, 19 nt, Human
cuaaguaaaucucuucugu

SEQ ID NO: 2006392 - RNA, 23 nt, Human
cuaaguaaaucucuucuguguuu

SEQ ID NO: 2006393 - RNA, 22 nt, Human
cgugagccacugcaccgggcca

SEQ ID NO: 2006394 - RNA, 17 nt, Human
cgugacaauguuuacaa

SEQ ID NO: 2006395 - RNA, 14 nt, Human
cgugaggccagaga

SEQ ID NO: 2006396 - RNA, 14 nt, Human
cgugagccacugca

SEQ ID NO: 2006397 - RNA, 16 nt, Human
cgugacaauguuuaca

SEQ ID NO: 2006398 - RNA, 15 nt, Human
cgugagccacugcac

SEQ ID NO: 2006399 - RNA, 20 nt, Human
cgugagccacugcaccgggc

SEQ ID NO: 2006400 - RNA, 14 nt, Human
cgugacaacacuug

SEQ ID NO: 2006401 - RNA, 15 nt, Human
cgugacaacacuugu

SEQ ID NO: 2006402 - RNA, 11 nt, Human
cuaaagcugcc

SEQ ID NO: 2006403 - RNA, 13 nt, Human
cuaaagauuuuga

SEQ ID NO: 2006404 - RNA, 17 nt, Human
cuaaagauuuugaucuc

SEQ ID NO: 2006405 - RNA, 18 nt, Human
cguuaggauacugccucc

SEQ ID NO: 2006406 - RNA, 19 nt, Human
cguguuaugacuccagaau

SEQ ID NO: 2006407 - RNA, 21 nt, Human
cguguuauuuuaaucucagaa

SEQ ID NO: 2006408 - RNA, 13 nt, Human
cguguucucagag

SEQ ID NO: 2006409 - RNA, 21 nt, Human
cgugaucaaagccacacucug

SEQ ID NO: 2006410 - RNA, 18 nt, Human
cgugaucaaagccacacu

SEQ ID NO: 2006411 - RNA, 15 nt, Human
cguguuaugacucca

SEQ ID NO: 2006412 - RNA, 18 nt, Human
cgugaguccuggcauggg

SEQ ID NO: 2006413 - RNA, 19 nt, Human
cgugaguccuggcauggga

SEQ ID NO: 2006414 - RNA, 14 nt, Human
cgugaucaaagcca

SEQ ID NO: 2006415 - RNA, 16 nt, Human
cgugaggccagagaca

SEQ ID NO: 2006416 - RNA, 20 nt, Human
cuaacgaaguauccuucagc

SEQ ID NO: 2006417 - RNA, 19 nt, Human
cuaaaguguauuuuuuuac

SEQ ID NO: 2006418 - RNA, 23 nt, Human
cuaaaguaaaaacaaagaaauua

SEQ ID NO: 2006419 - RNA, 16 nt, Human
cuaaagccucaaaaca

SEQ ID NO: 2006420 - RNA, 14 nt, Human
cuaaaguaauuggu

SEQ ID NO: 2006421 - RNA, 20 nt, Human
cuaaaguacugagcagugau

SEQ ID NO: 2006422 - RNA, 22 nt, Human
cuaaaguacugagcagugauau

SEQ ID NO: 2006423 - RNA, 23 nt, Human
cuaaaguacugagcagugauauu

SEQ ID NO: 2006424 - RNA, 23 nt, Human
cuaaaguccuuugagcuccuggg

SEQ ID NO: 2006425 - RNA, 22 nt, Human
cuaacuugucuuuggacccuga

SEQ ID NO: 2006426 - RNA, 14 nt, Human
cuaacuugucuuug

SEQ ID NO: 2006427 - RNA, 20 nt, Human
cuaagaacaaaagaagcagc

SEQ ID NO: 2006428 - RNA, 16 nt, Human
cuaacuuuccuucauu

SEQ ID NO: 2006429 - RNA, 17 nt, Human
cgcuggagugcagugag

SEQ ID NO: 2006430 - RNA, 18 nt, Human
cgcuggagugcagugagc

SEQ ID NO: 2006431 - RNA, 21 nt, Human
cgcucuuggcagguacucagc

SEQ ID NO: 2006432 - RNA, 15 nt, Human
cgcugacuacagggc

SEQ ID NO: 2006433 - RNA, 20 nt, Human
cgcucugucgcccaggcugg

SEQ ID NO: 2006434 - RNA, 13 nt, Human
cgcucugcugugg

SEQ ID NO: 2006435 - RNA, 20 nt, Human
cgcugccccuggcagccccu

SEQ ID NO: 2006436 - RNA, 19 nt, Human
cgcugccccuggcagcccc

SEQ ID NO: 2006437 - RNA, 16 nt, Human
cgcugacuacagggcc

SEQ ID NO: 2006438 - RNA, 17 nt, Human
cgcugacuacagggccg

SEQ ID NO: 2006439 - RNA, 11 nt, Human
cgccacauccc

SEQ ID NO: 2006440 - RNA, 15 nt, Human
cgccaccacacccaa

SEQ ID NO: 2006441 - RNA, 19 nt, Human
cgccugccuuuggcacucu

SEQ ID NO: 2006442 - RNA, 20 nt, Human
ccuuuucgcaggauucuucc

SEQ ID NO: 2006443 - RNA, 20 nt, Human
ccuuuuccagagcauuccag

SEQ ID NO: 2006444 - RNA, 15 nt, Human
ccuuuuccagagcau

SEQ ID NO: 2006445 - RNA, 15 nt, Human
cgcaguguuugugug

SEQ ID NO: 2006446 - RNA, 20 nt, Human
cgagucucuucuccacugga

SEQ ID NO: 2006447 - RNA, 21 nt, Human
cgagucucuucuccacuggau

SEQ ID NO: 2006448 - RNA, 13 nt, Human
cgagucugaggcc

SEQ ID NO: 2006449 - RNA, 20 nt, Human
cgagugccgcaucucacagc

SEQ ID NO: 2006450 - RNA, 21 nt, Human
cgcaggcuggcccugcccugg

SEQ ID NO: 2006451 - RNA, 22 nt, Human
cgcaggcuggcccugcccuggu

SEQ ID NO: 2006452 - RNA, 17 nt, Human
cgagucucuucuccacu

SEQ ID NO: 2006453 - RNA, 18 nt, Human
cgagucucuucuccacug

SEQ ID NO: 2006454 - RNA, 16 nt, Human
cgagucucuucuccac

SEQ ID NO: 2006455 - RNA, 20 nt, Human
cggagacggagucccaccuu

SEQ ID NO: 2006456 - RNA, 17 nt, Human
cggagacggagucccac

SEQ ID NO: 2006457 - RNA, 21 nt, Human
cggagucccaccuuggcugca

SEQ ID NO: 2006458 - RNA, 22 nt, Human
cggagucccaccuuggcugcag

SEQ ID NO: 2006459 - RNA, 23 nt, Human
cggagucccaccuuggcugcagg

SEQ ID NO: 2006460 - RNA, 15 nt, Human
cggaggggccuggca

SEQ ID NO: 2006461 - RNA, 18 nt, Human
cggcuaauuuuuguauuu

SEQ ID NO: 2006462 - RNA, 13 nt, Human
cggcuaagcaggc

SEQ ID NO: 2006463 - RNA, 12 nt, Human
cgggcugugccc

SEQ ID NO: 2006464 - RNA, 20 nt, Human
cgguggcucacgccuguaau

SEQ ID NO: 2006465 - RNA, 22 nt, Human
cguacacauuuuauuuuauuau

SEQ ID NO: 2006466 - RNA, 15 nt, Human
cguacauaauacuga

SEQ ID NO: 2006467 - RNA, 16 nt, Human
cguacauaauacugaa

SEQ ID NO: 2006468 - RNA, 20 nt, Human
cguacauaauacugaaccac

SEQ ID NO: 2006469 - RNA, 14 nt, Human
cguacuaaggauac

SEQ ID NO: 2006470 - RNA, 14 nt, Human
cguacuuauaaaga

SEQ ID NO: 2006471 - RNA, 13 nt, Human
cgggcucugccuc

SEQ ID NO: 2006472 - RNA, 12 nt, Human
cgggcucugccu

SEQ ID NO: 2006473 - RNA, 16 nt, Human
cgggcugggagcucug

SEQ ID NO: 2006474 - RNA, 20 nt, Human
cgggcugggagcucugcaga

SEQ ID NO: 2006475 - RNA, 19 nt, Human
cgggcucagcaaaagaugc

SEQ ID NO: 2006476 - RNA, 16 nt, Human
cgggccuggagaacua

SEQ ID NO: 2006477 - RNA, 20 nt, Human
cgggccuggagaacuagaga

SEQ ID NO: 2006478 - RNA, 22 nt, Human
cgggcuccgacuugugcacagg

SEQ ID NO: 2006479 - RNA, 17 nt, Human
cggcucaagcccaggag

SEQ ID NO: 2006480 - RNA, 16 nt, Human
cggcucaagcccagga

SEQ ID NO: 2006481 - RNA, 15 nt, Human
cgggccccaccugca

SEQ ID NO: 2006482 - RNA, 17 nt, Human
cgggccccaccugcagc

SEQ ID NO: 2006483 - RNA, 19 nt, Human
cgggccccaccugcagcuc

SEQ ID NO: 2006484 - RNA, 21 nt, Human
cgggccccaccugcagcuccc

SEQ ID NO: 2006485 - RNA, 17 nt, Human
ccaugggccuccugugu

SEQ ID NO: 2006486 - RNA, 12 nt, Human
ccaugggcagga

SEQ ID NO: 2006487 - RNA, 13 nt, Human
ccaugggcaggag

SEQ ID NO: 2006488 - RNA, 17 nt, Human
ccauggggucucucaca

SEQ ID NO: 2006489 - RNA, 23 nt, Human
ccauggggucucucacagacagg

SEQ ID NO: 2006490 - RNA, 20 nt, Human
ccaugucucugagcauuaga

SEQ ID NO: 2006491 - RNA, 14 nt, Human
ccaugucucgacuc

SEQ ID NO: 2006492 - RNA, 15 nt, Human
ccaugucucgacuca

SEQ ID NO: 2006493 - RNA, 16 nt, Human
ccaugugagcugcugc

SEQ ID NO: 2006494 - RNA, 23 nt, Human
ccaugagaauguuuuagcacagc

SEQ ID NO: 2006495 - RNA, 22 nt, Human
ccaugagaauguuuuagcacag

SEQ ID NO: 2006496 - RNA, 18 nt, Human
ccaugaggaacaaggcaa

SEQ ID NO: 2006497 - RNA, 17 nt, Human
ccaugaggaacaaggca

SEQ ID NO: 2006498 - RNA, 16 nt, Human
ccaugaggaacaaggc

SEQ ID NO: 2006499 - RNA, 13 nt, Human
ccaugagccucag

SEQ ID NO: 2006500 - RNA, 18 nt, Human
cccaccgcagacaggacc

SEQ ID NO: 2006501 - RNA, 15 nt, Human
cccaccgcagacagg

SEQ ID NO: 2006502 - RNA, 23 nt, Human
cccacuguacuugcucuugaugc

SEQ ID NO: 2006503 - RNA, 19 nt, Human
cccacuguacuugcucuug

SEQ ID NO: 2006504 - RNA, 18 nt, Human
cccacuguacuugcucuu

SEQ ID NO: 2006505 - RNA, 12 nt, Human
ccauuguucuga

SEQ ID NO: 2006506 - RNA, 21 nt, Human
ccauuguucaggauucuaaua

SEQ ID NO: 2006507 - RNA, 13 nt, Human
cccaaccugcucu

SEQ ID NO: 2006508 - RNA, 14 nt, Human
cccaaccugcucuc

SEQ ID NO: 2006509 - RNA, 21 nt, Human
cccaaccugcucuccucuugc

SEQ ID NO: 2006510 - RNA, 18 nt, Human
cccaacuugccuuugaag

SEQ ID NO: 2006511 - RNA, 23 nt, Human
cccaaccugcucuccucuugcca

SEQ ID NO: 2006512 - RNA, 13 nt, Human
ccauugguguuga

SEQ ID NO: 2006513 - RNA, 22 nt, Human
ccauuguggucacaggaaguag

SEQ ID NO: 2006514 - RNA, 15 nt, Human
cccacccaagggccu

SEQ ID NO: 2006515 - RNA, 16 nt, Human
cccaccaucugcuguc

SEQ ID NO: 2006516 - RNA, 17 nt, Human
cccaccaucugcugucu

SEQ ID NO: 2006517 - RNA, 19 nt, Human
cccaccaucugcugucuuu

SEQ ID NO: 2006518 - RNA, 21 nt, Human
cccaccaucugcugucuuuuc

SEQ ID NO: 2006519 - RNA, 18 nt, Human
cccaccaucaugucuggc

SEQ ID NO: 2006520 - RNA, 12 nt, Human
cccaccaucugc

SEQ ID NO: 2006521 - RNA, 13 nt, Human
cccaccaucugcu

SEQ ID NO: 2006522 - RNA, 14 nt, Human
cccaccaucugcug

SEQ ID NO: 2006523 - RNA, 15 nt, Human
cccaccaucugcugu

SEQ ID NO: 2006524 - RNA, 18 nt, Human
cccacccaagggccuggc

SEQ ID NO: 2006525 - RNA, 18 nt, Human
cccaagcgcccuggcccc

SEQ ID NO: 2006526 - RNA, 20 nt, Human
cccaagcgcccuggccccca

SEQ ID NO: 2006527 - RNA, 17 nt, Human
cccaagcucugcuccuc

SEQ ID NO: 2006528 - RNA, 14 nt, Human
cccaagcaggaggc

SEQ ID NO: 2006529 - RNA, 20 nt, Human
cccaagaauagaugcugacu

SEQ ID NO: 2006530 - RNA, 21 nt, Human
cccaagaauagaugcugacug

SEQ ID NO: 2006531 - RNA, 16 nt, Human
cccaagccuggcaagg

SEQ ID NO: 2006532 - RNA, 17 nt, Human
cccaagcgcccuggccc

SEQ ID NO: 2006533 - RNA, 23 nt, Human
cccaagccuacuuuugccauuga

SEQ ID NO: 2006534 - RNA, 15 nt, Human
ccccauuguggucac

SEQ ID NO: 2006535 - RNA, 14 nt, Human
cccccuuccaugga

SEQ ID NO: 2006536 - RNA, 18 nt, Human
ccccgcaguguuugugug

SEQ ID NO: 2006537 - RNA, 12 nt, Human
ccccgcccaggc

SEQ ID NO: 2006538 - RNA, 14 nt, Human
ccccgcccaggcuu

SEQ ID NO: 2006539 - RNA, 13 nt, Human
ccccggccaccug

SEQ ID NO: 2006540 - RNA, 18 nt, Human
ccccggccaccugcggug

SEQ ID NO: 2006541 - RNA, 14 nt, Human
ccccggccaccugc

SEQ ID NO: 2006542 - RNA, 12 nt, Human
ccccagccccaa

SEQ ID NO: 2006543 - RNA, 10 nt, Human
ccccagcccc

SEQ ID NO: 2006544 - RNA, 22 nt, Human
ccccagccagccuggcugggac

SEQ ID NO: 2006545 - RNA, 16 nt, Human
ccccagccagccuggc

SEQ ID NO: 2006546 - RNA, 18 nt, Human
ccccagccagccuggcug

SEQ ID NO: 2006547 - RNA, 14 nt, Human
ccccagccacuccc

SEQ ID NO: 2006548 - RNA, 21 nt, Human
ccccagccacuccccagccag

SEQ ID NO: 2006549 - RNA, 14 nt, Human
ccccagccccaaaa

SEQ ID NO: 2006550 - RNA, 14 nt, Human
ccccagccccaucc

SEQ ID NO: 2006551 - RNA, 21 nt, Human
ccccauucugccugcccaggc

SEQ ID NO: 2006552 - RNA, 18 nt, Human
ccccaaaacucuccucug

SEQ ID NO: 2006553 - RNA, 12 nt, Human
ccccagccacuc

SEQ ID NO: 2006554 - RNA, 20 nt, Human
ccccaaaacucuccucugcu

SEQ ID NO: 2006555 - RNA, 21 nt, Human
ccccaaaacucuccucugcug

SEQ ID NO: 2006556 - RNA, 12 nt, Human
cccauucugucc

SEQ ID NO: 2006557 - RNA, 23 nt, Human
cccauucugccugcccaggcccc

SEQ ID NO: 2006558 - RNA, 20 nt, Human
cccagcuggggccaggcugg

SEQ ID NO: 2006559 - RNA, 23 nt, Human
cccagccccaaaacucuccucug

SEQ ID NO: 2006560 - RNA, 21 nt, Human
cccagccccaaaacucuccuc

SEQ ID NO: 2006561 - RNA, 19 nt, Human
cccagcccacuucugccau

SEQ ID NO: 2006562 - RNA, 17 nt, Human
cccagcaucgcacucug

SEQ ID NO: 2006563 - RNA, 21 nt, Human
cccagcaucgcacucuggcag

SEQ ID NO: 2006564 - RNA, 19 nt, Human
cccauccucuguacagagc

SEQ ID NO: 2006565 - RNA, 15 nt, Human
cccauccucuguaca

SEQ ID NO: 2006566 - RNA, 20 nt, Human
cccauccucuguacagagcc

SEQ ID NO: 2006567 - RNA, 23 nt, Human
cccagcuggggccaggcuggguc

SEQ ID NO: 2006568 - RNA, 22 nt, Human
cccagcuggggccaggcugggu

SEQ ID NO: 2006569 - RNA, 18 nt, Human
cccaggcuggcgugcagu

SEQ ID NO: 2006570 - RNA, 19 nt, Human
cccaggcuggcgugcagug

SEQ ID NO: 2006571 - RNA, 20 nt, Human
cccaggcuggcgugcagugg

SEQ ID NO: 2006572 - RNA, 14 nt, Human
cccauccucuguac

SEQ ID NO: 2006573 - RNA, 21 nt, Human
cccauccaccguccccuccca

SEQ ID NO: 2006574 - RNA, 22 nt, Human
cccauccaccguccccucccag

SEQ ID NO: 2006575 - RNA, 13 nt, Human
cccagggcacgug

SEQ ID NO: 2006576 - RNA, 14 nt, Human
cccagggcacgugg

SEQ ID NO: 2006577 - RNA, 12 nt, Human
ccagcagccugg

SEQ ID NO: 2006578 - RNA, 11 nt, Human
ccagcagccug

SEQ ID NO: 2006579 - RNA, 16 nt, Human
ccagcagaaaugccuu

SEQ ID NO: 2006580 - RNA, 17 nt, Human
ccagcagaaaugccuua

SEQ ID NO: 2006581 - RNA, 22 nt, Human
ccagcagaaaugccuuacccuc

SEQ ID NO: 2006582 - RNA, 15 nt, Human
ccagccccuggaugc

SEQ ID NO: 2006583 - RNA, 14 nt, Human
ccagccccuggaug

SEQ ID NO: 2006584 - RNA, 13 nt, Human
ccagccccuggau

SEQ ID NO: 2006585 - RNA, 23 nt, Human
ccagccccauccucuguacagag

SEQ ID NO: 2006586 - RNA, 13 nt, Human
ccagcagccugga

SEQ ID NO: 2006587 - RNA, 17 nt, Human
ccagccccuucugaccc

SEQ ID NO: 2006588 - RNA, 16 nt, Human
ccagccccuucugacc

SEQ ID NO: 2006589 - RNA, 15 nt, Human
ccagccccuucugac

SEQ ID NO: 2006590 - RNA, 18 nt, Human
ccagccccuggaugcagc

SEQ ID NO: 2006591 - RNA, 18 nt, Human
ccagccccuucugaccca

SEQ ID NO: 2006592 - RNA, 21 nt, Human
ccagcgagcccugguggcagu

SEQ ID NO: 2006593 - RNA, 19 nt, Human
ccaggaaaggcuccaggag

SEQ ID NO: 2006594 - RNA, 18 nt, Human
ccaggaaaggcuccagga

SEQ ID NO: 2006595 - RNA, 17 nt, Human
ccaggaaaggcuccagg

SEQ ID NO: 2006596 - RNA, 20 nt, Human
ccaggaaaggcuccaggagc

SEQ ID NO: 2006597 - RNA, 23 nt, Human
ccagcgggaauggcagcugccac

SEQ ID NO: 2006598 - RNA, 17 nt, Human
ccagcgggaauggcagc

SEQ ID NO: 2006599 - RNA, 15 nt, Human
ccagcgcugacgugu

SEQ ID NO: 2006600 - RNA, 15 nt, Human
ccagcgcggacaucc

SEQ ID NO: 2006601 - RNA, 20 nt, Human
ccagcgcggacauccccugc

SEQ ID NO: 2006602 - RNA, 21 nt, Human
ccagcgcggacauccccugcu

SEQ ID NO: 2006603 - RNA, 20 nt, Human
ccagcuugaaaccuucacuu

SEQ ID NO: 2006604 - RNA, 14 nt, Human
ccagcuuggcucag

SEQ ID NO: 2006605 - RNA, 13 nt, Human
ccagcuugggcag

SEQ ID NO: 2006606 - RNA, 14 nt, Human
ccagcuugggcaga

SEQ ID NO: 2006607 - RNA, 17 nt, Human
ccagcuugggcagaucu

SEQ ID NO: 2006608 - RNA, 20 nt, Human
ccaggcagcugucacugcug

SEQ ID NO: 2006609 - RNA, 15 nt, Human
ccaggcagcacccag

SEQ ID NO: 2006610 - RNA, 16 nt, Human
ccagucaccccggcca

SEQ ID NO: 2006611 - RNA, 22 nt, Human
ccaguaucuugaagacuuuucu

SEQ ID NO: 2006612 - RNA, 19 nt, Human
ccaguaucuugaagacuuu

SEQ ID NO: 2006613 - RNA, 13 nt, Human
ccaguaucuugaa

SEQ ID NO: 2006614 - RNA, 22 nt, Human
ccaggggugggacacccuguga

SEQ ID NO: 2006615 - RNA, 21 nt, Human
ccaggggugggacacccugug

SEQ ID NO: 2006616 - RNA, 20 nt, Human
ccaggggugggacacccugu

SEQ ID NO: 2006617 - RNA, 13 nt, Human
ccaggcugagccu

SEQ ID NO: 2006618 - RNA, 14 nt, Human
ccaggcugagccuc

SEQ ID NO: 2006619 - RNA, 16 nt, Human
ccaggcugagccucag

SEQ ID NO: 2006620 - RNA, 17 nt, Human
ccaggcugagccucagu

SEQ ID NO: 2006621 - RNA, 19 nt, Human
ccaggcugagccucagucu

SEQ ID NO: 2006622 - RNA, 22 nt, Human
ccaggcugagccucagucuccc

SEQ ID NO: 2006623 - RNA, 18 nt, Human
ccagucaccccggccacc

SEQ ID NO: 2006624 - RNA, 17 nt, Human
ccagucaccccggccac

SEQ ID NO: 2006625 - RNA, 19 nt, Human
ccagucaccccggccaccu

SEQ ID NO: 2006626 - RNA, 13 nt, Human
ccacuucugccag

SEQ ID NO: 2006627 - RNA, 14 nt, Human
ccacuucugccaga

SEQ ID NO: 2006628 - RNA, 23 nt, Human
ccacuucccuggguuagacugcc

SEQ ID NO: 2006629 - RNA, 13 nt, Human
ccacuucccuggg

SEQ ID NO: 2006630 - RNA, 12 nt, Human
ccacuuggucug

SEQ ID NO: 2006631 - RNA, 19 nt, Human
ccacuucugccagaugucc

SEQ ID NO: 2006632 - RNA, 13 nt, Human
ccacuuccagggg

SEQ ID NO: 2006633 - RNA, 18 nt, Human
ccacuuccaggggaaccu

SEQ ID NO: 2006634 - RNA, 19 nt, Human
ccacuuccaggggaaccug

SEQ ID NO: 2006635 - RNA, 21 nt, Human
ccacuuccaggggaaccugcc

SEQ ID NO: 2006636 - RNA, 19 nt, Human
ccacugcacuauagccuag

SEQ ID NO: 2006637 - RNA, 20 nt, Human
ccacugcacuauagccuagg

SEQ ID NO: 2006638 - RNA, 13 nt, Human
ccacugcaccggg

SEQ ID NO: 2006639 - RNA, 14 nt, Human
ccacugcaccgggc

SEQ ID NO: 2006640 - RNA, 17 nt, Human
ccacugcaccgggccac

SEQ ID NO: 2006641 - RNA, 19 nt, Human
ccacugcaccgggccacag

SEQ ID NO: 2006642 - RNA, 16 nt, Human
ccacugaaucuguaca

SEQ ID NO: 2006643 - RNA, 11 nt, Human
ccacucuucuc

SEQ ID NO: 2006644 - RNA, 23 nt, Human
ccacucuggauucagccuucuuu

SEQ ID NO: 2006645 - RNA, 13 nt, Human
ccacuuucuagcc

SEQ ID NO: 2006646 - RNA, 14 nt, Human
ccacuuuauugcca

SEQ ID NO: 2006647 - RNA, 19 nt, Human
ccacuuucuagccagagga

SEQ ID NO: 2006648 - RNA, 18 nt, Human
ccacuuucuagccagagg

SEQ ID NO: 2006649 - RNA, 20 nt, Human
ccacuuucuagccagaggag

SEQ ID NO: 2006650 - RNA, 20 nt, Human
ccacuuuccaagucacugca

SEQ ID NO: 2006651 - RNA, 12 nt, Human
ccacuuuuccag

SEQ ID NO: 2006652 - RNA, 13 nt, Human
ccacuuuguccau

SEQ ID NO: 2006653 - RNA, 20 nt, Human
ccacuuggucugugagaugc

SEQ ID NO: 2006654 - RNA, 22 nt, Human
ccacuuggucugugagaugcua

SEQ ID NO: 2006655 - RNA, 12 nt, Human
ccacuuguagau

SEQ ID NO: 2006656 - RNA, 17 nt, Human
ccacuuguagauuugau

SEQ ID NO: 2006657 - RNA, 18 nt, Human
ccacuuguagauuugauu

SEQ ID NO: 2006658 - RNA, 20 nt, Human
ccacuuguagauuugauuuu

SEQ ID NO: 2006659 - RNA, 17 nt, Human
ccacuuguccaugugaa

SEQ ID NO: 2006660 - RNA, 15 nt, Human
ccacuuggucuguga

SEQ ID NO: 2006661 - RNA, 16 nt, Human
ccacuuggucugugag

SEQ ID NO: 2006662 - RNA, 17 nt, Human
ccacuuggucugugaga

SEQ ID NO: 2006663 - RNA, 19 nt, Human
ccacuuggucugugagaug

SEQ ID NO: 2006664 - RNA, 14 nt, Human
ccacuuuuguucuu

SEQ ID NO: 2006665 - RNA, 15 nt, Human
ccacuuuuguucuug

SEQ ID NO: 2006666 - RNA, 21 nt, Human
ccacuuuuguucuugguuugu

SEQ ID NO: 2006667 - RNA, 22 nt, Human
ccacuuuuguucuugguuugua

SEQ ID NO: 2006668 - RNA, 17 nt, Human
ccagacccggcugcgug

SEQ ID NO: 2006669 - RNA, 17 nt, Human
ccacuuuuccaguauuu

SEQ ID NO: 2006670 - RNA, 19 nt, Human
ccagacgcucauucagcau

SEQ ID NO: 2006671 - RNA, 19 nt, Human
ccagacgccugauauugaa

SEQ ID NO: 2006672 - RNA, 14 nt, Human
ccagacuccaccaa

SEQ ID NO: 2006673 - RNA, 18 nt, Human
ccagacuccaccaagccu

SEQ ID NO: 2006674 - RNA, 20 nt, Human
ccagacgcucauucagcauc

SEQ ID NO: 2006675 - RNA, 22 nt, Human
ccagacgcucauucagcaucug

SEQ ID NO: 2006676 - RNA, 22 nt, Human
ccagagaaaugaaagucaguuu

SEQ ID NO: 2006677 - RNA, 23 nt, Human
ccagagaaaugaaagucaguuua

SEQ ID NO: 2006678 - RNA, 12 nt, Human
ccagagaacaag

SEQ ID NO: 2006679 - RNA, 16 nt, Human
ccagagagaagagccc

SEQ ID NO: 2006680 - RNA, 17 nt, Human
ccagagagaagagcccc

SEQ ID NO: 2006681 - RNA, 18 nt, Human
ccagagagaagagcccca

SEQ ID NO: 2006682 - RNA, 19 nt, Human
ccagagagaagagccccac

SEQ ID NO: 2006683 - RNA, 20 nt, Human
ccagagagaagagccccacu

SEQ ID NO: 2006684 - RNA, 22 nt, Human
ccagagagaagagccccacucu

SEQ ID NO: 2006685 - RNA, 23 nt, Human
ccagagagaagagccccacucuc

SEQ ID NO: 2006686 - RNA, 18 nt, Human
ccagagacacaagccuuc

SEQ ID NO: 2006687 - RNA, 16 nt, Human
ccagagacacaagccu

SEQ ID NO: 2006688 - RNA, 13 nt, Human
ccagaugcaccag

SEQ ID NO: 2006689 - RNA, 14 nt, Human
ccagaugcaccagc

SEQ ID NO: 2006690 - RNA, 13 nt, Human
ccagaucagccag

SEQ ID NO: 2006691 - RNA, 15 nt, Human
ccagaucagccagaa

SEQ ID NO: 2006692 - RNA, 16 nt, Human
ccagaucagccagaag

SEQ ID NO: 2006693 - RNA, 13 nt, Human
ccagauccugggu

SEQ ID NO: 2006694 - RNA, 13 nt, Human
ccagagagggugg

SEQ ID NO: 2006695 - RNA, 19 nt, Human
ccagaguccccccacuccc

SEQ ID NO: 2006696 - RNA, 20 nt, Human
ccugccuccuuugugaggaa

SEQ ID NO: 2006697 - RNA, 19 nt, Human
ccugccuccuuugugagga

SEQ ID NO: 2006698 - RNA, 15 nt, Human
ccugccuccuuugug

SEQ ID NO: 2006699 - RNA, 13 nt, Human
ccugccuccuuug

SEQ ID NO: 2006700 - RNA, 22 nt, Human
ccugccuccuuugugaggaagc

SEQ ID NO: 2006701 - RNA, 21 nt, Human
ccugccuccuuugugaggaag

SEQ ID NO: 2006702 - RNA, 23 nt, Human
ccugccuccuuugugaggaagcc

SEQ ID NO: 2006703 - RNA, 17 nt, Human
ccugccucucugcaggu

SEQ ID NO: 2006704 - RNA, 15 nt, Human
ccugccucuucucua

SEQ ID NO: 2006705 - RNA, 17 nt, Human
ccugccuccuugauauu

SEQ ID NO: 2006706 - RNA, 21 nt, Human
ccugccucucugcaggucccu

SEQ ID NO: 2006707 - RNA, 20 nt, Human
ccugccucucugcagguccc

SEQ ID NO: 2006708 - RNA, 12 nt, Human
ccugccugcugg

SEQ ID NO: 2006709 - RNA, 19 nt, Human
ccugccugcccugucagga

SEQ ID NO: 2006710 - RNA, 14 nt, Human
ccugccugcccugu

SEQ ID NO: 2006711 - RNA, 16 nt, Human
ccugccugcccuguca

SEQ ID NO: 2006712 - RNA, 18 nt, Human
ccugccugcccugucagg

SEQ ID NO: 2006713 - RNA, 16 nt, Human
ccugcugcaguugcca

SEQ ID NO: 2006714 - RNA, 12 nt, Human
ccugcugcaguu

SEQ ID NO: 2006715 - RNA, 11 nt, Human
ccugcugcagu

SEQ ID NO: 2006716 - RNA, 22 nt, Human
ccugcugcaguugccagucacc

SEQ ID NO: 2006717 - RNA, 19 nt, Human
ccugcugccaguaccagcc

SEQ ID NO: 2006718 - RNA, 21 nt, Human
ccugcugccaguaccagcccc

SEQ ID NO: 2006719 - RNA, 14 nt, Human
ccucuucugagcuu

SEQ ID NO: 2006720 - RNA, 15 nt, Human
ccucuuggcugccuu

SEQ ID NO: 2006721 - RNA, 15 nt, Human
ccucuucuucucaag

SEQ ID NO: 2006722 - RNA, 19 nt, Human
ccucuuuggucuacacugu

SEQ ID NO: 2006723 - RNA, 16 nt, Human
ccucuuugagugaagc

SEQ ID NO: 2006724 - RNA, 21 nt, Human
ccucugccugaagucacacag

SEQ ID NO: 2006725 - RNA, 15 nt, Human
ccucugccugucucc

SEQ ID NO: 2006726 - RNA, 19 nt, Human
ccucugccugucuccccca

SEQ ID NO: 2006727 - RNA, 12 nt, Human
ccucugcuaaau

SEQ ID NO: 2006728 - RNA, 14 nt, Human
ccucugcuaaauug

SEQ ID NO: 2006729 - RNA, 15 nt, Human
ccucugcuaaauuga

SEQ ID NO: 2006730 - RNA, 22 nt, Human
ccucugcuaaauugauguugau

SEQ ID NO: 2006731 - RNA, 21 nt, Human
ccugcaggcagccaggccaca

SEQ ID NO: 2006732 - RNA, 20 nt, Human
ccugcaggcagccaggccac

SEQ ID NO: 2006733 - RNA, 19 nt, Human
ccugcaggcagccaggcca

SEQ ID NO: 2006734 - RNA, 18 nt, Human
ccugcaggcagccaggcc

SEQ ID NO: 2006735 - RNA, 23 nt, Human
ccugcaggcagccaggccacaag

SEQ ID NO: 2006736 - RNA, 14 nt, Human
ccugcagagggcac

SEQ ID NO: 2006737 - RNA, 12 nt, Human
ccugcagagcug

SEQ ID NO: 2006738 - RNA, 13 nt, Human
ccugcagagcugc

SEQ ID NO: 2006739 - RNA, 14 nt, Human
ccugcagagcugcg

SEQ ID NO: 2006740 - RNA, 17 nt, Human
ccugcagagcugcgggc

SEQ ID NO: 2006741 - RNA, 14 nt, Human
ccugaguuccuagc

SEQ ID NO: 2006742 - RNA, 18 nt, Human
ccugaguuaggcuuucuc

SEQ ID NO: 2006743 - RNA, 18 nt, Human
ccugaguuccuagccacc

SEQ ID NO: 2006744 - RNA, 19 nt, Human
ccugaguuaggcuuucucu

SEQ ID NO: 2006745 - RNA, 22 nt, Human
ccugaguuaggcuuucucuuca

SEQ ID NO: 2006746 - RNA, 17 nt, Human
ccugcaggcagccaggc

SEQ ID NO: 2006747 - RNA, 16 nt, Human
ccugcaggcagccagg

SEQ ID NO: 2006748 - RNA, 12 nt, Human
ccugcagagggc

SEQ ID NO: 2006749 - RNA, 15 nt, Human
ccugcaggcagccag

SEQ ID NO: 2006750 - RNA, 16 nt, Human
ccugaggggccucuua

SEQ ID NO: 2006751 - RNA, 15 nt, Human
ccugagugagagggg

SEQ ID NO: 2006752 - RNA, 16 nt, Human
ccugagugagagggga

SEQ ID NO: 2006753 - RNA, 18 nt, Human
ccugagugagaggggagg

SEQ ID NO: 2006754 - RNA, 21 nt, Human
ccugagugagaggggaggcca

SEQ ID NO: 2006755 - RNA, 22 nt, Human
ccugagugagaggggaggccaa

SEQ ID NO: 2006756 - RNA, 23 nt, Human
ccugagugagaggggaggccaag

SEQ ID NO: 2006757 - RNA, 12 nt, Human
ccugaggggccu

SEQ ID NO: 2006758 - RNA, 15 nt, Human
ccugaggggagacag

SEQ ID NO: 2006759 - RNA, 18 nt, Human
ccugaggggagacagagc

SEQ ID NO: 2006760 - RNA, 19 nt, Human
ccugaggggagacagagca

SEQ ID NO: 2006761 - RNA, 20 nt, Human
ccugaggggagacagagcaa

SEQ ID NO: 2006762 - RNA, 22 nt, Human
ccugaggggagacagagcaacc

SEQ ID NO: 2006763 - RNA, 15 nt, Human
ccugaggggcagccu

SEQ ID NO: 2006764 - RNA, 17 nt, Human
ccugaggggcagccugc

SEQ ID NO: 2006765 - RNA, 20 nt, Human
ccugaggggcagccugccuu

SEQ ID NO: 2006766 - RNA, 21 nt, Human
ccugaggggcagccugccuug

SEQ ID NO: 2006767 - RNA, 19 nt, Human
ccugacgagauaagcaguu

SEQ ID NO: 2006768 - RNA, 21 nt, Human
ccugaggcugggcucccuucc

SEQ ID NO: 2006769 - RNA, 19 nt, Human
ccugaggcugggcucccuu

SEQ ID NO: 2006770 - RNA, 17 nt, Human
ccugaggcugggcuccc

SEQ ID NO: 2006771 - RNA, 13 nt, Human
ccugacuccccca

SEQ ID NO: 2006772 - RNA, 19 nt, Human
ccugacucccccagucccc

SEQ ID NO: 2006773 - RNA, 19 nt, Human
ccucccacugcccacuggc

SEQ ID NO: 2006774 - RNA, 23 nt, Human
ccucccacugcccacuggccggc

SEQ ID NO: 2006775 - RNA, 14 nt, Human
ccucccacugccca

SEQ ID NO: 2006776 - RNA, 15 nt, Human
ccucccacugcccac

SEQ ID NO: 2006777 - RNA, 23 nt, Human
ccucccaacucaccccagcccca

SEQ ID NO: 2006778 - RNA, 21 nt, Human
ccucccaacucaccccagccc

SEQ ID NO: 2006779 - RNA, 20 nt, Human
ccucccaacucaccccagcc

SEQ ID NO: 2006780 - RNA, 17 nt, Human
ccucccaacucacccca

SEQ ID NO: 2006781 - RNA, 11 nt, Human
ccucaggcagg

SEQ ID NO: 2006782 - RNA, 19 nt, Human
ccucaggaggcaggaccuu

SEQ ID NO: 2006783 - RNA, 18 nt, Human
ccucagccuccugaguag

SEQ ID NO: 2006784 - RNA, 14 nt, Human
ccuaggaagugauu

SEQ ID NO: 2006785 - RNA, 17 nt, Human
ccuagccuugcacuuuc

SEQ ID NO: 2006786 - RNA, 23 nt, Human
ccuagccucacgcuccuuucuga

SEQ ID NO: 2006787 - RNA, 12 nt, Human
ccuagcuggaga

SEQ ID NO: 2006788 - RNA, 16 nt, Human
ccuagcuggagaggag

SEQ ID NO: 2006789 - RNA, 19 nt, Human
ccuagcuggagaggagccc

SEQ ID NO: 2006790 - RNA, 20 nt, Human
ccuagcuggagaggagcccu

SEQ ID NO: 2006791 - RNA, 21 nt, Human
ccuagcuggagaggagcccug

SEQ ID NO: 2006792 - RNA, 22 nt, Human
ccuagcuggagaggagcccugc

SEQ ID NO: 2006793 - RNA, 20 nt, Human
ccuccuuugugaggaagccg

SEQ ID NO: 2006794 - RNA, 19 nt, Human
ccuccuuugugaggaagcc

SEQ ID NO: 2006795 - RNA, 18 nt, Human
ccuccuuugugaggaagc

SEQ ID NO: 2006796 - RNA, 23 nt, Human
ccucgacacgugggcuccccucu

SEQ ID NO: 2006797 - RNA, 16 nt, Human
ccucgaacuggcugca

SEQ ID NO: 2006798 - RNA, 15 nt, Human
ccucgaacuggcugc

SEQ ID NO: 2006799 - RNA, 15 nt, Human
ccuccuaaaaggccc

SEQ ID NO: 2006800 - RNA, 16 nt, Human
ccuccuaaaaggccca

SEQ ID NO: 2006801 - RNA, 17 nt, Human
ccuccuaaaaggcccag

SEQ ID NO: 2006802 - RNA, 18 nt, Human
ccuccuaaaaggcccaga

SEQ ID NO: 2006803 - RNA, 19 nt, Human
ccuccuaaaaggcccagag

SEQ ID NO: 2006804 - RNA, 21 nt, Human
ccuccuaaaaggcccagagag

SEQ ID NO: 2006805 - RNA, 20 nt, Human
ccuccgucacuaccuggcug

SEQ ID NO: 2006806 - RNA, 14 nt, Human
ccuccggcuaagca

SEQ ID NO: 2006807 - RNA, 15 nt, Human
ccuccgggucuuccu

SEQ ID NO: 2006808 - RNA, 16 nt, Human
ccuccgggucuuccua

SEQ ID NO: 2006809 - RNA, 14 nt, Human
ccuccgucacuacc

SEQ ID NO: 2006810 - RNA, 16 nt, Human
ccuccgucacuaccug

SEQ ID NO: 2006811 - RNA, 19 nt, Human
ccuccgucacuaccuggcu

SEQ ID NO: 2006812 - RNA, 13 nt, Human
ccuccgccucccg

SEQ ID NO: 2006813 - RNA, 16 nt, Human
ccuccgccucccgggu

SEQ ID NO: 2006814 - RNA, 13 nt, Human
ccucuccuuccug

SEQ ID NO: 2006815 - RNA, 15 nt, Human
ccucuccuuccugug

SEQ ID NO: 2006816 - RNA, 17 nt, Human
ccucggcuggcugucca

SEQ ID NO: 2006817 - RNA, 14 nt, Human
ccucgcuccaacuc

SEQ ID NO: 2006818 - RNA, 12 nt, Human
ccucucucacuc

SEQ ID NO: 2006819 - RNA, 19 nt, Human
ccucucugcaggucccuaa

SEQ ID NO: 2006820 - RNA, 18 nt, Human
ccucucugcaggucccua

SEQ ID NO: 2006821 - RNA, 17 nt, Human
ccucucugcaggucccu

SEQ ID NO: 2006822 - RNA, 16 nt, Human
ccucucugcagguccc

SEQ ID NO: 2006823 - RNA, 20 nt, Human
ccucugccucugacacacag

SEQ ID NO: 2006824 - RNA, 11 nt, Human
ccucugcccug

SEQ ID NO: 2006825 - RNA, 12 nt, Human
ccucugcccugc

SEQ ID NO: 2006826 - RNA, 13 nt, Human
ccucugcccugcg

SEQ ID NO: 2006827 - RNA, 14 nt, Human
ccucugcccugcgg

SEQ ID NO: 2006828 - RNA, 21 nt, Human
ccucugccucugacacacagc

SEQ ID NO: 2006829 - RNA, 23 nt, Human
ccucugccucugacacacagcuc

SEQ ID NO: 2006830 - RNA, 11 nt, Human
ccucugccuga

SEQ ID NO: 2006831 - RNA, 20 nt, Human
ccucugccugaagucacaca

SEQ ID NO: 2006832 - RNA, 23 nt, Human
ccgaaggugaggagcuugaaacc

SEQ ID NO: 2006833 - RNA, 16 nt, Human
ccgaauagcugggacu

SEQ ID NO: 2006834 - RNA, 17 nt, Human
ccgaauagcugggacua

SEQ ID NO: 2006835 - RNA, 18 nt, Human
ccgaccagacaccuugac

SEQ ID NO: 2006836 - RNA, 15 nt, Human
ccgaccaccugccca

SEQ ID NO: 2006837 - RNA, 15 nt, Human
ccgcagacaggacca

SEQ ID NO: 2006838 - RNA, 13 nt, Human
ccgaccagacacc

SEQ ID NO: 2006839 - RNA, 17 nt, Human
ccgaccagacaccuuga

SEQ ID NO: 2006840 - RNA, 17 nt, Human
ccgaaaacguggcugcu

SEQ ID NO: 2006841 - RNA, 16 nt, Human
ccgaaaacguggcugc

SEQ ID NO: 2006842 - RNA, 19 nt, Human
ccgaaagggacuuggaagc

SEQ ID NO: 2006843 - RNA, 17 nt, Human
ccgaaaccaaagaagaa

SEQ ID NO: 2006844 - RNA, 19 nt, Human
ccgaaagaggcacccuucc

SEQ ID NO: 2006845 - RNA, 18 nt, Human
ccgaaaggucaccucacu

SEQ ID NO: 2006846 - RNA, 15 nt, Human
cccuuccucuuucca

SEQ ID NO: 2006847 - RNA, 13 nt, Human
cccuuccucugcu

SEQ ID NO: 2006848 - RNA, 14 nt, Human
cccuuccucugcuc

SEQ ID NO: 2006849 - RNA, 16 nt, Human
cccuuccucugcuccc

SEQ ID NO: 2006850 - RNA, 14 nt, Human
cccuuccugggcac

SEQ ID NO: 2006851 - RNA, 18 nt, Human
cccuuccugggcacacgc

SEQ ID NO: 2006852 - RNA, 22 nt, Human
cccuuccugggcacacgcugcu

SEQ ID NO: 2006853 - RNA, 23 nt, Human
cccuuccugggcacacgcugcuc

SEQ ID NO: 2006854 - RNA, 11 nt, Human
cccuuccugug

SEQ ID NO: 2006855 - RNA, 12 nt, Human
cccuuccuucuu

SEQ ID NO: 2006856 - RNA, 17 nt, Human
ccgcagacaggaccagg

SEQ ID NO: 2006857 - RNA, 16 nt, Human
ccgcagacaggaccag

SEQ ID NO: 2006858 - RNA, 17 nt, Human
ccgaccacuuccagggg

SEQ ID NO: 2006859 - RNA, 18 nt, Human
ccgcccaaaccuuucccc

SEQ ID NO: 2006860 - RNA, 22 nt, Human
ccgcccagagacccaagcugcc

SEQ ID NO: 2006861 - RNA, 14 nt, Human
ccgcccagcccacc

SEQ ID NO: 2006862 - RNA, 12 nt, Human
ccgcccaggcuu

SEQ ID NO: 2006863 - RNA, 22 nt, Human
cccugugauggggcccugccuc

SEQ ID NO: 2006864 - RNA, 21 nt, Human
cccugugauggggcccugccu

SEQ ID NO: 2006865 - RNA, 21 nt, Human
cccugugcagaagggagcugg

SEQ ID NO: 2006866 - RNA, 21 nt, Human
cccuuccucuccacugccuuc

SEQ ID NO: 2006867 - RNA, 23 nt, Human
cccugugauggggcccugccucc

SEQ ID NO: 2006868 - RNA, 18 nt, Human
ccggcaggguccuagaaa

SEQ ID NO: 2006869 - RNA, 16 nt, Human
ccggccaccugcggug

SEQ ID NO: 2006870 - RNA, 15 nt, Human
ccggccccugcuggu

SEQ ID NO: 2006871 - RNA, 20 nt, Human
ccuaacgaaguauccuucag

SEQ ID NO: 2006872 - RNA, 16 nt, Human
ccgugaggccagagac

SEQ ID NO: 2006873 - RNA, 14 nt, Human
ccgugaggccagag

SEQ ID NO: 2006874 - RNA, 13 nt, Human
ccgugaggccaga

SEQ ID NO: 2006875 - RNA, 12 nt, Human
ccgugaggccag

SEQ ID NO: 2006876 - RNA, 17 nt, Human
ccgucuaccugaggggc

SEQ ID NO: 2006877 - RNA, 15 nt, Human
ccgucuaccugaggg

SEQ ID NO: 2006878 - RNA, 14 nt, Human
ccgucuaccugagg

SEQ ID NO: 2006879 - RNA, 15 nt, Human
ccggcuccaggcucc

SEQ ID NO: 2006880 - RNA, 15 nt, Human
ccgucuacagcuccc

SEQ ID NO: 2006881 - RNA, 22 nt, Human
ccgucuacagcucccccagcuc

SEQ ID NO: 2006882 - RNA, 12 nt, Human
ccggcuccaggc

SEQ ID NO: 2006883 - RNA, 13 nt, Human
ccggcuccaggcu

SEQ ID NO: 2006884 - RNA, 14 nt, Human
ccggcuccaggcuc

SEQ ID NO: 2006885 - RNA, 19 nt, Human
ccuagcauacguacacauu

SEQ ID NO: 2006886 - RNA, 17 nt, Human
ccuagcacuuugggagg

SEQ ID NO: 2006887 - RNA, 20 nt, Human
ccuagccugugccucuggga

SEQ ID NO: 2006888 - RNA, 14 nt, Human
ccuaaucuucugaa

SEQ ID NO: 2006889 - RNA, 19 nt, Human
cccuggauccaucaggcca

SEQ ID NO: 2006890 - RNA, 21 nt, Human
cccuggaugcagccucacagu

SEQ ID NO: 2006891 - RNA, 17 nt, Human
cccuggaugcagccuca

SEQ ID NO: 2006892 - RNA, 13 nt, Human
cccuggaugcagc

SEQ ID NO: 2006893 - RNA, 22 nt, Human
cccugcccugguuuccugcccu

SEQ ID NO: 2006894 - RNA, 23 nt, Human
cccugcccugguuuccugcccug

SEQ ID NO: 2006895 - RNA, 11 nt, Human
cccugcccugg

SEQ ID NO: 2006896 - RNA, 12 nt, Human
cccugcccuggu

SEQ ID NO: 2006897 - RNA, 20 nt, Human
cccuggcucccacaggcccu

SEQ ID NO: 2006898 - RNA, 14 nt, Human
cccugccccccagc

SEQ ID NO: 2006899 - RNA, 20 nt, Human
cccugccccccagcccuccu

SEQ ID NO: 2006900 - RNA, 15 nt, Human
cccugccccccagcc

SEQ ID NO: 2006901 - RNA, 22 nt, Human
cccugcccaccuggccucugca

SEQ ID NO: 2006902 - RNA, 14 nt, Human
cccugcccagauca

SEQ ID NO: 2006903 - RNA, 20 nt, Human
cccugcccagaucagccaga

SEQ ID NO: 2006904 - RNA, 21 nt, Human
cccugcccagaucagccagaa

SEQ ID NO: 2006905 - RNA, 22 nt, Human
cccugcccagaucagccagaag

SEQ ID NO: 2006906 - RNA, 14 nt, Human
cccugcccggcugc

SEQ ID NO: 2006907 - RNA, 17 nt, Human
cccugcccggcugcgga

SEQ ID NO: 2006908 - RNA, 18 nt, Human
cccugccccucccuucaa

SEQ ID NO: 2006909 - RNA, 19 nt, Human
cccugccccucccuucaac

SEQ ID NO: 2006910 - RNA, 23 nt, Human
cccugccccucccuucaaccauu

SEQ ID NO: 2006911 - RNA, 17 nt, Human
cccugccccucccuuca

SEQ ID NO: 2006912 - RNA, 18 nt, Human
cccugagaucucugcagg

SEQ ID NO: 2006913 - RNA, 12 nt, Human
cccugacugggg

SEQ ID NO: 2006914 - RNA, 20 nt, Human
cccugacugggggcagacau

SEQ ID NO: 2006915 - RNA, 16 nt, Human
cccugagcuuucugcu

SEQ ID NO: 2006916 - RNA, 20 nt, Human
cccugcccaccuggccucug

SEQ ID NO: 2006917 - RNA, 12 nt, Human
cccugagcccac

SEQ ID NO: 2006918 - RNA, 13 nt, Human
cccugagcccacu

SEQ ID NO: 2006919 - RNA, 14 nt, Human
cccugagcccacug

SEQ ID NO: 2006920 - RNA, 16 nt, Human
cccugagcccacugug

SEQ ID NO: 2006921 - RNA, 17 nt, Human
cccugagcccacugugc

SEQ ID NO: 2006922 - RNA, 14 nt, Human
cccuccucucugcc

SEQ ID NO: 2006923 - RNA, 11 nt, Human
cccuccuccug

SEQ ID NO: 2006924 - RNA, 16 nt, Human
cccuccuccuggacuc

SEQ ID NO: 2006925 - RNA, 18 nt, Human
cccuccuccuggacuccu

SEQ ID NO: 2006926 - RNA, 17 nt, Human
cccuccgggucuuccua

SEQ ID NO: 2006927 - RNA, 20 nt, Human
cccucgcccagucccagcag

SEQ ID NO: 2006928 - RNA, 22 nt, Human
cccucgcccagucccagcagcc

SEQ ID NO: 2006929 - RNA, 12 nt, Human
cccucgcccagu

SEQ ID NO: 2006930 - RNA, 13 nt, Human
cccucgcccaguc

SEQ ID NO: 2006931 - RNA, 16 nt, Human
cccucgcccaguccca

SEQ ID NO: 2006932 - RNA, 18 nt, Human
cccucgcccagucccagc

SEQ ID NO: 2006933 - RNA, 18 nt, Human
cccugaaagcccugagcu

SEQ ID NO: 2006934 - RNA, 13 nt, Human
cccucgucuuucc

SEQ ID NO: 2006935 - RNA, 18 nt, Human
cccucggaguucuucuug

SEQ ID NO: 2006936 - RNA, 19 nt, Human
cccucggaguucuucuuga

SEQ ID NO: 2006937 - RNA, 19 nt, Human
cccugaaggccccgcccag

SEQ ID NO: 2006938 - RNA, 16 nt, Human
cccugaaggccccgcc

SEQ ID NO: 2006939 - RNA, 14 nt, Human
cccugaaggccccg

SEQ ID NO: 2006940 - RNA, 13 nt, Human
cccugaaggcccc

SEQ ID NO: 2006941 - RNA, 12 nt, Human
cccugaaggccc

SEQ ID NO: 2006942 - RNA, 14 nt, Human
cccugaaggaacca

SEQ ID NO: 2006943 - RNA, 22 nt, Human
cccugaacaacgagccuuuuca

SEQ ID NO: 2006944 - RNA, 14 nt, Human
cccucgucuuuccc

SEQ ID NO: 2006945 - RNA, 15 nt, Human
cccucgucuuuccca

SEQ ID NO: 2006946 - RNA, 11 nt, Human
cccugaaaugu

SEQ ID NO: 2006947 - RNA, 13 nt, Human
cccugaaaugugu

SEQ ID NO: 2006948 - RNA, 20 nt, Human
cccugaauuuaaauagcuuu

SEQ ID NO: 2006949 - RNA, 22 nt, Human
cccugacaacacucauugaccu

SEQ ID NO: 2006950 - RNA, 16 nt, Human
cccugacaacacucau

SEQ ID NO: 2006951 - RNA, 22 nt, Human
cccugaaggccccgcccaggcu

SEQ ID NO: 2006952 - RNA, 20 nt, Human
cccugaaggccccgcccagg

SEQ ID NO: 2006953 - RNA, 14 nt, Human
cccugacaacacuc

SEQ ID NO: 2006954 - RNA, 15 nt, Human
cauuggauucugaga

SEQ ID NO: 2006955 - RNA, 20 nt, Human
cauuggauucugagagcugu

SEQ ID NO: 2006956 - RNA, 16 nt, Human
cauuggagauguuuag

SEQ ID NO: 2006957 - RNA, 22 nt, Human
cauuggaagcagguuaaauguu

SEQ ID NO: 2006958 - RNA, 23 nt, Human
cauuggaagcagguuaaauguuu

SEQ ID NO: 2006959 - RNA, 21 nt, Human
cauuggaagcagguuaaaugu

SEQ ID NO: 2006960 - RNA, 16 nt, Human
cauuuaggugaggaag

SEQ ID NO: 2006961 - RNA, 18 nt, Human
cauuuaggugaggaagca

SEQ ID NO: 2006962 - RNA, 12 nt, Human
ccaaaaaauauc

SEQ ID NO: 2006963 - RNA, 17 nt, Human
ccaaaaaaauccagaaa

SEQ ID NO: 2006964 - RNA, 14 nt, Human
ccaaaagcugcuca

SEQ ID NO: 2006965 - RNA, 19 nt, Human
ccaaaaaauaucuaguaau

SEQ ID NO: 2006966 - RNA, 23 nt, Human
ccaaaaaauaucuaguaauauau

SEQ ID NO: 2006967 - RNA, 14 nt, Human
ccaaaaggcagaag

SEQ ID NO: 2006968 - RNA, 23 nt, Human
cauuuuuuuuaagaaaaaggaug

SEQ ID NO: 2006969 - RNA, 23 nt, Human
cauuuguuucuuucucugaggac

SEQ ID NO: 2006970 - RNA, 21 nt, Human
cauuuguuucuuucucugagg

SEQ ID NO: 2006971 - RNA, 22 nt, Human
cauuuguuucuuucucugagga

SEQ ID NO: 2006972 - RNA, 19 nt, Human
cauuuguugccagauuuca

SEQ ID NO: 2006973 - RNA, 14 nt, Human
cauuuguaauuuaa

SEQ ID NO: 2006974 - RNA, 12 nt, Human
cauuugggcaga

SEQ ID NO: 2006975 - RNA, 16 nt, Human
cauuugggcagagagg

SEQ ID NO: 2006976 - RNA, 21 nt, Human
cauuuggugguuucagaaaug

SEQ ID NO: 2006977 - RNA, 13 nt, Human
cauuuggugcuug

SEQ ID NO: 2006978 - RNA, 12 nt, Human
cauuuguaauuu

SEQ ID NO: 2006979 - RNA, 20 nt, Human
cauuuggguugguuccaagu

SEQ ID NO: 2006980 - RNA, 16 nt, Human
cauuuaucuugaagga

SEQ ID NO: 2006981 - RNA, 17 nt, Human
cauuuaucuugaaggaa

SEQ ID NO: 2006982 - RNA, 23 nt, Human
cauuuaucuugaaggaaaaauuc

SEQ ID NO: 2006983 - RNA, 12 nt, Human
cauuuaucuuga

SEQ ID NO: 2006984 - RNA, 14 nt, Human
cauuuaucuugaag

SEQ ID NO: 2006985 - RNA, 15 nt, Human
cauuuaucuugaagg

SEQ ID NO: 2006986 - RNA, 22 nt, Human
ccaaaguacacuguuucaaacu

SEQ ID NO: 2006987 - RNA, 14 nt, Human
ccaaaguauuguac

SEQ ID NO: 2006988 - RNA, 14 nt, Human
ccaaagugcuggga

SEQ ID NO: 2006989 - RNA, 20 nt, Human
ccaaggagggugagugcaag

SEQ ID NO: 2006990 - RNA, 22 nt, Human
ccaaggacagaaggcuccugcc

SEQ ID NO: 2006991 - RNA, 19 nt, Human
ccaauucgaacuuuuucca

SEQ ID NO: 2006992 - RNA, 14 nt, Human
ccaauucuccuuua

SEQ ID NO: 2006993 - RNA, 14 nt, Human
ccaaugggagcuca

SEQ ID NO: 2006994 - RNA, 23 nt, Human
ccaauggacuaacuugucuuugg

SEQ ID NO: 2006995 - RNA, 21 nt, Human
ccaauggagacugucucaaga

SEQ ID NO: 2006996 - RNA, 13 nt, Human
ccaacucacccca

SEQ ID NO: 2006997 - RNA, 16 nt, Human
ccaacuauggccugug

SEQ ID NO: 2006998 - RNA, 15 nt, Human
ccaacuauggccugu

SEQ ID NO: 2006999 - RNA, 14 nt, Human
ccaacuauggccug

SEQ ID NO: 2007000 - RNA, 15 nt, Human
ccaaaucagcugcua

SEQ ID NO: 2007001 - RNA, 23 nt, Human
ccaaaucagcugcuacuacuccu

SEQ ID NO: 2007002 - RNA, 16 nt, Human
ccaaaucauaguggcu

SEQ ID NO: 2007003 - RNA, 16 nt, Human
ccaagcucugcuccuc

SEQ ID NO: 2007004 - RNA, 14 nt, Human
ccaagcucugcucc

SEQ ID NO: 2007005 - RNA, 15 nt, Human
ccaagcucugcuccu

SEQ ID NO: 2007006 - RNA, 21 nt, Human
ccaacucaccccagccccaaa

SEQ ID NO: 2007007 - RNA, 16 nt, Human
ccaacuccaacaucca

SEQ ID NO: 2007008 - RNA, 17 nt, Human
ccaacuccaacauccac

SEQ ID NO: 2007009 - RNA, 18 nt, Human
ccaacuccaacauccacu

SEQ ID NO: 2007010 - RNA, 20 nt, Human
cauucuccuuguguuacuaa

SEQ ID NO: 2007011 - RNA, 20 nt, Human
cauucucuaauauccacuug

SEQ ID NO: 2007012 - RNA, 22 nt, Human
cauucucuccauuucacuggcu

SEQ ID NO: 2007013 - RNA, 12 nt, Human
cauucucucucc

SEQ ID NO: 2007014 - RNA, 21 nt, Human
cauucuccaccugccagggac

SEQ ID NO: 2007015 - RNA, 19 nt, Human
cauucuccaccugccaggg

SEQ ID NO: 2007016 - RNA, 18 nt, Human
cauucuccaccugccagg

SEQ ID NO: 2007017 - RNA, 17 nt, Human
cauucuccaccugccag

SEQ ID NO: 2007018 - RNA, 17 nt, Human
cauuaucuacuugugua

SEQ ID NO: 2007019 - RNA, 17 nt, Human
cauuauguuaauauuuc

SEQ ID NO: 2007020 - RNA, 15 nt, Human
cauuauguuaauauu

SEQ ID NO: 2007021 - RNA, 16 nt, Human
cauuauguuaauauuu

SEQ ID NO: 2007022 - RNA, 17 nt, Human
cauguuacauaagauaa

SEQ ID NO: 2007023 - RNA, 16 nt, Human
cauguuacauaagaua

SEQ ID NO: 2007024 - RNA, 16 nt, Human
cauguccaagaagccc

SEQ ID NO: 2007025 - RNA, 15 nt, Human
cauguccaagaagcc

SEQ ID NO: 2007026 - RNA, 13 nt, Human
cauguucuuaauu

SEQ ID NO: 2007027 - RNA, 16 nt, Human
cauguucuuaauucuu

SEQ ID NO: 2007028 - RNA, 21 nt, Human
cauguuacauaagauaaaugu

SEQ ID NO: 2007029 - RNA, 18 nt, Human
cauguuaauugauagaau

SEQ ID NO: 2007030 - RNA, 14 nt, Human
cauguucugcuuuc

SEQ ID NO: 2007031 - RNA, 18 nt, Human
cauguucuuaauucuuag

SEQ ID NO: 2007032 - RNA, 18 nt, Human
cauguuggccaggcuggu

SEQ ID NO: 2007033 - RNA, 17 nt, Human
cauguuggccaggcugg

SEQ ID NO: 2007034 - RNA, 19 nt, Human
cauguuggccaggcugguc

SEQ ID NO: 2007035 - RNA, 20 nt, Human
cauguuggccaggcugcucu

SEQ ID NO: 2007036 - RNA, 22 nt, Human
cauguuggccaggcugcucuca

SEQ ID NO: 2007037 - RNA, 23 nt, Human
cauguuggccaggcugcucucaa

SEQ ID NO: 2007038 - RNA, 14 nt, Human
cauguauggccagg

SEQ ID NO: 2007039 - RNA, 15 nt, Human
cauguauggccagga

SEQ ID NO: 2007040 - RNA, 12 nt, Human
cauguauggcca

SEQ ID NO: 2007041 - RNA, 12 nt, Human
cauguauuaaau

SEQ ID NO: 2007042 - RNA, 20 nt, Human
cauguauuaaauuacauuug

SEQ ID NO: 2007043 - RNA, 22 nt, Human
cauguauuaaauuacauuugua

SEQ ID NO: 2007044 - RNA, 16 nt, Human
caugcuccuggcccac

SEQ ID NO: 2007045 - RNA, 14 nt, Human
caugcuccuggccc

SEQ ID NO: 2007046 - RNA, 17 nt, Human
caugcuccuggcccacu

SEQ ID NO: 2007047 - RNA, 20 nt, Human
caugcuccuggcccacugca

SEQ ID NO: 2007048 - RNA, 15 nt, Human
cauggccagguggcc

SEQ ID NO: 2007049 - RNA, 16 nt, Human
cauggccggcuuucag

SEQ ID NO: 2007050 - RNA, 17 nt, Human
cauggccggcuuucagg

SEQ ID NO: 2007051 - RNA, 18 nt, Human
cauggccggcuuucagga

SEQ ID NO: 2007052 - RNA, 19 nt, Human
cauggccggcuuucaggag

SEQ ID NO: 2007053 - RNA, 18 nt, Human
caugggaaaggggaaguu

SEQ ID NO: 2007054 - RNA, 22 nt, Human
cauggcuucugaaccugucuuu

SEQ ID NO: 2007055 - RNA, 18 nt, Human
caugggaaaguauucucu

SEQ ID NO: 2007056 - RNA, 20 nt, Human
caugggaaaugucaacaagu

SEQ ID NO: 2007057 - RNA, 20 nt, Human
caugggaaaguauucucuuu

SEQ ID NO: 2007058 - RNA, 21 nt, Human
caugggaaaguauucucuuuu

SEQ ID NO: 2007059 - RNA, 22 nt, Human
cauggccucuucagaucucuaa

SEQ ID NO: 2007060 - RNA, 13 nt, Human
cauggcuucugaa

SEQ ID NO: 2007061 - RNA, 19 nt, Human
cauggcuucugaaccuguc

SEQ ID NO: 2007062 - RNA, 21 nt, Human
cauggccucuucagaucucua

SEQ ID NO: 2007063 - RNA, 20 nt, Human
cauggccggcuuucaggagc

SEQ ID NO: 2007064 - RNA, 22 nt, Human
cauggccggcuuucaggagcuc

SEQ ID NO: 2007065 - RNA, 14 nt, Human
cauggccgugaacu

SEQ ID NO: 2007066 - RNA, 12 nt, Human
caugcaagguca

SEQ ID NO: 2007067 - RNA, 15 nt, Human
caugcaaggucauuu

SEQ ID NO: 2007068 - RNA, 16 nt, Human
caugaugcucuuuccc

SEQ ID NO: 2007069 - RNA, 17 nt, Human
caugaugcucuuuccca

SEQ ID NO: 2007070 - RNA, 13 nt, Human
caugacaaagacu

SEQ ID NO: 2007071 - RNA, 16 nt, Human
caugaauuugugaagg

SEQ ID NO: 2007072 - RNA, 21 nt, Human
caugaauauuuaguguucaua

SEQ ID NO: 2007073 - RNA, 10 nt, Human
cagucucaca

SEQ ID NO: 2007074 - RNA, 12 nt, Human
cagucucacauu

SEQ ID NO: 2007075 - RNA, 20 nt, Human
cagucucacauuucucaaca

SEQ ID NO: 2007076 - RNA, 17 nt, Human
cagucucaccauuuccc

SEQ ID NO: 2007077 - RNA, 15 nt, Human
cagucuaucauuguu

SEQ ID NO: 2007078 - RNA, 20 nt, Human
cagucucaccauuuccccag

SEQ ID NO: 2007079 - RNA, 21 nt, Human
cagucugauucccaagcucug

SEQ ID NO: 2007080 - RNA, 22 nt, Human
cagucugauucccaagcucugc

SEQ ID NO: 2007081 - RNA, 21 nt, Human
cagucuaaauuuauuauuuaa

SEQ ID NO: 2007082 - RNA, 21 nt, Human
cagucgugguugggaacacag

SEQ ID NO: 2007083 - RNA, 20 nt, Human
cagugguaugaucacggcuc

SEQ ID NO: 2007084 - RNA, 15 nt, Human
cagugcccagguggc

SEQ ID NO: 2007085 - RNA, 22 nt, Human
cagugcccagguggcuguggaa

SEQ ID NO: 2007086 - RNA, 16 nt, Human
cagugggagcugccug

SEQ ID NO: 2007087 - RNA, 11 nt, Human
cagugcccagg

SEQ ID NO: 2007088 - RNA, 13 nt, Human
cagugcccaggug

SEQ ID NO: 2007089 - RNA, 14 nt, Human
cagugcccaggugg

SEQ ID NO: 2007090 - RNA, 17 nt, Human
cagugggagcugccugu

SEQ ID NO: 2007091 - RNA, 18 nt, Human
cagugggagcugccuguu

SEQ ID NO: 2007092 - RNA, 21 nt, Human
cagugcccacaggaucagucu

SEQ ID NO: 2007093 - RNA, 18 nt, Human
cagugcccacaggaucag

SEQ ID NO: 2007094 - RNA, 22 nt, Human
cagugcccacaggaucagucug

SEQ ID NO: 2007095 - RNA, 22 nt, Human
cagugauuaccagggacugagg

SEQ ID NO: 2007096 - RNA, 23 nt, Human
cagucugauucccaagcucugcu

SEQ ID NO: 2007097 - RNA, 20 nt, Human
caguuacucagaauucucua

SEQ ID NO: 2007098 - RNA, 23 nt, Human
caguuacuuuccaauucuccuuu

SEQ ID NO: 2007099 - RNA, 14 nt, Human
caguuacuuuuccu

SEQ ID NO: 2007100 - RNA, 15 nt, Human
caguuacuuuuccuu

SEQ ID NO: 2007101 - RNA, 16 nt, Human
caguuacuuuuccuug

SEQ ID NO: 2007102 - RNA, 19 nt, Human
caguuacuuuuccuugcau

SEQ ID NO: 2007103 - RNA, 21 nt, Human
cagugguaugaucacggcuca

SEQ ID NO: 2007104 - RNA, 19 nt, Human
caguggugcgaucuggguu

SEQ ID NO: 2007105 - RNA, 17 nt, Human
caguuauuauauuuaca

SEQ ID NO: 2007106 - RNA, 21 nt, Human
caguuauuauauuuacaaaug

SEQ ID NO: 2007107 - RNA, 13 nt, Human
caguucaaaguca

SEQ ID NO: 2007108 - RNA, 15 nt, Human
caguucaaagucaug

SEQ ID NO: 2007109 - RNA, 22 nt, Human
caguucaaagucaugauguuuu

SEQ ID NO: 2007110 - RNA, 23 nt, Human
caguucaaagucaugauguuuuu

SEQ ID NO: 2007111 - RNA, 22 nt, Human
caguuauuauauuuacaaaugg

SEQ ID NO: 2007112 - RNA, 13 nt, Human
caguuaugugacc

SEQ ID NO: 2007113 - RNA, 16 nt, Human
caguuaugugaccuca

SEQ ID NO: 2007114 - RNA, 21 nt, Human
caguuaugugaccucacgugc

SEQ ID NO: 2007115 - RNA, 17 nt, Human
caguuauugucccuggc

SEQ ID NO: 2007116 - RNA, 20 nt, Human
caguuauugucccuggcuuc

SEQ ID NO: 2007117 - RNA, 23 nt, Human
caguuauugucccuggcuuccuu

SEQ ID NO: 2007118 - RNA, 14 nt, Human
caguucagcuuggg

SEQ ID NO: 2007119 - RNA, 15 nt, Human
caguucagcuugggg

SEQ ID NO: 2007120 - RNA, 23 nt, Human
caguuccaaucaguagcuuaaga

SEQ ID NO: 2007121 - RNA, 22 nt, Human
cauccucuguacagagcccacg

SEQ ID NO: 2007122 - RNA, 12 nt, Human
caucccagcccc

SEQ ID NO: 2007123 - RNA, 11 nt, Human
caucccagccc

SEQ ID NO: 2007124 - RNA, 16 nt, Human
caucccaccccauccu

SEQ ID NO: 2007125 - RNA, 19 nt, Human
caucccaccccauccucca

SEQ ID NO: 2007126 - RNA, 20 nt, Human
caucccaaacccuucagugc

SEQ ID NO: 2007127 - RNA, 21 nt, Human
caucagcacgauuucuguuua

SEQ ID NO: 2007128 - RNA, 18 nt, Human
caucagcccaaucccuga

SEQ ID NO: 2007129 - RNA, 20 nt, Human
caucagcccaaucccugauc

SEQ ID NO: 2007130 - RNA, 11 nt, Human
caucagaaaua

SEQ ID NO: 2007131 - RNA, 19 nt, Human
caucagaaauaauaaaaaa

SEQ ID NO: 2007132 - RNA, 12 nt, Human
caucagaacagc

SEQ ID NO: 2007133 - RNA, 14 nt, Human
caucagaacagcug

SEQ ID NO: 2007134 - RNA, 17 nt, Human
caucagaacagcuguug

SEQ ID NO: 2007135 - RNA, 19 nt, Human
caucccaaacccuucagug

SEQ ID NO: 2007136 - RNA, 15 nt, Human
caucagcugcucaga

SEQ ID NO: 2007137 - RNA, 19 nt, Human
caucagcugcucagauccc

SEQ ID NO: 2007138 - RNA, 16 nt, Human
caucagcugcucagau

SEQ ID NO: 2007139 - RNA, 18 nt, Human
caucagcugcucagaucc

SEQ ID NO: 2007140 - RNA, 18 nt, Human
cauccugaggcuccacuu

SEQ ID NO: 2007141 - RNA, 19 nt, Human
cauccugaggcuccacuug

SEQ ID NO: 2007142 - RNA, 22 nt, Human
caucguuuucuucacuguccuc

SEQ ID NO: 2007143 - RNA, 13 nt, Human
caucuaaaaauau

SEQ ID NO: 2007144 - RNA, 14 nt, Human
caucuaaaaauaua

SEQ ID NO: 2007145 - RNA, 17 nt, Human
caucuaaaaauauacau

SEQ ID NO: 2007146 - RNA, 18 nt, Human
caucuaaaaauauacaug

SEQ ID NO: 2007147 - RNA, 19 nt, Human
caucuaaaaauauacaugu

SEQ ID NO: 2007148 - RNA, 21 nt, Human
caucuaaaaauauacauguuu

SEQ ID NO: 2007149 - RNA, 23 nt, Human
caucuaaaaauauacauguuuau

SEQ ID NO: 2007150 - RNA, 15 nt, Human
caucuaaacugcccc

SEQ ID NO: 2007151 - RNA, 21 nt, Human
caucuaaacugcccccucugc

SEQ ID NO: 2007152 - RNA, 17 nt, Human
caucuguaccucugccu

SEQ ID NO: 2007153 - RNA, 15 nt, Human
caucugguuuucucu

SEQ ID NO: 2007154 - RNA, 14 nt, Human
caucugguuuucuc

SEQ ID NO: 2007155 - RNA, 19 nt, Human
caucugguuuucucuccag

SEQ ID NO: 2007156 - RNA, 15 nt, Human
caucuguaagcuguu

SEQ ID NO: 2007157 - RNA, 20 nt, Human
caucuggagagcccagaguc

SEQ ID NO: 2007158 - RNA, 15 nt, Human
caucuggaguucuca

SEQ ID NO: 2007159 - RNA, 16 nt, Human
caucuggaguucucaa

SEQ ID NO: 2007160 - RNA, 20 nt, Human
cauagcagcuuauucacaag

SEQ ID NO: 2007161 - RNA, 19 nt, Human
cauagcagcuuauucacaa

SEQ ID NO: 2007162 - RNA, 23 nt, Human
cauagcagagaaugaaagggccc

SEQ ID NO: 2007163 - RNA, 16 nt, Human
cauagguuuaauaauu

SEQ ID NO: 2007164 - RNA, 16 nt, Human
cauagguuagauauag

SEQ ID NO: 2007165 - RNA, 21 nt, Human
cauauuauuuuauguugcaua

SEQ ID NO: 2007166 - RNA, 23 nt, Human
cauauuauaucagacugcuuuga

SEQ ID NO: 2007167 - RNA, 19 nt, Human
cauauuagcgacaacagau

SEQ ID NO: 2007168 - RNA, 20 nt, Human
cauauuagcgacaacagauu

SEQ ID NO: 2007169 - RNA, 23 nt, Human
cauauuagcgacaacagauugga

SEQ ID NO: 2007170 - RNA, 14 nt, Human
cauauuauaucaga

SEQ ID NO: 2007171 - RNA, 16 nt, Human
cauauuauaucagacu

SEQ ID NO: 2007172 - RNA, 19 nt, Human
cauauuacuguacauggga

SEQ ID NO: 2007173 - RNA, 22 nt, Human
cauauuacuguacaugggacua

SEQ ID NO: 2007174 - RNA, 12 nt, Human
cauauuagaaaa

SEQ ID NO: 2007175 - RNA, 13 nt, Human
cauauuagaaaac

SEQ ID NO: 2007176 - RNA, 15 nt, Human
cauauuagaaaacuu

SEQ ID NO: 2007177 - RNA, 16 nt, Human
cauauuagaaaacuuu

SEQ ID NO: 2007178 - RNA, 17 nt, Human
cauauuagaaaacuuug

SEQ ID NO: 2007179 - RNA, 18 nt, Human
cauauuagaaaacuuugu

SEQ ID NO: 2007180 - RNA, 19 nt, Human
cauauuagaaaacuuuguu

SEQ ID NO: 2007181 - RNA, 20 nt, Human
cauauuagaaaacuuuguua

SEQ ID NO: 2007182 - RNA, 21 nt, Human
cauauuagaaaacuuuguuag

SEQ ID NO: 2007183 - RNA, 18 nt, Human
cauauuagacuucuguuu

SEQ ID NO: 2007184 - RNA, 21 nt, Human
cauauuagacuucuguuuuca

SEQ ID NO: 2007185 - RNA, 22 nt, Human
cauauuagacuucuguuuucaa

SEQ ID NO: 2007186 - RNA, 20 nt, Human
cauauuagaggggaaaagcu

SEQ ID NO: 2007187 - RNA, 22 nt, Human
cauauuaccacagacauacuaa

SEQ ID NO: 2007188 - RNA, 15 nt, Human
cauauguauacaugu

SEQ ID NO: 2007189 - RNA, 16 nt, Human
cauauguauacaugug

SEQ ID NO: 2007190 - RNA, 19 nt, Human
cauacagggaugguguuca

SEQ ID NO: 2007191 - RNA, 16 nt, Human
cauacaguuugcacuu

SEQ ID NO: 2007192 - RNA, 16 nt, Human
cauacagggauggugu

SEQ ID NO: 2007193 - RNA, 23 nt, Human
cauacaggaagguagaaauaucu

SEQ ID NO: 2007194 - RNA, 18 nt, Human
cauaauuauuauuuggcc

SEQ ID NO: 2007195 - RNA, 15 nt, Human
cauaauguucugcua

SEQ ID NO: 2007196 - RNA, 13 nt, Human
cauaauuaacacu

SEQ ID NO: 2007197 - RNA, 18 nt, Human
caguuuuauagcuuuauu

SEQ ID NO: 2007198 - RNA, 23 nt, Human
cauaaugcgugcauaccacuuuu

SEQ ID NO: 2007199 - RNA, 22 nt, Human
caguuguuagugugucuuagug

SEQ ID NO: 2007200 - RNA, 21 nt, Human
caguuguuaguuacuaccucc

SEQ ID NO: 2007201 - RNA, 14 nt, Human
caguuguuauuuau

SEQ ID NO: 2007202 - RNA, 19 nt, Human
caguuguuauuuauugaaa

SEQ ID NO: 2007203 - RNA, 18 nt, Human
caguuguuagugugucuu

SEQ ID NO: 2007204 - RNA, 21 nt, Human
caguuguuauuuauugaaaug

SEQ ID NO: 2007205 - RNA, 23 nt, Human
caguuuauuccagagcugccagu

SEQ ID NO: 2007206 - RNA, 12 nt, Human
caguuucaauaa

SEQ ID NO: 2007207 - RNA, 13 nt, Human
caguuuauguuuu

SEQ ID NO: 2007208 - RNA, 14 nt, Human
caguuuauguuuug

SEQ ID NO: 2007209 - RNA, 19 nt, Human
caguuuauguuuuggucca

SEQ ID NO: 2007210 - RNA, 14 nt, Human
caguuuauuccaga

SEQ ID NO: 2007211 - RNA, 18 nt, Human
caguuuauuccagagcug

SEQ ID NO: 2007212 - RNA, 22 nt, Human
caguuuauuccagagcugccag

SEQ ID NO: 2007213 - RNA, 21 nt, Human
caguuuguuaguaugaggcau

SEQ ID NO: 2007214 - RNA, 21 nt, Human
caguuugaggauuaguuuaga

SEQ ID NO: 2007215 - RNA, 23 nt, Human
caguuugaggauuaguuuagaac

SEQ ID NO: 2007216 - RNA, 23 nt, Human
caguuuguuaguaugaggcauuu

SEQ ID NO: 2007217 - RNA, 20 nt, Human
caguuucaauaaaguuugau

SEQ ID NO: 2007218 - RNA, 13 nt, Human
caguuucaauaaa

SEQ ID NO: 2007219 - RNA, 16 nt, Human
caguuucaauaaaguu

SEQ ID NO: 2007220 - RNA, 17 nt, Human
caguuucaauaaaguuu

SEQ ID NO: 2007221 - RNA, 18 nt, Human
caguuucaauaaaguuug

SEQ ID NO: 2007222 - RNA, 19 nt, Human
cagcaccaucucuccuccu

SEQ ID NO: 2007223 - RNA, 19 nt, Human
cagcaccacccuccuuccc

SEQ ID NO: 2007224 - RNA, 14 nt, Human
cagcaccacucaag

SEQ ID NO: 2007225 - RNA, 21 nt, Human
cagcaccacucaagaccaaau

SEQ ID NO: 2007226 - RNA, 22 nt, Human
cagcaccacucaagaccaaaug

SEQ ID NO: 2007227 - RNA, 19 nt, Human
cagauuucacucuccuugg

SEQ ID NO: 2007228 - RNA, 17 nt, Human
cagcaccaucucuccuc

SEQ ID NO: 2007229 - RNA, 19 nt, Human
cagauuugaacucuucaau

SEQ ID NO: 2007230 - RNA, 16 nt, Human
cagauuucucuuugaa

SEQ ID NO: 2007231 - RNA, 17 nt, Human
cagcaccacccuccuuc

SEQ ID NO: 2007232 - RNA, 20 nt, Human
cagauuucacucuccuuggu

SEQ ID NO: 2007233 - RNA, 13 nt, Human
cagauuuaugcau

SEQ ID NO: 2007234 - RNA, 19 nt, Human
cagauugcaacaggcuggg

SEQ ID NO: 2007235 - RNA, 20 nt, Human
cagauugcaacaggcugggc

SEQ ID NO: 2007236 - RNA, 18 nt, Human
cagauugcaacaggcugg

SEQ ID NO: 2007237 - RNA, 18 nt, Human
cagccaggccacuggccc

SEQ ID NO: 2007238 - RNA, 14 nt, Human
cagcacgauuucug

SEQ ID NO: 2007239 - RNA, 15 nt, Human
cagcacgauuucugu

SEQ ID NO: 2007240 - RNA, 17 nt, Human
cagcacguguggccugu

SEQ ID NO: 2007241 - RNA, 18 nt, Human
cagcacgggggccaagga

SEQ ID NO: 2007242 - RNA, 12 nt, Human
cagagagggugg

SEQ ID NO: 2007243 - RNA, 16 nt, Human
cagagaggcugugguu

SEQ ID NO: 2007244 - RNA, 22 nt, Human
cagagagaagagccccacucuc

SEQ ID NO: 2007245 - RNA, 23 nt, Human
cagagagaagagccccacucuca

SEQ ID NO: 2007246 - RNA, 13 nt, Human
cagagaggguggg

SEQ ID NO: 2007247 - RNA, 17 nt, Human
cagagaggguggugacc

SEQ ID NO: 2007248 - RNA, 20 nt, Human
cagagaggguggugaccucu

SEQ ID NO: 2007249 - RNA, 22 nt, Human
cagagaggguggugaccucugc

SEQ ID NO: 2007250 - RNA, 21 nt, Human
cagagacugucccugaaaccu

SEQ ID NO: 2007251 - RNA, 15 nt, Human
cagagagaagagccc

SEQ ID NO: 2007252 - RNA, 16 nt, Human
cagagagaagagcccc

SEQ ID NO: 2007253 - RNA, 17 nt, Human
cagagagaagagcccca

SEQ ID NO: 2007254 - RNA, 18 nt, Human
cagagagaagagccccac

SEQ ID NO: 2007255 - RNA, 19 nt, Human
cagagagaagagccccacu

SEQ ID NO: 2007256 - RNA, 21 nt, Human
cagagagaagagccccacucu

SEQ ID NO: 2007257 - RNA, 13 nt, Human
cagagcugccacc

SEQ ID NO: 2007258 - RNA, 12 nt, Human
cagagcugaaga

SEQ ID NO: 2007259 - RNA, 20 nt, Human
cagagagguuaaggugggua

SEQ ID NO: 2007260 - RNA, 23 nt, Human
cagagagggugggagugggccca

SEQ ID NO: 2007261 - RNA, 23 nt, Human
cagagaggguggugaccucugcc

SEQ ID NO: 2007262 - RNA, 19 nt, Human
cagaggaaagcaaaggaga

SEQ ID NO: 2007263 - RNA, 17 nt, Human
cagaggaaagcaaagga

SEQ ID NO: 2007264 - RNA, 13 nt, Human
cagaggggguggc

SEQ ID NO: 2007265 - RNA, 20 nt, Human
cagaggaaagcaaaggagau

SEQ ID NO: 2007266 - RNA, 19 nt, Human
cagauacuuggggggcuga

SEQ ID NO: 2007267 - RNA, 16 nt, Human
cagaggggguggccuc

SEQ ID NO: 2007268 - RNA, 14 nt, Human
cagaggggguggcc

SEQ ID NO: 2007269 - RNA, 19 nt, Human
cagauagauauaugcucug

SEQ ID NO: 2007270 - RNA, 14 nt, Human
cagauaugauucaa

SEQ ID NO: 2007271 - RNA, 20 nt, Human
cagaucccacuuuugccaga

SEQ ID NO: 2007272 - RNA, 22 nt, Human
cagaucccagcuucggcauuug

SEQ ID NO: 2007273 - RNA, 14 nt, Human
cagauccccaagcc

SEQ ID NO: 2007274 - RNA, 14 nt, Human
cagacagcugccug

SEQ ID NO: 2007275 - RNA, 13 nt, Human
cagacagcugccu

SEQ ID NO: 2007276 - RNA, 14 nt, Human
cagacagcccucca

SEQ ID NO: 2007277 - RNA, 18 nt, Human
cagacagcugccugggau

SEQ ID NO: 2007278 - RNA, 17 nt, Human
cagacagcugccuggga

SEQ ID NO: 2007279 - RNA, 16 nt, Human
cagacagcugccuggg

SEQ ID NO: 2007280 - RNA, 15 nt, Human
cagacagcugccugg

SEQ ID NO: 2007281 - RNA, 16 nt, Human
cagacaggaccaggga

SEQ ID NO: 2007282 - RNA, 15 nt, Human
cagacaggaccaggg

SEQ ID NO: 2007283 - RNA, 13 nt, Human
cagacaggaccag

SEQ ID NO: 2007284 - RNA, 24 nt, Human
cagacaggaccagggauuuccaug

SEQ ID NO: 2007285 - RNA, 17 nt, Human
cagacaggaccagggau

SEQ ID NO: 2007286 - RNA, 11 nt, Human
cagacaggcaa

SEQ ID NO: 2007287 - RNA, 15 nt, Human
cagacaggaccccug

SEQ ID NO: 2007288 - RNA, 16 nt, Human
cagacaggaccccugc

SEQ ID NO: 2007289 - RNA, 18 nt, Human
cagacaggaccccugcag

SEQ ID NO: 2007290 - RNA, 23 nt, Human
cagacaggaccccugcaguuccc

SEQ ID NO: 2007291 - RNA, 13 nt, Human
cagacaggcaagc

SEQ ID NO: 2007292 - RNA, 18 nt, Human
cagacaggcaagcaccuc

SEQ ID NO: 2007293 - RNA, 20 nt, Human
cagacaggcaagcaccuccu

SEQ ID NO: 2007294 - RNA, 21 nt, Human
cagacaggcaagcaccuccug

SEQ ID NO: 2007295 - RNA, 20 nt, Human
cagacuggaagcacagcuuc

SEQ ID NO: 2007296 - RNA, 21 nt, Human
cagacuggaagcacagcuuca

SEQ ID NO: 2007297 - RNA, 14 nt, Human
cagacuggaagcac

SEQ ID NO: 2007298 - RNA, 16 nt, Human
cagacuggaagcacag

SEQ ID NO: 2007299 - RNA, 17 nt, Human
cagacuggaagcacagc

SEQ ID NO: 2007300 - RNA, 18 nt, Human
cagacuggaagcacagcu

SEQ ID NO: 2007301 - RNA, 13 nt, Human
cagacuggaagca

SEQ ID NO: 2007302 - RNA, 23 nt, Human
cagacucuacagaggccaugggc

SEQ ID NO: 2007303 - RNA, 18 nt, Human
cagacucuacagaggcca

SEQ ID NO: 2007304 - RNA, 19 nt, Human
cagacucuacagaggccau

SEQ ID NO: 2007305 - RNA, 20 nt, Human
cagacucuacagaggccaug

SEQ ID NO: 2007306 - RNA, 21 nt, Human
cagacucuacagaggccaugg

SEQ ID NO: 2007307 - RNA, 18 nt, Human
cagacagggggccagaac

SEQ ID NO: 2007308 - RNA, 22 nt, Human
cagacaggcaagcaccuccugc

SEQ ID NO: 2007309 - RNA, 23 nt, Human
cagacaggcaagcaccuccugcc

SEQ ID NO: 2007310 - RNA, 17 nt, Human
cagacucuacagaggcc

SEQ ID NO: 2007311 - RNA, 20 nt, Human
cagacagucacaaauuucuc

SEQ ID NO: 2007312 - RNA, 17 nt, Human
cagacagucacaaauuu

SEQ ID NO: 2007313 - RNA, 15 nt, Human
cagcguuuugcaagg

SEQ ID NO: 2007314 - RNA, 19 nt, Human
cagcguuuugcaagguaaa

SEQ ID NO: 2007315 - RNA, 15 nt, Human
cagcuaacauggaag

SEQ ID NO: 2007316 - RNA, 16 nt, Human
cagccugcuccagcug

SEQ ID NO: 2007317 - RNA, 23 nt, Human
cagcgcggacauccccugcuggc

SEQ ID NO: 2007318 - RNA, 20 nt, Human
cagcgcggacauccccugcu

SEQ ID NO: 2007319 - RNA, 22 nt, Human
cagcgcggacauccccugcugg

SEQ ID NO: 2007320 - RNA, 18 nt, Human
cagcgcucuggugcugca

SEQ ID NO: 2007321 - RNA, 12 nt, Human
cagcgcugacgu

SEQ ID NO: 2007322 - RNA, 19 nt, Human
cagccugcuccagcuguuc

SEQ ID NO: 2007323 - RNA, 17 nt, Human
cagccugcuccagcugu

SEQ ID NO: 2007324 - RNA, 16 nt, Human
cagcugagccuucuga

SEQ ID NO: 2007325 - RNA, 17 nt, Human
cagcugagccuucugag

SEQ ID NO: 2007326 - RNA, 18 nt, Human
cagcugagccuucugagc

SEQ ID NO: 2007327 - RNA, 23 nt, Human
cagcugccuaggauucacacccc

SEQ ID NO: 2007328 - RNA, 21 nt, Human
cagcugacuuuucuguccgag

SEQ ID NO: 2007329 - RNA, 14 nt, Human
cagcugagaggcug

SEQ ID NO: 2007330 - RNA, 15 nt, Human
cagcugagccuucug

SEQ ID NO: 2007331 - RNA, 17 nt, Human
caggaaaggcuccagga

SEQ ID NO: 2007332 - RNA, 16 nt, Human
caggaaaggcuccagg

SEQ ID NO: 2007333 - RNA, 20 nt, Human
caggaaaggcuccaggagca

SEQ ID NO: 2007334 - RNA, 19 nt, Human
caggaaaggcuccaggagc

SEQ ID NO: 2007335 - RNA, 16 nt, Human
cagcugucaaggcuca

SEQ ID NO: 2007336 - RNA, 14 nt, Human
cagcuucacuucug

SEQ ID NO: 2007337 - RNA, 15 nt, Human
cagcuucacuucuga

SEQ ID NO: 2007338 - RNA, 16 nt, Human
cagcuucacuucugac

SEQ ID NO: 2007339 - RNA, 16 nt, Human
caggaaagaagcauuu

SEQ ID NO: 2007340 - RNA, 23 nt, Human
caggcuaauguuggcagaugcag

SEQ ID NO: 2007341 - RNA, 21 nt, Human
caggcugggagagccuuccag

SEQ ID NO: 2007342 - RNA, 22 nt, Human
caggccuuaucuccaagaccag

SEQ ID NO: 2007343 - RNA, 17 nt, Human
caggccuuaucuccaag

SEQ ID NO: 2007344 - RNA, 16 nt, Human
caggccuuaucuccaa

SEQ ID NO: 2007345 - RNA, 21 nt, Human
caggcgugagccaccgugccu

SEQ ID NO: 2007346 - RNA, 14 nt, Human
caggccuccuacag

SEQ ID NO: 2007347 - RNA, 19 nt, Human
caggccuacuccugucuuc

SEQ ID NO: 2007348 - RNA, 15 nt, Human
caggccuguccaaca

SEQ ID NO: 2007349 - RNA, 12 nt, Human
caggccuccuac

SEQ ID NO: 2007350 - RNA, 15 nt, Human
caggccuacuccugu

SEQ ID NO: 2007351 - RNA, 16 nt, Human
caggccuacuccuguc

SEQ ID NO: 2007352 - RNA, 17 nt, Human
caggccuacuccugucu

SEQ ID NO: 2007353 - RNA, 18 nt, Human
caggccuacuccugucuu

SEQ ID NO: 2007354 - RNA, 17 nt, Human
caggccgggcagagcac

SEQ ID NO: 2007355 - RNA, 13 nt, Human
caggccgggcaga

SEQ ID NO: 2007356 - RNA, 14 nt, Human
caggccgggcagag

SEQ ID NO: 2007357 - RNA, 16 nt, Human
caggggaaaagaggag

SEQ ID NO: 2007358 - RNA, 14 nt, Human
caggggaaaagagg

SEQ ID NO: 2007359 - RNA, 17 nt, Human
caggggaaaaucagccu

SEQ ID NO: 2007360 - RNA, 13 nt, Human
cagggcuuuaaaa

SEQ ID NO: 2007361 - RNA, 14 nt, Human
cagggcuuuaaaau

SEQ ID NO: 2007362 - RNA, 15 nt, Human
cagggcuuuaaaauu

SEQ ID NO: 2007363 - RNA, 14 nt, Human
cagggagcagggaa

SEQ ID NO: 2007364 - RNA, 16 nt, Human
cagggagcagggaagg

SEQ ID NO: 2007365 - RNA, 18 nt, Human
cagggagcagggaaggcc

SEQ ID NO: 2007366 - RNA, 20 nt, Human
cagggagcagggaaggccug

SEQ ID NO: 2007367 - RNA, 21 nt, Human
cagggagcagggaaggccuga

SEQ ID NO: 2007368 - RNA, 23 nt, Human
caggcugggagagccuuccaggg

SEQ ID NO: 2007369 - RNA, 22 nt, Human
caggcugggagagccuuccagg

SEQ ID NO: 2007370 - RNA, 14 nt, Human
caggccaggccagc

SEQ ID NO: 2007371 - RNA, 12 nt, Human
caggccaggccc

SEQ ID NO: 2007372 - RNA, 11 nt, Human
caggccaggcc

SEQ ID NO: 2007373 - RNA, 23 nt, Human
caggaggcugggacgcucugcug

SEQ ID NO: 2007374 - RNA, 21 nt, Human
caggaggcugggacgcucugc

SEQ ID NO: 2007375 - RNA, 22 nt, Human
caggaggcugggacgcucugcu

SEQ ID NO: 2007376 - RNA, 14 nt, Human
caggcaaugcuggc

SEQ ID NO: 2007377 - RNA, 15 nt, Human
caggcaaugcuggcu

SEQ ID NO: 2007378 - RNA, 16 nt, Human
caggcaaugcuggcug

SEQ ID NO: 2007379 - RNA, 17 nt, Human
caggcaaugcuggcugu

SEQ ID NO: 2007380 - RNA, 19 nt, Human
caggaggaucacuugaguc

SEQ ID NO: 2007381 - RNA, 19 nt, Human
caggaggccagccuugacc

SEQ ID NO: 2007382 - RNA, 18 nt, Human
caggaggccagccuugac

SEQ ID NO: 2007383 - RNA, 22 nt, Human
caggaggccagccuugaccauu

SEQ ID NO: 2007384 - RNA, 17 nt, Human
caggaccagcccacgcu

SEQ ID NO: 2007385 - RNA, 21 nt, Human
caggaccagcccacgcugacu

SEQ ID NO: 2007386 - RNA, 19 nt, Human
caggaccaggguuggcacc

SEQ ID NO: 2007387 - RNA, 22 nt, Human
caggaccaggguuggcaccuuc

SEQ ID NO: 2007388 - RNA, 23 nt, Human
caggaccaggguuggcaccuucc

SEQ ID NO: 2007389 - RNA, 23 nt, Human
caggaccucaggugagaagcaga

SEQ ID NO: 2007390 - RNA, 16 nt, Human
caggaccucaggugag

SEQ ID NO: 2007391 - RNA, 13 nt, Human
caggaccagccca

SEQ ID NO: 2007392 - RNA, 14 nt, Human
caggaccagcccac

SEQ ID NO: 2007393 - RNA, 15 nt, Human
caggaccagcccacg

SEQ ID NO: 2007394 - RNA, 16 nt, Human
caggaccagcccacgc

SEQ ID NO: 2007395 - RNA, 22 nt, Human
auugagcugcuuuuuuugaaac

SEQ ID NO: 2007396 - RNA, 15 nt, Human
auugaggaaaaauau

SEQ ID NO: 2007397 - RNA, 17 nt, Human
auugaggaaaaauaugu

SEQ ID NO: 2007398 - RNA, 20 nt, Human
auugaggaaaaauaugugaa

SEQ ID NO: 2007399 - RNA, 21 nt, Human
auugaggaaaaauaugugaag

SEQ ID NO: 2007400 - RNA, 15 nt, Human
auucucuuauccaac

SEQ ID NO: 2007401 - RNA, 21 nt, Human
auucucuccauuucacuggcu

SEQ ID NO: 2007402 - RNA, 15 nt, Human
auucucuugccucag

SEQ ID NO: 2007403 - RNA, 17 nt, Human
auucucuugccucagcu

SEQ ID NO: 2007404 - RNA, 15 nt, Human
auucuuguuuugcuu

SEQ ID NO: 2007405 - RNA, 16 nt, Human
auucuuguuuugcuuc

SEQ ID NO: 2007406 - RNA, 15 nt, Human
auucuuuaaugauuc

SEQ ID NO: 2007407 - RNA, 19 nt, Human
auucuuuaaugauuccuau

SEQ ID NO: 2007408 - RNA, 15 nt, Human
auucuuuagagaaga

SEQ ID NO: 2007409 - RNA, 15 nt, Human
auucgggccccaccu

SEQ ID NO: 2007410 - RNA, 21 nt, Human
auucgcuacuaugauuuaauu

SEQ ID NO: 2007411 - RNA, 20 nt, Human
auuccuuuuuauuuauaugu

SEQ ID NO: 2007412 - RNA, 21 nt, Human
auuccuuuuuauuuauaugua

SEQ ID NO: 2007413 - RNA, 15 nt, Human
auuccuuuuuauuua

SEQ ID NO: 2007414 - RNA, 16 nt, Human
auuccuuuuuauuuau

SEQ ID NO: 2007415 - RNA, 18 nt, Human
auuccuuuuuauuuauau

SEQ ID NO: 2007416 - RNA, 15 nt, Human
auucauucuuuuuga

SEQ ID NO: 2007417 - RNA, 16 nt, Human
auucauucuuuuugaa

SEQ ID NO: 2007418 - RNA, 21 nt, Human
auucauucuuuuugaaauguc

SEQ ID NO: 2007419 - RNA, 14 nt, Human
auucucuuauccaa

SEQ ID NO: 2007420 - RNA, 12 nt, Human
auucucuuaucc

SEQ ID NO: 2007421 - RNA, 23 nt, Human
auucucuaguuugauuaaauucu

SEQ ID NO: 2007422 - RNA, 17 nt, Human
auucgggccccaccugc

SEQ ID NO: 2007423 - RNA, 16 nt, Human
auucguacauaauacu

SEQ ID NO: 2007424 - RNA, 18 nt, Human
auucguacauaauacuga

SEQ ID NO: 2007425 - RNA, 22 nt, Human
auucguacauaauacugaacca

SEQ ID NO: 2007426 - RNA, 23 nt, Human
auucguacauaauacugaaccac

SEQ ID NO: 2007427 - RNA, 20 nt, Human
auucucuaguuugauuaaau

SEQ ID NO: 2007428 - RNA, 16 nt, Human
auuagaggggaaaagc

SEQ ID NO: 2007429 - RNA, 23 nt, Human
auuaugugccagauuuaugcaua

SEQ ID NO: 2007430 - RNA, 21 nt, Human
auuaugugccagauuuaugca

SEQ ID NO: 2007431 - RNA, 13 nt, Human
auuaugugccaga

SEQ ID NO: 2007432 - RNA, 23 nt, Human
auucauauauuuuaugaaucaga

SEQ ID NO: 2007433 - RNA, 20 nt, Human
auucauauuacaauauuugu

SEQ ID NO: 2007434 - RNA, 15 nt, Human
auucauauuacaaua

SEQ ID NO: 2007435 - RNA, 17 nt, Human
auucauauuacaauauu

SEQ ID NO: 2007436 - RNA, 18 nt, Human
auucauauuacaauauuu

SEQ ID NO: 2007437 - RNA, 19 nt, Human
auucauauuacaauauuug

SEQ ID NO: 2007438 - RNA, 14 nt, Human
auucauauuacaau

SEQ ID NO: 2007439 - RNA, 13 nt, Human
auucauauuacaa

SEQ ID NO: 2007440 - RNA, 16 nt, Human
auucauaguagaacuu

SEQ ID NO: 2007441 - RNA, 17 nt, Human
auucauggccuggggga

SEQ ID NO: 2007442 - RNA, 14 nt, Human
auucauauuuacuu

SEQ ID NO: 2007443 - RNA, 14 nt, Human
auucauuaguuuug

SEQ ID NO: 2007444 - RNA, 15 nt, Human
auucauuaguuuuga

SEQ ID NO: 2007445 - RNA, 19 nt, Human
auuaacacuacucaaagca

SEQ ID NO: 2007446 - RNA, 21 nt, Human
auuaacacuacucaaagcaaa

SEQ ID NO: 2007447 - RNA, 21 nt, Human
auuaacaugaauauuuagugu

SEQ ID NO: 2007448 - RNA, 22 nt, Human
auuaaauuuuuuuguaugaaaa

SEQ ID NO: 2007449 - RNA, 23 nt, Human
auuaaauuuuuuuguaugaaaac

SEQ ID NO: 2007450 - RNA, 15 nt, Human
auuaaauuuuuuugu

SEQ ID NO: 2007451 - RNA, 16 nt, Human
auuaaauuuuuuugua

SEQ ID NO: 2007452 - RNA, 17 nt, Human
auuaaauuuuuuuguau

SEQ ID NO: 2007453 - RNA, 18 nt, Human
auuaaauuuuuuuguaug

SEQ ID NO: 2007454 - RNA, 19 nt, Human
auuaaauuuuuuuguauga

SEQ ID NO: 2007455 - RNA, 20 nt, Human
auuaaauuuuuuuguaugaa

SEQ ID NO: 2007456 - RNA, 21 nt, Human
auuaaauuuuuuuguaugaaa

SEQ ID NO: 2007457 - RNA, 13 nt, Human
auuacagguguga

SEQ ID NO: 2007458 - RNA, 17 nt, Human
auuacaggcuccugcca

SEQ ID NO: 2007459 - RNA, 19 nt, Human
auuacaggcuccugccacc

SEQ ID NO: 2007460 - RNA, 15 nt, Human
auuacaggcuccugc

SEQ ID NO: 2007461 - RNA, 16 nt, Human
auuacaggcuccugcc

SEQ ID NO: 2007462 - RNA, 22 nt, Human
auuacaagcgugagccacugca

SEQ ID NO: 2007463 - RNA, 14 nt, Human
auuacaauauuucu

SEQ ID NO: 2007464 - RNA, 13 nt, Human
auuacaauauuug

SEQ ID NO: 2007465 - RNA, 14 nt, Human
auuacaauauuugu

SEQ ID NO: 2007466 - RNA, 15 nt, Human
auuaauggaaauguu

SEQ ID NO: 2007467 - RNA, 12 nt, Human
auuaaugcuuug

SEQ ID NO: 2007468 - RNA, 13 nt, Human
auuaaugcuuugg

SEQ ID NO: 2007469 - RNA, 21 nt, Human
auuaauguauccaaugaaaua

SEQ ID NO: 2007470 - RNA, 11 nt, Human
auuaauugugu

SEQ ID NO: 2007471 - RNA, 14 nt, Human
auuaauugugugaa

SEQ ID NO: 2007472 - RNA, 16 nt, Human
auuaauugugugaacu

SEQ ID NO: 2007473 - RNA, 18 nt, Human
auuaauugugugaacuug

SEQ ID NO: 2007474 - RNA, 20 nt, Human
auuaauugugugaacuugga

SEQ ID NO: 2007475 - RNA, 21 nt, Human
auuaauugugugaacuuggaa

SEQ ID NO: 2007476 - RNA, 19 nt, Human
caaacaugagguucucucu

SEQ ID NO: 2007477 - RNA, 16 nt, Human
caaaccaucauugaaa

SEQ ID NO: 2007478 - RNA, 14 nt, Human
caaaccaucauuga

SEQ ID NO: 2007479 - RNA, 17 nt, Human
caaaccaucauugaaau

SEQ ID NO: 2007480 - RNA, 15 nt, Human
auuuuuaugugugau

SEQ ID NO: 2007481 - RNA, 15 nt, Human
auuuuuaucaggauu

SEQ ID NO: 2007482 - RNA, 22 nt, Human
auuuuguuuuugucuuaaaaag

SEQ ID NO: 2007483 - RNA, 16 nt, Human
auuuuuuucugaaauu

SEQ ID NO: 2007484 - RNA, 17 nt, Human
auuuuuuucugaaauuu

SEQ ID NO: 2007485 - RNA, 12 nt, Human
auuuuuuuccuu

SEQ ID NO: 2007486 - RNA, 15 nt, Human
auuuuuuuccuuaca

SEQ ID NO: 2007487 - RNA, 19 nt, Human
auuuuuuuccuuacauaaa

SEQ ID NO: 2007488 - RNA, 21 nt, Human
auuuuuuuccuuacauaaaca

SEQ ID NO: 2007489 - RNA, 15 nt, Human
auuuuuuucugaauu

SEQ ID NO: 2007490 - RNA, 22 nt, Human
auuuuuuuccuuacauaaacau

SEQ ID NO: 2007491 - RNA, 16 nt, Human
auuuuuauuaaauuau

SEQ ID NO: 2007492 - RNA, 13 nt, Human
auuuuuauuauua

SEQ ID NO: 2007493 - RNA, 17 nt, Human
auuuuuuuuaauuguau

SEQ ID NO: 2007494 - RNA, 18 nt, Human
auuuuuuuuaauuguauu

SEQ ID NO: 2007495 - RNA, 20 nt, Human
auuuuuuuuaauuguauuuu

SEQ ID NO: 2007496 - RNA, 22 nt, Human
auuuuuuuuaauuguauuuuug

SEQ ID NO: 2007497 - RNA, 22 nt, Human
auuuuuuuucaugcuuuaucaa

SEQ ID NO: 2007498 - RNA, 23 nt, Human
auuuuuuuucccauuuagaaugg

SEQ ID NO: 2007499 - RNA, 21 nt, Human
caaaagguauuuuaaucacca

SEQ ID NO: 2007500 - RNA, 19 nt, Human
caaaagcaucuaugugaga

SEQ ID NO: 2007501 - RNA, 13 nt, Human
caaaagcauguga

SEQ ID NO: 2007502 - RNA, 20 nt, Human
caaaagguuaauaaaguaau

SEQ ID NO: 2007503 - RNA, 14 nt, Human
auuuguguugaaga

SEQ ID NO: 2007504 - RNA, 15 nt, Human
auuuguguugaagag

SEQ ID NO: 2007505 - RNA, 21 nt, Human
auuuguguggagucauuucug

SEQ ID NO: 2007506 - RNA, 23 nt, Human
auuuguguggagucauuucugau

SEQ ID NO: 2007507 - RNA, 13 nt, Human
auuuguguguuac

SEQ ID NO: 2007508 - RNA, 17 nt, Human
auuuguguguuacaaug

SEQ ID NO: 2007509 - RNA, 20 nt, Human
auuugugugcuaaacgugua

SEQ ID NO: 2007510 - RNA, 20 nt, Human
auuuguguggagucauuucu

SEQ ID NO: 2007511 - RNA, 18 nt, Human
auuuguguugaagagguu

SEQ ID NO: 2007512 - RNA, 22 nt, Human
auuuguguugaagagguuuuaa

SEQ ID NO: 2007513 - RNA, 22 nt, Human
auuuguguguucacuaaacucu

SEQ ID NO: 2007514 - RNA, 18 nt, Human
auuuguguguucacuaaa

SEQ ID NO: 2007515 - RNA, 14 nt, Human
auuuguuauaauga

SEQ ID NO: 2007516 - RNA, 19 nt, Human
auuuguucuauagcuuuuc

SEQ ID NO: 2007517 - RNA, 20 nt, Human
auuuuaguggacccugaaau

SEQ ID NO: 2007518 - RNA, 21 nt, Human
auuuuaguggacccugaaaug

SEQ ID NO: 2007519 - RNA, 22 nt, Human
auuuuaguggacccugaaaugu

SEQ ID NO: 2007520 - RNA, 23 nt, Human
auuuuaguggacccugaaaugug

SEQ ID NO: 2007521 - RNA, 15 nt, Human
auuuugaaaaacugc

SEQ ID NO: 2007522 - RNA, 13 nt, Human
auuuugaaaaacu

SEQ ID NO: 2007523 - RNA, 14 nt, Human
auuuucucuuagaa

SEQ ID NO: 2007524 - RNA, 16 nt, Human
auuuucucuuagaaaa

SEQ ID NO: 2007525 - RNA, 13 nt, Human
auuuucucuuaga

SEQ ID NO: 2007526 - RNA, 22 nt, Human
auuuuaguuuugugcuuaguua

SEQ ID NO: 2007527 - RNA, 17 nt, Human
auuuucucugauacuuu

SEQ ID NO: 2007528 - RNA, 18 nt, Human
auuuucucugauacuuuu

SEQ ID NO: 2007529 - RNA, 19 nt, Human
auuuucucugauacuuuuu

SEQ ID NO: 2007530 - RNA, 17 nt, Human
auuuucuauaauuuaaa

SEQ ID NO: 2007531 - RNA, 18 nt, Human
auuuucuauaauuuaaau

SEQ ID NO: 2007532 - RNA, 22 nt, Human
auuuuaguuuuauuuucuaaag

SEQ ID NO: 2007533 - RNA, 14 nt, Human
auuuuaguuuuauu

SEQ ID NO: 2007534 - RNA, 20 nt, Human
auuuuaguuuuauuuucuaa

SEQ ID NO: 2007535 - RNA, 21 nt, Human
auuuuaguuuuauuuucuaaa

SEQ ID NO: 2007536 - RNA, 19 nt, Human
auuuucuauaauuuaaaua

SEQ ID NO: 2007537 - RNA, 14 nt, Human
auuuugaaaaguaa

SEQ ID NO: 2007538 - RNA, 16 nt, Human
auuuugaaaaguaaua

SEQ ID NO: 2007539 - RNA, 17 nt, Human
auuuugaaaaguaauau

SEQ ID NO: 2007540 - RNA, 21 nt, Human
auuuugaaaaguaauauuuau

SEQ ID NO: 2007541 - RNA, 12 nt, Human
auuuugaaaagu

SEQ ID NO: 2007542 - RNA, 13 nt, Human
auuucacaaauau

SEQ ID NO: 2007543 - RNA, 10 nt, Human
auuucacaag

SEQ ID NO: 2007544 - RNA, 15 nt, Human
auuucacaagcuauu

SEQ ID NO: 2007545 - RNA, 17 nt, Human
auuucacaguguguggu

SEQ ID NO: 2007546 - RNA, 14 nt, Human
auuucacaaauauu

SEQ ID NO: 2007547 - RNA, 15 nt, Human
auuucacaaauauua

SEQ ID NO: 2007548 - RNA, 18 nt, Human
auuucacaaauauuaaaa

SEQ ID NO: 2007549 - RNA, 20 nt, Human
auuucacaaauauuaaaaag

SEQ ID NO: 2007550 - RNA, 23 nt, Human
auuucacaaauauuaaaaagucu

SEQ ID NO: 2007551 - RNA, 14 nt, Human
auuucacucuccuu

SEQ ID NO: 2007552 - RNA, 16 nt, Human
auuucagcagcugcag

SEQ ID NO: 2007553 - RNA, 18 nt, Human
auuucacgucauaggaag

SEQ ID NO: 2007554 - RNA, 19 nt, Human
auuucacgucauaggaagu

SEQ ID NO: 2007555 - RNA, 12 nt, Human
auuucacucucc

SEQ ID NO: 2007556 - RNA, 18 nt, Human
auuuaauuugaaauaugg

SEQ ID NO: 2007557 - RNA, 13 nt, Human
auuuaauuugaag

SEQ ID NO: 2007558 - RNA, 15 nt, Human
auuuaauuugaaggu

SEQ ID NO: 2007559 - RNA, 22 nt, Human
auuuaauuugaagguagaaugu

SEQ ID NO: 2007560 - RNA, 22 nt, Human
auuuaauagguuuggacaaaau

SEQ ID NO: 2007561 - RNA, 12 nt, Human
auuuaaguuuug

SEQ ID NO: 2007562 - RNA, 20 nt, Human
auuuaaguuuugacaagcug

SEQ ID NO: 2007563 - RNA, 20 nt, Human
auuuaaggucuguuugcugu

SEQ ID NO: 2007564 - RNA, 22 nt, Human
auuuaaggucuguuugcuguug

SEQ ID NO: 2007565 - RNA, 15 nt, Human
auuuaagccuaaaga

SEQ ID NO: 2007566 - RNA, 16 nt, Human
auuuaagccuaaagau

SEQ ID NO: 2007567 - RNA, 17 nt, Human
auuuaagccuaaagauu

SEQ ID NO: 2007568 - RNA, 22 nt, Human
auuuaagccuaaagauuuugau

SEQ ID NO: 2007569 - RNA, 13 nt, Human
auuucucuuugaa

SEQ ID NO: 2007570 - RNA, 16 nt, Human
auuucucuuugaaaca

SEQ ID NO: 2007571 - RNA, 20 nt, Human
auuucuguuuagauaauaca

SEQ ID NO: 2007572 - RNA, 19 nt, Human
auuucuguuuagauaauac

SEQ ID NO: 2007573 - RNA, 19 nt, Human
auuucaguaaaccugucug

SEQ ID NO: 2007574 - RNA, 20 nt, Human
auuucaguaaaccugucuga

SEQ ID NO: 2007575 - RNA, 21 nt, Human
auuucaguaagaucaagcucc

SEQ ID NO: 2007576 - RNA, 12 nt, Human
auuucuccuuuu

SEQ ID NO: 2007577 - RNA, 17 nt, Human
auuucuccuuuuguguu

SEQ ID NO: 2007578 - RNA, 20 nt, Human
auuucuccuuuuguguucca

SEQ ID NO: 2007579 - RNA, 15 nt, Human
auuucucuguuccau

SEQ ID NO: 2007580 - RNA, 23 nt, Human
auuucucuguuccauaguuaaag

SEQ ID NO: 2007581 - RNA, 15 nt, Human
auuucucuuaaguac

SEQ ID NO: 2007582 - RNA, 21 nt, Human
auuucuguuuagauaauacac

SEQ ID NO: 2007583 - RNA, 18 nt, Human
auuugcacaaaaagauac

SEQ ID NO: 2007584 - RNA, 17 nt, Human
caagaaggaugauucaa

SEQ ID NO: 2007585 - RNA, 18 nt, Human
caagaagcccaggaaagg

SEQ ID NO: 2007586 - RNA, 18 nt, Human
caagaauagaugcugacu

SEQ ID NO: 2007587 - RNA, 19 nt, Human
caagaauagcauuguaaaa

SEQ ID NO: 2007588 - RNA, 13 nt, Human
caagaaugaaggu

SEQ ID NO: 2007589 - RNA, 21 nt, Human
caagaaugaagguuuuuguaa

SEQ ID NO: 2007590 - RNA, 15 nt, Human
caagaagcccaggaa

SEQ ID NO: 2007591 - RNA, 21 nt, Human
caacucccugccccccagccc

SEQ ID NO: 2007592 - RNA, 19 nt, Human
caacucccugccccccagc

SEQ ID NO: 2007593 - RNA, 20 nt, Human
caacucccugccccccagcc

SEQ ID NO: 2007594 - RNA, 14 nt, Human
caacuauggccugu

SEQ ID NO: 2007595 - RNA, 14 nt, Human
caacccccagccug

SEQ ID NO: 2007596 - RNA, 13 nt, Human
caacuauggccug

SEQ ID NO: 2007597 - RNA, 17 nt, Human
caaccccuucgcuccug

SEQ ID NO: 2007598 - RNA, 14 nt, Human
caaccccuucgcuc

SEQ ID NO: 2007599 - RNA, 16 nt, Human
caaccccuucgcuccu

SEQ ID NO: 2007600 - RNA, 14 nt, Human
caagcaccuccugc

SEQ ID NO: 2007601 - RNA, 18 nt, Human
caagcaccuagccucgcu

SEQ ID NO: 2007602 - RNA, 13 nt, Human
caagcaccauccc

SEQ ID NO: 2007603 - RNA, 17 nt, Human
caagcaccauccccucc

SEQ ID NO: 2007604 - RNA, 13 nt, Human
caagcacagucag

SEQ ID NO: 2007605 - RNA, 14 nt, Human
caagcacagucagg

SEQ ID NO: 2007606 - RNA, 13 nt, Human
caagcaccuccug

SEQ ID NO: 2007607 - RNA, 15 nt, Human
caagaccaaauggaa

SEQ ID NO: 2007608 - RNA, 16 nt, Human
caagaucaaaaaggcu

SEQ ID NO: 2007609 - RNA, 17 nt, Human
caagaucaaaaaggcuu

SEQ ID NO: 2007610 - RNA, 21 nt, Human
caagaucaaaaaggcuuauaa

SEQ ID NO: 2007611 - RNA, 14 nt, Human
caagaccacguuuc

SEQ ID NO: 2007612 - RNA, 16 nt, Human
caagaccacguuucua

SEQ ID NO: 2007613 - RNA, 18 nt, Human
caagcaagaaacacuggg

SEQ ID NO: 2007614 - RNA, 13 nt, Human
caagcaagaaaca

SEQ ID NO: 2007615 - RNA, 19 nt, Human
caagcaaaugugaaucauu

SEQ ID NO: 2007616 - RNA, 17 nt, Human
caagcaaaugugaauca

SEQ ID NO: 2007617 - RNA, 15 nt, Human
caagcaaaugugaau

SEQ ID NO: 2007618 - RNA, 15 nt, Human
caaguauuuaagccu

SEQ ID NO: 2007619 - RNA, 22 nt, Human
caaguauuuaagccuaaagauu

SEQ ID NO: 2007620 - RNA, 20 nt, Human
caaguuauuuuuaauuuggu

SEQ ID NO: 2007621 - RNA, 22 nt, Human
caaguucacaccugcagauucu

SEQ ID NO: 2007622 - RNA, 23 nt, Human
caaguucacaccugcagauucua

SEQ ID NO: 2007623 - RNA, 15 nt, Human
caaggcccccugccu

SEQ ID NO: 2007624 - RNA, 17 nt, Human
caaguauuauaccuuuu

SEQ ID NO: 2007625 - RNA, 22 nt, Human
caaguauuauaccuuuuuuaga

SEQ ID NO: 2007626 - RNA, 13 nt, Human
caaguauuauacc

SEQ ID NO: 2007627 - RNA, 14 nt, Human
caaggcaaggcugu

SEQ ID NO: 2007628 - RNA, 15 nt, Human
caaggcaaaaacaaa

SEQ ID NO: 2007629 - RNA, 19 nt, Human
caaggauugcuacuguccu

SEQ ID NO: 2007630 - RNA, 20 nt, Human
caaggauugcuacuguccua

SEQ ID NO: 2007631 - RNA, 14 nt, Human
caaggcaaaaacaa

SEQ ID NO: 2007632 - RNA, 18 nt, Human
caagcuccaagcucccag

SEQ ID NO: 2007633 - RNA, 17 nt, Human
caagcuccaagcuccca

SEQ ID NO: 2007634 - RNA, 21 nt, Human
caagcuccaagcucccaggca

SEQ ID NO: 2007635 - RNA, 19 nt, Human
caagcuccaagcucccagg

SEQ ID NO: 2007636 - RNA, 21 nt, Human
caagcuccaucuccacuccag

SEQ ID NO: 2007637 - RNA, 17 nt, Human
caagcuccaucuccacu

SEQ ID NO: 2007638 - RNA, 17 nt, Human
caagcucccaggcauuc

SEQ ID NO: 2007639 - RNA, 15 nt, Human
caagcucccaggcau

SEQ ID NO: 2007640 - RNA, 14 nt, Human
caagcucccaggca

SEQ ID NO: 2007641 - RNA, 12 nt, Human
caagcucccagg

SEQ ID NO: 2007642 - RNA, 15 nt, Human
caagcucugcuccuc

SEQ ID NO: 2007643 - RNA, 16 nt, Human
caagcucugcuccucu

SEQ ID NO: 2007644 - RNA, 23 nt, Human
caauauuugugugcuaaacgugu

SEQ ID NO: 2007645 - RNA, 19 nt, Human
caauauuugugugcuaaac

SEQ ID NO: 2007646 - RNA, 22 nt, Human
caauauuugugugcuaaacgug

SEQ ID NO: 2007647 - RNA, 16 nt, Human
caaugcuggagaaaaa

SEQ ID NO: 2007648 - RNA, 12 nt, Human
caaugcuggcug

SEQ ID NO: 2007649 - RNA, 13 nt, Human
caauggcagccuu

SEQ ID NO: 2007650 - RNA, 14 nt, Human
caauggcagccuug

SEQ ID NO: 2007651 - RNA, 15 nt, Human
caauggcagccuugg

SEQ ID NO: 2007652 - RNA, 14 nt, Human
caaucaaaucugcu

SEQ ID NO: 2007653 - RNA, 21 nt, Human
caaucaauaacagccgcucca

SEQ ID NO: 2007654 - RNA, 20 nt, Human
caaugccucuugucuuccua

SEQ ID NO: 2007655 - RNA, 16 nt, Human
caaugccucuugucuu

SEQ ID NO: 2007656 - RNA, 15 nt, Human
cacaaggaagaaauu

SEQ ID NO: 2007657 - RNA, 13 nt, Human
caauuuauuaugg

SEQ ID NO: 2007658 - RNA, 20 nt, Human
caauuuauuauggcacauca

SEQ ID NO: 2007659 - RNA, 19 nt, Human
caauuucaauuuugucugu

SEQ ID NO: 2007660 - RNA, 14 nt, Human
cacaaggaagaaau

SEQ ID NO: 2007661 - RNA, 23 nt, Human
cacaucuugcucugcugacagac

SEQ ID NO: 2007662 - RNA, 15 nt, Human
cacaucuuuuucacu

SEQ ID NO: 2007663 - RNA, 17 nt, Human
cacauuuauucugcuca

SEQ ID NO: 2007664 - RNA, 18 nt, Human
cacauuuauucugcucac

SEQ ID NO: 2007665 - RNA, 17 nt, Human
caccagccccagugccc

SEQ ID NO: 2007666 - RNA, 19 nt, Human
caccagcccuuagcaggga

SEQ ID NO: 2007667 - RNA, 18 nt, Human
caccagccccagugccca

SEQ ID NO: 2007668 - RNA, 21 nt, Human
caccagccccagugcccacag

SEQ ID NO: 2007669 - RNA, 22 nt, Human
caccagccccagugcccacagg

SEQ ID NO: 2007670 - RNA, 16 nt, Human
cacauuucacugucug

SEQ ID NO: 2007671 - RNA, 17 nt, Human
cacauuucacugucugu

SEQ ID NO: 2007672 - RNA, 12 nt, Human
cacccagcccac

SEQ ID NO: 2007673 - RNA, 11 nt, Human
cacccagggaa

SEQ ID NO: 2007674 - RNA, 21 nt, Human
cacccagggaacuaggaaggc

SEQ ID NO: 2007675 - RNA, 11 nt, Human
cacccagaaac

SEQ ID NO: 2007676 - RNA, 18 nt, Human
cacccaugaaagaaaacu

SEQ ID NO: 2007677 - RNA, 13 nt, Human
cacaucuugcucu

SEQ ID NO: 2007678 - RNA, 14 nt, Human
cacaucuugcucug

SEQ ID NO: 2007679 - RNA, 19 nt, Human
cacaucaucuguaagcugu

SEQ ID NO: 2007680 - RNA, 18 nt, Human
cacauccacagucucccc

SEQ ID NO: 2007681 - RNA, 13 nt, Human
cacaucccacccc

SEQ ID NO: 2007682 - RNA, 21 nt, Human
cacaucccaccccauccucca

SEQ ID NO: 2007683 - RNA, 15 nt, Human
cacaucuugcucugc

SEQ ID NO: 2007684 - RNA, 20 nt, Human
cacaucuugcucugcugaca

SEQ ID NO: 2007685 - RNA, 21 nt, Human
cacaucuugcucugcugacag

SEQ ID NO: 2007686 - RNA, 22 nt, Human
cacaucuugcucugcugacaga

SEQ ID NO: 2007687 - RNA, 14 nt, Human
cacaucaucuguaa

SEQ ID NO: 2007688 - RNA, 15 nt, Human
cacaucaucuguaag

SEQ ID NO: 2007689 - RNA, 20 nt, Human
caccugcggugcuaucuccc

SEQ ID NO: 2007690 - RNA, 15 nt, Human
caccugcgcuucacu

SEQ ID NO: 2007691 - RNA, 19 nt, Human
caccugcggugcuaucucc

SEQ ID NO: 2007692 - RNA, 17 nt, Human
caccugcggugcuaucu

SEQ ID NO: 2007693 - RNA, 16 nt, Human
caccugcggugcuauc

SEQ ID NO: 2007694 - RNA, 17 nt, Human
cacccuggggagaaagu

SEQ ID NO: 2007695 - RNA, 12 nt, Human
caccugccaggg

SEQ ID NO: 2007696 - RNA, 11 nt, Human
caccugccagg

SEQ ID NO: 2007697 - RNA, 21 nt, Human
caccugccccucaacucuccu

SEQ ID NO: 2007698 - RNA, 18 nt, Human
caccugccccucaacucu

SEQ ID NO: 2007699 - RNA, 12 nt, Human
cacccuccuuuc

SEQ ID NO: 2007700 - RNA, 23 nt, Human
cacccuccuucccacucuucuca

SEQ ID NO: 2007701 - RNA, 12 nt, Human
cacccuccuucc

SEQ ID NO: 2007702 - RNA, 13 nt, Human
cacccuccuuccc

SEQ ID NO: 2007703 - RNA, 14 nt, Human
cacccuccuuccca

SEQ ID NO: 2007704 - RNA, 20 nt, Human
cacccuccuucccacucuuc

SEQ ID NO: 2007705 - RNA, 22 nt, Human
cacccuccuucccacucuucuc

SEQ ID NO: 2007706 - RNA, 18 nt, Human
cacccugcuuggcccagg

SEQ ID NO: 2007707 - RNA, 16 nt, Human
cacccugcuuggccca

SEQ ID NO: 2007708 - RNA, 17 nt, Human
cacccugcuuggcccag

SEQ ID NO: 2007709 - RNA, 12 nt, Human
cacccugcucuc

SEQ ID NO: 2007710 - RNA, 16 nt, Human
cacccugcugagucug

SEQ ID NO: 2007711 - RNA, 16 nt, Human
cacuccagugagacag

SEQ ID NO: 2007712 - RNA, 21 nt, Human
cacuccagugagacagcucug

SEQ ID NO: 2007713 - RNA, 17 nt, Human
cacuccagaccccuggc

SEQ ID NO: 2007714 - RNA, 14 nt, Human
cacugaagaguaug

SEQ ID NO: 2007715 - RNA, 17 nt, Human
cacugaagucaguucuc

SEQ ID NO: 2007716 - RNA, 21 nt, Human
cacgcuggagugcagugagcc

SEQ ID NO: 2007717 - RNA, 14 nt, Human
cacgcuggggaaga

SEQ ID NO: 2007718 - RNA, 19 nt, Human
cacgcuggggaagaauuua

SEQ ID NO: 2007719 - RNA, 16 nt, Human
cacgcuggagugcagu

SEQ ID NO: 2007720 - RNA, 17 nt, Human
cacgcuggagugcagug

SEQ ID NO: 2007721 - RNA, 18 nt, Human
cacgcuggagugcaguga

SEQ ID NO: 2007722 - RNA, 20 nt, Human
cacgcuggagugcagugagc

SEQ ID NO: 2007723 - RNA, 15 nt, Human
cacgcuggagugcag

SEQ ID NO: 2007724 - RNA, 15 nt, Human
cacuacauucuguua

SEQ ID NO: 2007725 - RNA, 16 nt, Human
cacuagacccacugga

SEQ ID NO: 2007726 - RNA, 14 nt, Human
cacuccagaccccu

SEQ ID NO: 2007727 - RNA, 16 nt, Human
cacuccagaccccugg

SEQ ID NO: 2007728 - RNA, 13 nt, Human
cacuacauucugu

SEQ ID NO: 2007729 - RNA, 14 nt, Human
cacuacauucuguu

SEQ ID NO: 2007730 - RNA, 22 nt, Human
cacggaagagccuugcggaagg

SEQ ID NO: 2007731 - RNA, 16 nt, Human
cacggaagagccuugc

SEQ ID NO: 2007732 - RNA, 23 nt, Human
gcccuaaugcgcaggcuggcccu

SEQ ID NO: 2007733 - RNA, 15 nt, Human
gcccuaaaagcacac

SEQ ID NO: 2007734 - RNA, 22 nt, Human
gcccuaaaguguauuuuuuuac

SEQ ID NO: 2007735 - RNA, 15 nt, Human
gccccugccccugcc

SEQ ID NO: 2007736 - RNA, 22 nt, Human
gccccuggaugcagccucacag

SEQ ID NO: 2007737 - RNA, 18 nt, Human
gccccuggaugcagccuc

SEQ ID NO: 2007738 - RNA, 16 nt, Human
gccccuggaugcagcc

SEQ ID NO: 2007739 - RNA, 15 nt, Human
gccccugcccggcug

SEQ ID NO: 2007740 - RNA, 13 nt, Human
gccccugcccggc

SEQ ID NO: 2007741 - RNA, 14 nt, Human
gccccugcccggcu

SEQ ID NO: 2007742 - RNA, 14 nt, Human
gcccccucugcccu

SEQ ID NO: 2007743 - RNA, 19 nt, Human
gccccaaaacucuccucug

SEQ ID NO: 2007744 - RNA, 18 nt, Human
gccccaaaacucuccucu

SEQ ID NO: 2007745 - RNA, 19 nt, Human
gcccauuugggcagagagg

SEQ ID NO: 2007746 - RNA, 20 nt, Human
gcccauuugggcagagaggc

SEQ ID NO: 2007747 - RNA, 19 nt, Human
gcccauguggagucagccu

SEQ ID NO: 2007748 - RNA, 16 nt, Human
gcccauuuggagggcc

SEQ ID NO: 2007749 - RNA, 17 nt, Human
gcccauuuggagggccu

SEQ ID NO: 2007750 - RNA, 18 nt, Human
gcccauuuggagggccug

SEQ ID NO: 2007751 - RNA, 20 nt, Human
gcccauuuggagggccuggg

SEQ ID NO: 2007752 - RNA, 15 nt, Human
gcccauuugggcaga

SEQ ID NO: 2007753 - RNA, 18 nt, Human
gcccauuugggcagagag

SEQ ID NO: 2007754 - RNA, 15 nt, Human
gcccauguauggcca

SEQ ID NO: 2007755 - RNA, 16 nt, Human
gcccauguauggccag

SEQ ID NO: 2007756 - RNA, 17 nt, Human
gcccauguauggccagg

SEQ ID NO: 2007757 - RNA, 18 nt, Human
gcccauguauggccagga

SEQ ID NO: 2007758 - RNA, 20 nt, Human
gcccauguauggccaggaag

SEQ ID NO: 2007759 - RNA, 21 nt, Human
gcccauguauggccaggaagu

SEQ ID NO: 2007760 - RNA, 19 nt, Human
gcccacuccugcucugcuc

SEQ ID NO: 2007761 - RNA, 13 nt, Human
gcccacucccugc

SEQ ID NO: 2007762 - RNA, 23 nt, Human
gcccacuagacccacuggacuca

SEQ ID NO: 2007763 - RNA, 17 nt, Human
gcccacuagacccacug

SEQ ID NO: 2007764 - RNA, 22 nt, Human
gcccacgcugacuacagggccg

SEQ ID NO: 2007765 - RNA, 18 nt, Human
gcccacgcugacuacagg

SEQ ID NO: 2007766 - RNA, 19 nt, Human
gcccacgcugacuacaggg

SEQ ID NO: 2007767 - RNA, 15 nt, Human
gcccacucccugcaa

SEQ ID NO: 2007768 - RNA, 14 nt, Human
gcccacucccugca

SEQ ID NO: 2007769 - RNA, 19 nt, Human
gcccacucccugcaaccug

SEQ ID NO: 2007770 - RNA, 17 nt, Human
gcccacuccugcucugc

SEQ ID NO: 2007771 - RNA, 18 nt, Human
gcccacuccugcucugcu

SEQ ID NO: 2007772 - RNA, 13 nt, Human
gcccacuccugcu

SEQ ID NO: 2007773 - RNA, 15 nt, Human
gcccacuccugcucu

SEQ ID NO: 2007774 - RNA, 16 nt, Human
gcccacuccugcucug

SEQ ID NO: 2007775 - RNA, 22 nt, Human
gcccugccuccuuugugaggaa

SEQ ID NO: 2007776 - RNA, 16 nt, Human
gcccugccuccuuugu

SEQ ID NO: 2007777 - RNA, 16 nt, Human
gcccugcugaguccca

SEQ ID NO: 2007778 - RNA, 13 nt, Human
gcccugccucucc

SEQ ID NO: 2007779 - RNA, 15 nt, Human
gcccugccucuccgc

SEQ ID NO: 2007780 - RNA, 17 nt, Human
gcccugccucuccgccc

SEQ ID NO: 2007781 - RNA, 18 nt, Human
gcccugccucuccgcccc

SEQ ID NO: 2007782 - RNA, 21 nt, Human
gcccugccucuccgccccuga

SEQ ID NO: 2007783 - RNA, 23 nt, Human
gcccugcugagucccaggcugag

SEQ ID NO: 2007784 - RNA, 21 nt, Human
gcccugcugagucccaggcug

SEQ ID NO: 2007785 - RNA, 22 nt, Human
gcccugcugagucccaggcuga

SEQ ID NO: 2007786 - RNA, 17 nt, Human
gccgcgucgcccuccca

SEQ ID NO: 2007787 - RNA, 15 nt, Human
gccgccuucacagca

SEQ ID NO: 2007788 - RNA, 15 nt, Human
gccgccaugcuccug

SEQ ID NO: 2007789 - RNA, 20 nt, Human
gcccuuaccugccaggaagc

SEQ ID NO: 2007790 - RNA, 16 nt, Human
gcccuuaccugccagg

SEQ ID NO: 2007791 - RNA, 14 nt, Human
gccgcccaaggccc

SEQ ID NO: 2007792 - RNA, 16 nt, Human
gccgccaugcuccugg

SEQ ID NO: 2007793 - RNA, 17 nt, Human
gccuggccccucagggu

SEQ ID NO: 2007794 - RNA, 16 nt, Human
gccuggccccucaggg

SEQ ID NO: 2007795 - RNA, 15 nt, Human
gccuggccccucagg

SEQ ID NO: 2007796 - RNA, 10 nt, Human
gccuggccug

SEQ ID NO: 2007797 - RNA, 22 nt, Human
gccuggccccucagggucccug

SEQ ID NO: 2007798 - RNA, 20 nt, Human
gccuggccccucaggguccc

SEQ ID NO: 2007799 - RNA, 18 nt, Human
gccugggaucccucaucc

SEQ ID NO: 2007800 - RNA, 21 nt, Human
gccugggaucccucauccuca

SEQ ID NO: 2007801 - RNA, 17 nt, Human
gccugggauaggggcag

SEQ ID NO: 2007802 - RNA, 14 nt, Human
gccugggaucccuc

SEQ ID NO: 2007803 - RNA, 22 nt, Human
gccugggaggucaaggcugcag

SEQ ID NO: 2007804 - RNA, 21 nt, Human
gccugggaggucaaggcugca

SEQ ID NO: 2007805 - RNA, 21 nt, Human
gccugcgccaccgcccagaga

SEQ ID NO: 2007806 - RNA, 20 nt, Human
gccugccuuuggcacucuga

SEQ ID NO: 2007807 - RNA, 22 nt, Human
gccugccuugcccacuccugcu

SEQ ID NO: 2007808 - RNA, 20 nt, Human
gccugccuuaagugaggaaa

SEQ ID NO: 2007809 - RNA, 21 nt, Human
gccugccuuaagugaggaaau

SEQ ID NO: 2007810 - RNA, 16 nt, Human
gccugccucuucucua

SEQ ID NO: 2007811 - RNA, 17 nt, Human
gccugccuguucccauu

SEQ ID NO: 2007812 - RNA, 16 nt, Human
gccuacccacccccag

SEQ ID NO: 2007813 - RNA, 17 nt, Human
gccuacccacccccagg

SEQ ID NO: 2007814 - RNA, 19 nt, Human
gccuacaugcuuugugaac

SEQ ID NO: 2007815 - RNA, 23 nt, Human
gccuacuccugucuucugcuuug

SEQ ID NO: 2007816 - RNA, 13 nt, Human
gccuacuccuguc

SEQ ID NO: 2007817 - RNA, 15 nt, Human
gccuacuccugucuu

SEQ ID NO: 2007818 - RNA, 16 nt, Human
gccuacuccugucuuc

SEQ ID NO: 2007819 - RNA, 22 nt, Human
gccuacuccugucuucugcuuu

SEQ ID NO: 2007820 - RNA, 13 nt, Human
gccuccuccagcc

SEQ ID NO: 2007821 - RNA, 18 nt, Human
gccuccugcccuuaccug

SEQ ID NO: 2007822 - RNA, 12 nt, Human
gccucugggacu

SEQ ID NO: 2007823 - RNA, 19 nt, Human
gccucuggcucuacacaua

SEQ ID NO: 2007824 - RNA, 13 nt, Human
gccuccugugugu

SEQ ID NO: 2007825 - RNA, 14 nt, Human
gccuccuguggccu

SEQ ID NO: 2007826 - RNA, 18 nt, Human
gccuccuguggccugcca

SEQ ID NO: 2007827 - RNA, 20 nt, Human
gccuccuguggccugccagu

SEQ ID NO: 2007828 - RNA, 23 nt, Human
gccucuucucuacucuagggaaa

SEQ ID NO: 2007829 - RNA, 12 nt, Human
gccucuucucua

SEQ ID NO: 2007830 - RNA, 15 nt, Human
gccucuucugagcuu

SEQ ID NO: 2007831 - RNA, 22 nt, Human
gccucuuccucccucauuccac

SEQ ID NO: 2007832 - RNA, 12 nt, Human
gccucuuccucc

SEQ ID NO: 2007833 - RNA, 17 nt, Human
gccugcccaggccccug

SEQ ID NO: 2007834 - RNA, 18 nt, Human
gccugcccaggccccugc

SEQ ID NO: 2007835 - RNA, 19 nt, Human
gccugcccaggccccugcc

SEQ ID NO: 2007836 - RNA, 20 nt, Human
gccugcccaggccccugcca

SEQ ID NO: 2007837 - RNA, 23 nt, Human
gccaggccacaagacccuugugg

SEQ ID NO: 2007838 - RNA, 12 nt, Human
gccaggccagag

SEQ ID NO: 2007839 - RNA, 20 nt, Human
gccaggcccucugcccacuc

SEQ ID NO: 2007840 - RNA, 19 nt, Human
gccaggcccucugcccacu

SEQ ID NO: 2007841 - RNA, 21 nt, Human
gccaggcccucugcccacucc

SEQ ID NO: 2007842 - RNA, 17 nt, Human
gccaggcccucugccca

SEQ ID NO: 2007843 - RNA, 16 nt, Human
gccaggcccucugccc

SEQ ID NO: 2007844 - RNA, 13 nt, Human
gccaggccagagg

SEQ ID NO: 2007845 - RNA, 19 nt, Human
gccaggccacuggccccug

SEQ ID NO: 2007846 - RNA, 15 nt, Human
gccaggcccucugcc

SEQ ID NO: 2007847 - RNA, 17 nt, Human
gccagacccccuggaga

SEQ ID NO: 2007848 - RNA, 20 nt, Human
gccagcaaaacuuagaugug

SEQ ID NO: 2007849 - RNA, 22 nt, Human
gccagacgcucauucagcaucu

SEQ ID NO: 2007850 - RNA, 16 nt, Human
gccagaacucuguguc

SEQ ID NO: 2007851 - RNA, 16 nt, Human
gccagaaguagcuuug

SEQ ID NO: 2007852 - RNA, 22 nt, Human
gccagacaucaacagauaaaua

SEQ ID NO: 2007853 - RNA, 15 nt, Human
gccagaauuucaaac

SEQ ID NO: 2007854 - RNA, 18 nt, Human
gccagaaguagcuuugca

SEQ ID NO: 2007855 - RNA, 23 nt, Human
gccagcaggcucucaggccagcu

SEQ ID NO: 2007856 - RNA, 21 nt, Human
gccagcaggcucucaggccag

SEQ ID NO: 2007857 - RNA, 19 nt, Human
gccagccaaacacacagaa

SEQ ID NO: 2007858 - RNA, 20 nt, Human
gccagccaaacacacagaag

SEQ ID NO: 2007859 - RNA, 21 nt, Human
gccagccaaacacacagaagg

SEQ ID NO: 2007860 - RNA, 22 nt, Human
gccagccaaacacacagaaggg

SEQ ID NO: 2007861 - RNA, 20 nt, Human
gccagcaggcucucaggcca

SEQ ID NO: 2007862 - RNA, 19 nt, Human
gccagcaggcucucaggcc

SEQ ID NO: 2007863 - RNA, 18 nt, Human
gccagcaggcucucaggc

SEQ ID NO: 2007864 - RNA, 17 nt, Human
gccagcaggcucucagg

SEQ ID NO: 2007865 - RNA, 16 nt, Human
gccagcaggcucucag

SEQ ID NO: 2007866 - RNA, 13 nt, Human
gccagcaggcucu

SEQ ID NO: 2007867 - RNA, 19 nt, Human
gccauauucuguuggccag

SEQ ID NO: 2007868 - RNA, 20 nt, Human
gccauauucuguuggccagu

SEQ ID NO: 2007869 - RNA, 15 nt, Human
gccauguuggccagg

SEQ ID NO: 2007870 - RNA, 16 nt, Human
gccauguuggccaggc

SEQ ID NO: 2007871 - RNA, 17 nt, Human
gccauguuggccaggcu

SEQ ID NO: 2007872 - RNA, 18 nt, Human
gccauguuggccaggcug

SEQ ID NO: 2007873 - RNA, 14 nt, Human
gccauguuggccag

SEQ ID NO: 2007874 - RNA, 14 nt, Human
gcccacgcccccac

SEQ ID NO: 2007875 - RNA, 13 nt, Human
gcccacgccccca

SEQ ID NO: 2007876 - RNA, 18 nt, Human
gcccaccuuggcucaagu

SEQ ID NO: 2007877 - RNA, 15 nt, Human
gcccacgcuggagug

SEQ ID NO: 2007878 - RNA, 15 nt, Human
gcccacgcugacuac

SEQ ID NO: 2007879 - RNA, 17 nt, Human
gccauucugacucauau

SEQ ID NO: 2007880 - RNA, 16 nt, Human
gcccacgcuggagugc

SEQ ID NO: 2007881 - RNA, 17 nt, Human
gcccacgcuggagugca

SEQ ID NO: 2007882 - RNA, 17 nt, Human
gccauuccccgucucug

SEQ ID NO: 2007883 - RNA, 18 nt, Human
gccauuccccgucucugg

SEQ ID NO: 2007884 - RNA, 19 nt, Human
gccauguuggccaggcugg

SEQ ID NO: 2007885 - RNA, 20 nt, Human
gccauguuggccaggcuggu

SEQ ID NO: 2007886 - RNA, 22 nt, Human
gccauguuggccaggcuggucu

SEQ ID NO: 2007887 - RNA, 24 nt, Human
gccauguuggccaggcuggucuca

SEQ ID NO: 2007888 - RNA, 18 nt, Human
gcacuuggagacuuguau

SEQ ID NO: 2007889 - RNA, 18 nt, Human
gcacuugggggcucagca

SEQ ID NO: 2007890 - RNA, 19 nt, Human
gcacuugggggcucagcaa

SEQ ID NO: 2007891 - RNA, 21 nt, Human
gcacuugggggcucagcaagg

SEQ ID NO: 2007892 - RNA, 22 nt, Human
gcacuugggggcucagcaaggc

SEQ ID NO: 2007893 - RNA, 23 nt, Human
gcacuugggggcucagcaaggcc

SEQ ID NO: 2007894 - RNA, 21 nt, Human
gccacauugaaaaauguccac

SEQ ID NO: 2007895 - RNA, 20 nt, Human
gccacauuccugaugcuucu

SEQ ID NO: 2007896 - RNA, 16 nt, Human
gccacauuccugaugc

SEQ ID NO: 2007897 - RNA, 21 nt, Human
gccaccaacauacucccaucu

SEQ ID NO: 2007898 - RNA, 20 nt, Human
gccaccaacauacucccauc

SEQ ID NO: 2007899 - RNA, 19 nt, Human
gccaccaacauacucccau

SEQ ID NO: 2007900 - RNA, 21 nt, Human
gccaccaacagccacucagaa

SEQ ID NO: 2007901 - RNA, 22 nt, Human
gccaccaacauacucccaucug

SEQ ID NO: 2007902 - RNA, 13 nt, Human
gccaccacgcccg

SEQ ID NO: 2007903 - RNA, 23 nt, Human
gccaccaagugaaaaauguuagg

SEQ ID NO: 2007904 - RNA, 14 nt, Human
gccaccacgcccgg

SEQ ID NO: 2007905 - RNA, 17 nt, Human
gccaccacgccuagccu

SEQ ID NO: 2007906 - RNA, 24 nt, Human
gccaccacgccuagccucacgcuc

SEQ ID NO: 2007907 - RNA, 21 nt, Human
gccaccagaugugacaguguu

SEQ ID NO: 2007908 - RNA, 19 nt, Human
gccacugugaagagaacca

SEQ ID NO: 2007909 - RNA, 18 nt, Human
gccacugugaagagaacc

SEQ ID NO: 2007910 - RNA, 12 nt, Human
gccacugccucu

SEQ ID NO: 2007911 - RNA, 13 nt, Human
gccacugccucuu

SEQ ID NO: 2007912 - RNA, 16 nt, Human
gccacugccucuuccu

SEQ ID NO: 2007913 - RNA, 17 nt, Human
gccacugccucuuccuc

SEQ ID NO: 2007914 - RNA, 13 nt, Human
gccacuuuccaag

SEQ ID NO: 2007915 - RNA, 19 nt, Human
gccacuuugcaaaggagcu

SEQ ID NO: 2007916 - RNA, 18 nt, Human
gccacuuuccaagucacu

SEQ ID NO: 2007917 - RNA, 21 nt, Human
gccacuugaugacccccaacc

SEQ ID NO: 2007918 - RNA, 21 nt, Human
gccacugcacuauagccuagg

SEQ ID NO: 2007919 - RNA, 12 nt, Human
gccacccugugc

SEQ ID NO: 2007920 - RNA, 13 nt, Human
gccacccugugca

SEQ ID NO: 2007921 - RNA, 13 nt, Human
gccacccugggga

SEQ ID NO: 2007922 - RNA, 19 nt, Human
gccacccuggggagaaagu

SEQ ID NO: 2007923 - RNA, 16 nt, Human
gccaccgccuccuaca

SEQ ID NO: 2007924 - RNA, 23 nt, Human
gccacugcaccgggccacagaga

SEQ ID NO: 2007925 - RNA, 14 nt, Human
gccacccaaagcag

SEQ ID NO: 2007926 - RNA, 21 nt, Human
gcuaggaacacuccuucacag

SEQ ID NO: 2007927 - RNA, 19 nt, Human
gcuaggaacacuccuucac

SEQ ID NO: 2007928 - RNA, 18 nt, Human
gcuaggaacacuccuuca

SEQ ID NO: 2007929 - RNA, 19 nt, Human
gcuauggggauagaugugu

SEQ ID NO: 2007930 - RNA, 21 nt, Human
gcuauggggauagaugugugg

SEQ ID NO: 2007931 - RNA, 16 nt, Human
gcuauugucaccaggg

SEQ ID NO: 2007932 - RNA, 16 nt, Human
gcuaugucauuucaug

SEQ ID NO: 2007933 - RNA, 17 nt, Human
gcuaugucauuucaugu

SEQ ID NO: 2007934 - RNA, 12 nt, Human
gcuaugucauuu

SEQ ID NO: 2007935 - RNA, 20 nt, Human
gcuauugucaccagggcugg

SEQ ID NO: 2007936 - RNA, 21 nt, Human
gcuauugucaccagggcugga

SEQ ID NO: 2007937 - RNA, 22 nt, Human
gcuagucaacaguacccugguu

SEQ ID NO: 2007938 - RNA, 22 nt, Human
gcuaggcagggugucugccccc

SEQ ID NO: 2007939 - RNA, 13 nt, Human
gcuagucaacagu

SEQ ID NO: 2007940 - RNA, 16 nt, Human
gcuaguaucaaaagaa

SEQ ID NO: 2007941 - RNA, 14 nt, Human
gcuaggccuggcca

SEQ ID NO: 2007942 - RNA, 15 nt, Human
gcuaggccuggccag

SEQ ID NO: 2007943 - RNA, 19 nt, Human
gcuaggcagggugucugcc

SEQ ID NO: 2007944 - RNA, 20 nt, Human
gcuaggcagggugucugccc

SEQ ID NO: 2007945 - RNA, 20 nt, Human
gccuguucagcuccagcuca

SEQ ID NO: 2007946 - RNA, 19 nt, Human
gccuguucagcuccagcuc

SEQ ID NO: 2007947 - RNA, 22 nt, Human
gcucagguggggucacucuggc

SEQ ID NO: 2007948 - RNA, 21 nt, Human
gcucagguggggucacucugg

SEQ ID NO: 2007949 - RNA, 15 nt, Human
gcucagagagggugg

SEQ ID NO: 2007950 - RNA, 20 nt, Human
gcucagagagggugggagug

SEQ ID NO: 2007951 - RNA, 18 nt, Human
gcucagagagggugggag

SEQ ID NO: 2007952 - RNA, 22 nt, Human
gcucagagagggugggaguggg

SEQ ID NO: 2007953 - RNA, 14 nt, Human
gcucaggagcccug

SEQ ID NO: 2007954 - RNA, 18 nt, Human
gcucaggagcccugggag

SEQ ID NO: 2007955 - RNA, 15 nt, Human
gcucaggagcccugg

SEQ ID NO: 2007956 - RNA, 12 nt, Human
gcucagggccug

SEQ ID NO: 2007957 - RNA, 21 nt, Human
gcucaggagcccugggaggcu

SEQ ID NO: 2007958 - RNA, 16 nt, Human
gcucagggccuggcuc

SEQ ID NO: 2007959 - RNA, 13 nt, Human
gcucagggccugg

SEQ ID NO: 2007960 - RNA, 17 nt, Human
gcucagggccuggcuca

SEQ ID NO: 2007961 - RNA, 16 nt, Human
gcucucaggccagcug

SEQ ID NO: 2007962 - RNA, 15 nt, Human
gcucucaggccagcu

SEQ ID NO: 2007963 - RNA, 14 nt, Human
gcucucaggccagc

SEQ ID NO: 2007964 - RNA, 13 nt, Human
gcucucaggccag

SEQ ID NO: 2007965 - RNA, 20 nt, Human
gcucuacagcuaaucagcau

SEQ ID NO: 2007966 - RNA, 22 nt, Human
gcucuacagcuaaucagcauuc

SEQ ID NO: 2007967 - RNA, 21 nt, Human
gcucccaggcauuccccagga

SEQ ID NO: 2007968 - RNA, 20 nt, Human
gcucccaggcauuccccagg

SEQ ID NO: 2007969 - RNA, 19 nt, Human
gcuccccuaaagccucaaa

SEQ ID NO: 2007970 - RNA, 13 nt, Human
gcucccccuuuuc

SEQ ID NO: 2007971 - RNA, 17 nt, Human
gcucccccuuuucccuc

SEQ ID NO: 2007972 - RNA, 14 nt, Human
gcuccccagcccca

SEQ ID NO: 2007973 - RNA, 22 nt, Human
gcucccaggcauuccccaggag

SEQ ID NO: 2007974 - RNA, 14 nt, Human
gcuccugcccccau

SEQ ID NO: 2007975 - RNA, 11 nt, Human
gcuccugccca

SEQ ID NO: 2007976 - RNA, 11 nt, Human
gcuccugcccc

SEQ ID NO: 2007977 - RNA, 22 nt, Human
gcuccugccaccacgcccggcu

SEQ ID NO: 2007978 - RNA, 22 nt, Human
gcucugagagcaaacuggcuug

SEQ ID NO: 2007979 - RNA, 23 nt, Human
gcucuggagcccacuguacuugc

SEQ ID NO: 2007980 - RNA, 20 nt, Human
gcucugagcaaauguggcuc

SEQ ID NO: 2007981 - RNA, 21 nt, Human
gcucugagcaaauguggcucc

SEQ ID NO: 2007982 - RNA, 15 nt, Human
gcucuguugcccagg

SEQ ID NO: 2007983 - RNA, 16 nt, Human
gcucuguugcccaggc

SEQ ID NO: 2007984 - RNA, 18 nt, Human
gcucuguugcccaggcug

SEQ ID NO: 2007985 - RNA, 22 nt, Human
gcucuguugcccaggcuggagu

SEQ ID NO: 2007986 - RNA, 23 nt, Human
gcucuguugcccaggcuggagug

SEQ ID NO: 2007987 - RNA, 16 nt, Human
gcucuguccugggagu

SEQ ID NO: 2007988 - RNA, 19 nt, Human
gcucugucgcccaggcugg

SEQ ID NO: 2007989 - RNA, 15 nt, Human
gcucuguccugggag

SEQ ID NO: 2007990 - RNA, 14 nt, Human
gcucuguccuggga

SEQ ID NO: 2007991 - RNA, 16 nt, Human
gcucuuccaggcuggg

SEQ ID NO: 2007992 - RNA, 15 nt, Human
gcucuuccaggcugg

SEQ ID NO: 2007993 - RNA, 12 nt, Human
gcucuuccaggc

SEQ ID NO: 2007994 - RNA, 23 nt, Human
gcucuuagcaaaaacauguaugu

SEQ ID NO: 2007995 - RNA, 16 nt, Human
gcugacagacacaggc

SEQ ID NO: 2007996 - RNA, 13 nt, Human
gcugaauugagcc

SEQ ID NO: 2007997 - RNA, 21 nt, Human
gcugaauugagccuaaaaaua

SEQ ID NO: 2007998 - RNA, 14 nt, Human
gcugacagacacag

SEQ ID NO: 2007999 - RNA, 15 nt, Human
gcugacagacacagg

SEQ ID NO: 2008000 - RNA, 22 nt, Human
gcugaauacagaggcaacugca

SEQ ID NO: 2008001 - RNA, 17 nt, Human
gcugaaugguuuucaaa

SEQ ID NO: 2008002 - RNA, 20 nt, Human
gcugaaggcucgagcaugcc

SEQ ID NO: 2008003 - RNA, 12 nt, Human
gcugaaggcucg

SEQ ID NO: 2008004 - RNA, 17 nt, Human
gcugaaauugaaaaguu

SEQ ID NO: 2008005 - RNA, 16 nt, Human
gcugaacacauuucuu

SEQ ID NO: 2008006 - RNA, 18 nt, Human
gcugaacacauuucuuuu

SEQ ID NO: 2008007 - RNA, 19 nt, Human
gcugaacacauuucuuuuu

SEQ ID NO: 2008008 - RNA, 11 nt, Human
gcugaaauuga

SEQ ID NO: 2008009 - RNA, 19 nt, Human
gcugaaauugaaaaguuau

SEQ ID NO: 2008010 - RNA, 12 nt, Human
gcuucacuucug

SEQ ID NO: 2008011 - RNA, 21 nt, Human
gcuucacuucugacucuuccc

SEQ ID NO: 2008012 - RNA, 20 nt, Human
gcuucacggaagagccuugc

SEQ ID NO: 2008013 - RNA, 19 nt, Human
gcuucaccccaaucccagc

SEQ ID NO: 2008014 - RNA, 20 nt, Human
gcuucaccccaaucccagcu

SEQ ID NO: 2008015 - RNA, 14 nt, Human
gcuuaacuucacau

SEQ ID NO: 2008016 - RNA, 23 nt, Human
gcuuaaaugugaauuacuaacuu

SEQ ID NO: 2008017 - RNA, 14 nt, Human
gcuucacaggacag

SEQ ID NO: 2008018 - RNA, 22 nt, Human
gcuucacaggacaggaaagugg

SEQ ID NO: 2008019 - RNA, 20 nt, Human
gcuuaaaagaaaauguucac

SEQ ID NO: 2008020 - RNA, 22 nt, Human
gcuucaaggauccugagccaga

SEQ ID NO: 2008021 - RNA, 12 nt, Human
gcuuaaauguga

SEQ ID NO: 2008022 - RNA, 13 nt, Human
gcuuaaaugugaa

SEQ ID NO: 2008023 - RNA, 14 nt, Human
gcuuaaaugugaau

SEQ ID NO: 2008024 - RNA, 17 nt, Human
gcuuaaaugugaauuac

SEQ ID NO: 2008025 - RNA, 21 nt, Human
gcuguuggcugggggccucag

SEQ ID NO: 2008026 - RNA, 22 nt, Human
gcuguuggcugggggccucagu

SEQ ID NO: 2008027 - RNA, 14 nt, Human
gcuguugucucuuc

SEQ ID NO: 2008028 - RNA, 15 nt, Human
gcuguugucucuucu

SEQ ID NO: 2008029 - RNA, 22 nt, Human
gcugugcugcccugcccaccug

SEQ ID NO: 2008030 - RNA, 19 nt, Human
gcugugcugcccugcccac

SEQ ID NO: 2008031 - RNA, 13 nt, Human
gcugugcugcccu

SEQ ID NO: 2008032 - RNA, 12 nt, Human
gcugugcugccc

SEQ ID NO: 2008033 - RNA, 21 nt, Human
gcugugcucuggacaggcaug

SEQ ID NO: 2008034 - RNA, 23 nt, Human
gcugucuuucuugcucccugacu

SEQ ID NO: 2008035 - RNA, 18 nt, Human
gcugucuuuucuuugcca

SEQ ID NO: 2008036 - RNA, 22 nt, Human
gcugucuuuucuuugccaucuc

SEQ ID NO: 2008037 - RNA, 13 nt, Human
gcugugaaaaaaa

SEQ ID NO: 2008038 - RNA, 12 nt, Human
gcuguaaaagca

SEQ ID NO: 2008039 - RNA, 20 nt, Human
gcuguaaaagcaaguccugc

SEQ ID NO: 2008040 - RNA, 20 nt, Human
gcuguaucccaugagccuca

SEQ ID NO: 2008041 - RNA, 23 nt, Human
gcuguaucccaugagccucagca

SEQ ID NO: 2008042 - RNA, 17 nt, Human
gcuguaaggcaugaagg

SEQ ID NO: 2008043 - RNA, 18 nt, Human
gcuguaaggcaugaagga

SEQ ID NO: 2008044 - RNA, 19 nt, Human
gcuguaaggcaugaaggau

SEQ ID NO: 2008045 - RNA, 15 nt, Human
gcuggguucugaucc

SEQ ID NO: 2008046 - RNA, 15 nt, Human
gcuggguucuaccca

SEQ ID NO: 2008047 - RNA, 14 nt, Human
gcuggguuggaggg

SEQ ID NO: 2008048 - RNA, 21 nt, Human
gcuggguuggaggguguccca

SEQ ID NO: 2008049 - RNA, 23 nt, Human
gcuucccaaaugugugcccagcu

SEQ ID NO: 2008050 - RNA, 14 nt, Human
gcuuccccaguagc

SEQ ID NO: 2008051 - RNA, 16 nt, Human
gcuuccccaguagcug

SEQ ID NO: 2008052 - RNA, 12 nt, Human
gcuuccccuccc

SEQ ID NO: 2008053 - RNA, 23 nt, Human
gcuucccgcucagcccucccugc

SEQ ID NO: 2008054 - RNA, 14 nt, Human
gcuucccucccugc

SEQ ID NO: 2008055 - RNA, 15 nt, Human
gcuucccgcucagcc

SEQ ID NO: 2008056 - RNA, 16 nt, Human
gcuucccgcucagccc

SEQ ID NO: 2008057 - RNA, 17 nt, Human
gcuucccgcucagcccu

SEQ ID NO: 2008058 - RNA, 18 nt, Human
gcuucccgcucagcccuc

SEQ ID NO: 2008059 - RNA, 19 nt, Human
gcuucccugguucaagcga

SEQ ID NO: 2008060 - RNA, 14 nt, Human
gcuuguacauaaug

SEQ ID NO: 2008061 - RNA, 16 nt, Human
gcuuguacauaaugcg

SEQ ID NO: 2008062 - RNA, 19 nt, Human
gcuugggcuucauccuccu

SEQ ID NO: 2008063 - RNA, 15 nt, Human
gcuugggaauuuuau

SEQ ID NO: 2008064 - RNA, 16 nt, Human
gcuugggcagaucucc

SEQ ID NO: 2008065 - RNA, 22 nt, Human
gcuucuuucaagggcuuuccug

SEQ ID NO: 2008066 - RNA, 23 nt, Human
gcuucuuucaagggcuuuccugu

SEQ ID NO: 2008067 - RNA, 19 nt, Human
gcuugaaacccguggcgcu

SEQ ID NO: 2008068 - RNA, 20 nt, Human
gcuucuuuaaaaaagcuaua

SEQ ID NO: 2008069 - RNA, 21 nt, Human
gcuucuuucaagggcuuuccu

SEQ ID NO: 2008070 - RNA, 14 nt, Human
gcuucggcauuuga

SEQ ID NO: 2008071 - RNA, 17 nt, Human
gcuggagcucugcccau

SEQ ID NO: 2008072 - RNA, 12 nt, Human
gcuggagugcag

SEQ ID NO: 2008073 - RNA, 16 nt, Human
gcuggacucccucaag

SEQ ID NO: 2008074 - RNA, 14 nt, Human
gcuggagcucugcc

SEQ ID NO: 2008075 - RNA, 20 nt, Human
gcugggcucccuucccaccu

SEQ ID NO: 2008076 - RNA, 17 nt, Human
gcugggcucccuuccca

SEQ ID NO: 2008077 - RNA, 16 nt, Human
gcugggcucccuuccc

SEQ ID NO: 2008078 - RNA, 12 nt, Human
gcugggcucccu

SEQ ID NO: 2008079 - RNA, 19 nt, Human
gcugggcagaggaaagcaa

SEQ ID NO: 2008080 - RNA, 20 nt, Human
gcugggcacugcucucaccu

SEQ ID NO: 2008081 - RNA, 17 nt, Human
gcugggcagaggaaagc

SEQ ID NO: 2008082 - RNA, 16 nt, Human
gcugggcagaggaaag

SEQ ID NO: 2008083 - RNA, 16 nt, Human
gcugggucgcccugga

SEQ ID NO: 2008084 - RNA, 18 nt, Human
gcugggucgcccuggacu

SEQ ID NO: 2008085 - RNA, 17 nt, Human
gcugggucgcccuggac

SEQ ID NO: 2008086 - RNA, 15 nt, Human
gcuggguguggcgca

SEQ ID NO: 2008087 - RNA, 19 nt, Human
gcugggucgcccuggacug

SEQ ID NO: 2008088 - RNA, 17 nt, Human
gcuggccuggccccuca

SEQ ID NO: 2008089 - RNA, 16 nt, Human
gcuggccuggccccuc

SEQ ID NO: 2008090 - RNA, 14 nt, Human
gcuggagugcagug

SEQ ID NO: 2008091 - RNA, 15 nt, Human
gcuggagugcaguga

SEQ ID NO: 2008092 - RNA, 19 nt, Human
gcuggccuggccccucagg

SEQ ID NO: 2008093 - RNA, 18 nt, Human
gcuggccuggccccucag

SEQ ID NO: 2008094 - RNA, 16 nt, Human
gcugggauuacaggug

SEQ ID NO: 2008095 - RNA, 22 nt, Human
gcugggauuacaggcuccugcc

SEQ ID NO: 2008096 - RNA, 23 nt, Human
gcugggauuacaggcuccugcca

SEQ ID NO: 2008097 - RNA, 15 nt, Human
gcugggcagaggaaa

SEQ ID NO: 2008098 - RNA, 14 nt, Human
gcugggcagaggaa

SEQ ID NO: 2008099 - RNA, 13 nt, Human
gcugggcagagga

SEQ ID NO: 2008100 - RNA, 15 nt, Human
gcugggcacugcucu

SEQ ID NO: 2008101 - RNA, 19 nt, Human
gcugggcacugcucucacc

SEQ ID NO: 2008102 - RNA, 17 nt, Human
gcugggauuacaggugu

SEQ ID NO: 2008103 - RNA, 18 nt, Human
gcugggauuacaggugug

SEQ ID NO: 2008104 - RNA, 19 nt, Human
gcugggauuacagguguga

SEQ ID NO: 2008105 - RNA, 18 nt, Human
gcugagggugagugggug

SEQ ID NO: 2008106 - RNA, 21 nt, Human
gcugccagccgagauagccaa

SEQ ID NO: 2008107 - RNA, 19 nt, Human
gcugccagccgagauagcc

SEQ ID NO: 2008108 - RNA, 21 nt, Human
gcugccauccagguucagcuu

SEQ ID NO: 2008109 - RNA, 10 nt, Human
gcugccagua

SEQ ID NO: 2008110 - RNA, 23 nt, Human
gcugccauccagguucagcuugu

SEQ ID NO: 2008111 - RNA, 22 nt, Human
gcugcaccggcuggccuggccc

SEQ ID NO: 2008112 - RNA, 19 nt, Human
gcugcaccggcuggccugg

SEQ ID NO: 2008113 - RNA, 18 nt, Human
gcugcaccggcuggccug

SEQ ID NO: 2008114 - RNA, 17 nt, Human
gcugcaccggcuggccu

SEQ ID NO: 2008115 - RNA, 16 nt, Human
gcugcaccggcuggcc

SEQ ID NO: 2008116 - RNA, 14 nt, Human
gcugcaccggcugg

SEQ ID NO: 2008117 - RNA, 15 nt, Human
gcugccaguaccagc

SEQ ID NO: 2008118 - RNA, 13 nt, Human
gcugccugggauc

SEQ ID NO: 2008119 - RNA, 18 nt, Human
gcugccugggaucccuca

SEQ ID NO: 2008120 - RNA, 16 nt, Human
gcugccugggaucccu

SEQ ID NO: 2008121 - RNA, 19 nt, Human
gcugccugggaucccucau

SEQ ID NO: 2008122 - RNA, 12 nt, Human
gcugcucugccc

SEQ ID NO: 2008123 - RNA, 13 nt, Human
gcugcucugcccc

SEQ ID NO: 2008124 - RNA, 14 nt, Human
gcugcucugcccca

SEQ ID NO: 2008125 - RNA, 17 nt, Human
gcugcucugccccagcu

SEQ ID NO: 2008126 - RNA, 20 nt, Human
gcugcugagccgcagagaag

SEQ ID NO: 2008127 - RNA, 23 nt, Human
gcugcucugccccagcuugggca

SEQ ID NO: 2008128 - RNA, 20 nt, Human
gcugcucucaaaccccugac

SEQ ID NO: 2008129 - RNA, 19 nt, Human
gcuuguacauaaugcgugc

SEQ ID NO: 2008130 - RNA, 12 nt, Human
ggaccccagccu

SEQ ID NO: 2008131 - RNA, 13 nt, Human
ggaccccagccuc

SEQ ID NO: 2008132 - RNA, 14 nt, Human
ggaccccagccuca

SEQ ID NO: 2008133 - RNA, 15 nt, Human
ggaccccagccucaa

SEQ ID NO: 2008134 - RNA, 18 nt, Human
ggaccccuggugguucac

SEQ ID NO: 2008135 - RNA, 20 nt, Human
ggaccccaucugugaauaag

SEQ ID NO: 2008136 - RNA, 14 nt, Human
ggaccccaucugug

SEQ ID NO: 2008137 - RNA, 17 nt, Human
ggaccccaucugugaau

SEQ ID NO: 2008138 - RNA, 18 nt, Human
ggaccccaucugugaaua

SEQ ID NO: 2008139 - RNA, 18 nt, Human
ggacccugaggcccagag

SEQ ID NO: 2008140 - RNA, 15 nt, Human
ggacccugaggccca

SEQ ID NO: 2008141 - RNA, 14 nt, Human
ggacccugaggccc

SEQ ID NO: 2008142 - RNA, 20 nt, Human
ggacccggaggggccuggca

SEQ ID NO: 2008143 - RNA, 21 nt, Human
ggacccggaggggccuggcag

SEQ ID NO: 2008144 - RNA, 19 nt, Human
ggacccugaggcccagagg

SEQ ID NO: 2008145 - RNA, 16 nt, Human
ggacccuccaaggcca

SEQ ID NO: 2008146 - RNA, 15 nt, Human
ggagagcuagcagca

SEQ ID NO: 2008147 - RNA, 18 nt, Human
ggagagccuuccaggggu

SEQ ID NO: 2008148 - RNA, 17 nt, Human
ggagagccuuccagggg

SEQ ID NO: 2008149 - RNA, 22 nt, Human
ggagagccuuccagggguggga

SEQ ID NO: 2008150 - RNA, 16 nt, Human
ggagagccuuccaggg

SEQ ID NO: 2008151 - RNA, 13 nt, Human
ggagagccuucca

SEQ ID NO: 2008152 - RNA, 14 nt, Human
ggagagagacucca

SEQ ID NO: 2008153 - RNA, 23 nt, Human
ggacugugugcucaggagcccug

SEQ ID NO: 2008154 - RNA, 22 nt, Human
ggacugugugcucaggagcccu

SEQ ID NO: 2008155 - RNA, 12 nt, Human
ggacuuaggaag

SEQ ID NO: 2008156 - RNA, 17 nt, Human
ggacuuagcugggagaa

SEQ ID NO: 2008157 - RNA, 21 nt, Human
ggacuagagggaccucuccca

SEQ ID NO: 2008158 - RNA, 19 nt, Human
ggacuagagggaccucucc

SEQ ID NO: 2008159 - RNA, 18 nt, Human
ggacuagagggaccucuc

SEQ ID NO: 2008160 - RNA, 12 nt, Human
ggaccucaggcc

SEQ ID NO: 2008161 - RNA, 20 nt, Human
ggacuacaggugugagucac

SEQ ID NO: 2008162 - RNA, 17 nt, Human
ggacucagaaacuccau

SEQ ID NO: 2008163 - RNA, 16 nt, Human
ggacuaggguccuggg

SEQ ID NO: 2008164 - RNA, 22 nt, Human
ggacucaaugcacugacauugu

SEQ ID NO: 2008165 - RNA, 22 nt, Human
ggagaaccaaaaagaggcuaug

SEQ ID NO: 2008166 - RNA, 18 nt, Human
ggagaaaugaaaaaauau

SEQ ID NO: 2008167 - RNA, 13 nt, Human
ggagaacuagaga

SEQ ID NO: 2008168 - RNA, 22 nt, Human
ggagacugcugagucaacccaa

SEQ ID NO: 2008169 - RNA, 16 nt, Human
ggagacugucucaaga

SEQ ID NO: 2008170 - RNA, 11 nt, Human
ggacuuccuga

SEQ ID NO: 2008171 - RNA, 15 nt, Human
ggacuuggaagcucc

SEQ ID NO: 2008172 - RNA, 16 nt, Human
ggacuuggagguagcu

SEQ ID NO: 2008173 - RNA, 17 nt, Human
ggacuuggaagcuccgc

SEQ ID NO: 2008174 - RNA, 19 nt, Human
ggagaaaauggacguguua

SEQ ID NO: 2008175 - RNA, 18 nt, Human
ggacuuuuauuuccagug

SEQ ID NO: 2008176 - RNA, 13 nt, Human
ggagcagggaagg

SEQ ID NO: 2008177 - RNA, 16 nt, Human
ggagcagggaaggccu

SEQ ID NO: 2008178 - RNA, 17 nt, Human
ggagcagggaaggccug

SEQ ID NO: 2008179 - RNA, 19 nt, Human
ggagcagggaaggccugac

SEQ ID NO: 2008180 - RNA, 21 nt, Human
ggagcagggaaggccugacuu

SEQ ID NO: 2008181 - RNA, 18 nt, Human
ggagcaguaucaugaagc

SEQ ID NO: 2008182 - RNA, 15 nt, Human
ggagcccacuguacu

SEQ ID NO: 2008183 - RNA, 21 nt, Human
ggagcagccacauuccugaug

SEQ ID NO: 2008184 - RNA, 13 nt, Human
ggagcagccacau

SEQ ID NO: 2008185 - RNA, 15 nt, Human
ggaggcugagauggg

SEQ ID NO: 2008186 - RNA, 19 nt, Human
ggaggcugagaugggagaa

SEQ ID NO: 2008187 - RNA, 21 nt, Human
ggaggcucuggagcccacugu

SEQ ID NO: 2008188 - RNA, 16 nt, Human
ggaggucgaggcagga

SEQ ID NO: 2008189 - RNA, 15 nt, Human
ggaggucgaggcagg

SEQ ID NO: 2008190 - RNA, 15 nt, Human
ggaggugugaggcag

SEQ ID NO: 2008191 - RNA, 17 nt, Human
ggaggugugaggcagga

SEQ ID NO: 2008192 - RNA, 18 nt, Human
ggaggucgaggcaggagg

SEQ ID NO: 2008193 - RNA, 21 nt, Human
ggaggaagaacugaaaggcuu

SEQ ID NO: 2008194 - RNA, 21 nt, Human
ggaggcaugugaugagaggaa

SEQ ID NO: 2008195 - RNA, 20 nt, Human
ggaggaaaaccaagccgugg

SEQ ID NO: 2008196 - RNA, 21 nt, Human
ggaggaaaaccaagccguggc

SEQ ID NO: 2008197 - RNA, 22 nt, Human
ggaggaaaaccaagccguggcu

SEQ ID NO: 2008198 - RNA, 12 nt, Human
ggaggaagagaa

SEQ ID NO: 2008199 - RNA, 20 nt, Human
ggaggccaaggugggaggau

SEQ ID NO: 2008200 - RNA, 18 nt, Human
ggaggccaaggugggagg

SEQ ID NO: 2008201 - RNA, 13 nt, Human
ggaggccagccuu

SEQ ID NO: 2008202 - RNA, 11 nt, Human
ggaggccaaga

SEQ ID NO: 2008203 - RNA, 22 nt, Human
ggaggccaagaguggccccacc

SEQ ID NO: 2008204 - RNA, 23 nt, Human
ggaggccaagaguggccccaccu

SEQ ID NO: 2008205 - RNA, 20 nt, Human
ggaggcucuggagcccacug

SEQ ID NO: 2008206 - RNA, 17 nt, Human
ggaggcucuggagccca

SEQ ID NO: 2008207 - RNA, 21 nt, Human
ggaggcccagcgcggacaucc

SEQ ID NO: 2008208 - RNA, 17 nt, Human
ggaggccaucuggagag

SEQ ID NO: 2008209 - RNA, 22 nt, Human
ggaggcccagcgcggacauccc

SEQ ID NO: 2008210 - RNA, 12 nt, Human
ggaggccaucug

SEQ ID NO: 2008211 - RNA, 13 nt, Human
ggaggccaucugg

SEQ ID NO: 2008212 - RNA, 18 nt, Human
ggagcccauuuggagggc

SEQ ID NO: 2008213 - RNA, 21 nt, Human
ggagcccauuuggagggccug

SEQ ID NO: 2008214 - RNA, 22 nt, Human
ggagcccauuuggagggccugg

SEQ ID NO: 2008215 - RNA, 23 nt, Human
ggagcccauuuggagggccuggg

SEQ ID NO: 2008216 - RNA, 22 nt, Human
ggagcccacuguacuugcucuu

SEQ ID NO: 2008217 - RNA, 18 nt, Human
ggagcccacuguacuugc

SEQ ID NO: 2008218 - RNA, 16 nt, Human
ggagcugaguggggga

SEQ ID NO: 2008219 - RNA, 22 nt, Human
ggagcugccuguucagcuccag

SEQ ID NO: 2008220 - RNA, 17 nt, Human
ggagcuggaguccacug

SEQ ID NO: 2008221 - RNA, 19 nt, Human
ggccagguggccacuccag

SEQ ID NO: 2008222 - RNA, 12 nt, Human
ggcauucucucu

SEQ ID NO: 2008223 - RNA, 13 nt, Human
ggccaaagacaaa

SEQ ID NO: 2008224 - RNA, 15 nt, Human
ggccaaagacaaaua

SEQ ID NO: 2008225 - RNA, 16 nt, Human
ggccaaagacaaauag

SEQ ID NO: 2008226 - RNA, 16 nt, Human
ggcauuucccacccug

SEQ ID NO: 2008227 - RNA, 12 nt, Human
ggcauuguggga

SEQ ID NO: 2008228 - RNA, 16 nt, Human
ggcauuguaucugucu

SEQ ID NO: 2008229 - RNA, 19 nt, Human
ggcauuguaucugucuuuc

SEQ ID NO: 2008230 - RNA, 21 nt, Human
ggcauuguaucugucuuucca

SEQ ID NO: 2008231 - RNA, 21 nt, Human
ggccaaaggaagcacaugccu

SEQ ID NO: 2008232 - RNA, 12 nt, Human
ggccaaaggaag

SEQ ID NO: 2008233 - RNA, 15 nt, Human
ggccaaagccaaagc

SEQ ID NO: 2008234 - RNA, 13 nt, Human
ggccaagguggga

SEQ ID NO: 2008235 - RNA, 21 nt, Human
ggccaaggaugccccgucccc

SEQ ID NO: 2008236 - RNA, 16 nt, Human
ggccaaggagggugag

SEQ ID NO: 2008237 - RNA, 16 nt, Human
ggccaaguccgcagaa

SEQ ID NO: 2008238 - RNA, 23 nt, Human
ggccaaguccgcagaagcccuga

SEQ ID NO: 2008239 - RNA, 23 nt, Human
ggccagagggagugacagaggca

SEQ ID NO: 2008240 - RNA, 18 nt, Human
ggccagcaccaucucuuu

SEQ ID NO: 2008241 - RNA, 17 nt, Human
ggccagaugcaccagcc

SEQ ID NO: 2008242 - RNA, 19 nt, Human
ggccagaugcaccagcccu

SEQ ID NO: 2008243 - RNA, 20 nt, Human
ggccagaugcaccagcccuu

SEQ ID NO: 2008244 - RNA, 21 nt, Human
ggccuccgucacuaccuggcu

SEQ ID NO: 2008245 - RNA, 12 nt, Human
ggccucccugcc

SEQ ID NO: 2008246 - RNA, 13 nt, Human
ggccucccugcca

SEQ ID NO: 2008247 - RNA, 15 nt, Human
ggccucccugccagu

SEQ ID NO: 2008248 - RNA, 19 nt, Human
ggccucccugccaguaggg

SEQ ID NO: 2008249 - RNA, 14 nt, Human
ggccucccaacuca

SEQ ID NO: 2008250 - RNA, 13 nt, Human
ggccucccaacuc

SEQ ID NO: 2008251 - RNA, 14 nt, Human
ggcccuuccuuuuc

SEQ ID NO: 2008252 - RNA, 18 nt, Human
ggcccuuccucuccacug

SEQ ID NO: 2008253 - RNA, 19 nt, Human
ggcccuuccucuccacugc

SEQ ID NO: 2008254 - RNA, 22 nt, Human
ggcccuuccucuccacugccuu

SEQ ID NO: 2008255 - RNA, 23 nt, Human
ggcccuuccucuccacugccuuc

SEQ ID NO: 2008256 - RNA, 22 nt, Human
ggcccagcgcggacauccccug

SEQ ID NO: 2008257 - RNA, 17 nt, Human
ggcccauguauggccag

SEQ ID NO: 2008258 - RNA, 19 nt, Human
ggcccauguauggccagga

SEQ ID NO: 2008259 - RNA, 20 nt, Human
ggcccauguauggccaggaa

SEQ ID NO: 2008260 - RNA, 21 nt, Human
ggcccauguauggccaggaag

SEQ ID NO: 2008261 - RNA, 18 nt, Human
ggccccaggaaaggccca

SEQ ID NO: 2008262 - RNA, 13 nt, Human
ggccccacaccag

SEQ ID NO: 2008263 - RNA, 19 nt, Human
ggccccagcuucucagcuc

SEQ ID NO: 2008264 - RNA, 15 nt, Human
ggcccgacagccugg

SEQ ID NO: 2008265 - RNA, 16 nt, Human
ggcccgacagccuggc

SEQ ID NO: 2008266 - RNA, 17 nt, Human
ggcccgacagccuggca

SEQ ID NO: 2008267 - RNA, 17 nt, Human
ggcagaaagcaaaauua

SEQ ID NO: 2008268 - RNA, 12 nt, Human
ggcagaaggaag

SEQ ID NO: 2008269 - RNA, 21 nt, Human
ggcagaaguaggggaagaaua

SEQ ID NO: 2008270 - RNA, 17 nt, Human
ggcagccaggccacaag

SEQ ID NO: 2008271 - RNA, 15 nt, Human
ggcagccaggccaca

SEQ ID NO: 2008272 - RNA, 10 nt, Human
ggcagagcag

SEQ ID NO: 2008273 - RNA, 14 nt, Human
ggcagccaggccac

SEQ ID NO: 2008274 - RNA, 19 nt, Human
ggcagccgugccuucagcu

SEQ ID NO: 2008275 - RNA, 21 nt, Human
ggcagccgugccuucagcucu

SEQ ID NO: 2008276 - RNA, 18 nt, Human
ggcagccgugccuucagc

SEQ ID NO: 2008277 - RNA, 16 nt, Human
ggcagagaggcugugg

SEQ ID NO: 2008278 - RNA, 13 nt, Human
ggcagagcacagc

SEQ ID NO: 2008279 - RNA, 19 nt, Human
ggcaggacacugcagaaca

SEQ ID NO: 2008280 - RNA, 13 nt, Human
ggcaggaccagcc

SEQ ID NO: 2008281 - RNA, 14 nt, Human
ggcaggaccagccc

SEQ ID NO: 2008282 - RNA, 15 nt, Human
ggcaggaccagccca

SEQ ID NO: 2008283 - RNA, 16 nt, Human
ggcaggaccagcccac

SEQ ID NO: 2008284 - RNA, 17 nt, Human
ggcaggaccagcccacg

SEQ ID NO: 2008285 - RNA, 18 nt, Human
ggcaggaccagcccacgc

SEQ ID NO: 2008286 - RNA, 19 nt, Human
ggcaggaccagcccacgcu

SEQ ID NO: 2008287 - RNA, 22 nt, Human
ggcagccgugccuucagcucua

SEQ ID NO: 2008288 - RNA, 21 nt, Human
ggcaggaccuucgggcugugc

SEQ ID NO: 2008289 - RNA, 23 nt, Human
ggcaggaccuucgggcugugccc

SEQ ID NO: 2008290 - RNA, 23 nt, Human
ggcaggagacuguggagacugcu

SEQ ID NO: 2008291 - RNA, 11 nt, Human
ggcaggcaggg

SEQ ID NO: 2008292 - RNA, 10 nt, Human
ggcaggcagg

SEQ ID NO: 2008293 - RNA, 21 nt, Human
ggaugacaugcacucagcucu

SEQ ID NO: 2008294 - RNA, 21 nt, Human
ggaugaauuccaaauucugcu

SEQ ID NO: 2008295 - RNA, 12 nt, Human
ggaugagaaagg

SEQ ID NO: 2008296 - RNA, 22 nt, Human
ggaugagaaagguugaagcacc

SEQ ID NO: 2008297 - RNA, 16 nt, Human
ggaugugcugcagugc

SEQ ID NO: 2008298 - RNA, 16 nt, Human
ggaugugguggcagug

SEQ ID NO: 2008299 - RNA, 21 nt, Human
ggauuuugauccaagcugguc

SEQ ID NO: 2008300 - RNA, 16 nt, Human
ggauuuuauguugaca

SEQ ID NO: 2008301 - RNA, 21 nt, Human
ggauuuuauguugacauuugu

SEQ ID NO: 2008302 - RNA, 17 nt, Human
ggauuuggagagaaaua

SEQ ID NO: 2008303 - RNA, 18 nt, Human
ggauuuggagagaaauau

SEQ ID NO: 2008304 - RNA, 15 nt, Human
ggauuuuauguugac

SEQ ID NO: 2008305 - RNA, 23 nt, Human
ggauuaaacuuaaucuaaaugga

SEQ ID NO: 2008306 - RNA, 17 nt, Human
ggcaaacauuugaagga

SEQ ID NO: 2008307 - RNA, 21 nt, Human
ggcaaacauuuucucuuagaa

SEQ ID NO: 2008308 - RNA, 22 nt, Human
ggcaaacauuuucucuuagaaa

SEQ ID NO: 2008309 - RNA, 13 nt, Human
ggcaaagcuguuc

SEQ ID NO: 2008310 - RNA, 20 nt, Human
ggcaaagagacccagucaau

SEQ ID NO: 2008311 - RNA, 20 nt, Human
ggcaaagcagcaacacacau

SEQ ID NO: 2008312 - RNA, 16 nt, Human
ggcaaagggggaggag

SEQ ID NO: 2008313 - RNA, 17 nt, Human
ggcaaauccgaaaucag

SEQ ID NO: 2008314 - RNA, 20 nt, Human
ggcaaauccgaaaucagcag

SEQ ID NO: 2008315 - RNA, 16 nt, Human
ggcaacaaacugcaca

SEQ ID NO: 2008316 - RNA, 18 nt, Human
ggcaacaaacugcacaug

SEQ ID NO: 2008317 - RNA, 10 nt, Human
aaaaaaaaga

SEQ ID NO: 2008318 - RNA, 13 nt, Human
aaaaaaaaagaaa

SEQ ID NO: 2008319 - RNA, 20 nt, Human
aaaaagcuccaaaugcagcu

SEQ ID NO: 2008320 - RNA, 19 nt, Human
aaaaagcuauaaauuauau

SEQ ID NO: 2008321 - RNA, 12 nt, Human
aaaaaguauugc

SEQ ID NO: 2008322 - RNA, 15 nt, Human
aaaaaguauugccaa

SEQ ID NO: 2008323 - RNA, 19 nt, Human
aaaaaguaggaaaugaaug

SEQ ID NO: 2008324 - RNA, 14 nt, Human
aaaaagucuuuuaa

SEQ ID NO: 2008325 - RNA, 15 nt, Human
aaaaagucuuuuaaa

SEQ ID NO: 2008326 - RNA, 16 nt, Human
aaaaaguauugccaaa

SEQ ID NO: 2008327 - RNA, 20 nt, Human
aaaaaguauugccaaacauu

SEQ ID NO: 2008328 - RNA, 21 nt, Human
aaaaaguauugccaaacauua

SEQ ID NO: 2008329 - RNA, 11 nt, Human
aaaaaaaagaa

SEQ ID NO: 2008330 - RNA, 13 nt, Human
aaaaaaaacucuu

SEQ ID NO: 2008331 - RNA, 12 nt, Human
aaaaaagaaaga

SEQ ID NO: 2008332 - RNA, 13 nt, Human
aaaaaaacacaaa

SEQ ID NO: 2008333 - RNA, 12 nt, Human
aaaaaaguugua

SEQ ID NO: 2008334 - RNA, 18 nt, Human
aaaaaaggaugcaacaau

SEQ ID NO: 2008335 - RNA, 19 nt, Human
aaaaagcuagucaacagua

SEQ ID NO: 2008336 - RNA, 19 nt, Human
ggcuguaucccaugagccu

SEQ ID NO: 2008337 - RNA, 16 nt, Human
ggcuggugucaccuga

SEQ ID NO: 2008338 - RNA, 22 nt, Human
ggcugucaguguuuggugcacg

SEQ ID NO: 2008339 - RNA, 14 nt, Human
ggcuguccacccgc

SEQ ID NO: 2008340 - RNA, 15 nt, Human
ggcuucaguggcagc

SEQ ID NO: 2008341 - RNA, 20 nt, Human
ggcuguaucccaugagccuc

SEQ ID NO: 2008342 - RNA, 22 nt, Human
ggcuguaucccaugagccucag

SEQ ID NO: 2008343 - RNA, 15 nt, Human
ggcugucaauuacag

SEQ ID NO: 2008344 - RNA, 23 nt, Human
ggcuguaucccaugagccucagc

SEQ ID NO: 2008345 - RNA, 16 nt, Human
ggcuucaguggcagcu

SEQ ID NO: 2008346 - RNA, 22 nt, Human
ggcuucagggugggaguaguug

SEQ ID NO: 2008347 - RNA, 23 nt, Human
ggcuucccaaaugugugcccagc

SEQ ID NO: 2008348 - RNA, 17 nt, Human
ggcuuccugaggggaga

SEQ ID NO: 2008349 - RNA, 20 nt, Human
ggcuuccugaggggagacag

SEQ ID NO: 2008350 - RNA, 13 nt, Human
gggaaaaucagcc

SEQ ID NO: 2008351 - RNA, 17 nt, Human
ggcuuuuguuuugcuuu

SEQ ID NO: 2008352 - RNA, 13 nt, Human
gggaaaagcagcu

SEQ ID NO: 2008353 - RNA, 20 nt, Human
gggaaaaaguugaugucaau

SEQ ID NO: 2008354 - RNA, 22 nt, Human
gggaaaauaaaaaaagaaaaaa

SEQ ID NO: 2008355 - RNA, 23 nt, Human
gggaaaaucagccugcuccagcu

SEQ ID NO: 2008356 - RNA, 11 nt, Human
ggcugggaaau

SEQ ID NO: 2008357 - RNA, 22 nt, Human
ggcuggccuggccccucagggu

SEQ ID NO: 2008358 - RNA, 17 nt, Human
ggcuggccuggccccuc

SEQ ID NO: 2008359 - RNA, 13 nt, Human
ggcuggcccugcc

SEQ ID NO: 2008360 - RNA, 14 nt, Human
ggcuggcccugccc

SEQ ID NO: 2008361 - RNA, 15 nt, Human
ggcuggcccugcccu

SEQ ID NO: 2008362 - RNA, 14 nt, Human
ggcuggcgugcagu

SEQ ID NO: 2008363 - RNA, 16 nt, Human
ggcuggcccugcccug

SEQ ID NO: 2008364 - RNA, 16 nt, Human
ggcuggcgugcagugg

SEQ ID NO: 2008365 - RNA, 20 nt, Human
ggcuggcgugcaguggugcg

SEQ ID NO: 2008366 - RNA, 17 nt, Human
ggcuggaucugugaggg

SEQ ID NO: 2008367 - RNA, 17 nt, Human
ggcuggaguuggggcag

SEQ ID NO: 2008368 - RNA, 22 nt, Human
ggcuggaguuggggcagaggag

SEQ ID NO: 2008369 - RNA, 16 nt, Human
ggcucccuucccaccu

SEQ ID NO: 2008370 - RNA, 18 nt, Human
ggcucccuucccaccucu

SEQ ID NO: 2008371 - RNA, 17 nt, Human
ggcucccuucccaccuc

SEQ ID NO: 2008372 - RNA, 22 nt, Human
ggcucccuucccaccucucuca

SEQ ID NO: 2008373 - RNA, 20 nt, Human
ggcucccuucccaccucucu

SEQ ID NO: 2008374 - RNA, 17 nt, Human
ggcuccucccggugccc

SEQ ID NO: 2008375 - RNA, 12 nt, Human
ggcuccugccac

SEQ ID NO: 2008376 - RNA, 13 nt, Human
ggcuccugccacc

SEQ ID NO: 2008377 - RNA, 12 nt, Human
ggcuccugccca

SEQ ID NO: 2008378 - RNA, 12 nt, Human
ggcuccugcccc

SEQ ID NO: 2008379 - RNA, 15 nt, Human
ggcuccugcccccau

SEQ ID NO: 2008380 - RNA, 20 nt, Human
ggcucuuccaggcugggaga

SEQ ID NO: 2008381 - RNA, 24 nt, Human
ggcucuuccaggcugggagagccu

SEQ ID NO: 2008382 - RNA, 23 nt, Human
ggcucuuccaggcugggagagcc

SEQ ID NO: 2008383 - RNA, 18 nt, Human
ggcucgagcaugccugga

SEQ ID NO: 2008384 - RNA, 17 nt, Human
ggcugcagggaguccga

SEQ ID NO: 2008385 - RNA, 20 nt, Human
ggcugcaugcgggcuuccuc

SEQ ID NO: 2008386 - RNA, 22 nt, Human
ggcugcaugcgggcuuccuccu

SEQ ID NO: 2008387 - RNA, 18 nt, Human
aaaacauuuggcagaaaa

SEQ ID NO: 2008388 - RNA, 19 nt, Human
aaaaauuauugauugcuuu

SEQ ID NO: 2008389 - RNA, 15 nt, Human
aaaaccaauguucuc

SEQ ID NO: 2008390 - RNA, 20 nt, Human
aaaaccaaaaguuauuaaaa

SEQ ID NO: 2008391 - RNA, 23 nt, Human
aaaaccaaaaguuauuaaaauug

SEQ ID NO: 2008392 - RNA, 18 nt, Human
aaaacguggcugcuucaa

SEQ ID NO: 2008393 - RNA, 17 nt, Human
aaaacguggcugcuuca

SEQ ID NO: 2008394 - RNA, 16 nt, Human
aaaacguggcugcuuc

SEQ ID NO: 2008395 - RNA, 14 nt, Human
aaaacguggcugcu

SEQ ID NO: 2008396 - RNA, 13 nt, Human
aaaacuaaguucu

SEQ ID NO: 2008397 - RNA, 14 nt, Human
aaaacuacuuagca

SEQ ID NO: 2008398 - RNA, 15 nt, Human
aaaaauucaauagua

SEQ ID NO: 2008399 - RNA, 21 nt, Human
aaaacguggcugcuucaagga

SEQ ID NO: 2008400 - RNA, 19 nt, Human
aaaaccaagccguggcuuc

SEQ ID NO: 2008401 - RNA, 22 nt, Human
aaaacugauuuuuuuuuccuuc

SEQ ID NO: 2008402 - RNA, 18 nt, Human
aaaacugauuuuuuuuuc

SEQ ID NO: 2008403 - RNA, 20 nt, Human
aaaacugcugacuguuuucu

SEQ ID NO: 2008404 - RNA, 19 nt, Human
aaaacugcucauaugaugu

SEQ ID NO: 2008405 - RNA, 23 nt, Human
aaaaaucugaagauuguuuaucu

SEQ ID NO: 2008406 - RNA, 15 nt, Human
aaaaaucuuaauacu

SEQ ID NO: 2008407 - RNA, 18 nt, Human
aaaaaucuuaauacuguu

SEQ ID NO: 2008408 - RNA, 13 nt, Human
aaaaaucugaaga

SEQ ID NO: 2008409 - RNA, 14 nt, Human
aaaaaucugaagau

SEQ ID NO: 2008410 - RNA, 17 nt, Human
aaaaaucugaagauugu

SEQ ID NO: 2008411 - RNA, 20 nt, Human
aaaaaucugaagauuguuua

SEQ ID NO: 2008412 - RNA, 21 nt, Human
aaaaaucugaagauuguuuau

SEQ ID NO: 2008413 - RNA, 19 nt, Human
aaaaaucuuaauacuguua

SEQ ID NO: 2008414 - RNA, 23 nt, Human
aaaaaugucaaaaguagaacuuu

SEQ ID NO: 2008415 - RNA, 18 nt, Human
aaaaaugucaaaaguaga

SEQ ID NO: 2008416 - RNA, 13 nt, Human
aaaaauuacaguu

SEQ ID NO: 2008417 - RNA, 18 nt, Human
aaaaauguuaagcaucua

SEQ ID NO: 2008418 - RNA, 22 nt, Human
aaaaauguuaagcaucuaagga

SEQ ID NO: 2008419 - RNA, 14 nt, Human
gggaacagacugga

SEQ ID NO: 2008420 - RNA, 18 nt, Human
gggaaaugcugauuuaaa

SEQ ID NO: 2008421 - RNA, 23 nt, Human
gggaaaucgagugccgcaucuca

SEQ ID NO: 2008422 - RNA, 21 nt, Human
gggaaaguauucucuuuucaa

SEQ ID NO: 2008423 - RNA, 21 nt, Human
gggaaagccuuaagcugcagg

SEQ ID NO: 2008424 - RNA, 19 nt, Human
aaaaaucucaaauuucuaa

SEQ ID NO: 2008425 - RNA, 20 nt, Human
aaaaaucucaaauuucuaaa

SEQ ID NO: 2008426 - RNA, 17 nt, Human
aaaaaucucaaauuucu

SEQ ID NO: 2008427 - RNA, 22 nt, Human
gggaacagacuggaagcacagc

SEQ ID NO: 2008428 - RNA, 22 nt, Human
aaaacuugauguguuaucucuu

SEQ ID NO: 2008429 - RNA, 17 nt, Human
aaaacuacuuagcacuu

SEQ ID NO: 2008430 - RNA, 21 nt, Human
aaaacuuuaugcuaagugaaa

SEQ ID NO: 2008431 - RNA, 18 nt, Human
aaaagccuguuuaagaga

SEQ ID NO: 2008432 - RNA, 16 nt, Human
aaaagccuguuuaaga

SEQ ID NO: 2008433 - RNA, 20 nt, Human
aaaagcgacccauucagaga

SEQ ID NO: 2008434 - RNA, 11 nt, Human
aaaagccuugg

SEQ ID NO: 2008435 - RNA, 14 nt, Human
aaaagccuuggccu

SEQ ID NO: 2008436 - RNA, 13 nt, Human
aaaagcugcucag

SEQ ID NO: 2008437 - RNA, 18 nt, Human
aaaagcugaacacauuuc

SEQ ID NO: 2008438 - RNA, 19 nt, Human
aaaagcugaacacauuucu

SEQ ID NO: 2008439 - RNA, 20 nt, Human
aaaagcugaacacauuucuu

SEQ ID NO: 2008440 - RNA, 16 nt, Human
aaaagcugaacacauu

SEQ ID NO: 2008441 - RNA, 17 nt, Human
aaaagcuucccucccug

SEQ ID NO: 2008442 - RNA, 14 nt, Human
aaaagcugggcagg

SEQ ID NO: 2008443 - RNA, 17 nt, Human
aaaagcuagaacacugc

SEQ ID NO: 2008444 - RNA, 16 nt, Human
aaaagcuauaaauuau

SEQ ID NO: 2008445 - RNA, 22 nt, Human
aaaagcuccauuuuuagugaaa

SEQ ID NO: 2008446 - RNA, 20 nt, Human
gggaggcagagguugcagug

SEQ ID NO: 2008447 - RNA, 19 nt, Human
gggaggccaagaguggccc

SEQ ID NO: 2008448 - RNA, 22 nt, Human
gggaggccaagaguggccccac

SEQ ID NO: 2008449 - RNA, 23 nt, Human
gggaggccaagaguggccccacc

SEQ ID NO: 2008450 - RNA, 13 nt, Human
gggagggcuccag

SEQ ID NO: 2008451 - RNA, 11 nt, Human
gggagggcucc

SEQ ID NO: 2008452 - RNA, 13 nt, Human
gggagggccuggg

SEQ ID NO: 2008453 - RNA, 11 nt, Human
gggaggcagag

SEQ ID NO: 2008454 - RNA, 14 nt, Human
gggagacuuugaug

SEQ ID NO: 2008455 - RNA, 12 nt, Human
aaaauagccugc

SEQ ID NO: 2008456 - RNA, 14 nt, Human
aaaauaguuuauuu

SEQ ID NO: 2008457 - RNA, 13 nt, Human
aaaauaguuuauu

SEQ ID NO: 2008458 - RNA, 18 nt, Human
aaaauaguggugugauuu

SEQ ID NO: 2008459 - RNA, 18 nt, Human
aaaauauauaucaaauau

SEQ ID NO: 2008460 - RNA, 13 nt, Human
aaaauauguauua

SEQ ID NO: 2008461 - RNA, 13 nt, Human
aaaauauagcuaa

SEQ ID NO: 2008462 - RNA, 11 nt, Human
aaaauauacau

SEQ ID NO: 2008463 - RNA, 14 nt, Human
aaaauauacauguu

SEQ ID NO: 2008464 - RNA, 15 nt, Human
aaaaguagaacuuug

SEQ ID NO: 2008465 - RNA, 13 nt, Human
aaaaguagaacuu

SEQ ID NO: 2008466 - RNA, 13 nt, Human
aaaaguaauauuu

SEQ ID NO: 2008467 - RNA, 15 nt, Human
aaaaguaauauuuau

SEQ ID NO: 2008468 - RNA, 17 nt, Human
aaaaguagaacuuugua

SEQ ID NO: 2008469 - RNA, 11 nt, Human
aaaauaaagca

SEQ ID NO: 2008470 - RNA, 13 nt, Human
aaaauaaagcaag

SEQ ID NO: 2008471 - RNA, 12 nt, Human
aaaauaaauuau

SEQ ID NO: 2008472 - RNA, 13 nt, Human
aaaauaaauugga

SEQ ID NO: 2008473 - RNA, 14 nt, Human
aaaauaccagccag

SEQ ID NO: 2008474 - RNA, 14 nt, Human
aaaauaccaaggaa

SEQ ID NO: 2008475 - RNA, 15 nt, Human
aaaauaccagccagu

SEQ ID NO: 2008476 - RNA, 14 nt, Human
aaaauacucuuuuu

SEQ ID NO: 2008477 - RNA, 16 nt, Human
aaaagggacugagaaa

SEQ ID NO: 2008478 - RNA, 17 nt, Human
aaaaggcuuauaaaaca

SEQ ID NO: 2008479 - RNA, 19 nt, Human
aaaaggcuuauaaaacaga

SEQ ID NO: 2008480 - RNA, 20 nt, Human
aaaaggcuuauaaaacagag

SEQ ID NO: 2008481 - RNA, 15 nt, Human
gggcaggaccagccc

SEQ ID NO: 2008482 - RNA, 16 nt, Human
gggcaggaccagccca

SEQ ID NO: 2008483 - RNA, 17 nt, Human
gggcaggaccagcccac

SEQ ID NO: 2008484 - RNA, 18 nt, Human
gggcaggaccagcccacg

SEQ ID NO: 2008485 - RNA, 21 nt, Human
gggcaggaccagcccacgcug

SEQ ID NO: 2008486 - RNA, 22 nt, Human
gggcaggacagguccucccugc

SEQ ID NO: 2008487 - RNA, 13 nt, Human
gggcaggaccagc

SEQ ID NO: 2008488 - RNA, 14 nt, Human
gggcaggaccagcc

SEQ ID NO: 2008489 - RNA, 16 nt, Human
gggaggggagacuuug

SEQ ID NO: 2008490 - RNA, 15 nt, Human
gggauuuccaugaug

SEQ ID NO: 2008491 - RNA, 23 nt, Human
gggcagagcagagaccaucccug

SEQ ID NO: 2008492 - RNA, 23 nt, Human
gggauuuguugauucucuccauu

SEQ ID NO: 2008493 - RNA, 10 nt, Human
ggucuuugag

SEQ ID NO: 2008494 - RNA, 20 nt, Human
ggucuugguuccagccugcc

SEQ ID NO: 2008495 - RNA, 21 nt, Human
ggucuugguuccagccugcca

SEQ ID NO: 2008496 - RNA, 19 nt, Human
ggucuugcaaaauuccuga

SEQ ID NO: 2008497 - RNA, 16 nt, Human
ggucuugcauuuaaaa

SEQ ID NO: 2008498 - RNA, 21 nt, Human
ggugauccacucgccuucauc

SEQ ID NO: 2008499 - RNA, 22 nt, Human
ggucuuuuccucgcuucuuuca

SEQ ID NO: 2008500 - RNA, 17 nt, Human
ggucuuugagcucccac

SEQ ID NO: 2008501 - RNA, 22 nt, Human
ggugcacaagcuccaagcuccc

SEQ ID NO: 2008502 - RNA, 16 nt, Human
ggugcacaagcuccaa

SEQ ID NO: 2008503 - RNA, 22 nt, Human
ggugauguugacaucacuggca

SEQ ID NO: 2008504 - RNA, 22 nt, Human
ggugcacgcuggggaagaauuu

SEQ ID NO: 2008505 - RNA, 23 nt, Human
ggugcacuuggggcacagggaga

SEQ ID NO: 2008506 - RNA, 19 nt, Human
ggugcagacaaucuucugu

SEQ ID NO: 2008507 - RNA, 14 nt, Human
ggucuggaggaccu

SEQ ID NO: 2008508 - RNA, 19 nt, Human
ggucuggaggaccugcccg

SEQ ID NO: 2008509 - RNA, 19 nt, Human
ggucugcugccucaggaau

SEQ ID NO: 2008510 - RNA, 16 nt, Human
aaagauuuugaucuca

SEQ ID NO: 2008511 - RNA, 22 nt, Human
aaagauuuugaucucacauuuu

SEQ ID NO: 2008512 - RNA, 14 nt, Human
ggucugugagaugc

SEQ ID NO: 2008513 - RNA, 24 nt, Human
ggucugugagaugcuagaacuccc

SEQ ID NO: 2008514 - RNA, 12 nt, Human
ggucuguucuuu

SEQ ID NO: 2008515 - RNA, 17 nt, Human
ggucuguucuuuccaaa

SEQ ID NO: 2008516 - RNA, 19 nt, Human
ggucuguucuuuccaaagu

SEQ ID NO: 2008517 - RNA, 21 nt, Human
ggucuugaacuccuggccuca

SEQ ID NO: 2008518 - RNA, 22 nt, Human
ggucuugaacuccuggccucaa

SEQ ID NO: 2008519 - RNA, 19 nt, Human
aaagcggacaucagcuggu

SEQ ID NO: 2008520 - RNA, 22 nt, Human
aaagcaccaaaauaagaaaaga

SEQ ID NO: 2008521 - RNA, 18 nt, Human
aaagcggguuauaaugaa

SEQ ID NO: 2008522 - RNA, 23 nt, Human
aaagcaccaaaauaagaaaagau

SEQ ID NO: 2008523 - RNA, 22 nt, Human
aaagcagugcaugcugucccuu

SEQ ID NO: 2008524 - RNA, 21 nt, Human
aaagcagugcaugcugucccu

SEQ ID NO: 2008525 - RNA, 16 nt, Human
aaagcuacuuauugua

SEQ ID NO: 2008526 - RNA, 17 nt, Human
aaagcuacuuauuguag

SEQ ID NO: 2008527 - RNA, 18 nt, Human
aaagcuaggccuggccag

SEQ ID NO: 2008528 - RNA, 20 nt, Human
aaagcacacucauccccuca

SEQ ID NO: 2008529 - RNA, 20 nt, Human
ggugcccagaaugaggcugc

SEQ ID NO: 2008530 - RNA, 16 nt, Human
ggugccaucagugccc

SEQ ID NO: 2008531 - RNA, 22 nt, Human
ggugccaugucagcgcucuggu

SEQ ID NO: 2008532 - RNA, 17 nt, Human
aaagcagugcaugcugu

SEQ ID NO: 2008533 - RNA, 18 nt, Human
aaagcaccaaaauaagaa

SEQ ID NO: 2008534 - RNA, 19 nt, Human
aaagcaccaaaauaagaaa

SEQ ID NO: 2008535 - RNA, 20 nt, Human
aaagcaccaaaauaagaaaa

SEQ ID NO: 2008536 - RNA, 21 nt, Human
aaagcaccaaaauaagaaaag

SEQ ID NO: 2008537 - RNA, 13 nt, Human
aaagcacaaagga

SEQ ID NO: 2008538 - RNA, 16 nt, Human
aaagcaccaaaauaag

SEQ ID NO: 2008539 - RNA, 17 nt, Human
aaagcaccaaaauaaga

SEQ ID NO: 2008540 - RNA, 11 nt, Human
aaaggaaagag

SEQ ID NO: 2008541 - RNA, 13 nt, Human
aaaggaauuuaaa

SEQ ID NO: 2008542 - RNA, 19 nt, Human
aaagcuagucaacaguacc

SEQ ID NO: 2008543 - RNA, 13 nt, Human
aaagcuucugugg

SEQ ID NO: 2008544 - RNA, 13 nt, Human
aaagcuucccucc

SEQ ID NO: 2008545 - RNA, 16 nt, Human
aaagcuucccucccug

SEQ ID NO: 2008546 - RNA, 20 nt, Human
aaagcuucccucccugcugu

SEQ ID NO: 2008547 - RNA, 12 nt, Human
aaagcuucugug

SEQ ID NO: 2008548 - RNA, 14 nt, Human
aaagagacaggcag

SEQ ID NO: 2008549 - RNA, 12 nt, Human
aaagagaaaaga

SEQ ID NO: 2008550 - RNA, 13 nt, Human
aaagagaaaagaa

SEQ ID NO: 2008551 - RNA, 14 nt, Human
aaagagaaaagaaa

SEQ ID NO: 2008552 - RNA, 19 nt, Human
aaagacuuuuccaacccuc

SEQ ID NO: 2008553 - RNA, 15 nt, Human
aaagacuguacaaag

SEQ ID NO: 2008554 - RNA, 14 nt, Human
aaagacaaauagua

SEQ ID NO: 2008555 - RNA, 17 nt, Human
aaagaauggaaggugga

SEQ ID NO: 2008556 - RNA, 13 nt, Human
aaagaauguaaag

SEQ ID NO: 2008557 - RNA, 13 nt, Human
aaagaauuuguca

SEQ ID NO: 2008558 - RNA, 16 nt, Human
aaagaauuuuuggugu

SEQ ID NO: 2008559 - RNA, 11 nt, Human
aaagacaaaua

SEQ ID NO: 2008560 - RNA, 12 nt, Human
aaagacaaauag

SEQ ID NO: 2008561 - RNA, 18 nt, Human
aaagaggcuaugugagca

SEQ ID NO: 2008562 - RNA, 13 nt, Human
aaagaggcuaugu

SEQ ID NO: 2008563 - RNA, 15 nt, Human
aaagaugagugagca

SEQ ID NO: 2008564 - RNA, 20 nt, Human
aaagaggcaguugcccagcc

SEQ ID NO: 2008565 - RNA, 21 nt, Human
aaagaggccaaacaggcccuc

SEQ ID NO: 2008566 - RNA, 16 nt, Human
aaagauguucuggaua

SEQ ID NO: 2008567 - RNA, 12 nt, Human
aaagauguagca

SEQ ID NO: 2008568 - RNA, 14 nt, Human
aaagauguagcaaa

SEQ ID NO: 2008569 - RNA, 15 nt, Human
aaagauguagcaaac

SEQ ID NO: 2008570 - RNA, 14 nt, Human
aaagaugcaaugua

SEQ ID NO: 2008571 - RNA, 20 nt, Human
aaagaugagcuuugucuacu

SEQ ID NO: 2008572 - RNA, 20 nt, Human
ggucaugaugcucuuuccca

SEQ ID NO: 2008573 - RNA, 18 nt, Human
ggucaugaugcucuuucc

SEQ ID NO: 2008574 - RNA, 19 nt, Human
ggucaugaugcucuuuccc

SEQ ID NO: 2008575 - RNA, 20 nt, Human
ggucauuaaggccacaucca

SEQ ID NO: 2008576 - RNA, 20 nt, Human
ggucauuuccauguaugcau

SEQ ID NO: 2008577 - RNA, 21 nt, Human
ggucauuuccauguaugcaua

SEQ ID NO: 2008578 - RNA, 19 nt, Human
gguccacccaggagccccg

SEQ ID NO: 2008579 - RNA, 23 nt, Human
gguauuggcuagagguucaaaga

SEQ ID NO: 2008580 - RNA, 18 nt, Human
gguauuaagauuauaauu

SEQ ID NO: 2008581 - RNA, 18 nt, Human
gguauaaguggugugugu

SEQ ID NO: 2008582 - RNA, 13 nt, Human
gguaguucaagaa

SEQ ID NO: 2008583 - RNA, 14 nt, Human
gguaguucaagaaa

SEQ ID NO: 2008584 - RNA, 19 nt, Human
gguaguucaagaaaugaag

SEQ ID NO: 2008585 - RNA, 22 nt, Human
gguaguucaagaaaugaagagc

SEQ ID NO: 2008586 - RNA, 13 nt, Human
gguaguuucugug

SEQ ID NO: 2008587 - RNA, 14 nt, Human
gguagucaaaggca

SEQ ID NO: 2008588 - RNA, 22 nt, Human
aaacuguacuuugauucacaug

SEQ ID NO: 2008589 - RNA, 12 nt, Human
aaacuguacuuu

SEQ ID NO: 2008590 - RNA, 14 nt, Human
aaacuguacuuuga

SEQ ID NO: 2008591 - RNA, 15 nt, Human
aaacuguacuuugau

SEQ ID NO: 2008592 - RNA, 18 nt, Human
aaacuguacuuugauuca

SEQ ID NO: 2008593 - RNA, 20 nt, Human
aaacuguacuuugauucaca

SEQ ID NO: 2008594 - RNA, 21 nt, Human
aaacuguacuuugauucacau

SEQ ID NO: 2008595 - RNA, 14 nt, Human
aaacuuuaccuuuu

SEQ ID NO: 2008596 - RNA, 16 nt, Human
aaacuuguucuuccaa

SEQ ID NO: 2008597 - RNA, 15 nt, Human
aaacuuguugaauuu

SEQ ID NO: 2008598 - RNA, 12 nt, Human
ggucccacccca

SEQ ID NO: 2008599 - RNA, 20 nt, Human
gguccacccaggagccccga

SEQ ID NO: 2008600 - RNA, 22 nt, Human
gguccacccaggagccccgagg

SEQ ID NO: 2008601 - RNA, 20 nt, Human
gguccacuuuuccaguauuu

SEQ ID NO: 2008602 - RNA, 23 nt, Human
ggggcccugccuccuuugugagg

SEQ ID NO: 2008603 - RNA, 19 nt, Human
ggggcccugccuccuuugu

SEQ ID NO: 2008604 - RNA, 16 nt, Human
ggggcccugccuccuu

SEQ ID NO: 2008605 - RNA, 19 nt, Human
ggggccaguuggucccccu

SEQ ID NO: 2008606 - RNA, 17 nt, Human
ggggccaguuggucccc

SEQ ID NO: 2008607 - RNA, 16 nt, Human
ggggccaggcuggguc

SEQ ID NO: 2008608 - RNA, 14 nt, Human
ggggccaggcuggg

SEQ ID NO: 2008609 - RNA, 13 nt, Human
ggggccaggcugg

SEQ ID NO: 2008610 - RNA, 24 nt, Human
ggggaaaaucagccugcuccagcu

SEQ ID NO: 2008611 - RNA, 16 nt, Human
ggggaacguucucuuu

SEQ ID NO: 2008612 - RNA, 21 nt, Human
ggggaaccugccaugccagga

SEQ ID NO: 2008613 - RNA, 22 nt, Human
ggggaaccugccaugccaggaa

SEQ ID NO: 2008614 - RNA, 17 nt, Human
ggggaaaggcaaggucc

SEQ ID NO: 2008615 - RNA, 22 nt, Human
ggggaaaggcaagguccggccc

SEQ ID NO: 2008616 - RNA, 17 nt, Human
ggggaccucaggccugg

SEQ ID NO: 2008617 - RNA, 16 nt, Human
ggggaccucaggccug

SEQ ID NO: 2008618 - RNA, 15 nt, Human
ggggaccucaggccu

SEQ ID NO: 2008619 - RNA, 13 nt, Human
ggggaccucaggc

SEQ ID NO: 2008620 - RNA, 15 nt, Human
aaacaauaaagcaau

SEQ ID NO: 2008621 - RNA, 19 nt, Human
aaacaagucagucauucag

SEQ ID NO: 2008622 - RNA, 15 nt, Human
aaacaagaaugaagg

SEQ ID NO: 2008623 - RNA, 23 nt, Human
aaacaagaaugaagguuuuugua

SEQ ID NO: 2008624 - RNA, 12 nt, Human
aaacaagcauau

SEQ ID NO: 2008625 - RNA, 15 nt, Human
aaacaagcauauaaa

SEQ ID NO: 2008626 - RNA, 18 nt, Human
aaacaagcauauaaaaug

SEQ ID NO: 2008627 - RNA, 20 nt, Human
aaacaagcauauaaaauggc

SEQ ID NO: 2008628 - RNA, 16 nt, Human
aaacaugcuacacacu

SEQ ID NO: 2008629 - RNA, 22 nt, Human
aaacaugcuacacacugcaugu

SEQ ID NO: 2008630 - RNA, 16 nt, Human
aaacauacgugugcau

SEQ ID NO: 2008631 - RNA, 14 nt, Human
aaaauauguauuaa

SEQ ID NO: 2008632 - RNA, 20 nt, Human
aaaauaugucccagaaaugu

SEQ ID NO: 2008633 - RNA, 12 nt, Human
aaaauaugugaa

SEQ ID NO: 2008634 - RNA, 13 nt, Human
aaaauaugugaag

SEQ ID NO: 2008635 - RNA, 18 nt, Human
aaaauaugugaaggaccu

SEQ ID NO: 2008636 - RNA, 12 nt, Human
aaaauggaauac

SEQ ID NO: 2008637 - RNA, 21 nt, Human
aaaauggacguguuaugacuc

SEQ ID NO: 2008638 - RNA, 19 nt, Human
aaaauggcaacaaacugca

SEQ ID NO: 2008639 - RNA, 14 nt, Human
aaaauguacaugua

SEQ ID NO: 2008640 - RNA, 21 nt, Human
aaaauguaggguuauaauaau

SEQ ID NO: 2008641 - RNA, 22 nt, Human
aaaauguacauguauuaaauua

SEQ ID NO: 2008642 - RNA, 15 nt, Human
aaaauguacauguau

SEQ ID NO: 2008643 - RNA, 16 nt, Human
aaaauguacauguauu

SEQ ID NO: 2008644 - RNA, 18 nt, Human
aaaauguacauguauuaa

SEQ ID NO: 2008645 - RNA, 21 nt, Human
aaaauguacauguauuaaauu

SEQ ID NO: 2008646 - RNA, 19 nt, Human
aaaauuuuuaaucuuuaau

SEQ ID NO: 2008647 - RNA, 19 nt, Human
aaaauuuaaaaagcccaac

SEQ ID NO: 2008648 - RNA, 12 nt, Human
aaacaaaaccaa

SEQ ID NO: 2008649 - RNA, 13 nt, Human
aaacaaaaccaaa

SEQ ID NO: 2008650 - RNA, 19 nt, Human
aaacaaaagcugaacacau

SEQ ID NO: 2008651 - RNA, 23 nt, Human
aaacaaaagcugaacacauuucu

SEQ ID NO: 2008652 - RNA, 16 nt, Human
aaaauuuuuaaucuuu

SEQ ID NO: 2008653 - RNA, 15 nt, Human
aaaauuuuuaaucuu

SEQ ID NO: 2008654 - RNA, 18 nt, Human
aaaauuuaaaaagcccaa

SEQ ID NO: 2008655 - RNA, 16 nt, Human
aaaauugugauguguc

SEQ ID NO: 2008656 - RNA, 12 nt, Human
aaacaaaaggca

SEQ ID NO: 2008657 - RNA, 13 nt, Human
aaacaaagaaauu

SEQ ID NO: 2008658 - RNA, 18 nt, Human
aaacaagaccacguuucu

SEQ ID NO: 2008659 - RNA, 12 nt, Human
aaacaagaauga

SEQ ID NO: 2008660 - RNA, 20 nt, Human
aaacugggcuggaagauauu

SEQ ID NO: 2008661 - RNA, 16 nt, Human
aaacuggauuaaacuu

SEQ ID NO: 2008662 - RNA, 21 nt, Human
aaacugcccccucugcccugc

SEQ ID NO: 2008663 - RNA, 13 nt, Human
aaacugcccccuc

SEQ ID NO: 2008664 - RNA, 17 nt, Human
aaacugcccccucugcc

SEQ ID NO: 2008665 - RNA, 19 nt, Human
aaacugcccccucugcccu

SEQ ID NO: 2008666 - RNA, 20 nt, Human
aaacugcccccucugcccug

SEQ ID NO: 2008667 - RNA, 12 nt, Human
aaacugcccccu

SEQ ID NO: 2008668 - RNA, 11 nt, Human
aaacugccccc

SEQ ID NO: 2008669 - RNA, 15 nt, Human
aaacuccagaugcca

SEQ ID NO: 2008670 - RNA, 22 nt, Human
aaacuccagaugccacaaugga

SEQ ID NO: 2008671 - RNA, 15 nt, Human
aaacucauuuugcuu

SEQ ID NO: 2008672 - RNA, 20 nt, Human
aaacguggcugcuucaagga

SEQ ID NO: 2008673 - RNA, 17 nt, Human
aaacguggcugcuucaa

SEQ ID NO: 2008674 - RNA, 16 nt, Human
aaacguggcugcuuca

SEQ ID NO: 2008675 - RNA, 15 nt, Human
aaacgucuuaaauau

SEQ ID NO: 2008676 - RNA, 12 nt, Human
aaacgugaaaau

SEQ ID NO: 2008677 - RNA, 14 nt, Human
aaaccaccagaagc

SEQ ID NO: 2008678 - RNA, 21 nt, Human
aaaccacauuggagauguuua

SEQ ID NO: 2008679 - RNA, 23 nt, Human
aaacggccucacuaggcuucugg

SEQ ID NO: 2008680 - RNA, 16 nt, Human
aaacgcuucaguuguu

SEQ ID NO: 2008681 - RNA, 14 nt, Human
aaacauuaaaauau

SEQ ID NO: 2008682 - RNA, 19 nt, Human
aaacauuggaagcagguua

SEQ ID NO: 2008683 - RNA, 22 nt, Human
aaacauuggaagcagguuaaau

SEQ ID NO: 2008684 - RNA, 13 nt, Human
aaacauugcuuuu

SEQ ID NO: 2008685 - RNA, 16 nt, Human
aaacauugcuuuuaaa

SEQ ID NO: 2008686 - RNA, 13 nt, Human
aaacauuggaagc

SEQ ID NO: 2008687 - RNA, 17 nt, Human
aaacauuggaagcaggu

SEQ ID NO: 2008688 - RNA, 14 nt, Human
aaaccaagccgugg

SEQ ID NO: 2008689 - RNA, 19 nt, Human
aaaccaaaaguuauuaaaa

SEQ ID NO: 2008690 - RNA, 20 nt, Human
aaaccaaaaguuauuaaaau

SEQ ID NO: 2008691 - RNA, 22 nt, Human
aaaccaaaaguuauuaaaauug

SEQ ID NO: 2008692 - RNA, 14 nt, Human
aaaccaaagaagaa

SEQ ID NO: 2008693 - RNA, 15 nt, Human
aaaccaaagaagaaa

SEQ ID NO: 2008694 - RNA, 23 nt, Human
aaacauguuucuuuguaaugaaa

SEQ ID NO: 2008695 - RNA, 22 nt, Human
aaacauguuucuuuguaaugaa

SEQ ID NO: 2008696 - RNA, 19 nt, Human
aaacauguuucuuuguaau

SEQ ID NO: 2008697 - RNA, 20 nt, Human
aaacauguugccaaaauggu

SEQ ID NO: 2008698 - RNA, 22 nt, Human
aaacauguugccaaaauggugg

SEQ ID NO: 2008699 - RNA, 22 nt, Human
gggucucacuauguugcccagg

SEQ ID NO: 2008700 - RNA, 17 nt, Human
gggucaggccgggcaga

SEQ ID NO: 2008701 - RNA, 18 nt, Human
gggucaggccgggcagag

SEQ ID NO: 2008702 - RNA, 21 nt, Human
gggucaggccgggcagagcac

SEQ ID NO: 2008703 - RNA, 12 nt, Human
gggucucacucu

SEQ ID NO: 2008704 - RNA, 23 nt, Human
gggucucacuauguugcccaggc

SEQ ID NO: 2008705 - RNA, 23 nt, Human
ggggucuguguguuuaugugugu

SEQ ID NO: 2008706 - RNA, 23 nt, Human
ggguagcuguaaggcaugaagga

SEQ ID NO: 2008707 - RNA, 20 nt, Human
ggguaucaggugcugccauc

SEQ ID NO: 2008708 - RNA, 14 nt, Human
gggucagaagagag

SEQ ID NO: 2008709 - RNA, 19 nt, Human
ggggucucucacagacagg

SEQ ID NO: 2008710 - RNA, 23 nt, Human
ggggucucucacagacaggaccc

SEQ ID NO: 2008711 - RNA, 15 nt, Human
ggggucucucacaga

SEQ ID NO: 2008712 - RNA, 17 nt, Human
ggggucucucacagaca

SEQ ID NO: 2008713 - RNA, 15 nt, Human
ggggaagaauaauuu

SEQ ID NO: 2008714 - RNA, 20 nt, Human
ggggccuuugggugcuguuu

SEQ ID NO: 2008715 - RNA, 16 nt, Human
gacgcucucuggccuu

SEQ ID NO: 2008716 - RNA, 17 nt, Human
gacgcucucuggccuuc

SEQ ID NO: 2008717 - RNA, 15 nt, Human
gacgcucucuggccu

SEQ ID NO: 2008718 - RNA, 19 nt, Human
gacgcuacccgggaagggg

SEQ ID NO: 2008719 - RNA, 18 nt, Human
gacgcuacccgggaaggg

SEQ ID NO: 2008720 - RNA, 16 nt, Human
gacgcuacccgggaag

SEQ ID NO: 2008721 - RNA, 18 nt, Human
gacgccaucccagcccca

SEQ ID NO: 2008722 - RNA, 17 nt, Human
gacgccaucccagcccc

SEQ ID NO: 2008723 - RNA, 19 nt, Human
gaccugaggacauggcuuc

SEQ ID NO: 2008724 - RNA, 22 nt, Human
gaccugaggacauggcuucuga

SEQ ID NO: 2008725 - RNA, 16 nt, Human
gacgccaucccagccc

SEQ ID NO: 2008726 - RNA, 14 nt, Human
gaccugaggcccuu

SEQ ID NO: 2008727 - RNA, 13 nt, Human
gaccugaggcccu

SEQ ID NO: 2008728 - RNA, 11 nt, Human
gaccugaggcc

SEQ ID NO: 2008729 - RNA, 12 nt, Human
gaccucucccag

SEQ ID NO: 2008730 - RNA, 18 nt, Human
gaccucuagcccugcccg

SEQ ID NO: 2008731 - RNA, 14 nt, Human
gaccucucccaggg

SEQ ID NO: 2008732 - RNA, 14 nt, Human
gaccucugcagcaa

SEQ ID NO: 2008733 - RNA, 20 nt, Human
gaccaucccugaaggccccg

SEQ ID NO: 2008734 - RNA, 19 nt, Human
gaccaucuggaauugguuu

SEQ ID NO: 2008735 - RNA, 11 nt, Human
gacuuuauuag

SEQ ID NO: 2008736 - RNA, 13 nt, Human
gacuuuauuauuu

SEQ ID NO: 2008737 - RNA, 14 nt, Human
gacuuuauuauuua

SEQ ID NO: 2008738 - RNA, 15 nt, Human
gacuuuauuauuuau

SEQ ID NO: 2008739 - RNA, 21 nt, Human
gacuuucaaaguggaugcaau

SEQ ID NO: 2008740 - RNA, 22 nt, Human
gacuuuagccuaccuaacccag

SEQ ID NO: 2008741 - RNA, 15 nt, Human
gacuuuagcuuucug

SEQ ID NO: 2008742 - RNA, 15 nt, Human
gacucagaaacucca

SEQ ID NO: 2008743 - RNA, 16 nt, Human
gacucagaaacuccau

SEQ ID NO: 2008744 - RNA, 15 nt, Human
gacucaccuccccca

SEQ ID NO: 2008745 - RNA, 22 nt, Human
gacucaccucccccaucucuuc

SEQ ID NO: 2008746 - RNA, 12 nt, Human
gacucugccucc

SEQ ID NO: 2008747 - RNA, 16 nt, Human
gacucugccuccucuu

SEQ ID NO: 2008748 - RNA, 19 nt, Human
gacucugucucaaaaaaac

SEQ ID NO: 2008749 - RNA, 10 nt, Human
gacucuuccc

SEQ ID NO: 2008750 - RNA, 18 nt, Human
gacucuugacucuugccu

SEQ ID NO: 2008751 - RNA, 16 nt, Human
gacucuugaguuguuu

SEQ ID NO: 2008752 - RNA, 14 nt, Human
gacugaauuaugaa

SEQ ID NO: 2008753 - RNA, 14 nt, Human
gacugaauuucuuu

SEQ ID NO: 2008754 - RNA, 20 nt, Human
gacugaauuaugaaacuuuu

SEQ ID NO: 2008755 - RNA, 18 nt, Human
gacuguacuccucccagg

SEQ ID NO: 2008756 - RNA, 23 nt, Human
gacuguacuccucccaggcgccc

SEQ ID NO: 2008757 - RNA, 12 nt, Human
gacugaauucca

SEQ ID NO: 2008758 - RNA, 13 nt, Human
gacugaauuccaa

SEQ ID NO: 2008759 - RNA, 14 nt, Human
gacuuguuuuuguu

SEQ ID NO: 2008760 - RNA, 22 nt, Human
gacugugugcucaggagcccug

SEQ ID NO: 2008761 - RNA, 19 nt, Human
gacugugauuugaauccag

SEQ ID NO: 2008762 - RNA, 16 nt, Human
gacuguggagacugcu

SEQ ID NO: 2008763 - RNA, 18 nt, Human
gacuguggagacugcucc

SEQ ID NO: 2008764 - RNA, 19 nt, Human
gacuguggagacugcuccu

SEQ ID NO: 2008765 - RNA, 21 nt, Human
gacagaaagcagaacagugau

SEQ ID NO: 2008766 - RNA, 17 nt, Human
gacagcccgggcucugc

SEQ ID NO: 2008767 - RNA, 14 nt, Human
gacacagcucuucu

SEQ ID NO: 2008768 - RNA, 16 nt, Human
gacacagcucuucucc

SEQ ID NO: 2008769 - RNA, 13 nt, Human
gacacagcucuuc

SEQ ID NO: 2008770 - RNA, 17 nt, Human
gacacagcucuucucca

SEQ ID NO: 2008771 - RNA, 22 nt, Human
gacacagcucuucuccaggcug

SEQ ID NO: 2008772 - RNA, 23 nt, Human
gacacagcucuucuccaggcugu

SEQ ID NO: 2008773 - RNA, 12 nt, Human
gacacaggcccg

SEQ ID NO: 2008774 - RNA, 17 nt, Human
gacauuucuaauuccug

SEQ ID NO: 2008775 - RNA, 19 nt, Human
gacauuguuggccaaagcc

SEQ ID NO: 2008776 - RNA, 19 nt, Human
gacauuguagagcuucugg

SEQ ID NO: 2008777 - RNA, 18 nt, Human
gacauugauuugauuuuu

SEQ ID NO: 2008778 - RNA, 14 nt, Human
gacauugcggacag

SEQ ID NO: 2008779 - RNA, 15 nt, Human
gacauugcggacagc

SEQ ID NO: 2008780 - RNA, 19 nt, Human
gacagcccgggcucugccu

SEQ ID NO: 2008781 - RNA, 18 nt, Human
gacagcccgggcucugcc

SEQ ID NO: 2008782 - RNA, 20 nt, Human
gacagcccgggcucugccuc

SEQ ID NO: 2008783 - RNA, 21 nt, Human
gacagugagacucugucucag

SEQ ID NO: 2008784 - RNA, 18 nt, Human
gaccagggauuuccauga

SEQ ID NO: 2008785 - RNA, 17 nt, Human
gaccagcuuggcucagg

SEQ ID NO: 2008786 - RNA, 19 nt, Human
gaccaucccugaaggcccc

SEQ ID NO: 2008787 - RNA, 18 nt, Human
gaccaucccugaaggccc

SEQ ID NO: 2008788 - RNA, 13 nt, Human
gaccaucccugaa

SEQ ID NO: 2008789 - RNA, 12 nt, Human
gaccaucccuga

SEQ ID NO: 2008790 - RNA, 23 nt, Human
gaccagggacagauccagcaggc

SEQ ID NO: 2008791 - RNA, 20 nt, Human
gaccagggauuuccaugaug

SEQ ID NO: 2008792 - RNA, 13 nt, Human
gaccauacuaauu

SEQ ID NO: 2008793 - RNA, 23 nt, Human
gaccaucauuucaccugcugcuu

SEQ ID NO: 2008794 - RNA, 15 nt, Human
gaagcagaggaagga

SEQ ID NO: 2008795 - RNA, 23 nt, Human
gaagcacaccaaucuuacuuugu

SEQ ID NO: 2008796 - RNA, 23 nt, Human
gaagauuuugaaauuuuuauuaa

SEQ ID NO: 2008797 - RNA, 16 nt, Human
gaagacaaugacuuac

SEQ ID NO: 2008798 - RNA, 23 nt, Human
gaagacaaugugaaaagaaaaau

SEQ ID NO: 2008799 - RNA, 22 nt, Human
gaagacaaugacuuacuguaca

SEQ ID NO: 2008800 - RNA, 23 nt, Human
gaagcaacccaaauguucaucaa

SEQ ID NO: 2008801 - RNA, 20 nt, Human
gaagcaaugcuucaucccuu

SEQ ID NO: 2008802 - RNA, 20 nt, Human
gaagcacaugccucucucag

SEQ ID NO: 2008803 - RNA, 17 nt, Human
gaagcacaugccucucu

SEQ ID NO: 2008804 - RNA, 15 nt, Human
gaagcacaugccucu

SEQ ID NO: 2008805 - RNA, 22 nt, Human
gaagcacaccaaucuuacuuug

SEQ ID NO: 2008806 - RNA, 20 nt, Human
gaacucugacaacagacuuc

SEQ ID NO: 2008807 - RNA, 17 nt, Human
gaacucgguguccccac

SEQ ID NO: 2008808 - RNA, 20 nt, Human
gaacucgguguccccaccau

SEQ ID NO: 2008809 - RNA, 16 nt, Human
gaacucugccugcccu

SEQ ID NO: 2008810 - RNA, 18 nt, Human
gaacugacauuaaaauaa

SEQ ID NO: 2008811 - RNA, 17 nt, Human
gaacugcugggcuuggc

SEQ ID NO: 2008812 - RNA, 20 nt, Human
gaacugcugggcuuggcagc

SEQ ID NO: 2008813 - RNA, 16 nt, Human
gaacugcuuucuuucg

SEQ ID NO: 2008814 - RNA, 11 nt, Human
gaacuggcugc

SEQ ID NO: 2008815 - RNA, 12 nt, Human
gaacuggcugca

SEQ ID NO: 2008816 - RNA, 16 nt, Human
gaacugggcauauuuc

SEQ ID NO: 2008817 - RNA, 19 nt, Human
gaacugggcauauuucuaa

SEQ ID NO: 2008818 - RNA, 20 nt, Human
gaagaaugcaugcuuuccau

SEQ ID NO: 2008819 - RNA, 14 nt, Human
gaagaaugcaugcu

SEQ ID NO: 2008820 - RNA, 14 nt, Human
gaagaaugaagccc

SEQ ID NO: 2008821 - RNA, 12 nt, Human
gaagaauuuaaa

SEQ ID NO: 2008822 - RNA, 13 nt, Human
gaagaauuuaaag

SEQ ID NO: 2008823 - RNA, 16 nt, Human
gaaguuauguguaugu

SEQ ID NO: 2008824 - RNA, 20 nt, Human
gaaguuauguguaugugagu

SEQ ID NO: 2008825 - RNA, 15 nt, Human
gaaguucaagaucaa

SEQ ID NO: 2008826 - RNA, 13 nt, Human
gaaguuauauuuc

SEQ ID NO: 2008827 - RNA, 21 nt, Human
gaaguuauauuuccuauacca

SEQ ID NO: 2008828 - RNA, 18 nt, Human
gaaguucugccucugaug

SEQ ID NO: 2008829 - RNA, 14 nt, Human
gaaguucuuugauu

SEQ ID NO: 2008830 - RNA, 21 nt, Human
gaaguugacucugcucuugca

SEQ ID NO: 2008831 - RNA, 17 nt, Human
gaaguucugccucugau

SEQ ID NO: 2008832 - RNA, 16 nt, Human
gaaguugaucucccca

SEQ ID NO: 2008833 - RNA, 19 nt, Human
gaauagggcuaggaauaua

SEQ ID NO: 2008834 - RNA, 14 nt, Human
gaaguuuaaauauu

SEQ ID NO: 2008835 - RNA, 21 nt, Human
gaagugugggucugugugugu

SEQ ID NO: 2008836 - RNA, 24 nt, Human
gaagugugggucugugugugugua

SEQ ID NO: 2008837 - RNA, 18 nt, Human
gaaggggacugccaccuc

SEQ ID NO: 2008838 - RNA, 19 nt, Human
gaaggggacugccaccucc

SEQ ID NO: 2008839 - RNA, 15 nt, Human
gaaggggacugccac

SEQ ID NO: 2008840 - RNA, 22 nt, Human
gaaggggagauaaggguaucug

SEQ ID NO: 2008841 - RNA, 15 nt, Human
gaaguuaaagggaag

SEQ ID NO: 2008842 - RNA, 21 nt, Human
gaaguuaaagggaagaaaaca

SEQ ID NO: 2008843 - RNA, 20 nt, Human
gaaguuaaaagcacaaagga

SEQ ID NO: 2008844 - RNA, 12 nt, Human
gaaguuaaaggg

SEQ ID NO: 2008845 - RNA, 21 nt, Human
gaaguuacuguuacuugauaa

SEQ ID NO: 2008846 - RNA, 11 nt, Human
gaaguuagccu

SEQ ID NO: 2008847 - RNA, 18 nt, Human
gaaguuagccuuuaucua

SEQ ID NO: 2008848 - RNA, 21 nt, Human
gaaguuagccuuuaucuacca

SEQ ID NO: 2008849 - RNA, 22 nt, Human
gaaguuagccuuuaucuaccaa

SEQ ID NO: 2008850 - RNA, 21 nt, Human
gaauaugggagaaauagugug

SEQ ID NO: 2008851 - RNA, 15 nt, Human
gaauauugcugaugg

SEQ ID NO: 2008852 - RNA, 14 nt, Human
gaauauugcugaug

SEQ ID NO: 2008853 - RNA, 20 nt, Human
gaauauuagugaccucagcu

SEQ ID NO: 2008854 - RNA, 13 nt, Human
gaauauuauauuu

SEQ ID NO: 2008855 - RNA, 16 nt, Human
gaauauuauauuugga

SEQ ID NO: 2008856 - RNA, 19 nt, Human
gaauauuauauuuggaugc

SEQ ID NO: 2008857 - RNA, 24 nt, Human
gaauauuauauuuggaugcagagu

SEQ ID NO: 2008858 - RNA, 20 nt, Human
gaauauugcugauggugcaa

SEQ ID NO: 2008859 - RNA, 19 nt, Human
gaauauugcugauggugca

SEQ ID NO: 2008860 - RNA, 20 nt, Human
gaagcuaucguaaaauuaag

SEQ ID NO: 2008861 - RNA, 19 nt, Human
gaagcuccgcuuucuaccc

SEQ ID NO: 2008862 - RNA, 17 nt, Human
gaaggccccgcccaggc

SEQ ID NO: 2008863 - RNA, 22 nt, Human
gaagcuccgcuuucuacccagc

SEQ ID NO: 2008864 - RNA, 22 nt, Human
gaaggcuggguucugauccuag

SEQ ID NO: 2008865 - RNA, 20 nt, Human
gaaggcuggguucugauccu

SEQ ID NO: 2008866 - RNA, 19 nt, Human
gaaggccccgcccaggcuu

SEQ ID NO: 2008867 - RNA, 18 nt, Human
gaaggccccgcccaggcu

SEQ ID NO: 2008868 - RNA, 21 nt, Human
gaaggcucgagcaugccugga

SEQ ID NO: 2008869 - RNA, 19 nt, Human
gaaggcuggguucugaucc

SEQ ID NO: 2008870 - RNA, 15 nt, Human
gaaggcuggguucug

SEQ ID NO: 2008871 - RNA, 20 nt, Human
gagccuuccaggggugggac

SEQ ID NO: 2008872 - RNA, 23 nt, Human
gagccuuccaggggugggacacc

SEQ ID NO: 2008873 - RNA, 13 nt, Human
gagccuugaacuu

SEQ ID NO: 2008874 - RNA, 21 nt, Human
gagcgcccacuagacccacug

SEQ ID NO: 2008875 - RNA, 14 nt, Human
gagcgcagccgccu

SEQ ID NO: 2008876 - RNA, 22 nt, Human
gagcgcagccgccuucacagca

SEQ ID NO: 2008877 - RNA, 15 nt, Human
gagcugcugccauga

SEQ ID NO: 2008878 - RNA, 16 nt, Human
gagcuggacucccuca

SEQ ID NO: 2008879 - RNA, 13 nt, Human
gagcugcuucccc

SEQ ID NO: 2008880 - RNA, 16 nt, Human
gagcugcuuuuuuuga

SEQ ID NO: 2008881 - RNA, 18 nt, Human
gagcugcuuuuuuugaaa

SEQ ID NO: 2008882 - RNA, 21 nt, Human
gagcuggacaguggagugcaa

SEQ ID NO: 2008883 - RNA, 13 nt, Human
gaggaccugcccg

SEQ ID NO: 2008884 - RNA, 15 nt, Human
gaggacgcucucugg

SEQ ID NO: 2008885 - RNA, 14 nt, Human
gaggcagggucuca

SEQ ID NO: 2008886 - RNA, 21 nt, Human
gaggcaguugcccagccucuu

SEQ ID NO: 2008887 - RNA, 15 nt, Human
gaggcaguuugagga

SEQ ID NO: 2008888 - RNA, 21 nt, Human
gaggcaguucgaccagccagg

SEQ ID NO: 2008889 - RNA, 15 nt, Human
gaggcaguugcccag

SEQ ID NO: 2008890 - RNA, 18 nt, Human
gaggcaguugcccagccu

SEQ ID NO: 2008891 - RNA, 20 nt, Human
gaggcaguugcccagccucu

SEQ ID NO: 2008892 - RNA, 22 nt, Human
gaggccaaggugggaggauugc

SEQ ID NO: 2008893 - RNA, 17 nt, Human
gaggccaaggugggagg

SEQ ID NO: 2008894 - RNA, 13 nt, Human
gaggcaggucccc

SEQ ID NO: 2008895 - RNA, 16 nt, Human
gaggcagguccccaga

SEQ ID NO: 2008896 - RNA, 12 nt, Human
gaggcagguccc

SEQ ID NO: 2008897 - RNA, 15 nt, Human
gaggcagggucucac

SEQ ID NO: 2008898 - RNA, 12 nt, Human
gaggcuccacuu

SEQ ID NO: 2008899 - RNA, 23 nt, Human
gaggcuccacuuggucugugaga

SEQ ID NO: 2008900 - RNA, 19 nt, Human
gaggcuccacuuggucugu

SEQ ID NO: 2008901 - RNA, 18 nt, Human
gaggcuccacuuggucug

SEQ ID NO: 2008902 - RNA, 14 nt, Human
gaggcucagauugu

SEQ ID NO: 2008903 - RNA, 15 nt, Human
gaggcucaaauuuug

SEQ ID NO: 2008904 - RNA, 16 nt, Human
gaggcucaaauuuuga

SEQ ID NO: 2008905 - RNA, 18 nt, Human
gaggcuacuguaaggcaa

SEQ ID NO: 2008906 - RNA, 22 nt, Human
gaggcuagugugguguuuccug

SEQ ID NO: 2008907 - RNA, 19 nt, Human
gaggccagagacacaagcc

SEQ ID NO: 2008908 - RNA, 14 nt, Human
gaggccagagacac

SEQ ID NO: 2008909 - RNA, 13 nt, Human
gaggccagagaca

SEQ ID NO: 2008910 - RNA, 16 nt, Human
gaggcaguuugaggau

SEQ ID NO: 2008911 - RNA, 11 nt, Human
gaggccaccuc

SEQ ID NO: 2008912 - RNA, 12 nt, Human
gaggccaccucc

SEQ ID NO: 2008913 - RNA, 13 nt, Human
gaggccaccuccu

SEQ ID NO: 2008914 - RNA, 12 nt, Human
gaggggccucuu

SEQ ID NO: 2008915 - RNA, 18 nt, Human
gaggcugcagccaggcca

SEQ ID NO: 2008916 - RNA, 19 nt, Human
gaggcugcagccaggccac

SEQ ID NO: 2008917 - RNA, 15 nt, Human
gaggucgaggcagga

SEQ ID NO: 2008918 - RNA, 23 nt, Human
gaggugaccccagguuucuaugu

SEQ ID NO: 2008919 - RNA, 17 nt, Human
gaggugaaaaggccaag

SEQ ID NO: 2008920 - RNA, 15 nt, Human
gaggugaaaaggcca

SEQ ID NO: 2008921 - RNA, 16 nt, Human
gaggugaaaaggccaa

SEQ ID NO: 2008922 - RNA, 17 nt, Human
gagguggaagagggcug

SEQ ID NO: 2008923 - RNA, 20 nt, Human
gagguggaagagggcugcaa

SEQ ID NO: 2008924 - RNA, 17 nt, Human
gagucaccaagcccagu

SEQ ID NO: 2008925 - RNA, 16 nt, Human
gagucaccaagcccag

SEQ ID NO: 2008926 - RNA, 18 nt, Human
gagucagggagagcugaa

SEQ ID NO: 2008927 - RNA, 20 nt, Human
gagucagccucgcaggccuc

SEQ ID NO: 2008928 - RNA, 16 nt, Human
gagucagcuguuucua

SEQ ID NO: 2008929 - RNA, 22 nt, Human
gagucagaaguuucugccgcag

SEQ ID NO: 2008930 - RNA, 15 nt, Human
gagucagcuguuucu

SEQ ID NO: 2008931 - RNA, 12 nt, Human
gagucccaccuu

SEQ ID NO: 2008932 - RNA, 15 nt, Human
gagucagucgccuuu

SEQ ID NO: 2008933 - RNA, 18 nt, Human
gagugacagaggcagccc

SEQ ID NO: 2008934 - RNA, 20 nt, Human
gaguggagguuuauaguuaa

SEQ ID NO: 2008935 - RNA, 17 nt, Human
gaguugauucagcucug

SEQ ID NO: 2008936 - RNA, 16 nt, Human
gaguugauucagcucu

SEQ ID NO: 2008937 - RNA, 15 nt, Human
gaguugauucagcuc

SEQ ID NO: 2008938 - RNA, 13 nt, Human
gagugcaggccca

SEQ ID NO: 2008939 - RNA, 14 nt, Human
gagugcaggcccac

SEQ ID NO: 2008940 - RNA, 15 nt, Human
gagugcaggcccacc

SEQ ID NO: 2008941 - RNA, 21 nt, Human
gagugcaagccccugcuccag

SEQ ID NO: 2008942 - RNA, 23 nt, Human
gagugcaaaaggcuugcagaacu

SEQ ID NO: 2008943 - RNA, 20 nt, Human
gagugacagaggcagcccca

SEQ ID NO: 2008944 - RNA, 16 nt, Human
gaguuuaaauuguaau

SEQ ID NO: 2008945 - RNA, 13 nt, Human
gaguuguuuuugu

SEQ ID NO: 2008946 - RNA, 14 nt, Human
gaguuguuuuugua

SEQ ID NO: 2008947 - RNA, 16 nt, Human
gaguuguuuuuguaua

SEQ ID NO: 2008948 - RNA, 18 nt, Human
gaguuguuuuuguauauu

SEQ ID NO: 2008949 - RNA, 13 nt, Human
gaguuggcuggga

SEQ ID NO: 2008950 - RNA, 17 nt, Human
gaguuggaguagaaugu

SEQ ID NO: 2008951 - RNA, 20 nt, Human
gaguuggaguagaauguagu

SEQ ID NO: 2008952 - RNA, 22 nt, Human
gaguuguuacauuuuuaagugc

SEQ ID NO: 2008953 - RNA, 18 nt, Human
gaguugauucagcucugc

SEQ ID NO: 2008954 - RNA, 18 nt, Human
gauucuccugccucagcc

SEQ ID NO: 2008955 - RNA, 15 nt, Human
gauucuccugccuca

SEQ ID NO: 2008956 - RNA, 17 nt, Human
gauucuccugccucagc

SEQ ID NO: 2008957 - RNA, 15 nt, Human
gauuuauacucauuu

SEQ ID NO: 2008958 - RNA, 20 nt, Human
gauuuuuuacagcugccugc

SEQ ID NO: 2008959 - RNA, 12 nt, Human
gauuuauuaacu

SEQ ID NO: 2008960 - RNA, 18 nt, Human
gauucuuccucccucccu

SEQ ID NO: 2008961 - RNA, 17 nt, Human
gauucuuccucccuccc

SEQ ID NO: 2008962 - RNA, 12 nt, Human
gauuauuggaaa

SEQ ID NO: 2008963 - RNA, 20 nt, Human
gauuauaggcaccuaccacc

SEQ ID NO: 2008964 - RNA, 18 nt, Human
gauuauauaucccugaua

SEQ ID NO: 2008965 - RNA, 14 nt, Human
gauuauauuaugaa

SEQ ID NO: 2008966 - RNA, 17 nt, Human
gaugucagcaguugcug

SEQ ID NO: 2008967 - RNA, 21 nt, Human
gauguauguugaagccuuugu

SEQ ID NO: 2008968 - RNA, 15 nt, Human
gauguauuuugugag

SEQ ID NO: 2008969 - RNA, 16 nt, Human
gauguauuuugugagu

SEQ ID NO: 2008970 - RNA, 21 nt, Human
gauguauuuugugaguuuguu

SEQ ID NO: 2008971 - RNA, 20 nt, Human
gauguauguugaagccuuug

SEQ ID NO: 2008972 - RNA, 12 nt, Human
gaucugcugcag

SEQ ID NO: 2008973 - RNA, 21 nt, Human
gaugaucuaggaagacuuugg

SEQ ID NO: 2008974 - RNA, 15 nt, Human
gaugaucuaggaaga

SEQ ID NO: 2008975 - RNA, 19 nt, Human
gaugaguuuugggaaguua

SEQ ID NO: 2008976 - RNA, 16 nt, Human
gaugagugagcaugcc

SEQ ID NO: 2008977 - RNA, 17 nt, Human
gauguagaggagaaacu

SEQ ID NO: 2008978 - RNA, 18 nt, Human
gauguagaggagaaacug

SEQ ID NO: 2008979 - RNA, 12 nt, Human
gauguaaagaug

SEQ ID NO: 2008980 - RNA, 14 nt, Human
gauguagauuuauu

SEQ ID NO: 2008981 - RNA, 21 nt, Human
gauguagcaaacccugucaaa

SEQ ID NO: 2008982 - RNA, 15 nt, Human
gauguagauuuauuu

SEQ ID NO: 2008983 - RNA, 17 nt, Human
gauguagauuuauuuca

SEQ ID NO: 2008984 - RNA, 23 nt, Human
gcaccgggccacagagaaaguac

SEQ ID NO: 2008985 - RNA, 22 nt, Human
gcaccuaccaccacgcccggcu

SEQ ID NO: 2008986 - RNA, 21 nt, Human
gcaccuaccaccacgcccggc

SEQ ID NO: 2008987 - RNA, 22 nt, Human
gcacaucagcacgauuucuguu

SEQ ID NO: 2008988 - RNA, 23 nt, Human
gcacaucagcacgauuucuguuu

SEQ ID NO: 2008989 - RNA, 14 nt, Human
gcaccgggccacag

SEQ ID NO: 2008990 - RNA, 16 nt, Human
gcacuccccugcuggg

SEQ ID NO: 2008991 - RNA, 22 nt, Human
gcacuccccugcuggguguggc

SEQ ID NO: 2008992 - RNA, 13 nt, Human
gcacucagaagac

SEQ ID NO: 2008993 - RNA, 16 nt, Human
gcacucagaagacacu

SEQ ID NO: 2008994 - RNA, 17 nt, Human
gcacuccccugcugggu

SEQ ID NO: 2008995 - RNA, 17 nt, Human
gcacucagaagacacug

SEQ ID NO: 2008996 - RNA, 23 nt, Human
gauuuuuuuucccauuuagaaug

SEQ ID NO: 2008997 - RNA, 18 nt, Human
gcaagucagaauagaaau

SEQ ID NO: 2008998 - RNA, 13 nt, Human
gcaagugugaaua

SEQ ID NO: 2008999 - RNA, 16 nt, Human
gcaagugugaauacug

SEQ ID NO: 2009000 - RNA, 19 nt, Human
gcaagugugaauacugcuu

SEQ ID NO: 2009001 - RNA, 22 nt, Human
gcaagugugggggguccuucuc

SEQ ID NO: 2009002 - RNA, 12 nt, Human
gcaauauauuuu

SEQ ID NO: 2009003 - RNA, 14 nt, Human
gcaauauauuuugu

SEQ ID NO: 2009004 - RNA, 15 nt, Human
gcaauauauuuugua

SEQ ID NO: 2009005 - RNA, 17 nt, Human
gcaauauauuuuguaug

SEQ ID NO: 2009006 - RNA, 22 nt, Human
gcacaagcugcacccucaggca

SEQ ID NO: 2009007 - RNA, 18 nt, Human
gcaauauauuuuguaugc

SEQ ID NO: 2009008 - RNA, 19 nt, Human
gcaauauauuuuguaugca

SEQ ID NO: 2009009 - RNA, 20 nt, Human
gcaauauauuuuguaugcaa

SEQ ID NO: 2009010 - RNA, 14 nt, Human
gcaauauucucugu

SEQ ID NO: 2009011 - RNA, 17 nt, Human
gcaauauucucuguaca

SEQ ID NO: 2009012 - RNA, 19 nt, Human
gcaauauucucuguacaua

SEQ ID NO: 2009013 - RNA, 21 nt, Human
gcaauauucucuguacauauu

SEQ ID NO: 2009014 - RNA, 14 nt, Human
gcacacauuuuuua

SEQ ID NO: 2009015 - RNA, 16 nt, Human
gcacaccaaucuuacu

SEQ ID NO: 2009016 - RNA, 17 nt, Human
gcacaccaaucuuacuu

SEQ ID NO: 2009017 - RNA, 22 nt, Human
gcacaccaaucuuacuuuguaa

SEQ ID NO: 2009018 - RNA, 20 nt, Human
gcacaccaaucuuacuuugu

SEQ ID NO: 2009019 - RNA, 21 nt, Human
gcacaccaaucuuacuuugua

SEQ ID NO: 2009020 - RNA, 14 nt, Human
gcacaccgggcacu

SEQ ID NO: 2009021 - RNA, 23 nt, Human
gcacauagaaaguaaauaaaagg

SEQ ID NO: 2009022 - RNA, 19 nt, Human
gcacagugcaucucagccc

SEQ ID NO: 2009023 - RNA, 20 nt, Human
gcacagugcaucucagccca

SEQ ID NO: 2009024 - RNA, 21 nt, Human
gcacagugcaucucagcccac

SEQ ID NO: 2009025 - RNA, 15 nt, Human
cuucugacucuuccc

SEQ ID NO: 2009026 - RNA, 16 nt, Human
cuucugacucuucccc

SEQ ID NO: 2009027 - RNA, 17 nt, Human
cuucugacucuucccca

SEQ ID NO: 2009028 - RNA, 21 nt, Human
cuucuucagagacuccugcag

SEQ ID NO: 2009029 - RNA, 20 nt, Human
cuucuucagagacuccugca

SEQ ID NO: 2009030 - RNA, 13 nt, Human
cuucuguuuucaa

SEQ ID NO: 2009031 - RNA, 16 nt, Human
cuucuguuuucaaucu

SEQ ID NO: 2009032 - RNA, 19 nt, Human
cuucuguuuucaaucucgu

SEQ ID NO: 2009033 - RNA, 23 nt, Human
cuucugacucuuccccaggaagg

SEQ ID NO: 2009034 - RNA, 22 nt, Human
cuucuucagagacuccugcagg

SEQ ID NO: 2009035 - RNA, 18 nt, Human
cuucuucagagacuccug

SEQ ID NO: 2009036 - RNA, 20 nt, Human
cuugaaugaugccaugagga

SEQ ID NO: 2009037 - RNA, 23 nt, Human
cuugaauaaacaccacuggauua

SEQ ID NO: 2009038 - RNA, 11 nt, Human
cuuggcccagg

SEQ ID NO: 2009039 - RNA, 18 nt, Human
cuugcucucuuuuauucu

SEQ ID NO: 2009040 - RNA, 21 nt, Human
cuuggccagcaaguuagagaa

SEQ ID NO: 2009041 - RNA, 12 nt, Human
cuugcucugcug

SEQ ID NO: 2009042 - RNA, 23 nt, Human
cuugaaugaugccaugaggaaca

SEQ ID NO: 2009043 - RNA, 23 nt, Human
cuugccgucuaccugaggggccu

SEQ ID NO: 2009044 - RNA, 16 nt, Human
cuugacagagccugcc

SEQ ID NO: 2009045 - RNA, 19 nt, Human
cuugacagagccugcccca

SEQ ID NO: 2009046 - RNA, 12 nt, Human
cuugacagcuca

SEQ ID NO: 2009047 - RNA, 20 nt, Human
cuugccgucuaccugagggg

SEQ ID NO: 2009048 - RNA, 12 nt, Human
cuugacagggca

SEQ ID NO: 2009049 - RNA, 12 nt, Human
cuuuucaaaauc

SEQ ID NO: 2009050 - RNA, 15 nt, Human
cuuuucaaaacauuu

SEQ ID NO: 2009051 - RNA, 18 nt, Human
cuuuucaauauauuugua

SEQ ID NO: 2009052 - RNA, 14 nt, Human
cuuuucaaguauuu

SEQ ID NO: 2009053 - RNA, 17 nt, Human
cuuuucaaguauuuaag

SEQ ID NO: 2009054 - RNA, 19 nt, Human
cuuuuauuuagcaccaggg

SEQ ID NO: 2009055 - RNA, 16 nt, Human
cuuuuauaaacuuuac

SEQ ID NO: 2009056 - RNA, 18 nt, Human
cuuuuauaaacuuuaccu

SEQ ID NO: 2009057 - RNA, 15 nt, Human
cuuuuauaaacuuua

SEQ ID NO: 2009058 - RNA, 14 nt, Human
cuuugggugcuguu

SEQ ID NO: 2009059 - RNA, 16 nt, Human
cuuuggucuacacugu

SEQ ID NO: 2009060 - RNA, 20 nt, Human
cuuuggucuacacugugcug

SEQ ID NO: 2009061 - RNA, 15 nt, Human
cuuuggucacuuuua

SEQ ID NO: 2009062 - RNA, 18 nt, Human
cuuuggucacuuuuagau

SEQ ID NO: 2009063 - RNA, 20 nt, Human
cuuucgacuugcauuuuugc

SEQ ID NO: 2009064 - RNA, 22 nt, Human
cuuucggggagaggcugaggac

SEQ ID NO: 2009065 - RNA, 21 nt, Human
cuuucgacuugcauuuuugca

SEQ ID NO: 2009066 - RNA, 13 nt, Human
cuuucuccuuuuu

SEQ ID NO: 2009067 - RNA, 19 nt, Human
cuuucguuuguuuguuuca

SEQ ID NO: 2009068 - RNA, 14 nt, Human
cuuucuauaauuuu

SEQ ID NO: 2009069 - RNA, 17 nt, Human
cuuucuauaauuuuaca

SEQ ID NO: 2009070 - RNA, 18 nt, Human
cuuucuauaauuuuacaa

SEQ ID NO: 2009071 - RNA, 22 nt, Human
cuuugagguggaagagggcugc

SEQ ID NO: 2009072 - RNA, 17 nt, Human
cuuugauucacauguuu

SEQ ID NO: 2009073 - RNA, 20 nt, Human
cuuugauucacauguuuuca

SEQ ID NO: 2009074 - RNA, 21 nt, Human
cuuugauucacauguuuucaa

SEQ ID NO: 2009075 - RNA, 22 nt, Human
cuuugauucacauguuuucaaa

SEQ ID NO: 2009076 - RNA, 15 nt, Human
cuuugauucacaugu

SEQ ID NO: 2009077 - RNA, 16 nt, Human
cuuugauucacauguu

SEQ ID NO: 2009078 - RNA, 22 nt, Human
cuuugacgccaucccagcccca

SEQ ID NO: 2009079 - RNA, 21 nt, Human
cuuugacgccaucccagcccc

SEQ ID NO: 2009080 - RNA, 19 nt, Human
cuuugacgccaucccagcc

SEQ ID NO: 2009081 - RNA, 18 nt, Human
cuuugacgccaucccagc

SEQ ID NO: 2009082 - RNA, 14 nt, Human
cuuucucuaauaau

SEQ ID NO: 2009083 - RNA, 15 nt, Human
cuuucucuaauaaua

SEQ ID NO: 2009084 - RNA, 16 nt, Human
cuuucucuaauaauaa

SEQ ID NO: 2009085 - RNA, 17 nt, Human
cuuucucuaauaauaaa

SEQ ID NO: 2009086 - RNA, 18 nt, Human
cuuucucuaauaauaaau

SEQ ID NO: 2009087 - RNA, 19 nt, Human
cuuucucuaauaauaaaua

SEQ ID NO: 2009088 - RNA, 20 nt, Human
cuuucucuaauaauaaauag

SEQ ID NO: 2009089 - RNA, 22 nt, Human
cuuucucuaauaauaaauaguu

SEQ ID NO: 2009090 - RNA, 16 nt, Human
cuuugagguggaagag

SEQ ID NO: 2009091 - RNA, 17 nt, Human
cuuugagguggaagagg

SEQ ID NO: 2009092 - RNA, 14 nt, Human
cuuugagguggaag

SEQ ID NO: 2009093 - RNA, 16 nt, Human
cuuugagcuuaagaau

SEQ ID NO: 2009094 - RNA, 14 nt, Human
cuuugagcucccac

SEQ ID NO: 2009095 - RNA, 23 nt, Human
cuuugagaucuaaaaauaacugu

SEQ ID NO: 2009096 - RNA, 23 nt, Human
cuuugagcucccacuucugccag

SEQ ID NO: 2009097 - RNA, 16 nt, Human
cuuugagaucuaaaaa

SEQ ID NO: 2009098 - RNA, 17 nt, Human
cuuugagaucuaaaaau

SEQ ID NO: 2009099 - RNA, 19 nt, Human
cuuugagaucuaaaaauaa

SEQ ID NO: 2009100 - RNA, 22 nt, Human
cuuugagaucuaaaaauaacug

SEQ ID NO: 2009101 - RNA, 22 nt, Human
cuuucagacucucucugggagg

SEQ ID NO: 2009102 - RNA, 12 nt, Human
cuugugacuuuu

SEQ ID NO: 2009103 - RNA, 16 nt, Human
cuugugacuuuugcuu

SEQ ID NO: 2009104 - RNA, 17 nt, Human
cuugugacuuuugcuuu

SEQ ID NO: 2009105 - RNA, 19 nt, Human
cuugugacuuuugcuuuaa

SEQ ID NO: 2009106 - RNA, 21 nt, Human
cuugugacuuuugcuuuaauu

SEQ ID NO: 2009107 - RNA, 22 nt, Human
cuugugacuuuugcuuuaauuc

SEQ ID NO: 2009108 - RNA, 16 nt, Human
cuuguggacacagcuc

SEQ ID NO: 2009109 - RNA, 14 nt, Human
cuuguggacacagc

SEQ ID NO: 2009110 - RNA, 15 nt, Human
cuuguggacacagcu

SEQ ID NO: 2009111 - RNA, 13 nt, Human
cuuguggacacag

SEQ ID NO: 2009112 - RNA, 15 nt, Human
cuugugcacaggcag

SEQ ID NO: 2009113 - RNA, 16 nt, Human
cuugugcacaggcaga

SEQ ID NO: 2009114 - RNA, 18 nt, Human
cuugugcacaggcagagc

SEQ ID NO: 2009115 - RNA, 22 nt, Human
cuugugcacaggcagagcccag

SEQ ID NO: 2009116 - RNA, 14 nt, Human
cuuuaauaugaaau

SEQ ID NO: 2009117 - RNA, 17 nt, Human
cuuuaauaugaaauuuu

SEQ ID NO: 2009118 - RNA, 19 nt, Human
cuuuaaucagguccugcuc

SEQ ID NO: 2009119 - RNA, 18 nt, Human
cuuuacaaacaaaagcau

SEQ ID NO: 2009120 - RNA, 22 nt, Human
cuuucaauaggaaaaacugauu

SEQ ID NO: 2009121 - RNA, 21 nt, Human
cuuucaauaggaaaaacugau

SEQ ID NO: 2009122 - RNA, 20 nt, Human
cuuucaauaggaaaaacuga

SEQ ID NO: 2009123 - RNA, 23 nt, Human
cuuuacacggagcggauugcaaa

SEQ ID NO: 2009124 - RNA, 12 nt, Human
cuuucacuucuu

SEQ ID NO: 2009125 - RNA, 13 nt, Human
cuuucacuucuuu

SEQ ID NO: 2009126 - RNA, 14 nt, Human
cuuucacuucuuuc

SEQ ID NO: 2009127 - RNA, 15 nt, Human
cuuucacuucuuucc

SEQ ID NO: 2009128 - RNA, 16 nt, Human
cuuucacuucuuuccc

SEQ ID NO: 2009129 - RNA, 18 nt, Human
cuuucacuucuuucccuu

SEQ ID NO: 2009130 - RNA, 20 nt, Human
cuuucacuucuuucccuucc

SEQ ID NO: 2009131 - RNA, 21 nt, Human
cuuucacuucuuucccuuccu

SEQ ID NO: 2009132 - RNA, 19 nt, Human
cuuucagacucucucuggg

SEQ ID NO: 2009133 - RNA, 14 nt, Human
cuguugcugccuca

SEQ ID NO: 2009134 - RNA, 15 nt, Human
cuguugcugccucau

SEQ ID NO: 2009135 - RNA, 16 nt, Human
cuguugcugccucaug

SEQ ID NO: 2009136 - RNA, 17 nt, Human
cuguugcugccucaugc

SEQ ID NO: 2009137 - RNA, 20 nt, Human
cuguugggccaggagccucc

SEQ ID NO: 2009138 - RNA, 17 nt, Human
cuguugggccaggagcc

SEQ ID NO: 2009139 - RNA, 16 nt, Human
cuguugggccaggagc

SEQ ID NO: 2009140 - RNA, 13 nt, Human
cuuaaaauuugaa

SEQ ID NO: 2009141 - RNA, 14 nt, Human
cuuaaaauuugaaa

SEQ ID NO: 2009142 - RNA, 15 nt, Human
cuuaaaauuugaaac

SEQ ID NO: 2009143 - RNA, 16 nt, Human
cuuaaaauuugaaaca

SEQ ID NO: 2009144 - RNA, 19 nt, Human
cuuaaaauuugaaacauug

SEQ ID NO: 2009145 - RNA, 18 nt, Human
cuuaaaauauuccugcau

SEQ ID NO: 2009146 - RNA, 20 nt, Human
cuuaaaauauuccugcauuu

SEQ ID NO: 2009147 - RNA, 21 nt, Human
cuuacacuggcaaugguaguu

SEQ ID NO: 2009148 - RNA, 13 nt, Human
cuuacacaauggu

SEQ ID NO: 2009149 - RNA, 20 nt, Human
cuuaaaauuugaaacauugc

SEQ ID NO: 2009150 - RNA, 23 nt, Human
cuuaaaauuugaaacauugcuuu

SEQ ID NO: 2009151 - RNA, 17 nt, Human
cuuacccucauguucuu

SEQ ID NO: 2009152 - RNA, 18 nt, Human
cuuacccucauguucuua

SEQ ID NO: 2009153 - RNA, 19 nt, Human
cuuacccucauguucuuaa

SEQ ID NO: 2009154 - RNA, 13 nt, Human
cuuaccucggugc

SEQ ID NO: 2009155 - RNA, 14 nt, Human
cuuaccgacaagca

SEQ ID NO: 2009156 - RNA, 17 nt, Human
cuuaccugaguugaaga

SEQ ID NO: 2009157 - RNA, 13 nt, Human
cuuaccugccagg

SEQ ID NO: 2009158 - RNA, 21 nt, Human
cuuaccucggugccuuccucu

SEQ ID NO: 2009159 - RNA, 19 nt, Human
cuuaccucggugccuuccu

SEQ ID NO: 2009160 - RNA, 17 nt, Human
cuguucagcguuuugca

SEQ ID NO: 2009161 - RNA, 13 nt, Human
cuguucagcucca

SEQ ID NO: 2009162 - RNA, 14 nt, Human
cuguucagcguuuu

SEQ ID NO: 2009163 - RNA, 14 nt, Human
cuguucagcuccag

SEQ ID NO: 2009164 - RNA, 20 nt, Human
cugugucuugcaauggcagc

SEQ ID NO: 2009165 - RNA, 15 nt, Human
cuguucacucuacuu

SEQ ID NO: 2009166 - RNA, 16 nt, Human
cugugucuugcaaugg

SEQ ID NO: 2009167 - RNA, 19 nt, Human
cugugucuugcaauggcag

SEQ ID NO: 2009168 - RNA, 21 nt, Human
cugugacaucucuauucccca

SEQ ID NO: 2009169 - RNA, 17 nt, Human
cugugacuaggaaaaaa

SEQ ID NO: 2009170 - RNA, 17 nt, Human
cugugacuucagcucug

SEQ ID NO: 2009171 - RNA, 22 nt, Human
cugugacuucagcucuguuuua

SEQ ID NO: 2009172 - RNA, 15 nt, Human
cugugcguggggcuc

SEQ ID NO: 2009173 - RNA, 22 nt, Human
cugugcguggggcucccgccuc

SEQ ID NO: 2009174 - RNA, 14 nt, Human
cugugcguggggcu

SEQ ID NO: 2009175 - RNA, 21 nt, Human
cugugucagguggggcagcuu

SEQ ID NO: 2009176 - RNA, 20 nt, Human
cugugucagcauagaaguaa

SEQ ID NO: 2009177 - RNA, 19 nt, Human
cugugucagguggggcagc

SEQ ID NO: 2009178 - RNA, 19 nt, Human
cugugucucccuucauccu

SEQ ID NO: 2009179 - RNA, 14 nt, Human
cugugucucccuuc

SEQ ID NO: 2009180 - RNA, 14 nt, Human
cugugucuugcaau

SEQ ID NO: 2009181 - RNA, 22 nt, Human
cugugcugagucugaaggcugg

SEQ ID NO: 2009182 - RNA, 20 nt, Human
cugugcugagucugaaggcu

SEQ ID NO: 2009183 - RNA, 11 nt, Human
cugugcugccc

SEQ ID NO: 2009184 - RNA, 18 nt, Human
cuuagcagggaaacagcu

SEQ ID NO: 2009185 - RNA, 21 nt, Human
cuuagcagggaaacagcuaau

SEQ ID NO: 2009186 - RNA, 21 nt, Human
cuuaugggcuggguucuaccc

SEQ ID NO: 2009187 - RNA, 14 nt, Human
cuuaugggcugggu

SEQ ID NO: 2009188 - RNA, 23 nt, Human
cuuaugggcuggguucuacccag

SEQ ID NO: 2009189 - RNA, 22 nt, Human
cuuaugggcuggguucuaccca

SEQ ID NO: 2009190 - RNA, 18 nt, Human
cuuauuaaaacacuucau

SEQ ID NO: 2009191 - RNA, 21 nt, Human
cuuauggguagggcucugaca

SEQ ID NO: 2009192 - RNA, 12 nt, Human
cuuauugcccac

SEQ ID NO: 2009193 - RNA, 13 nt, Human
cuuauugcccacg

SEQ ID NO: 2009194 - RNA, 22 nt, Human
cuuauuaaaguuucaaaaaucu

SEQ ID NO: 2009195 - RNA, 23 nt, Human
cuuauuaaaguuucaaaaaucug

SEQ ID NO: 2009196 - RNA, 13 nt, Human
cuuauuaaaguuu

SEQ ID NO: 2009197 - RNA, 14 nt, Human
cuuauuaaaguuuc

SEQ ID NO: 2009198 - RNA, 15 nt, Human
cuuauuaaaguuuca

SEQ ID NO: 2009199 - RNA, 16 nt, Human
cuuauuaaaguuucaa

SEQ ID NO: 2009200 - RNA, 17 nt, Human
cuuauuaaaguuucaaa

SEQ ID NO: 2009201 - RNA, 18 nt, Human
cuuauuaaaguuucaaaa

SEQ ID NO: 2009202 - RNA, 19 nt, Human
cuuauuaaaguuucaaaaa

SEQ ID NO: 2009203 - RNA, 20 nt, Human
cuuauuaaaguuucaaaaau

SEQ ID NO: 2009204 - RNA, 17 nt, Human
cuuccaugucgccucug

SEQ ID NO: 2009205 - RNA, 18 nt, Human
cuuccaugucgccucugc

SEQ ID NO: 2009206 - RNA, 19 nt, Human
cuuccaugucgccucugca

SEQ ID NO: 2009207 - RNA, 20 nt, Human
cuuccaugucgccucugcau

SEQ ID NO: 2009208 - RNA, 20 nt, Human
cuuccagugaggcucugccc

SEQ ID NO: 2009209 - RNA, 19 nt, Human
cuuccagugaggcucugcc

SEQ ID NO: 2009210 - RNA, 17 nt, Human
cuuccagugaggcucug

SEQ ID NO: 2009211 - RNA, 18 nt, Human
cuuccagugaggcucugc

SEQ ID NO: 2009212 - RNA, 17 nt, Human
cuuccauggacuuuguu

SEQ ID NO: 2009213 - RNA, 16 nt, Human
cuuccauggacuuugu

SEQ ID NO: 2009214 - RNA, 15 nt, Human
cuuccaugucgccuc

SEQ ID NO: 2009215 - RNA, 16 nt, Human
cuuccaugucgccucu

SEQ ID NO: 2009216 - RNA, 11 nt, Human
cuucagacaua

SEQ ID NO: 2009217 - RNA, 14 nt, Human
cuucacuucugacu

SEQ ID NO: 2009218 - RNA, 20 nt, Human
cuucacuucugacucuuccc

SEQ ID NO: 2009219 - RNA, 21 nt, Human
cuucacuucugacucuucccc

SEQ ID NO: 2009220 - RNA, 13 nt, Human
cuucacuucugac

SEQ ID NO: 2009221 - RNA, 22 nt, Human
cuucagagacuccugcaggcag

SEQ ID NO: 2009222 - RNA, 21 nt, Human
cuucagagacuccugcaggca

SEQ ID NO: 2009223 - RNA, 16 nt, Human
cuucagagacuccugc

SEQ ID NO: 2009224 - RNA, 21 nt, Human
cuucacuguccuccaagccag

SEQ ID NO: 2009225 - RNA, 18 nt, Human
cuucacuguccuccaagc

SEQ ID NO: 2009226 - RNA, 20 nt, Human
cuucaccuuuguccccaccg

SEQ ID NO: 2009227 - RNA, 17 nt, Human
cuucaccuuugucccca

SEQ ID NO: 2009228 - RNA, 14 nt, Human
cuucaccuuugucc

SEQ ID NO: 2009229 - RNA, 18 nt, Human
cuuauugcccacgcugga

SEQ ID NO: 2009230 - RNA, 15 nt, Human
cuucauccuccucag

SEQ ID NO: 2009231 - RNA, 16 nt, Human
cuucauccccucagaa

SEQ ID NO: 2009232 - RNA, 13 nt, Human
cuucaucccucug

SEQ ID NO: 2009233 - RNA, 18 nt, Human
cuucaguuaagccuuugg

SEQ ID NO: 2009234 - RNA, 24 nt, Human
cuucagagacuccugcaggcagcc

SEQ ID NO: 2009235 - RNA, 23 nt, Human
cuucagagacuccugcaggcagc

SEQ ID NO: 2009236 - RNA, 18 nt, Human
cuucaguggcagcugcuu

SEQ ID NO: 2009237 - RNA, 17 nt, Human
cuucaguuaagccuuug

SEQ ID NO: 2009238 - RNA, 22 nt, Human
cuucaucucccaaagugcuggg

SEQ ID NO: 2009239 - RNA, 16 nt, Human
cuucauccuccucaga

SEQ ID NO: 2009240 - RNA, 22 nt, Human
cuggaugcagccucacaguccu

SEQ ID NO: 2009241 - RNA, 15 nt, Human
cuggaguucugguuc

SEQ ID NO: 2009242 - RNA, 14 nt, Human
cuggaucugugagg

SEQ ID NO: 2009243 - RNA, 17 nt, Human
cuggaguucugguuccu

SEQ ID NO: 2009244 - RNA, 16 nt, Human
cuggaguucugguucc

SEQ ID NO: 2009245 - RNA, 23 nt, Human
cuggacugugugcucaggagccc

SEQ ID NO: 2009246 - RNA, 22 nt, Human
cuggacugugugcucaggagcc

SEQ ID NO: 2009247 - RNA, 19 nt, Human
cuggacugugugcucagga

SEQ ID NO: 2009248 - RNA, 20 nt, Human
cugcuuaacuucacauauug

SEQ ID NO: 2009249 - RNA, 22 nt, Human
cugcugugggcacaggucaggc

SEQ ID NO: 2009250 - RNA, 19 nt, Human
cugcugugggcacagguca

SEQ ID NO: 2009251 - RNA, 19 nt, Human
cugcugucuuuucuuugcc

SEQ ID NO: 2009252 - RNA, 19 nt, Human
cugcugugaagcuggaacu

SEQ ID NO: 2009253 - RNA, 14 nt, Human
cugcucacauaucu

SEQ ID NO: 2009254 - RNA, 12 nt, Human
cugcugaaggcu

SEQ ID NO: 2009255 - RNA, 16 nt, Human
cugcucacauaucugu

SEQ ID NO: 2009256 - RNA, 19 nt, Human
cugcucacauaucugucau

SEQ ID NO: 2009257 - RNA, 13 nt, Human
cugcugacagugu

SEQ ID NO: 2009258 - RNA, 15 nt, Human
cugcugacaguguug

SEQ ID NO: 2009259 - RNA, 19 nt, Human
cugcugagucccaggcuga

SEQ ID NO: 2009260 - RNA, 23 nt, Human
cugcugagucccaggcugagccu

SEQ ID NO: 2009261 - RNA, 14 nt, Human
cugcugaaggcucg

SEQ ID NO: 2009262 - RNA, 13 nt, Human
cugcugaaggcuc

SEQ ID NO: 2009263 - RNA, 15 nt, Human
cugcugaaggcucga

SEQ ID NO: 2009264 - RNA, 12 nt, Human
cugcugacagug

SEQ ID NO: 2009265 - RNA, 19 nt, Human
cugcugaguccgaccuggc

SEQ ID NO: 2009266 - RNA, 21 nt, Human
cugcugaguccgaccuggccu

SEQ ID NO: 2009267 - RNA, 22 nt, Human
cugcugaguccgaccuggccug

SEQ ID NO: 2009268 - RNA, 17 nt, Human
cugcugagucuguucug

SEQ ID NO: 2009269 - RNA, 22 nt, Human
cugcugagucuguucugguaau

SEQ ID NO: 2009270 - RNA, 22 nt, Human
cugcugaugacccccccagcuu

SEQ ID NO: 2009271 - RNA, 13 nt, Human
cuggcccugugcc

SEQ ID NO: 2009272 - RNA, 12 nt, Human
cuggcccuuccu

SEQ ID NO: 2009273 - RNA, 22 nt, Human
cuggcuaugcauuugaaaauuu

SEQ ID NO: 2009274 - RNA, 23 nt, Human
cuggcucacacuuggcucugagg

SEQ ID NO: 2009275 - RNA, 15 nt, Human
cuggcuaugcauuug

SEQ ID NO: 2009276 - RNA, 16 nt, Human
cuggcuaugcauuuga

SEQ ID NO: 2009277 - RNA, 13 nt, Human
cuggcuaugcauu

SEQ ID NO: 2009278 - RNA, 14 nt, Human
cuggcuaugcauuu

SEQ ID NO: 2009279 - RNA, 22 nt, Human
cugggacaugggaaaggggaag

SEQ ID NO: 2009280 - RNA, 18 nt, Human
cugggacaugggaaaggg

SEQ ID NO: 2009281 - RNA, 14 nt, Human
cugggacaugggaa

SEQ ID NO: 2009282 - RNA, 16 nt, Human
cuggcucuacacauau

SEQ ID NO: 2009283 - RNA, 17 nt, Human
cugggacagggagcagc

SEQ ID NO: 2009284 - RNA, 13 nt, Human
cuggcucuacaca

SEQ ID NO: 2009285 - RNA, 14 nt, Human
cuggcucuacacau

SEQ ID NO: 2009286 - RNA, 22 nt, Human
cugggagaaccaaaaagaggcu

SEQ ID NO: 2009287 - RNA, 17 nt, Human
cugggagaaaugaaaaa

SEQ ID NO: 2009288 - RNA, 16 nt, Human
cugggagaaaugaaaa

SEQ ID NO: 2009289 - RNA, 21 nt, Human
cugggaccacaggugcccgcc

SEQ ID NO: 2009290 - RNA, 13 nt, Human
cugggacuacagg

SEQ ID NO: 2009291 - RNA, 15 nt, Human
cugggacuacaggca

SEQ ID NO: 2009292 - RNA, 16 nt, Human
cugggacuacaggcac

SEQ ID NO: 2009293 - RNA, 12 nt, Human
cuggugccucac

SEQ ID NO: 2009294 - RNA, 21 nt, Human
cuggugccucaccccuugcca

SEQ ID NO: 2009295 - RNA, 21 nt, Human
cuggguggcaccagcagccug

SEQ ID NO: 2009296 - RNA, 14 nt, Human
cuggguguggcgca

SEQ ID NO: 2009297 - RNA, 15 nt, Human
cuggguguggcgcag

SEQ ID NO: 2009298 - RNA, 13 nt, Human
cugggugcaggag

SEQ ID NO: 2009299 - RNA, 14 nt, Human
cugggugcaggagc

SEQ ID NO: 2009300 - RNA, 22 nt, Human
cugggugcaggagcgcucccuu

SEQ ID NO: 2009301 - RNA, 20 nt, Human
cuggguggcaccagcagccu

SEQ ID NO: 2009302 - RNA, 18 nt, Human
cuggguggcaccagcagc

SEQ ID NO: 2009303 - RNA, 13 nt, Human
cuggggagaaagu

SEQ ID NO: 2009304 - RNA, 22 nt, Human
cuggggaccagcuuggcucagg

SEQ ID NO: 2009305 - RNA, 15 nt, Human
cugggcccacauccg

SEQ ID NO: 2009306 - RNA, 18 nt, Human
cugggcccacccaagcag

SEQ ID NO: 2009307 - RNA, 21 nt, Human
cugggcccacccaagcaggag

SEQ ID NO: 2009308 - RNA, 23 nt, Human
cugggcccacccaagcaggaggc

SEQ ID NO: 2009309 - RNA, 20 nt, Human
cugggcagaggaaagcaaag

SEQ ID NO: 2009310 - RNA, 16 nt, Human
cugggcagaggaaagc

SEQ ID NO: 2009311 - RNA, 13 nt, Human
cugggcagaggaa

SEQ ID NO: 2009312 - RNA, 12 nt, Human
cugggcagagga

SEQ ID NO: 2009313 - RNA, 20 nt, Human
cugggcagguuggugggggc

SEQ ID NO: 2009314 - RNA, 19 nt, Human
cugcccugugggcccccaa

SEQ ID NO: 2009315 - RNA, 17 nt, Human
cugccccuccucucugc

SEQ ID NO: 2009316 - RNA, 18 nt, Human
cugccccuccucucugcc

SEQ ID NO: 2009317 - RNA, 13 nt, Human
cugccccucccuu

SEQ ID NO: 2009318 - RNA, 14 nt, Human
cugccccucccuuc

SEQ ID NO: 2009319 - RNA, 17 nt, Human
cugccccucccuucaac

SEQ ID NO: 2009320 - RNA, 17 nt, Human
cugcccuuaccugccag

SEQ ID NO: 2009321 - RNA, 16 nt, Human
cugcccuuaccugcca

SEQ ID NO: 2009322 - RNA, 12 nt, Human
cugcccuuaccu

SEQ ID NO: 2009323 - RNA, 19 nt, Human
cugccccuccucucugccc

SEQ ID NO: 2009324 - RNA, 16 nt, Human
cugccauauucuguug

SEQ ID NO: 2009325 - RNA, 16 nt, Human
cugccauccagguuca

SEQ ID NO: 2009326 - RNA, 18 nt, Human
cugccauccagguucagc

SEQ ID NO: 2009327 - RNA, 19 nt, Human
cugccauccagguucagcu

SEQ ID NO: 2009328 - RNA, 13 nt, Human
cugccccccagcc

SEQ ID NO: 2009329 - RNA, 22 nt, Human
cugccagggacagagggggugg

SEQ ID NO: 2009330 - RNA, 20 nt, Human
cugccagggacagagggggu

SEQ ID NO: 2009331 - RNA, 17 nt, Human
cugcauuuaaaagauac

SEQ ID NO: 2009332 - RNA, 18 nt, Human
cugcauuuaaaagauaca

SEQ ID NO: 2009333 - RNA, 23 nt, Human
cugccagggacagaggggguggc

SEQ ID NO: 2009334 - RNA, 22 nt, Human
cugccagucccccugccccagg

SEQ ID NO: 2009335 - RNA, 20 nt, Human
cugccagucccccugcccca

SEQ ID NO: 2009336 - RNA, 21 nt, Human
cugccagucccccugccccag

SEQ ID NO: 2009337 - RNA, 17 nt, Human
cugccagucccccugcc

SEQ ID NO: 2009338 - RNA, 22 nt, Human
cugccaguggggccugaggcuc

SEQ ID NO: 2009339 - RNA, 20 nt, Human
cugccaguggggccugaggc

SEQ ID NO: 2009340 - RNA, 12 nt, Human
cugccaguuuug

SEQ ID NO: 2009341 - RNA, 13 nt, Human
cugccaguuuugu

SEQ ID NO: 2009342 - RNA, 18 nt, Human
cugcauugggugaucauu

SEQ ID NO: 2009343 - RNA, 14 nt, Human
cugcauuuaaaaga

SEQ ID NO: 2009344 - RNA, 13 nt, Human
cugcauuggcuuu

SEQ ID NO: 2009345 - RNA, 23 nt, Human
cugcaggccaggccagcugccuc

SEQ ID NO: 2009346 - RNA, 18 nt, Human
cugcaggccaggccagcu

SEQ ID NO: 2009347 - RNA, 17 nt, Human
cugcaggccaggccagc

SEQ ID NO: 2009348 - RNA, 20 nt, Human
cugcaggcagccaggccaca

SEQ ID NO: 2009349 - RNA, 19 nt, Human
cugcaggcagccaggccac

SEQ ID NO: 2009350 - RNA, 18 nt, Human
cugcaggcagccaggcca

SEQ ID NO: 2009351 - RNA, 17 nt, Human
cugcaggcagccaggcc

SEQ ID NO: 2009352 - RNA, 16 nt, Human
cugcaggcagccaggc

SEQ ID NO: 2009353 - RNA, 15 nt, Human
cugcaggcagccagg

SEQ ID NO: 2009354 - RNA, 14 nt, Human
cugcaggcagccag

SEQ ID NO: 2009355 - RNA, 13 nt, Human
cugcaggcagcca

SEQ ID NO: 2009356 - RNA, 19 nt, Human
cugcaggauucucaccagc

SEQ ID NO: 2009357 - RNA, 20 nt, Human
cugcaggauucucaccagcu

SEQ ID NO: 2009358 - RNA, 17 nt, Human
cugcaggaaauggcugu

SEQ ID NO: 2009359 - RNA, 12 nt, Human
cugcagcuuugu

SEQ ID NO: 2009360 - RNA, 17 nt, Human
cugcacuccagccuggg

SEQ ID NO: 2009361 - RNA, 16 nt, Human
cugcacuccagccugg

SEQ ID NO: 2009362 - RNA, 18 nt, Human
cugcacuccagccugggu

SEQ ID NO: 2009363 - RNA, 24 nt, Human
cugcagccucaaccuccugggcua

SEQ ID NO: 2009364 - RNA, 19 nt, Human
cugcacuccagccugggug

SEQ ID NO: 2009365 - RNA, 23 nt, Human
cugcagccucaaccuccugggcu

SEQ ID NO: 2009366 - RNA, 17 nt, Human
cugcagcucucaugcug

SEQ ID NO: 2009367 - RNA, 11 nt, Human
cugcagcuccc

SEQ ID NO: 2009368 - RNA, 13 nt, Human
cugcagcucccuc

SEQ ID NO: 2009369 - RNA, 14 nt, Human
cugcagcucccuca

SEQ ID NO: 2009370 - RNA, 19 nt, Human
cugcagcucccucaaagag

SEQ ID NO: 2009371 - RNA, 23 nt, Human
cugcagcucccucaaagaggcag

SEQ ID NO: 2009372 - RNA, 18 nt, Human
cugcagcucucaugcugc

SEQ ID NO: 2009373 - RNA, 19 nt, Human
cugcagccuccgcuucccu

SEQ ID NO: 2009374 - RNA, 20 nt, Human
cugcagccuccgcuucccug

SEQ ID NO: 2009375 - RNA, 21 nt, Human
cugcagccuccgcuucccugg

SEQ ID NO: 2009376 - RNA, 16 nt, Human
cugcacuauagccuag

SEQ ID NO: 2009377 - RNA, 17 nt, Human
cugcacuauagccuagg

SEQ ID NO: 2009378 - RNA, 18 nt, Human
cugcacuauagccuaggu

SEQ ID NO: 2009379 - RNA, 20 nt, Human
cugcacuauagccuagguga

SEQ ID NO: 2009380 - RNA, 17 nt, Human
cugauggggcaaacuca

SEQ ID NO: 2009381 - RNA, 17 nt, Human
cugcacuccagccugag

SEQ ID NO: 2009382 - RNA, 20 nt, Human
cugcacuccagccugagcga

SEQ ID NO: 2009383 - RNA, 16 nt, Human
cugcacuccagccuga

SEQ ID NO: 2009384 - RNA, 15 nt, Human
cugcacuccagccug

SEQ ID NO: 2009385 - RNA, 13 nt, Human
cugcacuccagcc

SEQ ID NO: 2009386 - RNA, 22 nt, Human
cugcacuauagccuaggugaca

SEQ ID NO: 2009387 - RNA, 23 nt, Human
cugcacuauagccuaggugacag

SEQ ID NO: 2009388 - RNA, 18 nt, Human
cugcaagaauugaagcag

SEQ ID NO: 2009389 - RNA, 19 nt, Human
cugcaacuuguaaaugugg

SEQ ID NO: 2009390 - RNA, 18 nt, Human
cugcaacuuguaaaugug

SEQ ID NO: 2009391 - RNA, 22 nt, Human
cugcaaccugauugugucucuu

SEQ ID NO: 2009392 - RNA, 17 nt, Human
cugcaaccuucgccacc

SEQ ID NO: 2009393 - RNA, 19 nt, Human
cugcaaccuucgccaccug

SEQ ID NO: 2009394 - RNA, 20 nt, Human
cugcaaccuucgccaccugg

SEQ ID NO: 2009395 - RNA, 22 nt, Human
cugcaaccuucgccaccugggu

SEQ ID NO: 2009396 - RNA, 16 nt, Human
cugcaaauccuugugg

SEQ ID NO: 2009397 - RNA, 19 nt, Human
cugcaaauccuugugggaa

SEQ ID NO: 2009398 - RNA, 23 nt, Human
cugcaaaguacagguacuuuguc

SEQ ID NO: 2009399 - RNA, 21 nt, Human
cugcaaaguacagguacuuug

SEQ ID NO: 2009400 - RNA, 22 nt, Human
cugcaaaguacagguacuuugu

SEQ ID NO: 2009401 - RNA, 20 nt, Human
cugcaaccuccgccucuugg

SEQ ID NO: 2009402 - RNA, 21 nt, Human
cugcaaccaaacucccaucag

SEQ ID NO: 2009403 - RNA, 21 nt, Human
cugcaaccugauugugucucu

SEQ ID NO: 2009404 - RNA, 19 nt, Human
cugcaaccugauugugucu

SEQ ID NO: 2009405 - RNA, 14 nt, Human
cugcaaccugauug

SEQ ID NO: 2009406 - RNA, 22 nt, Human
cugcaaccuccgccucuugggu

SEQ ID NO: 2009407 - RNA, 20 nt, Human
cugcaagaauugaagcagga

SEQ ID NO: 2009408 - RNA, 12 nt, Human
cugcaagggagu

SEQ ID NO: 2009409 - RNA, 23 nt, Human
cugcaccgggccacagagaaagu

SEQ ID NO: 2009410 - RNA, 17 nt, Human
cugaugcuucuucagag

SEQ ID NO: 2009411 - RNA, 16 nt, Human
cugaugcuucuucaga

SEQ ID NO: 2009412 - RNA, 21 nt, Human
cugaugacccccccagcuuca

SEQ ID NO: 2009413 - RNA, 22 nt, Human
cugaugacccccccagcuucac

SEQ ID NO: 2009414 - RNA, 17 nt, Human
cugaugaccaauuuuaa

SEQ ID NO: 2009415 - RNA, 15 nt, Human
cucuuaugggcuggg

SEQ ID NO: 2009416 - RNA, 22 nt, Human
cucuuauaucuaaaucugucca

SEQ ID NO: 2009417 - RNA, 15 nt, Human
cucuuauaucuauau

SEQ ID NO: 2009418 - RNA, 18 nt, Human
cucuuauaucuauauuuu

SEQ ID NO: 2009419 - RNA, 14 nt, Human
cucuuaugggcugg

SEQ ID NO: 2009420 - RNA, 20 nt, Human
cugaugcuucuucagagacu

SEQ ID NO: 2009421 - RNA, 18 nt, Human
cugauggaauuuuuuugu

SEQ ID NO: 2009422 - RNA, 19 nt, Human
cugaugcuucuucagagac

SEQ ID NO: 2009423 - RNA, 18 nt, Human
cugaugcuucuucagaga

SEQ ID NO: 2009424 - RNA, 18 nt, Human
cugaugggcaacccccag

SEQ ID NO: 2009425 - RNA, 21 nt, Human
cugaugggcaacccccagccu

SEQ ID NO: 2009426 - RNA, 24 nt, Human
cugaugggcaacccccagccugcu

SEQ ID NO: 2009427 - RNA, 22 nt, Human
cugaugggcaacccccagccug

SEQ ID NO: 2009428 - RNA, 23 nt, Human
cugaugggcaacccccagccugc

SEQ ID NO: 2009429 - RNA, 21 nt, Human
cugcaaaggguaucaggugcu

SEQ ID NO: 2009430 - RNA, 17 nt, Human
cugcaaagcccagcuug

SEQ ID NO: 2009431 - RNA, 18 nt, Human
cugcaaagcccagcuuga

SEQ ID NO: 2009432 - RNA, 15 nt, Human
cugcaaaggaaauac

SEQ ID NO: 2009433 - RNA, 22 nt, Human
cugcaaaggguaucaggugcug

SEQ ID NO: 2009434 - RNA, 18 nt, Human
uuuuaaaaaacugcugac

SEQ ID NO: 2009435 - RNA, 16 nt, Human
uuuguuuuuugagucu

SEQ ID NO: 2009436 - RNA, 18 nt, Human
uuuguuuuuugagucuuu

SEQ ID NO: 2009437 - RNA, 19 nt, Human
uuuguuuuuugagucuuuu

SEQ ID NO: 2009438 - RNA, 18 nt, Human
uuuguuuuuuguuuuucu

SEQ ID NO: 2009439 - RNA, 21 nt, Human
uuuuaaaaaacugcugacugu

SEQ ID NO: 2009440 - RNA, 15 nt, Human
uuuguuuuucugcuu

SEQ ID NO: 2009441 - RNA, 16 nt, Human
uuuguuuuuugaagug

SEQ ID NO: 2009442 - RNA, 17 nt, Human
uuuguuuuuugaagugu

SEQ ID NO: 2009443 - RNA, 19 nt, Human
uuuguuuuuugaaguguug

SEQ ID NO: 2009444 - RNA, 11 nt, Human
uuuguuuuguu

SEQ ID NO: 2009445 - RNA, 14 nt, Human
uuuguuuuguugca

SEQ ID NO: 2009446 - RNA, 16 nt, Human
augugccacauuuucu

SEQ ID NO: 2009447 - RNA, 21 nt, Human
augugccagguuuuuggucug

SEQ ID NO: 2009448 - RNA, 16 nt, Human
augugcucaucagaaa

SEQ ID NO: 2009449 - RNA, 17 nt, Human
augugcucaucagaaac

SEQ ID NO: 2009450 - RNA, 13 nt, Human
augugcugcuuug

SEQ ID NO: 2009451 - RNA, 14 nt, Human
augugcugcuuuga

SEQ ID NO: 2009452 - RNA, 16 nt, Human
augugcugcuuugaua

SEQ ID NO: 2009453 - RNA, 19 nt, Human
augugcugcuuugauauau

SEQ ID NO: 2009454 - RNA, 20 nt, Human
augugcugcuuugauauaua

SEQ ID NO: 2009455 - RNA, 23 nt, Human
auguggaaaagccaagaggcugc

SEQ ID NO: 2009456 - RNA, 22 nt, Human
auguguguguguuguguguggg

SEQ ID NO: 2009457 - RNA, 23 nt, Human
auguguguguguuguguguggga

SEQ ID NO: 2009458 - RNA, 17 nt, Human
auguguuuagaauugaa

SEQ ID NO: 2009459 - RNA, 20 nt, Human
auguguuuagaauugaaggu

SEQ ID NO: 2009460 - RNA, 15 nt, Human
auguguguuuuaaaa

SEQ ID NO: 2009461 - RNA, 13 nt, Human
auguguuuagaau

SEQ ID NO: 2009462 - RNA, 14 nt, Human
auguguuuagaauu

SEQ ID NO: 2009463 - RNA, 16 nt, Human
auguguuuagaauuga

SEQ ID NO: 2009464 - RNA, 13 nt, Human
augugugugaugu

SEQ ID NO: 2009465 - RNA, 18 nt, Human
auguuaaagauguagcaa

SEQ ID NO: 2009466 - RNA, 20 nt, Human
auguuaaagauguagcaaac

SEQ ID NO: 2009467 - RNA, 13 nt, Human
auguuaaagaugu

SEQ ID NO: 2009468 - RNA, 15 nt, Human
auguuaaagauguag

SEQ ID NO: 2009469 - RNA, 17 nt, Human
auguuaaagauguagca

SEQ ID NO: 2009470 - RNA, 19 nt, Human
auguuacauaagauaaaug

SEQ ID NO: 2009471 - RNA, 20 nt, Human
auguuacauaagauaaaugu

SEQ ID NO: 2009472 - RNA, 16 nt, Human
auguuauguauauggu

SEQ ID NO: 2009473 - RNA, 12 nt, Human
auguuauguaua

SEQ ID NO: 2009474 - RNA, 13 nt, Human
auguuauguauau

SEQ ID NO: 2009475 - RNA, 16 nt, Human
auguugcccaggcagg

SEQ ID NO: 2009476 - RNA, 19 nt, Human
auguugaacaaaauaaauu

SEQ ID NO: 2009477 - RNA, 17 nt, Human
auguugcuauaauaaag

SEQ ID NO: 2009478 - RNA, 13 nt, Human
auguugaacaaaa

SEQ ID NO: 2009479 - RNA, 15 nt, Human
auguugaacaaaaua

SEQ ID NO: 2009480 - RNA, 21 nt, Human
uuuuagacccuauugcugcuu

SEQ ID NO: 2009481 - RNA, 17 nt, Human
uuuuagaguugauacua

SEQ ID NO: 2009482 - RNA, 19 nt, Human
auguuggcagaugcagcuc

SEQ ID NO: 2009483 - RNA, 20 nt, Human
auguuggcagaugcagcucu

SEQ ID NO: 2009484 - RNA, 21 nt, Human
auguuggcagaugcagcucuu

SEQ ID NO: 2009485 - RNA, 18 nt, Human
auguugaaagaucaaaag

SEQ ID NO: 2009486 - RNA, 13 nt, Human
auguugcccaggc

SEQ ID NO: 2009487 - RNA, 14 nt, Human
auguugcccaggca

SEQ ID NO: 2009488 - RNA, 15 nt, Human
auguugcccaggcag

SEQ ID NO: 2009489 - RNA, 12 nt, Human
auguugaaagau

SEQ ID NO: 2009490 - RNA, 13 nt, Human
uuuuauucuugau

SEQ ID NO: 2009491 - RNA, 18 nt, Human
uuuuauuaaucacugugu

SEQ ID NO: 2009492 - RNA, 20 nt, Human
uuuuauuaaucacuguguau

SEQ ID NO: 2009493 - RNA, 21 nt, Human
uuuuauuaaucacuguguaua

SEQ ID NO: 2009494 - RNA, 22 nt, Human
uuuuauuaaucacuguguauau

SEQ ID NO: 2009495 - RNA, 23 nt, Human
uuuuauuaaucacuguguauauu

SEQ ID NO: 2009496 - RNA, 23 nt, Human
uuuuauuccugcccugcuguuua

SEQ ID NO: 2009497 - RNA, 12 nt, Human
uuuuauuaaauu

SEQ ID NO: 2009498 - RNA, 21 nt, Human
uuuuauggcuuuugugcauua

SEQ ID NO: 2009499 - RNA, 12 nt, Human
uuuuauuaauca

SEQ ID NO: 2009500 - RNA, 13 nt, Human
uuuuauuaaucac

SEQ ID NO: 2009501 - RNA, 14 nt, Human
uuuuauuaaucacu

SEQ ID NO: 2009502 - RNA, 15 nt, Human
uuuuauuaaucacug

SEQ ID NO: 2009503 - RNA, 18 nt, Human
uuuuauggcuuuugugca

SEQ ID NO: 2009504 - RNA, 19 nt, Human
uuuuauggcuuuugugcau

SEQ ID NO: 2009505 - RNA, 20 nt, Human
uuuuaguggacccugaaaug

SEQ ID NO: 2009506 - RNA, 21 nt, Human
uuuuaguggacccugaaaugu

SEQ ID NO: 2009507 - RNA, 23 nt, Human
uuuuaguggacccugaaaugugu

SEQ ID NO: 2009508 - RNA, 15 nt, Human
uuuuaguagagacag

SEQ ID NO: 2009509 - RNA, 14 nt, Human
uuuucaguguacau

SEQ ID NO: 2009510 - RNA, 19 nt, Human
uuuuccagagcauuccagu

SEQ ID NO: 2009511 - RNA, 20 nt, Human
uuuuccagagcauuccaguc

SEQ ID NO: 2009512 - RNA, 13 nt, Human
uuuuauuguugaa

SEQ ID NO: 2009513 - RNA, 21 nt, Human
uuuucagcuaggaacaaaucu

SEQ ID NO: 2009514 - RNA, 18 nt, Human
uuuucaggugcucaaaau

SEQ ID NO: 2009515 - RNA, 21 nt, Human
uuuucaggugcucaaaaugca

SEQ ID NO: 2009516 - RNA, 22 nt, Human
uuuucagcuaggaacaaaucuu

SEQ ID NO: 2009517 - RNA, 23 nt, Human
uuuucagcuaggaacaaaucuuc

SEQ ID NO: 2009518 - RNA, 17 nt, Human
uuuucucugauacagaa

SEQ ID NO: 2009519 - RNA, 22 nt, Human
uuuucucugauacuuuuuugaa

SEQ ID NO: 2009520 - RNA, 14 nt, Human
uuuucucuuagaaa

SEQ ID NO: 2009521 - RNA, 16 nt, Human
uuuucucuuaucugug

SEQ ID NO: 2009522 - RNA, 13 nt, Human
uuuucucuucaua

SEQ ID NO: 2009523 - RNA, 14 nt, Human
uuuucucuucauau

SEQ ID NO: 2009524 - RNA, 16 nt, Human
uuuucuauaauuuaaa

SEQ ID NO: 2009525 - RNA, 15 nt, Human
auguuuuuuuuuaaa

SEQ ID NO: 2009526 - RNA, 23 nt, Human
auuaaaaaucucaaauuucuaaa

SEQ ID NO: 2009527 - RNA, 19 nt, Human
auuaaaacacaacaucuuu

SEQ ID NO: 2009528 - RNA, 23 nt, Human
auguuuuuaaaaucuuauuaaag

SEQ ID NO: 2009529 - RNA, 14 nt, Human
auguuuuuaaaauc

SEQ ID NO: 2009530 - RNA, 15 nt, Human
auguuuuuaaaaucu

SEQ ID NO: 2009531 - RNA, 16 nt, Human
auguuuuuaaaaucuu

SEQ ID NO: 2009532 - RNA, 17 nt, Human
auguuuuuaaaaucuua

SEQ ID NO: 2009533 - RNA, 22 nt, Human
auguuuuucaguucaaagucau

SEQ ID NO: 2009534 - RNA, 13 nt, Human
auguuuuucaguu

SEQ ID NO: 2009535 - RNA, 16 nt, Human
auguuuuucaguucaa

SEQ ID NO: 2009536 - RNA, 17 nt, Human
auguuuuucaguucaaa

SEQ ID NO: 2009537 - RNA, 19 nt, Human
auguuuuucaguucaaagu

SEQ ID NO: 2009538 - RNA, 13 nt, Human
auguuuuuaaaau

SEQ ID NO: 2009539 - RNA, 17 nt, Human
auguuggccaggcuggu

SEQ ID NO: 2009540 - RNA, 12 nt, Human
uuuucuuaacca

SEQ ID NO: 2009541 - RNA, 20 nt, Human
auguuuaaaauuucuuagaa

SEQ ID NO: 2009542 - RNA, 21 nt, Human
auguuuaagcagaauuggaaa

SEQ ID NO: 2009543 - RNA, 22 nt, Human
auguuuaagcagaauuggaaaa

SEQ ID NO: 2009544 - RNA, 14 nt, Human
auguuuaagcagaa

SEQ ID NO: 2009545 - RNA, 16 nt, Human
auguuuaagcagaauu

SEQ ID NO: 2009546 - RNA, 20 nt, Human
auguuuaagcagaauuggaa

SEQ ID NO: 2009547 - RNA, 14 nt, Human
auguuuaaaguaau

SEQ ID NO: 2009548 - RNA, 18 nt, Human
auguuuaaaguaauuguu

SEQ ID NO: 2009549 - RNA, 21 nt, Human
auguuuaaaguaauuguucca

SEQ ID NO: 2009550 - RNA, 22 nt, Human
auguuuaaaguaauuguuccag

SEQ ID NO: 2009551 - RNA, 12 nt, Human
uuuucuuaaaaa

SEQ ID NO: 2009552 - RNA, 13 nt, Human
uuuucuuaaaaag

SEQ ID NO: 2009553 - RNA, 14 nt, Human
uuuucuuaaaaagu

SEQ ID NO: 2009554 - RNA, 13 nt, Human
uuuucuguucuuu

SEQ ID NO: 2009555 - RNA, 21 nt, Human
uuuucuuaaccagaucauugu

SEQ ID NO: 2009556 - RNA, 22 nt, Human
uuuucugcuuuagacuugaaaa

SEQ ID NO: 2009557 - RNA, 12 nt, Human
uuuucugcuuua

SEQ ID NO: 2009558 - RNA, 15 nt, Human
uuuucugcuuuagac

SEQ ID NO: 2009559 - RNA, 19 nt, Human
uuuucugcuuuagacuuga

SEQ ID NO: 2009560 - RNA, 14 nt, Human
uuugucuuaaaaag

SEQ ID NO: 2009561 - RNA, 13 nt, Human
uuugucuuaaaaa

SEQ ID NO: 2009562 - RNA, 23 nt, Human
uuugucuuaaaaaguggaaaaau

SEQ ID NO: 2009563 - RNA, 16 nt, Human
uuugugauacaaugcu

SEQ ID NO: 2009564 - RNA, 22 nt, Human
uuugugauacaaugcugugccc

SEQ ID NO: 2009565 - RNA, 15 nt, Human
uuugugauacaaugc

SEQ ID NO: 2009566 - RNA, 19 nt, Human
uuugugcauuaucuagaua

SEQ ID NO: 2009567 - RNA, 16 nt, Human
uuugugauguacugua

SEQ ID NO: 2009568 - RNA, 22 nt, Human
uuugugcauuaucuagauacug

SEQ ID NO: 2009569 - RNA, 16 nt, Human
uuuguuucugaaaggg

SEQ ID NO: 2009570 - RNA, 14 nt, Human
uuuguuucugaaag

SEQ ID NO: 2009571 - RNA, 14 nt, Human
uuuguacagacaac

SEQ ID NO: 2009572 - RNA, 21 nt, Human
uuuguacacccaugaaagaaa

SEQ ID NO: 2009573 - RNA, 14 nt, Human
uuuguacagagugc

SEQ ID NO: 2009574 - RNA, 16 nt, Human
uuuguaauuuuuuuau

SEQ ID NO: 2009575 - RNA, 13 nt, Human
uuuguaauuuaag

SEQ ID NO: 2009576 - RNA, 17 nt, Human
uuuguacaagauuguca

SEQ ID NO: 2009577 - RNA, 15 nt, Human
augugaugagaggaa

SEQ ID NO: 2009578 - RNA, 16 nt, Human
augugaucucauuguu

SEQ ID NO: 2009579 - RNA, 18 nt, Human
augugauccuuuuggagu

SEQ ID NO: 2009580 - RNA, 11 nt, Human
augugaucuca

SEQ ID NO: 2009581 - RNA, 19 nt, Human
auguauauuuuauaucaau

SEQ ID NO: 2009582 - RNA, 12 nt, Human
auguaucaauga

SEQ ID NO: 2009583 - RNA, 17 nt, Human
auguaucaaauacauuu

SEQ ID NO: 2009584 - RNA, 13 nt, Human
augucauuucaug

SEQ ID NO: 2009585 - RNA, 14 nt, Human
augucauuucaugu

SEQ ID NO: 2009586 - RNA, 17 nt, Human
auguccaagaagcccag

SEQ ID NO: 2009587 - RNA, 16 nt, Human
auguccaagaagccca

SEQ ID NO: 2009588 - RNA, 16 nt, Human
augucccuuucuucuc

SEQ ID NO: 2009589 - RNA, 17 nt, Human
augucccuuucuucucc

SEQ ID NO: 2009590 - RNA, 18 nt, Human
augucccuuucuucuccc

SEQ ID NO: 2009591 - RNA, 15 nt, Human
auguccuaaugguga

SEQ ID NO: 2009592 - RNA, 16 nt, Human
auguccuaauggugau

SEQ ID NO: 2009593 - RNA, 15 nt, Human
auguccuagacaggu

SEQ ID NO: 2009594 - RNA, 15 nt, Human
augugagcugcugcc

SEQ ID NO: 2009595 - RNA, 16 nt, Human
augugagcugcugcca

SEQ ID NO: 2009596 - RNA, 19 nt, Human
augugagcugcugccauga

SEQ ID NO: 2009597 - RNA, 23 nt, Human
augugagcugcugccaugaacug

SEQ ID NO: 2009598 - RNA, 14 nt, Human
augugaguauucuc

SEQ ID NO: 2009599 - RNA, 17 nt, Human
augugaguauucucauu

SEQ ID NO: 2009600 - RNA, 15 nt, Human
augugagugguugaa

SEQ ID NO: 2009601 - RNA, 16 nt, Human
augugagugguugaau

SEQ ID NO: 2009602 - RNA, 19 nt, Human
augugagugguugaauaug

SEQ ID NO: 2009603 - RNA, 22 nt, Human
augugagugguugaauaugauu

SEQ ID NO: 2009604 - RNA, 18 nt, Human
augugauauaaacagcuu

SEQ ID NO: 2009605 - RNA, 19 nt, Human
augugauauaaacagcuuc

SEQ ID NO: 2009606 - RNA, 13 nt, Human
augugagaccauu

SEQ ID NO: 2009607 - RNA, 11 nt, Human
augugacauuu

SEQ ID NO: 2009608 - RNA, 13 nt, Human
augugacauuugu

SEQ ID NO: 2009609 - RNA, 14 nt, Human
augugacauuuguc

SEQ ID NO: 2009610 - RNA, 15 nt, Human
augugacauuuguca

SEQ ID NO: 2009611 - RNA, 18 nt, Human
augugacauuugucauuu

SEQ ID NO: 2009612 - RNA, 19 nt, Human
augugacauuugucauuuu

SEQ ID NO: 2009613 - RNA, 22 nt, Human
augugacauuugucauuuucau

SEQ ID NO: 2009614 - RNA, 13 nt, Human
augugacuuugaa

SEQ ID NO: 2009615 - RNA, 21 nt, Human
augugacuuugaaaauauaua

SEQ ID NO: 2009616 - RNA, 14 nt, Human
augugagacugguu

SEQ ID NO: 2009617 - RNA, 23 nt, Human
augucgucaaagcugaaauggac

SEQ ID NO: 2009618 - RNA, 15 nt, Human
augucgccucugcau

SEQ ID NO: 2009619 - RNA, 19 nt, Human
augucguaguuacucucag

SEQ ID NO: 2009620 - RNA, 22 nt, Human
augucguaguuacucucaggca

SEQ ID NO: 2009621 - RNA, 18 nt, Human
augucgucgagcuccccc

SEQ ID NO: 2009622 - RNA, 18 nt, Human
uuuggcaaacucuccacc

SEQ ID NO: 2009623 - RNA, 13 nt, Human
uuuggcuccugcc

SEQ ID NO: 2009624 - RNA, 14 nt, Human
uuuggcuccugccc

SEQ ID NO: 2009625 - RNA, 15 nt, Human
uuuggcuccugccca

SEQ ID NO: 2009626 - RNA, 13 nt, Human
uuuggcugcugaa

SEQ ID NO: 2009627 - RNA, 12 nt, Human
uuuggcugcuga

SEQ ID NO: 2009628 - RNA, 14 nt, Human
uuugggcugcccug

SEQ ID NO: 2009629 - RNA, 17 nt, Human
uuugggcagagaggcug

SEQ ID NO: 2009630 - RNA, 17 nt, Human
auguauauaaacaugcu

SEQ ID NO: 2009631 - RNA, 14 nt, Human
auguauaguauuug

SEQ ID NO: 2009632 - RNA, 16 nt, Human
auguauaguauuugaa

SEQ ID NO: 2009633 - RNA, 17 nt, Human
auguauaguauuugaaa

SEQ ID NO: 2009634 - RNA, 18 nt, Human
auguauaguauuugaaaa

SEQ ID NO: 2009635 - RNA, 20 nt, Human
auguauaguauuugaaaaca

SEQ ID NO: 2009636 - RNA, 14 nt, Human
auguauacaugugc

SEQ ID NO: 2009637 - RNA, 21 nt, Human
auguauaauucaaagcaccaa

SEQ ID NO: 2009638 - RNA, 13 nt, Human
uuuggggaagaac

SEQ ID NO: 2009639 - RNA, 23 nt, Human
uuugggcuuguuguuuguaacaa

SEQ ID NO: 2009640 - RNA, 21 nt, Human
uuugggguacccacugcucug

SEQ ID NO: 2009641 - RNA, 22 nt, Human
uuugggguacccacugcucugg

SEQ ID NO: 2009642 - RNA, 22 nt, Human
uuuggauuggaugaauuccaaa

SEQ ID NO: 2009643 - RNA, 20 nt, Human
uuugcuggagcucugcccau

SEQ ID NO: 2009644 - RNA, 19 nt, Human
uuugcuggggccgaaagaa

SEQ ID NO: 2009645 - RNA, 22 nt, Human
uuugcuggggccgaaagaacag

SEQ ID NO: 2009646 - RNA, 18 nt, Human
uuugauucagacagcugc

SEQ ID NO: 2009647 - RNA, 21 nt, Human
uuugauuuauuaacuuaauaa

SEQ ID NO: 2009648 - RNA, 14 nt, Human
uuugauuuguacag

SEQ ID NO: 2009649 - RNA, 14 nt, Human
uuugauuugucacu

SEQ ID NO: 2009650 - RNA, 13 nt, Human
uuugauuuauuaa

SEQ ID NO: 2009651 - RNA, 16 nt, Human
uuugauuuauuaacuu

SEQ ID NO: 2009652 - RNA, 22 nt, Human
uuugcaaaaauccaaauauugu

SEQ ID NO: 2009653 - RNA, 15 nt, Human
uuugcaaaggagcuc

SEQ ID NO: 2009654 - RNA, 22 nt, Human
uuugcgaauauuuuguaaauua

SEQ ID NO: 2009655 - RNA, 12 nt, Human
uuucccuuccag

SEQ ID NO: 2009656 - RNA, 13 nt, Human
uuucccuuccagu

SEQ ID NO: 2009657 - RNA, 14 nt, Human
uuucccuuccaguu

SEQ ID NO: 2009658 - RNA, 15 nt, Human
uuucccuugaggaaa

SEQ ID NO: 2009659 - RNA, 17 nt, Human
uuugaauuuucauuuua

SEQ ID NO: 2009660 - RNA, 13 nt, Human
uuucccugaaguu

SEQ ID NO: 2009661 - RNA, 21 nt, Human
uuucccugaaguuauguguau

SEQ ID NO: 2009662 - RNA, 23 nt, Human
uuucccucccuuccucuuuccau

SEQ ID NO: 2009663 - RNA, 16 nt, Human
uuucccucagaaaaug

SEQ ID NO: 2009664 - RNA, 19 nt, Human
uuugaccucugcagcaaua

SEQ ID NO: 2009665 - RNA, 21 nt, Human
uuugaccucugcagcaauaaa

SEQ ID NO: 2009666 - RNA, 14 nt, Human
uuugacaaggggca

SEQ ID NO: 2009667 - RNA, 18 nt, Human
uuugacaaagguaaauca

SEQ ID NO: 2009668 - RNA, 23 nt, Human
uuugacaagcuggcuuacacugg

SEQ ID NO: 2009669 - RNA, 20 nt, Human
uuugaauuuucauuuuacag

SEQ ID NO: 2009670 - RNA, 23 nt, Human
uuugaauuuucauuuuacaguua

SEQ ID NO: 2009671 - RNA, 15 nt, Human
uuugauucagacagc

SEQ ID NO: 2009672 - RNA, 13 nt, Human
uuugauucacaug

SEQ ID NO: 2009673 - RNA, 14 nt, Human
uuugauucacaugu

SEQ ID NO: 2009674 - RNA, 16 nt, Human
uuugauucacauguuu

SEQ ID NO: 2009675 - RNA, 18 nt, Human
uuugauucacauguuuuc

SEQ ID NO: 2009676 - RNA, 19 nt, Human
uuugauucacauguuuuca

SEQ ID NO: 2009677 - RNA, 20 nt, Human
uuugauucacauguuuucaa

SEQ ID NO: 2009678 - RNA, 21 nt, Human
uuugauucacauguuuucaaa

SEQ ID NO: 2009679 - RNA, 22 nt, Human
uuugauucacauguuuucaaau

SEQ ID NO: 2009680 - RNA, 12 nt, Human
uuugauucacau

SEQ ID NO: 2009681 - RNA, 18 nt, Human
uuugaucuuccucugcua

SEQ ID NO: 2009682 - RNA, 19 nt, Human
uuugaucuuccucugcuaa

SEQ ID NO: 2009683 - RNA, 20 nt, Human
uuugaucuuccucugcuaaa

SEQ ID NO: 2009684 - RNA, 22 nt, Human
uuugaucuuccucugcuaaauu

SEQ ID NO: 2009685 - RNA, 16 nt, Human
uuugaucucacauuuu

SEQ ID NO: 2009686 - RNA, 18 nt, Human
uuugaucucacauuuuua

SEQ ID NO: 2009687 - RNA, 14 nt, Human
uuugaucucacauu

SEQ ID NO: 2009688 - RNA, 15 nt, Human
uuugauccaagcugg

SEQ ID NO: 2009689 - RNA, 23 nt, Human
uuugaccuguugggagugaggau

SEQ ID NO: 2009690 - RNA, 18 nt, Human
uuugaccucugcagcaau

SEQ ID NO: 2009691 - RNA, 13 nt, Human
uuugagacagagu

SEQ ID NO: 2009692 - RNA, 15 nt, Human
auucagccuggcuuc

SEQ ID NO: 2009693 - RNA, 21 nt, Human
auucaaagaaucaccuaauua

SEQ ID NO: 2009694 - RNA, 19 nt, Human
auucaaagcaccaaaauaa

SEQ ID NO: 2009695 - RNA, 14 nt, Human
auucaaagaaucac

SEQ ID NO: 2009696 - RNA, 15 nt, Human
auucaaaccuaaguu

SEQ ID NO: 2009697 - RNA, 18 nt, Human
auucaaacugaaaagcug

SEQ ID NO: 2009698 - RNA, 13 nt, Human
auucaccuucagu

SEQ ID NO: 2009699 - RNA, 17 nt, Human
auuauugauguuuucau

SEQ ID NO: 2009700 - RNA, 14 nt, Human
auuauugaugaaaa

SEQ ID NO: 2009701 - RNA, 21 nt, Human
auuauuggaaaggaccuaaaa

SEQ ID NO: 2009702 - RNA, 22 nt, Human
auuauuguccuuugauuccaaa

SEQ ID NO: 2009703 - RNA, 12 nt, Human
auucaaaaaguc

SEQ ID NO: 2009704 - RNA, 19 nt, Human
auucaaaaagucacaguua

SEQ ID NO: 2009705 - RNA, 18 nt, Human
auuauaaacaagaaugaa

SEQ ID NO: 2009706 - RNA, 22 nt, Human
auuauaaacaagaaugaagguu

SEQ ID NO: 2009707 - RNA, 17 nt, Human
auuauaaacucauuuug

SEQ ID NO: 2009708 - RNA, 19 nt, Human
auuauaaacucauuuugcu

SEQ ID NO: 2009709 - RNA, 19 nt, Human
auuagacuucuguuuucaa

SEQ ID NO: 2009710 - RNA, 20 nt, Human
auuagacuucuguuuucaau

SEQ ID NO: 2009711 - RNA, 18 nt, Human
auuauaucagacugcuuu

SEQ ID NO: 2009712 - RNA, 20 nt, Human
auuauauggcuugaguuuaa

SEQ ID NO: 2009713 - RNA, 15 nt, Human
auuauucaggcuuua

SEQ ID NO: 2009714 - RNA, 16 nt, Human
auucagugaugugccu

SEQ ID NO: 2009715 - RNA, 18 nt, Human
auucaggggaaacuugau

SEQ ID NO: 2009716 - RNA, 20 nt, Human
auucagaaaugacuuuuuga

SEQ ID NO: 2009717 - RNA, 14 nt, Human
auucagccuggcuu

SEQ ID NO: 2009718 - RNA, 12 nt, Human
auucagcaucug

SEQ ID NO: 2009719 - RNA, 19 nt, Human
auucagcauuagugggaaa

SEQ ID NO: 2009720 - RNA, 14 nt, Human
auucagauuucucu

SEQ ID NO: 2009721 - RNA, 19 nt, Human
auucagauuucucuuugaa

SEQ ID NO: 2009722 - RNA, 20 nt, Human
auucagauuucucuuugaaa

SEQ ID NO: 2009723 - RNA, 20 nt, Human
auucagcaaggcgcuaacuu

SEQ ID NO: 2009724 - RNA, 21 nt, Human
auucagcaaggcgcuaacuug

SEQ ID NO: 2009725 - RNA, 23 nt, Human
auucagcaaggcgcuaacuugcu

SEQ ID NO: 2009726 - RNA, 22 nt, Human
auuccccaggaggccagccuug

SEQ ID NO: 2009727 - RNA, 20 nt, Human
auuccccaggaggccagccu

SEQ ID NO: 2009728 - RNA, 18 nt, Human
auucccaagcucugcucc

SEQ ID NO: 2009729 - RNA, 19 nt, Human
auucccaagcucugcuccu

SEQ ID NO: 2009730 - RNA, 18 nt, Human
auuccagaaugaagaauu

SEQ ID NO: 2009731 - RNA, 16 nt, Human
auuccagacagucaca

SEQ ID NO: 2009732 - RNA, 23 nt, Human
auuccagacagucacaaauuucu

SEQ ID NO: 2009733 - RNA, 17 nt, Human
auucccaagcucugcuc

SEQ ID NO: 2009734 - RNA, 18 nt, Human
auuccagagaguggcucc

SEQ ID NO: 2009735 - RNA, 17 nt, Human
auuccaagugauugaaa

SEQ ID NO: 2009736 - RNA, 12 nt, Human
auuccacagcug

SEQ ID NO: 2009737 - RNA, 23 nt, Human
auuccaagucagaaacuguuucu

SEQ ID NO: 2009738 - RNA, 17 nt, Human
uuuugugaaauuuuuca

SEQ ID NO: 2009739 - RNA, 20 nt, Human
uuuugugaaauuuuucauau

SEQ ID NO: 2009740 - RNA, 22 nt, Human
uuuugugaaauuuuucauauuu

SEQ ID NO: 2009741 - RNA, 19 nt, Human
uuuugugaagugaaggauu

SEQ ID NO: 2009742 - RNA, 12 nt, Human
uuuugugaaauu

SEQ ID NO: 2009743 - RNA, 13 nt, Human
uuuugugaaauuu

SEQ ID NO: 2009744 - RNA, 16 nt, Human
uuuuguguugaagagc

SEQ ID NO: 2009745 - RNA, 12 nt, Human
uuuuguguuuau

SEQ ID NO: 2009746 - RNA, 23 nt, Human
uuuuguguuuauucuugaugaaa

SEQ ID NO: 2009747 - RNA, 23 nt, Human
uuuugugaguuuguuucuuugaa

SEQ ID NO: 2009748 - RNA, 22 nt, Human
uuuugugcuuaguuaaaucuuu

SEQ ID NO: 2009749 - RNA, 23 nt, Human
uuuugugcauuaucuagauacug

SEQ ID NO: 2009750 - RNA, 14 nt, Human
uuuugugaguuugu

SEQ ID NO: 2009751 - RNA, 13 nt, Human
auuaaaauuguug

SEQ ID NO: 2009752 - RNA, 23 nt, Human
auuaaaauaugcacuaagucucu

SEQ ID NO: 2009753 - RNA, 17 nt, Human
uuuugcuuuaauuuuag

SEQ ID NO: 2009754 - RNA, 18 nt, Human
uuuugcuuuaauuuuagc

SEQ ID NO: 2009755 - RNA, 11 nt, Human
uuuugcuuuug

SEQ ID NO: 2009756 - RNA, 13 nt, Human
uuuugcuuccccu

SEQ ID NO: 2009757 - RNA, 22 nt, Human
uuuugcuugaagcaaacaguug

SEQ ID NO: 2009758 - RNA, 13 nt, Human
uuuugcuuuaauu

SEQ ID NO: 2009759 - RNA, 19 nt, Human
uuuugcuuuaauuccauga

SEQ ID NO: 2009760 - RNA, 22 nt, Human
uuuuggaaaacgauuuaauuua

SEQ ID NO: 2009761 - RNA, 16 nt, Human
uuuuguuacucuuggg

SEQ ID NO: 2009762 - RNA, 11 nt, Human
uuuuguugcac

SEQ ID NO: 2009763 - RNA, 12 nt, Human
uuuuguugcacu

SEQ ID NO: 2009764 - RNA, 13 nt, Human
uuuuguugcacug

SEQ ID NO: 2009765 - RNA, 15 nt, Human
uuuuguugcacugaa

SEQ ID NO: 2009766 - RNA, 18 nt, Human
uuuuguugcacugaaguu

SEQ ID NO: 2009767 - RNA, 16 nt, Human
uuuuguuuuugucuua

SEQ ID NO: 2009768 - RNA, 13 nt, Human
uuuuguuuugcuu

SEQ ID NO: 2009769 - RNA, 21 nt, Human
uuuuguugcacugaaguuuga

SEQ ID NO: 2009770 - RNA, 15 nt, Human
uuuuguuuuguugca

SEQ ID NO: 2009771 - RNA, 18 nt, Human
uuuuguuuuucugcuuua

SEQ ID NO: 2009772 - RNA, 16 nt, Human
uuuuguuuuuugaguc

SEQ ID NO: 2009773 - RNA, 13 nt, Human
uuuuuaauuguau

SEQ ID NO: 2009774 - RNA, 14 nt, Human
uuuuuauaucuugg

SEQ ID NO: 2009775 - RNA, 14 nt, Human
uuuuuauauuucaa

SEQ ID NO: 2009776 - RNA, 21 nt, Human
uuuuuauauuucaaguacacu

SEQ ID NO: 2009777 - RNA, 21 nt, Human
uuuuuauaccuguuuaaauug

SEQ ID NO: 2009778 - RNA, 17 nt, Human
uuuuuauauauaugcau

SEQ ID NO: 2009779 - RNA, 19 nt, Human
auuaaguacuauguaucaa

SEQ ID NO: 2009780 - RNA, 18 nt, Human
auuaaguacuauguauca

SEQ ID NO: 2009781 - RNA, 13 nt, Human
auuaaggaagaca

SEQ ID NO: 2009782 - RNA, 11 nt, Human
uuuuuguauuc

SEQ ID NO: 2009783 - RNA, 11 nt, Human
uuuuuguauuu

SEQ ID NO: 2009784 - RNA, 22 nt, Human
uuuuugggaaaagaaaagucaa

SEQ ID NO: 2009785 - RNA, 10 nt, Human
uuuuuguaaa

SEQ ID NO: 2009786 - RNA, 14 nt, Human
uuuuuguaaagauu

SEQ ID NO: 2009787 - RNA, 19 nt, Human
uuuuuguaaagauuucugu

SEQ ID NO: 2009788 - RNA, 9 nt, Human
uuuuuguau

SEQ ID NO: 2009789 - RNA, 22 nt, Human
uuuuuguauauugguuuuauga

SEQ ID NO: 2009790 - RNA, 19 nt, Human
uuuuuggaagugaaaacuu

SEQ ID NO: 2009791 - RNA, 15 nt, Human
uuuuuggacacauuu

SEQ ID NO: 2009792 - RNA, 15 nt, Human
uuuuuggaagugaaa

SEQ ID NO: 2009793 - RNA, 14 nt, Human
uuuuugcucuaaaa

SEQ ID NO: 2009794 - RNA, 18 nt, Human
uuuuugcaggagcaguau

SEQ ID NO: 2009795 - RNA, 13 nt, Human
uuuuugauagcau

SEQ ID NO: 2009796 - RNA, 14 nt, Human
uuuuugauagcauu

SEQ ID NO: 2009797 - RNA, 19 nt, Human
uuuuugauagcauuguaag

SEQ ID NO: 2009798 - RNA, 14 nt, Human
uuuuugaaguguug

SEQ ID NO: 2009799 - RNA, 15 nt, Human
uuuuuauuucuccuu

SEQ ID NO: 2009800 - RNA, 22 nt, Human
uuuuuauuucugucaguuauga

SEQ ID NO: 2009801 - RNA, 21 nt, Human
uuuuuauuuauauguaugugu

SEQ ID NO: 2009802 - RNA, 14 nt, Human
uuuuuauuucuccu

SEQ ID NO: 2009803 - RNA, 14 nt, Human
uuuuuauuuauaug

SEQ ID NO: 2009804 - RNA, 17 nt, Human
uuuuuauuuauauguau

SEQ ID NO: 2009805 - RNA, 22 nt, Human
uuuuuauauuucaaguacacug

SEQ ID NO: 2009806 - RNA, 13 nt, Human
uuuuuauuuauau

SEQ ID NO: 2009807 - RNA, 22 nt, Human
uuuuugaaggcagaaagcaaaa

SEQ ID NO: 2009808 - RNA, 23 nt, Human
uuuuugaaggcagaaagcaaaau

SEQ ID NO: 2009809 - RNA, 15 nt, Human
uuuuugaagcuguau

SEQ ID NO: 2009810 - RNA, 13 nt, Human
auuagagaagaga

SEQ ID NO: 2009811 - RNA, 14 nt, Human
auuagacuucuguu

SEQ ID NO: 2009812 - RNA, 15 nt, Human
auuagacuucuguuu

SEQ ID NO: 2009813 - RNA, 16 nt, Human
auuagacuucuguuuu

SEQ ID NO: 2009814 - RNA, 17 nt, Human
auuacuuguugccuaua

SEQ ID NO: 2009815 - RNA, 14 nt, Human
auuacuucugcuac

SEQ ID NO: 2009816 - RNA, 15 nt, Human
auuacuuguugccua

SEQ ID NO: 2009817 - RNA, 12 nt, Human
auuacuucugcu

SEQ ID NO: 2009818 - RNA, 13 nt, Human
auuacuucugcua

SEQ ID NO: 2009819 - RNA, 12 nt, Human
auuaaucacugu

SEQ ID NO: 2009820 - RNA, 13 nt, Human
auuaaucacugug

SEQ ID NO: 2009821 - RNA, 14 nt, Human
auuaaucacugugu

SEQ ID NO: 2009822 - RNA, 15 nt, Human
auuaaucacugugua

SEQ ID NO: 2009823 - RNA, 16 nt, Human
auuaaucacuguguau

SEQ ID NO: 2009824 - RNA, 17 nt, Human
auuaaucacuguguaua

SEQ ID NO: 2009825 - RNA, 18 nt, Human
auuaaucacuguguauau

SEQ ID NO: 2009826 - RNA, 19 nt, Human
auuaaucacuguguauauu

SEQ ID NO: 2009827 - RNA, 20 nt, Human
auuaaucacuguguauauuu

SEQ ID NO: 2009828 - RNA, 21 nt, Human
auuaaucacuguguauauuug

SEQ ID NO: 2009829 - RNA, 22 nt, Human
auuaaucacuguguauauuuga

SEQ ID NO: 2009830 - RNA, 23 nt, Human
auuaaucacuguguauauuugau

SEQ ID NO: 2009831 - RNA, 17 nt, Human
auuacuguuuaagacac

SEQ ID NO: 2009832 - RNA, 21 nt, Human
auuaaguccuacuuuuaaaga

SEQ ID NO: 2009833 - RNA, 20 nt, Human
auugaagguuuuugauagca

SEQ ID NO: 2009834 - RNA, 20 nt, Human
auugaauuuuuauuuuugaa

SEQ ID NO: 2009835 - RNA, 13 nt, Human
auugaagguuuuu

SEQ ID NO: 2009836 - RNA, 17 nt, Human
auugaagguuuuugaua

SEQ ID NO: 2009837 - RNA, 18 nt, Human
auugaagguuuuugauag

SEQ ID NO: 2009838 - RNA, 19 nt, Human
auugaagguuuuugauagc

SEQ ID NO: 2009839 - RNA, 17 nt, Human
auugcaacaggcugggc

SEQ ID NO: 2009840 - RNA, 18 nt, Human
auugcaacaggcugggcu

SEQ ID NO: 2009841 - RNA, 12 nt, Human
auugcaccacug

SEQ ID NO: 2009842 - RNA, 19 nt, Human
auugcaacaggcugggcuu

SEQ ID NO: 2009843 - RNA, 15 nt, Human
auugauuuuaaaaug

SEQ ID NO: 2009844 - RNA, 16 nt, Human
auugauuuuaaaaugu

SEQ ID NO: 2009845 - RNA, 19 nt, Human
auugauuuuaaaauguaca

SEQ ID NO: 2009846 - RNA, 20 nt, Human
auugauuuuaaaauguacau

SEQ ID NO: 2009847 - RNA, 15 nt, Human
auugauuugauuuuu

SEQ ID NO: 2009848 - RNA, 14 nt, Human
auugauguuuccuu

SEQ ID NO: 2009849 - RNA, 12 nt, Human
auugauguugau

SEQ ID NO: 2009850 - RNA, 13 nt, Human
auugauguugaug

SEQ ID NO: 2009851 - RNA, 14 nt, Human
auugauguugaugc

SEQ ID NO: 2009852 - RNA, 16 nt, Human
auugauguugaugcaa

SEQ ID NO: 2009853 - RNA, 18 nt, Human
auugauguugaugcaauc

SEQ ID NO: 2009854 - RNA, 13 nt, Human
auugauguuuuca

SEQ ID NO: 2009855 - RNA, 16 nt, Human
auugauguuuucauag

SEQ ID NO: 2009856 - RNA, 17 nt, Human
auugauguuuucauaga

SEQ ID NO: 2009857 - RNA, 23 nt, Human
auuggcuagagguucaaagauau

SEQ ID NO: 2009858 - RNA, 19 nt, Human
auuggcuagagguucaaag

SEQ ID NO: 2009859 - RNA, 20 nt, Human
auuggcuagagguucaaaga

SEQ ID NO: 2009860 - RNA, 22 nt, Human
auuggcuagagguucaaagaua

SEQ ID NO: 2009861 - RNA, 22 nt, Human
auugcauauaacuuauauugua

SEQ ID NO: 2009862 - RNA, 16 nt, Human
auugcauauaacuuau

SEQ ID NO: 2009863 - RNA, 18 nt, Human
auugcauauaacuuauau

SEQ ID NO: 2009864 - RNA, 20 nt, Human
auugcaucuggguagcugua

SEQ ID NO: 2009865 - RNA, 21 nt, Human
auugcaucuggguagcuguaa

SEQ ID NO: 2009866 - RNA, 15 nt, Human
auugcaucauuuaca

SEQ ID NO: 2009867 - RNA, 22 nt, Human
auugcaucuggguagcuguaag

SEQ ID NO: 2009868 - RNA, 19 nt, Human
auugcaugccgggugcagc

SEQ ID NO: 2009869 - RNA, 23 nt, Human
auugcaugccgggugcagcaucu

SEQ ID NO: 2009870 - RNA, 13 nt, Human
auuggaaauuuca

SEQ ID NO: 2009871 - RNA, 14 nt, Human
auuggaaauuucac

SEQ ID NO: 2009872 - RNA, 15 nt, Human
auuggaaauuucacg

SEQ ID NO: 2009873 - RNA, 17 nt, Human
auuggaaugcacucaga

SEQ ID NO: 2009874 - RNA, 12 nt, Human
auuggaagcagg

SEQ ID NO: 2009875 - RNA, 19 nt, Human
auuggaagcagguuaaaug

SEQ ID NO: 2009876 - RNA, 20 nt, Human
auuggaagcagguuaaaugu

SEQ ID NO: 2009877 - RNA, 21 nt, Human
auuggaagcagguuaaauguu

SEQ ID NO: 2009878 - RNA, 22 nt, Human
auuggaagcagguuaaauguuu

SEQ ID NO: 2009879 - RNA, 14 nt, Human
auuggaaacaaguc

SEQ ID NO: 2009880 - RNA, 13 nt, Human
auuggaaacaagu

SEQ ID NO: 2009881 - RNA, 13 nt, Human
auugccuuucugu

SEQ ID NO: 2009882 - RNA, 11 nt, Human
auuucuuuaua

SEQ ID NO: 2009883 - RNA, 15 nt, Human
auuucuuuauaaaau

SEQ ID NO: 2009884 - RNA, 22 nt, Human
auuucuuuauaaaauuuacugu

SEQ ID NO: 2009885 - RNA, 23 nt, Human
auuugaauguaugcuucauacag

SEQ ID NO: 2009886 - RNA, 20 nt, Human
auuucuugagguaaaagcau

SEQ ID NO: 2009887 - RNA, 16 nt, Human
auuucuuccacaagag

SEQ ID NO: 2009888 - RNA, 17 nt, Human
auuugaggucuguucuu

SEQ ID NO: 2009889 - RNA, 18 nt, Human
auuugaggucuguucuuu

SEQ ID NO: 2009890 - RNA, 15 nt, Human
auuugagcagggcuc

SEQ ID NO: 2009891 - RNA, 16 nt, Human
auuugagcagggcuca

SEQ ID NO: 2009892 - RNA, 12 nt, Human
auuugagauuuu

SEQ ID NO: 2009893 - RNA, 18 nt, Human
auuugauaugugaacagu

SEQ ID NO: 2009894 - RNA, 19 nt, Human
auuugauaugugaacaguu

SEQ ID NO: 2009895 - RNA, 21 nt, Human
auuugaggucuguucuuucca

SEQ ID NO: 2009896 - RNA, 16 nt, Human
auuuggagggccuggg

SEQ ID NO: 2009897 - RNA, 17 nt, Human
auuuggagggccugggc

SEQ ID NO: 2009898 - RNA, 15 nt, Human
auuuggagggccugg

SEQ ID NO: 2009899 - RNA, 14 nt, Human
auuuggagagaaau

SEQ ID NO: 2009900 - RNA, 15 nt, Human
auuuggagagaaaua

SEQ ID NO: 2009901 - RNA, 16 nt, Human
auuuggagagaaauau

SEQ ID NO: 2009902 - RNA, 17 nt, Human
auuuggagagaaauauu

SEQ ID NO: 2009903 - RNA, 18 nt, Human
auuuggagagaaauauuu

SEQ ID NO: 2009904 - RNA, 12 nt, Human
auuugguuuuca

SEQ ID NO: 2009905 - RNA, 14 nt, Human
auuugguuuucaca

SEQ ID NO: 2009906 - RNA, 13 nt, Human
auuuguaauuuaa

SEQ ID NO: 2009907 - RNA, 21 nt, Human
auuuguacagauucuuuauua

SEQ ID NO: 2009908 - RNA, 21 nt, Human
auuuggugguuucagaaaugu

SEQ ID NO: 2009909 - RNA, 14 nt, Human
auuuggaugcagag

SEQ ID NO: 2009910 - RNA, 22 nt, Human
auuuggagggccugggccuggc

SEQ ID NO: 2009911 - RNA, 19 nt, Human
auuuggauuauucuuucuc

SEQ ID NO: 2009912 - RNA, 23 nt, Human
auuuauaaaaauaaaaaacacug

SEQ ID NO: 2009913 - RNA, 17 nt, Human
auuuaguguucauaaau

SEQ ID NO: 2009914 - RNA, 20 nt, Human
auuuacuucuuauacauuug

SEQ ID NO: 2009915 - RNA, 19 nt, Human
auuuacuucuuauacauuu

SEQ ID NO: 2009916 - RNA, 16 nt, Human
auuuaguguucauaaa

SEQ ID NO: 2009917 - RNA, 15 nt, Human
auuuauaaacuuuuu

SEQ ID NO: 2009918 - RNA, 19 nt, Human
auuuaugguaaucauauua

SEQ ID NO: 2009919 - RNA, 22 nt, Human
auuuacuacaauauguacauuu

SEQ ID NO: 2009920 - RNA, 19 nt, Human
auuuacaagacaacauugu

SEQ ID NO: 2009921 - RNA, 16 nt, Human
auuuaaauagcuuuuu

SEQ ID NO: 2009922 - RNA, 15 nt, Human
auuuaaaauugugau

SEQ ID NO: 2009923 - RNA, 12 nt, Human
auuuaaaaugua

SEQ ID NO: 2009924 - RNA, 14 nt, Human
auuuaaaaaaaauc

SEQ ID NO: 2009925 - RNA, 20 nt, Human
auuguuuuucugauauguuu

SEQ ID NO: 2009926 - RNA, 19 nt, Human
auuguuuucaguguacaug

SEQ ID NO: 2009927 - RNA, 18 nt, Human
auuguuuucaguguacau

SEQ ID NO: 2009928 - RNA, 17 nt, Human
auuuaaaaaaaaaccug

SEQ ID NO: 2009929 - RNA, 20 nt, Human
auuguagcauccuggaauau

SEQ ID NO: 2009930 - RNA, 17 nt, Human
auuguuuucaguguaca

SEQ ID NO: 2009931 - RNA, 18 nt, Human
auuguagagccagagguc

SEQ ID NO: 2009932 - RNA, 17 nt, Human
auuguagcauccuggaa

SEQ ID NO: 2009933 - RNA, 17 nt, Human
auuguagagccagaggu

SEQ ID NO: 2009934 - RNA, 16 nt, Human
auuguaguccuguaau

SEQ ID NO: 2009935 - RNA, 16 nt, Human
auuuauucugggaaug

SEQ ID NO: 2009936 - RNA, 18 nt, Human
auuuauucugggaaugua

SEQ ID NO: 2009937 - RNA, 19 nt, Human
auuuauucugggaauguau

SEQ ID NO: 2009938 - RNA, 20 nt, Human
auuuauucugggaauguaua

SEQ ID NO: 2009939 - RNA, 21 nt, Human
auuuauucugggaauguauag

SEQ ID NO: 2009940 - RNA, 22 nt, Human
auuuauucugggaauguauagu

SEQ ID NO: 2009941 - RNA, 13 nt, Human
auuuauugaaaug

SEQ ID NO: 2009942 - RNA, 15 nt, Human
auuuauugaaaugau

SEQ ID NO: 2009943 - RNA, 22 nt, Human
auuuauugaaaugauuucacag

SEQ ID NO: 2009944 - RNA, 21 nt, Human
auuuauugaggaaaaauaugu

SEQ ID NO: 2009945 - RNA, 11 nt, Human
auuuauucuuu

SEQ ID NO: 2009946 - RNA, 13 nt, Human
auuuauugacucu

SEQ ID NO: 2009947 - RNA, 14 nt, Human
auuuauugacucuu

SEQ ID NO: 2009948 - RNA, 16 nt, Human
auuuauugacucuuga

SEQ ID NO: 2009949 - RNA, 19 nt, Human
auuuauugacucuugaguu

SEQ ID NO: 2009950 - RNA, 20 nt, Human
auuuauugacucuugaguug

SEQ ID NO: 2009951 - RNA, 22 nt, Human
auuuauugacucuugaguuguu

SEQ ID NO: 2009952 - RNA, 14 nt, Human
auuuauugaggaaa

SEQ ID NO: 2009953 - RNA, 15 nt, Human
auuuauugaggaaaa

SEQ ID NO: 2009954 - RNA, 17 nt, Human
auuuauugaggaaaaau

SEQ ID NO: 2009955 - RNA, 18 nt, Human
auuuauugaggaaaaaua

SEQ ID NO: 2009956 - RNA, 16 nt, Human
auuuccucuugaacca

SEQ ID NO: 2009957 - RNA, 16 nt, Human
auuucgugacuuuuuu

SEQ ID NO: 2009958 - RNA, 16 nt, Human
auuucccaaagcagug

SEQ ID NO: 2009959 - RNA, 14 nt, Human
auuucccaaagcag

SEQ ID NO: 2009960 - RNA, 17 nt, Human
auuuccguuaaaauacc

SEQ ID NO: 2009961 - RNA, 14 nt, Human
auuuccuaaauaua

SEQ ID NO: 2009962 - RNA, 15 nt, Human
auuuccuauaccauu

SEQ ID NO: 2009963 - RNA, 21 nt, Human
auuuccuaaauauauuuuaag

SEQ ID NO: 2009964 - RNA, 22 nt, Human
auuuauuuuuuuuaauuguauu

SEQ ID NO: 2009965 - RNA, 23 nt, Human
auuuauuuuuuuuaauuguauuu

SEQ ID NO: 2009966 - RNA, 17 nt, Human
auuuccauguaugcaua

SEQ ID NO: 2009967 - RNA, 18 nt, Human
auuuccauguaugcauaa

SEQ ID NO: 2009968 - RNA, 14 nt, Human
auuuccauguaugc

SEQ ID NO: 2009969 - RNA, 15 nt, Human
auuuccauguaugca

SEQ ID NO: 2009970 - RNA, 18 nt, Human
auuucauguccuguguca

SEQ ID NO: 2009971 - RNA, 21 nt, Human
auuucauguccugugucaguu

SEQ ID NO: 2009972 - RNA, 22 nt, Human
auuucauguccugugucaguuu

SEQ ID NO: 2009973 - RNA, 23 nt, Human
auuucauguccugugucaguuua

SEQ ID NO: 2009974 - RNA, 18 nt, Human
auuuauuuuuaagaaaga

SEQ ID NO: 2009975 - RNA, 19 nt, Human
auuuauuuuuaagaaagaa

SEQ ID NO: 2009976 - RNA, 20 nt, Human
auuuauuuuuaagaaagaaa

SEQ ID NO: 2009977 - RNA, 19 nt, Human
auuuauuuuuuuuaauugu

SEQ ID NO: 2009978 - RNA, 21 nt, Human
auuuauuuuuuuuaauuguau

SEQ ID NO: 2009979 - RNA, 23 nt, Human
augcacuuuguucuggcucuucc

SEQ ID NO: 2009980 - RNA, 17 nt, Human
augcagaauggcauuug

SEQ ID NO: 2009981 - RNA, 18 nt, Human
uuuaaaaaaauuccaagu

SEQ ID NO: 2009982 - RNA, 17 nt, Human
augcagagguccacaac

SEQ ID NO: 2009983 - RNA, 18 nt, Human
augcagagguccacaaca

SEQ ID NO: 2009984 - RNA, 14 nt, Human
augcacucagcucu

SEQ ID NO: 2009985 - RNA, 20 nt, Human
augcacuaagucucuuuuuu

SEQ ID NO: 2009986 - RNA, 21 nt, Human
augcacuuuguucuggcucuu

SEQ ID NO: 2009987 - RNA, 17 nt, Human
uuguucuugguuuguaa

SEQ ID NO: 2009988 - RNA, 19 nt, Human
uuguucuugguuuguaaau

SEQ ID NO: 2009989 - RNA, 14 nt, Human
uuguucuuccaaag

SEQ ID NO: 2009990 - RNA, 18 nt, Human
uuguucuuccaaagcaga

SEQ ID NO: 2009991 - RNA, 17 nt, Human
augauuuaauuugaaau

SEQ ID NO: 2009992 - RNA, 20 nt, Human
uuguucuugguuuguaaauu

SEQ ID NO: 2009993 - RNA, 13 nt, Human
uuguucuugauag

SEQ ID NO: 2009994 - RNA, 19 nt, Human
uuguucuuggcaauaaauu

SEQ ID NO: 2009995 - RNA, 21 nt, Human
uuguucuuggcaauaaauuuu

SEQ ID NO: 2009996 - RNA, 23 nt, Human
augcaaaaagcuagucaacagua

SEQ ID NO: 2009997 - RNA, 17 nt, Human
augcaaacauuggaaga

SEQ ID NO: 2009998 - RNA, 13 nt, Human
augcaaaaaaucu

SEQ ID NO: 2009999 - RNA, 14 nt, Human
augcaaaaaaucuu

SEQ ID NO: 2010000 - RNA, 15 nt, Human
augcaaaaaaucuua

SEQ ID NO: 2010001 - RNA, 17 nt, Human
augcaaaaaaucuuaau

SEQ ID NO: 2010002 - RNA, 23 nt, Human
augcaaaaaaucuuaauacuguu

SEQ ID NO: 2010003 - RNA, 13 nt, Human
augauuucauuca

SEQ ID NO: 2010004 - RNA, 13 nt, Human
augauuucacaaa

SEQ ID NO: 2010005 - RNA, 14 nt, Human
augauuucacaaau

SEQ ID NO: 2010006 - RNA, 12 nt, Human
augauuucacaa

SEQ ID NO: 2010007 - RNA, 16 nt, Human
uuuaaugaaagacugu

SEQ ID NO: 2010008 - RNA, 22 nt, Human
uuuaaggguuuguggaaaauga

SEQ ID NO: 2010009 - RNA, 15 nt, Human
uuuaaggucuguuug

SEQ ID NO: 2010010 - RNA, 17 nt, Human
uuuaaggguuuguggaa

SEQ ID NO: 2010011 - RNA, 20 nt, Human
uuuaaggguuuguggaaaau

SEQ ID NO: 2010012 - RNA, 20 nt, Human
uuuaaggaugcuuguacaua

SEQ ID NO: 2010013 - RNA, 21 nt, Human
uuuaaggaugcuuguacauaa

SEQ ID NO: 2010014 - RNA, 22 nt, Human
uuuaaggaugcuuguacauaau

SEQ ID NO: 2010015 - RNA, 18 nt, Human
uuuaaggacugacugagg

SEQ ID NO: 2010016 - RNA, 19 nt, Human
uuuaaggacugacugaggc

SEQ ID NO: 2010017 - RNA, 21 nt, Human
uuuaagcuguuacugucuuca

SEQ ID NO: 2010018 - RNA, 19 nt, Human
uuuaaggaugcuuguacau

SEQ ID NO: 2010019 - RNA, 15 nt, Human
uuuaaggaaaggcaa

SEQ ID NO: 2010020 - RNA, 12 nt, Human
uuuaaggaauau

SEQ ID NO: 2010021 - RNA, 12 nt, Human
uuuaagagaaau

SEQ ID NO: 2010022 - RNA, 14 nt, Human
uuuaagagacagcc

SEQ ID NO: 2010023 - RNA, 14 nt, Human
uuuaagaggcaggg

SEQ ID NO: 2010024 - RNA, 23 nt, Human
uuuaaaaauacagauagauauau

SEQ ID NO: 2010025 - RNA, 20 nt, Human
uuuaaaaaguguuuaaaugu

SEQ ID NO: 2010026 - RNA, 16 nt, Human
uuuaaaaaguguuuaa

SEQ ID NO: 2010027 - RNA, 13 nt, Human
uuuaaaaaguauu

SEQ ID NO: 2010028 - RNA, 16 nt, Human
uuuaaaaaguauugcc

SEQ ID NO: 2010029 - RNA, 17 nt, Human
uuuaaaaaguauugcca

SEQ ID NO: 2010030 - RNA, 20 nt, Human
uuuaaaaaguauugccaaac

SEQ ID NO: 2010031 - RNA, 21 nt, Human
uuuaaaaaauuaaucugggcc

SEQ ID NO: 2010032 - RNA, 16 nt, Human
uuuaaaaaacuuucua

SEQ ID NO: 2010033 - RNA, 14 nt, Human
uuuaaaaaacuuuc

SEQ ID NO: 2010034 - RNA, 18 nt, Human
uuuaaaaaacuuucuacu

SEQ ID NO: 2010035 - RNA, 19 nt, Human
uuuaaaaaacuuucuacuc

SEQ ID NO: 2010036 - RNA, 18 nt, Human
uuuaaaaacaaaaggcaa

SEQ ID NO: 2010037 - RNA, 11 nt, Human
uuuaaaaaacu

SEQ ID NO: 2010038 - RNA, 20 nt, Human
augcagaguucagggaagau

SEQ ID NO: 2010039 - RNA, 11 nt, Human
uuuaaaugcac

SEQ ID NO: 2010040 - RNA, 15 nt, Human
uuuaaauauuaagca

SEQ ID NO: 2010041 - RNA, 21 nt, Human
uuuaaauauaugcuaagucuu

SEQ ID NO: 2010042 - RNA, 16 nt, Human
uuguagcauccuggaa

SEQ ID NO: 2010043 - RNA, 18 nt, Human
uuguagcauccuggaaua

SEQ ID NO: 2010044 - RNA, 17 nt, Human
augagguacugagagug

SEQ ID NO: 2010045 - RNA, 18 nt, Human
augagguacugagaguga

SEQ ID NO: 2010046 - RNA, 15 nt, Human
augagguacugagag

SEQ ID NO: 2010047 - RNA, 22 nt, Human
augaggucagagccugcaguua

SEQ ID NO: 2010048 - RNA, 14 nt, Human
augagguucucucu

SEQ ID NO: 2010049 - RNA, 19 nt, Human
augaggucagagccugcag

SEQ ID NO: 2010050 - RNA, 20 nt, Human
augaggucagagccugcagu

SEQ ID NO: 2010051 - RNA, 15 nt, Human
augaggucagagccu

SEQ ID NO: 2010052 - RNA, 21 nt, Human
augagguacaaccuguucugc

SEQ ID NO: 2010053 - RNA, 16 nt, Human
augaggucagagccug

SEQ ID NO: 2010054 - RNA, 18 nt, Human
augaggucagagccugca

SEQ ID NO: 2010055 - RNA, 17 nt, Human
uugucacacacuuuggc

SEQ ID NO: 2010056 - RNA, 18 nt, Human
uugucaaugcuggagaaa

SEQ ID NO: 2010057 - RNA, 20 nt, Human
augaguuuugggaaguuaaa

SEQ ID NO: 2010058 - RNA, 20 nt, Human
uugucaaugcuggagaaaaa

SEQ ID NO: 2010059 - RNA, 16 nt, Human
uugucagaccauaaga

SEQ ID NO: 2010060 - RNA, 21 nt, Human
uugucauauaagauucauauu

SEQ ID NO: 2010061 - RNA, 16 nt, Human
uugucaucaccaugga

SEQ ID NO: 2010062 - RNA, 19 nt, Human
uugucaucagccaaaacgu

SEQ ID NO: 2010063 - RNA, 14 nt, Human
uugucauuuugguc

SEQ ID NO: 2010064 - RNA, 21 nt, Human
uuguccaauuguauaacuuug

SEQ ID NO: 2010065 - RNA, 13 nt, Human
uuguccagagcug

SEQ ID NO: 2010066 - RNA, 16 nt, Human
uuguccagagcugcuu

SEQ ID NO: 2010067 - RNA, 18 nt, Human
uuguccagagcugcuucc

SEQ ID NO: 2010068 - RNA, 19 nt, Human
uuguccagagcugcuuccc

SEQ ID NO: 2010069 - RNA, 13 nt, Human
augaguugcaguu

SEQ ID NO: 2010070 - RNA, 13 nt, Human
augaguuucacag

SEQ ID NO: 2010071 - RNA, 15 nt, Human
augaguuucacagug

SEQ ID NO: 2010072 - RNA, 22 nt, Human
augaguuucacagugugauuuu

SEQ ID NO: 2010073 - RNA, 14 nt, Human
augaguuucuuaga

SEQ ID NO: 2010074 - RNA, 15 nt, Human
augaguuucuuagac

SEQ ID NO: 2010075 - RNA, 13 nt, Human
augaguuuuggga

SEQ ID NO: 2010076 - RNA, 18 nt, Human
augaguuuugggaaguua

SEQ ID NO: 2010077 - RNA, 19 nt, Human
augaguuuugggaaguuaa

SEQ ID NO: 2010078 - RNA, 18 nt, Human
augaguuggcugggaaua

SEQ ID NO: 2010079 - RNA, 23 nt, Human
augaguccccuguuuguuucuga

SEQ ID NO: 2010080 - RNA, 13 nt, Human
augaguccccugu

SEQ ID NO: 2010081 - RNA, 16 nt, Human
augaguccaaacugga

SEQ ID NO: 2010082 - RNA, 19 nt, Human
augaguccaaacuggaaug

SEQ ID NO: 2010083 - RNA, 13 nt, Human
uugugaggaagcc

SEQ ID NO: 2010084 - RNA, 18 nt, Human
uugugaggaagccgcugg

SEQ ID NO: 2010085 - RNA, 17 nt, Human
uugugaggaagccgcug

SEQ ID NO: 2010086 - RNA, 20 nt, Human
uugugauacaaugcugugcc

SEQ ID NO: 2010087 - RNA, 16 nt, Human
uuguccccgacccuug

SEQ ID NO: 2010088 - RNA, 15 nt, Human
uuguccccgacccuu

SEQ ID NO: 2010089 - RNA, 13 nt, Human
uugugaauaauua

SEQ ID NO: 2010090 - RNA, 14 nt, Human
uugugaauaauuac

SEQ ID NO: 2010091 - RNA, 15 nt, Human
uugugaauaauuaca

SEQ ID NO: 2010092 - RNA, 21 nt, Human
uugugaauaauuacagugccu

SEQ ID NO: 2010093 - RNA, 20 nt, Human
uuguccccaccgcagacagg

SEQ ID NO: 2010094 - RNA, 18 nt, Human
uuguccccaccgcagaca

SEQ ID NO: 2010095 - RNA, 12 nt, Human
uugugauguguc

SEQ ID NO: 2010096 - RNA, 18 nt, Human
uugugaugucccaacuug

SEQ ID NO: 2010097 - RNA, 22 nt, Human
uugugaugucccaacuuguaaa

SEQ ID NO: 2010098 - RNA, 17 nt, Human
augcucagaccagcucu

SEQ ID NO: 2010099 - RNA, 14 nt, Human
augcucagaccagc

SEQ ID NO: 2010100 - RNA, 12 nt, Human
augcucagacca

SEQ ID NO: 2010101 - RNA, 14 nt, Human
uuuaucagaauucu

SEQ ID NO: 2010102 - RNA, 19 nt, Human
augcuccuggcccacugca

SEQ ID NO: 2010103 - RNA, 16 nt, Human
augcuggagaaaaaua

SEQ ID NO: 2010104 - RNA, 23 nt, Human
augcuggagaaaaauaucuguaa

SEQ ID NO: 2010105 - RNA, 14 nt, Human
augcuccuggccca

SEQ ID NO: 2010106 - RNA, 18 nt, Human
augcuggcuguuggcugg

SEQ ID NO: 2010107 - RNA, 23 nt, Human
augcuguucaugaaagauucaau

SEQ ID NO: 2010108 - RNA, 19 nt, Human
augcuggcuguuggcuggg

SEQ ID NO: 2010109 - RNA, 20 nt, Human
augcuggcuguuggcugggg

SEQ ID NO: 2010110 - RNA, 20 nt, Human
augcuucucacugccaugcc

SEQ ID NO: 2010111 - RNA, 16 nt, Human
augcuucucacugcca

SEQ ID NO: 2010112 - RNA, 18 nt, Human
auggaagacagcucuuau

SEQ ID NO: 2010113 - RNA, 17 nt, Human
auggaagacagcucuua

SEQ ID NO: 2010114 - RNA, 14 nt, Human
auggaaggggcuga

SEQ ID NO: 2010115 - RNA, 20 nt, Human
auggaagcgguggucagaag

SEQ ID NO: 2010116 - RNA, 15 nt, Human
uuucaccugcugcuu

SEQ ID NO: 2010117 - RNA, 13 nt, Human
uuucacauuggaa

SEQ ID NO: 2010118 - RNA, 14 nt, Human
uuucacauuggaaa

SEQ ID NO: 2010119 - RNA, 19 nt, Human
uuucacauuggaaacaagu

SEQ ID NO: 2010120 - RNA, 21 nt, Human
uuucagaaagaaguggggaca

SEQ ID NO: 2010121 - RNA, 21 nt, Human
uuucacgucauaggaaguuag

SEQ ID NO: 2010122 - RNA, 15 nt, Human
uuucagaaagccuuu

SEQ ID NO: 2010123 - RNA, 16 nt, Human
uuucagaaagccuuuc

SEQ ID NO: 2010124 - RNA, 21 nt, Human
uuucagaaagccuuucauuuu

SEQ ID NO: 2010125 - RNA, 13 nt, Human
uuucagaaauaca

SEQ ID NO: 2010126 - RNA, 22 nt, Human
uuucagaaauacagauaaauga

SEQ ID NO: 2010127 - RNA, 12 nt, Human
uuucaaacuuua

SEQ ID NO: 2010128 - RNA, 15 nt, Human
uuucaaacuuuacua

SEQ ID NO: 2010129 - RNA, 16 nt, Human
uuucauccuucccacu

SEQ ID NO: 2010130 - RNA, 13 nt, Human
uuucaugcuuuau

SEQ ID NO: 2010131 - RNA, 14 nt, Human
uuucaugcuuuauc

SEQ ID NO: 2010132 - RNA, 21 nt, Human
uuucaugcuguucaugaaaga

SEQ ID NO: 2010133 - RNA, 19 nt, Human
uuucaugcuguucaugaaa

SEQ ID NO: 2010134 - RNA, 11 nt, Human
uuucagaaaug

SEQ ID NO: 2010135 - RNA, 12 nt, Human
uuucagaaaugu

SEQ ID NO: 2010136 - RNA, 14 nt, Human
uuucauccaugucc

SEQ ID NO: 2010137 - RNA, 14 nt, Human
uuucauccuuccca

SEQ ID NO: 2010138 - RNA, 16 nt, Human
uuucaugcuuuaucaa

SEQ ID NO: 2010139 - RNA, 14 nt, Human
uuuccauguaugca

SEQ ID NO: 2010140 - RNA, 15 nt, Human
uuuccauguaugcau

SEQ ID NO: 2010141 - RNA, 20 nt, Human
uuuccauguaugcauaauaa

SEQ ID NO: 2010142 - RNA, 13 nt, Human
uuuccauuuuaua

SEQ ID NO: 2010143 - RNA, 18 nt, Human
uuuccauuuuauaaaugu

SEQ ID NO: 2010144 - RNA, 16 nt, Human
uuucccuauuagagaa

SEQ ID NO: 2010145 - RNA, 23 nt, Human
uuuaaugaaagacuguacaaagu

SEQ ID NO: 2010146 - RNA, 21 nt, Human
uuuaaugaaagacuguacaaa

SEQ ID NO: 2010147 - RNA, 14 nt, Human
uuuaaggucuguuu

SEQ ID NO: 2010148 - RNA, 20 nt, Human
augccaguccagaugugccu

SEQ ID NO: 2010149 - RNA, 13 nt, Human
augccaggggccu

SEQ ID NO: 2010150 - RNA, 17 nt, Human
augcccagccccuucug

SEQ ID NO: 2010151 - RNA, 15 nt, Human
augccccugaauuua

SEQ ID NO: 2010152 - RNA, 20 nt, Human
augccccugaauuuaaauag

SEQ ID NO: 2010153 - RNA, 21 nt, Human
augccccgucccccucuggcu

SEQ ID NO: 2010154 - RNA, 18 nt, Human
augccccgucccccucug

SEQ ID NO: 2010155 - RNA, 16 nt, Human
augcccagccccuucu

SEQ ID NO: 2010156 - RNA, 15 nt, Human
augcccagccccuuc

SEQ ID NO: 2010157 - RNA, 21 nt, Human
augccaugaggaacaaggcaa

SEQ ID NO: 2010158 - RNA, 15 nt, Human
augccucucucaggc

SEQ ID NO: 2010159 - RNA, 14 nt, Human
augccucucucagg

SEQ ID NO: 2010160 - RNA, 13 nt, Human
augccucucucag

SEQ ID NO: 2010161 - RNA, 22 nt, Human
augcgugcauaccacuuuuguu

SEQ ID NO: 2010162 - RNA, 20 nt, Human
augcgugcauaccacuuuug

SEQ ID NO: 2010163 - RNA, 12 nt, Human
augcgugugugu

SEQ ID NO: 2010164 - RNA, 18 nt, Human
augcuacaggauuugaaa

SEQ ID NO: 2010165 - RNA, 14 nt, Human
augcgcaggcuggc

SEQ ID NO: 2010166 - RNA, 18 nt, Human
augcgcaggcuggcccug

SEQ ID NO: 2010167 - RNA, 20 nt, Human
augcgcaggcuggcccugcc

SEQ ID NO: 2010168 - RNA, 22 nt, Human
augcgcaggcuggcccugcccu

SEQ ID NO: 2010169 - RNA, 13 nt, Human
augcgcaggcugg

SEQ ID NO: 2010170 - RNA, 13 nt, Human
uuuagucuuuaua

SEQ ID NO: 2010171 - RNA, 19 nt, Human
uuuaguggacccugaaaug

SEQ ID NO: 2010172 - RNA, 20 nt, Human
uuuaguggacccugaaaugu

SEQ ID NO: 2010173 - RNA, 21 nt, Human
uuuaguggacccugaaaugug

SEQ ID NO: 2010174 - RNA, 22 nt, Human
uuuaguggacccugaaaugugu

SEQ ID NO: 2010175 - RNA, 20 nt, Human
uuuaguggccaucauuucug

SEQ ID NO: 2010176 - RNA, 15 nt, Human
uuuauauguaugugu

SEQ ID NO: 2010177 - RNA, 14 nt, Human
uuuaguuauaaagg

SEQ ID NO: 2010178 - RNA, 20 nt, Human
uuuaggcauaugcuucuuua

SEQ ID NO: 2010179 - RNA, 21 nt, Human
uuuaggcauaugcuucuuuaa

SEQ ID NO: 2010180 - RNA, 19 nt, Human
uuuaggccaaucagaagcu

SEQ ID NO: 2010181 - RNA, 17 nt, Human
uuuagggguagcauuug

SEQ ID NO: 2010182 - RNA, 15 nt, Human
uuuagggaguauucu

SEQ ID NO: 2010183 - RNA, 18 nt, Human
uuuagggaguauucuaau

SEQ ID NO: 2010184 - RNA, 15 nt, Human
uuuacuucuuauaca

SEQ ID NO: 2010185 - RNA, 14 nt, Human
uuuacuucuuauac

SEQ ID NO: 2010186 - RNA, 13 nt, Human
uuuacuucuuaua

SEQ ID NO: 2010187 - RNA, 16 nt, Human
uuuacugcagcuuugu

SEQ ID NO: 2010188 - RNA, 11 nt, Human
uuuacuuaaac

SEQ ID NO: 2010189 - RNA, 17 nt, Human
uuuacugugacuuuauu

SEQ ID NO: 2010190 - RNA, 14 nt, Human
uuuacugcauucuu

SEQ ID NO: 2010191 - RNA, 18 nt, Human
uuuacugcauucuucuga

SEQ ID NO: 2010192 - RNA, 18 nt, Human
uuuaccugaagucuuugu

SEQ ID NO: 2010193 - RNA, 22 nt, Human
uuuaccugaagucuuuguacag

SEQ ID NO: 2010194 - RNA, 16 nt, Human
augcgugugugugugu

SEQ ID NO: 2010195 - RNA, 21 nt, Human
aucucaaauaacuaaaaggua

SEQ ID NO: 2010196 - RNA, 14 nt, Human
aucucaaauaacua

SEQ ID NO: 2010197 - RNA, 23 nt, Human
aucucaaauaacuaaaagguaug

SEQ ID NO: 2010198 - RNA, 14 nt, Human
aucucaaauuucua

SEQ ID NO: 2010199 - RNA, 19 nt, Human
aucuaggaagacuuuggaa

SEQ ID NO: 2010200 - RNA, 18 nt, Human
aucuaggaagacuuugga

SEQ ID NO: 2010201 - RNA, 17 nt, Human
aucuaggaagacuuugg

SEQ ID NO: 2010202 - RNA, 19 nt, Human
aucuagccagugaacauaa

SEQ ID NO: 2010203 - RNA, 17 nt, Human
aucuagauguaaauuuu

SEQ ID NO: 2010204 - RNA, 12 nt, Human
aucuacugcauu

SEQ ID NO: 2010205 - RNA, 13 nt, Human
aucuagauguaaa

SEQ ID NO: 2010206 - RNA, 14 nt, Human
aucuagauguaaau

SEQ ID NO: 2010207 - RNA, 15 nt, Human
aucuagauguaaauu

SEQ ID NO: 2010208 - RNA, 19 nt, Human
aucuagauacuguaucaug

SEQ ID NO: 2010209 - RNA, 18 nt, Human
aucuaaugacauucaaua

SEQ ID NO: 2010210 - RNA, 10 nt, Human
aucuacugca

SEQ ID NO: 2010211 - RNA, 18 nt, Human
aucuagauacuguaucau

SEQ ID NO: 2010212 - RNA, 19 nt, Human
aucuaccaacuuucaagaa

SEQ ID NO: 2010213 - RNA, 13 nt, Human
aucuaauucuuua

SEQ ID NO: 2010214 - RNA, 14 nt, Human
aucuaauucuuuaa

SEQ ID NO: 2010215 - RNA, 15 nt, Human
aucuaauucuuuaau

SEQ ID NO: 2010216 - RNA, 17 nt, Human
aucuaauucuuuaauga

SEQ ID NO: 2010217 - RNA, 15 nt, Human
aucuaccaacuuuca

SEQ ID NO: 2010218 - RNA, 16 nt, Human
aucuaccaacuuucaa

SEQ ID NO: 2010219 - RNA, 17 nt, Human
aucuaccaacuuucaag

SEQ ID NO: 2010220 - RNA, 18 nt, Human
aucuaccaacuuucaaga

SEQ ID NO: 2010221 - RNA, 20 nt, Human
aucuaauauguaacaagcca

SEQ ID NO: 2010222 - RNA, 23 nt, Human
aucuaauauguaacaagccaccc

SEQ ID NO: 2010223 - RNA, 15 nt, Human
uugauacuacaguuu

SEQ ID NO: 2010224 - RNA, 17 nt, Human
uugauacuacaguuugu

SEQ ID NO: 2010225 - RNA, 18 nt, Human
uugauagcacagacccug

SEQ ID NO: 2010226 - RNA, 22 nt, Human
uugaguggggggaacgcccacu

SEQ ID NO: 2010227 - RNA, 21 nt, Human
uugagugcugucuccauguuu

SEQ ID NO: 2010228 - RNA, 11 nt, Human
uugagugccuu

SEQ ID NO: 2010229 - RNA, 12 nt, Human
uugacaggaggu

SEQ ID NO: 2010230 - RNA, 16 nt, Human
uugacuuuuuagaugu

SEQ ID NO: 2010231 - RNA, 17 nt, Human
uugaccauucuccaccu

SEQ ID NO: 2010232 - RNA, 17 nt, Human
uugaccaggcaccuccc

SEQ ID NO: 2010233 - RNA, 16 nt, Human
uugagcagggcucagc

SEQ ID NO: 2010234 - RNA, 12 nt, Human
uugagcagggcu

SEQ ID NO: 2010235 - RNA, 13 nt, Human
uugagcaaacauu

SEQ ID NO: 2010236 - RNA, 10 nt, Human
uugagacaga

SEQ ID NO: 2010237 - RNA, 11 nt, Human
uugagacagag

SEQ ID NO: 2010238 - RNA, 20 nt, Human
aucccuuggacauuuuaugu

SEQ ID NO: 2010239 - RNA, 21 nt, Human
aucccuuggacauuuuauguc

SEQ ID NO: 2010240 - RNA, 21 nt, Human
aucccuucucuuccaggcagc

SEQ ID NO: 2010241 - RNA, 22 nt, Human
aucccuucucuuccaggcagcc

SEQ ID NO: 2010242 - RNA, 17 nt, Human
aucccuuggacauuuua

SEQ ID NO: 2010243 - RNA, 19 nt, Human
aucccuuggacauuuuaug

SEQ ID NO: 2010244 - RNA, 21 nt, Human
aucccuuaagaaugaguuucu

SEQ ID NO: 2010245 - RNA, 14 nt, Human
aucccuuccaccug

SEQ ID NO: 2010246 - RNA, 16 nt, Human
aucccuuccaccugcu

SEQ ID NO: 2010247 - RNA, 19 nt, Human
aucccuuccaccugcucug

SEQ ID NO: 2010248 - RNA, 22 nt, Human
aucccuuccaccugcucugcug

SEQ ID NO: 2010249 - RNA, 13 nt, Human
aucccuucucuuc

SEQ ID NO: 2010250 - RNA, 14 nt, Human
aucccuucucuucc

SEQ ID NO: 2010251 - RNA, 15 nt, Human
aucccuucucuucca

SEQ ID NO: 2010252 - RNA, 17 nt, Human
aucccuucucuuccagg

SEQ ID NO: 2010253 - RNA, 15 nt, Human
auccgaaaucagcag

SEQ ID NO: 2010254 - RNA, 19 nt, Human
uugacaggauuauuggaaa

SEQ ID NO: 2010255 - RNA, 10 nt, Human
uugacagggc

SEQ ID NO: 2010256 - RNA, 12 nt, Human
uugacagggcac

SEQ ID NO: 2010257 - RNA, 16 nt, Human
uugacaucaacugcau

SEQ ID NO: 2010258 - RNA, 13 nt, Human
uugacaucaacug

SEQ ID NO: 2010259 - RNA, 15 nt, Human
uugccaagagcccgu

SEQ ID NO: 2010260 - RNA, 21 nt, Human
uugccaaacauuaauguugau

SEQ ID NO: 2010261 - RNA, 24 nt, Human
uugccaaacauuaauguugauuuc

SEQ ID NO: 2010262 - RNA, 12 nt, Human
uugcaugaggcu

SEQ ID NO: 2010263 - RNA, 14 nt, Human
uugcaugaggcuag

SEQ ID NO: 2010264 - RNA, 17 nt, Human
uugcauguaaaagccua

SEQ ID NO: 2010265 - RNA, 21 nt, Human
uugcaccacugcacuccagcc

SEQ ID NO: 2010266 - RNA, 13 nt, Human
uugcaaucuauaa

SEQ ID NO: 2010267 - RNA, 16 nt, Human
uugcaaucuauaauau

SEQ ID NO: 2010268 - RNA, 14 nt, Human
uugcaauggcagcc

SEQ ID NO: 2010269 - RNA, 13 nt, Human
uugcccaggcagg

SEQ ID NO: 2010270 - RNA, 14 nt, Human
uugcccaggcaggu

SEQ ID NO: 2010271 - RNA, 16 nt, Human
uugcccaggcaggucu

SEQ ID NO: 2010272 - RNA, 18 nt, Human
uugcccaggcaggucuug

SEQ ID NO: 2010273 - RNA, 11 nt, Human
uugcccaggcu

SEQ ID NO: 2010274 - RNA, 12 nt, Human
uugcccaggcug

SEQ ID NO: 2010275 - RNA, 14 nt, Human
uugcccaggcuggc

SEQ ID NO: 2010276 - RNA, 23 nt, Human
uugcccaggcuggcgugcagugg

SEQ ID NO: 2010277 - RNA, 17 nt, Human
uugcccaggcuggagug

SEQ ID NO: 2010278 - RNA, 20 nt, Human
uugcccaugcugggcucccg

SEQ ID NO: 2010279 - RNA, 21 nt, Human
uugcccccaaacccccauucu

SEQ ID NO: 2010280 - RNA, 13 nt, Human
aucugagaaugaa

SEQ ID NO: 2010281 - RNA, 14 nt, Human
aucugagaaugaac

SEQ ID NO: 2010282 - RNA, 17 nt, Human
aucugagaaugaacaaa

SEQ ID NO: 2010283 - RNA, 21 nt, Human
aucugagagaggcuaaaaugu

SEQ ID NO: 2010284 - RNA, 22 nt, Human
aucugagagaggcuaaaauguu

SEQ ID NO: 2010285 - RNA, 23 nt, Human
uugauguucuuucacccuuuucu

SEQ ID NO: 2010286 - RNA, 14 nt, Human
uugauguugaugca

SEQ ID NO: 2010287 - RNA, 15 nt, Human
uugauguugaugcaa

SEQ ID NO: 2010288 - RNA, 23 nt, Human
aucugagagaggcuaaaauguuu

SEQ ID NO: 2010289 - RNA, 16 nt, Human
uugauguugaugcaau

SEQ ID NO: 2010290 - RNA, 13 nt, Human
uugauguuuccuu

SEQ ID NO: 2010291 - RNA, 18 nt, Human
uugcaacuuuguauaaaa

SEQ ID NO: 2010292 - RNA, 17 nt, Human
uugcaacuuuguauaaa

SEQ ID NO: 2010293 - RNA, 16 nt, Human
uugcaacuuuguauaa

SEQ ID NO: 2010294 - RNA, 15 nt, Human
uugauuaaauucuug

SEQ ID NO: 2010295 - RNA, 16 nt, Human
uugauuaaauucuugc

SEQ ID NO: 2010296 - RNA, 20 nt, Human
uugauuaaauucuugcaaag

SEQ ID NO: 2010297 - RNA, 21 nt, Human
uugauuaaauucuugcaaagu

SEQ ID NO: 2010298 - RNA, 23 nt, Human
aucucacacaugagcaucaggcc

SEQ ID NO: 2010299 - RNA, 19 nt, Human
aucucaaauuguaauuaau

SEQ ID NO: 2010300 - RNA, 17 nt, Human
aucucaaauuguaauua

SEQ ID NO: 2010301 - RNA, 16 nt, Human
aucucaaauuucuaaa

SEQ ID NO: 2010302 - RNA, 17 nt, Human
aucucaaauuucuaaau

SEQ ID NO: 2010303 - RNA, 14 nt, Human
aucucaacaugucu

SEQ ID NO: 2010304 - RNA, 12 nt, Human
aucucacagcua

SEQ ID NO: 2010305 - RNA, 15 nt, Human
aucucacagcuaugc

SEQ ID NO: 2010306 - RNA, 21 nt, Human
aucugaagauuguuuaucuag

SEQ ID NO: 2010307 - RNA, 14 nt, Human
aucugaagauuguu

SEQ ID NO: 2010308 - RNA, 15 nt, Human
aucugaagauuguuu

SEQ ID NO: 2010309 - RNA, 16 nt, Human
aucugaagauuguuua

SEQ ID NO: 2010310 - RNA, 20 nt, Human
aucugaagauuguuuaucua

SEQ ID NO: 2010311 - RNA, 16 nt, Human
aucucuuguuuaaauu

SEQ ID NO: 2010312 - RNA, 13 nt, Human
aucugaagauugu

SEQ ID NO: 2010313 - RNA, 15 nt, Human
uugcuuugugauuuu

SEQ ID NO: 2010314 - RNA, 13 nt, Human
uugcuuuguaugc

SEQ ID NO: 2010315 - RNA, 17 nt, Human
uugcuuuggaaguuuua

SEQ ID NO: 2010316 - RNA, 13 nt, Human
aucuuuaauuaaa

SEQ ID NO: 2010317 - RNA, 18 nt, Human
aucuuuaauuaaaaccug

SEQ ID NO: 2010318 - RNA, 11 nt, Human
aucuuuaauua

SEQ ID NO: 2010319 - RNA, 18 nt, Human
uugcucuugaugccuggc

SEQ ID NO: 2010320 - RNA, 17 nt, Human
uugcucuugaugccugg

SEQ ID NO: 2010321 - RNA, 14 nt, Human
uugcucuugaugcc

SEQ ID NO: 2010322 - RNA, 11 nt, Human
uuggagccugc

SEQ ID NO: 2010323 - RNA, 15 nt, Human
uuggagccugcagag

SEQ ID NO: 2010324 - RNA, 11 nt, Human
uuggagcauug

SEQ ID NO: 2010325 - RNA, 14 nt, Human
uugcuuuuaaaacu

SEQ ID NO: 2010326 - RNA, 17 nt, Human
uugcuuuuaaaacuacu

SEQ ID NO: 2010327 - RNA, 21 nt, Human
uugcuuuuaaaacuacuuagc

SEQ ID NO: 2010328 - RNA, 13 nt, Human
uugcuuuuaaaau

SEQ ID NO: 2010329 - RNA, 20 nt, Human
uuggaaaacgauuuaauuua

SEQ ID NO: 2010330 - RNA, 20 nt, Human
uugcuuugugauuuuuguaa

SEQ ID NO: 2010331 - RNA, 16 nt, Human
uugcuuuguaugcacu

SEQ ID NO: 2010332 - RNA, 17 nt, Human
uuggaaaauaaauuauu

SEQ ID NO: 2010333 - RNA, 12 nt, Human
uuggaaaauaaa

SEQ ID NO: 2010334 - RNA, 15 nt, Human
uuggaaaauaaauca

SEQ ID NO: 2010335 - RNA, 14 nt, Human
uuggaaacacuaaa

SEQ ID NO: 2010336 - RNA, 15 nt, Human
uuggaaacacuaaau

SEQ ID NO: 2010337 - RNA, 16 nt, Human
uuggaaacacuaaaug

SEQ ID NO: 2010338 - RNA, 17 nt, Human
uuggaaacacuaaaugu

SEQ ID NO: 2010339 - RNA, 18 nt, Human
uuggaaacacuaaauguu

SEQ ID NO: 2010340 - RNA, 23 nt, Human
aucugugccuuuuuuauaucuug

SEQ ID NO: 2010341 - RNA, 12 nt, Human
aucugucauuug

SEQ ID NO: 2010342 - RNA, 17 nt, Human
aucugucauuugagcag

SEQ ID NO: 2010343 - RNA, 21 nt, Human
aucugugaggggcucucucau

SEQ ID NO: 2010344 - RNA, 22 nt, Human
aucugugaggggcucucucaug

SEQ ID NO: 2010345 - RNA, 22 nt, Human
aucugucauuugagcagggcuc

SEQ ID NO: 2010346 - RNA, 15 nt, Human
aucuuggagagcugg

SEQ ID NO: 2010347 - RNA, 18 nt, Human
aucuuggcagguaggaau

SEQ ID NO: 2010348 - RNA, 19 nt, Human
aucuuggcagguaggaaua

SEQ ID NO: 2010349 - RNA, 20 nt, Human
aucuuggcagguaggaauau

SEQ ID NO: 2010350 - RNA, 19 nt, Human
aucuuggcccuguuaaggc

SEQ ID NO: 2010351 - RNA, 16 nt, Human
aucuuggccuuacugu

SEQ ID NO: 2010352 - RNA, 17 nt, Human
aucuuggccuuacugua

SEQ ID NO: 2010353 - RNA, 15 nt, Human
aucuugcucugcuga

SEQ ID NO: 2010354 - RNA, 16 nt, Human
aucuugcucugcugac

SEQ ID NO: 2010355 - RNA, 22 nt, Human
aucuuaauacuguuauucuuug

SEQ ID NO: 2010356 - RNA, 14 nt, Human
aucuugcucugcug

SEQ ID NO: 2010357 - RNA, 16 nt, Human
aucuuauaauuuaaaa

SEQ ID NO: 2010358 - RNA, 15 nt, Human
aucuuauaauuuaaa

SEQ ID NO: 2010359 - RNA, 13 nt, Human
aucuuaagaaaua

SEQ ID NO: 2010360 - RNA, 16 nt, Human
aucuuaagaaauaaau

SEQ ID NO: 2010361 - RNA, 13 nt, Human
aucuuaauacugu

SEQ ID NO: 2010362 - RNA, 14 nt, Human
aucuuaauacuguu

SEQ ID NO: 2010363 - RNA, 15 nt, Human
aucuuaauacuguua

SEQ ID NO: 2010364 - RNA, 17 nt, Human
aucuuaauacuguuauu

SEQ ID NO: 2010365 - RNA, 18 nt, Human
aucuuaauacuguuauuc

SEQ ID NO: 2010366 - RNA, 20 nt, Human
aucuuaauacuguuauucuu

SEQ ID NO: 2010367 - RNA, 21 nt, Human
aucuuaauacuguuauucuuu

SEQ ID NO: 2010368 - RNA, 23 nt, Human
augaaccacaucuugcucugcug

SEQ ID NO: 2010369 - RNA, 22 nt, Human
augaaccacaucuugcucugcu

SEQ ID NO: 2010370 - RNA, 15 nt, Human
augaacacaaauuau

SEQ ID NO: 2010371 - RNA, 16 nt, Human
augaacacaaauuaug

SEQ ID NO: 2010372 - RNA, 20 nt, Human
augaacacaaauuaugcuaa

SEQ ID NO: 2010373 - RNA, 13 nt, Human
augaacacaaauu

SEQ ID NO: 2010374 - RNA, 14 nt, Human
augaacacaaauua

SEQ ID NO: 2010375 - RNA, 19 nt, Human
augaacaaagaccaauuuu

SEQ ID NO: 2010376 - RNA, 18 nt, Human
uuggagccugcagagcug

SEQ ID NO: 2010377 - RNA, 13 nt, Human
uuggagcucugag

SEQ ID NO: 2010378 - RNA, 22 nt, Human
augaaauaaagacccaggggga

SEQ ID NO: 2010379 - RNA, 18 nt, Human
augaaauaacacagcagu

SEQ ID NO: 2010380 - RNA, 17 nt, Human
augaaccuucuggccuc

SEQ ID NO: 2010381 - RNA, 14 nt, Human
augaaccuucuggc

SEQ ID NO: 2010382 - RNA, 18 nt, Human
augaacuuguaaaggaau

SEQ ID NO: 2010383 - RNA, 14 nt, Human
augaagcaaugcuu

SEQ ID NO: 2010384 - RNA, 22 nt, Human
augaagaaaauacuuaaauguu

SEQ ID NO: 2010385 - RNA, 23 nt, Human
augaagaaaauacuuaaauguua

SEQ ID NO: 2010386 - RNA, 14 nt, Human
augaagaaaauacu

SEQ ID NO: 2010387 - RNA, 15 nt, Human
augaagaaaauacuu

SEQ ID NO: 2010388 - RNA, 17 nt, Human
augaagaaaauacuuaa

SEQ ID NO: 2010389 - RNA, 19 nt, Human
augaagaaaauacuuaaau

SEQ ID NO: 2010390 - RNA, 20 nt, Human
augaagaaaauacuuaaaug

SEQ ID NO: 2010391 - RNA, 21 nt, Human
augaagaaaauacuuaaaugu

SEQ ID NO: 2010392 - RNA, 17 nt, Human
augaaugaaacauuuug

SEQ ID NO: 2010393 - RNA, 15 nt, Human
augaagcaaugcuuc

SEQ ID NO: 2010394 - RNA, 19 nt, Human
uuggugucgggcaugacac

SEQ ID NO: 2010395 - RNA, 18 nt, Human
uuggugucgggcaugaca

SEQ ID NO: 2010396 - RNA, 17 nt, Human
uuggugucgggcaugac

SEQ ID NO: 2010397 - RNA, 18 nt, Human
uuggugggugaaaggaau

SEQ ID NO: 2010398 - RNA, 14 nt, Human
uugguuuguaaauu

SEQ ID NO: 2010399 - RNA, 16 nt, Human
uugguuucucuucucc

SEQ ID NO: 2010400 - RNA, 13 nt, Human
uugguuuuaaaau

SEQ ID NO: 2010401 - RNA, 16 nt, Human
uugguuuuaaaauacu

SEQ ID NO: 2010402 - RNA, 12 nt, Human
uugguuuuauga

SEQ ID NO: 2010403 - RNA, 18 nt, Human
uuggugguuucagaaaug

SEQ ID NO: 2010404 - RNA, 19 nt, Human
uuggugguuucagaaaugu

SEQ ID NO: 2010405 - RNA, 15 nt, Human
uugggugaucauuca

SEQ ID NO: 2010406 - RNA, 19 nt, Human
uugggugcugcuaauucuu

SEQ ID NO: 2010407 - RNA, 18 nt, Human
augaaugucagugugacu

SEQ ID NO: 2010408 - RNA, 16 nt, Human
augaaugucaguguga

SEQ ID NO: 2010409 - RNA, 16 nt, Human
uugguuuuaugaugac

SEQ ID NO: 2010410 - RNA, 19 nt, Human
uugguuuuaugaugacgua

SEQ ID NO: 2010411 - RNA, 20 nt, Human
uugguuuucacauuggaaac

SEQ ID NO: 2010412 - RNA, 13 nt, Human
uuguaaauuguca

SEQ ID NO: 2010413 - RNA, 19 nt, Human
uuguaaauuuaugugaugg

SEQ ID NO: 2010414 - RNA, 15 nt, Human
uuguaacaagaaaau

SEQ ID NO: 2010415 - RNA, 21 nt, Human
uuguaacauucuauuucaacu

SEQ ID NO: 2010416 - RNA, 17 nt, Human
uuguaagaaauacugua

SEQ ID NO: 2010417 - RNA, 12 nt, Human
uuguaaugaaaa

SEQ ID NO: 2010418 - RNA, 20 nt, Human
uuguaauuuaaggucuguuu

SEQ ID NO: 2010419 - RNA, 14 nt, Human
uuguaauauguaaa

SEQ ID NO: 2010420 - RNA, 15 nt, Human
uuguaauauguaaau

SEQ ID NO: 2010421 - RNA, 15 nt, Human
uuguaauaauaaaga

SEQ ID NO: 2010422 - RNA, 23 nt, Human
uuguaauaaacccuuaacuggca

SEQ ID NO: 2010423 - RNA, 13 nt, Human
auauaaacagcuu

SEQ ID NO: 2010424 - RNA, 12 nt, Human
auauaaaaugcc

SEQ ID NO: 2010425 - RNA, 13 nt, Human
auauaaaaugcca

SEQ ID NO: 2010426 - RNA, 15 nt, Human
auauaaaaugccaag

SEQ ID NO: 2010427 - RNA, 14 nt, Human
auauaaaauggcaa

SEQ ID NO: 2010428 - RNA, 19 nt, Human
auauaaaauggcaacaaac

SEQ ID NO: 2010429 - RNA, 23 nt, Human
auauaaaauggcaacaaacugca

SEQ ID NO: 2010430 - RNA, 19 nt, Human
auaguuuauuuuaaaacaa

SEQ ID NO: 2010431 - RNA, 21 nt, Human
auagucaagacgaacauguag

SEQ ID NO: 2010432 - RNA, 14 nt, Human
auagucaagacgaa

SEQ ID NO: 2010433 - RNA, 16 nt, Human
auauaaauugucuuaa

SEQ ID NO: 2010434 - RNA, 22 nt, Human
auauaagcccuugauuggaagg

SEQ ID NO: 2010435 - RNA, 14 nt, Human
auauaggacauuga

SEQ ID NO: 2010436 - RNA, 14 nt, Human
auauauagcauuua

SEQ ID NO: 2010437 - RNA, 16 nt, Human
auauauagcauuuaug

SEQ ID NO: 2010438 - RNA, 13 nt, Human
uucacugcuggcu

SEQ ID NO: 2010439 - RNA, 15 nt, Human
uucacugcuggcugc

SEQ ID NO: 2010440 - RNA, 16 nt, Human
uucacugcuggcugcc

SEQ ID NO: 2010441 - RNA, 17 nt, Human
uucacugcuggcugccu

SEQ ID NO: 2010442 - RNA, 18 nt, Human
uucacugcuggcugccuu

SEQ ID NO: 2010443 - RNA, 19 nt, Human
uucacugcuggcugccuua

SEQ ID NO: 2010444 - RNA, 13 nt, Human
uucagaaguuuaa

SEQ ID NO: 2010445 - RNA, 14 nt, Human
uucagaaguuuaaa

SEQ ID NO: 2010446 - RNA, 15 nt, Human
uucagaaguuuaaau

SEQ ID NO: 2010447 - RNA, 15 nt, Human
uucagaaagaagugg

SEQ ID NO: 2010448 - RNA, 22 nt, Human
uucagaaacaaagcauuugacu

SEQ ID NO: 2010449 - RNA, 20 nt, Human
uucacuggccacaguuguuu

SEQ ID NO: 2010450 - RNA, 17 nt, Human
uucagccacugagggac

SEQ ID NO: 2010451 - RNA, 21 nt, Human
uucagccacugagggacaaaa

SEQ ID NO: 2010452 - RNA, 19 nt, Human
uucagccaagaauucuuaa

SEQ ID NO: 2010453 - RNA, 14 nt, Human
uucagccaagaauu

SEQ ID NO: 2010454 - RNA, 22 nt, Human
uucagcaaacuuguugaauuua

SEQ ID NO: 2010455 - RNA, 17 nt, Human
uucagaucucuaacuuc

SEQ ID NO: 2010456 - RNA, 21 nt, Human
uucagauucaggcauuuuccc

SEQ ID NO: 2010457 - RNA, 15 nt, Human
uucagcaaacuuguu

SEQ ID NO: 2010458 - RNA, 21 nt, Human
uucagcaaggcgcuaacuugc

SEQ ID NO: 2010459 - RNA, 15 nt, Human
uucauagaauacuca

SEQ ID NO: 2010460 - RNA, 21 nt, Human
uucauauuuacuucuuauaca

SEQ ID NO: 2010461 - RNA, 16 nt, Human
uucauauuuacuucuu

SEQ ID NO: 2010462 - RNA, 18 nt, Human
uucauagagaauauaaaa

SEQ ID NO: 2010463 - RNA, 11 nt, Human
uucauagagaa

SEQ ID NO: 2010464 - RNA, 17 nt, Human
uucaggggaaacuugau

SEQ ID NO: 2010465 - RNA, 23 nt, Human
uucaggggcuagcuaagccaaga

SEQ ID NO: 2010466 - RNA, 14 nt, Human
uucaguaauaacuc

SEQ ID NO: 2010467 - RNA, 13 nt, Human
uucagccuaagag

SEQ ID NO: 2010468 - RNA, 16 nt, Human
uucagggcagauuuua

SEQ ID NO: 2010469 - RNA, 18 nt, Human
uucagggcagauuuuagu

SEQ ID NO: 2010470 - RNA, 20 nt, Human
uucagggcagauuuuaguuu

SEQ ID NO: 2010471 - RNA, 23 nt, Human
uucagggcagauuuuaguuuuau

SEQ ID NO: 2010472 - RNA, 21 nt, Human
uucaucauccuaagcuauuca

SEQ ID NO: 2010473 - RNA, 17 nt, Human
uucauauuuuaaacaga

SEQ ID NO: 2010474 - RNA, 20 nt, Human
uucauauuuguacuuucugu

SEQ ID NO: 2010475 - RNA, 22 nt, Human
uucauauuuguacuuucuguua

SEQ ID NO: 2010476 - RNA, 11 nt, Human
uucauauuugu

SEQ ID NO: 2010477 - RNA, 14 nt, Human
uucauauuuguacu

SEQ ID NO: 2010478 - RNA, 15 nt, Human
uucauauuuguacuu

SEQ ID NO: 2010479 - RNA, 20 nt, Human
uucauauuuaauuugaaggu

SEQ ID NO: 2010480 - RNA, 18 nt, Human
uucaucauccuaagcuau

SEQ ID NO: 2010481 - RNA, 21 nt, Human
uucauauuuuaaacagaggau

SEQ ID NO: 2010482 - RNA, 18 nt, Human
auauauguuuuugaaggc

SEQ ID NO: 2010483 - RNA, 17 nt, Human
auaucuauauuuuacau

SEQ ID NO: 2010484 - RNA, 16 nt, Human
auaucuauauuuuaca

SEQ ID NO: 2010485 - RNA, 20 nt, Human
auaucuauauuuuacauaaa

SEQ ID NO: 2010486 - RNA, 22 nt, Human
auaucuauauuuuacauaaauu

SEQ ID NO: 2010487 - RNA, 21 nt, Human
auauccuuuuagucugcauau

SEQ ID NO: 2010488 - RNA, 18 nt, Human
auaucuaaaucuguccaa

SEQ ID NO: 2010489 - RNA, 18 nt, Human
auauauucagccuggcuu

SEQ ID NO: 2010490 - RNA, 12 nt, Human
auaugauucaaa

SEQ ID NO: 2010491 - RNA, 23 nt, Human
auaucuugcuugaacuuacaggu

SEQ ID NO: 2010492 - RNA, 15 nt, Human
auaucuuggcaggua

SEQ ID NO: 2010493 - RNA, 18 nt, Human
auaucuucauuucuaaau

SEQ ID NO: 2010494 - RNA, 16 nt, Human
auaucuucauuucuaa

SEQ ID NO: 2010495 - RNA, 14 nt, Human
auaucuugcuugaa

SEQ ID NO: 2010496 - RNA, 13 nt, Human
auaugauucaaau

SEQ ID NO: 2010497 - RNA, 22 nt, Human
auaugauucaaaugucuauaaa

SEQ ID NO: 2010498 - RNA, 20 nt, Human
auaugauuuaaaucagccgu

SEQ ID NO: 2010499 - RNA, 14 nt, Human
auaucuucauuucu

SEQ ID NO: 2010500 - RNA, 22 nt, Human
auaucugaaaauguauguguaa

SEQ ID NO: 2010501 - RNA, 17 nt, Human
uucauguccugugucag

SEQ ID NO: 2010502 - RNA, 19 nt, Human
uucauguccugugucaguu

SEQ ID NO: 2010503 - RNA, 20 nt, Human
uucauguccugugucaguuu

SEQ ID NO: 2010504 - RNA, 21 nt, Human
uucauguccugugucaguuua

SEQ ID NO: 2010505 - RNA, 13 nt, Human
auaugugaacagu

SEQ ID NO: 2010506 - RNA, 14 nt, Human
auaugucaagccau

SEQ ID NO: 2010507 - RNA, 21 nt, Human
auauguauucuguaaaagaaa

SEQ ID NO: 2010508 - RNA, 13 nt, Human
auaugcacacauu

SEQ ID NO: 2010509 - RNA, 11 nt, Human
auauguaugug

SEQ ID NO: 2010510 - RNA, 13 nt, Human
auauguauguguu

SEQ ID NO: 2010511 - RNA, 14 nt, Human
auauguauguguuu

SEQ ID NO: 2010512 - RNA, 15 nt, Human
auauguauguguuua

SEQ ID NO: 2010513 - RNA, 17 nt, Human
auauguauguguuuaga

SEQ ID NO: 2010514 - RNA, 18 nt, Human
auauguauguguuuagaa

SEQ ID NO: 2010515 - RNA, 19 nt, Human
auauguauguguuuagaau

SEQ ID NO: 2010516 - RNA, 20 nt, Human
auauguauguguuuagaauu

SEQ ID NO: 2010517 - RNA, 21 nt, Human
auauguauguguuuagaauug

SEQ ID NO: 2010518 - RNA, 22 nt, Human
auauguauguguuuagaauuga

SEQ ID NO: 2010519 - RNA, 23 nt, Human
auauguauguguuuagaauugaa

SEQ ID NO: 2010520 - RNA, 21 nt, Human
auauguauuaacacuacucaa

SEQ ID NO: 2010521 - RNA, 22 nt, Human
auaucuuggcagguaggaauau

SEQ ID NO: 2010522 - RNA, 21 nt, Human
auaucuuggcagguaggaaua

SEQ ID NO: 2010523 - RNA, 13 nt, Human
uucaauaaaguuu

SEQ ID NO: 2010524 - RNA, 14 nt, Human
uucaauaaaguuug

SEQ ID NO: 2010525 - RNA, 15 nt, Human
uucaauaaaguuuga

SEQ ID NO: 2010526 - RNA, 17 nt, Human
uucacauauugauuucc

SEQ ID NO: 2010527 - RNA, 13 nt, Human
uucacauuggaaa

SEQ ID NO: 2010528 - RNA, 19 nt, Human
uucacauuguauucagagu

SEQ ID NO: 2010529 - RNA, 14 nt, Human
uucacauuggaaac

SEQ ID NO: 2010530 - RNA, 22 nt, Human
uucaccacaugugcacaugcac

SEQ ID NO: 2010531 - RNA, 15 nt, Human
uucaccacagacuuu

SEQ ID NO: 2010532 - RNA, 14 nt, Human
uucaccacagacuu

SEQ ID NO: 2010533 - RNA, 22 nt, Human
uucaccaguacauucucaguuu

SEQ ID NO: 2010534 - RNA, 23 nt, Human
uucaccaguacauucucaguuuu

SEQ ID NO: 2010535 - RNA, 17 nt, Human
auaggcacaggaaacca

SEQ ID NO: 2010536 - RNA, 22 nt, Human
auaggcaccuaccaccacgccc

SEQ ID NO: 2010537 - RNA, 19 nt, Human
auaggaaggucauuuccau

SEQ ID NO: 2010538 - RNA, 21 nt, Human
auaggaaguuagccuuuaucu

SEQ ID NO: 2010539 - RNA, 22 nt, Human
auaggaaguuagccuuuaucua

SEQ ID NO: 2010540 - RNA, 23 nt, Human
auaggaaguuagccuuuaucuac

SEQ ID NO: 2010541 - RNA, 19 nt, Human
auaggaugggcuucugugc

SEQ ID NO: 2010542 - RNA, 21 nt, Human
auaggaauugacccacaagaa

SEQ ID NO: 2010543 - RNA, 15 nt, Human
auagcuuuauuucuu

SEQ ID NO: 2010544 - RNA, 15 nt, Human
auaggaaggucauuu

SEQ ID NO: 2010545 - RNA, 17 nt, Human
auaggaaggucauuucc

SEQ ID NO: 2010546 - RNA, 19 nt, Human
auaggaacuuaaauaaugu

SEQ ID NO: 2010547 - RNA, 22 nt, Human
auagcuucaccccaaucccagc

SEQ ID NO: 2010548 - RNA, 21 nt, Human
auagcuucaccccaaucccag

SEQ ID NO: 2010549 - RNA, 22 nt, Human
uucaccauguuggccaggcugc

SEQ ID NO: 2010550 - RNA, 22 nt, Human
uucaccauguuggccaggcugg

SEQ ID NO: 2010551 - RNA, 13 nt, Human
uucaccauucgua

SEQ ID NO: 2010552 - RNA, 15 nt, Human
uucaagaaaugaaga

SEQ ID NO: 2010553 - RNA, 17 nt, Human
uucaagaaaugaagagc

SEQ ID NO: 2010554 - RNA, 22 nt, Human
uucaagggcuuuccugugccag

SEQ ID NO: 2010555 - RNA, 20 nt, Human
uucaagugauucucaugccu

SEQ ID NO: 2010556 - RNA, 22 nt, Human
uucaagugauucucaugccuca

SEQ ID NO: 2010557 - RNA, 21 nt, Human
uucaaggauccugagccagau

SEQ ID NO: 2010558 - RNA, 19 nt, Human
uucaaggauccugagccag

SEQ ID NO: 2010559 - RNA, 18 nt, Human
uucaaggauccugagcca

SEQ ID NO: 2010560 - RNA, 16 nt, Human
uucaaggauccugagc

SEQ ID NO: 2010561 - RNA, 15 nt, Human
uucaaggauccugag

SEQ ID NO: 2010562 - RNA, 11 nt, Human
uucaagaaaug

SEQ ID NO: 2010563 - RNA, 14 nt, Human
uucaagaaaugaag

SEQ ID NO: 2010564 - RNA, 16 nt, Human
uucaaaaaacuuguaa

SEQ ID NO: 2010565 - RNA, 21 nt, Human
uucaaaaagucacaguuaagg

SEQ ID NO: 2010566 - RNA, 12 nt, Human
uucaaaaaucug

SEQ ID NO: 2010567 - RNA, 14 nt, Human
uucaaaaaucugaa

SEQ ID NO: 2010568 - RNA, 16 nt, Human
uucaaaaaucugaaga

SEQ ID NO: 2010569 - RNA, 18 nt, Human
uucaaaaaucugaagauu

SEQ ID NO: 2010570 - RNA, 21 nt, Human
uucaaaaaucugaagauuguu

SEQ ID NO: 2010571 - RNA, 13 nt, Human
uuauuuuuuugaa

SEQ ID NO: 2010572 - RNA, 19 nt, Human
uuauuuuuuuuaauuguau

SEQ ID NO: 2010573 - RNA, 12 nt, Human
uuauuucuccuu

SEQ ID NO: 2010574 - RNA, 14 nt, Human
uuauuucuccuuuu

SEQ ID NO: 2010575 - RNA, 16 nt, Human
uucaacuucaggaaag

SEQ ID NO: 2010576 - RNA, 13 nt, Human
uucaaagaaucac

SEQ ID NO: 2010577 - RNA, 15 nt, Human
uucaaaccugugaag

SEQ ID NO: 2010578 - RNA, 13 nt, Human
uucaaacugaaaa

SEQ ID NO: 2010579 - RNA, 17 nt, Human
uucaaacugaaaagcug

SEQ ID NO: 2010580 - RNA, 22 nt, Human
uucaaaaaucugaagauuguuu

SEQ ID NO: 2010581 - RNA, 17 nt, Human
uucaaaauaaaauauca

SEQ ID NO: 2010582 - RNA, 21 nt, Human
uuauuuaaaauguaaaaagga

SEQ ID NO: 2010583 - RNA, 14 nt, Human
uuauuuaaauuuua

SEQ ID NO: 2010584 - RNA, 22 nt, Human
uuauuuaaugaaagacuguaca

SEQ ID NO: 2010585 - RNA, 18 nt, Human
uuauuuaaugaaagacug

SEQ ID NO: 2010586 - RNA, 23 nt, Human
auagcuggucuuauuuguaaagc

SEQ ID NO: 2010587 - RNA, 22 nt, Human
auagcuggucuuauuuguaaag

SEQ ID NO: 2010588 - RNA, 17 nt, Human
auagcugggacuacagg

SEQ ID NO: 2010589 - RNA, 16 nt, Human
uuauuuaguuccuuga

SEQ ID NO: 2010590 - RNA, 15 nt, Human
uuauuuaguauuuau

SEQ ID NO: 2010591 - RNA, 13 nt, Human
uuauuuauaugua

SEQ ID NO: 2010592 - RNA, 14 nt, Human
uuauuuauauguau

SEQ ID NO: 2010593 - RNA, 15 nt, Human
uuauuuacugcuagu

SEQ ID NO: 2010594 - RNA, 17 nt, Human
uuauuuagcaccaggga

SEQ ID NO: 2010595 - RNA, 20 nt, Human
uuauuucaucauauuauaca

SEQ ID NO: 2010596 - RNA, 12 nt, Human
uuauuuauucug

SEQ ID NO: 2010597 - RNA, 22 nt, Human
uuauuuauucugggaauguaua

SEQ ID NO: 2010598 - RNA, 11 nt, Human
uuauuuauuga

SEQ ID NO: 2010599 - RNA, 15 nt, Human
uuauuuauauguaug

SEQ ID NO: 2010600 - RNA, 16 nt, Human
uuauuuauauguaugu

SEQ ID NO: 2010601 - RNA, 15 nt, Human
uuauuuauauuuauu

SEQ ID NO: 2010602 - RNA, 16 nt, Human
uuauuuauauuuauug

SEQ ID NO: 2010603 - RNA, 17 nt, Human
uuauuuauauuuauuga

SEQ ID NO: 2010604 - RNA, 17 nt, Human
auaagauaaaugugcug

SEQ ID NO: 2010605 - RNA, 13 nt, Human
auaagauaaaugu

SEQ ID NO: 2010606 - RNA, 18 nt, Human
auagccugccucuucucu

SEQ ID NO: 2010607 - RNA, 15 nt, Human
auaagauauuuuauu

SEQ ID NO: 2010608 - RNA, 20 nt, Human
auaagauauuuuauuuugaa

SEQ ID NO: 2010609 - RNA, 22 nt, Human
auaagagcuuccaauuuuccuu

SEQ ID NO: 2010610 - RNA, 14 nt, Human
auagcuacuaauuu

SEQ ID NO: 2010611 - RNA, 17 nt, Human
auagcuacuaauuuuaa

SEQ ID NO: 2010612 - RNA, 12 nt, Human
auagcugggacu

SEQ ID NO: 2010613 - RNA, 20 nt, Human
auagcucaggugucccugca

SEQ ID NO: 2010614 - RNA, 21 nt, Human
auagcucaggugucccugcac

SEQ ID NO: 2010615 - RNA, 22 nt, Human
auagcucaggugucccugcacu

SEQ ID NO: 2010616 - RNA, 19 nt, Human
auagcucaggugucccugc

SEQ ID NO: 2010617 - RNA, 18 nt, Human
auagcuacuaauuuuaaa

SEQ ID NO: 2010618 - RNA, 14 nt, Human
uuccuucagugccu

SEQ ID NO: 2010619 - RNA, 11 nt, Human
uuccuucagug

SEQ ID NO: 2010620 - RNA, 18 nt, Human
auauuuucaugcuguuca

SEQ ID NO: 2010621 - RNA, 21 nt, Human
auauuuucaugcuguucauga

SEQ ID NO: 2010622 - RNA, 15 nt, Human
uuccuucagugccuu

SEQ ID NO: 2010623 - RNA, 19 nt, Human
auauuuucaacgcagcccu

SEQ ID NO: 2010624 - RNA, 20 nt, Human
auauuuucaacgcagcccug

SEQ ID NO: 2010625 - RNA, 16 nt, Human
uuccugggagcuuuug

SEQ ID NO: 2010626 - RNA, 16 nt, Human
uuccugggcacacgcu

SEQ ID NO: 2010627 - RNA, 19 nt, Human
uuccugggcacacgcugcu

SEQ ID NO: 2010628 - RNA, 20 nt, Human
uuccugggcacacgcugcuc

SEQ ID NO: 2010629 - RNA, 22 nt, Human
uuccugggcacacgcugcucug

SEQ ID NO: 2010630 - RNA, 19 nt, Human
uuccuggggcauccauggg

SEQ ID NO: 2010631 - RNA, 15 nt, Human
uuccugggagcuuuu

SEQ ID NO: 2010632 - RNA, 13 nt, Human
uuccucuugaacc

SEQ ID NO: 2010633 - RNA, 15 nt, Human
uuccucuugaaccag

SEQ ID NO: 2010634 - RNA, 15 nt, Human
uuccucuugacccug

SEQ ID NO: 2010635 - RNA, 17 nt, Human
uuccucuugacccugca

SEQ ID NO: 2010636 - RNA, 18 nt, Human
uuccucuugacccugcac

SEQ ID NO: 2010637 - RNA, 19 nt, Human
uuccucuugacccugcacc

SEQ ID NO: 2010638 - RNA, 22 nt, Human
uuccucuugacccugcacccuc

SEQ ID NO: 2010639 - RNA, 23 nt, Human
uuccucuugacccugcacccucc

SEQ ID NO: 2010640 - RNA, 11 nt, Human
uuccucuuucc

SEQ ID NO: 2010641 - RNA, 21 nt, Human
uuccuguguguccaaaacugc

SEQ ID NO: 2010642 - RNA, 22 nt, Human
uuccuguguguccaaaacugcc

SEQ ID NO: 2010643 - RNA, 17 nt, Human
uuccuguucccaugaga

SEQ ID NO: 2010644 - RNA, 21 nt, Human
uuccucugcucccccuuuucc

SEQ ID NO: 2010645 - RNA, 13 nt, Human
uuccucugcuccc

SEQ ID NO: 2010646 - RNA, 14 nt, Human
uuccucugcucccc

SEQ ID NO: 2010647 - RNA, 22 nt, Human
uuccucugcuaaauugauguug

SEQ ID NO: 2010648 - RNA, 11 nt, Human
uuccucugcuc

SEQ ID NO: 2010649 - RNA, 12 nt, Human
uuccucugcucc

SEQ ID NO: 2010650 - RNA, 13 nt, Human
uuccucgcuucuu

SEQ ID NO: 2010651 - RNA, 15 nt, Human
uuccucgcuucuuuc

SEQ ID NO: 2010652 - RNA, 20 nt, Human
uuccuaaucacucagagcag

SEQ ID NO: 2010653 - RNA, 15 nt, Human
uuccuaauccucuag

SEQ ID NO: 2010654 - RNA, 13 nt, Human
uuccuaauccucu

SEQ ID NO: 2010655 - RNA, 20 nt, Human
auauuuuauuuuuagaauuu

SEQ ID NO: 2010656 - RNA, 14 nt, Human
auauuuuauuuuua

SEQ ID NO: 2010657 - RNA, 14 nt, Human
auauuuuaagacga

SEQ ID NO: 2010658 - RNA, 16 nt, Human
aucacuggcauggugg

SEQ ID NO: 2010659 - RNA, 17 nt, Human
aucacuggcaugguggu

SEQ ID NO: 2010660 - RNA, 15 nt, Human
aucacuguguauauu

SEQ ID NO: 2010661 - RNA, 17 nt, Human
aucacuguguauauuug

SEQ ID NO: 2010662 - RNA, 18 nt, Human
aucacuguguauauuuga

SEQ ID NO: 2010663 - RNA, 19 nt, Human
aucacuguguauauuugau

SEQ ID NO: 2010664 - RNA, 15 nt, Human
aucacuguuuagauu

SEQ ID NO: 2010665 - RNA, 14 nt, Human
aucacuguuuagau

SEQ ID NO: 2010666 - RNA, 20 nt, Human
aucacuguguauauuugauu

SEQ ID NO: 2010667 - RNA, 23 nt, Human
uuccuuuucccaggaaagaagca

SEQ ID NO: 2010668 - RNA, 21 nt, Human
uuccuuuuaaaacacuuccau

SEQ ID NO: 2010669 - RNA, 22 nt, Human
uuccuuuuaaaacacuuccaua

SEQ ID NO: 2010670 - RNA, 20 nt, Human
uuccuuuuaaaacacuucca

SEQ ID NO: 2010671 - RNA, 16 nt, Human
aucacuguuuagauuu

SEQ ID NO: 2010672 - RNA, 22 nt, Human
aucacggcucacugcagccuca

SEQ ID NO: 2010673 - RNA, 14 nt, Human
aucacaaaugacuu

SEQ ID NO: 2010674 - RNA, 15 nt, Human
aucacaaaugacuuu

SEQ ID NO: 2010675 - RNA, 16 nt, Human
aucacaaaugacuuua

SEQ ID NO: 2010676 - RNA, 19 nt, Human
aucacaaaugacuuuauua

SEQ ID NO: 2010677 - RNA, 20 nt, Human
aucacaaaugacuuuauuau

SEQ ID NO: 2010678 - RNA, 11 nt, Human
aucacaaauga

SEQ ID NO: 2010679 - RNA, 12 nt, Human
aucacaaaugac

SEQ ID NO: 2010680 - RNA, 13 nt, Human
aucacaaaugacu

SEQ ID NO: 2010681 - RNA, 13 nt, Human
auauuuuguaaau

SEQ ID NO: 2010682 - RNA, 15 nt, Human
aucaagagccuuaaa

SEQ ID NO: 2010683 - RNA, 16 nt, Human
aucaagagccuuaaaa

SEQ ID NO: 2010684 - RNA, 18 nt, Human
aucaagagccuuaaaaca

SEQ ID NO: 2010685 - RNA, 21 nt, Human
aucaagagccuuaaaacauca

SEQ ID NO: 2010686 - RNA, 16 nt, Human
auauuuuguaugcaag

SEQ ID NO: 2010687 - RNA, 17 nt, Human
auauuuuguaugcaagc

SEQ ID NO: 2010688 - RNA, 14 nt, Human
auauuuuguaugca

SEQ ID NO: 2010689 - RNA, 14 nt, Human
aucaagagccuuaa

SEQ ID NO: 2010690 - RNA, 14 nt, Human
aucaaguauuauaa

SEQ ID NO: 2010691 - RNA, 15 nt, Human
aucaauaugcagaau

SEQ ID NO: 2010692 - RNA, 23 nt, Human
aucaauaugcagaauggcauuug

SEQ ID NO: 2010693 - RNA, 13 nt, Human
aucaaguauuaua

SEQ ID NO: 2010694 - RNA, 14 nt, Human
aucaaguauuauac

SEQ ID NO: 2010695 - RNA, 18 nt, Human
aucaaguauuauaccuuu

SEQ ID NO: 2010696 - RNA, 22 nt, Human
auauucucacagcuccaagaau

SEQ ID NO: 2010697 - RNA, 23 nt, Human
auauucucacagcuccaagaauu

SEQ ID NO: 2010698 - RNA, 21 nt, Human
auauucucacagcuccaagaa

SEQ ID NO: 2010699 - RNA, 12 nt, Human
auauucucugua

SEQ ID NO: 2010700 - RNA, 13 nt, Human
auauucucuguac

SEQ ID NO: 2010701 - RNA, 14 nt, Human
auauucucuguaca

SEQ ID NO: 2010702 - RNA, 15 nt, Human
auauucucuguacau

SEQ ID NO: 2010703 - RNA, 16 nt, Human
auauucucuguacaua

SEQ ID NO: 2010704 - RNA, 19 nt, Human
auauucucuguacauauua

SEQ ID NO: 2010705 - RNA, 16 nt, Human
auauucuguuggccag

SEQ ID NO: 2010706 - RNA, 19 nt, Human
auauugauuuccguuaaaa

SEQ ID NO: 2010707 - RNA, 21 nt, Human
auauugauuuccguuaaaaua

SEQ ID NO: 2010708 - RNA, 22 nt, Human
auauugauuuccguuaaaauac

SEQ ID NO: 2010709 - RNA, 22 nt, Human
auauugauccagaaagaaaacu

SEQ ID NO: 2010710 - RNA, 15 nt, Human
auauugauccagaaa

SEQ ID NO: 2010711 - RNA, 14 nt, Human
auauucuuuguuaa

SEQ ID NO: 2010712 - RNA, 20 nt, Human
auauucuuuguuaauuugga

SEQ ID NO: 2010713 - RNA, 20 nt, Human
auauguuuuaagaggcaggg

SEQ ID NO: 2010714 - RNA, 17 nt, Human
auauguuuccuucccuc

SEQ ID NO: 2010715 - RNA, 18 nt, Human
auauguuuuaagaggcag

SEQ ID NO: 2010716 - RNA, 16 nt, Human
auauguuuccuucccu

SEQ ID NO: 2010717 - RNA, 17 nt, Human
uucauguucccacuuca

SEQ ID NO: 2010718 - RNA, 22 nt, Human
uucauguccugugucaguuuau

SEQ ID NO: 2010719 - RNA, 23 nt, Human
uucauguccugugucaguuuaug

SEQ ID NO: 2010720 - RNA, 20 nt, Human
uucaugugggaucccaucuu

SEQ ID NO: 2010721 - RNA, 22 nt, Human
uucaugugggaucccaucuuuu

SEQ ID NO: 2010722 - RNA, 22 nt, Human
auauuaaggaagacaaugugaa

SEQ ID NO: 2010723 - RNA, 24 nt, Human
auauuaagaaagacuaucuaaaug

SEQ ID NO: 2010724 - RNA, 20 nt, Human
auauuaagcaugacagaaaa

SEQ ID NO: 2010725 - RNA, 20 nt, Human
auauuaaguaagucucaagg

SEQ ID NO: 2010726 - RNA, 23 nt, Human
auauuaagcaugacagaaaauau

SEQ ID NO: 2010727 - RNA, 20 nt, Human
auauuuguaaauuuauguga

SEQ ID NO: 2010728 - RNA, 14 nt, Human
auauuuguacuuuc

SEQ ID NO: 2010729 - RNA, 15 nt, Human
auauuuguacuuucu

SEQ ID NO: 2010730 - RNA, 17 nt, Human
auauuuguacuuucugu

SEQ ID NO: 2010731 - RNA, 19 nt, Human
auauuuguacuuucuguua

SEQ ID NO: 2010732 - RNA, 20 nt, Human
auauuuguacuuucuguuaa

SEQ ID NO: 2010733 - RNA, 21 nt, Human
auauuuguacuuucuguuaaa

SEQ ID NO: 2010734 - RNA, 19 nt, Human
auauuuguauuuauucuuu

SEQ ID NO: 2010735 - RNA, 17 nt, Human
auauuuguauuuauucu

SEQ ID NO: 2010736 - RNA, 18 nt, Human
auauuuguauuuauucuu

SEQ ID NO: 2010737 - RNA, 14 nt, Human
auauuuuaaacaga

SEQ ID NO: 2010738 - RNA, 17 nt, Human
auauuuuaaaauaaacu

SEQ ID NO: 2010739 - RNA, 11 nt, Human
auauuugugua

SEQ ID NO: 2010740 - RNA, 16 nt, Human
auauuugugugcuaaa

SEQ ID NO: 2010741 - RNA, 22 nt, Human
auauuugugugcuaaacgugua

SEQ ID NO: 2010742 - RNA, 23 nt, Human
auauuugugugcuaaacguguau

SEQ ID NO: 2010743 - RNA, 17 nt, Human
auauuuguguguucacu

SEQ ID NO: 2010744 - RNA, 22 nt, Human
auauuuaaaggcccuaucuguu

SEQ ID NO: 2010745 - RNA, 14 nt, Human
auauuuaaaacuuu

SEQ ID NO: 2010746 - RNA, 23 nt, Human
auauuucugaggagccugcaaca

SEQ ID NO: 2010747 - RNA, 12 nt, Human
auauuguuaagg

SEQ ID NO: 2010748 - RNA, 20 nt, Human
auauuguuuucaguguacau

SEQ ID NO: 2010749 - RNA, 19 nt, Human
auauuuaaaaacaaaaggc

SEQ ID NO: 2010750 - RNA, 22 nt, Human
auauuuaaaaacaaaaggcaau

SEQ ID NO: 2010751 - RNA, 21 nt, Human
auauugcugauggugcaauga

SEQ ID NO: 2010752 - RNA, 17 nt, Human
auauugcugauggugca

SEQ ID NO: 2010753 - RNA, 17 nt, Human
auauugccauuaugcuu

SEQ ID NO: 2010754 - RNA, 20 nt, Human
auauugaaaggcaaacauuu

SEQ ID NO: 2010755 - RNA, 17 nt, Human
auauugcacaauuauaa

SEQ ID NO: 2010756 - RNA, 23 nt, Human
uucugggaauguauaguauuuga

SEQ ID NO: 2010757 - RNA, 15 nt, Human
uucugggguuuuucu

SEQ ID NO: 2010758 - RNA, 11 nt, Human
uucugguaauc

SEQ ID NO: 2010759 - RNA, 23 nt, Human
uucuguaauaacuagaacaaaua

SEQ ID NO: 2010760 - RNA, 23 nt, Human
uucugccgcagcccugcagaggg

SEQ ID NO: 2010761 - RNA, 21 nt, Human
uucugccacccugcugagucu

SEQ ID NO: 2010762 - RNA, 16 nt, Human
uucugccgcagcccug

SEQ ID NO: 2010763 - RNA, 22 nt, Human
uucugccagauguccuaauggu

SEQ ID NO: 2010764 - RNA, 10 nt, Human
uucugggaca

SEQ ID NO: 2010765 - RNA, 15 nt, Human
uucugccucugaugu

SEQ ID NO: 2010766 - RNA, 16 nt, Human
uucugccucugaugua

SEQ ID NO: 2010767 - RNA, 22 nt, Human
uucugccucugauguauuuugu

SEQ ID NO: 2010768 - RNA, 21 nt, Human
uucugccugaggggcagccug

SEQ ID NO: 2010769 - RNA, 23 nt, Human
uucugccugaggggcagccugcc

SEQ ID NO: 2010770 - RNA, 11 nt, Human
uucugggacac

SEQ ID NO: 2010771 - RNA, 22 nt, Human
uucugggacacaguucaauucu

SEQ ID NO: 2010772 - RNA, 21 nt, Human
uucugaaauuuccugggagcu

SEQ ID NO: 2010773 - RNA, 16 nt, Human
uucugaaccugucuuu

SEQ ID NO: 2010774 - RNA, 13 nt, Human
uucucuucacuca

SEQ ID NO: 2010775 - RNA, 19 nt, Human
uucucuucauauucagcuu

SEQ ID NO: 2010776 - RNA, 12 nt, Human
uucucuuagaaa

SEQ ID NO: 2010777 - RNA, 22 nt, Human
uucucuuagaaaaggugauaaa

SEQ ID NO: 2010778 - RNA, 12 nt, Human
uucugaaagagu

SEQ ID NO: 2010779 - RNA, 19 nt, Human
uucugaaagagucuuucuu

SEQ ID NO: 2010780 - RNA, 15 nt, Human
uucugaaagggacgc

SEQ ID NO: 2010781 - RNA, 19 nt, Human
aucauugaaaucuuuuugc

SEQ ID NO: 2010782 - RNA, 20 nt, Human
aucauugaaaucuuuuugcu

SEQ ID NO: 2010783 - RNA, 23 nt, Human
aucauuccuuuuuauuuauaugu

SEQ ID NO: 2010784 - RNA, 17 nt, Human
aucccauaugccugggc

SEQ ID NO: 2010785 - RNA, 16 nt, Human
aucccauaugccuggg

SEQ ID NO: 2010786 - RNA, 16 nt, Human
aucccugcucacugca

SEQ ID NO: 2010787 - RNA, 20 nt, Human
aucccugcucacugcagccu

SEQ ID NO: 2010788 - RNA, 12 nt, Human
aucccugcucac

SEQ ID NO: 2010789 - RNA, 13 nt, Human
aucccugcucacu

SEQ ID NO: 2010790 - RNA, 15 nt, Human
aucccugcucacugc

SEQ ID NO: 2010791 - RNA, 15 nt, Human
aucccuguguuaauu

SEQ ID NO: 2010792 - RNA, 20 nt, Human
aucccuguguuaauuuaagu

SEQ ID NO: 2010793 - RNA, 12 nt, Human
aucccuuaagaa

SEQ ID NO: 2010794 - RNA, 14 nt, Human
aucccuuaagaaug

SEQ ID NO: 2010795 - RNA, 17 nt, Human
aucccaggauguacaag

SEQ ID NO: 2010796 - RNA, 19 nt, Human
auccauggggucucucaca

SEQ ID NO: 2010797 - RNA, 22 nt, Human
auccauggggucucucacagac

SEQ ID NO: 2010798 - RNA, 23 nt, Human
auccauggggucucucacagaca

SEQ ID NO: 2010799 - RNA, 15 nt, Human
auccagguucagcuu

SEQ ID NO: 2010800 - RNA, 16 nt, Human
auccagguucagcuug

SEQ ID NO: 2010801 - RNA, 17 nt, Human
auccaggguggugguga

SEQ ID NO: 2010802 - RNA, 11 nt, Human
aucauuucugg

SEQ ID NO: 2010803 - RNA, 19 nt, Human
aucauuuguucaaagcugu

SEQ ID NO: 2010804 - RNA, 11 nt, Human
aucauuugagu

SEQ ID NO: 2010805 - RNA, 14 nt, Human
aucauuugaguuca

SEQ ID NO: 2010806 - RNA, 12 nt, Human
aucauuuguuca

SEQ ID NO: 2010807 - RNA, 18 nt, Human
aucauguuuacagaggac

SEQ ID NO: 2010808 - RNA, 23 nt, Human
aucauguuuacagaggacaguau

SEQ ID NO: 2010809 - RNA, 12 nt, Human
aucauguuucuu

SEQ ID NO: 2010810 - RNA, 14 nt, Human
aucauguuucuuug

SEQ ID NO: 2010811 - RNA, 15 nt, Human
aucauguuucuuuga

SEQ ID NO: 2010812 - RNA, 16 nt, Human
aucauguuucuuugau

SEQ ID NO: 2010813 - RNA, 23 nt, Human
aucauguuucuuugaucaugaau

SEQ ID NO: 2010814 - RNA, 23 nt, Human
aucauaguggcuuaaaacaacac

SEQ ID NO: 2010815 - RNA, 23 nt, Human
aucauauugguauauccuuuucu

SEQ ID NO: 2010816 - RNA, 15 nt, Human
aucauauuauacaga

SEQ ID NO: 2010817 - RNA, 16 nt, Human
aucauauuauacagac

SEQ ID NO: 2010818 - RNA, 14 nt, Human
aucauucauuuucu

SEQ ID NO: 2010819 - RNA, 22 nt, Human
aucauuaaagccugaguuugcu

SEQ ID NO: 2010820 - RNA, 15 nt, Human
aucauugaaaucuuu

SEQ ID NO: 2010821 - RNA, 14 nt, Human
aucauugaaaucuu

SEQ ID NO: 2010822 - RNA, 14 nt, Human
aucauuccuuuuua

SEQ ID NO: 2010823 - RNA, 15 nt, Human
aucauuccuuuuuau

SEQ ID NO: 2010824 - RNA, 20 nt, Human
aucauuccuuuuuauuuaua

SEQ ID NO: 2010825 - RNA, 21 nt, Human
aucauuccuuuuuauuuauau

SEQ ID NO: 2010826 - RNA, 13 nt, Human
aucauucuaaaga

SEQ ID NO: 2010827 - RNA, 16 nt, Human
aucagugucuuuccac

SEQ ID NO: 2010828 - RNA, 14 nt, Human
aucauaaguauuug

SEQ ID NO: 2010829 - RNA, 17 nt, Human
aucauaaguauuuggaa

SEQ ID NO: 2010830 - RNA, 18 nt, Human
aucauaaguauuuggaau

SEQ ID NO: 2010831 - RNA, 19 nt, Human
aucauaaguauuuggaauu

SEQ ID NO: 2010832 - RNA, 23 nt, Human
aucauaaguauuuggaauuagaa

SEQ ID NO: 2010833 - RNA, 17 nt, Human
aucauacuccuaugcuu

SEQ ID NO: 2010834 - RNA, 18 nt, Human
aucauacuccuaugcuuu

SEQ ID NO: 2010835 - RNA, 19 nt, Human
aucauacuccuaugcuuua

SEQ ID NO: 2010836 - RNA, 15 nt, Human
aucagcacgauuucu

SEQ ID NO: 2010837 - RNA, 16 nt, Human
aucagcacgauuucug

SEQ ID NO: 2010838 - RNA, 17 nt, Human
aucagcacgauuucugu

SEQ ID NO: 2010839 - RNA, 18 nt, Human
aucagcacgauuucuguu

SEQ ID NO: 2010840 - RNA, 15 nt, Human
aucagaacagcuguu

SEQ ID NO: 2010841 - RNA, 13 nt, Human
aucagaacagcug

SEQ ID NO: 2010842 - RNA, 14 nt, Human
aucagaacagcugu

SEQ ID NO: 2010843 - RNA, 16 nt, Human
aucagaaauaauaaaa

SEQ ID NO: 2010844 - RNA, 20 nt, Human
uucucacagcuccaagaauu

SEQ ID NO: 2010845 - RNA, 22 nt, Human
uucucagaaucucaaauaacua

SEQ ID NO: 2010846 - RNA, 19 nt, Human
uucucagaaucucaaauaa

SEQ ID NO: 2010847 - RNA, 23 nt, Human
uucucagaaucucaaauaacuaa

SEQ ID NO: 2010848 - RNA, 14 nt, Human
uucucaguuuuucu

SEQ ID NO: 2010849 - RNA, 15 nt, Human
uucucaguuuuucuu

SEQ ID NO: 2010850 - RNA, 16 nt, Human
uucucaguuuuucuua

SEQ ID NO: 2010851 - RNA, 18 nt, Human
uucucaguuuuucuuaau

SEQ ID NO: 2010852 - RNA, 19 nt, Human
uucucaguuuuucuuaaua

SEQ ID NO: 2010853 - RNA, 21 nt, Human
uucucaagggacguccuccaa

SEQ ID NO: 2010854 - RNA, 18 nt, Human
uuccuuuuuauuuauaug

SEQ ID NO: 2010855 - RNA, 13 nt, Human
uucuaggccuggg

SEQ ID NO: 2010856 - RNA, 20 nt, Human
uuccuuuuuauuuauaugua

SEQ ID NO: 2010857 - RNA, 23 nt, Human
uucuaggacugaauuaugaaacu

SEQ ID NO: 2010858 - RNA, 17 nt, Human
agugaggcucugcccuu

SEQ ID NO: 2010859 - RNA, 16 nt, Human
agugaggcucugcccu

SEQ ID NO: 2010860 - RNA, 14 nt, Human
agugaggcucugcc

SEQ ID NO: 2010861 - RNA, 15 nt, Human
agugaggcucugccc

SEQ ID NO: 2010862 - RNA, 20 nt, Human
agugaggcucugcccuuggu

SEQ ID NO: 2010863 - RNA, 19 nt, Human
agugaggcucugcccuugg

SEQ ID NO: 2010864 - RNA, 21 nt, Human
agugaggcucugcccuugguu

SEQ ID NO: 2010865 - RNA, 14 nt, Human
agugagggauuauc

SEQ ID NO: 2010866 - RNA, 21 nt, Human
agugaguugauagcacagacc

SEQ ID NO: 2010867 - RNA, 15 nt, Human
agugagucgaggaca

SEQ ID NO: 2010868 - RNA, 21 nt, Human
ugugcccccauguaagcaccc

SEQ ID NO: 2010869 - RNA, 18 nt, Human
ugugcugcuuugauauau

SEQ ID NO: 2010870 - RNA, 17 nt, Human
ugugcccagaauacuga

SEQ ID NO: 2010871 - RNA, 18 nt, Human
ugugcccagaauacugau

SEQ ID NO: 2010872 - RNA, 21 nt, Human
ugugcccagaauacugaugga

SEQ ID NO: 2010873 - RNA, 23 nt, Human
uguggcaguuuggcaaacucucc

SEQ ID NO: 2010874 - RNA, 21 nt, Human
uguggaguucaucuugaauug

SEQ ID NO: 2010875 - RNA, 17 nt, Human
uguggagucauuucuga

SEQ ID NO: 2010876 - RNA, 22 nt, Human
uguggagucagccucgcaggcc

SEQ ID NO: 2010877 - RNA, 18 nt, Human
uguggagucauuucugau

SEQ ID NO: 2010878 - RNA, 17 nt, Human
uguggaguucaucuuga

SEQ ID NO: 2010879 - RNA, 20 nt, Human
ugugauggggcccugccucc

SEQ ID NO: 2010880 - RNA, 19 nt, Human
ugugauggggcccugccuc

SEQ ID NO: 2010881 - RNA, 18 nt, Human
ugugaugagaggaaauca

SEQ ID NO: 2010882 - RNA, 16 nt, Human
agugaacaaauuuaca

SEQ ID NO: 2010883 - RNA, 20 nt, Human
agugaacaaauuuacagaga

SEQ ID NO: 2010884 - RNA, 15 nt, Human
ugugaucucauuguu

SEQ ID NO: 2010885 - RNA, 16 nt, Human
ugugaucucauuguuc

SEQ ID NO: 2010886 - RNA, 15 nt, Human
agugaaagaaaauaa

SEQ ID NO: 2010887 - RNA, 18 nt, Human
agugaaauaccauuauua

SEQ ID NO: 2010888 - RNA, 13 nt, Human
agugaaauuuauu

SEQ ID NO: 2010889 - RNA, 18 nt, Human
ugugccagauuuaugcau

SEQ ID NO: 2010890 - RNA, 14 nt, Human
ugugcccacccucc

SEQ ID NO: 2010891 - RNA, 23 nt, Human
ugugcccacccuccacucuccuc

SEQ ID NO: 2010892 - RNA, 12 nt, Human
ugugccaugugc

SEQ ID NO: 2010893 - RNA, 16 nt, Human
ugugccaugugccagg

SEQ ID NO: 2010894 - RNA, 20 nt, Human
ugugccagauuuaugcauau

SEQ ID NO: 2010895 - RNA, 20 nt, Human
ugugccagguuuuuggucug

SEQ ID NO: 2010896 - RNA, 19 nt, Human
ugugccaggugaaggaggc

SEQ ID NO: 2010897 - RNA, 15 nt, Human
ugugagaugcuagaa

SEQ ID NO: 2010898 - RNA, 19 nt, Human
ugugagaugcuagaacucc

SEQ ID NO: 2010899 - RNA, 16 nt, Human
ugugacugaauuucuu

SEQ ID NO: 2010900 - RNA, 15 nt, Human
ugugacugaauuucu

SEQ ID NO: 2010901 - RNA, 13 nt, Human
agucucuucucca

SEQ ID NO: 2010902 - RNA, 14 nt, Human
agucucuucuccac

SEQ ID NO: 2010903 - RNA, 21 nt, Human
agucucagugcuagcuuauuu

SEQ ID NO: 2010904 - RNA, 14 nt, Human
agucuuuguacaga

SEQ ID NO: 2010905 - RNA, 16 nt, Human
agucuuucuucuucaa

SEQ ID NO: 2010906 - RNA, 11 nt, Human
agucuuuuaaa

SEQ ID NO: 2010907 - RNA, 18 nt, Human
agucuugccuauauuuuc

SEQ ID NO: 2010908 - RNA, 21 nt, Human
agucuugccuauauuuuccug

SEQ ID NO: 2010909 - RNA, 18 nt, Human
agucuucauguucccacu

SEQ ID NO: 2010910 - RNA, 14 nt, Human
agucuucaugaaau

SEQ ID NO: 2010911 - RNA, 15 nt, Human
agucuucaugaaaug

SEQ ID NO: 2010912 - RNA, 16 nt, Human
agucuucaugaaaugc

SEQ ID NO: 2010913 - RNA, 17 nt, Human
agucuucaugaaaugcu

SEQ ID NO: 2010914 - RNA, 18 nt, Human
agucuucaugaaaugcua

SEQ ID NO: 2010915 - RNA, 23 nt, Human
agucuucaugaaaugcuauguca

SEQ ID NO: 2010916 - RNA, 15 nt, Human
agucucuucuccacu

SEQ ID NO: 2010917 - RNA, 16 nt, Human
agucucuucuccacug

SEQ ID NO: 2010918 - RNA, 18 nt, Human
agucucuucuccacugga

SEQ ID NO: 2010919 - RNA, 17 nt, Human
agucucuucuccacugg

SEQ ID NO: 2010920 - RNA, 16 nt, Human
agucuuaugcuuccag

SEQ ID NO: 2010921 - RNA, 17 nt, Human
agucuuaugcuuccaga

SEQ ID NO: 2010922 - RNA, 18 nt, Human
agucuuaugcuuccagaa

SEQ ID NO: 2010923 - RNA, 15 nt, Human
ugugaacagcggcug

SEQ ID NO: 2010924 - RNA, 20 nt, Human
ugugaacaguuguguuugaa

SEQ ID NO: 2010925 - RNA, 19 nt, Human
ugugaaccaccacacccag

SEQ ID NO: 2010926 - RNA, 20 nt, Human
ugugaaccaccacacccagc

SEQ ID NO: 2010927 - RNA, 21 nt, Human
ugugaaccaccacacccagcc

SEQ ID NO: 2010928 - RNA, 20 nt, Human
ugugaaauuuuucauauuuu

SEQ ID NO: 2010929 - RNA, 15 nt, Human
ugugaacuuggaagc

SEQ ID NO: 2010930 - RNA, 18 nt, Human
ugugaacuuggaagcaca

SEQ ID NO: 2010931 - RNA, 13 nt, Human
ugugaccucacgu

SEQ ID NO: 2010932 - RNA, 14 nt, Human
ugugaagagaacca

SEQ ID NO: 2010933 - RNA, 18 nt, Human
ugugacuaggaaaaaauu

SEQ ID NO: 2010934 - RNA, 15 nt, Human
ugugaaauuuuucau

SEQ ID NO: 2010935 - RNA, 17 nt, Human
ugugaaauuuuucauau

SEQ ID NO: 2010936 - RNA, 19 nt, Human
ugugaaauuuuucauauuu

SEQ ID NO: 2010937 - RNA, 12 nt, Human
ugugaaauuauu

SEQ ID NO: 2010938 - RNA, 21 nt, Human
ugugaaaggaaagagggaggu

SEQ ID NO: 2010939 - RNA, 18 nt, Human
ugugaaaggaaagaggcu

SEQ ID NO: 2010940 - RNA, 15 nt, Human
ugugaaaggaaagag

SEQ ID NO: 2010941 - RNA, 14 nt, Human
uguuacaaauugua

SEQ ID NO: 2010942 - RNA, 21 nt, Human
uguuacaaaauguaacuguua

SEQ ID NO: 2010943 - RNA, 23 nt, Human
uguuacaaaauguaacuguuacc

SEQ ID NO: 2010944 - RNA, 16 nt, Human
uguuacaaaauguaac

SEQ ID NO: 2010945 - RNA, 17 nt, Human
uguuacaaaauguaacu

SEQ ID NO: 2010946 - RNA, 18 nt, Human
uguuacaaaauguaacug

SEQ ID NO: 2010947 - RNA, 19 nt, Human
uguuacaaaauguaacugu

SEQ ID NO: 2010948 - RNA, 17 nt, Human
aguggugcgaucugggu

SEQ ID NO: 2010949 - RNA, 16 nt, Human
aguggacccugaaaug

SEQ ID NO: 2010950 - RNA, 17 nt, Human
aguggacccugaaaugu

SEQ ID NO: 2010951 - RNA, 18 nt, Human
aguggacccugaaaugug

SEQ ID NO: 2010952 - RNA, 19 nt, Human
aguggugguuuucuguucu

SEQ ID NO: 2010953 - RNA, 20 nt, Human
aguggugguuuucuguucuu

SEQ ID NO: 2010954 - RNA, 21 nt, Human
aguggugguuuucuguucuuu

SEQ ID NO: 2010955 - RNA, 23 nt, Human
aguggugguuuucuguucuuucu

SEQ ID NO: 2010956 - RNA, 17 nt, Human
aguggugguuuucuguu

SEQ ID NO: 2010957 - RNA, 18 nt, Human
aguggugguuuucuguuc

SEQ ID NO: 2010958 - RNA, 21 nt, Human
agugguggugaacagaacaaa

SEQ ID NO: 2010959 - RNA, 16 nt, Human
aguguacuggauuuaa

SEQ ID NO: 2010960 - RNA, 22 nt, Human
aguguaaaauauuuuaaaauaa

SEQ ID NO: 2010961 - RNA, 20 nt, Human
agugugguguuuccuggcac

SEQ ID NO: 2010962 - RNA, 19 nt, Human
agugugguguuuccuggca

SEQ ID NO: 2010963 - RNA, 17 nt, Human
agugugguguuuccugg

SEQ ID NO: 2010964 - RNA, 23 nt, Human
agugugguguuuccugcaggcca

SEQ ID NO: 2010965 - RNA, 17 nt, Human
agugugcaguaucugug

SEQ ID NO: 2010966 - RNA, 16 nt, Human
agugugguguuuccug

SEQ ID NO: 2010967 - RNA, 18 nt, Human
uguucugugauauaagug

SEQ ID NO: 2010968 - RNA, 15 nt, Human
uguucugugauauaa

SEQ ID NO: 2010969 - RNA, 13 nt, Human
uguucuguuacaa

SEQ ID NO: 2010970 - RNA, 14 nt, Human
uguucuguuacaaa

SEQ ID NO: 2010971 - RNA, 15 nt, Human
uguucuguuacaaaa

SEQ ID NO: 2010972 - RNA, 16 nt, Human
uguucuguuacaaaau

SEQ ID NO: 2010973 - RNA, 18 nt, Human
uguucuguuacaaaaugu

SEQ ID NO: 2010974 - RNA, 19 nt, Human
uguucuguuacaaaaugua

SEQ ID NO: 2010975 - RNA, 22 nt, Human
uguucuguuacaaaauguaacu

SEQ ID NO: 2010976 - RNA, 23 nt, Human
uguucuguuacaaaauguaacug

SEQ ID NO: 2010977 - RNA, 11 nt, Human
uguugauuucu

SEQ ID NO: 2010978 - RNA, 14 nt, Human
uguugauuucuagu

SEQ ID NO: 2010979 - RNA, 15 nt, Human
uguugauuucuaguu

SEQ ID NO: 2010980 - RNA, 16 nt, Human
uguugauuucuaguua

SEQ ID NO: 2010981 - RNA, 18 nt, Human
uguugauuucuaguuauu

SEQ ID NO: 2010982 - RNA, 19 nt, Human
uguugauuucuaguuauuu

SEQ ID NO: 2010983 - RNA, 20 nt, Human
uguugauuucuaguuauuua

SEQ ID NO: 2010984 - RNA, 13 nt, Human
uguugcccaggca

SEQ ID NO: 2010985 - RNA, 12 nt, Human
uguugcccaggc

SEQ ID NO: 2010986 - RNA, 15 nt, Human
uguugcccaggcagg

SEQ ID NO: 2010987 - RNA, 16 nt, Human
uguugcccaggcaggu

SEQ ID NO: 2010988 - RNA, 17 nt, Human
uguugcccaggcagguc

SEQ ID NO: 2010989 - RNA, 18 nt, Human
uguugcccaggcaggucu

SEQ ID NO: 2010990 - RNA, 17 nt, Human
uguucccaccugcugga

SEQ ID NO: 2010991 - RNA, 18 nt, Human
uguuccauaguuaaagaa

SEQ ID NO: 2010992 - RNA, 10 nt, Human
uguuccaguu

SEQ ID NO: 2010993 - RNA, 21 nt, Human
uguuccgugguuaaacucgcu

SEQ ID NO: 2010994 - RNA, 22 nt, Human
uguuccgaaaccaaagaagaaa

SEQ ID NO: 2010995 - RNA, 16 nt, Human
uguucugggacacagu

SEQ ID NO: 2010996 - RNA, 20 nt, Human
agugugucuuagugugugca

SEQ ID NO: 2010997 - RNA, 12 nt, Human
uguuauaugaac

SEQ ID NO: 2010998 - RNA, 20 nt, Human
uguuccacaaguuaaauaaa

SEQ ID NO: 2010999 - RNA, 19 nt, Human
uguuauagguccuuuagaa

SEQ ID NO: 2011000 - RNA, 13 nt, Human
uguguugaagagg

SEQ ID NO: 2011001 - RNA, 17 nt, Human
uguguugaagagcagcu

SEQ ID NO: 2011002 - RNA, 13 nt, Human
uguuaaagaugua

SEQ ID NO: 2011003 - RNA, 19 nt, Human
uguuaaagauguagcaaac

SEQ ID NO: 2011004 - RNA, 15 nt, Human
uguuaaauaaggccu

SEQ ID NO: 2011005 - RNA, 14 nt, Human
uguuaaagauguag

SEQ ID NO: 2011006 - RNA, 18 nt, Human
uguuaaagauguagcaaa

SEQ ID NO: 2011007 - RNA, 14 nt, Human
uguuacaaaaugua

SEQ ID NO: 2011008 - RNA, 15 nt, Human
uguuacaaaauguaa

SEQ ID NO: 2011009 - RNA, 15 nt, Human
uguuaauuuggacca

SEQ ID NO: 2011010 - RNA, 22 nt, Human
uguuaauuuggaccauuuuccu

SEQ ID NO: 2011011 - RNA, 15 nt, Human
uguuaauuuaaguuu

SEQ ID NO: 2011012 - RNA, 16 nt, Human
uguuaauuuaaguuuu

SEQ ID NO: 2011013 - RNA, 17 nt, Human
uguuaagggaccaggga

SEQ ID NO: 2011014 - RNA, 22 nt, Human
uguuaagguggauugaggccag

SEQ ID NO: 2011015 - RNA, 15 nt, Human
uguuaaauuaauuau

SEQ ID NO: 2011016 - RNA, 20 nt, Human
ugugucucuugguccugcug

SEQ ID NO: 2011017 - RNA, 17 nt, Human
ugugucucuugguccug

SEQ ID NO: 2011018 - RNA, 17 nt, Human
uguguaagaaauacaga

SEQ ID NO: 2011019 - RNA, 21 nt, Human
ugugucucuugguccugcugc

SEQ ID NO: 2011020 - RNA, 21 nt, Human
ugugucuugcaauggcagccu

SEQ ID NO: 2011021 - RNA, 12 nt, Human
ugugugugggag

SEQ ID NO: 2011022 - RNA, 20 nt, Human
ugugugugggaguguguaau

SEQ ID NO: 2011023 - RNA, 14 nt, Human
uguguguguaugug

SEQ ID NO: 2011024 - RNA, 23 nt, Human
uguguguuuauugucaaaguggu

SEQ ID NO: 2011025 - RNA, 19 nt, Human
uguguguuuauugucaaag

SEQ ID NO: 2011026 - RNA, 20 nt, Human
uguggucacaggaaguagag

SEQ ID NO: 2011027 - RNA, 23 nt, Human
uguggguuucuaaagcugccagc

SEQ ID NO: 2011028 - RNA, 21 nt, Human
uguggguuucuaaagcugcca

SEQ ID NO: 2011029 - RNA, 12 nt, Human
agugcugugaaa

SEQ ID NO: 2011030 - RNA, 13 nt, Human
agugcugugaaaa

SEQ ID NO: 2011031 - RNA, 14 nt, Human
agugcugugaaaaa

SEQ ID NO: 2011032 - RNA, 16 nt, Human
agugcugugaaaaaaa

SEQ ID NO: 2011033 - RNA, 16 nt, Human
ugugguguuuccuggc

SEQ ID NO: 2011034 - RNA, 14 nt, Human
ugugguguuuccug

SEQ ID NO: 2011035 - RNA, 18 nt, Human
uguguaagacaaaaagcu

SEQ ID NO: 2011036 - RNA, 21 nt, Human
ugugguguuuccugcaggcca

SEQ ID NO: 2011037 - RNA, 16 nt, Human
ugugguguugaggcuu

SEQ ID NO: 2011038 - RNA, 20 nt, Human
ugugguguuuccuggcacug

SEQ ID NO: 2011039 - RNA, 15 nt, Human
uguggucccacccca

SEQ ID NO: 2011040 - RNA, 13 nt, Human
uguggucccaccc

SEQ ID NO: 2011041 - RNA, 16 nt, Human
uguggucccaccccac

SEQ ID NO: 2011042 - RNA, 14 nt, Human
uguggugucugugu

SEQ ID NO: 2011043 - RNA, 16 nt, Human
agugcugcauuuaaaa

SEQ ID NO: 2011044 - RNA, 17 nt, Human
agugcugcauuuaaaag

SEQ ID NO: 2011045 - RNA, 19 nt, Human
agugcugcauuuaaaagau

SEQ ID NO: 2011046 - RNA, 20 nt, Human
agugcugggauuacaggugu

SEQ ID NO: 2011047 - RNA, 21 nt, Human
agugcugggauuacaggugug

SEQ ID NO: 2011048 - RNA, 23 nt, Human
agugaguugauagcacagacccu

SEQ ID NO: 2011049 - RNA, 22 nt, Human
agugaguugauagcacagaccc

SEQ ID NO: 2011050 - RNA, 22 nt, Human
agugaguacaugcacacucaug

SEQ ID NO: 2011051 - RNA, 12 nt, Human
agugcugcauuu

SEQ ID NO: 2011052 - RNA, 13 nt, Human
agugcugcauuua

SEQ ID NO: 2011053 - RNA, 21 nt, Human
agugcugcagggcuuuaaaau

SEQ ID NO: 2011054 - RNA, 21 nt, Human
aguucugcagauaaacaguag

SEQ ID NO: 2011055 - RNA, 16 nt, Human
aguucugcagauaaac

SEQ ID NO: 2011056 - RNA, 13 nt, Human
uguuuugcaugua

SEQ ID NO: 2011057 - RNA, 21 nt, Human
aguucugccucugauguauuu

SEQ ID NO: 2011058 - RNA, 14 nt, Human
aguucuuaacccag

SEQ ID NO: 2011059 - RNA, 18 nt, Human
aguucuuaacccaguguc

SEQ ID NO: 2011060 - RNA, 14 nt, Human
aguucugguuccua

SEQ ID NO: 2011061 - RNA, 11 nt, Human
aguucugggca

SEQ ID NO: 2011062 - RNA, 20 nt, Human
uguuuuccaugaguccccug

SEQ ID NO: 2011063 - RNA, 21 nt, Human
uguuuuauuuaaccucuaaau

SEQ ID NO: 2011064 - RNA, 21 nt, Human
uguuuuauuuuaauucaguug

SEQ ID NO: 2011065 - RNA, 13 nt, Human
uguuuggagacag

SEQ ID NO: 2011066 - RNA, 13 nt, Human
uguuuuaucuggu

SEQ ID NO: 2011067 - RNA, 20 nt, Human
uguuugcugaacauuggaga

SEQ ID NO: 2011068 - RNA, 21 nt, Human
uguuugaugcauuaaaagaaa

SEQ ID NO: 2011069 - RNA, 19 nt, Human
uguugccuugcauaauggu

SEQ ID NO: 2011070 - RNA, 19 nt, Human
uguugcccaggcaggucuu

SEQ ID NO: 2011071 - RNA, 16 nt, Human
uguugcuauaauaaag

SEQ ID NO: 2011072 - RNA, 15 nt, Human
uguuuagucuuuaua

SEQ ID NO: 2011073 - RNA, 13 nt, Human
uguuuaugugugu

SEQ ID NO: 2011074 - RNA, 16 nt, Human
uguuuaugugugugug

SEQ ID NO: 2011075 - RNA, 17 nt, Human
uguuuaucccuuaagaa

SEQ ID NO: 2011076 - RNA, 19 nt, Human
uguuuauugucaaaguggu

SEQ ID NO: 2011077 - RNA, 17 nt, Human
uguuuauugucaaagug

SEQ ID NO: 2011078 - RNA, 22 nt, Human
uguuugagcaucgcuuaggaga

SEQ ID NO: 2011079 - RNA, 15 nt, Human
uguuucuuugaucau

SEQ ID NO: 2011080 - RNA, 16 nt, Human
uguuugaaaauaguuu

SEQ ID NO: 2011081 - RNA, 17 nt, Human
uguuugaaaauaguuua

SEQ ID NO: 2011082 - RNA, 18 nt, Human
uguuugaaaauaguuuau

SEQ ID NO: 2011083 - RNA, 19 nt, Human
uguuugaaaauaguuuauu

SEQ ID NO: 2011084 - RNA, 22 nt, Human
uguuugauucagacagcugccu

SEQ ID NO: 2011085 - RNA, 17 nt, Human
uguuugauucagacagc

SEQ ID NO: 2011086 - RNA, 13 nt, Human
uguuugaugcauu

SEQ ID NO: 2011087 - RNA, 16 nt, Human
uguuugaugcauuaaa

SEQ ID NO: 2011088 - RNA, 19 nt, Human
uguuugaugcauuaaaaga

SEQ ID NO: 2011089 - RNA, 19 nt, Human
uguuucuuuguaaugaaaa

SEQ ID NO: 2011090 - RNA, 18 nt, Human
uguuucuuuguaaugaaa

SEQ ID NO: 2011091 - RNA, 20 nt, Human
uguuucuuucucugaggaca

SEQ ID NO: 2011092 - RNA, 21 nt, Human
uguuucuuucucugaggacaa

SEQ ID NO: 2011093 - RNA, 12 nt, Human
uguuucuuugaa

SEQ ID NO: 2011094 - RNA, 13 nt, Human
uguuucuuugaau

SEQ ID NO: 2011095 - RNA, 16 nt, Human
uguuucuuugaauuuu

SEQ ID NO: 2011096 - RNA, 18 nt, Human
uguuucuuugaauuuuca

SEQ ID NO: 2011097 - RNA, 19 nt, Human
uguuucuuugaauuuucau

SEQ ID NO: 2011098 - RNA, 23 nt, Human
uguuucuuugaauuuucauuuua

SEQ ID NO: 2011099 - RNA, 12 nt, Human
uguuucuuugau

SEQ ID NO: 2011100 - RNA, 13 nt, Human
uuaaaauugugau

SEQ ID NO: 2011101 - RNA, 23 nt, Human
uuaaaauucucuuccaaccauuu

SEQ ID NO: 2011102 - RNA, 18 nt, Human
uuaaaauugugauguguc

SEQ ID NO: 2011103 - RNA, 20 nt, Human
uuaaaaaguauugccaaaca

SEQ ID NO: 2011104 - RNA, 21 nt, Human
uuaaaaaguauugccaaacau

SEQ ID NO: 2011105 - RNA, 22 nt, Human
uuaaaaaguauugccaaacauu

SEQ ID NO: 2011106 - RNA, 23 nt, Human
uuaaaaaguauugccaaacauua

SEQ ID NO: 2011107 - RNA, 12 nt, Human
uuaaaaaguauu

SEQ ID NO: 2011108 - RNA, 14 nt, Human
uuaaaaagcccaac

SEQ ID NO: 2011109 - RNA, 17 nt, Human
uuaaaaagcccaaccuc

SEQ ID NO: 2011110 - RNA, 23 nt, Human
uuaaaaagauaaaaaaacagcuu

SEQ ID NO: 2011111 - RNA, 16 nt, Human
uuaaaaacaaaaggca

SEQ ID NO: 2011112 - RNA, 17 nt, Human
uuaaaaacaaaaggcaa

SEQ ID NO: 2011113 - RNA, 12 nt, Human
uuaaaauuuuaa

SEQ ID NO: 2011114 - RNA, 21 nt, Human
uuaaaauuuuaagcuaggaaa

SEQ ID NO: 2011115 - RNA, 13 nt, Human
uuaaaauuucuua

SEQ ID NO: 2011116 - RNA, 19 nt, Human
uuaaaauuucuuagaaaac

SEQ ID NO: 2011117 - RNA, 22 nt, Human
uuaaaauuucuuagaaaacaau

SEQ ID NO: 2011118 - RNA, 13 nt, Human
uuaaaauuugaaa

SEQ ID NO: 2011119 - RNA, 14 nt, Human
uuaaaauuugaaac

SEQ ID NO: 2011120 - RNA, 15 nt, Human
uuaaaauuugaaaca

SEQ ID NO: 2011121 - RNA, 17 nt, Human
uuaaaauuugaaacauu

SEQ ID NO: 2011122 - RNA, 18 nt, Human
uuaaaauuugaaacauug

SEQ ID NO: 2011123 - RNA, 22 nt, Human
uuaaagggaagaaaacacuguu

SEQ ID NO: 2011124 - RNA, 23 nt, Human
uuaaagggaagaaaacacuguua

SEQ ID NO: 2011125 - RNA, 15 nt, Human
uuaaagggaaauuga

SEQ ID NO: 2011126 - RNA, 13 nt, Human
uuaaagggaagaa

SEQ ID NO: 2011127 - RNA, 15 nt, Human
uuaaagggaagaaaa

SEQ ID NO: 2011128 - RNA, 16 nt, Human
uuaaagggaagaaaac

SEQ ID NO: 2011129 - RNA, 18 nt, Human
uuaaagggaagaaaacac

SEQ ID NO: 2011130 - RNA, 20 nt, Human
uuaaauucuugcaaaguauc

SEQ ID NO: 2011131 - RNA, 14 nt, Human
uuaaauugcucaca

SEQ ID NO: 2011132 - RNA, 21 nt, Human
uuaaauugcucacaguuauua

SEQ ID NO: 2011133 - RNA, 11 nt, Human
uuaacaaauaa

SEQ ID NO: 2011134 - RNA, 17 nt, Human
uuaacaggcaaacauuu

SEQ ID NO: 2011135 - RNA, 18 nt, Human
uuaacaggcaaacauuuu

SEQ ID NO: 2011136 - RNA, 23 nt, Human
uuaacaggcaaacauuuucucuu

SEQ ID NO: 2011137 - RNA, 22 nt, Human
uuaacagggucucuagugcugu

SEQ ID NO: 2011138 - RNA, 17 nt, Human
uuaacaaauaacaacuu

SEQ ID NO: 2011139 - RNA, 12 nt, Human
uuaacaagaagc

SEQ ID NO: 2011140 - RNA, 16 nt, Human
aguuucagaguucuca

SEQ ID NO: 2011141 - RNA, 14 nt, Human
aguuuaaggaauau

SEQ ID NO: 2011142 - RNA, 22 nt, Human
aguuguuuuuguauauugguuu

SEQ ID NO: 2011143 - RNA, 19 nt, Human
aguuguuuuuguauauugg

SEQ ID NO: 2011144 - RNA, 20 nt, Human
aguuguuuuuguauauuggu

SEQ ID NO: 2011145 - RNA, 15 nt, Human
aguuguuuuuguaua

SEQ ID NO: 2011146 - RNA, 16 nt, Human
aguuguuuuuguauau

SEQ ID NO: 2011147 - RNA, 17 nt, Human
aguuguuuuuguauauu

SEQ ID NO: 2011148 - RNA, 18 nt, Human
aguuguuuuuguauauug

SEQ ID NO: 2011149 - RNA, 23 nt, Human
aguuguuugauucagacagcugc

SEQ ID NO: 2011150 - RNA, 21 nt, Human
aguuguuugauucagacagcu

SEQ ID NO: 2011151 - RNA, 21 nt, Human
aguuguaacauucuauuucaa

SEQ ID NO: 2011152 - RNA, 18 nt, Human
aguuggucccccuuccau

SEQ ID NO: 2011153 - RNA, 21 nt, Human
aguuggguggaugccuggugg

SEQ ID NO: 2011154 - RNA, 13 nt, Human
aguuggcuucuaa

SEQ ID NO: 2011155 - RNA, 17 nt, Human
aguuggguggaugccug

SEQ ID NO: 2011156 - RNA, 16 nt, Human
aguuggcuaggacccc

SEQ ID NO: 2011157 - RNA, 12 nt, Human
auaaauauuaua

SEQ ID NO: 2011158 - RNA, 22 nt, Human
auaaauauuauauuauauauau

SEQ ID NO: 2011159 - RNA, 19 nt, Human
auaaauauucacacuugaa

SEQ ID NO: 2011160 - RNA, 18 nt, Human
auaaaucuuccaaaguuu

SEQ ID NO: 2011161 - RNA, 13 nt, Human
auaaaguuugauc

SEQ ID NO: 2011162 - RNA, 15 nt, Human
auaaaguuugaucuu

SEQ ID NO: 2011163 - RNA, 12 nt, Human
auaaaguuugau

SEQ ID NO: 2011164 - RNA, 22 nt, Human
auaaaguuugaucuuccucugc

SEQ ID NO: 2011165 - RNA, 18 nt, Human
auaaacaccacuggauua

SEQ ID NO: 2011166 - RNA, 15 nt, Human
auaaacaagaaugaa

SEQ ID NO: 2011167 - RNA, 20 nt, Human
auaaacaccacuggauuaau

SEQ ID NO: 2011168 - RNA, 14 nt, Human
uuacaggaaguacu

SEQ ID NO: 2011169 - RNA, 14 nt, Human
uuacagcugccugc

SEQ ID NO: 2011170 - RNA, 13 nt, Human
uuacagcugccug

SEQ ID NO: 2011171 - RNA, 20 nt, Human
uuacagccugggcaauaaag

SEQ ID NO: 2011172 - RNA, 17 nt, Human
auaacuacauauugaau

SEQ ID NO: 2011173 - RNA, 15 nt, Human
auaaauguauugauu

SEQ ID NO: 2011174 - RNA, 16 nt, Human
auaacuaaaagguaug

SEQ ID NO: 2011175 - RNA, 15 nt, Human
auaaaugauucaaaa

SEQ ID NO: 2011176 - RNA, 14 nt, Human
uuacuguaaaaugc

SEQ ID NO: 2011177 - RNA, 15 nt, Human
uuacuguaaaaugca

SEQ ID NO: 2011178 - RNA, 16 nt, Human
uuacuguaaaaugcaa

SEQ ID NO: 2011179 - RNA, 20 nt, Human
uuacuguaaaaugcaaaaaa

SEQ ID NO: 2011180 - RNA, 14 nt, Human
uuagaaauauaauu

SEQ ID NO: 2011181 - RNA, 12 nt, Human
uuagaaauauaa

SEQ ID NO: 2011182 - RNA, 11 nt, Human
uuagaaauaua

SEQ ID NO: 2011183 - RNA, 16 nt, Human
uuagaagaaguguguc

SEQ ID NO: 2011184 - RNA, 13 nt, Human
uuagaauugaagg

SEQ ID NO: 2011185 - RNA, 14 nt, Human
uuagaauugaaggu

SEQ ID NO: 2011186 - RNA, 16 nt, Human
uuagaauugaagguuu

SEQ ID NO: 2011187 - RNA, 17 nt, Human
uuagaauugaagguuuu

SEQ ID NO: 2011188 - RNA, 14 nt, Human
uuagaagaagugug

SEQ ID NO: 2011189 - RNA, 15 nt, Human
uuagaagaagugugu

SEQ ID NO: 2011190 - RNA, 15 nt, Human
uuagaacagguuuuu

SEQ ID NO: 2011191 - RNA, 13 nt, Human
uuagaaccuuucu

SEQ ID NO: 2011192 - RNA, 11 nt, Human
uuagacagagu

SEQ ID NO: 2011193 - RNA, 18 nt, Human
uuagaauugaagguuuuu

SEQ ID NO: 2011194 - RNA, 19 nt, Human
uuagaauuuugugaaacag

SEQ ID NO: 2011195 - RNA, 21 nt, Human
auaacuuauauuguaagaaau

SEQ ID NO: 2011196 - RNA, 22 nt, Human
auaacuuauauuguaagaaaua

SEQ ID NO: 2011197 - RNA, 23 nt, Human
auaacuuauauuguaagaaauac

SEQ ID NO: 2011198 - RNA, 15 nt, Human
uuacucacagccagc

SEQ ID NO: 2011199 - RNA, 20 nt, Human
uuacugaccucaccuaggaa

SEQ ID NO: 2011200 - RNA, 18 nt, Human
uuacucagaauucucuag

SEQ ID NO: 2011201 - RNA, 23 nt, Human
uuacucagaauucucuaguuuga

SEQ ID NO: 2011202 - RNA, 18 nt, Human
uuacuauucgguguguuu

SEQ ID NO: 2011203 - RNA, 15 nt, Human
uuacucaaugugugc

SEQ ID NO: 2011204 - RNA, 19 nt, Human
uuacauauguauacaugug

SEQ ID NO: 2011205 - RNA, 20 nt, Human
uuacauaagauaaaugugcu

SEQ ID NO: 2011206 - RNA, 14 nt, Human
auaaaauggcaaca

SEQ ID NO: 2011207 - RNA, 16 nt, Human
auaaaauggcaacaaa

SEQ ID NO: 2011208 - RNA, 19 nt, Human
auaaaauguccaguaagau

SEQ ID NO: 2011209 - RNA, 21 nt, Human
auaaaauguccaguaagauca

SEQ ID NO: 2011210 - RNA, 23 nt, Human
auaaaauguccaguaagaucacu

SEQ ID NO: 2011211 - RNA, 22 nt, Human
auaaaauggcaacaaacugcac

SEQ ID NO: 2011212 - RNA, 12 nt, Human
auaaaaucauaa

SEQ ID NO: 2011213 - RNA, 15 nt, Human
auaaaaucauaagua

SEQ ID NO: 2011214 - RNA, 16 nt, Human
auaaaaucauaaguau

SEQ ID NO: 2011215 - RNA, 19 nt, Human
auaaaaucauaaguauuug

SEQ ID NO: 2011216 - RNA, 20 nt, Human
auaaaaucauaaguauuugg

SEQ ID NO: 2011217 - RNA, 22 nt, Human
auaaaaucauaaguauuuggaa

SEQ ID NO: 2011218 - RNA, 22 nt, Human
auaaaagggacugagaaauuua

SEQ ID NO: 2011219 - RNA, 17 nt, Human
uuaaguacuauguauca

SEQ ID NO: 2011220 - RNA, 17 nt, Human
uuaagugaaaauauagc

SEQ ID NO: 2011221 - RNA, 12 nt, Human
uuaagugaaauu

SEQ ID NO: 2011222 - RNA, 13 nt, Human
uuaagugaaauuu

SEQ ID NO: 2011223 - RNA, 14 nt, Human
uuaagugaaauuua

SEQ ID NO: 2011224 - RNA, 22 nt, Human
uuaagugcugcauuuaaaagau

SEQ ID NO: 2011225 - RNA, 15 nt, Human
uuaagugaaauuuau

SEQ ID NO: 2011226 - RNA, 16 nt, Human
uuaagugaggaaauca

SEQ ID NO: 2011227 - RNA, 17 nt, Human
uuaagugaggaaaucaa

SEQ ID NO: 2011228 - RNA, 19 nt, Human
uuaagugaggaaaucaaag

SEQ ID NO: 2011229 - RNA, 20 nt, Human
uuaagugaggaaaucaaagu

SEQ ID NO: 2011230 - RNA, 23 nt, Human
uuaagugaggaaaucaaagugcu

SEQ ID NO: 2011231 - RNA, 18 nt, Human
uuaaguaaggaauuuuau

SEQ ID NO: 2011232 - RNA, 15 nt, Human
uuaagaggcaggguc

SEQ ID NO: 2011233 - RNA, 16 nt, Human
uuaagaggcagggucu

SEQ ID NO: 2011234 - RNA, 13 nt, Human
uuaagaggcaggg

SEQ ID NO: 2011235 - RNA, 16 nt, Human
auaaaauuaaagcuga

SEQ ID NO: 2011236 - RNA, 12 nt, Human
uuacaaaaugua

SEQ ID NO: 2011237 - RNA, 13 nt, Human
uuacaaaauguaa

SEQ ID NO: 2011238 - RNA, 15 nt, Human
uuacaaaauguaacu

SEQ ID NO: 2011239 - RNA, 16 nt, Human
uuacaaaauguaacug

SEQ ID NO: 2011240 - RNA, 23 nt, Human
uuaauuuaaguuuugacaagcug

SEQ ID NO: 2011241 - RNA, 19 nt, Human
uuaauuuuuuugagacaga

SEQ ID NO: 2011242 - RNA, 23 nt, Human
auaaacaagaccacguuucuaaa

SEQ ID NO: 2011243 - RNA, 14 nt, Human
auaaacaagaauga

SEQ ID NO: 2011244 - RNA, 15 nt, Human
auaaacaagaccacg

SEQ ID NO: 2011245 - RNA, 22 nt, Human
auaaacaagaccacguuucuaa

SEQ ID NO: 2011246 - RNA, 20 nt, Human
auaaaauuuuuaaucuuuaa

SEQ ID NO: 2011247 - RNA, 13 nt, Human
uuaauuuaaguuu

SEQ ID NO: 2011248 - RNA, 15 nt, Human
uuaauuuaaguuuug

SEQ ID NO: 2011249 - RNA, 16 nt, Human
uuaauuuaaguuuuga

SEQ ID NO: 2011250 - RNA, 15 nt, Human
uuaauucuuagcuca

SEQ ID NO: 2011251 - RNA, 12 nt, Human
uuaauucucuuu

SEQ ID NO: 2011252 - RNA, 20 nt, Human
uuaaugaaagacuguacaaa

SEQ ID NO: 2011253 - RNA, 23 nt, Human
uuaaugaaagacuguacaaagua

SEQ ID NO: 2011254 - RNA, 20 nt, Human
uuaauaaagcgaaaaacuca

SEQ ID NO: 2011255 - RNA, 19 nt, Human
uuaauaaauccuacaguau

SEQ ID NO: 2011256 - RNA, 13 nt, Human
uuaauaaacacuc

SEQ ID NO: 2011257 - RNA, 20 nt, Human
uuaaguuaguuccacugaga

SEQ ID NO: 2011258 - RNA, 17 nt, Human
uuaauaaacacucuuga

SEQ ID NO: 2011259 - RNA, 21 nt, Human
uggguggcaccagcagccugg

SEQ ID NO: 2011260 - RNA, 20 nt, Human
uggguggcaccagcagccug

SEQ ID NO: 2011261 - RNA, 17 nt, Human
uggguggcaccagcagc

SEQ ID NO: 2011262 - RNA, 12 nt, Human
ugguaagaaaaa

SEQ ID NO: 2011263 - RNA, 13 nt, Human
ugguaagaaaaag

SEQ ID NO: 2011264 - RNA, 17 nt, Human
ugguaagaaaaagcaaa

SEQ ID NO: 2011265 - RNA, 22 nt, Human
ugguaagaaaaagcaaaaggca

SEQ ID NO: 2011266 - RNA, 20 nt, Human
ugguagagugugccugaagu

SEQ ID NO: 2011267 - RNA, 13 nt, Human
ugguaccuugcac

SEQ ID NO: 2011268 - RNA, 14 nt, Human
ugguaccuugcaca

SEQ ID NO: 2011269 - RNA, 23 nt, Human
ugguaagaaaaagcaaaaggcau

SEQ ID NO: 2011270 - RNA, 14 nt, Human
ugggugcaggagcg

SEQ ID NO: 2011271 - RNA, 20 nt, Human
ugggugcaggagcgcucccu

SEQ ID NO: 2011272 - RNA, 18 nt, Human
ugggucgcccuggacugu

SEQ ID NO: 2011273 - RNA, 16 nt, Human
ugggucgcccuggacu

SEQ ID NO: 2011274 - RNA, 19 nt, Human
uggguccccagcccuuccu

SEQ ID NO: 2011275 - RNA, 15 nt, Human
uggguccccagcccu

SEQ ID NO: 2011276 - RNA, 16 nt, Human
uggguccccagcccuu

SEQ ID NO: 2011277 - RNA, 16 nt, Human
aggguggugaccucug

SEQ ID NO: 2011278 - RNA, 15 nt, Human
aggggagccaggagg

SEQ ID NO: 2011279 - RNA, 16 nt, Human
aggggagccaggaggg

SEQ ID NO: 2011280 - RNA, 12 nt, Human
aggggagccagg

SEQ ID NO: 2011281 - RNA, 13 nt, Human
aggggagccagga

SEQ ID NO: 2011282 - RNA, 20 nt, Human
aggggaaucuggagguagcc

SEQ ID NO: 2011283 - RNA, 18 nt, Human
aggggagcaugggaagug

SEQ ID NO: 2011284 - RNA, 19 nt, Human
aggggaauguuugccucug

SEQ ID NO: 2011285 - RNA, 20 nt, Human
aggggaauguuugccucugc

SEQ ID NO: 2011286 - RNA, 21 nt, Human
aggggaauguuugccucugcc

SEQ ID NO: 2011287 - RNA, 15 nt, Human
aggguaaggcugugg

SEQ ID NO: 2011288 - RNA, 21 nt, Human
agggguuuucuugauaauuuu

SEQ ID NO: 2011289 - RNA, 14 nt, Human
agggucucacucug

SEQ ID NO: 2011290 - RNA, 15 nt, Human
agggucucacucugu

SEQ ID NO: 2011291 - RNA, 16 nt, Human
agggucucacucuguc

SEQ ID NO: 2011292 - RNA, 18 nt, Human
aggggugggacacccugu

SEQ ID NO: 2011293 - RNA, 20 nt, Human
aggggguggccucccaacuc

SEQ ID NO: 2011294 - RNA, 16 nt, Human
agggguaccacugaau

SEQ ID NO: 2011295 - RNA, 19 nt, Human
agggguaccacugaaucug

SEQ ID NO: 2011296 - RNA, 14 nt, Human
uggggagggauuug

SEQ ID NO: 2011297 - RNA, 12 nt, Human
uggggaggacaa

SEQ ID NO: 2011298 - RNA, 17 nt, Human
uggggaccucaggccug

SEQ ID NO: 2011299 - RNA, 16 nt, Human
uggggaccucaggccu

SEQ ID NO: 2011300 - RNA, 15 nt, Human
uggggaccucaggcc

SEQ ID NO: 2011301 - RNA, 14 nt, Human
uggggaccucaggc

SEQ ID NO: 2011302 - RNA, 17 nt, Human
agggcucugacaaagcu

SEQ ID NO: 2011303 - RNA, 15 nt, Human
agggcuccagacaca

SEQ ID NO: 2011304 - RNA, 12 nt, Human
agggcuccagac

SEQ ID NO: 2011305 - RNA, 15 nt, Human
uggggcucagagugg

SEQ ID NO: 2011306 - RNA, 23 nt, Human
uggggcugcaccggcuggccugg

SEQ ID NO: 2011307 - RNA, 22 nt, Human
uggggcugcaccggcuggccug

SEQ ID NO: 2011308 - RNA, 15 nt, Human
uggggcucccgccuc

SEQ ID NO: 2011309 - RNA, 16 nt, Human
uggggcucccgccucc

SEQ ID NO: 2011310 - RNA, 23 nt, Human
uggggcucccgccuccaaccccu

SEQ ID NO: 2011311 - RNA, 22 nt, Human
uggggagggauuuggggcucag

SEQ ID NO: 2011312 - RNA, 21 nt, Human
uggggccaguuggucccccuu

SEQ ID NO: 2011313 - RNA, 20 nt, Human
uggggccauugcuuaccuug

SEQ ID NO: 2011314 - RNA, 12 nt, Human
uggggcccugcc

SEQ ID NO: 2011315 - RNA, 13 nt, Human
aggggaauguuug

SEQ ID NO: 2011316 - RNA, 21 nt, Human
aggggaauaaacuguugaguc

SEQ ID NO: 2011317 - RNA, 14 nt, Human
aggggaaccugcca

SEQ ID NO: 2011318 - RNA, 15 nt, Human
aggggaaccugccau

SEQ ID NO: 2011319 - RNA, 16 nt, Human
aggggaagaauaauuu

SEQ ID NO: 2011320 - RNA, 22 nt, Human
aggggaaaaucagccugcucca

SEQ ID NO: 2011321 - RNA, 18 nt, Human
aggggaaaaucagccugc

SEQ ID NO: 2011322 - RNA, 14 nt, Human
aggggaacagacug

SEQ ID NO: 2011323 - RNA, 13 nt, Human
aggggaaccugcc

SEQ ID NO: 2011324 - RNA, 19 nt, Human
uggggucuccucaggacca

SEQ ID NO: 2011325 - RNA, 22 nt, Human
uggggucuccucaggaccaggg

SEQ ID NO: 2011326 - RNA, 17 nt, Human
uggggucucucacagac

SEQ ID NO: 2011327 - RNA, 21 nt, Human
uggggucucucacagacagga

SEQ ID NO: 2011328 - RNA, 13 nt, Human
aggggaaaagagg

SEQ ID NO: 2011329 - RNA, 23 nt, Human
agggcuuuaaaauucucuuccaa

SEQ ID NO: 2011330 - RNA, 18 nt, Human
agggcuuuccugugccag

SEQ ID NO: 2011331 - RNA, 13 nt, Human
agggcuuuucaaa

SEQ ID NO: 2011332 - RNA, 14 nt, Human
agggcuuuucaaaa

SEQ ID NO: 2011333 - RNA, 19 nt, Human
agggcuuuaaaauucucuu

SEQ ID NO: 2011334 - RNA, 20 nt, Human
agggcuuuaaaauucucuuc

SEQ ID NO: 2011335 - RNA, 17 nt, Human
ugggguacccacugcuc

SEQ ID NO: 2011336 - RNA, 18 nt, Human
ugggguacccacugcucu

SEQ ID NO: 2011337 - RNA, 14 nt, Human
uggggucacucugg

SEQ ID NO: 2011338 - RNA, 13 nt, Human
uggggucacucug

SEQ ID NO: 2011339 - RNA, 19 nt, Human
ugggguacccacugcucug

SEQ ID NO: 2011340 - RNA, 22 nt, Human
uggggucacucuggcagcucag

SEQ ID NO: 2011341 - RNA, 19 nt, Human
uggggucaggccgggcaga

SEQ ID NO: 2011342 - RNA, 16 nt, Human
uggggucacucuggca

SEQ ID NO: 2011343 - RNA, 14 nt, Human
uggggcugcuguga

SEQ ID NO: 2011344 - RNA, 22 nt, Human
uggggucagguugacaggaggu

SEQ ID NO: 2011345 - RNA, 20 nt, Human
uggggucaggccgggcagag

SEQ ID NO: 2011346 - RNA, 22 nt, Human
uggggucaggccgggcagagca

SEQ ID NO: 2011347 - RNA, 18 nt, Human
ugggcacugcucucaccu

SEQ ID NO: 2011348 - RNA, 20 nt, Human
ugggaggccaaggugggagg

SEQ ID NO: 2011349 - RNA, 19 nt, Human
ugggaggccaaggugggag

SEQ ID NO: 2011350 - RNA, 22 nt, Human
ugggaggaucucuugagccugg

SEQ ID NO: 2011351 - RNA, 21 nt, Human
ugggaggaucucuugagccug

SEQ ID NO: 2011352 - RNA, 20 nt, Human
ugggaggaucucuugagccu

SEQ ID NO: 2011353 - RNA, 13 nt, Human
ugggcagagcaga

SEQ ID NO: 2011354 - RNA, 18 nt, Human
ugggccaggagccuccug

SEQ ID NO: 2011355 - RNA, 12 nt, Human
ugggcagagcag

SEQ ID NO: 2011356 - RNA, 11 nt, Human
ugggcagagca

SEQ ID NO: 2011357 - RNA, 12 nt, Human
ugggcagaagga

SEQ ID NO: 2011358 - RNA, 21 nt, Human
ugggcccccaaauggaaaugg

SEQ ID NO: 2011359 - RNA, 16 nt, Human
ugggcccccaaaugga

SEQ ID NO: 2011360 - RNA, 22 nt, Human
ugggccccaguuguauuuauuu

SEQ ID NO: 2011361 - RNA, 18 nt, Human
ugggccccaguuguauuu

SEQ ID NO: 2011362 - RNA, 14 nt, Human
agggaggcccagcg

SEQ ID NO: 2011363 - RNA, 13 nt, Human
agggagggcucca

SEQ ID NO: 2011364 - RNA, 15 nt, Human
agggagggagggcuc

SEQ ID NO: 2011365 - RNA, 19 nt, Human
ugggccccugccucucugc

SEQ ID NO: 2011366 - RNA, 15 nt, Human
ugggccccugccucu

SEQ ID NO: 2011367 - RNA, 15 nt, Human
ugggccccugccaga

SEQ ID NO: 2011368 - RNA, 20 nt, Human
ugggccccugccucucugca

SEQ ID NO: 2011369 - RNA, 17 nt, Human
agggccagaaguagcuu

SEQ ID NO: 2011370 - RNA, 21 nt, Human
agggccauugaacucugagag

SEQ ID NO: 2011371 - RNA, 19 nt, Human
agggcucagcggggacagc

SEQ ID NO: 2011372 - RNA, 20 nt, Human
agggcucagcggggacagcu

SEQ ID NO: 2011373 - RNA, 22 nt, Human
agggcucagcggggacagcucc

SEQ ID NO: 2011374 - RNA, 23 nt, Human
agggcucagcggggacagcuccu

SEQ ID NO: 2011375 - RNA, 16 nt, Human
agggcccgggaagcaa

SEQ ID NO: 2011376 - RNA, 15 nt, Human
agggagggcuccaga

SEQ ID NO: 2011377 - RNA, 14 nt, Human
agggagggcuccag

SEQ ID NO: 2011378 - RNA, 16 nt, Human
agggagggcuccagac

SEQ ID NO: 2011379 - RNA, 19 nt, Human
agggcacagggccuggccc

SEQ ID NO: 2011380 - RNA, 20 nt, Human
agggcacagggccuggccca

SEQ ID NO: 2011381 - RNA, 16 nt, Human
agggcacugguggccc

SEQ ID NO: 2011382 - RNA, 14 nt, Human
agggcacugguggc

SEQ ID NO: 2011383 - RNA, 18 nt, Human
agggcaggaccagcccac

SEQ ID NO: 2011384 - RNA, 19 nt, Human
agggcaggaccagcccacg

SEQ ID NO: 2011385 - RNA, 13 nt, Human
agggcaggaccag

SEQ ID NO: 2011386 - RNA, 14 nt, Human
agggcaggaccagc

SEQ ID NO: 2011387 - RNA, 16 nt, Human
agggcaggaccagccc

SEQ ID NO: 2011388 - RNA, 17 nt, Human
agggcaggaccagccca

SEQ ID NO: 2011389 - RNA, 12 nt, Human
agggcaggacca

SEQ ID NO: 2011390 - RNA, 12 nt, Human
agggcaugaaau

SEQ ID NO: 2011391 - RNA, 13 nt, Human
agggcaugaaaug

SEQ ID NO: 2011392 - RNA, 14 nt, Human
agggcaugaaauga

SEQ ID NO: 2011393 - RNA, 15 nt, Human
agggaauagaaaugu

SEQ ID NO: 2011394 - RNA, 20 nt, Human
agggaaguugcuggaaagag

SEQ ID NO: 2011395 - RNA, 23 nt, Human
agggaaguugcuggaaagagcau

SEQ ID NO: 2011396 - RNA, 13 nt, Human
agggacaaaacuu

SEQ ID NO: 2011397 - RNA, 21 nt, Human
agggaauuucuucaacucccu

SEQ ID NO: 2011398 - RNA, 22 nt, Human
agggaaggauacaaaagcaugu

SEQ ID NO: 2011399 - RNA, 12 nt, Human
agggaaggccug

SEQ ID NO: 2011400 - RNA, 13 nt, Human
agggaaggggaca

SEQ ID NO: 2011401 - RNA, 22 nt, Human
agggaaggggacaaggacuagg

SEQ ID NO: 2011402 - RNA, 19 nt, Human
agggaaggggggucagaag

SEQ ID NO: 2011403 - RNA, 16 nt, Human
agggaaggccugacuu

SEQ ID NO: 2011404 - RNA, 13 nt, Human
agggaaggccuga

SEQ ID NO: 2011405 - RNA, 14 nt, Human
agggaaggccugac

SEQ ID NO: 2011406 - RNA, 21 nt, Human
aggcccggcuccaggcuccuu

SEQ ID NO: 2011407 - RNA, 18 nt, Human
aggcccggcuccaggcuc

SEQ ID NO: 2011408 - RNA, 20 nt, Human
aggcccggcuccaggcuccu

SEQ ID NO: 2011409 - RNA, 22 nt, Human
aggcccuaucuguuuacagugu

SEQ ID NO: 2011410 - RNA, 19 nt, Human
aggcccuccucccucccag

SEQ ID NO: 2011411 - RNA, 22 nt, Human
aggcccuccucccucccagcuc

SEQ ID NO: 2011412 - RNA, 13 nt, Human
agggaaauuucag

SEQ ID NO: 2011413 - RNA, 16 nt, Human
agggaacuaggaaggc

SEQ ID NO: 2011414 - RNA, 19 nt, Human
agggaagaauaaagagcug

SEQ ID NO: 2011415 - RNA, 21 nt, Human
agggaacaaguugagcuauga

SEQ ID NO: 2011416 - RNA, 23 nt, Human
aggcccuccucccucccagcucc

SEQ ID NO: 2011417 - RNA, 20 nt, Human
agggaacaaguugagcuaug

SEQ ID NO: 2011418 - RNA, 17 nt, Human
agggaagauaaguugga

SEQ ID NO: 2011419 - RNA, 18 nt, Human
agggaagauaaguuggaa

SEQ ID NO: 2011420 - RNA, 19 nt, Human
agggaagauaaguuggaaa

SEQ ID NO: 2011421 - RNA, 20 nt, Human
agggaagauaaguuggaaac

SEQ ID NO: 2011422 - RNA, 21 nt, Human
agggaagauaaguuggaaaca

SEQ ID NO: 2011423 - RNA, 16 nt, Human
agggaagcuggccuga

SEQ ID NO: 2011424 - RNA, 17 nt, Human
agggaagcuggccugag

SEQ ID NO: 2011425 - RNA, 23 nt, Human
agggaagcuggccugagagggga

SEQ ID NO: 2011426 - RNA, 23 nt, Human
agggaggacgcucucuggccuuc

SEQ ID NO: 2011427 - RNA, 21 nt, Human
agggaggacgcucucuggccu

SEQ ID NO: 2011428 - RNA, 22 nt, Human
agggaggacgcucucuggccuu

SEQ ID NO: 2011429 - RNA, 14 nt, Human
ugggacuacaggca

SEQ ID NO: 2011430 - RNA, 15 nt, Human
ugggacuacaggcac

SEQ ID NO: 2011431 - RNA, 16 nt, Human
ugggacuacaggcacc

SEQ ID NO: 2011432 - RNA, 15 nt, Human
agggagcuggcucca

SEQ ID NO: 2011433 - RNA, 16 nt, Human
agggagcuggcuccag

SEQ ID NO: 2011434 - RNA, 19 nt, Human
agggagcuggcuccagccu

SEQ ID NO: 2011435 - RNA, 20 nt, Human
agggagcuggcuccagccug

SEQ ID NO: 2011436 - RNA, 21 nt, Human
agggagcuggcuccagccugg

SEQ ID NO: 2011437 - RNA, 22 nt, Human
agggagcuggcuccagccugga

SEQ ID NO: 2011438 - RNA, 19 nt, Human
agggaggaaaguuucuuug

SEQ ID NO: 2011439 - RNA, 21 nt, Human
agggagcacaacccccagcuc

SEQ ID NO: 2011440 - RNA, 22 nt, Human
agggagcacaacccccagcucc

SEQ ID NO: 2011441 - RNA, 23 nt, Human
agggagcacaacccccagcuccc

SEQ ID NO: 2011442 - RNA, 12 nt, Human
agggagaggccg

SEQ ID NO: 2011443 - RNA, 19 nt, Human
ugggagaaugucaguaugu

SEQ ID NO: 2011444 - RNA, 20 nt, Human
ugggagaaugucaguaugug

SEQ ID NO: 2011445 - RNA, 22 nt, Human
ugggagaaugucaguaugugga

SEQ ID NO: 2011446 - RNA, 16 nt, Human
ugggagaagggcagag

SEQ ID NO: 2011447 - RNA, 17 nt, Human
ugggagaagggcagagu

SEQ ID NO: 2011448 - RNA, 22 nt, Human
ugggagaaccaaaaagaggcua

SEQ ID NO: 2011449 - RNA, 20 nt, Human
ugggacucaaugcacugaca

SEQ ID NO: 2011450 - RNA, 16 nt, Human
ugggagagccuuccag

SEQ ID NO: 2011451 - RNA, 18 nt, Human
ugggaggaucucuugagc

SEQ ID NO: 2011452 - RNA, 18 nt, Human
ugggagacugcugaguca

SEQ ID NO: 2011453 - RNA, 21 nt, Human
ugggagagaagagaaugcaca

SEQ ID NO: 2011454 - RNA, 19 nt, Human
ugggagagaagagaaugca

SEQ ID NO: 2011455 - RNA, 12 nt, Human
aguaccauuuaa

SEQ ID NO: 2011456 - RNA, 23 nt, Human
aguaccauuuaauggggaggaca

SEQ ID NO: 2011457 - RNA, 12 nt, Human
aguacccugguu

SEQ ID NO: 2011458 - RNA, 18 nt, Human
aguacccugguugugugu

SEQ ID NO: 2011459 - RNA, 19 nt, Human
aguacccugguuguguguc

SEQ ID NO: 2011460 - RNA, 20 nt, Human
aguagaagucuuagauguau

SEQ ID NO: 2011461 - RNA, 19 nt, Human
aguagaagucuuagaugua

SEQ ID NO: 2011462 - RNA, 21 nt, Human
aguagaagucuuagauguaua

SEQ ID NO: 2011463 - RNA, 13 nt, Human
aguagaauguagu

SEQ ID NO: 2011464 - RNA, 13 nt, Human
aguacauucucag

SEQ ID NO: 2011465 - RNA, 16 nt, Human
aguacauucucaguuu

SEQ ID NO: 2011466 - RNA, 17 nt, Human
aguacauucucaguuuu

SEQ ID NO: 2011467 - RNA, 20 nt, Human
aguacauucucaguuuuucu

SEQ ID NO: 2011468 - RNA, 16 nt, Human
aguacagguacuuugu

SEQ ID NO: 2011469 - RNA, 17 nt, Human
aguacagguacuuuguc

SEQ ID NO: 2011470 - RNA, 20 nt, Human
aguacagguacuuugucuaa

SEQ ID NO: 2011471 - RNA, 14 nt, Human
aguaauauaauaca

SEQ ID NO: 2011472 - RNA, 20 nt, Human
aguaauauaauacacaaaau

SEQ ID NO: 2011473 - RNA, 16 nt, Human
aguaauauauuuaaag

SEQ ID NO: 2011474 - RNA, 17 nt, Human
aguaauauauuuaaagg

SEQ ID NO: 2011475 - RNA, 21 nt, Human
aguaauauauuuaaagggaaa

SEQ ID NO: 2011476 - RNA, 19 nt, Human
aguagcgguaccaaugcag

SEQ ID NO: 2011477 - RNA, 19 nt, Human
aguagacuugcuuugguca

SEQ ID NO: 2011478 - RNA, 15 nt, Human
aguagacuacuguuc

SEQ ID NO: 2011479 - RNA, 14 nt, Human
aguagacuccaaca

SEQ ID NO: 2011480 - RNA, 11 nt, Human
aguagagacag

SEQ ID NO: 2011481 - RNA, 20 nt, Human
uguaggcauaaagucagggg

SEQ ID NO: 2011482 - RNA, 17 nt, Human
uguaggcauaaagucag

SEQ ID NO: 2011483 - RNA, 20 nt, Human
uguacuuugauucacauguu

SEQ ID NO: 2011484 - RNA, 19 nt, Human
uguacuuucuguuaaaaug

SEQ ID NO: 2011485 - RNA, 17 nt, Human
uguacuuugauucacau

SEQ ID NO: 2011486 - RNA, 18 nt, Human
uguacuuugauucacaug

SEQ ID NO: 2011487 - RNA, 19 nt, Human
uguacuuugauucacaugu

SEQ ID NO: 2011488 - RNA, 12 nt, Human
uguacuuucugu

SEQ ID NO: 2011489 - RNA, 13 nt, Human
uguacuuucuguu

SEQ ID NO: 2011490 - RNA, 15 nt, Human
uguacuuucuguuaa

SEQ ID NO: 2011491 - RNA, 19 nt, Human
uguacuugcucuugaugcc

SEQ ID NO: 2011492 - RNA, 23 nt, Human
uguacuugcucuugaugccuggc

SEQ ID NO: 2011493 - RNA, 22 nt, Human
uguacuugcucuugaugccugg

SEQ ID NO: 2011494 - RNA, 16 nt, Human
uguagaggagaaacug

SEQ ID NO: 2011495 - RNA, 23 nt, Human
agguuuguuuagaagaagugugu

SEQ ID NO: 2011496 - RNA, 14 nt, Human
uguagagcuucugg

SEQ ID NO: 2011497 - RNA, 18 nt, Human
agguuuuaaaagccuugg

SEQ ID NO: 2011498 - RNA, 16 nt, Human
uguagagccagggucu

SEQ ID NO: 2011499 - RNA, 18 nt, Human
uguagagccagggucuca

SEQ ID NO: 2011500 - RNA, 17 nt, Human
aguaaaauacucuuuuu

SEQ ID NO: 2011501 - RNA, 14 nt, Human
aguaauaugcacac

SEQ ID NO: 2011502 - RNA, 15 nt, Human
aguaauaugcacaca

SEQ ID NO: 2011503 - RNA, 23 nt, Human
agguuuuugauagcauuguaagc

SEQ ID NO: 2011504 - RNA, 13 nt, Human
agguuuuuguaaa

SEQ ID NO: 2011505 - RNA, 15 nt, Human
agguuuuuguaaaga

SEQ ID NO: 2011506 - RNA, 22 nt, Human
agguuuuuguaaagauuucugu

SEQ ID NO: 2011507 - RNA, 23 nt, Human
aguaaaagaagaaauaguucugu

SEQ ID NO: 2011508 - RNA, 16 nt, Human
agguuuuuguaaagau

SEQ ID NO: 2011509 - RNA, 17 nt, Human
agguuuuuguaaagauu

SEQ ID NO: 2011510 - RNA, 13 nt, Human
aguaaaauccaca

SEQ ID NO: 2011511 - RNA, 23 nt, Human
agucacacaguauuacuucugcu

SEQ ID NO: 2011512 - RNA, 19 nt, Human
agucaccccggccaccugc

SEQ ID NO: 2011513 - RNA, 15 nt, Human
agucacacagugagu

SEQ ID NO: 2011514 - RNA, 23 nt, Human
agucacacagugagucgaggaca

SEQ ID NO: 2011515 - RNA, 15 nt, Human
ugucaauuacaggaa

SEQ ID NO: 2011516 - RNA, 14 nt, Human
ugucaauuacagga

SEQ ID NO: 2011517 - RNA, 17 nt, Human
ugucaaguggcaaagcu

SEQ ID NO: 2011518 - RNA, 18 nt, Human
ugucaaguggcaaagcug

SEQ ID NO: 2011519 - RNA, 17 nt, Human
ugucaagugucaguaag

SEQ ID NO: 2011520 - RNA, 17 nt, Human
ugucaauuacaggaagu

SEQ ID NO: 2011521 - RNA, 19 nt, Human
ugucaauuacaggaaguac

SEQ ID NO: 2011522 - RNA, 20 nt, Human
aguaggucguuuuaaaaaca

SEQ ID NO: 2011523 - RNA, 15 nt, Human
aguaugguggcuggg

SEQ ID NO: 2011524 - RNA, 16 nt, Human
aguaugguggcugggu

SEQ ID NO: 2011525 - RNA, 20 nt, Human
aguaguaaaagaagaaauag

SEQ ID NO: 2011526 - RNA, 15 nt, Human
aguauuacuucugcu

SEQ ID NO: 2011527 - RNA, 17 nt, Human
aguaugguggcuggguu

SEQ ID NO: 2011528 - RNA, 18 nt, Human
aguauuacuucugcuaca

SEQ ID NO: 2011529 - RNA, 20 nt, Human
ugucaaacauuaguacuuua

SEQ ID NO: 2011530 - RNA, 12 nt, Human
ugucaaacauua

SEQ ID NO: 2011531 - RNA, 22 nt, Human
ugucaaaaguagaacuuuguau

SEQ ID NO: 2011532 - RNA, 12 nt, Human
ugucaaaaguag

SEQ ID NO: 2011533 - RNA, 17 nt, Human
ugucaaaaguagaacuu

SEQ ID NO: 2011534 - RNA, 20 nt, Human
ugucaaaaguagaacuuugu

SEQ ID NO: 2011535 - RNA, 21 nt, Human
ugucaaaaguagaacuuugua

SEQ ID NO: 2011536 - RNA, 19 nt, Human
uguauucucuccuguaccu

SEQ ID NO: 2011537 - RNA, 20 nt, Human
uguauucucuccuguaccuc

SEQ ID NO: 2011538 - RNA, 16 nt, Human
ugucaaaaaucaauau

SEQ ID NO: 2011539 - RNA, 18 nt, Human
uguauguuuuucaguuca

SEQ ID NO: 2011540 - RNA, 20 nt, Human
uguauguuuuucaguucaaa

SEQ ID NO: 2011541 - RNA, 21 nt, Human
uguauguuuuucaguucaaag

SEQ ID NO: 2011542 - RNA, 22 nt, Human
uguauguuuuucaguucaaagu

SEQ ID NO: 2011543 - RNA, 17 nt, Human
uguauucccauaucaaa

SEQ ID NO: 2011544 - RNA, 22 nt, Human
uguauuacaaauccaaugaaau

SEQ ID NO: 2011545 - RNA, 13 nt, Human
uguauguuuuuca

SEQ ID NO: 2011546 - RNA, 15 nt, Human
uguauguuuuucagu

SEQ ID NO: 2011547 - RNA, 16 nt, Human
uguauguuuuucaguu

SEQ ID NO: 2011548 - RNA, 13 nt, Human
uguauuacaaauc

SEQ ID NO: 2011549 - RNA, 16 nt, Human
uguaguguucagaaaa

SEQ ID NO: 2011550 - RNA, 18 nt, Human
uguaguguucagaaaaaa

SEQ ID NO: 2011551 - RNA, 17 nt, Human
uguaucaaugaguaaca

SEQ ID NO: 2011552 - RNA, 23 nt, Human
uguaucaaauacauuuaaaacau

SEQ ID NO: 2011553 - RNA, 14 nt, Human
uguaucaaauacau

SEQ ID NO: 2011554 - RNA, 21 nt, Human
uguaucaaauacauuuaaaac

SEQ ID NO: 2011555 - RNA, 13 nt, Human
uguauguauaauu

SEQ ID NO: 2011556 - RNA, 15 nt, Human
uguauguauaauuca

SEQ ID NO: 2011557 - RNA, 20 nt, Human
uguaugugggggucugugug

SEQ ID NO: 2011558 - RNA, 11 nt, Human
uguauguguuu

SEQ ID NO: 2011559 - RNA, 12 nt, Human
uguauguguuua

SEQ ID NO: 2011560 - RNA, 14 nt, Human
uguauguguuuaga

SEQ ID NO: 2011561 - RNA, 15 nt, Human
uguauguguuuagaa

SEQ ID NO: 2011562 - RNA, 16 nt, Human
uguauguguuuagaau

SEQ ID NO: 2011563 - RNA, 19 nt, Human
uguauguguuuagaauuga

SEQ ID NO: 2011564 - RNA, 20 nt, Human
uguauguguuuagaauugaa

SEQ ID NO: 2011565 - RNA, 12 nt, Human
uguauguggggg

SEQ ID NO: 2011566 - RNA, 16 nt, Human
aggugagaagcagagg

SEQ ID NO: 2011567 - RNA, 23 nt, Human
aggugagaagcagaggaaggaga

SEQ ID NO: 2011568 - RNA, 21 nt, Human
aggugagaagcagaggaagga

SEQ ID NO: 2011569 - RNA, 22 nt, Human
aggugagcaagcccaggagaau

SEQ ID NO: 2011570 - RNA, 22 nt, Human
aggugacagagugagacucugu

SEQ ID NO: 2011571 - RNA, 23 nt, Human
aggugaaggaggcuccaggcagc

SEQ ID NO: 2011572 - RNA, 13 nt, Human
aggugaccccagg

SEQ ID NO: 2011573 - RNA, 18 nt, Human
aggucuugaacuccuggc

SEQ ID NO: 2011574 - RNA, 17 nt, Human
aggucuugaacuccugg

SEQ ID NO: 2011575 - RNA, 13 nt, Human
aggugacagagug

SEQ ID NO: 2011576 - RNA, 15 nt, Human
aggugacagagugag

SEQ ID NO: 2011577 - RNA, 19 nt, Human
agguccacaacacacagau

SEQ ID NO: 2011578 - RNA, 15 nt, Human
aggucagcucagagc

SEQ ID NO: 2011579 - RNA, 15 nt, Human
uggucacuucuucug

SEQ ID NO: 2011580 - RNA, 16 nt, Human
uggucacuucuucugu

SEQ ID NO: 2011581 - RNA, 16 nt, Human
aggucuugaacuccug

SEQ ID NO: 2011582 - RNA, 15 nt, Human
uggucagauuugaac

SEQ ID NO: 2011583 - RNA, 16 nt, Human
uggucagauuugaacu

SEQ ID NO: 2011584 - RNA, 13 nt, Human
aggucagagccug

SEQ ID NO: 2011585 - RNA, 14 nt, Human
aggucagagccugc

SEQ ID NO: 2011586 - RNA, 15 nt, Human
aggucagagccugca

SEQ ID NO: 2011587 - RNA, 17 nt, Human
aggucagagccugcagu

SEQ ID NO: 2011588 - RNA, 18 nt, Human
aggucagagccugcaguu

SEQ ID NO: 2011589 - RNA, 23 nt, Human
uggugugaccacugcagaagaca

SEQ ID NO: 2011590 - RNA, 20 nt, Human
ugguuaggcauugugggaag

SEQ ID NO: 2011591 - RNA, 18 nt, Human
ugguuaggcauuguggga

SEQ ID NO: 2011592 - RNA, 14 nt, Human
ugguggcagcugcg

SEQ ID NO: 2011593 - RNA, 13 nt, Human
ugguggcagcugc

SEQ ID NO: 2011594 - RNA, 15 nt, Human
ugguggcagcugcgg

SEQ ID NO: 2011595 - RNA, 12 nt, Human
ugguggcagugg

SEQ ID NO: 2011596 - RNA, 21 nt, Human
ugguggagaggcccggccucu

SEQ ID NO: 2011597 - RNA, 18 nt, Human
uggugcuuuccuguuucu

SEQ ID NO: 2011598 - RNA, 16 nt, Human
uggugcgaucuggguu

SEQ ID NO: 2011599 - RNA, 17 nt, Human
uggugcgaucuggguuc

SEQ ID NO: 2011600 - RNA, 13 nt, Human
uggugcugccaca

SEQ ID NO: 2011601 - RNA, 18 nt, Human
uggugcugccacacuuca

SEQ ID NO: 2011602 - RNA, 15 nt, Human
aggugauaaaaucau

SEQ ID NO: 2011603 - RNA, 14 nt, Human
aggugauaaaauca

SEQ ID NO: 2011604 - RNA, 18 nt, Human
aggugccucaagagaagg

SEQ ID NO: 2011605 - RNA, 15 nt, Human
aggugggauccucca

SEQ ID NO: 2011606 - RNA, 17 nt, Human
aggugggauccuccagg

SEQ ID NO: 2011607 - RNA, 16 nt, Human
aggugggauccuccag

SEQ ID NO: 2011608 - RNA, 18 nt, Human
aggugggauccuccaggu

SEQ ID NO: 2011609 - RNA, 23 nt, Human
agguggggcagcuugaggguugg

SEQ ID NO: 2011610 - RNA, 18 nt, Human
aggugcccagaaugaggc

SEQ ID NO: 2011611 - RNA, 22 nt, Human
aggugcccagaaugaggcugcu

SEQ ID NO: 2011612 - RNA, 15 nt, Human
aggugcccgccacca

SEQ ID NO: 2011613 - RNA, 14 nt, Human
aggugauccaccca

SEQ ID NO: 2011614 - RNA, 20 nt, Human
aggugauccacccaccucag

SEQ ID NO: 2011615 - RNA, 20 nt, Human
aggugcauauuuauaaaaau

SEQ ID NO: 2011616 - RNA, 14 nt, Human
agguuuaagcuguu

SEQ ID NO: 2011617 - RNA, 12 nt, Human
agguucucucua

SEQ ID NO: 2011618 - RNA, 20 nt, Human
agguucucucuacugguccu

SEQ ID NO: 2011619 - RNA, 18 nt, Human
agguucugggugcaggag

SEQ ID NO: 2011620 - RNA, 24 nt, Human
agguguggcagaagcuugcagaug

SEQ ID NO: 2011621 - RNA, 15 nt, Human
agguguguugcagug

SEQ ID NO: 2011622 - RNA, 19 nt, Human
agguggggucacucuggca

SEQ ID NO: 2011623 - RNA, 17 nt, Human
aggugugaaccaccaca

SEQ ID NO: 2011624 - RNA, 15 nt, Human
aggugugcucugauc

SEQ ID NO: 2011625 - RNA, 20 nt, Human
aggugugcucugaucaucca

SEQ ID NO: 2011626 - RNA, 15 nt, Human
uguaaauagcucagg

SEQ ID NO: 2011627 - RNA, 16 nt, Human
uguaaauagcucaggu

SEQ ID NO: 2011628 - RNA, 21 nt, Human
uguaaauacuguuuuuaacaa

SEQ ID NO: 2011629 - RNA, 22 nt, Human
uguaaauaauucuuuuuuauua

SEQ ID NO: 2011630 - RNA, 23 nt, Human
uguaaauaauucuuuuuuauuaa

SEQ ID NO: 2011631 - RNA, 17 nt, Human
uguaaauaaaggaacca

SEQ ID NO: 2011632 - RNA, 14 nt, Human
uguaaauaauucuu

SEQ ID NO: 2011633 - RNA, 15 nt, Human
uguaaauaauucuuu

SEQ ID NO: 2011634 - RNA, 19 nt, Human
uguaaauaaagaacuagca

SEQ ID NO: 2011635 - RNA, 16 nt, Human
uguaaaggucacuuuu

SEQ ID NO: 2011636 - RNA, 18 nt, Human
uguaaaggucacuuuuca

SEQ ID NO: 2011637 - RNA, 21 nt, Human
uguaaaggucacuuuucacau

SEQ ID NO: 2011638 - RNA, 18 nt, Human
uguaaagaaaaauauuua

SEQ ID NO: 2011639 - RNA, 16 nt, Human
uguaaaggaauuuaaa

SEQ ID NO: 2011640 - RNA, 12 nt, Human
uguaaacuuuga

SEQ ID NO: 2011641 - RNA, 13 nt, Human
uguaaacuuugaa

SEQ ID NO: 2011642 - RNA, 18 nt, Human
uguaaacuuugaaauaua

SEQ ID NO: 2011643 - RNA, 13 nt, Human
uguaaagaaaaau

SEQ ID NO: 2011644 - RNA, 14 nt, Human
uguaaacuuugaaa

SEQ ID NO: 2011645 - RNA, 15 nt, Human
uguaaacuuugaaau

SEQ ID NO: 2011646 - RNA, 16 nt, Human
uguaaacuuugaaaua

SEQ ID NO: 2011647 - RNA, 17 nt, Human
uguaaacuuugaaauau

SEQ ID NO: 2011648 - RNA, 15 nt, Human
uguaaagaaaaauau

SEQ ID NO: 2011649 - RNA, 16 nt, Human
uguaaagaaaaauauu

SEQ ID NO: 2011650 - RNA, 17 nt, Human
ugguuuucaaaauaaaa

SEQ ID NO: 2011651 - RNA, 15 nt, Human
ugguuuucaaaauaa

SEQ ID NO: 2011652 - RNA, 19 nt, Human
ugguuuucaaccucuagaa

SEQ ID NO: 2011653 - RNA, 17 nt, Human
ugguuugggggagaaga

SEQ ID NO: 2011654 - RNA, 20 nt, Human
ugguuuucaaccucuagaau

SEQ ID NO: 2011655 - RNA, 21 nt, Human
ugguuuucaaccucuagaauu

SEQ ID NO: 2011656 - RNA, 14 nt, Human
ugguuuucaaaaua

SEQ ID NO: 2011657 - RNA, 15 nt, Human
ugguuuguaaauuaa

SEQ ID NO: 2011658 - RNA, 14 nt, Human
ugguuauggagagg

SEQ ID NO: 2011659 - RNA, 18 nt, Human
ugguuauagugcaauaua

SEQ ID NO: 2011660 - RNA, 19 nt, Human
ugguuauagugcaauauau

SEQ ID NO: 2011661 - RNA, 20 nt, Human
ugguuauagugcaauauauu

SEQ ID NO: 2011662 - RNA, 21 nt, Human
ugguuauagugcaauauauuu

SEQ ID NO: 2011663 - RNA, 22 nt, Human
ugguuauagugcaauauauuuu

SEQ ID NO: 2011664 - RNA, 12 nt, Human
ugguuaugaacu

SEQ ID NO: 2011665 - RNA, 13 nt, Human
ugguuagaaaaca

SEQ ID NO: 2011666 - RNA, 14 nt, Human
ugguuauagugcaa

SEQ ID NO: 2011667 - RNA, 14 nt, Human
ugguuuccugcccu

SEQ ID NO: 2011668 - RNA, 15 nt, Human
ugguuuccugcccug

SEQ ID NO: 2011669 - RNA, 20 nt, Human
ugguuuccugcccugggagg

SEQ ID NO: 2011670 - RNA, 12 nt, Human
ugguuuccugcc

SEQ ID NO: 2011671 - RNA, 13 nt, Human
ugguuuccugccc

SEQ ID NO: 2011672 - RNA, 17 nt, Human
ugguuaugaauacuuug

SEQ ID NO: 2011673 - RNA, 20 nt, Human
agcuugcccuggugccucac

SEQ ID NO: 2011674 - RNA, 14 nt, Human
agcuugcacauuug

SEQ ID NO: 2011675 - RNA, 15 nt, Human
agcuugcacauuugg

SEQ ID NO: 2011676 - RNA, 23 nt, Human
agcuugaccgugaggccagagac

SEQ ID NO: 2011677 - RNA, 22 nt, Human
agcuugaggguugggcuggugu

SEQ ID NO: 2011678 - RNA, 22 nt, Human
agcuugaccgugaggccagaga

SEQ ID NO: 2011679 - RNA, 20 nt, Human
agcuugaccgugaggccaga

SEQ ID NO: 2011680 - RNA, 19 nt, Human
agcuuaagggucauauguu

SEQ ID NO: 2011681 - RNA, 20 nt, Human
agcuuaagggucauauguuu

SEQ ID NO: 2011682 - RNA, 22 nt, Human
agcuuugagguggaagagggcu

SEQ ID NO: 2011683 - RNA, 22 nt, Human
agcuuuccccaugucucgacuc

SEQ ID NO: 2011684 - RNA, 20 nt, Human
agcuuuggcuaugagggccu

SEQ ID NO: 2011685 - RNA, 21 nt, Human
agcuuuggcuaugagggccuu

SEQ ID NO: 2011686 - RNA, 12 nt, Human
aggaaaagaaau

SEQ ID NO: 2011687 - RNA, 14 nt, Human
aggaaaagaaaucu

SEQ ID NO: 2011688 - RNA, 15 nt, Human
aggaaaagaaaucua

SEQ ID NO: 2011689 - RNA, 16 nt, Human
aggaaaagaaaucuau

SEQ ID NO: 2011690 - RNA, 17 nt, Human
aggaaaagaaaucuaua

SEQ ID NO: 2011691 - RNA, 20 nt, Human
aggaaaagcggacaucagcu

SEQ ID NO: 2011692 - RNA, 14 nt, Human
aggaaaagcugcug

SEQ ID NO: 2011693 - RNA, 18 nt, Human
ugcuacagaaaagaaacu

SEQ ID NO: 2011694 - RNA, 11 nt, Human
ugcuacacacu

SEQ ID NO: 2011695 - RNA, 20 nt, Human
ugcuaauuuugaaaaacugc

SEQ ID NO: 2011696 - RNA, 19 nt, Human
ugcuaauuuugaaaaacug

SEQ ID NO: 2011697 - RNA, 18 nt, Human
ugcuaauuuugaaaaacu

SEQ ID NO: 2011698 - RNA, 16 nt, Human
ugcuaauuuugaaaaa

SEQ ID NO: 2011699 - RNA, 13 nt, Human
agcuuaacagugu

SEQ ID NO: 2011700 - RNA, 14 nt, Human
agcuuaagaaaaaa

SEQ ID NO: 2011701 - RNA, 16 nt, Human
agcuuaagggucauau

SEQ ID NO: 2011702 - RNA, 19 nt, Human
agcuguugucucuucuccu

SEQ ID NO: 2011703 - RNA, 20 nt, Human
agcuguugucucuucuccuu

SEQ ID NO: 2011704 - RNA, 21 nt, Human
agcuguugucucuucuccuua

SEQ ID NO: 2011705 - RNA, 16 nt, Human
agcuguugucucuucu

SEQ ID NO: 2011706 - RNA, 17 nt, Human
agcuguugucucuucuc

SEQ ID NO: 2011707 - RNA, 18 nt, Human
ugcuaccacggccuccuu

SEQ ID NO: 2011708 - RNA, 20 nt, Human
ugcuaccacggccuccuuuc

SEQ ID NO: 2011709 - RNA, 21 nt, Human
ugcuaccacggccuccuuucc

SEQ ID NO: 2011710 - RNA, 16 nt, Human
ugccuuggugugcugu

SEQ ID NO: 2011711 - RNA, 14 nt, Human
ugcgguccacccag

SEQ ID NO: 2011712 - RNA, 15 nt, Human
ugcgguccacccagg

SEQ ID NO: 2011713 - RNA, 23 nt, Human
ugcuaaucuugugaaaauaauug

SEQ ID NO: 2011714 - RNA, 12 nt, Human
ugcuaauucuuu

SEQ ID NO: 2011715 - RNA, 18 nt, Human
ugcuaaucuugugaaaau

SEQ ID NO: 2011716 - RNA, 19 nt, Human
ugcuaaucuugugaaaaua

SEQ ID NO: 2011717 - RNA, 21 nt, Human
ugcuaaucuugugaaaauaau

SEQ ID NO: 2011718 - RNA, 13 nt, Human
ugcuaauucuuug

SEQ ID NO: 2011719 - RNA, 14 nt, Human
ugcuaauucuuugc

SEQ ID NO: 2011720 - RNA, 15 nt, Human
ugcuaauucuuugca

SEQ ID NO: 2011721 - RNA, 16 nt, Human
ugcuaauucuuugcaa

SEQ ID NO: 2011722 - RNA, 17 nt, Human
ugcuaauucuuugcaaa

SEQ ID NO: 2011723 - RNA, 20 nt, Human
ugcuaauucuuugcaaaaau

SEQ ID NO: 2011724 - RNA, 21 nt, Human
ugcuaauucuuugcaaaaauc

SEQ ID NO: 2011725 - RNA, 22 nt, Human
ugcuaauucuuugcaaaaaucc

SEQ ID NO: 2011726 - RNA, 13 nt, Human
ugcucaaaaugca

SEQ ID NO: 2011727 - RNA, 15 nt, Human
ugcucaaaaugcaaa

SEQ ID NO: 2011728 - RNA, 22 nt, Human
ugcuaugagcuggggaugucuc

SEQ ID NO: 2011729 - RNA, 21 nt, Human
ugcuaugauguuaguuuuccu

SEQ ID NO: 2011730 - RNA, 22 nt, Human
ugcuaugauguuaguuuuccuu

SEQ ID NO: 2011731 - RNA, 19 nt, Human
ugcuaugagcuggggaugu

SEQ ID NO: 2011732 - RNA, 20 nt, Human
ugcuaugagcuggggauguc

SEQ ID NO: 2011733 - RNA, 16 nt, Human
ugcuaugagcugggga

SEQ ID NO: 2011734 - RNA, 18 nt, Human
ugcuaucucccccagccc

SEQ ID NO: 2011735 - RNA, 17 nt, Human
ugcuaucucccccagcc

SEQ ID NO: 2011736 - RNA, 14 nt, Human
ugcuaucuccccca

SEQ ID NO: 2011737 - RNA, 13 nt, Human
ugcuaucuccccc

SEQ ID NO: 2011738 - RNA, 15 nt, Human
aggaaacaacagcuu

SEQ ID NO: 2011739 - RNA, 14 nt, Human
aggaaacaacagcu

SEQ ID NO: 2011740 - RNA, 16 nt, Human
aggaaaagcugcugac

SEQ ID NO: 2011741 - RNA, 21 nt, Human
ugcuccagcuguucagcuggu

SEQ ID NO: 2011742 - RNA, 20 nt, Human
ugcuccagcuguucagcugg

SEQ ID NO: 2011743 - RNA, 17 nt, Human
ugcucugccccagcuug

SEQ ID NO: 2011744 - RNA, 23 nt, Human
ugcucugccccagcuugggcaga

SEQ ID NO: 2011745 - RNA, 23 nt, Human
ugcucugagagcaaacuggcuug

SEQ ID NO: 2011746 - RNA, 12 nt, Human
ugcucugagagc

SEQ ID NO: 2011747 - RNA, 13 nt, Human
ugcugacuuagaa

SEQ ID NO: 2011748 - RNA, 14 nt, Human
ugcugacuuagaau

SEQ ID NO: 2011749 - RNA, 15 nt, Human
ugcugacuuagaauc

SEQ ID NO: 2011750 - RNA, 20 nt, Human
ugcucuugaacuccugaccu

SEQ ID NO: 2011751 - RNA, 22 nt, Human
ugcucuugaacuccugaccuca

SEQ ID NO: 2011752 - RNA, 15 nt, Human
ugcucuugaacuccu

SEQ ID NO: 2011753 - RNA, 14 nt, Human
ugcucugcugacag

SEQ ID NO: 2011754 - RNA, 15 nt, Human
ugcucugcugacaga

SEQ ID NO: 2011755 - RNA, 16 nt, Human
ugcucugcugacagac

SEQ ID NO: 2011756 - RNA, 14 nt, Human
ugcucugcucgccu

SEQ ID NO: 2011757 - RNA, 10 nt, Human
ugcucugcug

SEQ ID NO: 2011758 - RNA, 14 nt, Human
aggaaaguacauuu

SEQ ID NO: 2011759 - RNA, 17 nt, Human
aggaaaguacauuuuuu

SEQ ID NO: 2011760 - RNA, 23 nt, Human
aggaaaggcuccaggagcagcca

SEQ ID NO: 2011761 - RNA, 22 nt, Human
aggaaaguggcaccugucugcu

SEQ ID NO: 2011762 - RNA, 20 nt, Human
aggaaaguuucuuugaaaau

SEQ ID NO: 2011763 - RNA, 15 nt, Human
aggaaggcacuucug

SEQ ID NO: 2011764 - RNA, 16 nt, Human
aggaagcucagggccu

SEQ ID NO: 2011765 - RNA, 15 nt, Human
aggaagcucagggcc

SEQ ID NO: 2011766 - RNA, 14 nt, Human
aggaagcucagggc

SEQ ID NO: 2011767 - RNA, 13 nt, Human
aggaagcucaggg

SEQ ID NO: 2011768 - RNA, 13 nt, Human
aggaagccagcag

SEQ ID NO: 2011769 - RNA, 18 nt, Human
aggaagcagcuuucccca

SEQ ID NO: 2011770 - RNA, 21 nt, Human
ugccugcuuuuuauggccugu

SEQ ID NO: 2011771 - RNA, 20 nt, Human
ugccugcuuuuuauggccug

SEQ ID NO: 2011772 - RNA, 22 nt, Human
ugccugcuuuuuauggccugug

SEQ ID NO: 2011773 - RNA, 24 nt, Human
ugccugcccaggccccugccaccc

SEQ ID NO: 2011774 - RNA, 12 nt, Human
ugccucugccug

SEQ ID NO: 2011775 - RNA, 20 nt, Human
ugccugcccaggccccugcc

SEQ ID NO: 2011776 - RNA, 22 nt, Human
ugccugcccaggccccugccac

SEQ ID NO: 2011777 - RNA, 23 nt, Human
ugccugcccaggccccugccacc

SEQ ID NO: 2011778 - RNA, 14 nt, Human
ugccucagccuccc

SEQ ID NO: 2011779 - RNA, 18 nt, Human
ugccucugccucugacac

SEQ ID NO: 2011780 - RNA, 20 nt, Human
ugccucugccucugacacac

SEQ ID NO: 2011781 - RNA, 17 nt, Human
ugccucugccucugaca

SEQ ID NO: 2011782 - RNA, 19 nt, Human
agcuggccgggagccugau

SEQ ID NO: 2011783 - RNA, 18 nt, Human
agcuggccgggagccuga

SEQ ID NO: 2011784 - RNA, 12 nt, Human
agcuggcuccag

SEQ ID NO: 2011785 - RNA, 15 nt, Human
agcuggcuccagccu

SEQ ID NO: 2011786 - RNA, 16 nt, Human
agcuggccucucacug

SEQ ID NO: 2011787 - RNA, 22 nt, Human
agcuggccucucacugccuccc

SEQ ID NO: 2011788 - RNA, 12 nt, Human
agcuggccugag

SEQ ID NO: 2011789 - RNA, 21 nt, Human
agcuggccugagaggggaagc

SEQ ID NO: 2011790 - RNA, 16 nt, Human
agcugcuugggcuuca

SEQ ID NO: 2011791 - RNA, 20 nt, Human
agcugcuugggcuucauccu

SEQ ID NO: 2011792 - RNA, 12 nt, Human
agcugcugccau

SEQ ID NO: 2011793 - RNA, 13 nt, Human
agcugcugagccg

SEQ ID NO: 2011794 - RNA, 16 nt, Human
agcugcugagccgcag

SEQ ID NO: 2011795 - RNA, 17 nt, Human
agcugcugagccgcaga

SEQ ID NO: 2011796 - RNA, 21 nt, Human
agcugcugagccgcagagaag

SEQ ID NO: 2011797 - RNA, 21 nt, Human
ugccuggauggggcugcaccg

SEQ ID NO: 2011798 - RNA, 20 nt, Human
ugccuggauggggcugcacc

SEQ ID NO: 2011799 - RNA, 17 nt, Human
ugccuggauggggcugc

SEQ ID NO: 2011800 - RNA, 16 nt, Human
ugccuggauggggcug

SEQ ID NO: 2011801 - RNA, 18 nt, Human
agcugccuguucagcucc

SEQ ID NO: 2011802 - RNA, 14 nt, Human
agcugccuguucag

SEQ ID NO: 2011803 - RNA, 16 nt, Human
agcugccuguucagcu

SEQ ID NO: 2011804 - RNA, 18 nt, Human
agcuguuacugucuucag

SEQ ID NO: 2011805 - RNA, 22 nt, Human
agcugugggcaaaagaguguaa

SEQ ID NO: 2011806 - RNA, 23 nt, Human
agcugugggcaaaagaguguaaa

SEQ ID NO: 2011807 - RNA, 20 nt, Human
agcuguguccggcccaguuu

SEQ ID NO: 2011808 - RNA, 17 nt, Human
agcugugcucuggacag

SEQ ID NO: 2011809 - RNA, 18 nt, Human
agcugugcucuggacagg

SEQ ID NO: 2011810 - RNA, 16 nt, Human
agcuggcuccagccug

SEQ ID NO: 2011811 - RNA, 17 nt, Human
agcuggcuccagccugg

SEQ ID NO: 2011812 - RNA, 23 nt, Human
agcugggguggggaccucaggcc

SEQ ID NO: 2011813 - RNA, 22 nt, Human
agcugggguggggaccucaggc

SEQ ID NO: 2011814 - RNA, 20 nt, Human
agcugggacuacaggcaccc

SEQ ID NO: 2011815 - RNA, 23 nt, Human
agcugggacuacaggcacccacc

SEQ ID NO: 2011816 - RNA, 20 nt, Human
agcugggguggggaccucag

SEQ ID NO: 2011817 - RNA, 16 nt, Human
agcugggacuacaggu

SEQ ID NO: 2011818 - RNA, 17 nt, Human
ugccuguugggccagga

SEQ ID NO: 2011819 - RNA, 16 nt, Human
ugccuguugggccagg

SEQ ID NO: 2011820 - RNA, 20 nt, Human
ugccuuacccucauguucuu

SEQ ID NO: 2011821 - RNA, 24 nt, Human
ugccuuaaagacaagacagcauuu

SEQ ID NO: 2011822 - RNA, 15 nt, Human
ugccuuaagugagga

SEQ ID NO: 2011823 - RNA, 16 nt, Human
ugccuuggggacaaga

SEQ ID NO: 2011824 - RNA, 21 nt, Human
ugccuuacccucauguucuua

SEQ ID NO: 2011825 - RNA, 21 nt, Human
ugccuuaagugaggaaaucaa

SEQ ID NO: 2011826 - RNA, 22 nt, Human
ugccuuaagugaggaaaucaaa

SEQ ID NO: 2011827 - RNA, 19 nt, Human
agcuguuacugucuucagu

SEQ ID NO: 2011828 - RNA, 14 nt, Human
ugccuguucccauu

SEQ ID NO: 2011829 - RNA, 19 nt, Human
agcugcagauaaguggccu

SEQ ID NO: 2011830 - RNA, 20 nt, Human
agcugccagccgagauagcc

SEQ ID NO: 2011831 - RNA, 13 nt, Human
agcugcaccccuu

SEQ ID NO: 2011832 - RNA, 15 nt, Human
agcugcaccccuucc

SEQ ID NO: 2011833 - RNA, 19 nt, Human
agcugcaaucgcuuuccua

SEQ ID NO: 2011834 - RNA, 16 nt, Human
agcucuguccugggag

SEQ ID NO: 2011835 - RNA, 21 nt, Human
agcucuguccugggagugagc

SEQ ID NO: 2011836 - RNA, 21 nt, Human
agcugauuuugaggguuuuua

SEQ ID NO: 2011837 - RNA, 23 nt, Human
agcucuguccugggagugagcug

SEQ ID NO: 2011838 - RNA, 16 nt, Human
ugccgagcccuugccc

SEQ ID NO: 2011839 - RNA, 14 nt, Human
ugccgcagcccugc

SEQ ID NO: 2011840 - RNA, 12 nt, Human
ugccgcagcccu

SEQ ID NO: 2011841 - RNA, 12 nt, Human
ugccucagccuc

SEQ ID NO: 2011842 - RNA, 13 nt, Human
ugccucagccucc

SEQ ID NO: 2011843 - RNA, 18 nt, Human
ugcccuuaccugccagga

SEQ ID NO: 2011844 - RNA, 17 nt, Human
agcucugguccauagag

SEQ ID NO: 2011845 - RNA, 14 nt, Human
agcucuguccuggg

SEQ ID NO: 2011846 - RNA, 12 nt, Human
agcucuggucca

SEQ ID NO: 2011847 - RNA, 14 nt, Human
agcuccuuuuccag

SEQ ID NO: 2011848 - RNA, 18 nt, Human
agcuccuuuuccagagca

SEQ ID NO: 2011849 - RNA, 19 nt, Human
agcuccuuuuccagagcau

SEQ ID NO: 2011850 - RNA, 16 nt, Human
agcuccuucuguccua

SEQ ID NO: 2011851 - RNA, 21 nt, Human
agcuccuucuguccuacucug

SEQ ID NO: 2011852 - RNA, 18 nt, Human
agcuccauacacacgcug

SEQ ID NO: 2011853 - RNA, 19 nt, Human
agcuccauacacacgcugc

SEQ ID NO: 2011854 - RNA, 20 nt, Human
agcuccauacacacgcugcc

SEQ ID NO: 2011855 - RNA, 22 nt, Human
agcuccauacacacgcugccuu

SEQ ID NO: 2011856 - RNA, 13 nt, Human
agcuccaucucca

SEQ ID NO: 2011857 - RNA, 15 nt, Human
agcuccaucuccacu

SEQ ID NO: 2011858 - RNA, 13 nt, Human
agcucccaggcau

SEQ ID NO: 2011859 - RNA, 16 nt, Human
agcuccaucuccacuc

SEQ ID NO: 2011860 - RNA, 23 nt, Human
agcuccauacacacgcugccuuc

SEQ ID NO: 2011861 - RNA, 15 nt, Human
agcuccuucuguccu

SEQ ID NO: 2011862 - RNA, 23 nt, Human
agcucccaggcauuccccaggag

SEQ ID NO: 2011863 - RNA, 16 nt, Human
ugccaucauguuuaca

SEQ ID NO: 2011864 - RNA, 14 nt, Human
ugccauagaguaca

SEQ ID NO: 2011865 - RNA, 15 nt, Human
ugccauagaguacac

SEQ ID NO: 2011866 - RNA, 18 nt, Human
ugccauagaguacacugc

SEQ ID NO: 2011867 - RNA, 20 nt, Human
aggcagcuguugucucuucu

SEQ ID NO: 2011868 - RNA, 21 nt, Human
aggcagcuguugucucuucuc

SEQ ID NO: 2011869 - RNA, 12 nt, Human
aggcacaggcag

SEQ ID NO: 2011870 - RNA, 13 nt, Human
aggcacaggcagg

SEQ ID NO: 2011871 - RNA, 14 nt, Human
aggcacaggcaggg

SEQ ID NO: 2011872 - RNA, 13 nt, Human
aggcagcuguugu

SEQ ID NO: 2011873 - RNA, 14 nt, Human
aggcaggggaaugu

SEQ ID NO: 2011874 - RNA, 16 nt, Human
aggcaggggaauguau

SEQ ID NO: 2011875 - RNA, 19 nt, Human
aggcaggggaauguaugug

SEQ ID NO: 2011876 - RNA, 17 nt, Human
aggcaggggcccugcag

SEQ ID NO: 2011877 - RNA, 18 nt, Human
aggcaggggcccugcagc

SEQ ID NO: 2011878 - RNA, 19 nt, Human
aggcaggggcccugcagcu

SEQ ID NO: 2011879 - RNA, 20 nt, Human
aggcaggggcccugcagcuc

SEQ ID NO: 2011880 - RNA, 21 nt, Human
aggcaggggcccugcagcucu

SEQ ID NO: 2011881 - RNA, 22 nt, Human
aggcaggggcccugcagcucuc

SEQ ID NO: 2011882 - RNA, 17 nt, Human
aggcaggugggauggau

SEQ ID NO: 2011883 - RNA, 20 nt, Human
aggcaggugaucugcugcag

SEQ ID NO: 2011884 - RNA, 23 nt, Human
aggcaggugaucugcugcagagc

SEQ ID NO: 2011885 - RNA, 15 nt, Human
aggcauaaagucagg

SEQ ID NO: 2011886 - RNA, 23 nt, Human
aggcaguuugaggauuaguuuag

SEQ ID NO: 2011887 - RNA, 12 nt, Human
aggcagggucuc

SEQ ID NO: 2011888 - RNA, 22 nt, Human
aggcaggucuugaacuccuggc

SEQ ID NO: 2011889 - RNA, 18 nt, Human
aggcauuucccacccuga

SEQ ID NO: 2011890 - RNA, 20 nt, Human
aggcauuuaggccaugggac

SEQ ID NO: 2011891 - RNA, 18 nt, Human
aggcauugugggaagggg

SEQ ID NO: 2011892 - RNA, 22 nt, Human
aggcauaaagucagggguuccc

SEQ ID NO: 2011893 - RNA, 17 nt, Human
uggacuguucccugagg

SEQ ID NO: 2011894 - RNA, 14 nt, Human
uggagaaaauggac

SEQ ID NO: 2011895 - RNA, 13 nt, Human
uggacuuaggaag

SEQ ID NO: 2011896 - RNA, 16 nt, Human
uggacuguucccugag

SEQ ID NO: 2011897 - RNA, 18 nt, Human
aggauugcuacuguccua

SEQ ID NO: 2011898 - RNA, 15 nt, Human
aggauugcuacuguc

SEQ ID NO: 2011899 - RNA, 17 nt, Human
aggauugcuacuguccu

SEQ ID NO: 2011900 - RNA, 16 nt, Human
aggcaaggcugucaau

SEQ ID NO: 2011901 - RNA, 17 nt, Human
aggcaaggcugucaauu

SEQ ID NO: 2011902 - RNA, 20 nt, Human
aggcaagcaccuccugccuc

SEQ ID NO: 2011903 - RNA, 18 nt, Human
aggcaagcaccuccugcc

SEQ ID NO: 2011904 - RNA, 19 nt, Human
aggcaagcaccuccugccu

SEQ ID NO: 2011905 - RNA, 17 nt, Human
uggagccaauggagacu

SEQ ID NO: 2011906 - RNA, 17 nt, Human
aggcaagcaccuccugc

SEQ ID NO: 2011907 - RNA, 16 nt, Human
uggauucugagagcug

SEQ ID NO: 2011908 - RNA, 17 nt, Human
uggauucugagagcugu

SEQ ID NO: 2011909 - RNA, 20 nt, Human
uggauucugaggcccugccc

SEQ ID NO: 2011910 - RNA, 17 nt, Human
uggauucuuguuuugcu

SEQ ID NO: 2011911 - RNA, 14 nt, Human
uggauuccuguuuc

SEQ ID NO: 2011912 - RNA, 23 nt, Human
uggcacaucagcacgauuucugu

SEQ ID NO: 2011913 - RNA, 17 nt, Human
uggauucauauuuaauu

SEQ ID NO: 2011914 - RNA, 13 nt, Human
uggauucagccuu

SEQ ID NO: 2011915 - RNA, 14 nt, Human
uggauucagccuuc

SEQ ID NO: 2011916 - RNA, 17 nt, Human
uggauucagccuucuuu

SEQ ID NO: 2011917 - RNA, 23 nt, Human
uggauucagccuucuuuuucugg

SEQ ID NO: 2011918 - RNA, 14 nt, Human
uggauucauauuua

SEQ ID NO: 2011919 - RNA, 19 nt, Human
uggaguucucaaagaccug

SEQ ID NO: 2011920 - RNA, 13 nt, Human
uggauggaagggg

SEQ ID NO: 2011921 - RNA, 21 nt, Human
uggaugccugguggcagcugc

SEQ ID NO: 2011922 - RNA, 23 nt, Human
uggaugccugguggcagcugcgg

SEQ ID NO: 2011923 - RNA, 11 nt, Human
uggaguuggag

SEQ ID NO: 2011924 - RNA, 20 nt, Human
aggcauuugcugaauacaga

SEQ ID NO: 2011925 - RNA, 16 nt, Human
aggcauuugcugaaua

SEQ ID NO: 2011926 - RNA, 12 nt, Human
uggagugaccaa

SEQ ID NO: 2011927 - RNA, 14 nt, Human
uggagugcagugag

SEQ ID NO: 2011928 - RNA, 16 nt, Human
uggagugcaaaaggcu

SEQ ID NO: 2011929 - RNA, 14 nt, Human
uggaguugaaaauc

SEQ ID NO: 2011930 - RNA, 15 nt, Human
aggccagccuugacc

SEQ ID NO: 2011931 - RNA, 13 nt, Human
aggccagcugccu

SEQ ID NO: 2011932 - RNA, 13 nt, Human
aggccagccuuga

SEQ ID NO: 2011933 - RNA, 14 nt, Human
aggccaccucuucc

SEQ ID NO: 2011934 - RNA, 15 nt, Human
aggccaccucuuccu

SEQ ID NO: 2011935 - RNA, 21 nt, Human
aggccaccucuuccuggccgg

SEQ ID NO: 2011936 - RNA, 23 nt, Human
aggccaccucuuccuggccggug

SEQ ID NO: 2011937 - RNA, 12 nt, Human
aggccaccuccu

SEQ ID NO: 2011938 - RNA, 13 nt, Human
aggccaccuccua

SEQ ID NO: 2011939 - RNA, 21 nt, Human
aggccaccuccuaaaaggccc

SEQ ID NO: 2011940 - RNA, 22 nt, Human
aggccaccuccuaaaaggccca

SEQ ID NO: 2011941 - RNA, 23 nt, Human
aggccaccuccuaaaaggcccag

SEQ ID NO: 2011942 - RNA, 22 nt, Human
uggcagcucaccucucccuugg

SEQ ID NO: 2011943 - RNA, 21 nt, Human
uggcagcucaccucucccuug

SEQ ID NO: 2011944 - RNA, 23 nt, Human
uggcagcucaccucucccuugga

SEQ ID NO: 2011945 - RNA, 13 nt, Human
uggcagcucagag

SEQ ID NO: 2011946 - RNA, 18 nt, Human
uggcacccggccccugcu

SEQ ID NO: 2011947 - RNA, 19 nt, Human
uggcacccggccccugcug

SEQ ID NO: 2011948 - RNA, 20 nt, Human
uggcacccggccccugcugg

SEQ ID NO: 2011949 - RNA, 15 nt, Human
aggcccccugccugc

SEQ ID NO: 2011950 - RNA, 18 nt, Human
aggcccccugccugcccu

SEQ ID NO: 2011951 - RNA, 14 nt, Human
aggccccgcccagg

SEQ ID NO: 2011952 - RNA, 13 nt, Human
aggcccggcucca

SEQ ID NO: 2011953 - RNA, 15 nt, Human
aggcccggccucuca

SEQ ID NO: 2011954 - RNA, 13 nt, Human
aggcccggccucu

SEQ ID NO: 2011955 - RNA, 14 nt, Human
aggcccggccucuc

SEQ ID NO: 2011956 - RNA, 13 nt, Human
aggcccagagggc

SEQ ID NO: 2011957 - RNA, 20 nt, Human
aggcccagagagaagagccc

SEQ ID NO: 2011958 - RNA, 14 nt, Human
aggcccacccugcu

SEQ ID NO: 2011959 - RNA, 15 nt, Human
aggcccacccugcuu

SEQ ID NO: 2011960 - RNA, 22 nt, Human
aggcccacccugcuuggcccag

SEQ ID NO: 2011961 - RNA, 23 nt, Human
aggcccacccugcuuggcccagg

SEQ ID NO: 2011962 - RNA, 12 nt, Human
aggcccacccug

SEQ ID NO: 2011963 - RNA, 13 nt, Human
aggcccacccugc

SEQ ID NO: 2011964 - RNA, 22 nt, Human
aggcccagagagaagagcccca

SEQ ID NO: 2011965 - RNA, 23 nt, Human
aggcccagagagaagagccccac

SEQ ID NO: 2011966 - RNA, 13 nt, Human
aggauauauuuua

SEQ ID NO: 2011967 - RNA, 14 nt, Human
aggauauauuuuau

SEQ ID NO: 2011968 - RNA, 18 nt, Human
aggauauauuuuauuuuu

SEQ ID NO: 2011969 - RNA, 17 nt, Human
aggaggcuccaggcagc

SEQ ID NO: 2011970 - RNA, 18 nt, Human
aggaggcuccaggcagca

SEQ ID NO: 2011971 - RNA, 21 nt, Human
aggaggccuugggcucugcug

SEQ ID NO: 2011972 - RNA, 12 nt, Human
aggaggcuccag

SEQ ID NO: 2011973 - RNA, 23 nt, Human
uggaagaggaacagcacugggga

SEQ ID NO: 2011974 - RNA, 17 nt, Human
uggaagcagguuaaaug

SEQ ID NO: 2011975 - RNA, 18 nt, Human
uggaagcagguuaaaugu

SEQ ID NO: 2011976 - RNA, 19 nt, Human
uggaagcagguuaaauguu

SEQ ID NO: 2011977 - RNA, 20 nt, Human
uggaagcagguuaaauguuu

SEQ ID NO: 2011978 - RNA, 21 nt, Human
uggaagcagguuaaauguuuu

SEQ ID NO: 2011979 - RNA, 14 nt, Human
uggaagcagugccc

SEQ ID NO: 2011980 - RNA, 16 nt, Human
uggaagcagugcccag

SEQ ID NO: 2011981 - RNA, 17 nt, Human
uggaagcagugcccagg

SEQ ID NO: 2011982 - RNA, 18 nt, Human
uggaagcagugcccaggu

SEQ ID NO: 2011983 - RNA, 19 nt, Human
uggaagcagugcccaggug

SEQ ID NO: 2011984 - RNA, 20 nt, Human
uggaagcagugcccaggugg

SEQ ID NO: 2011985 - RNA, 23 nt, Human
aggaugacaaaauucuuucuggu

SEQ ID NO: 2011986 - RNA, 13 nt, Human
aggaucagucuga

SEQ ID NO: 2011987 - RNA, 17 nt, Human
aggauaucggcauuugu

SEQ ID NO: 2011988 - RNA, 21 nt, Human
aggauaucggcauuuguuucu

SEQ ID NO: 2011989 - RNA, 14 nt, Human
aggauaugccugcu

SEQ ID NO: 2011990 - RNA, 19 nt, Human
aggauucuuccucccuccc

SEQ ID NO: 2011991 - RNA, 17 nt, Human
aggauucuuccucccuc

SEQ ID NO: 2011992 - RNA, 23 nt, Human
aggaugaucuaggaagacuuugg

SEQ ID NO: 2011993 - RNA, 22 nt, Human
aggaugaucuaggaagacuuug

SEQ ID NO: 2011994 - RNA, 22 nt, Human
aggaugcacagaguuguuacau

SEQ ID NO: 2011995 - RNA, 10 nt, Human
ugcuuuuaaa

SEQ ID NO: 2011996 - RNA, 23 nt, Human
ugcuuuguugugugccucuagcu

SEQ ID NO: 2011997 - RNA, 24 nt, Human
ugcuuuguugugugccucuagcug

SEQ ID NO: 2011998 - RNA, 16 nt, Human
ugcuuuuuauggccug

SEQ ID NO: 2011999 - RNA, 23 nt, Human
uggaaauuuguuauaaugaauga

SEQ ID NO: 2012000 - RNA, 21 nt, Human
uggaaauuuguuauaaugaau

SEQ ID NO: 2012001 - RNA, 12 nt, Human
uggaaauuucac

SEQ ID NO: 2012002 - RNA, 13 nt, Human
uggaaauuucacg

SEQ ID NO: 2012003 - RNA, 15 nt, Human
uggaagagggcugca

SEQ ID NO: 2012004 - RNA, 18 nt, Human
uggaagagcuaggcaggg

SEQ ID NO: 2012005 - RNA, 16 nt, Human
uggaagacagcucuua

SEQ ID NO: 2012006 - RNA, 14 nt, Human
uggaaauuucacgu

SEQ ID NO: 2012007 - RNA, 14 nt, Human
ugcuuugggcugcc

SEQ ID NO: 2012008 - RNA, 15 nt, Human
ugcuuugggcugccc

SEQ ID NO: 2012009 - RNA, 20 nt, Human
ugcuugaagcaaacaguuga

SEQ ID NO: 2012010 - RNA, 15 nt, Human
ugcuugaauaaacac

SEQ ID NO: 2012011 - RNA, 20 nt, Human
ugcuugaauaaacaccacug

SEQ ID NO: 2012012 - RNA, 15 nt, Human
ugcuugagcucagga

SEQ ID NO: 2012013 - RNA, 12 nt, Human
ugcuugaauaaa

SEQ ID NO: 2012014 - RNA, 17 nt, Human
ugcuugaacuuacaggu

SEQ ID NO: 2012015 - RNA, 19 nt, Human
ugcuugaagcaaacaguug

SEQ ID NO: 2012016 - RNA, 17 nt, Human
aggagccuccugcccuu

SEQ ID NO: 2012017 - RNA, 17 nt, Human
ugcuuugugauuuuugu

SEQ ID NO: 2012018 - RNA, 15 nt, Human
ugcuuuguugugugc

SEQ ID NO: 2012019 - RNA, 16 nt, Human
ugcuuuguugugugcc

SEQ ID NO: 2012020 - RNA, 18 nt, Human
ugcuuuguugugugccuc

SEQ ID NO: 2012021 - RNA, 19 nt, Human
ugcuuuguugugugccucu

SEQ ID NO: 2012022 - RNA, 20 nt, Human
ugcuuuguugugugccucua

SEQ ID NO: 2012023 - RNA, 21 nt, Human
ugcuuuguugugugccucuag

SEQ ID NO: 2012024 - RNA, 22 nt, Human
ugcuuugugauuuuuguaauuu

SEQ ID NO: 2012025 - RNA, 16 nt, Human
ugcuuugggcugcccu

SEQ ID NO: 2012026 - RNA, 23 nt, Human
ugcuuuuuaauauugauaugcuu

SEQ ID NO: 2012027 - RNA, 20 nt, Human
ugcuuuugucuaugggacuc

SEQ ID NO: 2012028 - RNA, 18 nt, Human
ugcuuuuggucuguguga

SEQ ID NO: 2012029 - RNA, 12 nt, Human
aggacucugccu

SEQ ID NO: 2012030 - RNA, 13 nt, Human
aggacucugccuc

SEQ ID NO: 2012031 - RNA, 14 nt, Human
aggacucugccucc

SEQ ID NO: 2012032 - RNA, 16 nt, Human
aggacucugccuccuc

SEQ ID NO: 2012033 - RNA, 17 nt, Human
aggacucugccuccucu

SEQ ID NO: 2012034 - RNA, 18 nt, Human
aggacucugccuccucuu

SEQ ID NO: 2012035 - RNA, 18 nt, Human
aggagaaacuggaacucu

SEQ ID NO: 2012036 - RNA, 19 nt, Human
aggagaaacuggaacucuc

SEQ ID NO: 2012037 - RNA, 22 nt, Human
aggacuuuucuuuguggcuucc

SEQ ID NO: 2012038 - RNA, 17 nt, Human
aggagaaacuggaacuc

SEQ ID NO: 2012039 - RNA, 17 nt, Human
aggacuuuucuuugugg

SEQ ID NO: 2012040 - RNA, 19 nt, Human
aggacuuuucuuuguggcu

SEQ ID NO: 2012041 - RNA, 16 nt, Human
aggagccuccugcccu

SEQ ID NO: 2012042 - RNA, 23 nt, Human
aggagcccugggaggcucuggag

SEQ ID NO: 2012043 - RNA, 17 nt, Human
aggagccccgaggccuu

SEQ ID NO: 2012044 - RNA, 22 nt, Human
aggagcccauuuggagggccug

SEQ ID NO: 2012045 - RNA, 15 nt, Human
aggagcacugaaagu

SEQ ID NO: 2012046 - RNA, 13 nt, Human
aggagcagccaca

SEQ ID NO: 2012047 - RNA, 12 nt, Human
aggagcagccac

SEQ ID NO: 2012048 - RNA, 15 nt, Human
aggagaugcugugcc

SEQ ID NO: 2012049 - RNA, 13 nt, Human
aggaccugugucc

SEQ ID NO: 2012050 - RNA, 18 nt, Human
aggaccuucgggcugugc

SEQ ID NO: 2012051 - RNA, 19 nt, Human
aggaccuucgggcugugcc

SEQ ID NO: 2012052 - RNA, 18 nt, Human
aggacaaggugcaggcag

SEQ ID NO: 2012053 - RNA, 19 nt, Human
aggacaaggugcaggcagg

SEQ ID NO: 2012054 - RNA, 20 nt, Human
aggacaaggugcaggcaggc

SEQ ID NO: 2012055 - RNA, 23 nt, Human
aggacaaggugcaggcaggcugg

SEQ ID NO: 2012056 - RNA, 16 nt, Human
aggacgcucucuggcc

SEQ ID NO: 2012057 - RNA, 17 nt, Human
aggacgcucucuggccu

SEQ ID NO: 2012058 - RNA, 19 nt, Human
aggacgcucucuggccuuc

SEQ ID NO: 2012059 - RNA, 20 nt, Human
aggacgcucucuggccuucg

SEQ ID NO: 2012060 - RNA, 20 nt, Human
aggaccuucgggcugugccc

SEQ ID NO: 2012061 - RNA, 21 nt, Human
aggaccuucacucuaagaugu

SEQ ID NO: 2012062 - RNA, 23 nt, Human
aggaccuucacucuaagauguua

SEQ ID NO: 2012063 - RNA, 13 nt, Human
aggacgcucucug

SEQ ID NO: 2012064 - RNA, 14 nt, Human
aggacgcucucugg

SEQ ID NO: 2012065 - RNA, 19 nt, Human
aggacuaggguccugggga

SEQ ID NO: 2012066 - RNA, 16 nt, Human
aggacuaggguccugg

SEQ ID NO: 2012067 - RNA, 18 nt, Human
aggacuaggguccugggg

SEQ ID NO: 2012068 - RNA, 15 nt, Human
aggacuaggguccug

SEQ ID NO: 2012069 - RNA, 17 nt, Human
aggacgcuucacaggac

SEQ ID NO: 2012070 - RNA, 19 nt, Human
aggacgcuucacaggacag

SEQ ID NO: 2012071 - RNA, 20 nt, Human
aggacgcuucacaggacagg

SEQ ID NO: 2012072 - RNA, 21 nt, Human
aggacucucacgauaugcaag

SEQ ID NO: 2012073 - RNA, 14 nt, Human
ugcaugcuuuccau

SEQ ID NO: 2012074 - RNA, 15 nt, Human
ugcaugcuuuccaua

SEQ ID NO: 2012075 - RNA, 18 nt, Human
ugcaugcuuuccauauuu

SEQ ID NO: 2012076 - RNA, 21 nt, Human
ugcaugcugucccuuacguga

SEQ ID NO: 2012077 - RNA, 19 nt, Human
ugcaugcugucccuuacgu

SEQ ID NO: 2012078 - RNA, 18 nt, Human
ugcaugcugucccuuacg

SEQ ID NO: 2012079 - RNA, 15 nt, Human
ugcaugauugcagaa

SEQ ID NO: 2012080 - RNA, 18 nt, Human
ugcaucuuugauguguug

SEQ ID NO: 2012081 - RNA, 16 nt, Human
ugcaugauugcagaau

SEQ ID NO: 2012082 - RNA, 12 nt, Human
ugcaucuuaaaa

SEQ ID NO: 2012083 - RNA, 12 nt, Human
ugcaucuuugau

SEQ ID NO: 2012084 - RNA, 16 nt, Human
ugcaucuuugaugugu

SEQ ID NO: 2012085 - RNA, 17 nt, Human
ugcaucuuugauguguu

SEQ ID NO: 2012086 - RNA, 13 nt, Human
ugcaucucagccc

SEQ ID NO: 2012087 - RNA, 14 nt, Human
ugcaucucagccca

SEQ ID NO: 2012088 - RNA, 15 nt, Human
ugcaucucagcccac

SEQ ID NO: 2012089 - RNA, 13 nt, Human
ugcauacucauua

SEQ ID NO: 2012090 - RNA, 19 nt, Human
ugcauacucauuaggaugg

SEQ ID NO: 2012091 - RNA, 17 nt, Human
ugcauagaauaaaauuu

SEQ ID NO: 2012092 - RNA, 16 nt, Human
ugcaguaucugugaac

SEQ ID NO: 2012093 - RNA, 18 nt, Human
ugcagguuaguuacauau

SEQ ID NO: 2012094 - RNA, 16 nt, Human
ugcauaccacuuuugu

SEQ ID NO: 2012095 - RNA, 13 nt, Human
ugcagucacugca

SEQ ID NO: 2012096 - RNA, 18 nt, Human
ugcauaccacuuuuguuc

SEQ ID NO: 2012097 - RNA, 20 nt, Human
ugcauaccacuuuuguucuu

SEQ ID NO: 2012098 - RNA, 17 nt, Human
agccucgacacagagug

SEQ ID NO: 2012099 - RNA, 18 nt, Human
agccucgacacagagugg

SEQ ID NO: 2012100 - RNA, 20 nt, Human
agccucgcaggccucccugc

SEQ ID NO: 2012101 - RNA, 22 nt, Human
agccucgcaggccucccugcca

SEQ ID NO: 2012102 - RNA, 23 nt, Human
agccucgcaggccucccugccag

SEQ ID NO: 2012103 - RNA, 16 nt, Human
agccucguuggaagag

SEQ ID NO: 2012104 - RNA, 21 nt, Human
agccucguuggaagaggaaca

SEQ ID NO: 2012105 - RNA, 18 nt, Human
agccuccugcccuuaccu

SEQ ID NO: 2012106 - RNA, 14 nt, Human
agccuccugcccuu

SEQ ID NO: 2012107 - RNA, 13 nt, Human
agccuccugcccu

SEQ ID NO: 2012108 - RNA, 12 nt, Human
ugcagacaggca

SEQ ID NO: 2012109 - RNA, 14 nt, Human
ugcagaauuguuua

SEQ ID NO: 2012110 - RNA, 17 nt, Human
ugcagacaaucuucugu

SEQ ID NO: 2012111 - RNA, 13 nt, Human
ugcagacaggcaa

SEQ ID NO: 2012112 - RNA, 21 nt, Human
ugcagacaggcaagcaccucc

SEQ ID NO: 2012113 - RNA, 21 nt, Human
ugcagccucacaguccuuacc

SEQ ID NO: 2012114 - RNA, 17 nt, Human
ugcagccucacaguccu

SEQ ID NO: 2012115 - RNA, 18 nt, Human
ugcagccucacaguccuu

SEQ ID NO: 2012116 - RNA, 12 nt, Human
agccucuuuccc

SEQ ID NO: 2012117 - RNA, 13 nt, Human
agccucuuucccu

SEQ ID NO: 2012118 - RNA, 20 nt, Human
agccucuuucccuuccaguu

SEQ ID NO: 2012119 - RNA, 21 nt, Human
agccucuuucccuuccaguuu

SEQ ID NO: 2012120 - RNA, 22 nt, Human
ugcaggucccuaauaaagcugu

SEQ ID NO: 2012121 - RNA, 18 nt, Human
ugcagccuccgcuucccu

SEQ ID NO: 2012122 - RNA, 17 nt, Human
ugcagggcuuuaaaauu

SEQ ID NO: 2012123 - RNA, 19 nt, Human
ugcagggcuuuaaaauucu

SEQ ID NO: 2012124 - RNA, 14 nt, Human
ugccaaugggagcu

SEQ ID NO: 2012125 - RNA, 13 nt, Human
ugccaauggacua

SEQ ID NO: 2012126 - RNA, 18 nt, Human
ugccaaugggagcucaug

SEQ ID NO: 2012127 - RNA, 16 nt, Human
ugcauuuaaaagauac

SEQ ID NO: 2012128 - RNA, 17 nt, Human
ugcauugggugaucauu

SEQ ID NO: 2012129 - RNA, 13 nt, Human
agcgcccuggccc

SEQ ID NO: 2012130 - RNA, 14 nt, Human
agcgcccuggcccc

SEQ ID NO: 2012131 - RNA, 16 nt, Human
agcgcccuggccccca

SEQ ID NO: 2012132 - RNA, 18 nt, Human
agcgcccuggcccccaca

SEQ ID NO: 2012133 - RNA, 20 nt, Human
agcgcccuggcccccacaug

SEQ ID NO: 2012134 - RNA, 22 nt, Human
ugccagccgagauagccaaggc

SEQ ID NO: 2012135 - RNA, 17 nt, Human
ugccagccgagauagcc

SEQ ID NO: 2012136 - RNA, 15 nt, Human
ugccagcccagaggc

SEQ ID NO: 2012137 - RNA, 15 nt, Human
ugccagcccauuugg

SEQ ID NO: 2012138 - RNA, 13 nt, Human
ugccauaauuacu

SEQ ID NO: 2012139 - RNA, 19 nt, Human
ugccaguuuuguuuccuuu

SEQ ID NO: 2012140 - RNA, 16 nt, Human
ugccaguggggccuga

SEQ ID NO: 2012141 - RNA, 19 nt, Human
agccuugcggaagguucua

SEQ ID NO: 2012142 - RNA, 21 nt, Human
agccuugaccauucuccaccu

SEQ ID NO: 2012143 - RNA, 19 nt, Human
agccuugaccauucuccac

SEQ ID NO: 2012144 - RNA, 18 nt, Human
agccuugaccauucucca

SEQ ID NO: 2012145 - RNA, 16 nt, Human
agccuugggaccccug

SEQ ID NO: 2012146 - RNA, 17 nt, Human
agccuuggccucagagg

SEQ ID NO: 2012147 - RNA, 13 nt, Human
agccuugaacuuu

SEQ ID NO: 2012148 - RNA, 23 nt, Human
agccuugaacuuugaccucugca

SEQ ID NO: 2012149 - RNA, 16 nt, Human
agccuucuuuuucugg

SEQ ID NO: 2012150 - RNA, 17 nt, Human
agccuucuuuuucugga

SEQ ID NO: 2012151 - RNA, 18 nt, Human
agccuucuuuuucuggac

SEQ ID NO: 2012152 - RNA, 20 nt, Human
agccuucuuuuucuggacuc

SEQ ID NO: 2012153 - RNA, 23 nt, Human
agccuucuuuuucuggacucugg

SEQ ID NO: 2012154 - RNA, 13 nt, Human
agccuucugagcu

SEQ ID NO: 2012155 - RNA, 19 nt, Human
agccuucugagcuggccuc

SEQ ID NO: 2012156 - RNA, 15 nt, Human
agccuguuuaagaga

SEQ ID NO: 2012157 - RNA, 19 nt, Human
agccuuaaaacaucauucc

SEQ ID NO: 2012158 - RNA, 22 nt, Human
agccuuaaaacaucauuccuuu

SEQ ID NO: 2012159 - RNA, 20 nt, Human
agccuuagaagucacacagu

SEQ ID NO: 2012160 - RNA, 22 nt, Human
agccuuagaagucacacaguau

SEQ ID NO: 2012161 - RNA, 14 nt, Human
agccuuaagcugca

SEQ ID NO: 2012162 - RNA, 16 nt, Human
agccuuaagcugcagg

SEQ ID NO: 2012163 - RNA, 16 nt, Human
agccugagucaccugc

SEQ ID NO: 2012164 - RNA, 19 nt, Human
agccugagucaccugcaga

SEQ ID NO: 2012165 - RNA, 19 nt, Human
agccugugccucugggacu

SEQ ID NO: 2012166 - RNA, 18 nt, Human
agccugugccucugggac

SEQ ID NO: 2012167 - RNA, 17 nt, Human
agccugugccucuggga

SEQ ID NO: 2012168 - RNA, 20 nt, Human
ugcaaaccaucauugaaauc

SEQ ID NO: 2012169 - RNA, 18 nt, Human
ugcaaaccaucauugaaa

SEQ ID NO: 2012170 - RNA, 22 nt, Human
ugcaaacugggcuggaagauau

SEQ ID NO: 2012171 - RNA, 23 nt, Human
ugcaaacugggcuggaagauauu

SEQ ID NO: 2012172 - RNA, 21 nt, Human
ugcaaaggguaucaggugcug

SEQ ID NO: 2012173 - RNA, 14 nt, Human
ugcaaagcccagcu

SEQ ID NO: 2012174 - RNA, 15 nt, Human
ugcaaagcccagcuu

SEQ ID NO: 2012175 - RNA, 17 nt, Human
ugcaaagcccagcuuga

SEQ ID NO: 2012176 - RNA, 13 nt, Human
ugcaaaggaaaua

SEQ ID NO: 2012177 - RNA, 16 nt, Human
ugcaaaggaaauacca

SEQ ID NO: 2012178 - RNA, 20 nt, Human
ugcaaaguaucccuacugua

SEQ ID NO: 2012179 - RNA, 17 nt, Human
ugcaaaguacagguacu

SEQ ID NO: 2012180 - RNA, 21 nt, Human
ugcaaaguacagguacuuugu

SEQ ID NO: 2012181 - RNA, 23 nt, Human
ugcaaaguucccuacuuccugug

SEQ ID NO: 2012182 - RNA, 13 nt, Human
ugcaaaccaucau

SEQ ID NO: 2012183 - RNA, 12 nt, Human
ugcaaaccauca

SEQ ID NO: 2012184 - RNA, 18 nt, Human
ugcaaacauuggaagauu

SEQ ID NO: 2012185 - RNA, 12 nt, Human
ugauuuggaaaa

SEQ ID NO: 2012186 - RNA, 13 nt, Human
ugauuugagauuu

SEQ ID NO: 2012187 - RNA, 14 nt, Human
ugauuugagauuuu

SEQ ID NO: 2012188 - RNA, 17 nt, Human
agccacggccaggccag

SEQ ID NO: 2012189 - RNA, 18 nt, Human
agccacggccaggccaga

SEQ ID NO: 2012190 - RNA, 12 nt, Human
ugauuuauuaac

SEQ ID NO: 2012191 - RNA, 15 nt, Human
ugauuuauuaacuua

SEQ ID NO: 2012192 - RNA, 16 nt, Human
ugauuuauuaacuuaa

SEQ ID NO: 2012193 - RNA, 13 nt, Human
ugauuucauucaa

SEQ ID NO: 2012194 - RNA, 13 nt, Human
ugauuucagaaac

SEQ ID NO: 2012195 - RNA, 19 nt, Human
ugauuuauuaacuuaauaa

SEQ ID NO: 2012196 - RNA, 22 nt, Human
ugauuuauuaacuuaauaauca

SEQ ID NO: 2012197 - RNA, 15 nt, Human
ugauuucacaaauau

SEQ ID NO: 2012198 - RNA, 16 nt, Human
ugauuucacaaauauu

SEQ ID NO: 2012199 - RNA, 19 nt, Human
ugauuucacaaauauuaaa

SEQ ID NO: 2012200 - RNA, 20 nt, Human
ugauuucacaaauauuaaaa

SEQ ID NO: 2012201 - RNA, 23 nt, Human
ugauuucacaaauauuaaaaagu

SEQ ID NO: 2012202 - RNA, 14 nt, Human
ugauuucacagugu

SEQ ID NO: 2012203 - RNA, 16 nt, Human
ugauuucacagugugu

SEQ ID NO: 2012204 - RNA, 14 nt, Human
ugcaauauauuuug

SEQ ID NO: 2012205 - RNA, 15 nt, Human
ugcaauauauuuugu

SEQ ID NO: 2012206 - RNA, 16 nt, Human
ugcaauauauuuugua

SEQ ID NO: 2012207 - RNA, 18 nt, Human
ugcaauauauuuuguaug

SEQ ID NO: 2012208 - RNA, 20 nt, Human
ugcaauauauuuuguaugca

SEQ ID NO: 2012209 - RNA, 21 nt, Human
ugcaauauauuuuguaugcaa

SEQ ID NO: 2012210 - RNA, 12 nt, Human
agcccaggccuc

SEQ ID NO: 2012211 - RNA, 18 nt, Human
ugcaaucuauaauauuug

SEQ ID NO: 2012212 - RNA, 15 nt, Human
ugcaauccuuacaaa

SEQ ID NO: 2012213 - RNA, 16 nt, Human
ugcaauccuuacaaau

SEQ ID NO: 2012214 - RNA, 17 nt, Human
ugcaauccuuacaaaug

SEQ ID NO: 2012215 - RNA, 20 nt, Human
ugcaauccuuacaaaugauu

SEQ ID NO: 2012216 - RNA, 12 nt, Human
ugcaauccuuac

SEQ ID NO: 2012217 - RNA, 14 nt, Human
ugcaauccuuacaa

SEQ ID NO: 2012218 - RNA, 20 nt, Human
ugcaagggcggccuuuccca

SEQ ID NO: 2012219 - RNA, 19 nt, Human
ugcaaggucuugcauuuaa

SEQ ID NO: 2012220 - RNA, 15 nt, Human
ugcaaggucauuuuu

SEQ ID NO: 2012221 - RNA, 15 nt, Human
ugcaagguaaaauuu

SEQ ID NO: 2012222 - RNA, 16 nt, Human
ugcaagguaaaauuuu

SEQ ID NO: 2012223 - RNA, 13 nt, Human
ugcaagcuuuucc

SEQ ID NO: 2012224 - RNA, 17 nt, Human
ugcaagcuuuuccuaau

SEQ ID NO: 2012225 - RNA, 23 nt, Human
ugcaagcaguuucaauaaaguuu

SEQ ID NO: 2012226 - RNA, 23 nt, Human
ugcaagccccugcuccagaagau

SEQ ID NO: 2012227 - RNA, 17 nt, Human
ugcaagcaguuucaaua

SEQ ID NO: 2012228 - RNA, 21 nt, Human
ugcaagcaguuucaauaaagu

SEQ ID NO: 2012229 - RNA, 15 nt, Human
ugcaagcaguuucaa

SEQ ID NO: 2012230 - RNA, 13 nt, Human
ugcaacaggcugg

SEQ ID NO: 2012231 - RNA, 16 nt, Human
ugcaacaaaauacauu

SEQ ID NO: 2012232 - RNA, 12 nt, Human
ugcaacaaaaua

SEQ ID NO: 2012233 - RNA, 15 nt, Human
agcccgggcucugcc

SEQ ID NO: 2012234 - RNA, 14 nt, Human
agcccgggcucugc

SEQ ID NO: 2012235 - RNA, 13 nt, Human
agcccgggcucug

SEQ ID NO: 2012236 - RNA, 19 nt, Human
agccccuucugacccaugc

SEQ ID NO: 2012237 - RNA, 16 nt, Human
agccccuucugaccca

SEQ ID NO: 2012238 - RNA, 15 nt, Human
agccccuucugaccc

SEQ ID NO: 2012239 - RNA, 14 nt, Human
agccccuucugacc

SEQ ID NO: 2012240 - RNA, 19 nt, Human
agcccugcagagggcacag

SEQ ID NO: 2012241 - RNA, 16 nt, Human
agcccugcagagggca

SEQ ID NO: 2012242 - RNA, 15 nt, Human
agcccugcagagggc

SEQ ID NO: 2012243 - RNA, 14 nt, Human
agcccugcagaggg

SEQ ID NO: 2012244 - RNA, 20 nt, Human
agcccugaguuccuagccac

SEQ ID NO: 2012245 - RNA, 23 nt, Human
agcccugaguuccuagccaccgc

SEQ ID NO: 2012246 - RNA, 23 nt, Human
agcccugauguguccucagggag

SEQ ID NO: 2012247 - RNA, 18 nt, Human
agcccugaguuccuagcc

SEQ ID NO: 2012248 - RNA, 16 nt, Human
agcccgggcucugccu

SEQ ID NO: 2012249 - RNA, 12 nt, Human
agcccccugguc

SEQ ID NO: 2012250 - RNA, 18 nt, Human
agcccccuggucuuugag

SEQ ID NO: 2012251 - RNA, 22 nt, Human
agcccccuggucuuugagcucc

SEQ ID NO: 2012252 - RNA, 19 nt, Human
agcccaggccuccuacagc

SEQ ID NO: 2012253 - RNA, 14 nt, Human
agcccaggccuccu

SEQ ID NO: 2012254 - RNA, 14 nt, Human
agccccgaggccuu

SEQ ID NO: 2012255 - RNA, 21 nt, Human
agccccucuccccgcaguguu

SEQ ID NO: 2012256 - RNA, 18 nt, Human
agccccgugggguuccuc

SEQ ID NO: 2012257 - RNA, 15 nt, Human
agccccucccuccuc

SEQ ID NO: 2012258 - RNA, 16 nt, Human
agccccucccuccucu

SEQ ID NO: 2012259 - RNA, 18 nt, Human
agccccucccuccucuga

SEQ ID NO: 2012260 - RNA, 15 nt, Human
ugcacuccagccuga

SEQ ID NO: 2012261 - RNA, 14 nt, Human
ugcacuccagccug

SEQ ID NO: 2012262 - RNA, 14 nt, Human
ugcacucagcucuu

SEQ ID NO: 2012263 - RNA, 16 nt, Human
ugcacucagacuguau

SEQ ID NO: 2012264 - RNA, 16 nt, Human
ugcaccggcuggccug

SEQ ID NO: 2012265 - RNA, 15 nt, Human
ugcaccggcuggccu

SEQ ID NO: 2012266 - RNA, 14 nt, Human
ugcaccggcuggcc

SEQ ID NO: 2012267 - RNA, 13 nt, Human
ugcaccccuuccu

SEQ ID NO: 2012268 - RNA, 15 nt, Human
ugcaccccuuccugg

SEQ ID NO: 2012269 - RNA, 16 nt, Human
ugcaccccuuccuggg

SEQ ID NO: 2012270 - RNA, 17 nt, Human
ugcaccccuuccugggc

SEQ ID NO: 2012271 - RNA, 18 nt, Human
ugcaccccuuccugggca

SEQ ID NO: 2012272 - RNA, 19 nt, Human
ugcaccccuuccugggcac

SEQ ID NO: 2012273 - RNA, 17 nt, Human
ugcacuccagccugagc

SEQ ID NO: 2012274 - RNA, 15 nt, Human
ugcacuccagccugg

SEQ ID NO: 2012275 - RNA, 16 nt, Human
ugcacuccagccuggg

SEQ ID NO: 2012276 - RNA, 22 nt, Human
ugcagaagacaguauggcagcu

SEQ ID NO: 2012277 - RNA, 17 nt, Human
ugcagaauggcauuugc

SEQ ID NO: 2012278 - RNA, 18 nt, Human
ugcagaauggcauuugca

SEQ ID NO: 2012279 - RNA, 21 nt, Human
ugcagaauggcauuugcaaua

SEQ ID NO: 2012280 - RNA, 22 nt, Human
ugcagaauggcauuugcaauaa

SEQ ID NO: 2012281 - RNA, 15 nt, Human
ugcagaagggagcug

SEQ ID NO: 2012282 - RNA, 22 nt, Human
ugcagaagggagcuggcuccag

SEQ ID NO: 2012283 - RNA, 21 nt, Human
ugcaccacugcacuccagccu

SEQ ID NO: 2012284 - RNA, 13 nt, Human
ugcaccagcccuu

SEQ ID NO: 2012285 - RNA, 21 nt, Human
ugcaccagguagaacgccagg

SEQ ID NO: 2012286 - RNA, 13 nt, Human
ugcaccauacuca

SEQ ID NO: 2012287 - RNA, 17 nt, Human
ugcaccauacucaugca

SEQ ID NO: 2012288 - RNA, 20 nt, Human
agcccugggaggcucuggag

SEQ ID NO: 2012289 - RNA, 18 nt, Human
agcccugggaggcucugg

SEQ ID NO: 2012290 - RNA, 17 nt, Human
agcccugggaggcucug

SEQ ID NO: 2012291 - RNA, 22 nt, Human
agcccugccucuccgccccuga

SEQ ID NO: 2012292 - RNA, 13 nt, Human
agcccugccucuc

SEQ ID NO: 2012293 - RNA, 15 nt, Human
agcccugccucuccg

SEQ ID NO: 2012294 - RNA, 16 nt, Human
agcccugccucuccgc

SEQ ID NO: 2012295 - RNA, 18 nt, Human
agcccugccucuccgccc

SEQ ID NO: 2012296 - RNA, 16 nt, Human
agcauauucaggaagc

SEQ ID NO: 2012297 - RNA, 18 nt, Human
agcaucacuuaaaacacg

SEQ ID NO: 2012298 - RNA, 22 nt, Human
agcaucacuuaaaacacguuuu

SEQ ID NO: 2012299 - RNA, 14 nt, Human
agcaucacuuaaaa

SEQ ID NO: 2012300 - RNA, 16 nt, Human
agcaucacuuaaaaca

SEQ ID NO: 2012301 - RNA, 17 nt, Human
agcaucacuuaaaacac

SEQ ID NO: 2012302 - RNA, 21 nt, Human
agcaucaggccaggcccucug

SEQ ID NO: 2012303 - RNA, 22 nt, Human
agcaucaggccaggcccucugc

SEQ ID NO: 2012304 - RNA, 23 nt, Human
agcaucaggccaggcccucugcc

SEQ ID NO: 2012305 - RNA, 20 nt, Human
agcaucaguacuuguuucua

SEQ ID NO: 2012306 - RNA, 13 nt, Human
agcauccuggaau

SEQ ID NO: 2012307 - RNA, 14 nt, Human
agcauccuggaaua

SEQ ID NO: 2012308 - RNA, 15 nt, Human
agcauccuggaauau

SEQ ID NO: 2012309 - RNA, 13 nt, Human
agcauggcugcca

SEQ ID NO: 2012310 - RNA, 21 nt, Human
ugauacagaaaaguugaauuu

SEQ ID NO: 2012311 - RNA, 18 nt, Human
ugauacaaugcugugccc

SEQ ID NO: 2012312 - RNA, 21 nt, Human
ugauaauuuuccuuuaauaug

SEQ ID NO: 2012313 - RNA, 21 nt, Human
agcauauucaggaagcucagg

SEQ ID NO: 2012314 - RNA, 20 nt, Human
agcaucacaugaacuuguaa

SEQ ID NO: 2012315 - RNA, 19 nt, Human
agcauauucaggaagcuca

SEQ ID NO: 2012316 - RNA, 17 nt, Human
agcauauucaggaagcu

SEQ ID NO: 2012317 - RNA, 18 nt, Human
ugaucacggcucacugca

SEQ ID NO: 2012318 - RNA, 14 nt, Human
ugaucaccugcccu

SEQ ID NO: 2012319 - RNA, 15 nt, Human
ugaucacggcucacu

SEQ ID NO: 2012320 - RNA, 13 nt, Human
ugaucacggcuca

SEQ ID NO: 2012321 - RNA, 14 nt, Human
ugaucacggcucac

SEQ ID NO: 2012322 - RNA, 16 nt, Human
agcauuagugggaaaa

SEQ ID NO: 2012323 - RNA, 21 nt, Human
agcauuauaaucaccagggcc

SEQ ID NO: 2012324 - RNA, 17 nt, Human
agcauuagauuucucau

SEQ ID NO: 2012325 - RNA, 19 nt, Human
agcauggcugccaauggga

SEQ ID NO: 2012326 - RNA, 14 nt, Human
agcauuacaggcaa

SEQ ID NO: 2012327 - RNA, 17 nt, Human
agcauuaccucuuugga

SEQ ID NO: 2012328 - RNA, 19 nt, Human
agcauuaccucuuuggaaa

SEQ ID NO: 2012329 - RNA, 23 nt, Human
agcauuaccucuuuggaaaagga

SEQ ID NO: 2012330 - RNA, 14 nt, Human
agcauucggaggga

SEQ ID NO: 2012331 - RNA, 18 nt, Human
agcauucucacuccuacc

SEQ ID NO: 2012332 - RNA, 20 nt, Human
agcauucucacuccuaccug

SEQ ID NO: 2012333 - RNA, 14 nt, Human
agcauuccagucag

SEQ ID NO: 2012334 - RNA, 22 nt, Human
agcauucucacuccuaccuggu

SEQ ID NO: 2012335 - RNA, 12 nt, Human
agcauucucucc

SEQ ID NO: 2012336 - RNA, 13 nt, Human
agcauuuuguaau

SEQ ID NO: 2012337 - RNA, 14 nt, Human
agcauuuuggcgcu

SEQ ID NO: 2012338 - RNA, 22 nt, Human
agcauuuugcuaaaugugaaug

SEQ ID NO: 2012339 - RNA, 15 nt, Human
agcauuuugcuaaau

SEQ ID NO: 2012340 - RNA, 23 nt, Human
agccaaaaugugagugguugaau

SEQ ID NO: 2012341 - RNA, 15 nt, Human
agccaaaauuaaggu

SEQ ID NO: 2012342 - RNA, 18 nt, Human
agccaaacauccuacaag

SEQ ID NO: 2012343 - RNA, 17 nt, Human
agccaaaauuaaggugu

SEQ ID NO: 2012344 - RNA, 18 nt, Human
agccaaaauuaagguguu

SEQ ID NO: 2012345 - RNA, 18 nt, Human
agccaaacacacagaagg

SEQ ID NO: 2012346 - RNA, 22 nt, Human
agccaaacacacagaaggggac

SEQ ID NO: 2012347 - RNA, 17 nt, Human
agcauuuguguugaaga

SEQ ID NO: 2012348 - RNA, 18 nt, Human
agcauuuguguugaagag

SEQ ID NO: 2012349 - RNA, 16 nt, Human
agcauuuguguguuac

SEQ ID NO: 2012350 - RNA, 17 nt, Human
agcauuuaugguaauca

SEQ ID NO: 2012351 - RNA, 13 nt, Human
agcauuuggugcu

SEQ ID NO: 2012352 - RNA, 14 nt, Human
agcauuuggugcuu

SEQ ID NO: 2012353 - RNA, 15 nt, Human
agcauuuggugcuug

SEQ ID NO: 2012354 - RNA, 12 nt, Human
agcauuugauau

SEQ ID NO: 2012355 - RNA, 16 nt, Human
agcauuugacuuucug

SEQ ID NO: 2012356 - RNA, 17 nt, Human
agcauuugacuuucugu

SEQ ID NO: 2012357 - RNA, 21 nt, Human
agcauuugacuuucugucugu

SEQ ID NO: 2012358 - RNA, 21 nt, Human
agccacacucugggcuccaga

SEQ ID NO: 2012359 - RNA, 13 nt, Human
agccaccacgccc

SEQ ID NO: 2012360 - RNA, 14 nt, Human
agccaccagaugug

SEQ ID NO: 2012361 - RNA, 22 nt, Human
agccaccagaugugacaguguu

SEQ ID NO: 2012362 - RNA, 18 nt, Human
ugauccucccaccucagc

SEQ ID NO: 2012363 - RNA, 20 nt, Human
ugaucccuuccaccugcucu

SEQ ID NO: 2012364 - RNA, 23 nt, Human
ugaucccuuccaccugcucugcu

SEQ ID NO: 2012365 - RNA, 13 nt, Human
ugaucuaggaaga

SEQ ID NO: 2012366 - RNA, 19 nt, Human
ugauccucccaccucagcc

SEQ ID NO: 2012367 - RNA, 20 nt, Human
ugauccucccaccucagccu

SEQ ID NO: 2012368 - RNA, 13 nt, Human
ugauccagaaaga

SEQ ID NO: 2012369 - RNA, 18 nt, Human
ugauccacucgccuucau

SEQ ID NO: 2012370 - RNA, 14 nt, Human
ugauccacucgccu

SEQ ID NO: 2012371 - RNA, 14 nt, Human
agccacccaaagca

SEQ ID NO: 2012372 - RNA, 15 nt, Human
agccacccaaagcag

SEQ ID NO: 2012373 - RNA, 18 nt, Human
agccacccaaagcagugg

SEQ ID NO: 2012374 - RNA, 23 nt, Human
ugauccagaaagaaaacuuguau

SEQ ID NO: 2012375 - RNA, 15 nt, Human
ugaugggucaguugu

SEQ ID NO: 2012376 - RNA, 17 nt, Human
ugaugggcagccugcug

SEQ ID NO: 2012377 - RNA, 22 nt, Human
ugaugggcagccugcuggucag

SEQ ID NO: 2012378 - RNA, 22 nt, Human
ugauggggcccugccuccuuug

SEQ ID NO: 2012379 - RNA, 19 nt, Human
ugauggguuaguggaugga

SEQ ID NO: 2012380 - RNA, 23 nt, Human
ugauggguuaguggauggaaggg

SEQ ID NO: 2012381 - RNA, 17 nt, Human
ugauguuuuccaugagu

SEQ ID NO: 2012382 - RNA, 21 nt, Human
ugauguuuuaaggaugcuugu

SEQ ID NO: 2012383 - RNA, 19 nt, Human
ugauguuuuccaugagucc

SEQ ID NO: 2012384 - RNA, 23 nt, Human
ugauguuuuccaugaguccccug

SEQ ID NO: 2012385 - RNA, 17 nt, Human
ugauuaaauucuugcaa

SEQ ID NO: 2012386 - RNA, 20 nt, Human
ugauuaaccacuucagcuga

SEQ ID NO: 2012387 - RNA, 13 nt, Human
ugauuaaauucuu

SEQ ID NO: 2012388 - RNA, 16 nt, Human
ugauuaaauucuugca

SEQ ID NO: 2012389 - RNA, 16 nt, Human
agccacggccaggcca

SEQ ID NO: 2012390 - RNA, 17 nt, Human
ugauuaacucaguccug

SEQ ID NO: 2012391 - RNA, 13 nt, Human
ugauuaacuugga

SEQ ID NO: 2012392 - RNA, 14 nt, Human
ugauuaacuuggau

SEQ ID NO: 2012393 - RNA, 21 nt, Human
ugauuaacuuggaugaguuuu

SEQ ID NO: 2012394 - RNA, 15 nt, Human
ugaucuaggaagacu

SEQ ID NO: 2012395 - RNA, 14 nt, Human
ugaucuaggaagac

SEQ ID NO: 2012396 - RNA, 18 nt, Human
ugaugaaaauauuuaaag

SEQ ID NO: 2012397 - RNA, 22 nt, Human
ugaugaaaugaggucagagccu

SEQ ID NO: 2012398 - RNA, 23 nt, Human
ugaugaaaugaggucagagccug

SEQ ID NO: 2012399 - RNA, 18 nt, Human
ugaugaaauguaaauacu

SEQ ID NO: 2012400 - RNA, 19 nt, Human
ugaugaucuuugcagacag

SEQ ID NO: 2012401 - RNA, 20 nt, Human
ugaugaucuuugcagacagg

SEQ ID NO: 2012402 - RNA, 17 nt, Human
ugauggcuuaugauagc

SEQ ID NO: 2012403 - RNA, 21 nt, Human
ugaugggcaacccccagccug

SEQ ID NO: 2012404 - RNA, 13 nt, Human
ugauggggcccug

SEQ ID NO: 2012405 - RNA, 22 nt, Human
ugaugggcaacccccagccugc

SEQ ID NO: 2012406 - RNA, 19 nt, Human
ugaugaaauaacacagcag

SEQ ID NO: 2012407 - RNA, 21 nt, Human
ugaugaucuuugcagacaggc

SEQ ID NO: 2012408 - RNA, 19 nt, Human
agcaggcucucaggccagc

SEQ ID NO: 2012409 - RNA, 18 nt, Human
agcaggcucucaggccag

SEQ ID NO: 2012410 - RNA, 17 nt, Human
agcaggcucucaggcca

SEQ ID NO: 2012411 - RNA, 16 nt, Human
agcaggcucucaggcc

SEQ ID NO: 2012412 - RNA, 15 nt, Human
agcaggcucucaggc

SEQ ID NO: 2012413 - RNA, 14 nt, Human
agcaggcucucagg

SEQ ID NO: 2012414 - RNA, 13 nt, Human
agcaggcucucag

SEQ ID NO: 2012415 - RNA, 17 nt, Human
agcaggcucgggcuccc

SEQ ID NO: 2012416 - RNA, 23 nt, Human
agcaggcucucaggccagcugcu

SEQ ID NO: 2012417 - RNA, 22 nt, Human
agcaggcucucaggccagcugc

SEQ ID NO: 2012418 - RNA, 21 nt, Human
agcaggcucucaggccagcug

SEQ ID NO: 2012419 - RNA, 13 nt, Human
agcagggaaacag

SEQ ID NO: 2012420 - RNA, 15 nt, Human
agcaggcugugaguu

SEQ ID NO: 2012421 - RNA, 14 nt, Human
agcagggaaacagc

SEQ ID NO: 2012422 - RNA, 15 nt, Human
agcagggaaacagcu

SEQ ID NO: 2012423 - RNA, 20 nt, Human
agcagguccccagcuuuggc

SEQ ID NO: 2012424 - RNA, 21 nt, Human
agcagguccccagcuuuggcu

SEQ ID NO: 2012425 - RNA, 22 nt, Human
agcagggcucagcggggacagc

SEQ ID NO: 2012426 - RNA, 16 nt, Human
agcagggaaggccuga

SEQ ID NO: 2012427 - RNA, 17 nt, Human
agcagggaaggccugac

SEQ ID NO: 2012428 - RNA, 12 nt, Human
agcagggaaggc

SEQ ID NO: 2012429 - RNA, 14 nt, Human
agcagggaaggccu

SEQ ID NO: 2012430 - RNA, 15 nt, Human
agcagggaaggccug

SEQ ID NO: 2012431 - RNA, 22 nt, Human
agcaggcuucuaugaaagacuc

SEQ ID NO: 2012432 - RNA, 20 nt, Human
agcagggagggcuucugcca

SEQ ID NO: 2012433 - RNA, 13 nt, Human
agcagggcucagc

SEQ ID NO: 2012434 - RNA, 14 nt, Human
agcagggcucagcg

SEQ ID NO: 2012435 - RNA, 15 nt, Human
agcagggcucagcgg

SEQ ID NO: 2012436 - RNA, 19 nt, Human
ugacccaugcugcccugug

SEQ ID NO: 2012437 - RNA, 18 nt, Human
ugacccaugcugcccugu

SEQ ID NO: 2012438 - RNA, 17 nt, Human
ugacccaugcugcccug

SEQ ID NO: 2012439 - RNA, 20 nt, Human
ugacccaugcugcccuguga

SEQ ID NO: 2012440 - RNA, 11 nt, Human
agcagccacau

SEQ ID NO: 2012441 - RNA, 15 nt, Human
agcagccacauuccu

SEQ ID NO: 2012442 - RNA, 13 nt, Human
agcaggacaugga

SEQ ID NO: 2012443 - RNA, 16 nt, Human
agcagcagggagggcu

SEQ ID NO: 2012444 - RNA, 15 nt, Human
agcaggaggcuggga

SEQ ID NO: 2012445 - RNA, 14 nt, Human
agcaggagggacag

SEQ ID NO: 2012446 - RNA, 10 nt, Human
agcaggaggc

SEQ ID NO: 2012447 - RNA, 18 nt, Human
agcaggagggacagucuc

SEQ ID NO: 2012448 - RNA, 19 nt, Human
agcaggagggacagucuca

SEQ ID NO: 2012449 - RNA, 11 nt, Human
agcaggcagcc

SEQ ID NO: 2012450 - RNA, 23 nt, Human
agcaggcccaugggaggcuggag

SEQ ID NO: 2012451 - RNA, 10 nt, Human
agcaggcagc

SEQ ID NO: 2012452 - RNA, 13 nt, Human
agcaggcagccuu

SEQ ID NO: 2012453 - RNA, 11 nt, Human
agcauaaagaa

SEQ ID NO: 2012454 - RNA, 20 nt, Human
agcaguuuucuuuuaauuuu

SEQ ID NO: 2012455 - RNA, 23 nt, Human
agcauaaaaauuagccaagugug

SEQ ID NO: 2012456 - RNA, 15 nt, Human
agcauauaaaauggc

SEQ ID NO: 2012457 - RNA, 19 nt, Human
agcauauaaaauggcaaca

SEQ ID NO: 2012458 - RNA, 23 nt, Human
agcauauaaaauggcaacaaacu

SEQ ID NO: 2012459 - RNA, 14 nt, Human
agcauauaaaaugg

SEQ ID NO: 2012460 - RNA, 16 nt, Human
agcauagcucuguaca

SEQ ID NO: 2012461 - RNA, 16 nt, Human
ugaguacguugugcau

SEQ ID NO: 2012462 - RNA, 17 nt, Human
ugaguacguugugcauu

SEQ ID NO: 2012463 - RNA, 18 nt, Human
ugaguacguugugcauuu

SEQ ID NO: 2012464 - RNA, 19 nt, Human
ugaguacguugugcauuug

SEQ ID NO: 2012465 - RNA, 22 nt, Human
agcagguuaaauguuuuguaaa

SEQ ID NO: 2012466 - RNA, 18 nt, Human
agcaggugugagggcagu

SEQ ID NO: 2012467 - RNA, 14 nt, Human
agcagguuaaaugu

SEQ ID NO: 2012468 - RNA, 15 nt, Human
agcagguuaaauguu

SEQ ID NO: 2012469 - RNA, 16 nt, Human
agcagguuaaauguuu

SEQ ID NO: 2012470 - RNA, 18 nt, Human
agcagguuaaauguuuug

SEQ ID NO: 2012471 - RNA, 20 nt, Human
agcagguuaaauguuuugua

SEQ ID NO: 2012472 - RNA, 15 nt, Human
agcaguaagggaaca

SEQ ID NO: 2012473 - RNA, 16 nt, Human
agcaguaucaugaagc

SEQ ID NO: 2012474 - RNA, 19 nt, Human
agcauaaaaauuagccaag

SEQ ID NO: 2012475 - RNA, 14 nt, Human
agcaguuugcuuug

SEQ ID NO: 2012476 - RNA, 20 nt, Human
agcaguuucaauaaaguuug

SEQ ID NO: 2012477 - RNA, 21 nt, Human
agcaguuucaauaaaguuuga

SEQ ID NO: 2012478 - RNA, 14 nt, Human
agcaguuucaggua

SEQ ID NO: 2012479 - RNA, 15 nt, Human
agcaguuucaauaaa

SEQ ID NO: 2012480 - RNA, 17 nt, Human
agcaguuucaauaaagu

SEQ ID NO: 2012481 - RNA, 14 nt, Human
ugauacaaugcugu

SEQ ID NO: 2012482 - RNA, 15 nt, Human
ugauacaaugcugug

SEQ ID NO: 2012483 - RNA, 14 nt, Human
ugauaauuuuccuu

SEQ ID NO: 2012484 - RNA, 17 nt, Human
ugauaauuuuccuuuaa

SEQ ID NO: 2012485 - RNA, 19 nt, Human
ugauaauuuuccuuuaaua

SEQ ID NO: 2012486 - RNA, 13 nt, Human
ugauaauuuuccu

SEQ ID NO: 2012487 - RNA, 13 nt, Human
ugauaauagaaga

SEQ ID NO: 2012488 - RNA, 15 nt, Human
ugauaauagaagagu

SEQ ID NO: 2012489 - RNA, 21 nt, Human
ugagugggggaucacagccuc

SEQ ID NO: 2012490 - RNA, 21 nt, Human
ugagugugauccaguuuuuca

SEQ ID NO: 2012491 - RNA, 14 nt, Human
ugaguuccuagcca

SEQ ID NO: 2012492 - RNA, 24 nt, Human
ugaguuacuugcugcccugugcuc

SEQ ID NO: 2012493 - RNA, 18 nt, Human
ugaguuccuagccaccgc

SEQ ID NO: 2012494 - RNA, 17 nt, Human
ugaguuccggcaccagu

SEQ ID NO: 2012495 - RNA, 18 nt, Human
ugaguucauacccuguua

SEQ ID NO: 2012496 - RNA, 20 nt, Human
ugaguccaaacuggaaugag

SEQ ID NO: 2012497 - RNA, 14 nt, Human
ugaguacuacaguc

SEQ ID NO: 2012498 - RNA, 20 nt, Human
ugaguacaugcacacucaug

SEQ ID NO: 2012499 - RNA, 20 nt, Human
ugaguacguugugcauuugg

SEQ ID NO: 2012500 - RNA, 18 nt, Human
ugagucaccaagcccagu

SEQ ID NO: 2012501 - RNA, 16 nt, Human
ugagugccuuacacaa

SEQ ID NO: 2012502 - RNA, 18 nt, Human
ugagugcaggcccacccu

SEQ ID NO: 2012503 - RNA, 14 nt, Human
ugagugcauguacu

SEQ ID NO: 2012504 - RNA, 14 nt, Human
ugagugccuuacac

SEQ ID NO: 2012505 - RNA, 13 nt, Human
ugagugccuuaca

SEQ ID NO: 2012506 - RNA, 17 nt, Human
ugagugcagcucuggag

SEQ ID NO: 2012507 - RNA, 13 nt, Human
ugagugcaggccc

SEQ ID NO: 2012508 - RNA, 14 nt, Human
ugagugcaggccca

SEQ ID NO: 2012509 - RNA, 15 nt, Human
ugagugcaggcccac

SEQ ID NO: 2012510 - RNA, 16 nt, Human
ugagugcaggcccacc

SEQ ID NO: 2012511 - RNA, 18 nt, Human
agagcagagaccaucccu

SEQ ID NO: 2012512 - RNA, 17 nt, Human
agagcagagaccauccc

SEQ ID NO: 2012513 - RNA, 20 nt, Human
agagcagagaccaucccuga

SEQ ID NO: 2012514 - RNA, 22 nt, Human
agagcagaaauucuguuuuuaa

SEQ ID NO: 2012515 - RNA, 12 nt, Human
agagcagcaagg

SEQ ID NO: 2012516 - RNA, 16 nt, Human
agagcagugggccugg

SEQ ID NO: 2012517 - RNA, 19 nt, Human
agagcagcaaggucuugcu

SEQ ID NO: 2012518 - RNA, 23 nt, Human
agagcauuauaaucaccagggcc

SEQ ID NO: 2012519 - RNA, 16 nt, Human
agagcauuccagucag

SEQ ID NO: 2012520 - RNA, 17 nt, Human
agagcauuccagucagg

SEQ ID NO: 2012521 - RNA, 18 nt, Human
agagcauuccagucaggc

SEQ ID NO: 2012522 - RNA, 19 nt, Human
agagcauuccagucaggcu

SEQ ID NO: 2012523 - RNA, 21 nt, Human
agagcauuccagucaggcucu

SEQ ID NO: 2012524 - RNA, 21 nt, Human
agagccuugcggaagguucua

SEQ ID NO: 2012525 - RNA, 11 nt, Human
agagccuugcg

SEQ ID NO: 2012526 - RNA, 13 nt, Human
agagcaagagagc

SEQ ID NO: 2012527 - RNA, 16 nt, Human
agagcaagagagcagc

SEQ ID NO: 2012528 - RNA, 20 nt, Human
agagcaagagagcagcaagg

SEQ ID NO: 2012529 - RNA, 17 nt, Human
agagcaaggaagguaaa

SEQ ID NO: 2012530 - RNA, 21 nt, Human
agagcaaggaagguaaaaagu

SEQ ID NO: 2012531 - RNA, 23 nt, Human
agagcaaggaagguaaaaaguua

SEQ ID NO: 2012532 - RNA, 12 nt, Human
agagcagagacc

SEQ ID NO: 2012533 - RNA, 14 nt, Human
agagcagaaauucu

SEQ ID NO: 2012534 - RNA, 15 nt, Human
agagcagaaauucug

SEQ ID NO: 2012535 - RNA, 17 nt, Human
agagcagaaauucuguu

SEQ ID NO: 2012536 - RNA, 20 nt, Human
agagcagaaauucuguuuuu

SEQ ID NO: 2012537 - RNA, 21 nt, Human
ucuuuggacccugaggcccag

SEQ ID NO: 2012538 - RNA, 17 nt, Human
ucuuuggacccugaggc

SEQ ID NO: 2012539 - RNA, 14 nt, Human
agagauuuggggcu

SEQ ID NO: 2012540 - RNA, 21 nt, Human
agagauuuggggcuaaagacu

SEQ ID NO: 2012541 - RNA, 22 nt, Human
agagauuuggggcuaaagacug

SEQ ID NO: 2012542 - RNA, 23 nt, Human
ugaaauuuccugggagcuuuugu

SEQ ID NO: 2012543 - RNA, 22 nt, Human
ugaaauacauaugauaaauuug

SEQ ID NO: 2012544 - RNA, 22 nt, Human
ugaaauauauggucuaauguuu

SEQ ID NO: 2012545 - RNA, 15 nt, Human
ugaaauuguauuaca

SEQ ID NO: 2012546 - RNA, 18 nt, Human
agagcugccaccugccug

SEQ ID NO: 2012547 - RNA, 15 nt, Human
agagcguugaaguug

SEQ ID NO: 2012548 - RNA, 12 nt, Human
agagcugccagu

SEQ ID NO: 2012549 - RNA, 13 nt, Human
agagcugccagug

SEQ ID NO: 2012550 - RNA, 18 nt, Human
agagccuuuuucuaggcc

SEQ ID NO: 2012551 - RNA, 15 nt, Human
agagcgacagagcag

SEQ ID NO: 2012552 - RNA, 16 nt, Human
agagcgacagagcagu

SEQ ID NO: 2012553 - RNA, 14 nt, Human
agagcgcagcaucc

SEQ ID NO: 2012554 - RNA, 17 nt, Human
ugaaauaagccagacau

SEQ ID NO: 2012555 - RNA, 18 nt, Human
ugaaauaagccagacauc

SEQ ID NO: 2012556 - RNA, 20 nt, Human
ugaaauaagccagacaucaa

SEQ ID NO: 2012557 - RNA, 23 nt, Human
ugaaauaagccagacaucaacag

SEQ ID NO: 2012558 - RNA, 13 nt, Human
ugaaagugccuuu

SEQ ID NO: 2012559 - RNA, 14 nt, Human
ugaaagugccuuug

SEQ ID NO: 2012560 - RNA, 16 nt, Human
ugaaagugccuuugca

SEQ ID NO: 2012561 - RNA, 17 nt, Human
ugaaagugccuuugcag

SEQ ID NO: 2012562 - RNA, 21 nt, Human
ugaaagugccuuugcagcuca

SEQ ID NO: 2012563 - RNA, 18 nt, Human
agaguaaucuuguugguu

SEQ ID NO: 2012564 - RNA, 12 nt, Human
agaguacacugc

SEQ ID NO: 2012565 - RNA, 13 nt, Human
agaguacacugcc

SEQ ID NO: 2012566 - RNA, 15 nt, Human
agaguacacugccug

SEQ ID NO: 2012567 - RNA, 19 nt, Human
agaguacacugccugccuu

SEQ ID NO: 2012568 - RNA, 12 nt, Human
agagguuuuaaa

SEQ ID NO: 2012569 - RNA, 18 nt, Human
agagguuuggcuccugcc

SEQ ID NO: 2012570 - RNA, 20 nt, Human
agagguuuggcuccugccca

SEQ ID NO: 2012571 - RNA, 22 nt, Human
agaguaauccaagcaaauguga

SEQ ID NO: 2012572 - RNA, 18 nt, Human
agaguagagguauaauug

SEQ ID NO: 2012573 - RNA, 20 nt, Human
ugaagcaaacaguugacaau

SEQ ID NO: 2012574 - RNA, 15 nt, Human
ugaagcaaacaguug

SEQ ID NO: 2012575 - RNA, 22 nt, Human
ugaagcacagugaucaaguuau

SEQ ID NO: 2012576 - RNA, 15 nt, Human
agagguugcagugag

SEQ ID NO: 2012577 - RNA, 13 nt, Human
agagguuucagug

SEQ ID NO: 2012578 - RNA, 19 nt, Human
agagguccacaacacacag

SEQ ID NO: 2012579 - RNA, 21 nt, Human
agaggucccaagguucugggu

SEQ ID NO: 2012580 - RNA, 13 nt, Human
agagguauaauug

SEQ ID NO: 2012581 - RNA, 13 nt, Human
agaggcugaggac

SEQ ID NO: 2012582 - RNA, 21 nt, Human
agaggccccaauaccccaugg

SEQ ID NO: 2012583 - RNA, 17 nt, Human
agaggcuaugugagcac

SEQ ID NO: 2012584 - RNA, 20 nt, Human
agaggccccaauaccccaug

SEQ ID NO: 2012585 - RNA, 10 nt, Human
agaggcucag

SEQ ID NO: 2012586 - RNA, 18 nt, Human
agaggcucagauuguaau

SEQ ID NO: 2012587 - RNA, 19 nt, Human
agaggccaugggccuccug

SEQ ID NO: 2012588 - RNA, 14 nt, Human
agaggccauggagg

SEQ ID NO: 2012589 - RNA, 10 nt, Human
agaggcaggg

SEQ ID NO: 2012590 - RNA, 13 nt, Human
agaggcagggucu

SEQ ID NO: 2012591 - RNA, 18 nt, Human
agagcuuagaaacuggaa

SEQ ID NO: 2012592 - RNA, 14 nt, Human
agaggaaaagaaau

SEQ ID NO: 2012593 - RNA, 13 nt, Human
agaggcagcccca

SEQ ID NO: 2012594 - RNA, 19 nt, Human
agaggcagccccauucugc

SEQ ID NO: 2012595 - RNA, 24 nt, Human
agaggcagccccauucugccugcc

SEQ ID NO: 2012596 - RNA, 19 nt, Human
ugaacuuugaccucugcag

SEQ ID NO: 2012597 - RNA, 20 nt, Human
ugaacuuugaccucugcagc

SEQ ID NO: 2012598 - RNA, 22 nt, Human
ugaacuuugaccucugcagcaa

SEQ ID NO: 2012599 - RNA, 24 nt, Human
ugaagaaaauacuuaaauguuaug

SEQ ID NO: 2012600 - RNA, 16 nt, Human
ugaagaaacagcuaug

SEQ ID NO: 2012601 - RNA, 20 nt, Human
ugaagaaaauacuuaaaugu

SEQ ID NO: 2012602 - RNA, 22 nt, Human
ugaagaaaauacuuaaauguua

SEQ ID NO: 2012603 - RNA, 12 nt, Human
ugaagaaaauac

SEQ ID NO: 2012604 - RNA, 14 nt, Human
ugaagaaaauacuu

SEQ ID NO: 2012605 - RNA, 16 nt, Human
ugaagaaaauacuuaa

SEQ ID NO: 2012606 - RNA, 18 nt, Human
ugaagaaaauacuuaaau

SEQ ID NO: 2012607 - RNA, 14 nt, Human
agagcugcgggcug

SEQ ID NO: 2012608 - RNA, 22 nt, Human
agagcuucuguugcugccucau

SEQ ID NO: 2012609 - RNA, 15 nt, Human
agagcuuaacagugu

SEQ ID NO: 2012610 - RNA, 12 nt, Human
agagcuuagaaa

SEQ ID NO: 2012611 - RNA, 13 nt, Human
agagcuuagaaac

SEQ ID NO: 2012612 - RNA, 14 nt, Human
agagcuuagaaacu

SEQ ID NO: 2012613 - RNA, 18 nt, Human
agagcuguugaugggaug

SEQ ID NO: 2012614 - RNA, 19 nt, Human
ugaacaaauuuacagagac

SEQ ID NO: 2012615 - RNA, 20 nt, Human
ugaacaaauuuacagagaca

SEQ ID NO: 2012616 - RNA, 15 nt, Human
ugaaauuuuuauuaa

SEQ ID NO: 2012617 - RNA, 18 nt, Human
ugaacaaauuuacagaga

SEQ ID NO: 2012618 - RNA, 12 nt, Human
ugaaccugaaua

SEQ ID NO: 2012619 - RNA, 22 nt, Human
ugaaccgaugagaaauaaaguu

SEQ ID NO: 2012620 - RNA, 18 nt, Human
ugaacaacgagccuuuuc

SEQ ID NO: 2012621 - RNA, 19 nt, Human
ugaacaacgagccuuuuca

SEQ ID NO: 2012622 - RNA, 13 nt, Human
ugaacgcccagag

SEQ ID NO: 2012623 - RNA, 21 nt, Human
ugaacuaggauuguaguccca

SEQ ID NO: 2012624 - RNA, 14 nt, Human
ugaacuccuggccu

SEQ ID NO: 2012625 - RNA, 15 nt, Human
ugaacuccuggccuc

SEQ ID NO: 2012626 - RNA, 12 nt, Human
ugaacuccuggc

SEQ ID NO: 2012627 - RNA, 14 nt, Human
agagucauuguaau

SEQ ID NO: 2012628 - RNA, 16 nt, Human
agagucauuguaaugu

SEQ ID NO: 2012629 - RNA, 14 nt, Human
agaguccccccacu

SEQ ID NO: 2012630 - RNA, 23 nt, Human
agagucauuguaauguugugaau

SEQ ID NO: 2012631 - RNA, 21 nt, Human
agagucauuguaauguuguga

SEQ ID NO: 2012632 - RNA, 22 nt, Human
agagucauuguaauguugugaa

SEQ ID NO: 2012633 - RNA, 20 nt, Human
ugaaugguuuucaaaauaaa

SEQ ID NO: 2012634 - RNA, 19 nt, Human
ugaaugucagugugacuga

SEQ ID NO: 2012635 - RNA, 15 nt, Human
ugaaugucaguuguu

SEQ ID NO: 2012636 - RNA, 21 nt, Human
agaguuguuacauuuuuaagu

SEQ ID NO: 2012637 - RNA, 16 nt, Human
agaguuguuacauuuu

SEQ ID NO: 2012638 - RNA, 12 nt, Human
agaguuguuaca

SEQ ID NO: 2012639 - RNA, 20 nt, Human
agaguugaugguuguacaua

SEQ ID NO: 2012640 - RNA, 17 nt, Human
agaguuggcaugacucu

SEQ ID NO: 2012641 - RNA, 17 nt, Human
agaguugauacuacagu

SEQ ID NO: 2012642 - RNA, 20 nt, Human
agaguugauacuacaguuug

SEQ ID NO: 2012643 - RNA, 22 nt, Human
agaguugauacuacaguuuguu

SEQ ID NO: 2012644 - RNA, 22 nt, Human
agagucugagggcuuguaguuc

SEQ ID NO: 2012645 - RNA, 23 nt, Human
agagucugagggcuuguaguucu

SEQ ID NO: 2012646 - RNA, 21 nt, Human
agagucuggggaccagcuugg

SEQ ID NO: 2012647 - RNA, 12 nt, Human
agagucugaggg

SEQ ID NO: 2012648 - RNA, 14 nt, Human
agagucugagggcu

SEQ ID NO: 2012649 - RNA, 21 nt, Human
agagucugagggcuuguaguu

SEQ ID NO: 2012650 - RNA, 21 nt, Human
agaguccccccacucccagca

SEQ ID NO: 2012651 - RNA, 15 nt, Human
agaguccccccacuc

SEQ ID NO: 2012652 - RNA, 18 nt, Human
agaguccccccacuccca

SEQ ID NO: 2012653 - RNA, 16 nt, Human
agauaaaugauucaaa

SEQ ID NO: 2012654 - RNA, 12 nt, Human
agauacugaaau

SEQ ID NO: 2012655 - RNA, 21 nt, Human
agauacuacugaccagacaag

SEQ ID NO: 2012656 - RNA, 23 nt, Human
agauacuacugaccagacaagcu

SEQ ID NO: 2012657 - RNA, 13 nt, Human
agauacugaaaua

SEQ ID NO: 2012658 - RNA, 15 nt, Human
agauacugaaauaaa

SEQ ID NO: 2012659 - RNA, 12 nt, Human
agauacucuggg

SEQ ID NO: 2012660 - RNA, 14 nt, Human
agauaaauauuaua

SEQ ID NO: 2012661 - RNA, 12 nt, Human
agauaaaugugc

SEQ ID NO: 2012662 - RNA, 12 nt, Human
agauaaauauua

SEQ ID NO: 2012663 - RNA, 17 nt, Human
agauaaagguucaugca

SEQ ID NO: 2012664 - RNA, 14 nt, Human
agaucacgccacug

SEQ ID NO: 2012665 - RNA, 15 nt, Human
agaucacgccacugc

SEQ ID NO: 2012666 - RNA, 16 nt, Human
agaucacgccacugca

SEQ ID NO: 2012667 - RNA, 20 nt, Human
ugacacacagcucuguccug

SEQ ID NO: 2012668 - RNA, 11 nt, Human
ugaauuuucau

SEQ ID NO: 2012669 - RNA, 12 nt, Human
ugaauuuucauu

SEQ ID NO: 2012670 - RNA, 13 nt, Human
ugaauuuucauuu

SEQ ID NO: 2012671 - RNA, 14 nt, Human
ugaauuuucauuuu

SEQ ID NO: 2012672 - RNA, 15 nt, Human
ugaauuuucauuuua

SEQ ID NO: 2012673 - RNA, 16 nt, Human
ugaauuuucauuuuac

SEQ ID NO: 2012674 - RNA, 17 nt, Human
ugaauuuucauuuuaca

SEQ ID NO: 2012675 - RNA, 18 nt, Human
ugaauuuucauuuuacag

SEQ ID NO: 2012676 - RNA, 19 nt, Human
ugaauuuucauuuuacagu

SEQ ID NO: 2012677 - RNA, 21 nt, Human
ugaauuuucauuuuacaguua

SEQ ID NO: 2012678 - RNA, 16 nt, Human
ugaauuuuacauggcu

SEQ ID NO: 2012679 - RNA, 15 nt, Human
ugaauuucuuuugcc

SEQ ID NO: 2012680 - RNA, 17 nt, Human
agaucacgccacugcac

SEQ ID NO: 2012681 - RNA, 18 nt, Human
agaucacgccacugcacu

SEQ ID NO: 2012682 - RNA, 22 nt, Human
agauguggaaaagccaagaggc

SEQ ID NO: 2012683 - RNA, 16 nt, Human
agaugugcugcuuuga

SEQ ID NO: 2012684 - RNA, 17 nt, Human
agauguggaaaagccaa

SEQ ID NO: 2012685 - RNA, 14 nt, Human
agaugugcugcuuu

SEQ ID NO: 2012686 - RNA, 17 nt, Human
agauguuauauuuuucu

SEQ ID NO: 2012687 - RNA, 19 nt, Human
agauguuauauuuuucuua

SEQ ID NO: 2012688 - RNA, 21 nt, Human
agauguuauauuuuucuuaaa

SEQ ID NO: 2012689 - RNA, 15 nt, Human
agaugcuucucacug

SEQ ID NO: 2012690 - RNA, 15 nt, Human
agaugcugugccccu

SEQ ID NO: 2012691 - RNA, 20 nt, Human
agaugcugugccccuggccu

SEQ ID NO: 2012692 - RNA, 12 nt, Human
ugacccacugcu

SEQ ID NO: 2012693 - RNA, 13 nt, Human
ugacccacugcuu

SEQ ID NO: 2012694 - RNA, 17 nt, Human
ugacccacaagaaauga

SEQ ID NO: 2012695 - RNA, 23 nt, Human
ugaccauucuccaccugccaggg

SEQ ID NO: 2012696 - RNA, 22 nt, Human
agauccauuuuuuauauuucaa

SEQ ID NO: 2012697 - RNA, 14 nt, Human
agaugcaccagccc

SEQ ID NO: 2012698 - RNA, 15 nt, Human
agaugcaccagcccu

SEQ ID NO: 2012699 - RNA, 14 nt, Human
agaugcuagaacuc

SEQ ID NO: 2012700 - RNA, 15 nt, Human
agaugcuagaacucc

SEQ ID NO: 2012701 - RNA, 11 nt, Human
agaugccuggg

SEQ ID NO: 2012702 - RNA, 17 nt, Human
ugacagcgcacagcugc

SEQ ID NO: 2012703 - RNA, 19 nt, Human
ugacagcgcacagcugcuc

SEQ ID NO: 2012704 - RNA, 20 nt, Human
ugacaggcaaugcuggcugu

SEQ ID NO: 2012705 - RNA, 16 nt, Human
ugacagcgcacagcug

SEQ ID NO: 2012706 - RNA, 21 nt, Human
ugacacacagcucuguccugg

SEQ ID NO: 2012707 - RNA, 11 nt, Human
ugacagggcac

SEQ ID NO: 2012708 - RNA, 16 nt, Human
ugacagggcacaccgg

SEQ ID NO: 2012709 - RNA, 14 nt, Human
ugacaggccugucc

SEQ ID NO: 2012710 - RNA, 18 nt, Human
ugacaggcgaaagaaaac

SEQ ID NO: 2012711 - RNA, 21 nt, Human
ugacaguggccgcccaaggcc

SEQ ID NO: 2012712 - RNA, 21 nt, Human
ugacagggcacaccgggcacu

SEQ ID NO: 2012713 - RNA, 20 nt, Human
ugacagggcacaccgggcac

SEQ ID NO: 2012714 - RNA, 18 nt, Human
ugaccaaugauggucacc

SEQ ID NO: 2012715 - RNA, 19 nt, Human
ugacauuuagucccucaag

SEQ ID NO: 2012716 - RNA, 20 nt, Human
ugacauuguuggccaaagcc

SEQ ID NO: 2012717 - RNA, 21 nt, Human
ugacauuguuggccaaagcca

SEQ ID NO: 2012718 - RNA, 22 nt, Human
ugacauuguagagcuucuggca

SEQ ID NO: 2012719 - RNA, 15 nt, Human
agaucagccugggca

SEQ ID NO: 2012720 - RNA, 13 nt, Human
agaucagccuggg

SEQ ID NO: 2012721 - RNA, 13 nt, Human
agaucauaguuuu

SEQ ID NO: 2012722 - RNA, 14 nt, Human
agaucauaguuuua

SEQ ID NO: 2012723 - RNA, 16 nt, Human
agaucauaguuuuauu

SEQ ID NO: 2012724 - RNA, 17 nt, Human
agaucauaguuuuauuu

SEQ ID NO: 2012725 - RNA, 19 nt, Human
agaucauaguuuuauuuau

SEQ ID NO: 2012726 - RNA, 20 nt, Human
agaucauaguuuuauuuaua

SEQ ID NO: 2012727 - RNA, 22 nt, Human
agaucauaguuuuauuuauauu

SEQ ID NO: 2012728 - RNA, 12 nt, Human
agaucauuguga

SEQ ID NO: 2012729 - RNA, 23 nt, Human
agaucauaguuuuauuuauauuu

SEQ ID NO: 2012730 - RNA, 17 nt, Human
ucuuuaggucuuugccu

SEQ ID NO: 2012731 - RNA, 14 nt, Human
ucuuuaauuaaaac

SEQ ID NO: 2012732 - RNA, 20 nt, Human
ucuuuaauuaaaaccuggga

SEQ ID NO: 2012733 - RNA, 14 nt, Human
ucuuuaauuuuaca

SEQ ID NO: 2012734 - RNA, 22 nt, Human
ucuuuaaugucacaggcagguc

SEQ ID NO: 2012735 - RNA, 16 nt, Human
ucuugguuuguaaauu

SEQ ID NO: 2012736 - RNA, 20 nt, Human
ucuuuaaugucacaggcagg

SEQ ID NO: 2012737 - RNA, 13 nt, Human
ucuugguuccagc

SEQ ID NO: 2012738 - RNA, 21 nt, Human
ucuugauaauuuuccuuuaau

SEQ ID NO: 2012739 - RNA, 17 nt, Human
ucuugaucaguaguuug

SEQ ID NO: 2012740 - RNA, 17 nt, Human
ucuugguuccagccugc

SEQ ID NO: 2012741 - RNA, 18 nt, Human
ucuugguuccagccugcc

SEQ ID NO: 2012742 - RNA, 19 nt, Human
ucuugguuccagccugcca

SEQ ID NO: 2012743 - RNA, 14 nt, Human
ucuugguuuguaaa

SEQ ID NO: 2012744 - RNA, 13 nt, Human
ucuuucugcuuug

SEQ ID NO: 2012745 - RNA, 20 nt, Human
ucuuuauaauucuacuuuga

SEQ ID NO: 2012746 - RNA, 18 nt, Human
ucuuucuggcuaugcauu

SEQ ID NO: 2012747 - RNA, 19 nt, Human
ucuuucuggcuaugcauuu

SEQ ID NO: 2012748 - RNA, 14 nt, Human
ucuuucuuccucug

SEQ ID NO: 2012749 - RNA, 19 nt, Human
agacucgcgacaaugcaaa

SEQ ID NO: 2012750 - RNA, 18 nt, Human
agacucgcgacaaugcaa

SEQ ID NO: 2012751 - RNA, 17 nt, Human
agacucgcgacaaugca

SEQ ID NO: 2012752 - RNA, 15 nt, Human
agacucgcgacaaug

SEQ ID NO: 2012753 - RNA, 17 nt, Human
ucuuucuuccucugcug

SEQ ID NO: 2012754 - RNA, 15 nt, Human
ucuuucuuccucugc

SEQ ID NO: 2012755 - RNA, 16 nt, Human
ucuuucuuccucugcu

SEQ ID NO: 2012756 - RNA, 14 nt, Human
agacugucucaaga

SEQ ID NO: 2012757 - RNA, 14 nt, Human
agacuuaucaacau

SEQ ID NO: 2012758 - RNA, 16 nt, Human
agacuguacaaaguag

SEQ ID NO: 2012759 - RNA, 15 nt, Human
agacuguacaaagua

SEQ ID NO: 2012760 - RNA, 20 nt, Human
agacucgcgacaaugcaaac

SEQ ID NO: 2012761 - RNA, 22 nt, Human
agagaaaaaauauuuuccugcc

SEQ ID NO: 2012762 - RNA, 19 nt, Human
agacuuuuuuuaaauagua

SEQ ID NO: 2012763 - RNA, 17 nt, Human
agacuuuagcuuucuga

SEQ ID NO: 2012764 - RNA, 18 nt, Human
agacuuguaugaaagaug

SEQ ID NO: 2012765 - RNA, 16 nt, Human
agacuuguauauucua

SEQ ID NO: 2012766 - RNA, 18 nt, Human
agacuuguauauucuauu

SEQ ID NO: 2012767 - RNA, 21 nt, Human
agacuuguauauucuauuuua

SEQ ID NO: 2012768 - RNA, 14 nt, Human
agagaaaaaagcca

SEQ ID NO: 2012769 - RNA, 15 nt, Human
agagaauuaaacgaa

SEQ ID NO: 2012770 - RNA, 24 nt, Human
agagacagaaagcagaacagugau

SEQ ID NO: 2012771 - RNA, 19 nt, Human
agagacaauagcauuagaa

SEQ ID NO: 2012772 - RNA, 20 nt, Human
ucuucugagcuuacguaguu

SEQ ID NO: 2012773 - RNA, 14 nt, Human
ucuuauuccauauu

SEQ ID NO: 2012774 - RNA, 18 nt, Human
ucuuauuccauauuagaa

SEQ ID NO: 2012775 - RNA, 19 nt, Human
ucuuauuccauauuagaaa

SEQ ID NO: 2012776 - RNA, 17 nt, Human
ucuuauuuaaugaaaga

SEQ ID NO: 2012777 - RNA, 12 nt, Human
ucuucuggaaug

SEQ ID NO: 2012778 - RNA, 21 nt, Human
ucuucuguacgucugacaggc

SEQ ID NO: 2012779 - RNA, 22 nt, Human
ucuucuguacgucugacaggca

SEQ ID NO: 2012780 - RNA, 22 nt, Human
ucuucugcuucagccucccgag

SEQ ID NO: 2012781 - RNA, 12 nt, Human
ucuucugcuuug

SEQ ID NO: 2012782 - RNA, 13 nt, Human
ucuucugcuuugu

SEQ ID NO: 2012783 - RNA, 21 nt, Human
ucuucugcuuuguugugugcc

SEQ ID NO: 2012784 - RNA, 23 nt, Human
ucuucugcuuuguugugugccuc

SEQ ID NO: 2012785 - RNA, 22 nt, Human
ucuucugagcuuacguaguucu

SEQ ID NO: 2012786 - RNA, 20 nt, Human
ucuucugaguggcuaaaacu

SEQ ID NO: 2012787 - RNA, 21 nt, Human
ucuucugaguggcuaaaacuu

SEQ ID NO: 2012788 - RNA, 19 nt, Human
ucuucugaucacugaaaua

SEQ ID NO: 2012789 - RNA, 21 nt, Human
agacauuugcuaugagcuggg

SEQ ID NO: 2012790 - RNA, 14 nt, Human
agacauagaauuaa

SEQ ID NO: 2012791 - RNA, 23 nt, Human
agacauacuaaccagcagaaaug

SEQ ID NO: 2012792 - RNA, 23 nt, Human
ucuucuguacgucugacaggcaa

SEQ ID NO: 2012793 - RNA, 15 nt, Human
ucuucuucaaaccuu

SEQ ID NO: 2012794 - RNA, 13 nt, Human
ucuucuucaaacc

SEQ ID NO: 2012795 - RNA, 20 nt, Human
ucuugagccuugaacuuuga

SEQ ID NO: 2012796 - RNA, 18 nt, Human
ucuugagccuugaacuuu

SEQ ID NO: 2012797 - RNA, 19 nt, Human
ucuugagccuugaacuuug

SEQ ID NO: 2012798 - RNA, 21 nt, Human
agacucaguggggaggggcug

SEQ ID NO: 2012799 - RNA, 17 nt, Human
ucuugagccuugaacuu

SEQ ID NO: 2012800 - RNA, 15 nt, Human
agacucauucuucug

SEQ ID NO: 2012801 - RNA, 22 nt, Human
agaccugccccuccucucugcc

SEQ ID NO: 2012802 - RNA, 23 nt, Human
agaccugccccuccucucugccc

SEQ ID NO: 2012803 - RNA, 16 nt, Human
agaccugccccuccuc

SEQ ID NO: 2012804 - RNA, 13 nt, Human
agaccugccccuc

SEQ ID NO: 2012805 - RNA, 13 nt, Human
agacucaaaugcu

SEQ ID NO: 2012806 - RNA, 14 nt, Human
agacccggcugcgu

SEQ ID NO: 2012807 - RNA, 21 nt, Human
agaccccuggcuuuucacugc

SEQ ID NO: 2012808 - RNA, 15 nt, Human
agaccccuggcuuuu

SEQ ID NO: 2012809 - RNA, 14 nt, Human
agaccccuggcuuu

SEQ ID NO: 2012810 - RNA, 16 nt, Human
agaccaaacagugcug

SEQ ID NO: 2012811 - RNA, 18 nt, Human
agaccaaacagugcuguu

SEQ ID NO: 2012812 - RNA, 20 nt, Human
agaccgaacuguuguauaaa

SEQ ID NO: 2012813 - RNA, 17 nt, Human
agaccgaacuguuguau

SEQ ID NO: 2012814 - RNA, 17 nt, Human
agaccaaauggaaacag

SEQ ID NO: 2012815 - RNA, 12 nt, Human
ucuuauucauca

SEQ ID NO: 2012816 - RNA, 19 nt, Human
agaccgugaagauacuuug

SEQ ID NO: 2012817 - RNA, 18 nt, Human
agaccgugaagauacuuu

SEQ ID NO: 2012818 - RNA, 12 nt, Human
agacagaaaaaa

SEQ ID NO: 2012819 - RNA, 22 nt, Human
agacacuuuuucuuuacaaaca

SEQ ID NO: 2012820 - RNA, 14 nt, Human
agacagcugccugg

SEQ ID NO: 2012821 - RNA, 13 nt, Human
agacagcugccug

SEQ ID NO: 2012822 - RNA, 22 nt, Human
agacacauguccaagaagccca

SEQ ID NO: 2012823 - RNA, 21 nt, Human
agacacauguccaagaagccc

SEQ ID NO: 2012824 - RNA, 23 nt, Human
agacacaggcccggcuccaggcu

SEQ ID NO: 2012825 - RNA, 19 nt, Human
agacaccuugacagggcac

SEQ ID NO: 2012826 - RNA, 24 nt, Human
agacacauguccaagaagcccagg

SEQ ID NO: 2012827 - RNA, 22 nt, Human
agacaccuugacagggcacacc

SEQ ID NO: 2012828 - RNA, 17 nt, Human
agaauucucuuauccaa

SEQ ID NO: 2012829 - RNA, 18 nt, Human
agaauucucuaguuugau

SEQ ID NO: 2012830 - RNA, 19 nt, Human
agaauucucuaguuugauu

SEQ ID NO: 2012831 - RNA, 13 nt, Human
agacacaagccuu

SEQ ID NO: 2012832 - RNA, 14 nt, Human
agacacaagccuuc

SEQ ID NO: 2012833 - RNA, 14 nt, Human
agacacacaaagca

SEQ ID NO: 2012834 - RNA, 15 nt, Human
agacacacaaagcag

SEQ ID NO: 2012835 - RNA, 19 nt, Human
agacacaggcccggcucca

SEQ ID NO: 2012836 - RNA, 20 nt, Human
agacacaggcccggcuccag

SEQ ID NO: 2012837 - RNA, 21 nt, Human
agacacaggcccggcuccagg

SEQ ID NO: 2012838 - RNA, 22 nt, Human
agacacaggcccggcuccaggc

SEQ ID NO: 2012839 - RNA, 17 nt, Human
agacacaggcccggcuc

SEQ ID NO: 2012840 - RNA, 12 nt, Human
ucuuagauguau

SEQ ID NO: 2012841 - RNA, 11 nt, Human
ucuuacuuugu

SEQ ID NO: 2012842 - RNA, 13 nt, Human
ucuuacuuuguaa

SEQ ID NO: 2012843 - RNA, 14 nt, Human
ucuuacuuuguaaa

SEQ ID NO: 2012844 - RNA, 15 nt, Human
ucuuacuuuguaaau

SEQ ID NO: 2012845 - RNA, 16 nt, Human
ucuuacuuuguaaauu

SEQ ID NO: 2012846 - RNA, 17 nt, Human
ucuuacuuuguaaauuc

SEQ ID NO: 2012847 - RNA, 18 nt, Human
ucuuacuuuguaaauucu

SEQ ID NO: 2012848 - RNA, 20 nt, Human
ucuuacuuuguaaauucuga

SEQ ID NO: 2012849 - RNA, 22 nt, Human
ucuuacuuuguaaauucugauu

SEQ ID NO: 2012850 - RNA, 15 nt, Human
ucuuagaaaagguga

SEQ ID NO: 2012851 - RNA, 19 nt, Human
ucuuauuaaaguuucaaaa

SEQ ID NO: 2012852 - RNA, 20 nt, Human
ucuuauuaaaguuucaaaaa

SEQ ID NO: 2012853 - RNA, 21 nt, Human
ucuuauuaaaguuucaaaaau

SEQ ID NO: 2012854 - RNA, 22 nt, Human
ucuuauuaaaguuucaaaaauc

SEQ ID NO: 2012855 - RNA, 14 nt, Human
ucuuauuaaaacac

SEQ ID NO: 2012856 - RNA, 12 nt, Human
ucuuauuaaagu

SEQ ID NO: 2012857 - RNA, 14 nt, Human
ucuuauuaaaguuu

SEQ ID NO: 2012858 - RNA, 15 nt, Human
ucuuauuaaaguuuc

SEQ ID NO: 2012859 - RNA, 16 nt, Human
ucuuauuaaaguuuca

SEQ ID NO: 2012860 - RNA, 17 nt, Human
ucuuauuaaaguuucaa

SEQ ID NO: 2012861 - RNA, 18 nt, Human
ucuuauuaaaguuucaaa

SEQ ID NO: 2012862 - RNA, 20 nt, Human
ucuuagaaaaggugauaaaa

SEQ ID NO: 2012863 - RNA, 22 nt, Human
ucuuagaaaaggugauaaaauc

SEQ ID NO: 2012864 - RNA, 14 nt, Human
ucuuagauguauau

SEQ ID NO: 2012865 - RNA, 19 nt, Human
ucuuacugucuuuuuucua

SEQ ID NO: 2012866 - RNA, 19 nt, Human
ucuuacuuuccugaaaaua

SEQ ID NO: 2012867 - RNA, 20 nt, Human
ucuuaccuugaacugaaggc

SEQ ID NO: 2012868 - RNA, 17 nt, Human
ucuuaccgacaagcaca

SEQ ID NO: 2012869 - RNA, 22 nt, Human
ucuuaccgacaagcacagucag

SEQ ID NO: 2012870 - RNA, 15 nt, Human
ucuuaccgacaagca

SEQ ID NO: 2012871 - RNA, 12 nt, Human
agacagucccug

SEQ ID NO: 2012872 - RNA, 15 nt, Human
agacagucacaaauu

SEQ ID NO: 2012873 - RNA, 18 nt, Human
agacagucacaaauuucu

SEQ ID NO: 2012874 - RNA, 16 nt, Human
agacagcugccuggga

SEQ ID NO: 2012875 - RNA, 15 nt, Human
agacagcugccuggg

SEQ ID NO: 2012876 - RNA, 14 nt, Human
agacagucccugcc

SEQ ID NO: 2012877 - RNA, 13 nt, Human
agacagucccugc

SEQ ID NO: 2012878 - RNA, 18 nt, Human
ucuuaauggaugaaauca

SEQ ID NO: 2012879 - RNA, 19 nt, Human
ucuuaauggaugaaaucau

SEQ ID NO: 2012880 - RNA, 23 nt, Human
ucuguuuagauaauacaccacua

SEQ ID NO: 2012881 - RNA, 16 nt, Human
ucuguuuagauaauac

SEQ ID NO: 2012882 - RNA, 19 nt, Human
ucuguuuagauaauacacc

SEQ ID NO: 2012883 - RNA, 17 nt, Human
ucuguucugcacacagc

SEQ ID NO: 2012884 - RNA, 18 nt, Human
ucuguucugcacacagca

SEQ ID NO: 2012885 - RNA, 19 nt, Human
ucuguucugcacacagcac

SEQ ID NO: 2012886 - RNA, 18 nt, Human
ucugucccaguuaacugu

SEQ ID NO: 2012887 - RNA, 12 nt, Human
ucuguauuugaa

SEQ ID NO: 2012888 - RNA, 13 nt, Human
ucuguauuugaaa

SEQ ID NO: 2012889 - RNA, 14 nt, Human
ucugugaagagcaa

SEQ ID NO: 2012890 - RNA, 16 nt, Human
ucugugaauaagccau

SEQ ID NO: 2012891 - RNA, 11 nt, Human
ucugugaauaa

SEQ ID NO: 2012892 - RNA, 12 nt, Human
ucugugaauaag

SEQ ID NO: 2012893 - RNA, 13 nt, Human
ucugugaauaagc

SEQ ID NO: 2012894 - RNA, 14 nt, Human
ucuguaugauucua

SEQ ID NO: 2012895 - RNA, 18 nt, Human
ucuguacgucugacaggc

SEQ ID NO: 2012896 - RNA, 21 nt, Human
ucugguaucuaauucuuuaau

SEQ ID NO: 2012897 - RNA, 15 nt, Human
agaaugucaguaugu

SEQ ID NO: 2012898 - RNA, 16 nt, Human
agaaugucaguaugug

SEQ ID NO: 2012899 - RNA, 22 nt, Human
agaaccccuggcuccaggccag

SEQ ID NO: 2012900 - RNA, 23 nt, Human
agaaccccaggguccuguagccc

SEQ ID NO: 2012901 - RNA, 17 nt, Human
agaaugucaguaugugg

SEQ ID NO: 2012902 - RNA, 19 nt, Human
agaaugucaguauguggaa

SEQ ID NO: 2012903 - RNA, 21 nt, Human
agaauguguuuaaacuugguu

SEQ ID NO: 2012904 - RNA, 19 nt, Human
agaauuaguggcacuugcu

SEQ ID NO: 2012905 - RNA, 23 nt, Human
agaauguugaaacugacuugcug

SEQ ID NO: 2012906 - RNA, 12 nt, Human
agaauguuuuca

SEQ ID NO: 2012907 - RNA, 13 nt, Human
ucugggcuccaga

SEQ ID NO: 2012908 - RNA, 14 nt, Human
agaauucucuaguu

SEQ ID NO: 2012909 - RNA, 20 nt, Human
agaauucucagaaucucaaa

SEQ ID NO: 2012910 - RNA, 20 nt, Human
agaauuauaauuaguuccuc

SEQ ID NO: 2012911 - RNA, 13 nt, Human
ucuggggaccagc

SEQ ID NO: 2012912 - RNA, 23 nt, Human
ucuggguuccuuccucugagccu

SEQ ID NO: 2012913 - RNA, 21 nt, Human
ucugguaaucgggguauaaua

SEQ ID NO: 2012914 - RNA, 22 nt, Human
ucuggguuccuuccucugagcc

SEQ ID NO: 2012915 - RNA, 18 nt, Human
ucuggguagcuguaaggc

SEQ ID NO: 2012916 - RNA, 14 nt, Human
ucuccuacugagga

SEQ ID NO: 2012917 - RNA, 15 nt, Human
ucuccuacugaggau

SEQ ID NO: 2012918 - RNA, 16 nt, Human
ucuccauguuugaugu

SEQ ID NO: 2012919 - RNA, 20 nt, Human
acuuuaacuuaguuuugcau

SEQ ID NO: 2012920 - RNA, 21 nt, Human
acuuuaacuuaguuuugcaua

SEQ ID NO: 2012921 - RNA, 22 nt, Human
acuuuaacuuaguuuugcauag

SEQ ID NO: 2012922 - RNA, 17 nt, Human
acuuucuagccagagga

SEQ ID NO: 2012923 - RNA, 16 nt, Human
acuuucuagccagagg

SEQ ID NO: 2012924 - RNA, 14 nt, Human
acuuugaccucugc

SEQ ID NO: 2012925 - RNA, 12 nt, Human
acuuucucuaau

SEQ ID NO: 2012926 - RNA, 14 nt, Human
acuuucucuaauaa

SEQ ID NO: 2012927 - RNA, 15 nt, Human
acuuucucuaauaau

SEQ ID NO: 2012928 - RNA, 17 nt, Human
acuuucucuaauaauaa

SEQ ID NO: 2012929 - RNA, 18 nt, Human
acuuucucuaauaauaaa

SEQ ID NO: 2012930 - RNA, 19 nt, Human
acuuucucuaauaauaaau

SEQ ID NO: 2012931 - RNA, 21 nt, Human
acuuucucuaauaauaaauag

SEQ ID NO: 2012932 - RNA, 23 nt, Human
acuuucucuaauaauaaauaguu

SEQ ID NO: 2012933 - RNA, 21 nt, Human
ucuccuccuuuucacaguucu

SEQ ID NO: 2012934 - RNA, 13 nt, Human
ucucagggccugg

SEQ ID NO: 2012935 - RNA, 12 nt, Human
ucucagggccug

SEQ ID NO: 2012936 - RNA, 16 nt, Human
ucucauuccagaggaa

SEQ ID NO: 2012937 - RNA, 14 nt, Human
ucucauuacuuguu

SEQ ID NO: 2012938 - RNA, 15 nt, Human
ucucagggccugguc

SEQ ID NO: 2012939 - RNA, 14 nt, Human
ucucagggccuggu

SEQ ID NO: 2012940 - RNA, 19 nt, Human
ucucagggccuggucguuu

SEQ ID NO: 2012941 - RNA, 17 nt, Human
ucuccaaaauaaaacuu

SEQ ID NO: 2012942 - RNA, 19 nt, Human
ucuccaaaauaaaacuuuu

SEQ ID NO: 2012943 - RNA, 22 nt, Human
ucuccaaaauaaaacuuuuuaa

SEQ ID NO: 2012944 - RNA, 16 nt, Human
ucuccaggcuguaucc

SEQ ID NO: 2012945 - RNA, 16 nt, Human
acuugccuuugaagag

SEQ ID NO: 2012946 - RNA, 14 nt, Human
acuugccuuugaag

SEQ ID NO: 2012947 - RNA, 15 nt, Human
acuugccuuugaaga

SEQ ID NO: 2012948 - RNA, 14 nt, Human
acuugcucuugaug

SEQ ID NO: 2012949 - RNA, 21 nt, Human
acuuggaugaguuuugggaag

SEQ ID NO: 2012950 - RNA, 14 nt, Human
acuuggaugaguuu

SEQ ID NO: 2012951 - RNA, 15 nt, Human
acuuggaguuugcau

SEQ ID NO: 2012952 - RNA, 16 nt, Human
acuuguggacacagcu

SEQ ID NO: 2012953 - RNA, 17 nt, Human
acuuguggacacagcuc

SEQ ID NO: 2012954 - RNA, 18 nt, Human
acuuguggacacagcucu

SEQ ID NO: 2012955 - RNA, 19 nt, Human
acuugaaccauaguuacug

SEQ ID NO: 2012956 - RNA, 21 nt, Human
acuugaacccgggaggcagag

SEQ ID NO: 2012957 - RNA, 19 nt, Human
acuugagcccagagugaac

SEQ ID NO: 2012958 - RNA, 21 nt, Human
acuugaacccauauuuguaca

SEQ ID NO: 2012959 - RNA, 14 nt, Human
acuugaaccauaaa

SEQ ID NO: 2012960 - RNA, 15 nt, Human
acuugaaccauaaaa

SEQ ID NO: 2012961 - RNA, 16 nt, Human
acuugaaccauaaaau

SEQ ID NO: 2012962 - RNA, 17 nt, Human
acuugaaccauaaaaug

SEQ ID NO: 2012963 - RNA, 19 nt, Human
acuugaaccauaaaauguc

SEQ ID NO: 2012964 - RNA, 20 nt, Human
acuugaaccauaaaaugucc

SEQ ID NO: 2012965 - RNA, 22 nt, Human
acuugaaccauaaaauguccag

SEQ ID NO: 2012966 - RNA, 19 nt, Human
acuugaacccgggaggcag

SEQ ID NO: 2012967 - RNA, 20 nt, Human
acuugaacccgggaggcaga

SEQ ID NO: 2012968 - RNA, 15 nt, Human
acuucuccacccugc

SEQ ID NO: 2012969 - RNA, 16 nt, Human
acuucuccacccugcu

SEQ ID NO: 2012970 - RNA, 21 nt, Human
ucucacagcuccaagaauuuc

SEQ ID NO: 2012971 - RNA, 23 nt, Human
ucucacagacaggaccccugcag

SEQ ID NO: 2012972 - RNA, 14 nt, Human
ucucacagcuaugc

SEQ ID NO: 2012973 - RNA, 17 nt, Human
ucucacagcuaugcaaa

SEQ ID NO: 2012974 - RNA, 18 nt, Human
ucucacagcuaugcaaaa

SEQ ID NO: 2012975 - RNA, 22 nt, Human
ucucacagcuaugcaaaaagcu

SEQ ID NO: 2012976 - RNA, 12 nt, Human
ucucacagacag

SEQ ID NO: 2012977 - RNA, 13 nt, Human
ucucacagacagg

SEQ ID NO: 2012978 - RNA, 14 nt, Human
ucucacagacagga

SEQ ID NO: 2012979 - RNA, 19 nt, Human
ucucacagacaggaccccu

SEQ ID NO: 2012980 - RNA, 20 nt, Human
ucucacagacaggaccccug

SEQ ID NO: 2012981 - RNA, 21 nt, Human
ucucacagacaggaccccugc

SEQ ID NO: 2012982 - RNA, 22 nt, Human
ucucacagacaggaccccugca

SEQ ID NO: 2012983 - RNA, 11 nt, Human
ucucacuccuu

SEQ ID NO: 2012984 - RNA, 17 nt, Human
ucucaccuugguuccug

SEQ ID NO: 2012985 - RNA, 16 nt, Human
acuucagcugacuuuu

SEQ ID NO: 2012986 - RNA, 11 nt, Human
acuucagcuga

SEQ ID NO: 2012987 - RNA, 14 nt, Human
acuucaggcucuuc

SEQ ID NO: 2012988 - RNA, 15 nt, Human
ucuauuucaucagaa

SEQ ID NO: 2012989 - RNA, 21 nt, Human
ucuauuucaucagaacagcug

SEQ ID NO: 2012990 - RNA, 18 nt, Human
ucuauuucccccuuucuu

SEQ ID NO: 2012991 - RNA, 19 nt, Human
ucuauuucccccuuucuuc

SEQ ID NO: 2012992 - RNA, 21 nt, Human
ucuauuucccccuuucuuccu

SEQ ID NO: 2012993 - RNA, 22 nt, Human
ucuauuucccccuuucuuccuc

SEQ ID NO: 2012994 - RNA, 14 nt, Human
acuucuccacccug

SEQ ID NO: 2012995 - RNA, 19 nt, Human
acuucuaaguugaguauau

SEQ ID NO: 2012996 - RNA, 23 nt, Human
acuucuaaguugaguauauuaua

SEQ ID NO: 2012997 - RNA, 14 nt, Human
acuucuaaaacugu

SEQ ID NO: 2012998 - RNA, 15 nt, Human
acuucuaaaacugua

SEQ ID NO: 2012999 - RNA, 16 nt, Human
acuucuaaaacuguac

SEQ ID NO: 2013000 - RNA, 19 nt, Human
acuucuaaaacuguacuuu

SEQ ID NO: 2013001 - RNA, 21 nt, Human
acuucuaaaacuguacuuuga

SEQ ID NO: 2013002 - RNA, 22 nt, Human
acuucuaaaacuguacuuugau

SEQ ID NO: 2013003 - RNA, 23 nt, Human
acuucuaaaacuguacuuugauu

SEQ ID NO: 2013004 - RNA, 13 nt, Human
ucucacuccuuga

SEQ ID NO: 2013005 - RNA, 16 nt, Human
ucucacuauguugccc

SEQ ID NO: 2013006 - RNA, 16 nt, Human
ucucacucugucgccc

SEQ ID NO: 2013007 - RNA, 12 nt, Human
ucucacucuguc

SEQ ID NO: 2013008 - RNA, 15 nt, Human
acuuccugugacuuc

SEQ ID NO: 2013009 - RNA, 14 nt, Human
acuuccuugccagu

SEQ ID NO: 2013010 - RNA, 22 nt, Human
acuucgggaggucgaggcagga

SEQ ID NO: 2013011 - RNA, 18 nt, Human
ucugcagcaauaaagcag

SEQ ID NO: 2013012 - RNA, 20 nt, Human
ucugcacuccccugcugggu

SEQ ID NO: 2013013 - RNA, 14 nt, Human
ucugauuccagcac

SEQ ID NO: 2013014 - RNA, 17 nt, Human
ucugcaggucccuaaua

SEQ ID NO: 2013015 - RNA, 16 nt, Human
ucugcaggucccuaau

SEQ ID NO: 2013016 - RNA, 15 nt, Human
ucugcaggucccuaa

SEQ ID NO: 2013017 - RNA, 17 nt, Human
agaaauuuauaaacuuu

SEQ ID NO: 2013018 - RNA, 16 nt, Human
agaaauuuauaaacuu

SEQ ID NO: 2013019 - RNA, 22 nt, Human
agaaauuaugugccagauuuau

SEQ ID NO: 2013020 - RNA, 21 nt, Human
agaaauuaugugccagauuua

SEQ ID NO: 2013021 - RNA, 13 nt, Human
agaaauuaugugc

SEQ ID NO: 2013022 - RNA, 18 nt, Human
ucugcaggucccuaauaa

SEQ ID NO: 2013023 - RNA, 14 nt, Human
ucugcaggucccua

SEQ ID NO: 2013024 - RNA, 23 nt, Human
ucugaguuccggcaccaguagca

SEQ ID NO: 2013025 - RNA, 19 nt, Human
ucugaguuguuaccccaag

SEQ ID NO: 2013026 - RNA, 23 nt, Human
ucugaguuguuaccccaagcgcc

SEQ ID NO: 2013027 - RNA, 20 nt, Human
ucugagagaggcuaaaaugu

SEQ ID NO: 2013028 - RNA, 21 nt, Human
ucugagagaggcuaaaauguu

SEQ ID NO: 2013029 - RNA, 22 nt, Human
ucugagagaggcuaaaauguuu

SEQ ID NO: 2013030 - RNA, 23 nt, Human
ucugagagaggcuaaaauguuuu

SEQ ID NO: 2013031 - RNA, 14 nt, Human
ucugagagauuugg

SEQ ID NO: 2013032 - RNA, 15 nt, Human
ucugagagcaaacug

SEQ ID NO: 2013033 - RNA, 16 nt, Human
ucugagagcaaacugg

SEQ ID NO: 2013034 - RNA, 23 nt, Human
ucugagacucgcgacaaugcaaa

SEQ ID NO: 2013035 - RNA, 22 nt, Human
ucugagacucgcgacaaugcaa

SEQ ID NO: 2013036 - RNA, 14 nt, Human
ucugaccuuaaaug

SEQ ID NO: 2013037 - RNA, 15 nt, Human
ucugacgggauuugu

SEQ ID NO: 2013038 - RNA, 13 nt, Human
ucugauacagaaa

SEQ ID NO: 2013039 - RNA, 23 nt, Human
ucugaugcaagcaagaaacacug

SEQ ID NO: 2013040 - RNA, 19 nt, Human
ucugcacuccccugcuggg

SEQ ID NO: 2013041 - RNA, 18 nt, Human
ucugcacuccccugcugg

SEQ ID NO: 2013042 - RNA, 18 nt, Human
ucugauucccaagcucug

SEQ ID NO: 2013043 - RNA, 15 nt, Human
ucugauguauuuugu

SEQ ID NO: 2013044 - RNA, 21 nt, Human
ucugauguauuuugugaguuu

SEQ ID NO: 2013045 - RNA, 20 nt, Human
agaaauaucugaaaauguau

SEQ ID NO: 2013046 - RNA, 19 nt, Human
agaaauaucugaaaaugua

SEQ ID NO: 2013047 - RNA, 14 nt, Human
agaaauauaauuga

SEQ ID NO: 2013048 - RNA, 17 nt, Human
agaaaugaaaaaauaua

SEQ ID NO: 2013049 - RNA, 15 nt, Human
agaaaucuaaaaaac

SEQ ID NO: 2013050 - RNA, 12 nt, Human
agaaaucuaaaa

SEQ ID NO: 2013051 - RNA, 14 nt, Human
agaaagaaaaucag

SEQ ID NO: 2013052 - RNA, 13 nt, Human
agaaacuucgccu

SEQ ID NO: 2013053 - RNA, 13 nt, Human
agaaacuuguucu

SEQ ID NO: 2013054 - RNA, 23 nt, Human
agaaacuuguucuuccaaagcag

SEQ ID NO: 2013055 - RNA, 20 nt, Human
agaaagccuuucauuuugcu

SEQ ID NO: 2013056 - RNA, 22 nt, Human
agaaagccuuucauuuugcuuu

SEQ ID NO: 2013057 - RNA, 14 nt, Human
agaaaugaaagcag

SEQ ID NO: 2013058 - RNA, 16 nt, Human
agaaaugaaaaaauau

SEQ ID NO: 2013059 - RNA, 23 nt, Human
agaaaugaaaaaauauauaucaa

SEQ ID NO: 2013060 - RNA, 18 nt, Human
agaaaugaaaaaauauau

SEQ ID NO: 2013061 - RNA, 14 nt, Human
ucugaagauuguuu

SEQ ID NO: 2013062 - RNA, 18 nt, Human
ucugaagauuguuuaucu

SEQ ID NO: 2013063 - RNA, 19 nt, Human
ucugaagauuguuuaucua

SEQ ID NO: 2013064 - RNA, 12 nt, Human
ucugacacacag

SEQ ID NO: 2013065 - RNA, 16 nt, Human
ucugacaacagacuuc

SEQ ID NO: 2013066 - RNA, 15 nt, Human
ucugacaacagacuu

SEQ ID NO: 2013067 - RNA, 15 nt, Human
ucugaagucacugca

SEQ ID NO: 2013068 - RNA, 16 nt, Human
ucugaagucacugcac

SEQ ID NO: 2013069 - RNA, 18 nt, Human
ucugaagucacugcacag

SEQ ID NO: 2013070 - RNA, 19 nt, Human
ucugaauuuaucuuugaua

SEQ ID NO: 2013071 - RNA, 21 nt, Human
ucugaauuuaucuuugauaac

SEQ ID NO: 2013072 - RNA, 20 nt, Human
ucugaauuggaaugcacuca

SEQ ID NO: 2013073 - RNA, 17 nt, Human
ucugaauuuaucuuuga

SEQ ID NO: 2013074 - RNA, 19 nt, Human
ucucucacagacaggaccc

SEQ ID NO: 2013075 - RNA, 23 nt, Human
ucucucacagacaggaccccugc

SEQ ID NO: 2013076 - RNA, 14 nt, Human
ucucucauuugugu

SEQ ID NO: 2013077 - RNA, 18 nt, Human
ucucuccaaggugugccc

SEQ ID NO: 2013078 - RNA, 19 nt, Human
ucucuccagccccuggaug

SEQ ID NO: 2013079 - RNA, 18 nt, Human
ucucuccagccccuggau

SEQ ID NO: 2013080 - RNA, 16 nt, Human
ucucuccagccccugg

SEQ ID NO: 2013081 - RNA, 17 nt, Human
ucucuccagccccugga

SEQ ID NO: 2013082 - RNA, 15 nt, Human
acuuugaccucugca

SEQ ID NO: 2013083 - RNA, 16 nt, Human
acuuugaccucugcag

SEQ ID NO: 2013084 - RNA, 18 nt, Human
acuuugaccucugcagca

SEQ ID NO: 2013085 - RNA, 17 nt, Human
ucucucacuuguuuuau

SEQ ID NO: 2013086 - RNA, 15 nt, Human
ucucucacagacagg

SEQ ID NO: 2013087 - RNA, 17 nt, Human
ucucucacagacaggac

SEQ ID NO: 2013088 - RNA, 15 nt, Human
ucucucacuccuuga

SEQ ID NO: 2013089 - RNA, 13 nt, Human
ucucucacuccuu

SEQ ID NO: 2013090 - RNA, 17 nt, Human
ucucugcccuccaagac

SEQ ID NO: 2013091 - RNA, 16 nt, Human
ucucugcccuccaaga

SEQ ID NO: 2013092 - RNA, 15 nt, Human
ucucugcccuccaag

SEQ ID NO: 2013093 - RNA, 11 nt, Human
ucucugcccuc

SEQ ID NO: 2013094 - RNA, 14 nt, Human
ucucuccuguaccu

SEQ ID NO: 2013095 - RNA, 16 nt, Human
ucucuccuguaccucu

SEQ ID NO: 2013096 - RNA, 17 nt, Human
ucucuccuguaccucuu

SEQ ID NO: 2013097 - RNA, 12 nt, Human
ucucuggccuuc

SEQ ID NO: 2013098 - RNA, 19 nt, Human
ucucuggaauuugaaacac

SEQ ID NO: 2013099 - RNA, 13 nt, Human
ucucugcuggacg

SEQ ID NO: 2013100 - RNA, 15 nt, Human
ucucuggaauuugaa

SEQ ID NO: 2013101 - RNA, 21 nt, Human
ucucuggccuucggccuccau

SEQ ID NO: 2013102 - RNA, 22 nt, Human
ucucuggccuucggccuccauc

SEQ ID NO: 2013103 - RNA, 23 nt, Human
ucucuggccuucggccuccaucc

SEQ ID NO: 2013104 - RNA, 17 nt, Human
ucucuugagccugggag

SEQ ID NO: 2013105 - RNA, 18 nt, Human
ucucuugagccugggagg

SEQ ID NO: 2013106 - RNA, 16 nt, Human
ucucuugauucauaau

SEQ ID NO: 2013107 - RNA, 14 nt, Human
ucucuugauucaua

SEQ ID NO: 2013108 - RNA, 22 nt, Human
ucucuugccucagcuuccccag

SEQ ID NO: 2013109 - RNA, 13 nt, Human
ucucuugccucag

SEQ ID NO: 2013110 - RNA, 13 nt, Human
agaaaaagaaaaa

SEQ ID NO: 2013111 - RNA, 20 nt, Human
ucucuuuaaugucacaggca

SEQ ID NO: 2013112 - RNA, 21 nt, Human
ucucuuuaaugucacaggcag

SEQ ID NO: 2013113 - RNA, 19 nt, Human
agaaaacuuguauuaugug

SEQ ID NO: 2013114 - RNA, 21 nt, Human
agaaaacuuguauuaugugug

SEQ ID NO: 2013115 - RNA, 12 nt, Human
agaaaaagcaaa

SEQ ID NO: 2013116 - RNA, 16 nt, Human
agaaaaagcaaaaggc

SEQ ID NO: 2013117 - RNA, 17 nt, Human
agaaaaagcaaaaggca

SEQ ID NO: 2013118 - RNA, 17 nt, Human
agaaaaaggaugcacag

SEQ ID NO: 2013119 - RNA, 19 nt, Human
agaaaagacgcaccagccc

SEQ ID NO: 2013120 - RNA, 17 nt, Human
agaaaagaaaaaaaaag

SEQ ID NO: 2013121 - RNA, 18 nt, Human
agaaaagaaaaaaaaaga

SEQ ID NO: 2013122 - RNA, 17 nt, Human
agaaaacuuuuaugcaa

SEQ ID NO: 2013123 - RNA, 12 nt, Human
agaaaacuuugu

SEQ ID NO: 2013124 - RNA, 14 nt, Human
agaaaacuuuguua

SEQ ID NO: 2013125 - RNA, 20 nt, Human
agaaaacuuuguuaggccaa

SEQ ID NO: 2013126 - RNA, 9 nt, Human
agaaaagaa

SEQ ID NO: 2013127 - RNA, 10 nt, Human
agaaaagaaa

SEQ ID NO: 2013128 - RNA, 11 nt, Human
agaaaagaaaa

SEQ ID NO: 2013129 - RNA, 12 nt, Human
agaaaagaaaaa

SEQ ID NO: 2013130 - RNA, 13 nt, Human
agaaaagaaaaaa

SEQ ID NO: 2013131 - RNA, 17 nt, Human
agaaacuaaaacaaaua

SEQ ID NO: 2013132 - RNA, 15 nt, Human
agaaacuccaugaug

SEQ ID NO: 2013133 - RNA, 16 nt, Human
agaaacagcuaugaga

SEQ ID NO: 2013134 - RNA, 23 nt, Human
acuggcuugaauuggugacauuu

SEQ ID NO: 2013135 - RNA, 23 nt, Human
ucgcuccaacuccaacauccacu

SEQ ID NO: 2013136 - RNA, 18 nt, Human
ucgcuauugucaccaggg

SEQ ID NO: 2013137 - RNA, 14 nt, Human
ucgcuccaacucca

SEQ ID NO: 2013138 - RNA, 23 nt, Human
ucgcuagcauuucccaacacaaa

SEQ ID NO: 2013139 - RNA, 17 nt, Human
ucgcuacauuuccgcca

SEQ ID NO: 2013140 - RNA, 18 nt, Human
ucgagcaugccuggaugg

SEQ ID NO: 2013141 - RNA, 16 nt, Human
ucgagcaugccuggau

SEQ ID NO: 2013142 - RNA, 19 nt, Human
ucgcgacaaugcaaaccau

SEQ ID NO: 2013143 - RNA, 19 nt, Human
ucgagcuccccccaggucu

SEQ ID NO: 2013144 - RNA, 16 nt, Human
ucgcgacaaugcaaac

SEQ ID NO: 2013145 - RNA, 13 nt, Human
ucgaggacaggga

SEQ ID NO: 2013146 - RNA, 22 nt, Human
uccuuuagcgcccaguugggug

SEQ ID NO: 2013147 - RNA, 23 nt, Human
uccuuuagcgcccaguugggugg

SEQ ID NO: 2013148 - RNA, 12 nt, Human
uccuuuagaaac

SEQ ID NO: 2013149 - RNA, 13 nt, Human
uccuuuagaaaca

SEQ ID NO: 2013150 - RNA, 17 nt, Human
uccuuucugaucuucac

SEQ ID NO: 2013151 - RNA, 12 nt, Human
uccuuucuugau

SEQ ID NO: 2013152 - RNA, 11 nt, Human
ucgagaauugu

SEQ ID NO: 2013153 - RNA, 14 nt, Human
ucgacuugcauuuu

SEQ ID NO: 2013154 - RNA, 13 nt, Human
uccuugucaguug

SEQ ID NO: 2013155 - RNA, 14 nt, Human
uccuuuaauaugaa

SEQ ID NO: 2013156 - RNA, 14 nt, Human
uccuuguguuacua

SEQ ID NO: 2013157 - RNA, 23 nt, Human
uccuuguguuacuaaguuuuuau

SEQ ID NO: 2013158 - RNA, 15 nt, Human
uccuuuaauaugaaa

SEQ ID NO: 2013159 - RNA, 18 nt, Human
uccuuuaauaugaaauuu

SEQ ID NO: 2013160 - RNA, 15 nt, Human
uccuuuagcgcccag

SEQ ID NO: 2013161 - RNA, 19 nt, Human
uccuuuagcgcccaguugg

SEQ ID NO: 2013162 - RNA, 23 nt, Human
acuggccaguggcuggaucugug

SEQ ID NO: 2013163 - RNA, 15 nt, Human
uccuucagugccuua

SEQ ID NO: 2013164 - RNA, 14 nt, Human
uccuucagugccuu

SEQ ID NO: 2013165 - RNA, 14 nt, Human
acuggccucugcug

SEQ ID NO: 2013166 - RNA, 17 nt, Human
acuggccgcgggggcag

SEQ ID NO: 2013167 - RNA, 15 nt, Human
uccuucccacucugu

SEQ ID NO: 2013168 - RNA, 19 nt, Human
uccuucccacucuucucau

SEQ ID NO: 2013169 - RNA, 14 nt, Human
uccuucccacucuu

SEQ ID NO: 2013170 - RNA, 17 nt, Human
uccuucccacucuucuc

SEQ ID NO: 2013171 - RNA, 17 nt, Human
uccuucagugccuuaug

SEQ ID NO: 2013172 - RNA, 16 nt, Human
uccuucagugccuuau

SEQ ID NO: 2013173 - RNA, 15 nt, Human
acugcauguuuguga

SEQ ID NO: 2013174 - RNA, 16 nt, Human
acugcauguuugugau

SEQ ID NO: 2013175 - RNA, 23 nt, Human
acugcauccuccgccucccgggu

SEQ ID NO: 2013176 - RNA, 22 nt, Human
acugcaucaagaugugacaugu

SEQ ID NO: 2013177 - RNA, 20 nt, Human
acugcaucaagaugugacau

SEQ ID NO: 2013178 - RNA, 17 nt, Human
acugcauccuccgccuc

SEQ ID NO: 2013179 - RNA, 20 nt, Human
acugcauccuccgccucccg

SEQ ID NO: 2013180 - RNA, 16 nt, Human
acugcauaugaaagga

SEQ ID NO: 2013181 - RNA, 22 nt, Human
uccuagaaauuccccacccuga

SEQ ID NO: 2013182 - RNA, 21 nt, Human
uccuagaaauuccccacccug

SEQ ID NO: 2013183 - RNA, 16 nt, Human
uccuacuuuuaaagaa

SEQ ID NO: 2013184 - RNA, 17 nt, Human
uccuacuuuuaaagaau

SEQ ID NO: 2013185 - RNA, 18 nt, Human
uccuacuuuuaaagaauu

SEQ ID NO: 2013186 - RNA, 14 nt, Human
uccuagagaacugu

SEQ ID NO: 2013187 - RNA, 18 nt, Human
uccuagacagguguuuau

SEQ ID NO: 2013188 - RNA, 18 nt, Human
acugccucccccaggguc

SEQ ID NO: 2013189 - RNA, 21 nt, Human
acugccuccccaaggcccccu

SEQ ID NO: 2013190 - RNA, 13 nt, Human
acugccuccccca

SEQ ID NO: 2013191 - RNA, 21 nt, Human
acugccuauuuuaauaaacac

SEQ ID NO: 2013192 - RNA, 16 nt, Human
acugccuauuuuaaua

SEQ ID NO: 2013193 - RNA, 17 nt, Human
acugcauucuucugauc

SEQ ID NO: 2013194 - RNA, 16 nt, Human
acugcauucuucugau

SEQ ID NO: 2013195 - RNA, 14 nt, Human
acugccucuuccuc

SEQ ID NO: 2013196 - RNA, 15 nt, Human
acugccucuuccucc

SEQ ID NO: 2013197 - RNA, 13 nt, Human
acugccugccuua

SEQ ID NO: 2013198 - RNA, 14 nt, Human
acugccugccuuaa

SEQ ID NO: 2013199 - RNA, 15 nt, Human
acugccugccuuaag

SEQ ID NO: 2013200 - RNA, 18 nt, Human
acugccugccuuaaguga

SEQ ID NO: 2013201 - RNA, 21 nt, Human
acugcuaaggauuagucccug

SEQ ID NO: 2013202 - RNA, 16 nt, Human
acugcuaagaauauuu

SEQ ID NO: 2013203 - RNA, 18 nt, Human
acugcuaagaauauuuga

SEQ ID NO: 2013204 - RNA, 18 nt, Human
acugcuuaacuucacaua

SEQ ID NO: 2013205 - RNA, 13 nt, Human
acugcucucaccu

SEQ ID NO: 2013206 - RNA, 21 nt, Human
acugcucucaccuugguuccu

SEQ ID NO: 2013207 - RNA, 22 nt, Human
acugcucucaccuugguuccug

SEQ ID NO: 2013208 - RNA, 14 nt, Human
acugcuggcugccu

SEQ ID NO: 2013209 - RNA, 15 nt, Human
acugcuggcugccuu

SEQ ID NO: 2013210 - RNA, 11 nt, Human
acugcucucac

SEQ ID NO: 2013211 - RNA, 19 nt, Human
acugcuccugagcccccag

SEQ ID NO: 2013212 - RNA, 20 nt, Human
acugcuccugagcccccagc

SEQ ID NO: 2013213 - RNA, 21 nt, Human
acugcuccugagcccccagcu

SEQ ID NO: 2013214 - RNA, 22 nt, Human
acugcuccugagcccccagcuu

SEQ ID NO: 2013215 - RNA, 13 nt, Human
acugcuccugagc

SEQ ID NO: 2013216 - RNA, 15 nt, Human
acugcuccugagccc

SEQ ID NO: 2013217 - RNA, 16 nt, Human
acugcuccugagcccc

SEQ ID NO: 2013218 - RNA, 17 nt, Human
acugcuccugagccccc

SEQ ID NO: 2013219 - RNA, 18 nt, Human
acugcuccugagccccca

SEQ ID NO: 2013220 - RNA, 20 nt, Human
acugcuuaacuucacauauu

SEQ ID NO: 2013221 - RNA, 17 nt, Human
acugcuuccagugaggc

SEQ ID NO: 2013222 - RNA, 21 nt, Human
acugcuugugaaaggaaagag

SEQ ID NO: 2013223 - RNA, 17 nt, Human
acugcuuucuuucguuu

SEQ ID NO: 2013224 - RNA, 23 nt, Human
acugcuuucuuucguuuguuugu

SEQ ID NO: 2013225 - RNA, 14 nt, Human
acugcuuuuggucu

SEQ ID NO: 2013226 - RNA, 14 nt, Human
acugcuuugagaaa

SEQ ID NO: 2013227 - RNA, 15 nt, Human
acuggauuaaacuua

SEQ ID NO: 2013228 - RNA, 21 nt, Human
acuggcaaugguaguuucugu

SEQ ID NO: 2013229 - RNA, 23 nt, Human
acuggcaaugguaguuucugugg

SEQ ID NO: 2013230 - RNA, 16 nt, Human
acuggccacaguuguu

SEQ ID NO: 2013231 - RNA, 12 nt, Human
acugugugcuca

SEQ ID NO: 2013232 - RNA, 17 nt, Human
acuguguauauuugauu

SEQ ID NO: 2013233 - RNA, 18 nt, Human
acuguguauauuugauuu

SEQ ID NO: 2013234 - RNA, 19 nt, Human
acuguguauauuugauuua

SEQ ID NO: 2013235 - RNA, 13 nt, Human
acuguguauauuu

SEQ ID NO: 2013236 - RNA, 15 nt, Human
acuguguauauuuga

SEQ ID NO: 2013237 - RNA, 16 nt, Human
acuguguauauuugau

SEQ ID NO: 2013238 - RNA, 21 nt, Human
acugugugcucaggagcccug

SEQ ID NO: 2013239 - RNA, 20 nt, Human
acugugugcucaggagcccu

SEQ ID NO: 2013240 - RNA, 19 nt, Human
acugugugcucaggagccc

SEQ ID NO: 2013241 - RNA, 15 nt, Human
acugugugcucagga

SEQ ID NO: 2013242 - RNA, 19 nt, Human
acugugguagguguuugaa

SEQ ID NO: 2013243 - RNA, 16 nt, Human
acugggagaaaugaaa

SEQ ID NO: 2013244 - RNA, 16 nt, Human
acugggaacagaacuc

SEQ ID NO: 2013245 - RNA, 18 nt, Human
acuguccuacccacccuc

SEQ ID NO: 2013246 - RNA, 23 nt, Human
acuguccuacccacccuccuuuc

SEQ ID NO: 2013247 - RNA, 17 nt, Human
acuguccuacccacccu

SEQ ID NO: 2013248 - RNA, 11 nt, Human
acuguggagac

SEQ ID NO: 2013249 - RNA, 15 nt, Human
acuguggagacugcu

SEQ ID NO: 2013250 - RNA, 17 nt, Human
acuguggagacugcucc

SEQ ID NO: 2013251 - RNA, 22 nt, Human
acuguggagacugcuccugagc

SEQ ID NO: 2013252 - RNA, 22 nt, Human
ucuaaaacuguacuuugauuca

SEQ ID NO: 2013253 - RNA, 22 nt, Human
ucuaaaauauuuaugaagaaaa

SEQ ID NO: 2013254 - RNA, 19 nt, Human
ucuaaaaauauacauguuu

SEQ ID NO: 2013255 - RNA, 18 nt, Human
ucuaaaaauaacuguaau

SEQ ID NO: 2013256 - RNA, 14 nt, Human
ucuaaaaauauaca

SEQ ID NO: 2013257 - RNA, 15 nt, Human
ucuaaaaauauacau

SEQ ID NO: 2013258 - RNA, 12 nt, Human
ucuaaaacugua

SEQ ID NO: 2013259 - RNA, 15 nt, Human
ucuaaaacuguacuu

SEQ ID NO: 2013260 - RNA, 18 nt, Human
ucuaaaacuguacuuuga

SEQ ID NO: 2013261 - RNA, 19 nt, Human
ucuaaaacuguacuuugau

SEQ ID NO: 2013262 - RNA, 16 nt, Human
ucguaaaauuaagaaa

SEQ ID NO: 2013263 - RNA, 17 nt, Human
ucguaaacaucucagag

SEQ ID NO: 2013264 - RNA, 22 nt, Human
ucguuuucaaaauuguuacaaa

SEQ ID NO: 2013265 - RNA, 17 nt, Human
ucguuugaaucacagua

SEQ ID NO: 2013266 - RNA, 13 nt, Human
ucguaaaauuaag

SEQ ID NO: 2013267 - RNA, 16 nt, Human
ucgguguccccaccau

SEQ ID NO: 2013268 - RNA, 19 nt, Human
ucgguguccccaccaucug

SEQ ID NO: 2013269 - RNA, 20 nt, Human
ucgguguccccaccaucugc

SEQ ID NO: 2013270 - RNA, 21 nt, Human
ucgguguccccaccaucugcu

SEQ ID NO: 2013271 - RNA, 15 nt, Human
ucgguuaacaaauaa

SEQ ID NO: 2013272 - RNA, 20 nt, Human
ucgguuaacaaauaacaacu

SEQ ID NO: 2013273 - RNA, 17 nt, Human
ucggugccaucagugcc

SEQ ID NO: 2013274 - RNA, 21 nt, Human
ucgggaggucgaggcaggagg

SEQ ID NO: 2013275 - RNA, 19 nt, Human
ucgggaggucgaggcagga

SEQ ID NO: 2013276 - RNA, 17 nt, Human
ucgggaggucgaggcag

SEQ ID NO: 2013277 - RNA, 18 nt, Human
ucggcucacugcauccuc

SEQ ID NO: 2013278 - RNA, 22 nt, Human
ucggcuccaguccccagaacuc

SEQ ID NO: 2013279 - RNA, 12 nt, Human
ucgggcaugaca

SEQ ID NO: 2013280 - RNA, 11 nt, Human
ucgggcaugac

SEQ ID NO: 2013281 - RNA, 15 nt, Human
ucgggccccaccugc

SEQ ID NO: 2013282 - RNA, 17 nt, Human
ucgggccccaccugcag

SEQ ID NO: 2013283 - RNA, 20 nt, Human
ucgggccccaccugcagcuc

SEQ ID NO: 2013284 - RNA, 23 nt, Human
ucgggggggacccuccaaggcca

SEQ ID NO: 2013285 - RNA, 19 nt, Human
ucgggggggacccuccaag

SEQ ID NO: 2013286 - RNA, 15 nt, Human
ucgguacccaccaca

SEQ ID NO: 2013287 - RNA, 23 nt, Human
acuuaccugaagggguuuucuug

SEQ ID NO: 2013288 - RNA, 19 nt, Human
acuuaccugaguugaagag

SEQ ID NO: 2013289 - RNA, 20 nt, Human
acuuaccugaguugaagagg

SEQ ID NO: 2013290 - RNA, 13 nt, Human
acuuaaucuaaau

SEQ ID NO: 2013291 - RNA, 23 nt, Human
acuuaauaaucaagagccuuaaa

SEQ ID NO: 2013292 - RNA, 23 nt, Human
acuuaauaucuucauuucuaaau

SEQ ID NO: 2013293 - RNA, 15 nt, Human
acuuaaucuaaaugg

SEQ ID NO: 2013294 - RNA, 16 nt, Human
acuuaaucuaaaugga

SEQ ID NO: 2013295 - RNA, 14 nt, Human
acuucagcucuguu

SEQ ID NO: 2013296 - RNA, 18 nt, Human
acuuauaaagaagguugg

SEQ ID NO: 2013297 - RNA, 13 nt, Human
acuuaguuuugca

SEQ ID NO: 2013298 - RNA, 17 nt, Human
acuuaguuuugcauagu

SEQ ID NO: 2013299 - RNA, 16 nt, Human
acuuagaaauugcauu

SEQ ID NO: 2013300 - RNA, 21 nt, Human
acuuagaaucccuguguuaau

SEQ ID NO: 2013301 - RNA, 22 nt, Human
acuuagagcuuuuuuuuuuuaa

SEQ ID NO: 2013302 - RNA, 23 nt, Human
acuuagagcuuuuuuuuuuuaau

SEQ ID NO: 2013303 - RNA, 18 nt, Human
acuuagaaucccuguguu

SEQ ID NO: 2013304 - RNA, 19 nt, Human
acuuagaaucccuguguua

SEQ ID NO: 2013305 - RNA, 20 nt, Human
acuuagaaucccuguguuaa

SEQ ID NO: 2013306 - RNA, 22 nt, Human
acuuagaaucccuguguuaauu

SEQ ID NO: 2013307 - RNA, 12 nt, Human
acuguugcccag

SEQ ID NO: 2013308 - RNA, 13 nt, Human
acuguugcccagg

SEQ ID NO: 2013309 - RNA, 14 nt, Human
acuguugcccaggc

SEQ ID NO: 2013310 - RNA, 17 nt, Human
acuguugcccaggcugg

SEQ ID NO: 2013311 - RNA, 18 nt, Human
acuguugcccaggcuggc

SEQ ID NO: 2013312 - RNA, 17 nt, Human
acuuaaauaaugugaaa

SEQ ID NO: 2013313 - RNA, 18 nt, Human
acuuaaauaaugugaaac

SEQ ID NO: 2013314 - RNA, 16 nt, Human
acuuaaauaaugugaa

SEQ ID NO: 2013315 - RNA, 15 nt, Human
acuuaaauaauguga

SEQ ID NO: 2013316 - RNA, 12 nt, Human
acuguuguauaa

SEQ ID NO: 2013317 - RNA, 13 nt, Human
acuuaauaaucaa

SEQ ID NO: 2013318 - RNA, 15 nt, Human
acuuaauaaucaaga

SEQ ID NO: 2013319 - RNA, 19 nt, Human
acuuaauaaucaagagccu

SEQ ID NO: 2013320 - RNA, 22 nt, Human
acuuaauaaucaagagccuuaa

SEQ ID NO: 2013321 - RNA, 13 nt, Human
acuguuguauaaa

SEQ ID NO: 2013322 - RNA, 12 nt, Human
acuguuauucuu

SEQ ID NO: 2013323 - RNA, 14 nt, Human
acuguuagaaugua

SEQ ID NO: 2013324 - RNA, 15 nt, Human
acuguuagaauguaa

SEQ ID NO: 2013325 - RNA, 13 nt, Human
acuguuaucauuu

SEQ ID NO: 2013326 - RNA, 14 nt, Human
acuguuaucauuuu

SEQ ID NO: 2013327 - RNA, 13 nt, Human
acuguuagaaugu

SEQ ID NO: 2013328 - RNA, 16 nt, Human
acuguuaccauuggaa

SEQ ID NO: 2013329 - RNA, 17 nt, Human
acuguuaccauuggaaa

SEQ ID NO: 2013330 - RNA, 18 nt, Human
acuguuaccauuggaaau

SEQ ID NO: 2013331 - RNA, 19 nt, Human
acuguuaccauuggaaauu

SEQ ID NO: 2013332 - RNA, 21 nt, Human
acuguuaccauuggaaauuuc

SEQ ID NO: 2013333 - RNA, 22 nt, Human
acuguuaccauuggaaauuuca

SEQ ID NO: 2013334 - RNA, 14 nt, Human
acuguuacuugaua

SEQ ID NO: 2013335 - RNA, 14 nt, Human
ucuaccaacuuuca

SEQ ID NO: 2013336 - RNA, 17 nt, Human
ucuaccaacuuucaaga

SEQ ID NO: 2013337 - RNA, 18 nt, Human
ucuaccaacuuucaagaa

SEQ ID NO: 2013338 - RNA, 22 nt, Human
ucuaccaacuuucaagaacuug

SEQ ID NO: 2013339 - RNA, 16 nt, Human
acuguucccugaggug

SEQ ID NO: 2013340 - RNA, 19 nt, Human
acuguucccugagguggga

SEQ ID NO: 2013341 - RNA, 13 nt, Human
acuguuauucuuu

SEQ ID NO: 2013342 - RNA, 15 nt, Human
acuguuauucuuugc

SEQ ID NO: 2013343 - RNA, 16 nt, Human
acuguuauucuuugca

SEQ ID NO: 2013344 - RNA, 18 nt, Human
acuguuauucuuugcacu

SEQ ID NO: 2013345 - RNA, 14 nt, Human
acuguucucugccc

SEQ ID NO: 2013346 - RNA, 19 nt, Human
acuguuauucuuugcacuu

SEQ ID NO: 2013347 - RNA, 20 nt, Human
acuguucucugcccuccaag

SEQ ID NO: 2013348 - RNA, 15 nt, Human
acuguucucugcccu

SEQ ID NO: 2013349 - RNA, 21 nt, Human
acuguucucugcccuccaaga

SEQ ID NO: 2013350 - RNA, 15 nt, Human
ucuaaagcugccagc

SEQ ID NO: 2013351 - RNA, 16 nt, Human
ucuaaagcugccagcc

SEQ ID NO: 2013352 - RNA, 11 nt, Human
ucuaaggacaa

SEQ ID NO: 2013353 - RNA, 14 nt, Human
ucuaaagcugccag

SEQ ID NO: 2013354 - RNA, 13 nt, Human
ucuaaagcugcca

SEQ ID NO: 2013355 - RNA, 20 nt, Human
ucuaaagccauuguaguccu

SEQ ID NO: 2013356 - RNA, 15 nt, Human
acuccuccuagccac

SEQ ID NO: 2013357 - RNA, 16 nt, Human
acuccuccuagccacc

SEQ ID NO: 2013358 - RNA, 18 nt, Human
acuccuccuagccaccca

SEQ ID NO: 2013359 - RNA, 14 nt, Human
acuccuccuagcca

SEQ ID NO: 2013360 - RNA, 13 nt, Human
acuccuccuagcc

SEQ ID NO: 2013361 - RNA, 13 nt, Human
acuccagccuggg

SEQ ID NO: 2013362 - RNA, 12 nt, Human
acuccagccugg

SEQ ID NO: 2013363 - RNA, 23 nt, Human
acuccagaauuucccaaagcagu

SEQ ID NO: 2013364 - RNA, 17 nt, Human
acuccugcaggcagcca

SEQ ID NO: 2013365 - RNA, 19 nt, Human
acuccugcaggcagccagg

SEQ ID NO: 2013366 - RNA, 18 nt, Human
acuccugcaggcagccag

SEQ ID NO: 2013367 - RNA, 14 nt, Human
acuccucuguccag

SEQ ID NO: 2013368 - RNA, 13 nt, Human
acuccucugucca

SEQ ID NO: 2013369 - RNA, 17 nt, Human
acuccagaauuucccaa

SEQ ID NO: 2013370 - RNA, 15 nt, Human
acuccagaauuuccc

SEQ ID NO: 2013371 - RNA, 20 nt, Human
acuccagaaaugucccuuuc

SEQ ID NO: 2013372 - RNA, 23 nt, Human
acuccagaaaugucccuuucuuc

SEQ ID NO: 2013373 - RNA, 15 nt, Human
acucauugaccugag

SEQ ID NO: 2013374 - RNA, 13 nt, Human
acucaugugauuu

SEQ ID NO: 2013375 - RNA, 18 nt, Human
acucagaaacuccaugau

SEQ ID NO: 2013376 - RNA, 23 nt, Human
acucacuggggaacguucucuuu

SEQ ID NO: 2013377 - RNA, 19 nt, Human
acucacuggugguuuuccg

SEQ ID NO: 2013378 - RNA, 14 nt, Human
acucauugaccuga

SEQ ID NO: 2013379 - RNA, 15 nt, Human
acucauucuucugua

SEQ ID NO: 2013380 - RNA, 14 nt, Human
acucauguuaauug

SEQ ID NO: 2013381 - RNA, 17 nt, Human
ucccuuacgugaguccu

SEQ ID NO: 2013382 - RNA, 19 nt, Human
ucccuuaagaaugaguuuc

SEQ ID NO: 2013383 - RNA, 22 nt, Human
ucccuuaagaaugaguuucuua

SEQ ID NO: 2013384 - RNA, 18 nt, Human
ucccuuaagaaugaguuu

SEQ ID NO: 2013385 - RNA, 20 nt, Human
ucccuguguuaauuuaaguu

SEQ ID NO: 2013386 - RNA, 17 nt, Human
ucccugguaagaaaaag

SEQ ID NO: 2013387 - RNA, 21 nt, Human
ucccuggguuagacugccagc

SEQ ID NO: 2013388 - RNA, 22 nt, Human
ucccuggguuagacugccagcu

SEQ ID NO: 2013389 - RNA, 23 nt, Human
ucccuggguuagacugccagcuc

SEQ ID NO: 2013390 - RNA, 14 nt, Human
ucccuggggugggg

SEQ ID NO: 2013391 - RNA, 20 nt, Human
ucccuggguuagacugccag

SEQ ID NO: 2013392 - RNA, 21 nt, Human
acuccugcaggcagccaggcc

SEQ ID NO: 2013393 - RNA, 12 nt, Human
ucccugucccag

SEQ ID NO: 2013394 - RNA, 15 nt, Human
ucccugguggcagcu

SEQ ID NO: 2013395 - RNA, 16 nt, Human
uccuagaaauucccca

SEQ ID NO: 2013396 - RNA, 14 nt, Human
uccuacuuccccuu

SEQ ID NO: 2013397 - RNA, 17 nt, Human
uccuacucuucucucug

SEQ ID NO: 2013398 - RNA, 18 nt, Human
uccuacucuucucucugc

SEQ ID NO: 2013399 - RNA, 20 nt, Human
uccuacucuucucucugcuc

SEQ ID NO: 2013400 - RNA, 23 nt, Human
uccuacucuucucucugcucuga

SEQ ID NO: 2013401 - RNA, 13 nt, Human
uccuaacccuggc

SEQ ID NO: 2013402 - RNA, 19 nt, Human
uccuaaauauauuuuaaga

SEQ ID NO: 2013403 - RNA, 17 nt, Human
uccggucccugucccag

SEQ ID NO: 2013404 - RNA, 14 nt, Human
uccgggucuuccua

SEQ ID NO: 2013405 - RNA, 12 nt, Human
ucccuuuuccuu

SEQ ID NO: 2013406 - RNA, 14 nt, Human
ucccuuuuccauga

SEQ ID NO: 2013407 - RNA, 16 nt, Human
ucccuuucuucucccc

SEQ ID NO: 2013408 - RNA, 21 nt, Human
uccgggacguggcaccuccuc

SEQ ID NO: 2013409 - RNA, 15 nt, Human
uccggggccagcucc

SEQ ID NO: 2013410 - RNA, 16 nt, Human
uccggggccagcuccg

SEQ ID NO: 2013411 - RNA, 14 nt, Human
ucccucuuucccuc

SEQ ID NO: 2013412 - RNA, 20 nt, Human
ucccucuuucccucccuucc

SEQ ID NO: 2013413 - RNA, 18 nt, Human
ucccucuuucccucccuu

SEQ ID NO: 2013414 - RNA, 20 nt, Human
ucccugaaggaaccaaagcg

SEQ ID NO: 2013415 - RNA, 21 nt, Human
ucccucuuucccucccuuccu

SEQ ID NO: 2013416 - RNA, 15 nt, Human
ucccugaaggccccg

SEQ ID NO: 2013417 - RNA, 11 nt, Human
ucccugaaggc

SEQ ID NO: 2013418 - RNA, 13 nt, Human
ucccggcugcccu

SEQ ID NO: 2013419 - RNA, 14 nt, Human
ucccggcugcccuu

SEQ ID NO: 2013420 - RNA, 15 nt, Human
ucccggcugcccuuu

SEQ ID NO: 2013421 - RNA, 18 nt, Human
ucccggcugcccuuucug

SEQ ID NO: 2013422 - RNA, 22 nt, Human
ucccggcugcccuuucugggca

SEQ ID NO: 2013423 - RNA, 14 nt, Human
ucccggcccugccu

SEQ ID NO: 2013424 - RNA, 15 nt, Human
ucccggcccugccug

SEQ ID NO: 2013425 - RNA, 14 nt, Human
ucccugauaaauau

SEQ ID NO: 2013426 - RNA, 15 nt, Human
ucccugauaaauauu

SEQ ID NO: 2013427 - RNA, 15 nt, Human
ucccugaucccugau

SEQ ID NO: 2013428 - RNA, 14 nt, Human
ucccugaucccuuc

SEQ ID NO: 2013429 - RNA, 15 nt, Human
ucccugaucccuucc

SEQ ID NO: 2013430 - RNA, 17 nt, Human
ucccugaucccuuccac

SEQ ID NO: 2013431 - RNA, 20 nt, Human
ucccugaggcagguccccag

SEQ ID NO: 2013432 - RNA, 21 nt, Human
ucccugaggcagguccccaga

SEQ ID NO: 2013433 - RNA, 22 nt, Human
ucccugaggcagguccccagac

SEQ ID NO: 2013434 - RNA, 11 nt, Human
ucccugaggca

SEQ ID NO: 2013435 - RNA, 12 nt, Human
ucccugacuggg

SEQ ID NO: 2013436 - RNA, 23 nt, Human
ucccugacugggggcagacaugg

SEQ ID NO: 2013437 - RNA, 16 nt, Human
ucccugaaggccccgc

SEQ ID NO: 2013438 - RNA, 15 nt, Human
uccccucuccuuccu

SEQ ID NO: 2013439 - RNA, 16 nt, Human
uccccucuccuuccug

SEQ ID NO: 2013440 - RNA, 20 nt, Human
ucccgaauagcugggacuac

SEQ ID NO: 2013441 - RNA, 15 nt, Human
ucccgaguagcuggg

SEQ ID NO: 2013442 - RNA, 19 nt, Human
ucccgagacggcacugaga

SEQ ID NO: 2013443 - RNA, 18 nt, Human
ucccgaguagcugggacu

SEQ ID NO: 2013444 - RNA, 20 nt, Human
ucccgaguagcugagauuau

SEQ ID NO: 2013445 - RNA, 16 nt, Human
ucccgaguagcuggga

SEQ ID NO: 2013446 - RNA, 17 nt, Human
ucccgaguagcugggac

SEQ ID NO: 2013447 - RNA, 17 nt, Human
acuacucccccaggugg

SEQ ID NO: 2013448 - RNA, 16 nt, Human
acuacucaaagcaaaa

SEQ ID NO: 2013449 - RNA, 18 nt, Human
acuacucaaagcaaaagu

SEQ ID NO: 2013450 - RNA, 17 nt, Human
acuaccuccucuccuga

SEQ ID NO: 2013451 - RNA, 12 nt, Human
acuaccuggcug

SEQ ID NO: 2013452 - RNA, 14 nt, Human
acuaccuggcugcg

SEQ ID NO: 2013453 - RNA, 21 nt, Human
acuacuagggaaaugccuuug

SEQ ID NO: 2013454 - RNA, 14 nt, Human
acuacuagggaaau

SEQ ID NO: 2013455 - RNA, 14 nt, Human
acuaccuccucucc

SEQ ID NO: 2013456 - RNA, 16 nt, Human
acuaccuccucuccug

SEQ ID NO: 2013457 - RNA, 21 nt, Human
acucacauuuauucugcucac

SEQ ID NO: 2013458 - RNA, 12 nt, Human
acucaccccagc

SEQ ID NO: 2013459 - RNA, 16 nt, Human
uccccuaaucuuuucu

SEQ ID NO: 2013460 - RNA, 14 nt, Human
uccccucccaggga

SEQ ID NO: 2013461 - RNA, 17 nt, Human
uccccucccagggagca

SEQ ID NO: 2013462 - RNA, 20 nt, Human
uccaucucuugcuuguuccu

SEQ ID NO: 2013463 - RNA, 13 nt, Human
uccaugaagaugu

SEQ ID NO: 2013464 - RNA, 21 nt, Human
uccaugaagauguagaggaga

SEQ ID NO: 2013465 - RNA, 20 nt, Human
uccauccugaggcuccacuu

SEQ ID NO: 2013466 - RNA, 21 nt, Human
uccauccugaggcuccacuug

SEQ ID NO: 2013467 - RNA, 23 nt, Human
acgccagauucuuuccugaggcu

SEQ ID NO: 2013468 - RNA, 22 nt, Human
acgccagauucuuuccugaggc

SEQ ID NO: 2013469 - RNA, 18 nt, Human
uccaucuaaacugccccc

SEQ ID NO: 2013470 - RNA, 16 nt, Human
uccaucuaaacugccc

SEQ ID NO: 2013471 - RNA, 14 nt, Human
uccaucuaaaaaua

SEQ ID NO: 2013472 - RNA, 15 nt, Human
uccaucuaaaaauau

SEQ ID NO: 2013473 - RNA, 16 nt, Human
uccaucuaaaaauaua

SEQ ID NO: 2013474 - RNA, 21 nt, Human
uccaucuaaaaauauacaugu

SEQ ID NO: 2013475 - RNA, 15 nt, Human
uccauccuuucuccu

SEQ ID NO: 2013476 - RNA, 18 nt, Human
ucccaaagcagugcaugc

SEQ ID NO: 2013477 - RNA, 17 nt, Human
ucccaaagcagugcaug

SEQ ID NO: 2013478 - RNA, 21 nt, Human
ucccaaagcagugcaugcugu

SEQ ID NO: 2013479 - RNA, 12 nt, Human
ucccaaaggcau

SEQ ID NO: 2013480 - RNA, 13 nt, Human
ucccaaagugcug

SEQ ID NO: 2013481 - RNA, 14 nt, Human
ucccaaagugcugg

SEQ ID NO: 2013482 - RNA, 12 nt, Human
ucccaaaagcua

SEQ ID NO: 2013483 - RNA, 15 nt, Human
uccauuuuuuauauu

SEQ ID NO: 2013484 - RNA, 17 nt, Human
uccauuuccuuaugcug

SEQ ID NO: 2013485 - RNA, 14 nt, Human
uccauuucacuggc

SEQ ID NO: 2013486 - RNA, 15 nt, Human
uccauuucacuggcu

SEQ ID NO: 2013487 - RNA, 18 nt, Human
ucccaaacccuucagugc

SEQ ID NO: 2013488 - RNA, 17 nt, Human
ucccaaaaucaccguac

SEQ ID NO: 2013489 - RNA, 16 nt, Human
ucccaaagcagugcau

SEQ ID NO: 2013490 - RNA, 17 nt, Human
acgguuuuacugcagcu

SEQ ID NO: 2013491 - RNA, 15 nt, Human
acgguuuuacugcag

SEQ ID NO: 2013492 - RNA, 22 nt, Human
acguauaaaagccuguuuaaga

SEQ ID NO: 2013493 - RNA, 20 nt, Human
acguagucggcacagccugg

SEQ ID NO: 2013494 - RNA, 13 nt, Human
acguauuauuguc

SEQ ID NO: 2013495 - RNA, 23 nt, Human
acguggcugcuucaaggauccug

SEQ ID NO: 2013496 - RNA, 19 nt, Human
acguuccucuccaccugca

SEQ ID NO: 2013497 - RNA, 11 nt, Human
acguguauguu

SEQ ID NO: 2013498 - RNA, 13 nt, Human
acguguauguuuu

SEQ ID NO: 2013499 - RNA, 16 nt, Human
acguguauguuuuuca

SEQ ID NO: 2013500 - RNA, 19 nt, Human
acguguauguuuuucaguu

SEQ ID NO: 2013501 - RNA, 23 nt, Human
acguguauguuuuucaguucaaa

SEQ ID NO: 2013502 - RNA, 15 nt, Human
acgugugcauguguc

SEQ ID NO: 2013503 - RNA, 16 nt, Human
acgugugcaugugucu

SEQ ID NO: 2013504 - RNA, 16 nt, Human
acgugggcuccccucu

SEQ ID NO: 2013505 - RNA, 17 nt, Human
acgugggcuccccucuu

SEQ ID NO: 2013506 - RNA, 19 nt, Human
acgugggcuccccucuucc

SEQ ID NO: 2013507 - RNA, 17 nt, Human
acgugggcauucaaaug

SEQ ID NO: 2013508 - RNA, 20 nt, Human
acgugggcauucaaauguau

SEQ ID NO: 2013509 - RNA, 20 nt, Human
ucccaccccacacacgccag

SEQ ID NO: 2013510 - RNA, 15 nt, Human
ucccaccccacacac

SEQ ID NO: 2013511 - RNA, 16 nt, Human
ucccacaaaggagagc

SEQ ID NO: 2013512 - RNA, 20 nt, Human
acgggaggguaaggcugugg

SEQ ID NO: 2013513 - RNA, 18 nt, Human
ucccaccccauccuccag

SEQ ID NO: 2013514 - RNA, 19 nt, Human
ucccaccccauccuccagg

SEQ ID NO: 2013515 - RNA, 19 nt, Human
acgguucaaaccugugaag

SEQ ID NO: 2013516 - RNA, 10 nt, Human
acgguuccua

SEQ ID NO: 2013517 - RNA, 17 nt, Human
acgguuccuacacagga

SEQ ID NO: 2013518 - RNA, 18 nt, Human
acgguuccuacacaggac

SEQ ID NO: 2013519 - RNA, 20 nt, Human
acgguuccuacacaggacag

SEQ ID NO: 2013520 - RNA, 21 nt, Human
uccccaccgcagacaggacca

SEQ ID NO: 2013521 - RNA, 18 nt, Human
uccccaccgcagacagga

SEQ ID NO: 2013522 - RNA, 17 nt, Human
uccccaccgcagacagg

SEQ ID NO: 2013523 - RNA, 17 nt, Human
uccccacccuccccuuc

SEQ ID NO: 2013524 - RNA, 22 nt, Human
uccccaccgcagacaggaccag

SEQ ID NO: 2013525 - RNA, 17 nt, Human
uccccaugucucgacuc

SEQ ID NO: 2013526 - RNA, 15 nt, Human
acuacauucuguuaa

SEQ ID NO: 2013527 - RNA, 15 nt, Human
acuaccaaaggacac

SEQ ID NO: 2013528 - RNA, 14 nt, Human
acuaccccuugauu

SEQ ID NO: 2013529 - RNA, 21 nt, Human
acuaccccuugauuuuccauc

SEQ ID NO: 2013530 - RNA, 22 nt, Human
ucccauaugccugggcagaagg

SEQ ID NO: 2013531 - RNA, 16 nt, Human
ucccaguagaaaauau

SEQ ID NO: 2013532 - RNA, 15 nt, Human
ucccaucacccgcua

SEQ ID NO: 2013533 - RNA, 15 nt, Human
ucccaguagaaaaua

SEQ ID NO: 2013534 - RNA, 14 nt, Human
uccccaccaucugc

SEQ ID NO: 2013535 - RNA, 15 nt, Human
uccccaccaucugcu

SEQ ID NO: 2013536 - RNA, 18 nt, Human
uccccaccaucugcuguc

SEQ ID NO: 2013537 - RNA, 19 nt, Human
uccccaccaucugcugucu

SEQ ID NO: 2013538 - RNA, 23 nt, Human
uccccaccaucugcugucuuuuc

SEQ ID NO: 2013539 - RNA, 15 nt, Human
acuacaguuuguuag

SEQ ID NO: 2013540 - RNA, 11 nt, Human
acuacauucug

SEQ ID NO: 2013541 - RNA, 12 nt, Human
acuacauucugu

SEQ ID NO: 2013542 - RNA, 13 nt, Human
acuacauucuguu

SEQ ID NO: 2013543 - RNA, 14 nt, Human
acuacauucuguua

SEQ ID NO: 2013544 - RNA, 12 nt, Human
ucccagccccaa

SEQ ID NO: 2013545 - RNA, 17 nt, Human
ucccagcugugcucugg

SEQ ID NO: 2013546 - RNA, 17 nt, Human
ucccagcaucgcacucu

SEQ ID NO: 2013547 - RNA, 13 nt, Human
ucccagcagccag

SEQ ID NO: 2013548 - RNA, 14 nt, Human
ucccagcagccagc

SEQ ID NO: 2013549 - RNA, 15 nt, Human
ucccagcagccagcc

SEQ ID NO: 2013550 - RNA, 16 nt, Human
ucccagcagccagcca

SEQ ID NO: 2013551 - RNA, 13 nt, Human
acuacaguuuguu

SEQ ID NO: 2013552 - RNA, 14 nt, Human
acuacaguuuguua

SEQ ID NO: 2013553 - RNA, 15 nt, Human
acuacaggcacccac

SEQ ID NO: 2013554 - RNA, 18 nt, Human
acuacagggccgccggca

SEQ ID NO: 2013555 - RNA, 16 nt, Human
acuacaauauguacau

SEQ ID NO: 2013556 - RNA, 18 nt, Human
acuacaauauguacauuu

SEQ ID NO: 2013557 - RNA, 13 nt, Human
acuacaauaugua

SEQ ID NO: 2013558 - RNA, 20 nt, Human
acuacaauauguacauuucu

SEQ ID NO: 2013559 - RNA, 11 nt, Human
acuacaggcac

SEQ ID NO: 2013560 - RNA, 12 nt, Human
acuaaccacgcu

SEQ ID NO: 2013561 - RNA, 14 nt, Human
accucuaaauucuu

SEQ ID NO: 2013562 - RNA, 13 nt, Human
accucucccaggg

SEQ ID NO: 2013563 - RNA, 12 nt, Human
accucuuguuuu

SEQ ID NO: 2013564 - RNA, 13 nt, Human
accucuuuggaaa

SEQ ID NO: 2013565 - RNA, 14 nt, Human
accugaggcccuuc

SEQ ID NO: 2013566 - RNA, 20 nt, Human
accugaggacauggcuucug

SEQ ID NO: 2013567 - RNA, 21 nt, Human
accugaggacauggcuucuga

SEQ ID NO: 2013568 - RNA, 21 nt, Human
accugaggcccuucucuccag

SEQ ID NO: 2013569 - RNA, 20 nt, Human
accugaggcccuucucucca

SEQ ID NO: 2013570 - RNA, 16 nt, Human
accugaggcccuucuc

SEQ ID NO: 2013571 - RNA, 15 nt, Human
accugaggcccuucu

SEQ ID NO: 2013572 - RNA, 22 nt, Human
accugaggcccuucucuccagc

SEQ ID NO: 2013573 - RNA, 18 nt, Human
accugauugugucucuug

SEQ ID NO: 2013574 - RNA, 17 nt, Human
accugauugugucucuu

SEQ ID NO: 2013575 - RNA, 15 nt, Human
accugauugugucuc

SEQ ID NO: 2013576 - RNA, 17 nt, Human
accugaguugaagaggg

SEQ ID NO: 2013577 - RNA, 14 nt, Human
accugaguuccuga

SEQ ID NO: 2013578 - RNA, 14 nt, Human
accugaguugaaga

SEQ ID NO: 2013579 - RNA, 16 nt, Human
accugaguugaagagg

SEQ ID NO: 2013580 - RNA, 17 nt, Human
accugcagauucuagga

SEQ ID NO: 2013581 - RNA, 13 nt, Human
accugcagcuccc

SEQ ID NO: 2013582 - RNA, 15 nt, Human
accugcagcucccuc

SEQ ID NO: 2013583 - RNA, 15 nt, Human
accugauuucuccug

SEQ ID NO: 2013584 - RNA, 14 nt, Human
ucauugcaucauuu

SEQ ID NO: 2013585 - RNA, 15 nt, Human
ucauugaccugaggc

SEQ ID NO: 2013586 - RNA, 14 nt, Human
ucauugaccugagg

SEQ ID NO: 2013587 - RNA, 12 nt, Human
ucauugaccuga

SEQ ID NO: 2013588 - RNA, 22 nt, Human
ucauugaaaucuuuuugcuuug

SEQ ID NO: 2013589 - RNA, 19 nt, Human
accucggugccuuccucuu

SEQ ID NO: 2013590 - RNA, 13 nt, Human
accuccugggcua

SEQ ID NO: 2013591 - RNA, 18 nt, Human
ucaugaugcucuuuccca

SEQ ID NO: 2013592 - RNA, 23 nt, Human
ucaugaugcucuuucccacccag

SEQ ID NO: 2013593 - RNA, 13 nt, Human
ucaugauguuuuu

SEQ ID NO: 2013594 - RNA, 19 nt, Human
ucaugauguuuuuaaaauc

SEQ ID NO: 2013595 - RNA, 20 nt, Human
ucaugauguuuuuaaaaucu

SEQ ID NO: 2013596 - RNA, 21 nt, Human
ucaugauguuuuuaaaaucuu

SEQ ID NO: 2013597 - RNA, 16 nt, Human
ucaugaugcucuuucc

SEQ ID NO: 2013598 - RNA, 17 nt, Human
ucaugaugcucuuuccc

SEQ ID NO: 2013599 - RNA, 13 nt, Human
ucauugaaaucuu

SEQ ID NO: 2013600 - RNA, 12 nt, Human
ucauugaaaucu

SEQ ID NO: 2013601 - RNA, 21 nt, Human
ucauucuuuuugaaaugucaa

SEQ ID NO: 2013602 - RNA, 12 nt, Human
ucauucuucugu

SEQ ID NO: 2013603 - RNA, 12 nt, Human
ucauuacuuguu

SEQ ID NO: 2013604 - RNA, 17 nt, Human
ucauuacuuguugccua

SEQ ID NO: 2013605 - RNA, 22 nt, Human
ucauccuucuggaauaaggaga

SEQ ID NO: 2013606 - RNA, 14 nt, Human
ucaucuaggauuuu

SEQ ID NO: 2013607 - RNA, 18 nt, Human
ucaucuagguaaauuaca

SEQ ID NO: 2013608 - RNA, 13 nt, Human
ucauccuucccac

SEQ ID NO: 2013609 - RNA, 18 nt, Human
ucauccuucccacucugu

SEQ ID NO: 2013610 - RNA, 20 nt, Human
ucauccuuucacuucuuucc

SEQ ID NO: 2013611 - RNA, 22 nt, Human
ucauccuuucacuucuuucccu

SEQ ID NO: 2013612 - RNA, 21 nt, Human
ucaugaauaacugauuaguaa

SEQ ID NO: 2013613 - RNA, 19 nt, Human
ucauccuccucagaucuuc

SEQ ID NO: 2013614 - RNA, 13 nt, Human
ucauccuccucag

SEQ ID NO: 2013615 - RNA, 18 nt, Human
ucauccucauacccaccc

SEQ ID NO: 2013616 - RNA, 14 nt, Human
ucauccuucuggaa

SEQ ID NO: 2013617 - RNA, 15 nt, Human
ucauccuaagcuauu

SEQ ID NO: 2013618 - RNA, 14 nt, Human
ucaucccuucucuu

SEQ ID NO: 2013619 - RNA, 16 nt, Human
ucaucccuucucuucc

SEQ ID NO: 2013620 - RNA, 21 nt, Human
ucaucccuucucuuccaggca

SEQ ID NO: 2013621 - RNA, 23 nt, Human
ucaucccuucucuuccaggcagc

SEQ ID NO: 2013622 - RNA, 17 nt, Human
ucauccccucacuugcc

SEQ ID NO: 2013623 - RNA, 14 nt, Human
ucauccccucagaa

SEQ ID NO: 2013624 - RNA, 20 nt, Human
ucauccccucagaaggucug

SEQ ID NO: 2013625 - RNA, 23 nt, Human
accuccugccucgaacuggcugc

SEQ ID NO: 2013626 - RNA, 16 nt, Human
accucaaccaaugcca

SEQ ID NO: 2013627 - RNA, 20 nt, Human
accucaaaugaugugccugc

SEQ ID NO: 2013628 - RNA, 22 nt, Human
accucaaaugaugugccugcuu

SEQ ID NO: 2013629 - RNA, 13 nt, Human
accuccugccucg

SEQ ID NO: 2013630 - RNA, 12 nt, Human
accuccugccuc

SEQ ID NO: 2013631 - RNA, 20 nt, Human
accuaacaacauuguagccu

SEQ ID NO: 2013632 - RNA, 13 nt, Human
accuaaaugaaua

SEQ ID NO: 2013633 - RNA, 14 nt, Human
accuaaccagggcc

SEQ ID NO: 2013634 - RNA, 13 nt, Human
accuaacccagaa

SEQ ID NO: 2013635 - RNA, 16 nt, Human
accuaacccagaaaau

SEQ ID NO: 2013636 - RNA, 15 nt, Human
ucaggaagcucaggg

SEQ ID NO: 2013637 - RNA, 14 nt, Human
ucaggaagcucagg

SEQ ID NO: 2013638 - RNA, 13 nt, Human
ucaggaagcucag

SEQ ID NO: 2013639 - RNA, 12 nt, Human
ucaggaagcuca

SEQ ID NO: 2013640 - RNA, 14 nt, Human
accuaguacugccc

SEQ ID NO: 2013641 - RNA, 16 nt, Human
accuaccaccacgccc

SEQ ID NO: 2013642 - RNA, 20 nt, Human
accuaccaccacgcccggcu

SEQ ID NO: 2013643 - RNA, 15 nt, Human
accuaccacuacauu

SEQ ID NO: 2013644 - RNA, 14 nt, Human
accuaauuaauuuc

SEQ ID NO: 2013645 - RNA, 15 nt, Human
accuaauuaauuuca

SEQ ID NO: 2013646 - RNA, 15 nt, Human
accuaauugcacaac

SEQ ID NO: 2013647 - RNA, 23 nt, Human
accuaauugcacaacagagacug

SEQ ID NO: 2013648 - RNA, 18 nt, Human
uccacuggggauugggcc

SEQ ID NO: 2013649 - RNA, 14 nt, Human
uccagacccggcug

SEQ ID NO: 2013650 - RNA, 13 nt, Human
uccagacacaugu

SEQ ID NO: 2013651 - RNA, 22 nt, Human
uccagaauuucccaaagcagug

SEQ ID NO: 2013652 - RNA, 20 nt, Human
uccagaauuucccaaagcag

SEQ ID NO: 2013653 - RNA, 21 nt, Human
uccacuccuccuagccaccca

SEQ ID NO: 2013654 - RNA, 13 nt, Human
uccacugccuucg

SEQ ID NO: 2013655 - RNA, 15 nt, Human
uccacugccuucgau

SEQ ID NO: 2013656 - RNA, 22 nt, Human
uccacugccuucgauacaccgg

SEQ ID NO: 2013657 - RNA, 16 nt, Human
uccagaauuucccaaa

SEQ ID NO: 2013658 - RNA, 19 nt, Human
uccagacccggcugcgugg

SEQ ID NO: 2013659 - RNA, 15 nt, Human
uccagacccggcugc

SEQ ID NO: 2013660 - RNA, 18 nt, Human
uccagacccggcugcgug

SEQ ID NO: 2013661 - RNA, 15 nt, Human
uccacuccuccuagc

SEQ ID NO: 2013662 - RNA, 18 nt, Human
uccacuccuccuagccac

SEQ ID NO: 2013663 - RNA, 16 nt, Human
uccaccuucccaugcc

SEQ ID NO: 2013664 - RNA, 18 nt, Human
uccaccuucccaugcccu

SEQ ID NO: 2013665 - RNA, 19 nt, Human
uccaccuucccaugcccug

SEQ ID NO: 2013666 - RNA, 20 nt, Human
accuuaaauuaguacagcac

SEQ ID NO: 2013667 - RNA, 12 nt, Human
accuucaagcug

SEQ ID NO: 2013668 - RNA, 14 nt, Human
accuucaagcugcu

SEQ ID NO: 2013669 - RNA, 20 nt, Human
accuucaagcugcuuuuugu

SEQ ID NO: 2013670 - RNA, 20 nt, Human
accuuuugagugccuuacac

SEQ ID NO: 2013671 - RNA, 17 nt, Human
accuuuugagugccuua

SEQ ID NO: 2013672 - RNA, 14 nt, Human
accuuuugagugcc

SEQ ID NO: 2013673 - RNA, 16 nt, Human
uccaggccagggggcc

SEQ ID NO: 2013674 - RNA, 12 nt, Human
uccaggcagcac

SEQ ID NO: 2013675 - RNA, 18 nt, Human
uccaggcagcacccaggu

SEQ ID NO: 2013676 - RNA, 11 nt, Human
uccaggcagcc

SEQ ID NO: 2013677 - RNA, 13 nt, Human
uccaggcagccgc

SEQ ID NO: 2013678 - RNA, 18 nt, Human
uccaggccagggggccag

SEQ ID NO: 2013679 - RNA, 14 nt, Human
uccaggcuguaucc

SEQ ID NO: 2013680 - RNA, 17 nt, Human
uccaggccccucccucu

SEQ ID NO: 2013681 - RNA, 16 nt, Human
uccaggccuacuccug

SEQ ID NO: 2013682 - RNA, 18 nt, Human
uccaggccuacuccuguc

SEQ ID NO: 2013683 - RNA, 12 nt, Human
uccagccccugg

SEQ ID NO: 2013684 - RNA, 16 nt, Human
uccagagaguggcucc

SEQ ID NO: 2013685 - RNA, 17 nt, Human
uccagagaguggcuccu

SEQ ID NO: 2013686 - RNA, 15 nt, Human
uccagagaguggcuc

SEQ ID NO: 2013687 - RNA, 13 nt, Human
uccagccccugga

SEQ ID NO: 2013688 - RNA, 14 nt, Human
uccagccccuggau

SEQ ID NO: 2013689 - RNA, 17 nt, Human
acgccagauucuuuccu

SEQ ID NO: 2013690 - RNA, 19 nt, Human
acgccagauucuuuccuga

SEQ ID NO: 2013691 - RNA, 16 nt, Human
acgagcaggcuucuuc

SEQ ID NO: 2013692 - RNA, 13 nt, Human
acgagccuuuuca

SEQ ID NO: 2013693 - RNA, 19 nt, Human
accuuuuuuauacauaaac

SEQ ID NO: 2013694 - RNA, 20 nt, Human
accuuuuuuauacauaaaca

SEQ ID NO: 2013695 - RNA, 21 nt, Human
uccaggcuguaucccaugagc

SEQ ID NO: 2013696 - RNA, 20 nt, Human
uccaggcuuuguacagagug

SEQ ID NO: 2013697 - RNA, 21 nt, Human
accuuuuuuauacauaaacaa

SEQ ID NO: 2013698 - RNA, 22 nt, Human
accuuuuuuauacauaaacaag

SEQ ID NO: 2013699 - RNA, 14 nt, Human
acgagaaaacaaua

SEQ ID NO: 2013700 - RNA, 20 nt, Human
accuuagacagucccugcca

SEQ ID NO: 2013701 - RNA, 19 nt, Human
accuuagacagucccugcc

SEQ ID NO: 2013702 - RNA, 18 nt, Human
accuuagacagucccugc

SEQ ID NO: 2013703 - RNA, 17 nt, Human
accuuaaaauuugaaac

SEQ ID NO: 2013704 - RNA, 20 nt, Human
accuuaaaauuugaaacauu

SEQ ID NO: 2013705 - RNA, 21 nt, Human
accuuaaaauuugaaacauug

SEQ ID NO: 2013706 - RNA, 12 nt, Human
accuuaaaauuu

SEQ ID NO: 2013707 - RNA, 13 nt, Human
accuuaaaauuug

SEQ ID NO: 2013708 - RNA, 14 nt, Human
accuuaaaauuuga

SEQ ID NO: 2013709 - RNA, 15 nt, Human
accuuaaaauuugaa

SEQ ID NO: 2013710 - RNA, 19 nt, Human
accuguuucugcagccacu

SEQ ID NO: 2013711 - RNA, 21 nt, Human
accuggucacaggacucugcc

SEQ ID NO: 2013712 - RNA, 13 nt, Human
accuguuuaaauu

SEQ ID NO: 2013713 - RNA, 15 nt, Human
accuguuuaaauugc

SEQ ID NO: 2013714 - RNA, 16 nt, Human
accuguuuaaauugcu

SEQ ID NO: 2013715 - RNA, 23 nt, Human
accuguuuaaauugcucacaguu

SEQ ID NO: 2013716 - RNA, 20 nt, Human
accuggccucugcacucccc

SEQ ID NO: 2013717 - RNA, 18 nt, Human
accuggccucugcacucc

SEQ ID NO: 2013718 - RNA, 23 nt, Human
accuggccucugcacuccccugc

SEQ ID NO: 2013719 - RNA, 15 nt, Human
accuggccugucugu

SEQ ID NO: 2013720 - RNA, 23 nt, Human
accuggguccccagcccuuccuc

SEQ ID NO: 2013721 - RNA, 22 nt, Human
accuggauugugccuaaugugu

SEQ ID NO: 2013722 - RNA, 17 nt, Human
accuggccucugcacuc

SEQ ID NO: 2013723 - RNA, 16 nt, Human
accuggccucugcacu

SEQ ID NO: 2013724 - RNA, 14 nt, Human
accuggccucugca

SEQ ID NO: 2013725 - RNA, 17 nt, Human
uccacccaccucagccu

SEQ ID NO: 2013726 - RNA, 18 nt, Human
uccacccaccucagccuc

SEQ ID NO: 2013727 - RNA, 19 nt, Human
uccacccaccucagccucc

SEQ ID NO: 2013728 - RNA, 12 nt, Human
uccacccaggag

SEQ ID NO: 2013729 - RNA, 14 nt, Human
uccacccaggagcc

SEQ ID NO: 2013730 - RNA, 15 nt, Human
uccacccaggagccc

SEQ ID NO: 2013731 - RNA, 24 nt, Human
uccaaccccucgcccagucccagc

SEQ ID NO: 2013732 - RNA, 19 nt, Human
uccaacuccaacauccacu

SEQ ID NO: 2013733 - RNA, 21 nt, Human
uccaacuccaacauccacucu

SEQ ID NO: 2013734 - RNA, 23 nt, Human
uccaacugagaaguaccuuauca

SEQ ID NO: 2013735 - RNA, 12 nt, Human
uccaagaagccc

SEQ ID NO: 2013736 - RNA, 16 nt, Human
uccaagcuggucccac

SEQ ID NO: 2013737 - RNA, 20 nt, Human
uccaagcuggucccacucag

SEQ ID NO: 2013738 - RNA, 21 nt, Human
uccaagcuggucccacucagu

SEQ ID NO: 2013739 - RNA, 18 nt, Human
uccaaggguacuaaggaa

SEQ ID NO: 2013740 - RNA, 18 nt, Human
uccaaucccaccaacccu

SEQ ID NO: 2013741 - RNA, 14 nt, Human
uccaagucacugca

SEQ ID NO: 2013742 - RNA, 19 nt, Human
uccaagucuuugcuauugu

SEQ ID NO: 2013743 - RNA, 23 nt, Human
uccaagucacugcaaaaccaggu

SEQ ID NO: 2013744 - RNA, 21 nt, Human
uccaagucuuugcuauuguga

SEQ ID NO: 2013745 - RNA, 20 nt, Human
uccaaguggccuccgucacu

SEQ ID NO: 2013746 - RNA, 13 nt, Human
uccaaccccucgc

SEQ ID NO: 2013747 - RNA, 14 nt, Human
uccaaccccucgcc

SEQ ID NO: 2013748 - RNA, 18 nt, Human
uccaaccccucgcccagu

SEQ ID NO: 2013749 - RNA, 19 nt, Human
uccaaccccucgcccaguc

SEQ ID NO: 2013750 - RNA, 14 nt, Human
uccaacccucauca

SEQ ID NO: 2013751 - RNA, 17 nt, Human
uccaacccucaucacca

SEQ ID NO: 2013752 - RNA, 16 nt, Human
uccaacccucaucacc

SEQ ID NO: 2013753 - RNA, 23 nt, Human
uccaacccucaucaccaacgucu

SEQ ID NO: 2013754 - RNA, 15 nt, Human
accugccaggaagcc

SEQ ID NO: 2013755 - RNA, 14 nt, Human
accugccaggaagc

SEQ ID NO: 2013756 - RNA, 12 nt, Human
accugccaggaa

SEQ ID NO: 2013757 - RNA, 14 nt, Human
acaguuuucuucau

SEQ ID NO: 2013758 - RNA, 16 nt, Human
acaguuuguuaguaug

SEQ ID NO: 2013759 - RNA, 20 nt, Human
acaguuuguuaguaugaggc

SEQ ID NO: 2013760 - RNA, 14 nt, Human
acauacucugcuua

SEQ ID NO: 2013761 - RNA, 17 nt, Human
acauacucccaucugug

SEQ ID NO: 2013762 - RNA, 21 nt, Human
acauacuaaccagcagaaaug

SEQ ID NO: 2013763 - RNA, 22 nt, Human
acauacuaaccagcagaaaugc

SEQ ID NO: 2013764 - RNA, 13 nt, Human
acauacucccauc

SEQ ID NO: 2013765 - RNA, 21 nt, Human
acauacgugugcaugugucuu

SEQ ID NO: 2013766 - RNA, 22 nt, Human
acauacgugugcaugugucuuu

SEQ ID NO: 2013767 - RNA, 15 nt, Human
acauacguaaaaauc

SEQ ID NO: 2013768 - RNA, 15 nt, Human
acauacgugugcaug

SEQ ID NO: 2013769 - RNA, 16 nt, Human
acauacgugugcaugu

SEQ ID NO: 2013770 - RNA, 13 nt, Human
acauacuaaccag

SEQ ID NO: 2013771 - RNA, 12 nt, Human
acaguugugcag

SEQ ID NO: 2013772 - RNA, 17 nt, Human
acaguugugcaggaggu

SEQ ID NO: 2013773 - RNA, 11 nt, Human
acaguuguuug

SEQ ID NO: 2013774 - RNA, 12 nt, Human
acaguuguuuga

SEQ ID NO: 2013775 - RNA, 13 nt, Human
acaguuguuugau

SEQ ID NO: 2013776 - RNA, 15 nt, Human
acaguuguuugaugc

SEQ ID NO: 2013777 - RNA, 22 nt, Human
acaguuguuugaugcauuaaaa

SEQ ID NO: 2013778 - RNA, 16 nt, Human
acaguugaaaaacagc

SEQ ID NO: 2013779 - RNA, 15 nt, Human
acaguugaaaaacag

SEQ ID NO: 2013780 - RNA, 20 nt, Human
acaguugaaaaacagcugag

SEQ ID NO: 2013781 - RNA, 20 nt, Human
uaugaacuuuauaguuguuu

SEQ ID NO: 2013782 - RNA, 20 nt, Human
uaugaagaaaauacuuaaau

SEQ ID NO: 2013783 - RNA, 22 nt, Human
uaugaagaaaauacuuaaaugu

SEQ ID NO: 2013784 - RNA, 14 nt, Human
uaugaagaaaauac

SEQ ID NO: 2013785 - RNA, 15 nt, Human
uaugaagaaaauacu

SEQ ID NO: 2013786 - RNA, 16 nt, Human
uaugaagaaaauacuu

SEQ ID NO: 2013787 - RNA, 22 nt, Human
uauuucccugaaggaaccaaag

SEQ ID NO: 2013788 - RNA, 22 nt, Human
uauuucccucaccuuucccauc

SEQ ID NO: 2013789 - RNA, 15 nt, Human
uauuucccccuuucu

SEQ ID NO: 2013790 - RNA, 20 nt, Human
uauuucccccuuucuuccuc

SEQ ID NO: 2013791 - RNA, 23 nt, Human
uauuuccuauauuguuuucagug

SEQ ID NO: 2013792 - RNA, 17 nt, Human
uauuuccuauaccauuu

SEQ ID NO: 2013793 - RNA, 19 nt, Human
uauuuccuauaccauuucc

SEQ ID NO: 2013794 - RNA, 13 nt, Human
uauuucccuuuag

SEQ ID NO: 2013795 - RNA, 16 nt, Human
uauuucccuuuagcug

SEQ ID NO: 2013796 - RNA, 20 nt, Human
uauuucuagacacuuuuucu

SEQ ID NO: 2013797 - RNA, 18 nt, Human
acaugaaaacacauuuuu

SEQ ID NO: 2013798 - RNA, 19 nt, Human
acaugaaaacacauuuuuc

SEQ ID NO: 2013799 - RNA, 17 nt, Human
acaugaaaacacauuuu

SEQ ID NO: 2013800 - RNA, 21 nt, Human
acaucuugcucugcugacaga

SEQ ID NO: 2013801 - RNA, 18 nt, Human
acaucuugcucugcugac

SEQ ID NO: 2013802 - RNA, 19 nt, Human
acaucuugcucugcugaca

SEQ ID NO: 2013803 - RNA, 11 nt, Human
acaucuccuua

SEQ ID NO: 2013804 - RNA, 15 nt, Human
acaucuccuuagaaa

SEQ ID NO: 2013805 - RNA, 15 nt, Human
acaucucuauucccc

SEQ ID NO: 2013806 - RNA, 13 nt, Human
acaucuugcucug

SEQ ID NO: 2013807 - RNA, 14 nt, Human
acaucuugcucugc

SEQ ID NO: 2013808 - RNA, 13 nt, Human
acaucuguuuugu

SEQ ID NO: 2013809 - RNA, 20 nt, Human
acaucagaaauaauaaaaaa

SEQ ID NO: 2013810 - RNA, 23 nt, Human
acaucucccuuuuccaugacugu

SEQ ID NO: 2013811 - RNA, 11 nt, Human
acaucucagag

SEQ ID NO: 2013812 - RNA, 12 nt, Human
acaucucagaga

SEQ ID NO: 2013813 - RNA, 12 nt, Human
acaucacuggca

SEQ ID NO: 2013814 - RNA, 14 nt, Human
acaucacuggcaug

SEQ ID NO: 2013815 - RNA, 23 nt, Human
acaucacuggcauggugguuggg

SEQ ID NO: 2013816 - RNA, 23 nt, Human
acaucaaauaauugaagagacaa

SEQ ID NO: 2013817 - RNA, 13 nt, Human
acaucaacagaua

SEQ ID NO: 2013818 - RNA, 18 nt, Human
acaucaacaucuugguca

SEQ ID NO: 2013819 - RNA, 16 nt, Human
acaucaacaucuuggu

SEQ ID NO: 2013820 - RNA, 14 nt, Human
acauagaauuaaca

SEQ ID NO: 2013821 - RNA, 18 nt, Human
acauagaauuaacacaug

SEQ ID NO: 2013822 - RNA, 16 nt, Human
acauagccaaaaugug

SEQ ID NO: 2013823 - RNA, 19 nt, Human
acauagccaaaaugugagu

SEQ ID NO: 2013824 - RNA, 21 nt, Human
acauaggaaguuaaaagcaca

SEQ ID NO: 2013825 - RNA, 16 nt, Human
acauaggguucccacg

SEQ ID NO: 2013826 - RNA, 16 nt, Human
acauagugaugguucc

SEQ ID NO: 2013827 - RNA, 21 nt, Human
acauagugaugguuccccugu

SEQ ID NO: 2013828 - RNA, 15 nt, Human
acauauacaacacca

SEQ ID NO: 2013829 - RNA, 16 nt, Human
acauauaaauugucuu

SEQ ID NO: 2013830 - RNA, 17 nt, Human
acauauaaauugucuua

SEQ ID NO: 2013831 - RNA, 22 nt, Human
acauauaaauugucuuaaugga

SEQ ID NO: 2013832 - RNA, 18 nt, Human
acauauugauuuccguua

SEQ ID NO: 2013833 - RNA, 22 nt, Human
acauauugauuuccguuaaaau

SEQ ID NO: 2013834 - RNA, 23 nt, Human
acauauugauuuccguuaaaaua

SEQ ID NO: 2013835 - RNA, 20 nt, Human
acauauuagcgacaacagau

SEQ ID NO: 2013836 - RNA, 14 nt, Human
acauauugauuucc

SEQ ID NO: 2013837 - RNA, 16 nt, Human
acauauugauuuccgu

SEQ ID NO: 2013838 - RNA, 16 nt, Human
acauauguauacaugu

SEQ ID NO: 2013839 - RNA, 17 nt, Human
acauauguauacaugug

SEQ ID NO: 2013840 - RNA, 18 nt, Human
acauauguauacaugugc

SEQ ID NO: 2013841 - RNA, 21 nt, Human
ucaacauggcuacuugcuuug

SEQ ID NO: 2013842 - RNA, 22 nt, Human
ucaacauggcuacuugcuuuga

SEQ ID NO: 2013843 - RNA, 14 nt, Human
ucaacaugucuccu

SEQ ID NO: 2013844 - RNA, 17 nt, Human
ucaacauaccuuggcca

SEQ ID NO: 2013845 - RNA, 10 nt, Human
ucaagaaaug

SEQ ID NO: 2013846 - RNA, 14 nt, Human
ucaagaaaugaaga

SEQ ID NO: 2013847 - RNA, 15 nt, Human
ucaagaaaugaagag

SEQ ID NO: 2013848 - RNA, 16 nt, Human
ucaagaaaugaagagc

SEQ ID NO: 2013849 - RNA, 14 nt, Human
ucaagaaguucuuu

SEQ ID NO: 2013850 - RNA, 18 nt, Human
ucaagaaaugaagagcug

SEQ ID NO: 2013851 - RNA, 21 nt, Human
ucaagaaaugaagagcuguug

SEQ ID NO: 2013852 - RNA, 14 nt, Human
ucaagaacuuguuu

SEQ ID NO: 2013853 - RNA, 15 nt, Human
ucaagaacuuguuua

SEQ ID NO: 2013854 - RNA, 16 nt, Human
ucaagaacuuguuuaa

SEQ ID NO: 2013855 - RNA, 16 nt, Human
ucaagacugaauucca

SEQ ID NO: 2013856 - RNA, 17 nt, Human
ucaagacugaauuccaa

SEQ ID NO: 2013857 - RNA, 11 nt, Human
ucaagagccuu

SEQ ID NO: 2013858 - RNA, 19 nt, Human
ucaagaauagcauuguaaa

SEQ ID NO: 2013859 - RNA, 22 nt, Human
ucaagaaguucuuugauucugu

SEQ ID NO: 2013860 - RNA, 13 nt, Human
ucaagaccaaaug

SEQ ID NO: 2013861 - RNA, 19 nt, Human
ucaagaccaaauggaaaca

SEQ ID NO: 2013862 - RNA, 21 nt, Human
ucaagaccaaauggaaacaga

SEQ ID NO: 2013863 - RNA, 15 nt, Human
ucaaguauuauaaac

SEQ ID NO: 2013864 - RNA, 16 nt, Human
ucaaguauuauaaaca

SEQ ID NO: 2013865 - RNA, 16 nt, Human
ucaaguauuuaagccu

SEQ ID NO: 2013866 - RNA, 23 nt, Human
ucaaguauuauaccuuuuuuaga

SEQ ID NO: 2013867 - RNA, 16 nt, Human
ucaaguauuauaccuu

SEQ ID NO: 2013868 - RNA, 21 nt, Human
ucaaguauuauaccuuuuuua

SEQ ID NO: 2013869 - RNA, 18 nt, Human
ucaaguagacuacuguuc

SEQ ID NO: 2013870 - RNA, 19 nt, Human
ucaaguagacuacuguuca

SEQ ID NO: 2013871 - RNA, 21 nt, Human
ucaaguagacuacuguucagc

SEQ ID NO: 2013872 - RNA, 14 nt, Human
ucaaguauuauaaa

SEQ ID NO: 2013873 - RNA, 15 nt, Human
ucaaguauuauaccu

SEQ ID NO: 2013874 - RNA, 11 nt, Human
ucaaguauuau

SEQ ID NO: 2013875 - RNA, 17 nt, Human
ucaaguagacuacuguu

SEQ ID NO: 2013876 - RNA, 14 nt, Human
ucaagggcuuuccu

SEQ ID NO: 2013877 - RNA, 15 nt, Human
ucaagggcuuuccug

SEQ ID NO: 2013878 - RNA, 19 nt, Human
ucaagggcuuuccugugcc

SEQ ID NO: 2013879 - RNA, 21 nt, Human
ucaagggcuuuccugugccag

SEQ ID NO: 2013880 - RNA, 17 nt, Human
ucaagaucaaaaaggcu

SEQ ID NO: 2013881 - RNA, 19 nt, Human
ucaagaucaaaaaggcuua

SEQ ID NO: 2013882 - RNA, 15 nt, Human
ucaagagccuuaaaa

SEQ ID NO: 2013883 - RNA, 16 nt, Human
ucaagagccuuaaaac

SEQ ID NO: 2013884 - RNA, 17 nt, Human
ucaagagccuuaaaaca

SEQ ID NO: 2013885 - RNA, 18 nt, Human
ucaagagccuuaaaacau

SEQ ID NO: 2013886 - RNA, 19 nt, Human
ucaagagccuuaaaacauc

SEQ ID NO: 2013887 - RNA, 20 nt, Human
ucaagagccuuaaaacauca

SEQ ID NO: 2013888 - RNA, 21 nt, Human
ucaagagccuuaaaacaucau

SEQ ID NO: 2013889 - RNA, 23 nt, Human
ucaagaucaaaaaggcuuauaaa

SEQ ID NO: 2013890 - RNA, 24 nt, Human
ucaagaucaaaaaggcuuauaaaa

SEQ ID NO: 2013891 - RNA, 14 nt, Human
ucaaauuucuaaau

SEQ ID NO: 2013892 - RNA, 15 nt, Human
acauucuguuaauca

SEQ ID NO: 2013893 - RNA, 15 nt, Human
ucaaauuucuaaauc

SEQ ID NO: 2013894 - RNA, 16 nt, Human
ucaaauuucuaaaucu

SEQ ID NO: 2013895 - RNA, 12 nt, Human
acauucuguuaa

SEQ ID NO: 2013896 - RNA, 17 nt, Human
ucaaauuucuaaaucuc

SEQ ID NO: 2013897 - RNA, 16 nt, Human
ucaacagguuuuccug

SEQ ID NO: 2013898 - RNA, 15 nt, Human
ucaacagcaagugug

SEQ ID NO: 2013899 - RNA, 16 nt, Human
ucaacagcaaguguga

SEQ ID NO: 2013900 - RNA, 22 nt, Human
ucaacagcaagugugaauacug

SEQ ID NO: 2013901 - RNA, 21 nt, Human
acauguccaagaagcccagga

SEQ ID NO: 2013902 - RNA, 13 nt, Human
acauuaacaggca

SEQ ID NO: 2013903 - RNA, 19 nt, Human
acaugucuccuacugagga

SEQ ID NO: 2013904 - RNA, 22 nt, Human
acauuaguacuuuauagaagaa

SEQ ID NO: 2013905 - RNA, 23 nt, Human
acauuaguacuuuauagaagaau

SEQ ID NO: 2013906 - RNA, 16 nt, Human
acauuaguacuuuaua

SEQ ID NO: 2013907 - RNA, 18 nt, Human
acauuaguacuuuauaga

SEQ ID NO: 2013908 - RNA, 19 nt, Human
acauuaguacuuuauagaa

SEQ ID NO: 2013909 - RNA, 18 nt, Human
acauuagcaguuugcuuu

SEQ ID NO: 2013910 - RNA, 22 nt, Human
acauuagcaguuugcuuuguau

SEQ ID NO: 2013911 - RNA, 17 nt, Human
uauuuguaaauuuaugu

SEQ ID NO: 2013912 - RNA, 22 nt, Human
uauuuguaaauuuaugugaugg

SEQ ID NO: 2013913 - RNA, 16 nt, Human
uauuuguaaauuuaug

SEQ ID NO: 2013914 - RNA, 12 nt, Human
uauuugugugcu

SEQ ID NO: 2013915 - RNA, 16 nt, Human
uauuuuuacaugcaga

SEQ ID NO: 2013916 - RNA, 13 nt, Human
uauuuuucuuaaa

SEQ ID NO: 2013917 - RNA, 18 nt, Human
ucaaaagaaagaaaauca

SEQ ID NO: 2013918 - RNA, 14 nt, Human
uauuuuugaaaaau

SEQ ID NO: 2013919 - RNA, 19 nt, Human
ucaaaauuguuacaaauug

SEQ ID NO: 2013920 - RNA, 16 nt, Human
ucaaaauuguuacaaa

SEQ ID NO: 2013921 - RNA, 13 nt, Human
ucaaaaugcaaaa

SEQ ID NO: 2013922 - RNA, 13 nt, Human
ucaaaaguuuguu

SEQ ID NO: 2013923 - RNA, 14 nt, Human
ucaaaaguuuguuu

SEQ ID NO: 2013924 - RNA, 16 nt, Human
ucaaaagagaugaaag

SEQ ID NO: 2013925 - RNA, 20 nt, Human
ucaaaagagcacuuuaauaa

SEQ ID NO: 2013926 - RNA, 17 nt, Human
ucaaaauagguuuuuau

SEQ ID NO: 2013927 - RNA, 20 nt, Human
ucaaaauauaaaaugccaag

SEQ ID NO: 2013928 - RNA, 19 nt, Human
acaugauccugcaauucca

SEQ ID NO: 2013929 - RNA, 19 nt, Human
acaugagcaucaggccagg

SEQ ID NO: 2013930 - RNA, 18 nt, Human
acaugagcaucaggccag

SEQ ID NO: 2013931 - RNA, 17 nt, Human
acaugagcaucaggcca

SEQ ID NO: 2013932 - RNA, 17 nt, Human
acaugaucuucuuuaua

SEQ ID NO: 2013933 - RNA, 15 nt, Human
acaugaucuucuuua

SEQ ID NO: 2013934 - RNA, 22 nt, Human
acaugcuacacacugcauguuu

SEQ ID NO: 2013935 - RNA, 20 nt, Human
acaugagcaucaggccaggc

SEQ ID NO: 2013936 - RNA, 18 nt, Human
ucaaauaacuaaaaggua

SEQ ID NO: 2013937 - RNA, 21 nt, Human
ucaaauacauuuaaaacauua

SEQ ID NO: 2013938 - RNA, 22 nt, Human
ucaaauacauuuaaaacauuaa

SEQ ID NO: 2013939 - RNA, 19 nt, Human
ucaaauaauaccuuagaag

SEQ ID NO: 2013940 - RNA, 21 nt, Human
ucaaauaauaccuuagaaggu

SEQ ID NO: 2013941 - RNA, 11 nt, Human
ucaaauaauac

SEQ ID NO: 2013942 - RNA, 19 nt, Human
ucaaacaaacucucugaac

SEQ ID NO: 2013943 - RNA, 15 nt, Human
ucaaagccacacucu

SEQ ID NO: 2013944 - RNA, 17 nt, Human
ucaaacacuugugacuu

SEQ ID NO: 2013945 - RNA, 14 nt, Human
ucaaagcugaaaug

SEQ ID NO: 2013946 - RNA, 18 nt, Human
ucaaagccccauuaacug

SEQ ID NO: 2013947 - RNA, 20 nt, Human
ucaaagccccauuaacugcu

SEQ ID NO: 2013948 - RNA, 21 nt, Human
ucaaagccccauuaacugcuu

SEQ ID NO: 2013949 - RNA, 17 nt, Human
ucaaagccccauuaacu

SEQ ID NO: 2013950 - RNA, 17 nt, Human
accccuguaggccucag

SEQ ID NO: 2013951 - RNA, 15 nt, Human
accccuguaggccuc

SEQ ID NO: 2013952 - RNA, 16 nt, Human
accccuguaggccuca

SEQ ID NO: 2013953 - RNA, 12 nt, Human
acccccccagcu

SEQ ID NO: 2013954 - RNA, 22 nt, Human
acccccccagcuucacuucuga

SEQ ID NO: 2013955 - RNA, 13 nt, Human
accccccccccac

SEQ ID NO: 2013956 - RNA, 12 nt, Human
acccccacccaa

SEQ ID NO: 2013957 - RNA, 23 nt, Human
accccuuccugggcacacgcugc

SEQ ID NO: 2013958 - RNA, 20 nt, Human
ucagccuucuuuuucuggac

SEQ ID NO: 2013959 - RNA, 21 nt, Human
ucagccuucuuuuucuggacu

SEQ ID NO: 2013960 - RNA, 16 nt, Human
accccuucgcuccugu

SEQ ID NO: 2013961 - RNA, 14 nt, Human
accccuucgcuccu

SEQ ID NO: 2013962 - RNA, 15 nt, Human
accccuucgcuccug

SEQ ID NO: 2013963 - RNA, 15 nt, Human
accccuuccugggca

SEQ ID NO: 2013964 - RNA, 22 nt, Human
accccuuccugggcacacgcug

SEQ ID NO: 2013965 - RNA, 12 nt, Human
ucagcucagagc

SEQ ID NO: 2013966 - RNA, 20 nt, Human
ucagcuuguaaauagcucag

SEQ ID NO: 2013967 - RNA, 14 nt, Human
ucagcggggacagc

SEQ ID NO: 2013968 - RNA, 16 nt, Human
ucagcuaggaacaaau

SEQ ID NO: 2013969 - RNA, 19 nt, Human
ucagcuaggaacaaaucuu

SEQ ID NO: 2013970 - RNA, 20 nt, Human
ucagcuaggaacaaaucuuc

SEQ ID NO: 2013971 - RNA, 21 nt, Human
ucagcuaggaacaaaucuucc

SEQ ID NO: 2013972 - RNA, 23 nt, Human
ucagcuaggaacaaaucuuccug

SEQ ID NO: 2013973 - RNA, 13 nt, Human
ucagcucacugca

SEQ ID NO: 2013974 - RNA, 16 nt, Human
ucagcucacugcaacc

SEQ ID NO: 2013975 - RNA, 16 nt, Human
ucagcuugcacauuug

SEQ ID NO: 2013976 - RNA, 17 nt, Human
ucagcuugcacauuugg

SEQ ID NO: 2013977 - RNA, 21 nt, Human
ucagcccaaaccaccagaagc

SEQ ID NO: 2013978 - RNA, 22 nt, Human
ucagcccaaaccaccagaagcc

SEQ ID NO: 2013979 - RNA, 19 nt, Human
ucagcccaaucccugaucc

SEQ ID NO: 2013980 - RNA, 21 nt, Human
ucagcccaaucccugaucccu

SEQ ID NO: 2013981 - RNA, 23 nt, Human
ucagccguguaaccauggaccca

SEQ ID NO: 2013982 - RNA, 19 nt, Human
acccagcgagcccuggugg

SEQ ID NO: 2013983 - RNA, 23 nt, Human
acccagcgagcccugguggcagu

SEQ ID NO: 2013984 - RNA, 13 nt, Human
ucagccuaagaga

SEQ ID NO: 2013985 - RNA, 17 nt, Human
ucagccaucaacuaaag

SEQ ID NO: 2013986 - RNA, 22 nt, Human
ucagccaagaauucuuaaauau

SEQ ID NO: 2013987 - RNA, 24 nt, Human
acccagcgagcccugguggcagug

SEQ ID NO: 2013988 - RNA, 11 nt, Human
accccaccugc

SEQ ID NO: 2013989 - RNA, 12 nt, Human
accccaccugcg

SEQ ID NO: 2013990 - RNA, 23 nt, Human
accccagcuggggccaggcuggg

SEQ ID NO: 2013991 - RNA, 22 nt, Human
accccacuuagccuuucuuuuc

SEQ ID NO: 2013992 - RNA, 10 nt, Human
acccacugcu

SEQ ID NO: 2013993 - RNA, 11 nt, Human
acccacugcuc

SEQ ID NO: 2013994 - RNA, 15 nt, Human
accauuuuccugcau

SEQ ID NO: 2013995 - RNA, 12 nt, Human
accauuuuccug

SEQ ID NO: 2013996 - RNA, 14 nt, Human
accauuuuccugca

SEQ ID NO: 2013997 - RNA, 23 nt, Human
accauuucuugagguaaaagcau

SEQ ID NO: 2013998 - RNA, 13 nt, Human
acccacugcucug

SEQ ID NO: 2013999 - RNA, 14 nt, Human
acccacugcucugg

SEQ ID NO: 2014000 - RNA, 15 nt, Human
acccacugcucuggu

SEQ ID NO: 2014001 - RNA, 11 nt, Human
acccacugcuu

SEQ ID NO: 2014002 - RNA, 20 nt, Human
accauuaaaauaugcacuaa

SEQ ID NO: 2014003 - RNA, 14 nt, Human
accauuaaaauaug

SEQ ID NO: 2014004 - RNA, 19 nt, Human
accauuaaaauaugcacua

SEQ ID NO: 2014005 - RNA, 17 nt, Human
accauuauuaucaagua

SEQ ID NO: 2014006 - RNA, 22 nt, Human
accauugagaccgugaagauac

SEQ ID NO: 2014007 - RNA, 15 nt, Human
accauugcaacaaaa

SEQ ID NO: 2014008 - RNA, 23 nt, Human
accauugagaccgugaagauacu

SEQ ID NO: 2014009 - RNA, 16 nt, Human
accauugcaacaaaau

SEQ ID NO: 2014010 - RNA, 18 nt, Human
accauugcaacaaaauac

SEQ ID NO: 2014011 - RNA, 13 nt, Human
accauuggaaauu

SEQ ID NO: 2014012 - RNA, 14 nt, Human
accauuggaaauuu

SEQ ID NO: 2014013 - RNA, 15 nt, Human
accauuggaaauuuc

SEQ ID NO: 2014014 - RNA, 18 nt, Human
accauuggaaauuucacg

SEQ ID NO: 2014015 - RNA, 19 nt, Human
accauuggaaauuucacgu

SEQ ID NO: 2014016 - RNA, 20 nt, Human
accauuggaaauuucacguc

SEQ ID NO: 2014017 - RNA, 13 nt, Human
ucacucuuggagc

SEQ ID NO: 2014018 - RNA, 15 nt, Human
ucacuccuaccuggu

SEQ ID NO: 2014019 - RNA, 21 nt, Human
ucacucuuauugcccacgcug

SEQ ID NO: 2014020 - RNA, 23 nt, Human
ucacucuuauugcccacgcugga

SEQ ID NO: 2014021 - RNA, 22 nt, Human
accauggucggaaaacaugcua

SEQ ID NO: 2014022 - RNA, 20 nt, Human
ucagagacuccugcaggcag

SEQ ID NO: 2014023 - RNA, 17 nt, Human
ucagagacuccugcagg

SEQ ID NO: 2014024 - RNA, 21 nt, Human
ucagagacuccugcaggcagc

SEQ ID NO: 2014025 - RNA, 19 nt, Human
ucagaaucucaaauaacua

SEQ ID NO: 2014026 - RNA, 18 nt, Human
ucagaaucucaaauaacu

SEQ ID NO: 2014027 - RNA, 23 nt, Human
ucagaaguuuaaauauuaagcau

SEQ ID NO: 2014028 - RNA, 21 nt, Human
ucagagagggugggagugggc

SEQ ID NO: 2014029 - RNA, 16 nt, Human
ucagagagggugggag

SEQ ID NO: 2014030 - RNA, 23 nt, Human
ucagagagggugggagugggccc

SEQ ID NO: 2014031 - RNA, 12 nt, Human
ucagagccugca

SEQ ID NO: 2014032 - RNA, 13 nt, Human
ucagagccugcag

SEQ ID NO: 2014033 - RNA, 14 nt, Human
ucagagccugcagu

SEQ ID NO: 2014034 - RNA, 15 nt, Human
ucagagccugcaguu

SEQ ID NO: 2014035 - RNA, 18 nt, Human
ucagagccugcaguuauu

SEQ ID NO: 2014036 - RNA, 14 nt, Human
ucagaagacacuga

SEQ ID NO: 2014037 - RNA, 22 nt, Human
ucagaaguuucugccgcagccc

SEQ ID NO: 2014038 - RNA, 19 nt, Human
ucagaaguuucugccgcag

SEQ ID NO: 2014039 - RNA, 19 nt, Human
ucagaaguuucucagcucc

SEQ ID NO: 2014040 - RNA, 15 nt, Human
ucagaaguuuaaaua

SEQ ID NO: 2014041 - RNA, 17 nt, Human
ucagaaguuuaaauauu

SEQ ID NO: 2014042 - RNA, 15 nt, Human
ucagaaguccagagu

SEQ ID NO: 2014043 - RNA, 19 nt, Human
ucagaaggucuguuuugag

SEQ ID NO: 2014044 - RNA, 17 nt, Human
ucagaagguuguuuuau

SEQ ID NO: 2014045 - RNA, 14 nt, Human
ucagaaggucuguu

SEQ ID NO: 2014046 - RNA, 14 nt, Human
accacuuccagggg

SEQ ID NO: 2014047 - RNA, 20 nt, Human
accacuuccaggggaaccug

SEQ ID NO: 2014048 - RNA, 23 nt, Human
accacuuccaggggaaccugcca

SEQ ID NO: 2014049 - RNA, 15 nt, Human
accacuuuuguucuu

SEQ ID NO: 2014050 - RNA, 16 nt, Human
accacuuuuguucuug

SEQ ID NO: 2014051 - RNA, 21 nt, Human
accacuuuuguucuugguuug

SEQ ID NO: 2014052 - RNA, 22 nt, Human
ucaccccggccaccugcggugc

SEQ ID NO: 2014053 - RNA, 21 nt, Human
accacugcacuccagccuggg

SEQ ID NO: 2014054 - RNA, 23 nt, Human
accacugcucugaugaagaggag

SEQ ID NO: 2014055 - RNA, 15 nt, Human
accacugcucugaug

SEQ ID NO: 2014056 - RNA, 17 nt, Human
accacugcucugaugaa

SEQ ID NO: 2014057 - RNA, 20 nt, Human
accacugcacuccagccugg

SEQ ID NO: 2014058 - RNA, 17 nt, Human
accacugcacuccagcc

SEQ ID NO: 2014059 - RNA, 18 nt, Human
ucaccccggccaccugcg

SEQ ID NO: 2014060 - RNA, 17 nt, Human
ucaccccggccaccugc

SEQ ID NO: 2014061 - RNA, 14 nt, Human
accagacaagcugu

SEQ ID NO: 2014062 - RNA, 16 nt, Human
accagacaagcuguug

SEQ ID NO: 2014063 - RNA, 13 nt, Human
accagacacaaac

SEQ ID NO: 2014064 - RNA, 14 nt, Human
accagaagcccaga

SEQ ID NO: 2014065 - RNA, 16 nt, Human
accagaagcccagaau

SEQ ID NO: 2014066 - RNA, 13 nt, Human
accagaagcccag

SEQ ID NO: 2014067 - RNA, 14 nt, Human
accagaaccaaacc

SEQ ID NO: 2014068 - RNA, 19 nt, Human
accagaaccagucuuucaa

SEQ ID NO: 2014069 - RNA, 22 nt, Human
accacuuuuguucuugguuugu

SEQ ID NO: 2014070 - RNA, 19 nt, Human
accacuuguagauuugauu

SEQ ID NO: 2014071 - RNA, 13 nt, Human
accacuuguagau

SEQ ID NO: 2014072 - RNA, 14 nt, Human
accacuuguagauu

SEQ ID NO: 2014073 - RNA, 16 nt, Human
accacuuguagauuug

SEQ ID NO: 2014074 - RNA, 12 nt, Human
accagagcccac

SEQ ID NO: 2014075 - RNA, 14 nt, Human
accagagcccaccu

SEQ ID NO: 2014076 - RNA, 16 nt, Human
accagagcccaccuug

SEQ ID NO: 2014077 - RNA, 14 nt, Human
accagacaccuuga

SEQ ID NO: 2014078 - RNA, 11 nt, Human
accagacaggu

SEQ ID NO: 2014079 - RNA, 13 nt, Human
ucaccugccccuc

SEQ ID NO: 2014080 - RNA, 15 nt, Human
ucaccugccccucaa

SEQ ID NO: 2014081 - RNA, 15 nt, Human
ucaccucucccuugg

SEQ ID NO: 2014082 - RNA, 16 nt, Human
ucaccugaagacucau

SEQ ID NO: 2014083 - RNA, 14 nt, Human
accagggacugagg

SEQ ID NO: 2014084 - RNA, 17 nt, Human
accagagcccaccuugg

SEQ ID NO: 2014085 - RNA, 18 nt, Human
accagacuuuuuuaaaca

SEQ ID NO: 2014086 - RNA, 14 nt, Human
accagccuccaugc

SEQ ID NO: 2014087 - RNA, 19 nt, Human
accagccuccaugcugccu

SEQ ID NO: 2014088 - RNA, 20 nt, Human
accagccuccaugcugccuc

SEQ ID NO: 2014089 - RNA, 21 nt, Human
accagccuccaugcugccucc

SEQ ID NO: 2014090 - RNA, 18 nt, Human
ucacuauguugcccaggc

SEQ ID NO: 2014091 - RNA, 17 nt, Human
ucacuauguugcccagg

SEQ ID NO: 2014092 - RNA, 19 nt, Human
ucacuauguugcccaggca

SEQ ID NO: 2014093 - RNA, 20 nt, Human
ucacuauguugcccaggcag

SEQ ID NO: 2014094 - RNA, 20 nt, Human
ucaccccagccccaaaacuc

SEQ ID NO: 2014095 - RNA, 14 nt, Human
ucaccccagcccca

SEQ ID NO: 2014096 - RNA, 13 nt, Human
ucaccccagcccc

SEQ ID NO: 2014097 - RNA, 15 nt, Human
ucaccccggccaccu

SEQ ID NO: 2014098 - RNA, 15 nt, Human
ucaccaguacauucu

SEQ ID NO: 2014099 - RNA, 17 nt, Human
ucaccaguacauucuca

SEQ ID NO: 2014100 - RNA, 19 nt, Human
ucaccaguacauucucagu

SEQ ID NO: 2014101 - RNA, 21 nt, Human
ucaccaguacauucucaguuu

SEQ ID NO: 2014102 - RNA, 19 nt, Human
ucaccagugaccuggaagg

SEQ ID NO: 2014103 - RNA, 16 nt, Human
ucacaucuuuuucacu

SEQ ID NO: 2014104 - RNA, 22 nt, Human
ucacacgucuggcuucacagau

SEQ ID NO: 2014105 - RNA, 13 nt, Human
ucacaccugcaga

SEQ ID NO: 2014106 - RNA, 14 nt, Human
ucacaaauuucucu

SEQ ID NO: 2014107 - RNA, 18 nt, Human
ucacaaauuucucuguuc

SEQ ID NO: 2014108 - RNA, 19 nt, Human
ucacaaauuucucuguucc

SEQ ID NO: 2014109 - RNA, 16 nt, Human
ucacaacaaccugguc

SEQ ID NO: 2014110 - RNA, 18 nt, Human
ucacaaaugacuuuauua

SEQ ID NO: 2014111 - RNA, 19 nt, Human
ucacaaaugacuuuauuau

SEQ ID NO: 2014112 - RNA, 20 nt, Human
ucacaaaugacuuuauuauu

SEQ ID NO: 2014113 - RNA, 23 nt, Human
ucacaaauauuaaaaagucuuuu

SEQ ID NO: 2014114 - RNA, 11 nt, Human
ucacaaaugac

SEQ ID NO: 2014115 - RNA, 12 nt, Human
ucacaaaugacu

SEQ ID NO: 2014116 - RNA, 13 nt, Human
ucacaaaugacuu

SEQ ID NO: 2014117 - RNA, 14 nt, Human
ucacaaaugacuuu

SEQ ID NO: 2014118 - RNA, 15 nt, Human
ucacaaaugacuuua

SEQ ID NO: 2014119 - RNA, 12 nt, Human
ucacauaucugu

SEQ ID NO: 2014120 - RNA, 15 nt, Human
ucacauaucugucau

SEQ ID NO: 2014121 - RNA, 16 nt, Human
ucacauccuugacuuu

SEQ ID NO: 2014122 - RNA, 19 nt, Human
ucacauccuugacuuuuua

SEQ ID NO: 2014123 - RNA, 21 nt, Human
ucacauccuugacuuuuuaga

SEQ ID NO: 2014124 - RNA, 15 nt, Human
ucacaguucucuccu

SEQ ID NO: 2014125 - RNA, 17 nt, Human
ucacaguuauuacauac

SEQ ID NO: 2014126 - RNA, 15 nt, Human
accaauguucucucu

SEQ ID NO: 2014127 - RNA, 22 nt, Human
accaacauacucccaucuguga

SEQ ID NO: 2014128 - RNA, 21 nt, Human
accaacauacucccaucugug

SEQ ID NO: 2014129 - RNA, 19 nt, Human
accaacauacucccaucug

SEQ ID NO: 2014130 - RNA, 20 nt, Human
ucaagugauucucaugccuc

SEQ ID NO: 2014131 - RNA, 17 nt, Human
accaacauacucccauc

SEQ ID NO: 2014132 - RNA, 23 nt, Human
ucaagugaaaaaggaggaagaga

SEQ ID NO: 2014133 - RNA, 17 nt, Human
ucaagugauucucaugc

SEQ ID NO: 2014134 - RNA, 22 nt, Human
ucaaguauuuaagccuaaagau

SEQ ID NO: 2014135 - RNA, 15 nt, Human
ucaagugaaaaagga

SEQ ID NO: 2014136 - RNA, 15 nt, Human
ucaauucuugccaaa

SEQ ID NO: 2014137 - RNA, 14 nt, Human
ucacaaauauuaaa

SEQ ID NO: 2014138 - RNA, 15 nt, Human
ucacaaauauuaaaa

SEQ ID NO: 2014139 - RNA, 17 nt, Human
ucacaaauauuaaaaag

SEQ ID NO: 2014140 - RNA, 18 nt, Human
ucacaaauauuaaaaagu

SEQ ID NO: 2014141 - RNA, 20 nt, Human
ucacaaauauuaaaaagucu

SEQ ID NO: 2014142 - RNA, 21 nt, Human
ucacaaauauuaaaaagucuu

SEQ ID NO: 2014143 - RNA, 20 nt, Human
ucaauuuuugguugaauaaa

SEQ ID NO: 2014144 - RNA, 22 nt, Human
accacacguaaugaaacuugga

SEQ ID NO: 2014145 - RNA, 14 nt, Human
accacacuccagcu

SEQ ID NO: 2014146 - RNA, 15 nt, Human
accaauuuuaacuua

SEQ ID NO: 2014147 - RNA, 21 nt, Human
accaauuuuuugugugugaag

SEQ ID NO: 2014148 - RNA, 22 nt, Human
accaauuuuuugugugugaagc

SEQ ID NO: 2014149 - RNA, 13 nt, Human
uagucucaagaau

SEQ ID NO: 2014150 - RNA, 17 nt, Human
uagucuuaagaacugcu

SEQ ID NO: 2014151 - RNA, 21 nt, Human
uaguacuuuauagaagaaugc

SEQ ID NO: 2014152 - RNA, 12 nt, Human
uaguagagacag

SEQ ID NO: 2014153 - RNA, 13 nt, Human
uaguagagacagg

SEQ ID NO: 2014154 - RNA, 13 nt, Human
uaguacuuuauag

SEQ ID NO: 2014155 - RNA, 14 nt, Human
uaguacuuuauaga

SEQ ID NO: 2014156 - RNA, 15 nt, Human
uaguacuuuauagaa

SEQ ID NO: 2014157 - RNA, 16 nt, Human
uaguacuuuauagaag

SEQ ID NO: 2014158 - RNA, 18 nt, Human
uaguacuuuauagaagaa

SEQ ID NO: 2014159 - RNA, 14 nt, Human
uaguaauauaauac

SEQ ID NO: 2014160 - RNA, 23 nt, Human
uaguacuggauuauucaggcuuu

SEQ ID NO: 2014161 - RNA, 14 nt, Human
uaguacugugaauc

SEQ ID NO: 2014162 - RNA, 11 nt, Human
acacagugagu

SEQ ID NO: 2014163 - RNA, 18 nt, Human
acacaggacagggguucc

SEQ ID NO: 2014164 - RNA, 22 nt, Human
uaguaagucuugccuauauuuu

SEQ ID NO: 2014165 - RNA, 14 nt, Human
uaguaauaaagacu

SEQ ID NO: 2014166 - RNA, 23 nt, Human
uaguaagcggcucaagcccagga

SEQ ID NO: 2014167 - RNA, 13 nt, Human
uaguaagauacug

SEQ ID NO: 2014168 - RNA, 21 nt, Human
uagguuggcaaaaaggcagga

SEQ ID NO: 2014169 - RNA, 13 nt, Human
acacagugagucg

SEQ ID NO: 2014170 - RNA, 17 nt, Human
acacagugaccauacua

SEQ ID NO: 2014171 - RNA, 11 nt, Human
acacacagcuc

SEQ ID NO: 2014172 - RNA, 12 nt, Human
acacacagcucu

SEQ ID NO: 2014173 - RNA, 14 nt, Human
acacacacauacac

SEQ ID NO: 2014174 - RNA, 21 nt, Human
acaaugguuuucuuguguguu

SEQ ID NO: 2014175 - RNA, 19 nt, Human
uagcuuauuuuuacaguua

SEQ ID NO: 2014176 - RNA, 15 nt, Human
acaaugguuuucuug

SEQ ID NO: 2014177 - RNA, 22 nt, Human
uauaaccaguguuguggauuua

SEQ ID NO: 2014178 - RNA, 19 nt, Human
uauaacuauguugauaaaa

SEQ ID NO: 2014179 - RNA, 18 nt, Human
uauaacuacauauugaau

SEQ ID NO: 2014180 - RNA, 13 nt, Human
uauaacuacauau

SEQ ID NO: 2014181 - RNA, 16 nt, Human
acacuaaccacgcugg

SEQ ID NO: 2014182 - RNA, 17 nt, Human
acacuaaccacgcugga

SEQ ID NO: 2014183 - RNA, 19 nt, Human
acacuaaccacgcuggacc

SEQ ID NO: 2014184 - RNA, 19 nt, Human
acaccucugcacaagcugc

SEQ ID NO: 2014185 - RNA, 14 nt, Human
acaccuugacaggg

SEQ ID NO: 2014186 - RNA, 19 nt, Human
acaccugcagauucuagga

SEQ ID NO: 2014187 - RNA, 15 nt, Human
acaccuugacagggc

SEQ ID NO: 2014188 - RNA, 16 nt, Human
acaccuugacagggca

SEQ ID NO: 2014189 - RNA, 18 nt, Human
acaccucugcacaagcug

SEQ ID NO: 2014190 - RNA, 20 nt, Human
acaccuccucccacugccca

SEQ ID NO: 2014191 - RNA, 22 nt, Human
acaccuccucccacugcccacu

SEQ ID NO: 2014192 - RNA, 14 nt, Human
acaccuccucccac

SEQ ID NO: 2014193 - RNA, 15 nt, Human
acaccuccucccacu

SEQ ID NO: 2014194 - RNA, 12 nt, Human
acacccagggaa

SEQ ID NO: 2014195 - RNA, 21 nt, Human
acaccccaccugcgcuucacu

SEQ ID NO: 2014196 - RNA, 12 nt, Human
acaccccaccug

SEQ ID NO: 2014197 - RNA, 14 nt, Human
acacccaugaaaga

SEQ ID NO: 2014198 - RNA, 13 nt, Human
acaccccaccugc

SEQ ID NO: 2014199 - RNA, 14 nt, Human
acaccccaccugcg

SEQ ID NO: 2014200 - RNA, 16 nt, Human
acaccccaccugcgcu

SEQ ID NO: 2014201 - RNA, 19 nt, Human
acacauguccaagaagccc

SEQ ID NO: 2014202 - RNA, 18 nt, Human
acacauguccaagaagcc

SEQ ID NO: 2014203 - RNA, 13 nt, Human
acacauguccaag

SEQ ID NO: 2014204 - RNA, 16 nt, Human
uauaaaauggcaacaa

SEQ ID NO: 2014205 - RNA, 20 nt, Human
uauaaaauggcaacaaacug

SEQ ID NO: 2014206 - RNA, 22 nt, Human
uauaaaauggcaacaaacugca

SEQ ID NO: 2014207 - RNA, 18 nt, Human
uauaaaauguaucaacac

SEQ ID NO: 2014208 - RNA, 22 nt, Human
acacauguccaagaagcccagg

SEQ ID NO: 2014209 - RNA, 21 nt, Human
acacauguccaagaagcccag

SEQ ID NO: 2014210 - RNA, 18 nt, Human
acacauuucacugucugu

SEQ ID NO: 2014211 - RNA, 13 nt, Human
acacauuuuauuu

SEQ ID NO: 2014212 - RNA, 11 nt, Human
acacauuucuu

SEQ ID NO: 2014213 - RNA, 22 nt, Human
acacauuuguugccagauuuca

SEQ ID NO: 2014214 - RNA, 23 nt, Human
acacauuuguugccagauuucag

SEQ ID NO: 2014215 - RNA, 12 nt, Human
acacccagccca

SEQ ID NO: 2014216 - RNA, 13 nt, Human
acacccagcccac

SEQ ID NO: 2014217 - RNA, 21 nt, Human
uauaaaaauaaaaaacacugg

SEQ ID NO: 2014218 - RNA, 20 nt, Human
uauaaaaauaaaaaacacug

SEQ ID NO: 2014219 - RNA, 21 nt, Human
uauaaaacagaguaaucuugu

SEQ ID NO: 2014220 - RNA, 23 nt, Human
uauaaaacagcccuauuucuuga

SEQ ID NO: 2014221 - RNA, 12 nt, Human
uaguuuugcaua

SEQ ID NO: 2014222 - RNA, 13 nt, Human
uaguuuugcuuuu

SEQ ID NO: 2014223 - RNA, 18 nt, Human
uaguucagguaacaggca

SEQ ID NO: 2014224 - RNA, 14 nt, Human
uaguucaagaaaug

SEQ ID NO: 2014225 - RNA, 15 nt, Human
uaguucaagaaauga

SEQ ID NO: 2014226 - RNA, 18 nt, Human
uaguucaagaaaugaaga

SEQ ID NO: 2014227 - RNA, 20 nt, Human
uaguucaagaaaugaagagc

SEQ ID NO: 2014228 - RNA, 21 nt, Human
uaguucaagaaaugaagagcu

SEQ ID NO: 2014229 - RNA, 23 nt, Human
uaguucaaucuggauucauauuu

SEQ ID NO: 2014230 - RNA, 13 nt, Human
uaguuauguaaau

SEQ ID NO: 2014231 - RNA, 15 nt, Human
uaguuauguaaauaa

SEQ ID NO: 2014232 - RNA, 19 nt, Human
uaguuauguaaauaauucu

SEQ ID NO: 2014233 - RNA, 20 nt, Human
uaguuauguaaauaauucuu

SEQ ID NO: 2014234 - RNA, 21 nt, Human
uaguuauguaaauaauucuuu

SEQ ID NO: 2014235 - RNA, 19 nt, Human
uaucccuacuguaauuugu

SEQ ID NO: 2014236 - RNA, 20 nt, Human
uaucccuacuguaauuugug

SEQ ID NO: 2014237 - RNA, 16 nt, Human
uaucccggcugcccuu

SEQ ID NO: 2014238 - RNA, 14 nt, Human
uaucccugauaaau

SEQ ID NO: 2014239 - RNA, 15 nt, Human
uaucucagggccugg

SEQ ID NO: 2014240 - RNA, 13 nt, Human
uaucucagggccu

SEQ ID NO: 2014241 - RNA, 14 nt, Human
uaucucaaauugua

SEQ ID NO: 2014242 - RNA, 16 nt, Human
uaucucagauauuugc

SEQ ID NO: 2014243 - RNA, 17 nt, Human
uaucucagauauuugca

SEQ ID NO: 2014244 - RNA, 18 nt, Human
uaucucagauauuugcac

SEQ ID NO: 2014245 - RNA, 19 nt, Human
uaucucagauauuugcacc

SEQ ID NO: 2014246 - RNA, 14 nt, Human
uauccuacuucccc

SEQ ID NO: 2014247 - RNA, 17 nt, Human
uauccuacuuccccuuc

SEQ ID NO: 2014248 - RNA, 16 nt, Human
acagagcaguugagag

SEQ ID NO: 2014249 - RNA, 21 nt, Human
acagagcaagugagacccugu

SEQ ID NO: 2014250 - RNA, 15 nt, Human
acagagaugucucuu

SEQ ID NO: 2014251 - RNA, 16 nt, Human
acagagcaaccccugg

SEQ ID NO: 2014252 - RNA, 20 nt, Human
acagagcaaccccuggaccc

SEQ ID NO: 2014253 - RNA, 22 nt, Human
acagagcaaccccuggacccca

SEQ ID NO: 2014254 - RNA, 23 nt, Human
acagagcaaccccuggaccccag

SEQ ID NO: 2014255 - RNA, 13 nt, Human
acagagaugucuc

SEQ ID NO: 2014256 - RNA, 21 nt, Human
uaucuccuuuguauucugucu

SEQ ID NO: 2014257 - RNA, 17 nt, Human
acagaguuguuacauuu

SEQ ID NO: 2014258 - RNA, 18 nt, Human
acagaguuguuacauuuu

SEQ ID NO: 2014259 - RNA, 19 nt, Human
acagaguuguuacauuuuu

SEQ ID NO: 2014260 - RNA, 20 nt, Human
acagaguuguuacauuuuua

SEQ ID NO: 2014261 - RNA, 16 nt, Human
acagaguuguuacauu

SEQ ID NO: 2014262 - RNA, 20 nt, Human
acagcaacgaucacaaauga

SEQ ID NO: 2014263 - RNA, 21 nt, Human
acagcaacgaucacaaaugac

SEQ ID NO: 2014264 - RNA, 22 nt, Human
acagcaacgaucacaaaugacu

SEQ ID NO: 2014265 - RNA, 15 nt, Human
acagcccuauuucuu

SEQ ID NO: 2014266 - RNA, 23 nt, Human
acagcccgggcucugccucccau

SEQ ID NO: 2014267 - RNA, 22 nt, Human
acagcccgggcucugccuccca

SEQ ID NO: 2014268 - RNA, 21 nt, Human
acagcccgggcucugccuccc

SEQ ID NO: 2014269 - RNA, 16 nt, Human
uaucuuggcagguagg

SEQ ID NO: 2014270 - RNA, 17 nt, Human
acagcccuauuucuuga

SEQ ID NO: 2014271 - RNA, 18 nt, Human
acagcccuauuucuugau

SEQ ID NO: 2014272 - RNA, 20 nt, Human
uaugaaagauggcugugccu

SEQ ID NO: 2014273 - RNA, 22 nt, Human
uaugaaagauggcugugccucu

SEQ ID NO: 2014274 - RNA, 23 nt, Human
uaugaaagauggcugugccucug

SEQ ID NO: 2014275 - RNA, 12 nt, Human
uaucuuugauaa

SEQ ID NO: 2014276 - RNA, 15 nt, Human
acagaguuguuacau

SEQ ID NO: 2014277 - RNA, 21 nt, Human
acagaguuguuacauuuuuaa

SEQ ID NO: 2014278 - RNA, 22 nt, Human
acagaguuguuacauuuuuaag

SEQ ID NO: 2014279 - RNA, 20 nt, Human
acagauagauauaugcucug

SEQ ID NO: 2014280 - RNA, 20 nt, Human
acagauacuccuccaagguu

SEQ ID NO: 2014281 - RNA, 23 nt, Human
acagaugggugcuuggaggaagg

SEQ ID NO: 2014282 - RNA, 13 nt, Human
acagauucuuuau

SEQ ID NO: 2014283 - RNA, 18 nt, Human
acagaaaauucuucucca

SEQ ID NO: 2014284 - RNA, 20 nt, Human
acacuuguugauuaauggaa

SEQ ID NO: 2014285 - RNA, 23 nt, Human
acacuuguugauuaauggaaaug

SEQ ID NO: 2014286 - RNA, 13 nt, Human
acacuuuaauggg

SEQ ID NO: 2014287 - RNA, 13 nt, Human
acacuuaaaaaug

SEQ ID NO: 2014288 - RNA, 15 nt, Human
acacuuaaaaauggu

SEQ ID NO: 2014289 - RNA, 16 nt, Human
acacuguuucaaacuu

SEQ ID NO: 2014290 - RNA, 15 nt, Human
acacuguuucaaacu

SEQ ID NO: 2014291 - RNA, 23 nt, Human
acacuguuucaaacuuuacuaug

SEQ ID NO: 2014292 - RNA, 19 nt, Human
acacuguuuguuccagaau

SEQ ID NO: 2014293 - RNA, 14 nt, Human
acacuugucggcuc

SEQ ID NO: 2014294 - RNA, 14 nt, Human
acacuugugacuuu

SEQ ID NO: 2014295 - RNA, 15 nt, Human
acacuugugacuuuu

SEQ ID NO: 2014296 - RNA, 18 nt, Human
acacuugugacuuuugcu

SEQ ID NO: 2014297 - RNA, 20 nt, Human
acacuugugacuuuugcuuu

SEQ ID NO: 2014298 - RNA, 21 nt, Human
acacuugugacuuuugcuuua

SEQ ID NO: 2014299 - RNA, 17 nt, Human
acagacuggaagcacag

SEQ ID NO: 2014300 - RNA, 19 nt, Human
acagacuggaagcacagcu

SEQ ID NO: 2014301 - RNA, 21 nt, Human
acagacuggaagcacagcuuc

SEQ ID NO: 2014302 - RNA, 22 nt, Human
acagacuggaagcacagcuuca

SEQ ID NO: 2014303 - RNA, 18 nt, Human
acagacacaggcccggcu

SEQ ID NO: 2014304 - RNA, 22 nt, Human
acagacacaggcccggcuccag

SEQ ID NO: 2014305 - RNA, 19 nt, Human
acagaaagcagaacaguga

SEQ ID NO: 2014306 - RNA, 17 nt, Human
acagacacaggcccggc

SEQ ID NO: 2014307 - RNA, 12 nt, Human
uauauuuacaaa

SEQ ID NO: 2014308 - RNA, 17 nt, Human
uauauucuauuuuacaa

SEQ ID NO: 2014309 - RNA, 16 nt, Human
uauauucuauuuuaca

SEQ ID NO: 2014310 - RNA, 19 nt, Human
uauauuuaaagggaaauug

SEQ ID NO: 2014311 - RNA, 20 nt, Human
uauauucauucuuuuugaaa

SEQ ID NO: 2014312 - RNA, 19 nt, Human
uauauucauucuuuuugaa

SEQ ID NO: 2014313 - RNA, 19 nt, Human
uauauuccucuugcauuuc

SEQ ID NO: 2014314 - RNA, 23 nt, Human
uauauuccuuuucccaggaaaga

SEQ ID NO: 2014315 - RNA, 16 nt, Human
acacucacccaacaau

SEQ ID NO: 2014316 - RNA, 16 nt, Human
uauaaggacuuccuga

SEQ ID NO: 2014317 - RNA, 14 nt, Human
acacuccagugaga

SEQ ID NO: 2014318 - RNA, 13 nt, Human
acacuccuucaca

SEQ ID NO: 2014319 - RNA, 13 nt, Human
acacucugagacu

SEQ ID NO: 2014320 - RNA, 11 nt, Human
acacucugaga

SEQ ID NO: 2014321 - RNA, 20 nt, Human
acacuguucucugcccucca

SEQ ID NO: 2014322 - RNA, 18 nt, Human
acacuguucucugcccuc

SEQ ID NO: 2014323 - RNA, 17 nt, Human
acacuguucucugcccu

SEQ ID NO: 2014324 - RNA, 16 nt, Human
acacuguucucugccc

SEQ ID NO: 2014325 - RNA, 10 nt, Human
acacuguuau

SEQ ID NO: 2014326 - RNA, 23 nt, Human
acacuguucucugcccuccaaga

SEQ ID NO: 2014327 - RNA, 22 nt, Human
acacuguucucugcccuccaag

SEQ ID NO: 2014328 - RNA, 15 nt, Human
acacuguucucugcc

SEQ ID NO: 2014329 - RNA, 14 nt, Human
acacuguucucugc

SEQ ID NO: 2014330 - RNA, 20 nt, Human
acacucugggcuccagagug

SEQ ID NO: 2014331 - RNA, 13 nt, Human
uacugaaagccuu

SEQ ID NO: 2014332 - RNA, 14 nt, Human
uacucuagagaagu

SEQ ID NO: 2014333 - RNA, 19 nt, Human
uacugaaauaaacgucuua

SEQ ID NO: 2014334 - RNA, 22 nt, Human
uacugaaauaaacgucuuaaau

SEQ ID NO: 2014335 - RNA, 17 nt, Human
uacugaccagacaagcu

SEQ ID NO: 2014336 - RNA, 17 nt, Human
uacugagagugaacaaa

SEQ ID NO: 2014337 - RNA, 16 nt, Human
uacugggagccuaccc

SEQ ID NO: 2014338 - RNA, 19 nt, Human
uacugagagugaacaaauu

SEQ ID NO: 2014339 - RNA, 16 nt, Human
uacuguaauuugugau

SEQ ID NO: 2014340 - RNA, 17 nt, Human
uacuguaauuugugaua

SEQ ID NO: 2014341 - RNA, 15 nt, Human
uacuguaauuuguga

SEQ ID NO: 2014342 - RNA, 22 nt, Human
aauugagcugcuuuuuuugaaa

SEQ ID NO: 2014343 - RNA, 23 nt, Human
aauugagcugcuuuuuuugaaac

SEQ ID NO: 2014344 - RNA, 12 nt, Human
aauugauguuga

SEQ ID NO: 2014345 - RNA, 13 nt, Human
aauugauguugau

SEQ ID NO: 2014346 - RNA, 14 nt, Human
aauugauguugaug

SEQ ID NO: 2014347 - RNA, 15 nt, Human
aauugauguugaugc

SEQ ID NO: 2014348 - RNA, 16 nt, Human
aauugauguugaugca

SEQ ID NO: 2014349 - RNA, 17 nt, Human
aauugauguugaugcaa

SEQ ID NO: 2014350 - RNA, 15 nt, Human
aauugcaaucuauaa

SEQ ID NO: 2014351 - RNA, 23 nt, Human
aauugagccuaaaaauaaagcac

SEQ ID NO: 2014352 - RNA, 17 nt, Human
aauugagccuaaaaaua

SEQ ID NO: 2014353 - RNA, 19 nt, Human
uacuguacaaugacuuuau

SEQ ID NO: 2014354 - RNA, 23 nt, Human
uacuguacagacagaaaaaacug

SEQ ID NO: 2014355 - RNA, 19 nt, Human
uacuguacagacagaaaaa

SEQ ID NO: 2014356 - RNA, 16 nt, Human
aaugugugcccagcuu

SEQ ID NO: 2014357 - RNA, 18 nt, Human
aaugugugagugcaugua

SEQ ID NO: 2014358 - RNA, 20 nt, Human
aaugugugagugcauguacu

SEQ ID NO: 2014359 - RNA, 21 nt, Human
aaugugugagugcauguacua

SEQ ID NO: 2014360 - RNA, 16 nt, Human
aaugugugugauguga

SEQ ID NO: 2014361 - RNA, 21 nt, Human
aaugugugugaugugacauuu

SEQ ID NO: 2014362 - RNA, 23 nt, Human
aaugugugugaugugacauuugu

SEQ ID NO: 2014363 - RNA, 24 nt, Human
uacgcuccaucgcugucaucucag

SEQ ID NO: 2014364 - RNA, 18 nt, Human
aauugacaggcgaaagaa

SEQ ID NO: 2014365 - RNA, 22 nt, Human
uacggauccugcacugacucug

SEQ ID NO: 2014366 - RNA, 15 nt, Human
uacgucugacaggca

SEQ ID NO: 2014367 - RNA, 22 nt, Human
uacucuacccucuuagaaaaac

SEQ ID NO: 2014368 - RNA, 18 nt, Human
uacuagggaaaugccuuu

SEQ ID NO: 2014369 - RNA, 18 nt, Human
uacuaaaaauacaaaaaa

SEQ ID NO: 2014370 - RNA, 18 nt, Human
uacuagacugccacaagg

SEQ ID NO: 2014371 - RNA, 16 nt, Human
uacuagaguuggcaug

SEQ ID NO: 2014372 - RNA, 16 nt, Human
uacuagauuugggaga

SEQ ID NO: 2014373 - RNA, 23 nt, Human
uacuagauuugggagaagggcag

SEQ ID NO: 2014374 - RNA, 14 nt, Human
uacuaaaaauacaa

SEQ ID NO: 2014375 - RNA, 13 nt, Human
uacgugaguccug

SEQ ID NO: 2014376 - RNA, 16 nt, Human
uacgucugacaggcaa

SEQ ID NO: 2014377 - RNA, 23 nt, Human
uacggauccugcacugacucugg

SEQ ID NO: 2014378 - RNA, 15 nt, Human
uacuugaaaauuaac

SEQ ID NO: 2014379 - RNA, 17 nt, Human
uacuuuccaauucuccu

SEQ ID NO: 2014380 - RNA, 19 nt, Human
uacuuuccaauucuccuuu

SEQ ID NO: 2014381 - RNA, 12 nt, Human
uacuuucuguua

SEQ ID NO: 2014382 - RNA, 15 nt, Human
uacuuucuguuaaaa

SEQ ID NO: 2014383 - RNA, 23 nt, Human
uacuuugauauuuucaacgcagc

SEQ ID NO: 2014384 - RNA, 21 nt, Human
uacuuugucuaagaaacauug

SEQ ID NO: 2014385 - RNA, 17 nt, Human
uacuuugucuaagaaac

SEQ ID NO: 2014386 - RNA, 19 nt, Human
uacuuugucuaagaaacau

SEQ ID NO: 2014387 - RNA, 20 nt, Human
uacuuugucuaagaaacauu

SEQ ID NO: 2014388 - RNA, 17 nt, Human
uacuuucuguuaaaaug

SEQ ID NO: 2014389 - RNA, 15 nt, Human
uacuuucuucaaaau

SEQ ID NO: 2014390 - RNA, 15 nt, Human
uacuucuuauacauu

SEQ ID NO: 2014391 - RNA, 14 nt, Human
uacuucuuauacau

SEQ ID NO: 2014392 - RNA, 16 nt, Human
uacuucuuauacauuu

SEQ ID NO: 2014393 - RNA, 20 nt, Human
uacuucuccacccugcucuc

SEQ ID NO: 2014394 - RNA, 15 nt, Human
uacuucugcuacaua

SEQ ID NO: 2014395 - RNA, 23 nt, Human
uacuuccugugacuucagcucug

SEQ ID NO: 2014396 - RNA, 13 nt, Human
uacuucuccaccc

SEQ ID NO: 2014397 - RNA, 18 nt, Human
uacuucuccacccugcuc

SEQ ID NO: 2014398 - RNA, 14 nt, Human
uacuuccccuuccu

SEQ ID NO: 2014399 - RNA, 15 nt, Human
uacuuccccuuccua

SEQ ID NO: 2014400 - RNA, 18 nt, Human
uacuuccccuuccuaauu

SEQ ID NO: 2014401 - RNA, 20 nt, Human
uacuuccccuuccuaauucc

SEQ ID NO: 2014402 - RNA, 18 nt, Human
uacuucauguaauccaaa

SEQ ID NO: 2014403 - RNA, 23 nt, Human
uacuuccaagacuuauuuucaca

SEQ ID NO: 2014404 - RNA, 22 nt, Human
uacuuauuuaugaacagacuuu

SEQ ID NO: 2014405 - RNA, 14 nt, Human
uacuuauaaagaag

SEQ ID NO: 2014406 - RNA, 11 nt, Human
aauuucuuuug

SEQ ID NO: 2014407 - RNA, 16 nt, Human
aauuugaaaaugauaa

SEQ ID NO: 2014408 - RNA, 15 nt, Human
aauuggaaaagacua

SEQ ID NO: 2014409 - RNA, 18 nt, Human
aauuggaaugcacucaga

SEQ ID NO: 2014410 - RNA, 19 nt, Human
aauuggaaaagacuaagau

SEQ ID NO: 2014411 - RNA, 16 nt, Human
aauuuaaggucuguuu

SEQ ID NO: 2014412 - RNA, 21 nt, Human
aauuuaaggucuguuugcugu

SEQ ID NO: 2014413 - RNA, 13 nt, Human
aauuuaguauuuu

SEQ ID NO: 2014414 - RNA, 14 nt, Human
aauuuacugugacu

SEQ ID NO: 2014415 - RNA, 15 nt, Human
aauuuacuuuggaaa

SEQ ID NO: 2014416 - RNA, 16 nt, Human
aauuuacuacaauaug

SEQ ID NO: 2014417 - RNA, 17 nt, Human
aauuuacuacaauaugu

SEQ ID NO: 2014418 - RNA, 21 nt, Human
aauuuacuacaauauguacau

SEQ ID NO: 2014419 - RNA, 22 nt, Human
aauuuacuacaauauguacauu

SEQ ID NO: 2014420 - RNA, 23 nt, Human
aauuuacuacaauauguacauuu

SEQ ID NO: 2014421 - RNA, 17 nt, Human
aauuuacagagacagaa

SEQ ID NO: 2014422 - RNA, 18 nt, Human
aauuuacagagacagaaa

SEQ ID NO: 2014423 - RNA, 17 nt, Human
aauuuaccugaagucuu

SEQ ID NO: 2014424 - RNA, 15 nt, Human
aauuuacauacucug

SEQ ID NO: 2014425 - RNA, 23 nt, Human
aauuucuaggacugaauuaugaa

SEQ ID NO: 2014426 - RNA, 16 nt, Human
aauuucuuuauaaaau

SEQ ID NO: 2014427 - RNA, 22 nt, Human
aauuucuuuauaaaauuuacug

SEQ ID NO: 2014428 - RNA, 13 nt, Human
aauuuauuauggc

SEQ ID NO: 2014429 - RNA, 14 nt, Human
aauuuauuauggca

SEQ ID NO: 2014430 - RNA, 18 nt, Human
aauuucuaggacugaauu

SEQ ID NO: 2014431 - RNA, 22 nt, Human
aauuucuaggacugaauuauga

SEQ ID NO: 2014432 - RNA, 17 nt, Human
aauuucuaggacugaau

SEQ ID NO: 2014433 - RNA, 22 nt, Human
aauuuauaaacuuuuuucuuac

SEQ ID NO: 2014434 - RNA, 15 nt, Human
aauuugcagcuucca

SEQ ID NO: 2014435 - RNA, 15 nt, Human
uacuuuuuugaaauc

SEQ ID NO: 2014436 - RNA, 14 nt, Human
uacuuuuuugaaau

SEQ ID NO: 2014437 - RNA, 13 nt, Human
aauuugguuuuca

SEQ ID NO: 2014438 - RNA, 15 nt, Human
aauuugguuuucaca

SEQ ID NO: 2014439 - RNA, 21 nt, Human
aauuugguuuucacauuggaa

SEQ ID NO: 2014440 - RNA, 14 nt, Human
aauuuguggugauu

SEQ ID NO: 2014441 - RNA, 16 nt, Human
aauuuguggugauuug

SEQ ID NO: 2014442 - RNA, 16 nt, Human
aauuuguuauaaugaa

SEQ ID NO: 2014443 - RNA, 19 nt, Human
aauuuguguaaauuauuga

SEQ ID NO: 2014444 - RNA, 18 nt, Human
aauuuuugguugaauaaa

SEQ ID NO: 2014445 - RNA, 14 nt, Human
aauuuuugguugaa

SEQ ID NO: 2014446 - RNA, 16 nt, Human
aauuuuugguugaaua

SEQ ID NO: 2014447 - RNA, 23 nt, Human
aauuuuuggugggugaaaggaau

SEQ ID NO: 2014448 - RNA, 22 nt, Human
aauuuuuuuaucgucacugcuu

SEQ ID NO: 2014449 - RNA, 17 nt, Human
aauuuuuuuguaugaaa

SEQ ID NO: 2014450 - RNA, 18 nt, Human
aauuuuuuuguaugaaaa

SEQ ID NO: 2014451 - RNA, 19 nt, Human
aauuuuuuuguaugaaaac

SEQ ID NO: 2014452 - RNA, 20 nt, Human
aauuuuuuuucaugcuuuau

SEQ ID NO: 2014453 - RNA, 22 nt, Human
aauuuuuaaucuuuaauuuuac

SEQ ID NO: 2014454 - RNA, 22 nt, Human
aauuuuuaccauaguuuucuca

SEQ ID NO: 2014455 - RNA, 21 nt, Human
aauuuuucuguauagacagga

SEQ ID NO: 2014456 - RNA, 14 nt, Human
acaaauaacaacuu

SEQ ID NO: 2014457 - RNA, 15 nt, Human
acaaauaacaacuuu

SEQ ID NO: 2014458 - RNA, 22 nt, Human
acaaauaacaacuuuuuuuucu

SEQ ID NO: 2014459 - RNA, 18 nt, Human
acaaaguuuaucuuggcc

SEQ ID NO: 2014460 - RNA, 21 nt, Human
acaaagcgugguggacaugca

SEQ ID NO: 2014461 - RNA, 18 nt, Human
acaaagcccuuccauguc

SEQ ID NO: 2014462 - RNA, 21 nt, Human
acaaaacuuagcaucuaauuu

SEQ ID NO: 2014463 - RNA, 14 nt, Human
acaaaacuuuucua

SEQ ID NO: 2014464 - RNA, 22 nt, Human
uagauaggucagugcaaauacu

SEQ ID NO: 2014465 - RNA, 23 nt, Human
acaaauaacaacuuuuuuuucuu

SEQ ID NO: 2014466 - RNA, 23 nt, Human
acaaauaguaggcaagauggcac

SEQ ID NO: 2014467 - RNA, 12 nt, Human
acaaauauuaaa

SEQ ID NO: 2014468 - RNA, 16 nt, Human
acaaauauuaaaaagu

SEQ ID NO: 2014469 - RNA, 20 nt, Human
acaaauauuaaaaagucuuu

SEQ ID NO: 2014470 - RNA, 18 nt, Human
acaaauauuaaaaagucu

SEQ ID NO: 2014471 - RNA, 20 nt, Human
uagaugaaugucaguuguua

SEQ ID NO: 2014472 - RNA, 19 nt, Human
acaagcuccaagcucccag

SEQ ID NO: 2014473 - RNA, 17 nt, Human
acaagcuccaagcuccc

SEQ ID NO: 2014474 - RNA, 16 nt, Human
acaagcuccaagcucc

SEQ ID NO: 2014475 - RNA, 15 nt, Human
acaagcuccaagcuc

SEQ ID NO: 2014476 - RNA, 22 nt, Human
acaagcuccaagcucccaggca

SEQ ID NO: 2014477 - RNA, 18 nt, Human
acaagcgugagccacugc

SEQ ID NO: 2014478 - RNA, 22 nt, Human
acaagccuggaaaaaaacauca

SEQ ID NO: 2014479 - RNA, 20 nt, Human
acaaguugagcuaugacuua

SEQ ID NO: 2014480 - RNA, 21 nt, Human
acaaguugagcuaugacuuaa

SEQ ID NO: 2014481 - RNA, 18 nt, Human
acaaucucggcucacugc

SEQ ID NO: 2014482 - RNA, 20 nt, Human
acaaucucggcucacugcau

SEQ ID NO: 2014483 - RNA, 21 nt, Human
acaauauaagagcuuccaauu

SEQ ID NO: 2014484 - RNA, 18 nt, Human
acaauaugcccuuucugg

SEQ ID NO: 2014485 - RNA, 17 nt, Human
acaauauguacauuucu

SEQ ID NO: 2014486 - RNA, 18 nt, Human
acaauauguacauuucua

SEQ ID NO: 2014487 - RNA, 22 nt, Human
acaauaggaugggcuucugugc

SEQ ID NO: 2014488 - RNA, 16 nt, Human
uagcucaggugucccu

SEQ ID NO: 2014489 - RNA, 19 nt, Human
uagcgacaacagauuggau

SEQ ID NO: 2014490 - RNA, 20 nt, Human
uagcgacaacagauuggauu

SEQ ID NO: 2014491 - RNA, 21 nt, Human
uagcuacguuuacucacagcc

SEQ ID NO: 2014492 - RNA, 12 nt, Human
acaaucuucugu

SEQ ID NO: 2014493 - RNA, 16 nt, Human
uagcuacuaauuuuaa

SEQ ID NO: 2014494 - RNA, 13 nt, Human
uagccuuucuuuu

SEQ ID NO: 2014495 - RNA, 17 nt, Human
acaacaucuuuuucuac

SEQ ID NO: 2014496 - RNA, 13 nt, Human
acaagacacagug

SEQ ID NO: 2014497 - RNA, 16 nt, Human
acaacauccaaguggc

SEQ ID NO: 2014498 - RNA, 17 nt, Human
acaaauuuacagagaca

SEQ ID NO: 2014499 - RNA, 22 nt, Human
acaaauuguuacuccauauaua

SEQ ID NO: 2014500 - RNA, 21 nt, Human
acaaauucugucucuggauua

SEQ ID NO: 2014501 - RNA, 15 nt, Human
acaaaugcaucuuug

SEQ ID NO: 2014502 - RNA, 16 nt, Human
acaaaugcaucuuuga

SEQ ID NO: 2014503 - RNA, 18 nt, Human
acaaaugcaucuuugaug

SEQ ID NO: 2014504 - RNA, 20 nt, Human
acaaaugcaucuuugaugug

SEQ ID NO: 2014505 - RNA, 18 nt, Human
acaaaugacuuuauuauu

SEQ ID NO: 2014506 - RNA, 21 nt, Human
acaaaugacuuuauuauuuau

SEQ ID NO: 2014507 - RNA, 23 nt, Human
acaaaugacuuuauuauuuauuu

SEQ ID NO: 2014508 - RNA, 15 nt, Human
acaaaugauugcuuu

SEQ ID NO: 2014509 - RNA, 16 nt, Human
acaaaugauugcuuuu

SEQ ID NO: 2014510 - RNA, 18 nt, Human
acaaaugauugcuuuuaa

SEQ ID NO: 2014511 - RNA, 19 nt, Human
acaaaugauugcuuuuaaa

SEQ ID NO: 2014512 - RNA, 21 nt, Human
acaaaugauugcuuuuaaaau

SEQ ID NO: 2014513 - RNA, 21 nt, Human
uagcaaagcggguuauaauga

SEQ ID NO: 2014514 - RNA, 22 nt, Human
uagcaaaugagacagcagucuu

SEQ ID NO: 2014515 - RNA, 16 nt, Human
acaaaugacuuuauua

SEQ ID NO: 2014516 - RNA, 17 nt, Human
acaaaugacuuuauuau

SEQ ID NO: 2014517 - RNA, 22 nt, Human
acaagagcccaggccuccuaca

SEQ ID NO: 2014518 - RNA, 18 nt, Human
acaagagcuuaacagugu

SEQ ID NO: 2014519 - RNA, 19 nt, Human
acaagagcuuaacagugug

SEQ ID NO: 2014520 - RNA, 16 nt, Human
acaagaccacguuucu

SEQ ID NO: 2014521 - RNA, 23 nt, Human
acaacauccaaguggccuccguc

SEQ ID NO: 2014522 - RNA, 14 nt, Human
acaagacacaguga

SEQ ID NO: 2014523 - RNA, 17 nt, Human
acaagaccacguuucua

SEQ ID NO: 2014524 - RNA, 13 nt, Human
acaagcuccaagc

SEQ ID NO: 2014525 - RNA, 17 nt, Human
acaagcgugagccacug

SEQ ID NO: 2014526 - RNA, 19 nt, Human
acaagauugucauuaguga

SEQ ID NO: 2014527 - RNA, 23 nt, Human
uaaaggucacuuuucacauccuu

SEQ ID NO: 2014528 - RNA, 20 nt, Human
uaaagguuaccgauuucaaa

SEQ ID NO: 2014529 - RNA, 20 nt, Human
guuuugaagauucuauguua

SEQ ID NO: 2014530 - RNA, 16 nt, Human
guuuugaagauucuau

SEQ ID NO: 2014531 - RNA, 17 nt, Human
guuuugaagauucuaug

SEQ ID NO: 2014532 - RNA, 20 nt, Human
guuuugaaauaaaaagagua

SEQ ID NO: 2014533 - RNA, 16 nt, Human
guuuucuugauaauuu

SEQ ID NO: 2014534 - RNA, 21 nt, Human
guuuucuugauaauuuuccuu

SEQ ID NO: 2014535 - RNA, 23 nt, Human
guuuucuugauaauuuuccuuua

SEQ ID NO: 2014536 - RNA, 16 nt, Human
guuuucuuuuaauuuu

SEQ ID NO: 2014537 - RNA, 22 nt, Human
uaaaguaaaaacaaagaaauua

SEQ ID NO: 2014538 - RNA, 21 nt, Human
uaaaguaaaaacaaagaaauu

SEQ ID NO: 2014539 - RNA, 19 nt, Human
uaaaguaaaaacaaagaaa

SEQ ID NO: 2014540 - RNA, 22 nt, Human
uaaagguucaugcaaacuuuau

SEQ ID NO: 2014541 - RNA, 21 nt, Human
uaaaguaguaaaagaagaaau

SEQ ID NO: 2014542 - RNA, 17 nt, Human
uaaaguauacucuuagg

SEQ ID NO: 2014543 - RNA, 22 nt, Human
uaaaguacugagcagugauauu

SEQ ID NO: 2014544 - RNA, 23 nt, Human
uaaaguacugagcagugauauuc

SEQ ID NO: 2014545 - RNA, 13 nt, Human
uaaaguaauuggu

SEQ ID NO: 2014546 - RNA, 17 nt, Human
uaaaguaauuguuccag

SEQ ID NO: 2014547 - RNA, 20 nt, Human
uaaaguaauuguuccagaga

SEQ ID NO: 2014548 - RNA, 19 nt, Human
uaaaguacugagcagugau

SEQ ID NO: 2014549 - RNA, 21 nt, Human
uaaagguuucuauuuucucug

SEQ ID NO: 2014550 - RNA, 15 nt, Human
aauaaaaaaaagaaa

SEQ ID NO: 2014551 - RNA, 13 nt, Human
aauaaaaaaaaga

SEQ ID NO: 2014552 - RNA, 14 nt, Human
aauaaaaaaaagaa

SEQ ID NO: 2014553 - RNA, 21 nt, Human
aaguuuugugaaauuuuucau

SEQ ID NO: 2014554 - RNA, 20 nt, Human
aaguuuuuauggcuuuugug

SEQ ID NO: 2014555 - RNA, 12 nt, Human
aaguuuugugaa

SEQ ID NO: 2014556 - RNA, 13 nt, Human
aaguuuugugaaa

SEQ ID NO: 2014557 - RNA, 14 nt, Human
aaguuuugugaaau

SEQ ID NO: 2014558 - RNA, 15 nt, Human
aaguuuugugaaauu

SEQ ID NO: 2014559 - RNA, 16 nt, Human
aaguuuugugaaauuu

SEQ ID NO: 2014560 - RNA, 18 nt, Human
aaguuuugugaaauuuuu

SEQ ID NO: 2014561 - RNA, 19 nt, Human
aaguuuugugaaauuuuuc

SEQ ID NO: 2014562 - RNA, 20 nt, Human
aaguuuugugaaauuuuuca

SEQ ID NO: 2014563 - RNA, 19 nt, Human
uaaaguauuuggguuuugu

SEQ ID NO: 2014564 - RNA, 11 nt, Human
aaguuuuguga

SEQ ID NO: 2014565 - RNA, 12 nt, Human
aauaaaguuuga

SEQ ID NO: 2014566 - RNA, 15 nt, Human
aauaaaguuugaucu

SEQ ID NO: 2014567 - RNA, 19 nt, Human
aauaaauccacccauguua

SEQ ID NO: 2014568 - RNA, 16 nt, Human
aauaaaucauaaaacu

SEQ ID NO: 2014569 - RNA, 12 nt, Human
aauaaaacuuuu

SEQ ID NO: 2014570 - RNA, 14 nt, Human
aauaaaacuuuuua

SEQ ID NO: 2014571 - RNA, 15 nt, Human
aauaaaacuuuuuaa

SEQ ID NO: 2014572 - RNA, 18 nt, Human
aauaaaacuuuuuaaaau

SEQ ID NO: 2014573 - RNA, 14 nt, Human
aauaaauuggaguu

SEQ ID NO: 2014574 - RNA, 15 nt, Human
aauaacgauaaaaga

SEQ ID NO: 2014575 - RNA, 21 nt, Human
aauaacugauuaguaagucuu

SEQ ID NO: 2014576 - RNA, 16 nt, Human
aauaaauugcuccuug

SEQ ID NO: 2014577 - RNA, 20 nt, Human
aauaaauugcuccuugacau

SEQ ID NO: 2014578 - RNA, 21 nt, Human
aauaacaaugaaaguugauaa

SEQ ID NO: 2014579 - RNA, 18 nt, Human
uaaauuaacuuuuauaaa

SEQ ID NO: 2014580 - RNA, 17 nt, Human
uaaauuaacuuuuauaa

SEQ ID NO: 2014581 - RNA, 15 nt, Human
uaaauuaacuuuuau

SEQ ID NO: 2014582 - RNA, 16 nt, Human
uaaauuaacuuuuaua

SEQ ID NO: 2014583 - RNA, 12 nt, Human
uaaauuaacuuu

SEQ ID NO: 2014584 - RNA, 14 nt, Human
uaaauuaacuuuua

SEQ ID NO: 2014585 - RNA, 24 nt, Human
uaaauguuuuuuuuuaaagacuuu

SEQ ID NO: 2014586 - RNA, 20 nt, Human
uaaauguugaaagaucaaaa

SEQ ID NO: 2014587 - RNA, 23 nt, Human
uaaauguuuuuuuuuaaagacuu

SEQ ID NO: 2014588 - RNA, 15 nt, Human
uaaauguugaaagau

SEQ ID NO: 2014589 - RNA, 14 nt, Human
uaaauguuauguau

SEQ ID NO: 2014590 - RNA, 15 nt, Human
uaaauguuauguaua

SEQ ID NO: 2014591 - RNA, 16 nt, Human
uaaauguuauguauau

SEQ ID NO: 2014592 - RNA, 19 nt, Human
uaaauguuauguauauggu

SEQ ID NO: 2014593 - RNA, 19 nt, Human
uaaaugcaaccauuugaaa

SEQ ID NO: 2014594 - RNA, 23 nt, Human
uaaaugcaccuggaauauauaac

SEQ ID NO: 2014595 - RNA, 16 nt, Human
uaaaugcaguuacaaa

SEQ ID NO: 2014596 - RNA, 17 nt, Human
uaaaugcaguuacaaau

SEQ ID NO: 2014597 - RNA, 19 nt, Human
uaaaugcaguuacaaauua
